United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 136

SEQ ID NO: 5769264 - DNA, 23 bp, Homo sapiens
ggagtcccaccttggctgcaggg

SEQ ID NO: 5769265 - DNA, 14 bp, Homo sapiens
ggagtcccagagct

SEQ ID NO: 5769266 - DNA, 16 bp, Homo sapiens
ggagtcccaggggcag

SEQ ID NO: 5769267 - DNA, 13 bp, Homo sapiens
ggagtccccatcc

SEQ ID NO: 5769268 - DNA, 22 bp, Homo sapiens
ggagtccccgtgtgccccaaga

SEQ ID NO: 5769269 - DNA, 11 bp, Homo sapiens
ggagtccctcc

SEQ ID NO: 5769270 - DNA, 17 bp, Homo sapiens
ggagtccctgcaggtga

SEQ ID NO: 5769271 - DNA, 19 bp, Homo sapiens
ggagtcctctccagagagg

SEQ ID NO: 5769272 - DNA, 14 bp, Homo sapiens
ggagtcctgttctc

SEQ ID NO: 5769273 - DNA, 22 bp, Homo sapiens
ggagtccttacctcggggagag

SEQ ID NO: 5769274 - DNA, 15 bp, Homo sapiens
ggagtcgagctggcc

SEQ ID NO: 5769275 - DNA, 17 bp, Homo sapiens
ggagtcggagtggacac

SEQ ID NO: 5769276 - DNA, 18 bp, Homo sapiens
ggagtcggttagtcattg

SEQ ID NO: 5769277 - DNA, 23 bp, Homo sapiens
ggagtcggttagtcattgataga

SEQ ID NO: 5769278 - DNA, 18 bp, Homo sapiens
ggagtctcaggaggaggc

SEQ ID NO: 5769279 - DNA, 20 bp, Homo sapiens
ggagtctcaggaggaggctg

SEQ ID NO: 5769280 - DNA, 15 bp, Homo sapiens
ggagtctccctctga

SEQ ID NO: 5769281 - DNA, 19 bp, Homo sapiens
ggagtctcctcactgccac

SEQ ID NO: 5769282 - DNA, 22 bp, Homo sapiens
ggagtctcgctctgtcgcccag

SEQ ID NO: 5769283 - DNA, 12 bp, Homo sapiens
ggagtctctctt

SEQ ID NO: 5769284 - DNA, 13 bp, Homo sapiens
ggagtctctgcca

SEQ ID NO: 5769285 - DNA, 17 bp, Homo sapiens
ggagtctctgccaccca

SEQ ID NO: 5769286 - DNA, 20 bp, Homo sapiens
ggagtctgaaggagaggagt

SEQ ID NO: 5769287 - DNA, 16 bp, Homo sapiens
ggagtctgactgtgcc

SEQ ID NO: 5769288 - DNA, 14 bp, Homo sapiens
ggagtctgagtctg

SEQ ID NO: 5769289 - DNA, 18 bp, Homo sapiens
ggagtctgagtctgagtc

SEQ ID NO: 5769290 - DNA, 21 bp, Homo sapiens
ggagtctgccacccaggatcc

SEQ ID NO: 5769291 - DNA, 13 bp, Homo sapiens
ggagtctgccagg

SEQ ID NO: 5769292 - DNA, 14 bp, Homo sapiens
ggagtctgccaggg

SEQ ID NO: 5769293 - DNA, 16 bp, Homo sapiens
ggagtctgccagggcc

SEQ ID NO: 5769294 - DNA, 22 bp, Homo sapiens
ggagtctgccagggcccctctc

SEQ ID NO: 5769295 - DNA, 18 bp, Homo sapiens
ggagtctggagtgggcag

SEQ ID NO: 5769296 - DNA, 13 bp, Homo sapiens
ggagtctgggctc

SEQ ID NO: 5769297 - DNA, 12 bp, Homo sapiens
ggagtcttgctc

SEQ ID NO: 5769298 - DNA, 12 bp, Homo sapiens
ggagtcttgtgc

SEQ ID NO: 5769299 - DNA, 20 bp, Homo sapiens
ggagtgaagaggggcagccc

SEQ ID NO: 5769300 - DNA, 20 bp, Homo sapiens
ggagtgaagcatttaaaaga

SEQ ID NO: 5769301 - DNA, 21 bp, Homo sapiens
ggagtgaatgtggcagtttaa

SEQ ID NO: 5769302 - DNA, 14 bp, Homo sapiens
ggagtgacccagct

SEQ ID NO: 5769303 - DNA, 14 bp, Homo sapiens
ggagtgactctggc

SEQ ID NO: 5769304 - DNA, 22 bp, Homo sapiens
ggagtgactctggctgccaaga

SEQ ID NO: 5769305 - DNA, 16 bp, Homo sapiens
ggagtgagaaattttt

SEQ ID NO: 5769306 - DNA, 17 bp, Homo sapiens
ggagtgagacaggctgg

SEQ ID NO: 5769307 - DNA, 14 bp, Homo sapiens
ggagtgagacccag

SEQ ID NO: 5769308 - DNA, 15 bp, Homo sapiens
ggagtgagatgcctg

SEQ ID NO: 5769309 - DNA, 17 bp, Homo sapiens
ggagtgagcagctactg

SEQ ID NO: 5769310 - DNA, 18 bp, Homo sapiens
ggagtgaggcaggtgaca

SEQ ID NO: 5769311 - DNA, 21 bp, Homo sapiens
ggagtgaggcttccaggctct

SEQ ID NO: 5769312 - DNA, 17 bp, Homo sapiens
ggagtgagggcctcaga

SEQ ID NO: 5769313 - DNA, 16 bp, Homo sapiens
ggagtgaggggctgtg

SEQ ID NO: 5769314 - DNA, 15 bp, Homo sapiens
ggagtgagggtgggt

SEQ ID NO: 5769315 - DNA, 21 bp, Homo sapiens
ggagtgagtgaaactcccacc

SEQ ID NO: 5769316 - DNA, 21 bp, Homo sapiens
ggagtgagtgtggctcccctc

SEQ ID NO: 5769317 - DNA, 21 bp, Homo sapiens
ggagtgatatgatccagagca

SEQ ID NO: 5769318 - DNA, 22 bp, Homo sapiens
ggagtgatatgatccagagcag

SEQ ID NO: 5769319 - DNA, 19 bp, Homo sapiens
ggagtgatgatttggggga

SEQ ID NO: 5769320 - DNA, 20 bp, Homo sapiens
ggagtgatggtgtccttccc

SEQ ID NO: 5769321 - DNA, 15 bp, Homo sapiens
ggagtgcatggccac

SEQ ID NO: 5769322 - DNA, 17 bp, Homo sapiens
ggagtgcatggccacag

SEQ ID NO: 5769323 - DNA, 15 bp, Homo sapiens
ggagtgccaggacca

SEQ ID NO: 5769324 - DNA, 18 bp, Homo sapiens
ggagtgccaggaccagcc

SEQ ID NO: 5769325 - DNA, 20 bp, Homo sapiens
ggagtgccaggaccagcctg

SEQ ID NO: 5769326 - DNA, 15 bp, Homo sapiens
ggagtgccatggctg

SEQ ID NO: 5769327 - DNA, 17 bp, Homo sapiens
ggagtgccctgcaggca

SEQ ID NO: 5769328 - DNA, 13 bp, Homo sapiens
ggagtgcctggag

SEQ ID NO: 5769329 - DNA, 14 bp, Homo sapiens
ggagtgcctggagt

SEQ ID NO: 5769330 - DNA, 15 bp, Homo sapiens
ggagtgcctggagtc

SEQ ID NO: 5769331 - DNA, 17 bp, Homo sapiens
ggagtgcctggagtcag

SEQ ID NO: 5769332 - DNA, 23 bp, Homo sapiens
ggagtgcgctcttggtccctggt

SEQ ID NO: 5769333 - DNA, 18 bp, Homo sapiens
ggagtgcggaccaccctc

SEQ ID NO: 5769334 - DNA, 16 bp, Homo sapiens
ggagtgctggctcaca

SEQ ID NO: 5769335 - DNA, 18 bp, Homo sapiens
ggagtgctggctcacagt

SEQ ID NO: 5769336 - DNA, 22 bp, Homo sapiens
ggagtgctggctcacagtacag

SEQ ID NO: 5769337 - DNA, 14 bp, Homo sapiens
ggagtggaaacaaa

SEQ ID NO: 5769338 - DNA, 19 bp, Homo sapiens
ggagtggaagaagagggag

SEQ ID NO: 5769339 - DNA, 13 bp, Homo sapiens
ggagtggaaggtg

SEQ ID NO: 5769340 - DNA, 20 bp, Homo sapiens
ggagtggaatagtatcctcc

SEQ ID NO: 5769341 - DNA, 22 bp, Homo sapiens
ggagtggaatagtatcctccag

SEQ ID NO: 5769342 - DNA, 23 bp, Homo sapiens
ggagtggaatagtatcctccagg

SEQ ID NO: 5769343 - DNA, 23 bp, Homo sapiens
ggagtggacaccgctcagtatta

SEQ ID NO: 5769344 - DNA, 22 bp, Homo sapiens
ggagtggacattcaaaaacctg

SEQ ID NO: 5769345 - DNA, 18 bp, Homo sapiens
ggagtggacgctgtccat

SEQ ID NO: 5769346 - DNA, 13 bp, Homo sapiens
ggagtggagggtg

SEQ ID NO: 5769347 - DNA, 20 bp, Homo sapiens
ggagtggatctatttacata

SEQ ID NO: 5769348 - DNA, 23 bp, Homo sapiens
ggagtggattcctccccaccctg

SEQ ID NO: 5769349 - DNA, 20 bp, Homo sapiens
ggagtggcagcccagccagc

SEQ ID NO: 5769350 - DNA, 18 bp, Homo sapiens
ggagtggccaaataggag

SEQ ID NO: 5769351 - DNA, 14 bp, Homo sapiens
ggagtggccacaga

SEQ ID NO: 5769352 - DNA, 13 bp, Homo sapiens
ggagtggccctga

SEQ ID NO: 5769353 - DNA, 19 bp, Homo sapiens
ggagtggccctgatccagg

SEQ ID NO: 5769354 - DNA, 16 bp, Homo sapiens
ggagtggctgaccagg

SEQ ID NO: 5769355 - DNA, 23 bp, Homo sapiens
ggagtggctgaccaggccctgct

SEQ ID NO: 5769356 - DNA, 16 bp, Homo sapiens
ggagtgggaagggagc

SEQ ID NO: 5769357 - DNA, 16 bp, Homo sapiens
ggagtgggacagacag

SEQ ID NO: 5769358 - DNA, 13 bp, Homo sapiens
ggagtgggagagg

SEQ ID NO: 5769359 - DNA, 14 bp, Homo sapiens
ggagtgggagagga

SEQ ID NO: 5769360 - DNA, 17 bp, Homo sapiens
ggagtgggagaggaagc

SEQ ID NO: 5769361 - DNA, 17 bp, Homo sapiens
ggagtgggcacctcaga

SEQ ID NO: 5769362 - DNA, 17 bp, Homo sapiens
ggagtgggctctctgga

SEQ ID NO: 5769363 - DNA, 18 bp, Homo sapiens
ggagtgggctctgagcag

SEQ ID NO: 5769364 - DNA, 16 bp, Homo sapiens
ggagtggggaggagag

SEQ ID NO: 5769365 - DNA, 19 bp, Homo sapiens
ggagtggggtagaggaaga

SEQ ID NO: 5769366 - DNA, 23 bp, Homo sapiens
ggagtggggtggtgtcagaccct

SEQ ID NO: 5769367 - DNA, 17 bp, Homo sapiens
ggagtgggtctggagga

SEQ ID NO: 5769368 - DNA, 18 bp, Homo sapiens
ggagtgggtgggacacag

SEQ ID NO: 5769369 - DNA, 14 bp, Homo sapiens
ggagtgggtgggga

SEQ ID NO: 5769370 - DNA, 17 bp, Homo sapiens
ggagtggtaacaagagg

SEQ ID NO: 5769371 - DNA, 23 bp, Homo sapiens
ggagtggtacttaagctcccctg

SEQ ID NO: 5769372 - DNA, 18 bp, Homo sapiens
ggagtggtgatttgaaaa

SEQ ID NO: 5769373 - DNA, 13 bp, Homo sapiens
ggagtggtgcaga

SEQ ID NO: 5769374 - DNA, 18 bp, Homo sapiens
ggagtggttaggcagcaa

SEQ ID NO: 5769375 - DNA, 20 bp, Homo sapiens
ggagtggttgggctgtgcct

SEQ ID NO: 5769376 - DNA, 23 bp, Homo sapiens
ggagtgtaaaatgtatattttta

SEQ ID NO: 5769377 - DNA, 12 bp, Homo sapiens
ggagtgtaaacc

SEQ ID NO: 5769378 - DNA, 24 bp, Homo sapiens
ggagtgtcctcttccctctctgca

SEQ ID NO: 5769379 - DNA, 14 bp, Homo sapiens
ggagtgtcctgtct

SEQ ID NO: 5769380 - DNA, 14 bp, Homo sapiens
ggagtgtgcagaca

SEQ ID NO: 5769381 - DNA, 17 bp, Homo sapiens
ggagtgtgcagacagcc

SEQ ID NO: 5769382 - DNA, 21 bp, Homo sapiens
ggagtgtgcatttcagcttga

SEQ ID NO: 5769383 - DNA, 21 bp, Homo sapiens
ggagtgtgcctctctctccca

SEQ ID NO: 5769384 - DNA, 16 bp, Homo sapiens
ggagtgtgcgtggtgg

SEQ ID NO: 5769385 - DNA, 15 bp, Homo sapiens
ggagtgtggcctgga

SEQ ID NO: 5769386 - DNA, 22 bp, Homo sapiens
ggagtgtggcctggatccatcc

SEQ ID NO: 5769387 - DNA, 21 bp, Homo sapiens
ggagtgtgggggtgccatggt

SEQ ID NO: 5769388 - DNA, 19 bp, Homo sapiens
ggagtgtgtcagagcccag

SEQ ID NO: 5769389 - DNA, 20 bp, Homo sapiens
ggagtgtgtcagagcccagg

SEQ ID NO: 5769390 - DNA, 13 bp, Homo sapiens
ggagtgtgtgggg

SEQ ID NO: 5769391 - DNA, 15 bp, Homo sapiens
ggagtgtgtgggggt

SEQ ID NO: 5769392 - DNA, 19 bp, Homo sapiens
ggagtgtgtgggggtctgg

SEQ ID NO: 5769393 - DNA, 23 bp, Homo sapiens
ggagtgtgtgggggtctgggagg

SEQ ID NO: 5769394 - DNA, 19 bp, Homo sapiens
ggagtgttctgtttcccat

SEQ ID NO: 5769395 - DNA, 15 bp, Homo sapiens
ggagtgttggggctg

SEQ ID NO: 5769396 - DNA, 19 bp, Homo sapiens
ggagtgtttctaataaact

SEQ ID NO: 5769397 - DNA, 16 bp, Homo sapiens
ggagtgtttgaaaact

SEQ ID NO: 5769398 - DNA, 20 bp, Homo sapiens
ggagtgtttgtgtctgactc

SEQ ID NO: 5769399 - DNA, 21 bp, Homo sapiens
ggagtgtttgtgtctgactca

SEQ ID NO: 5769400 - DNA, 23 bp, Homo sapiens
ggagttaagacctggcagctctg

SEQ ID NO: 5769401 - DNA, 20 bp, Homo sapiens
ggagttagaaccacagcaga

SEQ ID NO: 5769402 - DNA, 13 bp, Homo sapiens
ggagttagggact

SEQ ID NO: 5769403 - DNA, 19 bp, Homo sapiens
ggagttagggactgaccag

SEQ ID NO: 5769404 - DNA, 13 bp, Homo sapiens
ggagttcaatgat

SEQ ID NO: 5769405 - DNA, 20 bp, Homo sapiens
ggagttcaatgatctaggtt

SEQ ID NO: 5769406 - DNA, 15 bp, Homo sapiens
ggagttcaccttgga

SEQ ID NO: 5769407 - DNA, 12 bp, Homo sapiens
ggagttcagagg

SEQ ID NO: 5769408 - DNA, 20 bp, Homo sapiens
ggagttcagtggtgtgatct

SEQ ID NO: 5769409 - DNA, 14 bp, Homo sapiens
ggagttccagtgct

SEQ ID NO: 5769410 - DNA, 19 bp, Homo sapiens
ggagttccatgaagaccac

SEQ ID NO: 5769411 - DNA, 12 bp, Homo sapiens
ggagttccttat

SEQ ID NO: 5769412 - DNA, 24 bp, Homo sapiens
ggagttccttatccctctcttccc

SEQ ID NO: 5769413 - DNA, 20 bp, Homo sapiens
ggagttcgagagcagcctgg

SEQ ID NO: 5769414 - DNA, 22 bp, Homo sapiens
ggagttcgaggcgagcctggcc

SEQ ID NO: 5769415 - DNA, 14 bp, Homo sapiens
ggagttctcctgga

SEQ ID NO: 5769416 - DNA, 15 bp, Homo sapiens
ggagttctcctggag

SEQ ID NO: 5769417 - DNA, 16 bp, Homo sapiens
ggagttctcctggagc

SEQ ID NO: 5769418 - DNA, 12 bp, Homo sapiens
ggagttctctga

SEQ ID NO: 5769419 - DNA, 15 bp, Homo sapiens
ggagttctggttcct

SEQ ID NO: 5769420 - DNA, 22 bp, Homo sapiens
ggagttctttggctctattgga

SEQ ID NO: 5769421 - DNA, 19 bp, Homo sapiens
ggagttgacgcatcctgca

SEQ ID NO: 5769422 - DNA, 21 bp, Homo sapiens
ggagttgatctggaacccaga

SEQ ID NO: 5769423 - DNA, 22 bp, Homo sapiens
ggagttgatctggaacccagac

SEQ ID NO: 5769424 - DNA, 23 bp, Homo sapiens
ggagttgctcactcaggactttg

SEQ ID NO: 5769425 - DNA, 24 bp, Homo sapiens
ggagttgctcctacccctgtcctg

SEQ ID NO: 5769426 - DNA, 14 bp, Homo sapiens
ggagttgggctggt

SEQ ID NO: 5769427 - DNA, 17 bp, Homo sapiens
ggagttggtctgagtga

SEQ ID NO: 5769428 - DNA, 17 bp, Homo sapiens
ggagttgtctgtcctgg

SEQ ID NO: 5769429 - DNA, 18 bp, Homo sapiens
ggagttgtctgtcctggt

SEQ ID NO: 5769430 - DNA, 21 bp, Homo sapiens
ggagtttatgttccattaaac

SEQ ID NO: 5769431 - DNA, 19 bp, Homo sapiens
ggagtttattacaatgtat

SEQ ID NO: 5769432 - DNA, 19 bp, Homo sapiens
ggagtttcctaaaagttca

SEQ ID NO: 5769433 - DNA, 12 bp, Homo sapiens
ggagtttctaag

SEQ ID NO: 5769434 - DNA, 13 bp, Homo sapiens
ggagtttctctgt

SEQ ID NO: 5769435 - DNA, 22 bp, Homo sapiens
ggagtttctgacgaaggtccta

SEQ ID NO: 5769436 - DNA, 21 bp, Homo sapiens
ggatccacgtgctcgcctctg

SEQ ID NO: 5769437 - DNA, 15 bp, Homo sapiens
ggatccagagacctg

SEQ ID NO: 5769438 - DNA, 22 bp, Homo sapiens
ggatccagagacctgctccaga

SEQ ID NO: 5769439 - DNA, 20 bp, Homo sapiens
ggatccagagacttggggac

SEQ ID NO: 5769440 - DNA, 18 bp, Homo sapiens
ggatccagatagcctagg

SEQ ID NO: 5769441 - DNA, 23 bp, Homo sapiens
ggatccagatagcctagggtgag

SEQ ID NO: 5769442 - DNA, 13 bp, Homo sapiens
ggatccagccact

SEQ ID NO: 5769443 - DNA, 23 bp, Homo sapiens
ggatccagccacttccccctctt

SEQ ID NO: 5769444 - DNA, 15 bp, Homo sapiens
ggatccagctctggg

SEQ ID NO: 5769445 - DNA, 18 bp, Homo sapiens
ggatccagctctgggagc

SEQ ID NO: 5769446 - DNA, 12 bp, Homo sapiens
ggatccagggca

SEQ ID NO: 5769447 - DNA, 19 bp, Homo sapiens
ggatccagggcagcaggcc

SEQ ID NO: 5769448 - DNA, 21 bp, Homo sapiens
ggatccatcttgagccacagt

SEQ ID NO: 5769449 - DNA, 15 bp, Homo sapiens
ggatccatctttgta

SEQ ID NO: 5769450 - DNA, 22 bp, Homo sapiens
ggatccatggggggagaagtga

SEQ ID NO: 5769451 - DNA, 21 bp, Homo sapiens
ggatcccaagcctcctgctgc

SEQ ID NO: 5769452 - DNA, 23 bp, Homo sapiens
ggatcccagagcttcccaggatc

SEQ ID NO: 5769453 - DNA, 13 bp, Homo sapiens
ggatcccccttct

SEQ ID NO: 5769454 - DNA, 15 bp, Homo sapiens
ggatcccctgtcccc

SEQ ID NO: 5769455 - DNA, 20 bp, Homo sapiens
ggatcccctgtcccctgggg

SEQ ID NO: 5769456 - DNA, 13 bp, Homo sapiens
ggatccccttcct

SEQ ID NO: 5769457 - DNA, 12 bp, Homo sapiens
ggatccctccca

SEQ ID NO: 5769458 - DNA, 16 bp, Homo sapiens
ggatccctcctccagc

SEQ ID NO: 5769459 - DNA, 13 bp, Homo sapiens
ggatccctcctga

SEQ ID NO: 5769460 - DNA, 20 bp, Homo sapiens
ggatccctttcactatgtcc

SEQ ID NO: 5769461 - DNA, 17 bp, Homo sapiens
ggatccgactgctttgg

SEQ ID NO: 5769462 - DNA, 19 bp, Homo sapiens
ggatccgcggggaccctgc

SEQ ID NO: 5769463 - DNA, 14 bp, Homo sapiens
ggatccgctgccac

SEQ ID NO: 5769464 - DNA, 15 bp, Homo sapiens
ggatccgctgccacc

SEQ ID NO: 5769465 - DNA, 20 bp, Homo sapiens
ggatcctattctcaccagga

SEQ ID NO: 5769466 - DNA, 17 bp, Homo sapiens
ggatcctcacaggagca

SEQ ID NO: 5769467 - DNA, 18 bp, Homo sapiens
ggatcctcacaggagcag

SEQ ID NO: 5769468 - DNA, 13 bp, Homo sapiens
ggatcctccaggt

SEQ ID NO: 5769469 - DNA, 17 bp, Homo sapiens
ggatcctctccaccctc

SEQ ID NO: 5769470 - DNA, 20 bp, Homo sapiens
ggatcctctctccaggcccc

SEQ ID NO: 5769471 - DNA, 17 bp, Homo sapiens
ggatcctgaatctgtgc

SEQ ID NO: 5769472 - DNA, 15 bp, Homo sapiens
ggatcctgatggcac

SEQ ID NO: 5769473 - DNA, 13 bp, Homo sapiens
ggatcctgctggg

SEQ ID NO: 5769474 - DNA, 18 bp, Homo sapiens
ggatcctgctgtggcctc

SEQ ID NO: 5769475 - DNA, 19 bp, Homo sapiens
ggatcctgctgtggcctca

SEQ ID NO: 5769476 - DNA, 20 bp, Homo sapiens
ggatcctgctgtggcctcac

SEQ ID NO: 5769477 - DNA, 18 bp, Homo sapiens
ggatcctggaaccactga

SEQ ID NO: 5769478 - DNA, 17 bp, Homo sapiens
ggatcctggagcccctg

SEQ ID NO: 5769479 - DNA, 17 bp, Homo sapiens
ggatcctggcctgagaa

SEQ ID NO: 5769480 - DNA, 18 bp, Homo sapiens
ggatcctgggctgggtgg

SEQ ID NO: 5769481 - DNA, 17 bp, Homo sapiens
ggatccttcagcacagg

SEQ ID NO: 5769482 - DNA, 19 bp, Homo sapiens
ggatcgagtgtagctgtga

SEQ ID NO: 5769483 - DNA, 21 bp, Homo sapiens
ggatcgagtgtagctgtgaaa

SEQ ID NO: 5769484 - DNA, 23 bp, Homo sapiens
ggatcgagtgtagctgtgaaatc

SEQ ID NO: 5769485 - DNA, 20 bp, Homo sapiens
ggatcgctgcacatggcctg

SEQ ID NO: 5769486 - DNA, 23 bp, Homo sapiens
ggatcggaggcttgtcagagctg

SEQ ID NO: 5769487 - DNA, 20 bp, Homo sapiens
ggatcgtgcatttgaggggc

SEQ ID NO: 5769488 - DNA, 22 bp, Homo sapiens
ggatcgtgcatttgaggggcca

SEQ ID NO: 5769489 - DNA, 19 bp, Homo sapiens
ggatctaaaaggaggacag

SEQ ID NO: 5769490 - DNA, 17 bp, Homo sapiens
ggatctaagaagggctg

SEQ ID NO: 5769491 - DNA, 15 bp, Homo sapiens
ggatctagaagggac

SEQ ID NO: 5769492 - DNA, 15 bp, Homo sapiens
ggatctagccatggc

SEQ ID NO: 5769493 - DNA, 16 bp, Homo sapiens
ggatctataggcagct

SEQ ID NO: 5769494 - DNA, 22 bp, Homo sapiens
ggatctataggcagcttctaag

SEQ ID NO: 5769495 - DNA, 17 bp, Homo sapiens
ggatctatcacctgtca

SEQ ID NO: 5769496 - DNA, 20 bp, Homo sapiens
ggatctatcacctgtcatca

SEQ ID NO: 5769497 - DNA, 14 bp, Homo sapiens
ggatctatgcaatt

SEQ ID NO: 5769498 - DNA, 19 bp, Homo sapiens
ggatctatgcaatttttaa

SEQ ID NO: 5769499 - DNA, 15 bp, Homo sapiens
ggatctcaagccagc

SEQ ID NO: 5769500 - DNA, 16 bp, Homo sapiens
ggatctcaccaggcag

SEQ ID NO: 5769501 - DNA, 17 bp, Homo sapiens
ggatctcaccaggcagc

SEQ ID NO: 5769502 - DNA, 22 bp, Homo sapiens
ggatctcaccaggcagcctctg

SEQ ID NO: 5769503 - DNA, 17 bp, Homo sapiens
ggatctcagctttgaga

SEQ ID NO: 5769504 - DNA, 13 bp, Homo sapiens
ggatctccaagga

SEQ ID NO: 5769505 - DNA, 14 bp, Homo sapiens
ggatctccaaggac

SEQ ID NO: 5769506 - DNA, 12 bp, Homo sapiens
ggatctccaggc

SEQ ID NO: 5769507 - DNA, 17 bp, Homo sapiens
ggatctccaggcccagc

SEQ ID NO: 5769508 - DNA, 14 bp, Homo sapiens
ggatctccttccct

SEQ ID NO: 5769509 - DNA, 18 bp, Homo sapiens
ggatctccttcccttctc

SEQ ID NO: 5769510 - DNA, 21 bp, Homo sapiens
ggatctccttcccttctcttg

SEQ ID NO: 5769511 - DNA, 13 bp, Homo sapiens
ggatctctcagga

SEQ ID NO: 5769512 - DNA, 23 bp, Homo sapiens
ggatctctctagtgatggtcaga

SEQ ID NO: 5769513 - DNA, 21 bp, Homo sapiens
ggatctcttcttaatgtacat

SEQ ID NO: 5769514 - DNA, 22 bp, Homo sapiens
ggatctcttcttaatgtacata

SEQ ID NO: 5769515 - DNA, 14 bp, Homo sapiens
ggatctgcccctcc

SEQ ID NO: 5769516 - DNA, 17 bp, Homo sapiens
ggatctgcccctccctg

SEQ ID NO: 5769517 - DNA, 18 bp, Homo sapiens
ggatctgctccatgcaga

SEQ ID NO: 5769518 - DNA, 15 bp, Homo sapiens
ggatctgctgaggcc

SEQ ID NO: 5769519 - DNA, 18 bp, Homo sapiens
ggatctgctgaggcccag

SEQ ID NO: 5769520 - DNA, 17 bp, Homo sapiens
ggatctggagaacctca

SEQ ID NO: 5769521 - DNA, 12 bp, Homo sapiens
ggatctgggcaa

SEQ ID NO: 5769522 - DNA, 18 bp, Homo sapiens
ggatctggggctctggga

SEQ ID NO: 5769523 - DNA, 17 bp, Homo sapiens
ggatctggggggtgggg

SEQ ID NO: 5769524 - DNA, 20 bp, Homo sapiens
ggatctgtaaggaactggaa

SEQ ID NO: 5769525 - DNA, 19 bp, Homo sapiens
ggatctgtatgtgttctat

SEQ ID NO: 5769526 - DNA, 16 bp, Homo sapiens
ggatctgtctgtgcac

SEQ ID NO: 5769527 - DNA, 15 bp, Homo sapiens
ggatctgtgcccaga

SEQ ID NO: 5769528 - DNA, 23 bp, Homo sapiens
ggatctgttgtgtacgtggagag

SEQ ID NO: 5769529 - DNA, 14 bp, Homo sapiens
ggatcttattttgt

SEQ ID NO: 5769530 - DNA, 22 bp, Homo sapiens
ggatcttcatctgactatgaca

SEQ ID NO: 5769531 - DNA, 14 bp, Homo sapiens
ggatcttgaatgtg

SEQ ID NO: 5769532 - DNA, 21 bp, Homo sapiens
ggatcttgaatgtggtctcag

SEQ ID NO: 5769533 - DNA, 20 bp, Homo sapiens
ggatctttcacccacagaaa

SEQ ID NO: 5769534 - DNA, 15 bp, Homo sapiens
ggatctttgtggcca

SEQ ID NO: 5769535 - DNA, 16 bp, Homo sapiens
ggatctttgtggccaa

SEQ ID NO: 5769536 - DNA, 17 bp, Homo sapiens
ggatctttgtggccaag

SEQ ID NO: 5769537 - DNA, 15 bp, Homo sapiens
ggatcttttgtaaat

SEQ ID NO: 5769538 - DNA, 18 bp, Homo sapiens
ggatgaaaaatatttctg

SEQ ID NO: 5769539 - DNA, 14 bp, Homo sapiens
ggatgaaaagccat

SEQ ID NO: 5769540 - DNA, 15 bp, Homo sapiens
ggatgaaaagccata

SEQ ID NO: 5769541 - DNA, 16 bp, Homo sapiens
ggatgaaaagccatat

SEQ ID NO: 5769542 - DNA, 21 bp, Homo sapiens
ggatgaaaagccatatctagt

SEQ ID NO: 5769543 - DNA, 22 bp, Homo sapiens
ggatgaaagacaaagaaggaaa

SEQ ID NO: 5769544 - DNA, 11 bp, Homo sapiens
ggatgaaagct

SEQ ID NO: 5769545 - DNA, 21 bp, Homo sapiens
ggatgaaagttcccccatcag

SEQ ID NO: 5769546 - DNA, 18 bp, Homo sapiens
ggatgaaataactccttc

SEQ ID NO: 5769547 - DNA, 17 bp, Homo sapiens
ggatgaaattttctaga

SEQ ID NO: 5769548 - DNA, 21 bp, Homo sapiens
ggatgaacattcaagagagct

SEQ ID NO: 5769549 - DNA, 17 bp, Homo sapiens
ggatgaagagaaggcac

SEQ ID NO: 5769550 - DNA, 20 bp, Homo sapiens
ggatgaattgtcacatctat

SEQ ID NO: 5769551 - DNA, 16 bp, Homo sapiens
ggatgaattttctgca

SEQ ID NO: 5769552 - DNA, 19 bp, Homo sapiens
ggatgacaggcgcctgcca

SEQ ID NO: 5769553 - DNA, 16 bp, Homo sapiens
ggatgacaggctctcc

SEQ ID NO: 5769554 - DNA, 19 bp, Homo sapiens
ggatgacaggctctcctgg

SEQ ID NO: 5769555 - DNA, 15 bp, Homo sapiens
ggatgacatgtccct

SEQ ID NO: 5769556 - DNA, 16 bp, Homo sapiens
ggatgacatgtcccta

SEQ ID NO: 5769557 - DNA, 20 bp, Homo sapiens
ggatgacatgtccctacacc

SEQ ID NO: 5769558 - DNA, 17 bp, Homo sapiens
ggatgaccatactcaga

SEQ ID NO: 5769559 - DNA, 16 bp, Homo sapiens
ggatgacggccaggct

SEQ ID NO: 5769560 - DNA, 17 bp, Homo sapiens
ggatgacggccaggctc

SEQ ID NO: 5769561 - DNA, 22 bp, Homo sapiens
ggatgacggccaggctccctga

SEQ ID NO: 5769562 - DNA, 11 bp, Homo sapiens
ggatgacttta

SEQ ID NO: 5769563 - DNA, 17 bp, Homo sapiens
ggatgagaaacagctca

SEQ ID NO: 5769564 - DNA, 22 bp, Homo sapiens
ggatgagaaacagctcagccag

SEQ ID NO: 5769565 - DNA, 18 bp, Homo sapiens
ggatgagaaagatgggca

SEQ ID NO: 5769566 - DNA, 22 bp, Homo sapiens
ggatgagaaaggttgaagcacc

SEQ ID NO: 5769567 - DNA, 12 bp, Homo sapiens
ggatgagaatgt

SEQ ID NO: 5769568 - DNA, 14 bp, Homo sapiens
ggatgagaatgtga

SEQ ID NO: 5769569 - DNA, 15 bp, Homo sapiens
ggatgagacccagcc

SEQ ID NO: 5769570 - DNA, 16 bp, Homo sapiens
ggatgagacccagccc

SEQ ID NO: 5769571 - DNA, 19 bp, Homo sapiens
ggatgagagcccagaggta

SEQ ID NO: 5769572 - DNA, 23 bp, Homo sapiens
ggatgagagcccagaggtaacag

SEQ ID NO: 5769573 - DNA, 12 bp, Homo sapiens
ggatgagcagag

SEQ ID NO: 5769574 - DNA, 22 bp, Homo sapiens
ggatgagccaaaccagcaggga

SEQ ID NO: 5769575 - DNA, 23 bp, Homo sapiens
ggatgagctcccacaagcctgag

SEQ ID NO: 5769576 - DNA, 15 bp, Homo sapiens
ggatgaggagacaga

SEQ ID NO: 5769577 - DNA, 18 bp, Homo sapiens
ggatgaggcttcttcctg

SEQ ID NO: 5769578 - DNA, 20 bp, Homo sapiens
ggatgagggagacagaccac

SEQ ID NO: 5769579 - DNA, 16 bp, Homo sapiens
ggatgagggcatgtgc

SEQ ID NO: 5769580 - DNA, 18 bp, Homo sapiens
ggatgaggtctcgaccct

SEQ ID NO: 5769581 - DNA, 18 bp, Homo sapiens
ggatgagtaaactgtttc

SEQ ID NO: 5769582 - DNA, 22 bp, Homo sapiens
ggatgagtaaactgtttctcag

SEQ ID NO: 5769583 - DNA, 21 bp, Homo sapiens
ggatgatagttgaagggaggt

SEQ ID NO: 5769584 - DNA, 16 bp, Homo sapiens
ggatgatccagggatt

SEQ ID NO: 5769585 - DNA, 16 bp, Homo sapiens
ggatgatccccacgcc

SEQ ID NO: 5769586 - DNA, 20 bp, Homo sapiens
ggatgatccccacgccacag

SEQ ID NO: 5769587 - DNA, 18 bp, Homo sapiens
ggatgatgactatggaaa

SEQ ID NO: 5769588 - DNA, 17 bp, Homo sapiens
ggatgatggcagagcca

SEQ ID NO: 5769589 - DNA, 20 bp, Homo sapiens
ggatgatggcagagccaggc

SEQ ID NO: 5769590 - DNA, 23 bp, Homo sapiens
ggatgatgtctttttattaaaat

SEQ ID NO: 5769591 - DNA, 15 bp, Homo sapiens
ggatgattcttttcc

SEQ ID NO: 5769592 - DNA, 15 bp, Homo sapiens
ggatgattgaagaaa

SEQ ID NO: 5769593 - DNA, 21 bp, Homo sapiens
ggatgattgcttgagctcagg

SEQ ID NO: 5769594 - DNA, 13 bp, Homo sapiens
ggatgcaaataaa

SEQ ID NO: 5769595 - DNA, 23 bp, Homo sapiens
ggatgcacagagttgttacattt

SEQ ID NO: 5769596 - DNA, 18 bp, Homo sapiens
ggatgcacagatgccatg

SEQ ID NO: 5769597 - DNA, 14 bp, Homo sapiens
ggatgcacatttct

SEQ ID NO: 5769598 - DNA, 19 bp, Homo sapiens
ggatgcacggcggcagggt

SEQ ID NO: 5769599 - DNA, 13 bp, Homo sapiens
ggatgcagagggg

SEQ ID NO: 5769600 - DNA, 18 bp, Homo sapiens
ggatgcagagtcagcaga

SEQ ID NO: 5769601 - DNA, 16 bp, Homo sapiens
ggatgcagtgatgtga

SEQ ID NO: 5769602 - DNA, 13 bp, Homo sapiens
ggatgcatgcagg

SEQ ID NO: 5769603 - DNA, 20 bp, Homo sapiens
ggatgccacagccccacagc

SEQ ID NO: 5769604 - DNA, 22 bp, Homo sapiens
ggatgccacagccccacagcac

SEQ ID NO: 5769605 - DNA, 18 bp, Homo sapiens
ggatgccacgcctggaag

SEQ ID NO: 5769606 - DNA, 20 bp, Homo sapiens
ggatgccactcctccctccg

SEQ ID NO: 5769607 - DNA, 16 bp, Homo sapiens
ggatgccagcccctgc

SEQ ID NO: 5769608 - DNA, 13 bp, Homo sapiens
ggatgccagctgt

SEQ ID NO: 5769609 - DNA, 21 bp, Homo sapiens
ggatgccataaaagccgccca

SEQ ID NO: 5769610 - DNA, 13 bp, Homo sapiens
ggatgcccagaag

SEQ ID NO: 5769611 - DNA, 18 bp, Homo sapiens
ggatgcccattcctgcct

SEQ ID NO: 5769612 - DNA, 18 bp, Homo sapiens
ggatgcccccaggcagcc

SEQ ID NO: 5769613 - DNA, 20 bp, Homo sapiens
ggatgttatgaacagctgtg

SEQ ID NO: 5769614 - DNA, 23 bp, Homo sapiens
ggatgttattatccttgggggct

SEQ ID NO: 5769615 - DNA, 23 bp, Homo sapiens
ggatgttcagcactgtcccttgc

SEQ ID NO: 5769616 - DNA, 22 bp, Homo sapiens
ggatgttccagtggatgagggc

SEQ ID NO: 5769617 - DNA, 23 bp, Homo sapiens
ggatgttctgcctctccctgggt

SEQ ID NO: 5769618 - DNA, 15 bp, Homo sapiens
ggatgttctggccct

SEQ ID NO: 5769619 - DNA, 13 bp, Homo sapiens
ggatgttctggga

SEQ ID NO: 5769620 - DNA, 16 bp, Homo sapiens
ggatgttctgggacac

SEQ ID NO: 5769621 - DNA, 16 bp, Homo sapiens
ggatgtttacctggtg

SEQ ID NO: 5769622 - DNA, 17 bp, Homo sapiens
ggattaaaacaattttt

SEQ ID NO: 5769623 - DNA, 14 bp, Homo sapiens
ggattaaactcagt

SEQ ID NO: 5769624 - DNA, 20 bp, Homo sapiens
ggattaaacttatgaatgtt

SEQ ID NO: 5769625 - DNA, 14 bp, Homo sapiens
ggattaaatggcac

SEQ ID NO: 5769626 - DNA, 20 bp, Homo sapiens
ggattaaatggcacctgtat

SEQ ID NO: 5769627 - DNA, 17 bp, Homo sapiens
ggattaacctctgcact

SEQ ID NO: 5769628 - DNA, 12 bp, Homo sapiens
ggattaatgaaa

SEQ ID NO: 5769629 - DNA, 22 bp, Homo sapiens
ggattaatggtcctgtgatgct

SEQ ID NO: 5769630 - DNA, 21 bp, Homo sapiens
ggattaattagttgattgctg

SEQ ID NO: 5769631 - DNA, 13 bp, Homo sapiens
ggattaatttatt

SEQ ID NO: 5769632 - DNA, 23 bp, Homo sapiens
ggattacaagcgtgagccactgc

SEQ ID NO: 5769633 - DNA, 19 bp, Homo sapiens
ggattacagacatgagcca

SEQ ID NO: 5769634 - DNA, 19 bp, Homo sapiens
ggattacaggcatgagcca

SEQ ID NO: 5769635 - DNA, 20 bp, Homo sapiens
ggattacaggcatgagccac

SEQ ID NO: 5769636 - DNA, 16 bp, Homo sapiens
ggattacaggcatgtg

SEQ ID NO: 5769637 - DNA, 19 bp, Homo sapiens
ggattacaggcatgtgcca

SEQ ID NO: 5769638 - DNA, 15 bp, Homo sapiens
ggattacccaagcaa

SEQ ID NO: 5769639 - DNA, 14 bp, Homo sapiens
ggattacttgaaac

SEQ ID NO: 5769640 - DNA, 15 bp, Homo sapiens
ggattagtagaaaat

SEQ ID NO: 5769641 - DNA, 17 bp, Homo sapiens
ggattagtttagaacag

SEQ ID NO: 5769642 - DNA, 18 bp, Homo sapiens
ggattagtttagaacagg

SEQ ID NO: 5769643 - DNA, 20 bp, Homo sapiens
ggattataggcatgagccac

SEQ ID NO: 5769644 - DNA, 12 bp, Homo sapiens
ggattatattat

SEQ ID NO: 5769645 - DNA, 13 bp, Homo sapiens
ggattatcctgag

SEQ ID NO: 5769646 - DNA, 13 bp, Homo sapiens
ggattatctacta

SEQ ID NO: 5769647 - DNA, 23 bp, Homo sapiens
ggattattactaattctatttct

SEQ ID NO: 5769648 - DNA, 15 bp, Homo sapiens
ggattattcatttaa

SEQ ID NO: 5769649 - DNA, 17 bp, Homo sapiens
ggattatttaataacat

SEQ ID NO: 5769650 - DNA, 16 bp, Homo sapiens
ggattcaaatgcatga

SEQ ID NO: 5769651 - DNA, 18 bp, Homo sapiens
ggattcaattacggactc

SEQ ID NO: 5769652 - DNA, 13 bp, Homo sapiens
ggattcaattcct

SEQ ID NO: 5769653 - DNA, 13 bp, Homo sapiens
ggattcacttcta

SEQ ID NO: 5769654 - DNA, 17 bp, Homo sapiens
ggattcacttctattta

SEQ ID NO: 5769655 - DNA, 16 bp, Homo sapiens
ggattcagcatgtcca

SEQ ID NO: 5769656 - DNA, 19 bp, Homo sapiens
ggattcaggaaaaggcctg

SEQ ID NO: 5769657 - DNA, 20 bp, Homo sapiens
ggattcaggaaaaggcctgg

SEQ ID NO: 5769658 - DNA, 14 bp, Homo sapiens
ggattcaggctgct

SEQ ID NO: 5769659 - DNA, 21 bp, Homo sapiens
ggattcagtcataaagaggta

SEQ ID NO: 5769660 - DNA, 14 bp, Homo sapiens
ggattcagttcatt

SEQ ID NO: 5769661 - DNA, 15 bp, Homo sapiens
ggattcatggctttg

SEQ ID NO: 5769662 - DNA, 16 bp, Homo sapiens
ggattcattacagctt

SEQ ID NO: 5769663 - DNA, 14 bp, Homo sapiens
ggattcatttcctg

SEQ ID NO: 5769664 - DNA, 16 bp, Homo sapiens
ggattcatttcctgcc

SEQ ID NO: 5769665 - DNA, 14 bp, Homo sapiens
ggattccccctgcc

SEQ ID NO: 5769666 - DNA, 18 bp, Homo sapiens
ggattccccctgccctgt

SEQ ID NO: 5769667 - DNA, 22 bp, Homo sapiens
ggattccccctgccctgtgccg

SEQ ID NO: 5769668 - DNA, 22 bp, Homo sapiens
ggattcccgtggctttgtgctt

SEQ ID NO: 5769669 - DNA, 23 bp, Homo sapiens
ggattcctaatcactcagagcag

SEQ ID NO: 5769670 - DNA, 18 bp, Homo sapiens
ggattcctcttttctctg

SEQ ID NO: 5769671 - DNA, 19 bp, Homo sapiens
ggattcctgacccaggccg

SEQ ID NO: 5769672 - DNA, 20 bp, Homo sapiens
ggattcctgacccaggccgc

SEQ ID NO: 5769673 - DNA, 18 bp, Homo sapiens
ggattccttaaacctgaa

SEQ ID NO: 5769674 - DNA, 21 bp, Homo sapiens
ggattccttctaagtgtactt

SEQ ID NO: 5769675 - DNA, 17 bp, Homo sapiens
ggattccttcttcccca

SEQ ID NO: 5769676 - DNA, 21 bp, Homo sapiens
ggattccttgtgttttgtcct

SEQ ID NO: 5769677 - DNA, 12 bp, Homo sapiens
ggattccttgtt

SEQ ID NO: 5769678 - DNA, 15 bp, Homo sapiens
ggattcgcttgagtt

SEQ ID NO: 5769679 - DNA, 15 bp, Homo sapiens
ggattctaaatacat

SEQ ID NO: 5769680 - DNA, 16 bp, Homo sapiens
ggattctgagagctgt

SEQ ID NO: 5769681 - DNA, 12 bp, Homo sapiens
ggattctgagca

SEQ ID NO: 5769682 - DNA, 20 bp, Homo sapiens
ggattctgaggccctgccca

SEQ ID NO: 5769683 - DNA, 23 bp, Homo sapiens
ggattctgatttgtattaaaatt

SEQ ID NO: 5769684 - DNA, 17 bp, Homo sapiens
ggattctgcctaataaa

SEQ ID NO: 5769685 - DNA, 18 bp, Homo sapiens
ggattctgcctaataaaa

SEQ ID NO: 5769686 - DNA, 13 bp, Homo sapiens
ggattctgggagg

SEQ ID NO: 5769687 - DNA, 18 bp, Homo sapiens
ggattctggttccagggt

SEQ ID NO: 5769688 - DNA, 19 bp, Homo sapiens
ggattctggttccagggtc

SEQ ID NO: 5769689 - DNA, 23 bp, Homo sapiens
ggattctgtgcctccaggaccag

SEQ ID NO: 5769690 - DNA, 20 bp, Homo sapiens
ggattctgttctgcaactcc

SEQ ID NO: 5769691 - DNA, 19 bp, Homo sapiens
ggattcttaattctctgca

SEQ ID NO: 5769692 - DNA, 16 bp, Homo sapiens
ggattcttcctccctc

SEQ ID NO: 5769693 - DNA, 22 bp, Homo sapiens
ggattcttgaacttgaaaaaaa

SEQ ID NO: 5769694 - DNA, 12 bp, Homo sapiens
ggattctttaaa

SEQ ID NO: 5769695 - DNA, 18 bp, Homo sapiens
ggattctttaaatatata

SEQ ID NO: 5769696 - DNA, 14 bp, Homo sapiens
ggattctttccatt

SEQ ID NO: 5769697 - DNA, 18 bp, Homo sapiens
ggattctttccattatga

SEQ ID NO: 5769698 - DNA, 15 bp, Homo sapiens
ggattctttccccag

SEQ ID NO: 5769699 - DNA, 17 bp, Homo sapiens
ggattctttccccagag

SEQ ID NO: 5769700 - DNA, 13 bp, Homo sapiens
ggattgaacacag

SEQ ID NO: 5769701 - DNA, 19 bp, Homo sapiens
ggattgaaggatgctgtct

SEQ ID NO: 5769702 - DNA, 17 bp, Homo sapiens
ggattgaggggccctgg

SEQ ID NO: 5769703 - DNA, 16 bp, Homo sapiens
ggattgatcattcttt

SEQ ID NO: 5769704 - DNA, 20 bp, Homo sapiens
ggattgatcggagcctcctc

SEQ ID NO: 5769705 - DNA, 20 bp, Homo sapiens
ggattgattcagtcttctgg

SEQ ID NO: 5769706 - DNA, 21 bp, Homo sapiens
ggattgattcagtcttctgga

SEQ ID NO: 5769707 - DNA, 17 bp, Homo sapiens
ggattgattttaaaatg

SEQ ID NO: 5769708 - DNA, 18 bp, Homo sapiens
ggattgattttaaaatgt

SEQ ID NO: 5769709 - DNA, 18 bp, Homo sapiens
ggattgcacgtggcctct

SEQ ID NO: 5769710 - DNA, 15 bp, Homo sapiens
ggattgcctctgaaa

SEQ ID NO: 5769711 - DNA, 17 bp, Homo sapiens
ggattgcgagagatgtg

SEQ ID NO: 5769712 - DNA, 15 bp, Homo sapiens
ggattgcgcctttgt

SEQ ID NO: 5769713 - DNA, 17 bp, Homo sapiens
ggattgctactgtccta

SEQ ID NO: 5769714 - DNA, 18 bp, Homo sapiens
ggattgctctggagcagc

SEQ ID NO: 5769715 - DNA, 12 bp, Homo sapiens
ggattgctgcca

SEQ ID NO: 5769716 - DNA, 23 bp, Homo sapiens
ggattggaccatgaatgatatgc

SEQ ID NO: 5769717 - DNA, 20 bp, Homo sapiens
ggattggcttgtgtgtttca

SEQ ID NO: 5769718 - DNA, 17 bp, Homo sapiens
ggattgggagggacagg

SEQ ID NO: 5769719 - DNA, 17 bp, Homo sapiens
ggattgggcccctgcca

SEQ ID NO: 5769720 - DNA, 18 bp, Homo sapiens
ggattggggaagactgtg

SEQ ID NO: 5769721 - DNA, 14 bp, Homo sapiens
ggattgggggctgg

SEQ ID NO: 5769722 - DNA, 22 bp, Homo sapiens
ggattggtttggcaagaacttg

SEQ ID NO: 5769723 - DNA, 15 bp, Homo sapiens
ggattgtacatattt

SEQ ID NO: 5769724 - DNA, 20 bp, Homo sapiens
ggattgtatcaagtggcatg

SEQ ID NO: 5769725 - DNA, 13 bp, Homo sapiens
ggattgtcactcc

SEQ ID NO: 5769726 - DNA, 15 bp, Homo sapiens
ggattgtccacaaat

SEQ ID NO: 5769727 - DNA, 22 bp, Homo sapiens
ggattgtccctgtgttgtccca

SEQ ID NO: 5769728 - DNA, 19 bp, Homo sapiens
ggattgttaatttcagtcc

SEQ ID NO: 5769729 - DNA, 17 bp, Homo sapiens
ggattgtttctggtgac

SEQ ID NO: 5769730 - DNA, 18 bp, Homo sapiens
ggatttaaaaactggaac

SEQ ID NO: 5769731 - DNA, 18 bp, Homo sapiens
ggatttaaaagcctgctc

SEQ ID NO: 5769732 - DNA, 16 bp, Homo sapiens
ggatttaaagggacac

SEQ ID NO: 5769733 - DNA, 22 bp, Homo sapiens
ggatttaacagaaatgtacagc

SEQ ID NO: 5769734 - DNA, 22 bp, Homo sapiens
ggatttaagcaaaggctccctc

SEQ ID NO: 5769735 - DNA, 18 bp, Homo sapiens
ggatttactgagagaagg

SEQ ID NO: 5769736 - DNA, 21 bp, Homo sapiens
ggatttatagtatgtgacttt

SEQ ID NO: 5769737 - DNA, 22 bp, Homo sapiens
ggatttattttttgtaactctt

SEQ ID NO: 5769738 - DNA, 18 bp, Homo sapiens
ggatttcacggagacagc

SEQ ID NO: 5769739 - DNA, 13 bp, Homo sapiens
ggatttcatcact

SEQ ID NO: 5769740 - DNA, 11 bp, Homo sapiens
ggatttcattt

SEQ ID NO: 5769741 - DNA, 19 bp, Homo sapiens
ggatttccagccagggctg

SEQ ID NO: 5769742 - DNA, 15 bp, Homo sapiens
ggatttccctgcaga

SEQ ID NO: 5769743 - DNA, 18 bp, Homo sapiens
ggatttcctattttaaaa

SEQ ID NO: 5769744 - DNA, 21 bp, Homo sapiens
ggatttcctattttaaaacca

SEQ ID NO: 5769745 - DNA, 23 bp, Homo sapiens
ggatttcctattttaaaaccatg

SEQ ID NO: 5769746 - DNA, 20 bp, Homo sapiens
ggatttcctggagtgccctg

SEQ ID NO: 5769747 - DNA, 15 bp, Homo sapiens
ggatttcgtttttct

SEQ ID NO: 5769748 - DNA, 23 bp, Homo sapiens
ggatttctctagaggctggcaag

SEQ ID NO: 5769749 - DNA, 22 bp, Homo sapiens
ggatttgaacttgctctttttg

SEQ ID NO: 5769750 - DNA, 18 bp, Homo sapiens
ggatttgactcctccaag

SEQ ID NO: 5769751 - DNA, 23 bp, Homo sapiens
ggatttgatgagttaactgtgaa

SEQ ID NO: 5769752 - DNA, 17 bp, Homo sapiens
ggatttgatgcttttct

SEQ ID NO: 5769753 - DNA, 19 bp, Homo sapiens
ggatttgattcattttcct

SEQ ID NO: 5769754 - DNA, 22 bp, Homo sapiens
ggatttgcacagaagcacatgc

SEQ ID NO: 5769755 - DNA, 14 bp, Homo sapiens
ggatttgccccttc

SEQ ID NO: 5769756 - DNA, 13 bp, Homo sapiens
ggatttgcctcac

SEQ ID NO: 5769757 - DNA, 18 bp, Homo sapiens
ggatttgtaactgttttt

SEQ ID NO: 5769758 - DNA, 20 bp, Homo sapiens
ggatttgtccaaacaggtgc

SEQ ID NO: 5769759 - DNA, 22 bp, Homo sapiens
ggatttgtccaaacaggtgctg

SEQ ID NO: 5769760 - DNA, 13 bp, Homo sapiens
ggatttgttcaca

SEQ ID NO: 5769761 - DNA, 23 bp, Homo sapiens
ggattttaaaaacatgagaaatg

SEQ ID NO: 5769762 - DNA, 17 bp, Homo sapiens
ggattttaaaaattgga

SEQ ID NO: 5769763 - DNA, 13 bp, Homo sapiens
ggattttaaacaa

SEQ ID NO: 5769764 - DNA, 14 bp, Homo sapiens
ggattttaaacaaa

SEQ ID NO: 5769765 - DNA, 19 bp, Homo sapiens
ggattttaaacaaaattta

SEQ ID NO: 5769766 - DNA, 15 bp, Homo sapiens
ggattttaaactaga

SEQ ID NO: 5769767 - DNA, 19 bp, Homo sapiens
ggattttaaactagatgac

SEQ ID NO: 5769768 - DNA, 15 bp, Homo sapiens
ggattttaaatgctg

SEQ ID NO: 5769769 - DNA, 17 bp, Homo sapiens
ggattttaatttcagga

SEQ ID NO: 5769770 - DNA, 15 bp, Homo sapiens
ggattttatgttgac

SEQ ID NO: 5769771 - DNA, 16 bp, Homo sapiens
ggattttatgttgaca

SEQ ID NO: 5769772 - DNA, 21 bp, Homo sapiens
ggattttatgttgacatttgt

SEQ ID NO: 5769773 - DNA, 12 bp, Homo sapiens
ggattttcaaag

SEQ ID NO: 5769774 - DNA, 18 bp, Homo sapiens
ggattttcaagttattca

SEQ ID NO: 5769775 - DNA, 13 bp, Homo sapiens
ggattttcctgaa

SEQ ID NO: 5769776 - DNA, 22 bp, Homo sapiens
ggattttcctgaagctgcttaa

SEQ ID NO: 5769777 - DNA, 18 bp, Homo sapiens
ggattttctagtttcctg

SEQ ID NO: 5769778 - DNA, 23 bp, Homo sapiens
ggattttgaattagattatttct

SEQ ID NO: 5769779 - DNA, 12 bp, Homo sapiens
ggattttgagta

SEQ ID NO: 5769780 - DNA, 23 bp, Homo sapiens
ggattttggaaactcaaggaaaa

SEQ ID NO: 5769781 - DNA, 15 bp, Homo sapiens
ggatttttaattaaa

SEQ ID NO: 5769782 - DNA, 21 bp, Homo sapiens
ggatttttacaaataaagatg

SEQ ID NO: 5769783 - DNA, 10 bp, Homo sapiens
ggatttttag

SEQ ID NO: 5769784 - DNA, 22 bp, Homo sapiens
ggatttttagagcattaaaata

SEQ ID NO: 5769785 - DNA, 13 bp, Homo sapiens
ggatttttgagtc

SEQ ID NO: 5769786 - DNA, 15 bp, Homo sapiens
ggattttttaaatca

SEQ ID NO: 5769787 - DNA, 18 bp, Homo sapiens
ggattttttactgccctt

SEQ ID NO: 5769788 - DNA, 21 bp, Homo sapiens
ggattttttatgtacaaccct

SEQ ID NO: 5769789 - DNA, 23 bp, Homo sapiens
ggattttttatgtacaaccctga

SEQ ID NO: 5769790 - DNA, 23 bp, Homo sapiens
ggcaaggtgggttccagggactg

SEQ ID NO: 5769791 - DNA, 16 bp, Homo sapiens
ggcaaggttcagtctg

SEQ ID NO: 5769792 - DNA, 21 bp, Homo sapiens
ggcaagtatttttatttaaat

SEQ ID NO: 5769793 - DNA, 22 bp, Homo sapiens
ggcaagtccctgactctctgtg

SEQ ID NO: 5769794 - DNA, 19 bp, Homo sapiens
ggcaagtgagaggggaggg

SEQ ID NO: 5769795 - DNA, 16 bp, Homo sapiens
ggcaagtgaggcaaga

SEQ ID NO: 5769796 - DNA, 13 bp, Homo sapiens
ggcaagtgattga

SEQ ID NO: 5769797 - DNA, 22 bp, Homo sapiens
ggcaagtggtagggatgaggtc

SEQ ID NO: 5769798 - DNA, 16 bp, Homo sapiens
ggcaagtttacttttt

SEQ ID NO: 5769799 - DNA, 16 bp, Homo sapiens
ggcaataaaagcccag

SEQ ID NO: 5769800 - DNA, 14 bp, Homo sapiens
ggcaataaaggaga

SEQ ID NO: 5769801 - DNA, 17 bp, Homo sapiens
ggcaataaataaatgtt

SEQ ID NO: 5769802 - DNA, 20 bp, Homo sapiens
ggcaatagaccgagactccg

SEQ ID NO: 5769803 - DNA, 16 bp, Homo sapiens
ggcaatataaccaatg

SEQ ID NO: 5769804 - DNA, 22 bp, Homo sapiens
ggcaatataaccaatgtttaaa

SEQ ID NO: 5769805 - DNA, 20 bp, Homo sapiens
ggcaatattctctgtacata

SEQ ID NO: 5769806 - DNA, 11 bp, Homo sapiens
ggcaatatttg

SEQ ID NO: 5769807 - DNA, 20 bp, Homo sapiens
ggcaatcaataaacagcagg

SEQ ID NO: 5769808 - DNA, 19 bp, Homo sapiens
ggcaatcacttgaggtcag

SEQ ID NO: 5769809 - DNA, 17 bp, Homo sapiens
ggcaatcctgggctggc

SEQ ID NO: 5769810 - DNA, 15 bp, Homo sapiens
ggcaatcgttctgct

SEQ ID NO: 5769811 - DNA, 23 bp, Homo sapiens
ggcaatcgttctgctggccaaga

SEQ ID NO: 5769812 - DNA, 13 bp, Homo sapiens
ggcaatcttgccc

SEQ ID NO: 5769813 - DNA, 13 bp, Homo sapiens
ggcaatgactgtg

SEQ ID NO: 5769814 - DNA, 17 bp, Homo sapiens
ggcaatgccctacctgc

SEQ ID NO: 5769815 - DNA, 14 bp, Homo sapiens
ggcaatgccctgcg

SEQ ID NO: 5769816 - DNA, 17 bp, Homo sapiens
ggcaatgccctgcggct

SEQ ID NO: 5769817 - DNA, 20 bp, Homo sapiens
ggcaatgccctgcggctctg

SEQ ID NO: 5769818 - DNA, 14 bp, Homo sapiens
ggcaatgctggctg

SEQ ID NO: 5769819 - DNA, 16 bp, Homo sapiens
ggcaatggggagaggc

SEQ ID NO: 5769820 - DNA, 16 bp, Homo sapiens
ggcaatggtagtttct

SEQ ID NO: 5769821 - DNA, 18 bp, Homo sapiens
ggcaatggtagtttctgt

SEQ ID NO: 5769822 - DNA, 18 bp, Homo sapiens
ggcaatgtcaggaacaga

SEQ ID NO: 5769823 - DNA, 20 bp, Homo sapiens
ggcaattaattccttcagca

SEQ ID NO: 5769824 - DNA, 18 bp, Homo sapiens
ggcaattagtgtgacagt

SEQ ID NO: 5769825 - DNA, 22 bp, Homo sapiens
ggcaattatatctattatgtat

SEQ ID NO: 5769826 - DNA, 20 bp, Homo sapiens
ggcaattgacttcctccaat

SEQ ID NO: 5769827 - DNA, 12 bp, Homo sapiens
ggcaattggaac

SEQ ID NO: 5769828 - DNA, 16 bp, Homo sapiens
ggcaatttagaaaaag

SEQ ID NO: 5769829 - DNA, 16 bp, Homo sapiens
ggcaattttagtgtat

SEQ ID NO: 5769830 - DNA, 15 bp, Homo sapiens
ggcaattttgtggtt

SEQ ID NO: 5769831 - DNA, 15 bp, Homo sapiens
ggcacaaaaccagaa

SEQ ID NO: 5769832 - DNA, 12 bp, Homo sapiens
ggcacaaaatgt

SEQ ID NO: 5769833 - DNA, 16 bp, Homo sapiens
ggcacaaaatgtgaca

SEQ ID NO: 5769834 - DNA, 16 bp, Homo sapiens
ggcacaactggaagct

SEQ ID NO: 5769835 - DNA, 15 bp, Homo sapiens
ggcacaagaatcact

SEQ ID NO: 5769836 - DNA, 14 bp, Homo sapiens
ggcacaagaattga

SEQ ID NO: 5769837 - DNA, 15 bp, Homo sapiens
ggcacaagacccctg

SEQ ID NO: 5769838 - DNA, 18 bp, Homo sapiens
ggcacaagacccctgctc

SEQ ID NO: 5769839 - DNA, 14 bp, Homo sapiens
ggcacaagactgac

SEQ ID NO: 5769840 - DNA, 22 bp, Homo sapiens
ggcacaagcaaaagggtgtctg

SEQ ID NO: 5769841 - DNA, 23 bp, Homo sapiens
ggcacaagtcctggatgttgtgt

SEQ ID NO: 5769842 - DNA, 22 bp, Homo sapiens
ggcacaatgttggagcagcagg

SEQ ID NO: 5769843 - DNA, 18 bp, Homo sapiens
ggcacaattcctgtgctc

SEQ ID NO: 5769844 - DNA, 19 bp, Homo sapiens
ggcacaattcctgtgctca

SEQ ID NO: 5769845 - DNA, 20 bp, Homo sapiens
ggcacacaaggggcccttgg

SEQ ID NO: 5769846 - DNA, 14 bp, Homo sapiens
ggcacacacagccc

SEQ ID NO: 5769847 - DNA, 15 bp, Homo sapiens
ggcacacacagcccc

SEQ ID NO: 5769848 - DNA, 14 bp, Homo sapiens
ggcacacaccacca

SEQ ID NO: 5769849 - DNA, 13 bp, Homo sapiens
ggcacacacctgt

SEQ ID NO: 5769850 - DNA, 20 bp, Homo sapiens
ggcacacacgccttcatgcc

SEQ ID NO: 5769851 - DNA, 22 bp, Homo sapiens
ggcacacacgccttcatgccag

SEQ ID NO: 5769852 - DNA, 12 bp, Homo sapiens
ggcacacactgt

SEQ ID NO: 5769853 - DNA, 14 bp, Homo sapiens
ggcacacagactgg

SEQ ID NO: 5769854 - DNA, 14 bp, Homo sapiens
ggcacacagcagcc

SEQ ID NO: 5769855 - DNA, 16 bp, Homo sapiens
ggcacaccactgccct

SEQ ID NO: 5769856 - DNA, 22 bp, Homo sapiens
ggcacaccactgccctgcctgc

SEQ ID NO: 5769857 - DNA, 17 bp, Homo sapiens
ggcacaccgccatcctc

SEQ ID NO: 5769858 - DNA, 23 bp, Homo sapiens
ggcacacctagacaaacaaggga

SEQ ID NO: 5769859 - DNA, 21 bp, Homo sapiens
ggcacacctcctcccactgcc

SEQ ID NO: 5769860 - DNA, 22 bp, Homo sapiens
ggcacacctcctcccactgccc

SEQ ID NO: 5769861 - DNA, 20 bp, Homo sapiens
ggcacacgcacaaacacaca

SEQ ID NO: 5769862 - DNA, 12 bp, Homo sapiens
ggcacacgcctc

SEQ ID NO: 5769863 - DNA, 17 bp, Homo sapiens
ggcacacgcctcccact

SEQ ID NO: 5769864 - DNA, 18 bp, Homo sapiens
ggcacacgcctcccactg

SEQ ID NO: 5769865 - DNA, 19 bp, Homo sapiens
ggcacactacagagcagct

SEQ ID NO: 5769866 - DNA, 21 bp, Homo sapiens
ggcacactctgccagcaaaga

SEQ ID NO: 5769867 - DNA, 14 bp, Homo sapiens
ggcacactgagcaa

SEQ ID NO: 5769868 - DNA, 13 bp, Homo sapiens
ggcacactgccaa

SEQ ID NO: 5769869 - DNA, 13 bp, Homo sapiens
ggcacactttctg

SEQ ID NO: 5769870 - DNA, 17 bp, Homo sapiens
ggcacactttctggcaa

SEQ ID NO: 5769871 - DNA, 15 bp, Homo sapiens
ggcacagaccaggcc

SEQ ID NO: 5769872 - DNA, 14 bp, Homo sapiens
ggcacagacgactg

SEQ ID NO: 5769873 - DNA, 18 bp, Homo sapiens
ggcacagacttctggaag

SEQ ID NO: 5769874 - DNA, 19 bp, Homo sapiens
ggcacagacttctggaagg

SEQ ID NO: 5769875 - DNA, 22 bp, Homo sapiens
ggcacagacttctggaaggctg

SEQ ID NO: 5769876 - DNA, 13 bp, Homo sapiens
ggcacagaggagg

SEQ ID NO: 5769877 - DNA, 16 bp, Homo sapiens
ggcacagaggaggtca

SEQ ID NO: 5769878 - DNA, 13 bp, Homo sapiens
ggcacagatgcct

SEQ ID NO: 5769879 - DNA, 14 bp, Homo sapiens
ggcacagattgaag

SEQ ID NO: 5769880 - DNA, 17 bp, Homo sapiens
ggcacagattgaagaat

SEQ ID NO: 5769881 - DNA, 17 bp, Homo sapiens
ggcacagcatctgtagt

SEQ ID NO: 5769882 - DNA, 12 bp, Homo sapiens
ggcacagccaga

SEQ ID NO: 5769883 - DNA, 16 bp, Homo sapiens
ggcacagccagcccaa

SEQ ID NO: 5769884 - DNA, 14 bp, Homo sapiens
ggcacagcccctgg

SEQ ID NO: 5769885 - DNA, 21 bp, Homo sapiens
ggcacagcccctggagcctca

SEQ ID NO: 5769886 - DNA, 12 bp, Homo sapiens
ggcacagccctc

SEQ ID NO: 5769887 - DNA, 13 bp, Homo sapiens
ggcacagccctcc

SEQ ID NO: 5769888 - DNA, 15 bp, Homo sapiens
ggcacagccctgagt

SEQ ID NO: 5769889 - DNA, 21 bp, Homo sapiens
ggcacagccctgagtgtccca

SEQ ID NO: 5769890 - DNA, 23 bp, Homo sapiens
ggcacagccggggcctgcctagc

SEQ ID NO: 5769891 - DNA, 14 bp, Homo sapiens
ggcacagcctgcac

SEQ ID NO: 5769892 - DNA, 20 bp, Homo sapiens
ggcacagcggagtctgtcct

SEQ ID NO: 5769893 - DNA, 22 bp, Homo sapiens
ggcacagcggagtctgtcctgt

SEQ ID NO: 5769894 - DNA, 18 bp, Homo sapiens
ggcacagcggggccccag

SEQ ID NO: 5769895 - DNA, 16 bp, Homo sapiens
ggcacagctgctgtgc

SEQ ID NO: 5769896 - DNA, 13 bp, Homo sapiens
ggcacagctggga

SEQ ID NO: 5769897 - DNA, 20 bp, Homo sapiens
ggcacagctgggagcctggt

SEQ ID NO: 5769898 - DNA, 14 bp, Homo sapiens
ggcacagctgtctg

SEQ ID NO: 5769899 - DNA, 21 bp, Homo sapiens
ggcacagctgtctgccaggca

SEQ ID NO: 5769900 - DNA, 23 bp, Homo sapiens
ggcacagctgtctgccaggcact

SEQ ID NO: 5769901 - DNA, 24 bp, Homo sapiens
ggcacagctgtctgccaggcactc

SEQ ID NO: 5769902 - DNA, 12 bp, Homo sapiens
ggcacaggaaac

SEQ ID NO: 5769903 - DNA, 22 bp, Homo sapiens
ggcacaggactgattctgggat

SEQ ID NO: 5769904 - DNA, 13 bp, Homo sapiens
ggcacaggagcta

SEQ ID NO: 5769905 - DNA, 16 bp, Homo sapiens
ggcacaggagctacct

SEQ ID NO: 5769906 - DNA, 20 bp, Homo sapiens
ggcacaggagctacctgtgt

SEQ ID NO: 5769907 - DNA, 12 bp, Homo sapiens
ggcacaggaggc

SEQ ID NO: 5769908 - DNA, 12 bp, Homo sapiens
ggcacaggcagg

SEQ ID NO: 5769909 - DNA, 13 bp, Homo sapiens
ggcacaggcagga

SEQ ID NO: 5769910 - DNA, 21 bp, Homo sapiens
ggcacaggcaggaagagagag

SEQ ID NO: 5769911 - DNA, 22 bp, Homo sapiens
ggcacaggcaggaagagagaga

SEQ ID NO: 5769912 - DNA, 16 bp, Homo sapiens
ggcacaggcagggcag

SEQ ID NO: 5769913 - DNA, 14 bp, Homo sapiens
ggcacaggccccct

SEQ ID NO: 5769914 - DNA, 15 bp, Homo sapiens
ggcacaggccccctt

SEQ ID NO: 5769915 - DNA, 18 bp, Homo sapiens
ggcacaggccgtcaccct

SEQ ID NO: 5769916 - DNA, 12 bp, Homo sapiens
ggcacaggctcc

SEQ ID NO: 5769917 - DNA, 22 bp, Homo sapiens
ggcacaggctgccccacccctc

SEQ ID NO: 5769918 - DNA, 13 bp, Homo sapiens
ggcacagggagag

SEQ ID NO: 5769919 - DNA, 18 bp, Homo sapiens
ggcacagggaggctgcag

SEQ ID NO: 5769920 - DNA, 19 bp, Homo sapiens
ggcacagggcaccagaggc

SEQ ID NO: 5769921 - DNA, 16 bp, Homo sapiens
ggcacagggcagtggg

SEQ ID NO: 5769922 - DNA, 12 bp, Homo sapiens
ggcacagggcct

SEQ ID NO: 5769923 - DNA, 17 bp, Homo sapiens
ggcacagggcctggccc

SEQ ID NO: 5769924 - DNA, 18 bp, Homo sapiens
ggcacagggcctggccca

SEQ ID NO: 5769925 - DNA, 20 bp, Homo sapiens
ggcacagggcctggcccatg

SEQ ID NO: 5769926 - DNA, 22 bp, Homo sapiens
ggcacaggtcaggggtgacaca

SEQ ID NO: 5769927 - DNA, 17 bp, Homo sapiens
ggcacaggtcgggcgca

SEQ ID NO: 5769928 - DNA, 17 bp, Homo sapiens
ggcacagtaccatataa

SEQ ID NO: 5769929 - DNA, 17 bp, Homo sapiens
ggcacagtccagaccca

SEQ ID NO: 5769930 - DNA, 22 bp, Homo sapiens
ggcacagtccaggaacaagcta

SEQ ID NO: 5769931 - DNA, 22 bp, Homo sapiens
ggcacagtctccatgtgtgtgc

SEQ ID NO: 5769932 - DNA, 21 bp, Homo sapiens
ggcacagtgatgccgggcgcc

SEQ ID NO: 5769933 - DNA, 23 bp, Homo sapiens
ggcacagtgatgccgggcgccag

SEQ ID NO: 5769934 - DNA, 17 bp, Homo sapiens
ggcacagtgctgcccct

SEQ ID NO: 5769935 - DNA, 21 bp, Homo sapiens
ggcacagtgctgccccttgca

SEQ ID NO: 5769936 - DNA, 13 bp, Homo sapiens
ggcacagtggctc

SEQ ID NO: 5769937 - DNA, 17 bp, Homo sapiens
ggcacagtgggagctga

SEQ ID NO: 5769938 - DNA, 21 bp, Homo sapiens
ggcacagttttctgagaaaga

SEQ ID NO: 5769939 - DNA, 16 bp, Homo sapiens
ggcacatagcataggc

SEQ ID NO: 5769940 - DNA, 22 bp, Homo sapiens
ggcacatcaattaattgattcc

SEQ ID NO: 5769941 - DNA, 18 bp, Homo sapiens
ggcacatcagcacgattt

SEQ ID NO: 5769942 - DNA, 17 bp, Homo sapiens
ggcacatgaacagcttg

SEQ ID NO: 5769943 - DNA, 15 bp, Homo sapiens
ggcacatgaggaggg

SEQ ID NO: 5769944 - DNA, 21 bp, Homo sapiens
ggcacatgaggagggtgccct

SEQ ID NO: 5769945 - DNA, 18 bp, Homo sapiens
ggcacatgccacctggca

SEQ ID NO: 5769946 - DNA, 16 bp, Homo sapiens
ggcacatgccccgatg

SEQ ID NO: 5769947 - DNA, 15 bp, Homo sapiens
ggcacatgctggccg

SEQ ID NO: 5769948 - DNA, 19 bp, Homo sapiens
ggcacattaactccctcca

SEQ ID NO: 5769949 - DNA, 22 bp, Homo sapiens
ggcacattaactccctccacca

SEQ ID NO: 5769950 - DNA, 12 bp, Homo sapiens
ggcacattcctt

SEQ ID NO: 5769951 - DNA, 14 bp, Homo sapiens
ggcacattgcccct

SEQ ID NO: 5769952 - DNA, 18 bp, Homo sapiens
ggcacatttaagagacag

SEQ ID NO: 5769953 - DNA, 17 bp, Homo sapiens
ggcacatttcagggaga

SEQ ID NO: 5769954 - DNA, 22 bp, Homo sapiens
ggcacattttacttagctggag

SEQ ID NO: 5769955 - DNA, 23 bp, Homo sapiens
ggcacatttttttttttaatttt

SEQ ID NO: 5769956 - DNA, 21 bp, Homo sapiens
ggcaccaaaccctgtcctccc

SEQ ID NO: 5769957 - DNA, 18 bp, Homo sapiens
ggcaccaaagatgcagcc

SEQ ID NO: 5769958 - DNA, 19 bp, Homo sapiens
ggcaccacagagaagacct

SEQ ID NO: 5769959 - DNA, 15 bp, Homo sapiens
ggcaccaccaggagc

SEQ ID NO: 5769960 - DNA, 17 bp, Homo sapiens
ggcaccaccaggagcag

SEQ ID NO: 5769961 - DNA, 23 bp, Homo sapiens
ggcaccaccaggagcagcagcca

SEQ ID NO: 5769962 - DNA, 20 bp, Homo sapiens
ggcaccaccagggtggacca

SEQ ID NO: 5769963 - DNA, 22 bp, Homo sapiens
ggcaccacccccagtcccccca

SEQ ID NO: 5769964 - DNA, 13 bp, Homo sapiens
ggcaccacctctg

SEQ ID NO: 5769965 - DNA, 22 bp, Homo sapiens
ggcaccactgcactccagcctg

SEQ ID NO: 5769966 - DNA, 13 bp, Homo sapiens
ggcaccagaatgc

SEQ ID NO: 5769967 - DNA, 15 bp, Homo sapiens
ggcaccagaggccga

SEQ ID NO: 5769968 - DNA, 15 bp, Homo sapiens
ggcaccagcagcctg

SEQ ID NO: 5769969 - DNA, 14 bp, Homo sapiens
ggcaccagcaggca

SEQ ID NO: 5769970 - DNA, 14 bp, Homo sapiens
ggcaccagccagcg

SEQ ID NO: 5769971 - DNA, 19 bp, Homo sapiens
ggcaccagccccctggatg

SEQ ID NO: 5769972 - DNA, 18 bp, Homo sapiens
ggcaccagccggggaaga

SEQ ID NO: 5769973 - DNA, 21 bp, Homo sapiens
ggcaccagggcgctgggaagg

SEQ ID NO: 5769974 - DNA, 15 bp, Homo sapiens
ggcaccagtccagca

SEQ ID NO: 5769975 - DNA, 18 bp, Homo sapiens
ggcaccagtccctgtccg

SEQ ID NO: 5769976 - DNA, 15 bp, Homo sapiens
ggcaccagtgcctca

SEQ ID NO: 5769977 - DNA, 16 bp, Homo sapiens
ggcaccagtgcctcag

SEQ ID NO: 5769978 - DNA, 17 bp, Homo sapiens
ggcaccagtgcctcagt

SEQ ID NO: 5769979 - DNA, 23 bp, Homo sapiens
ggcaccatagaagaacagcagat

SEQ ID NO: 5769980 - DNA, 14 bp, Homo sapiens
ggcaccatctccct

SEQ ID NO: 5769981 - DNA, 13 bp, Homo sapiens
ggcaccatctgga

SEQ ID NO: 5769982 - DNA, 19 bp, Homo sapiens
ggcaccattcaggaacctg

SEQ ID NO: 5769983 - DNA, 20 bp, Homo sapiens
ggcacccacaagtgccactg

SEQ ID NO: 5769984 - DNA, 14 bp, Homo sapiens
ggcacccacacaga

SEQ ID NO: 5769985 - DNA, 20 bp, Homo sapiens
ggcacccacacagaggacct

SEQ ID NO: 5769986 - DNA, 22 bp, Homo sapiens
ggcacccactccggattccggc

SEQ ID NO: 5769987 - DNA, 19 bp, Homo sapiens
ggcacccaggcctccctgc

SEQ ID NO: 5769988 - DNA, 20 bp, Homo sapiens
ggcacccagtgagcactccc

SEQ ID NO: 5769989 - DNA, 19 bp, Homo sapiens
ggcaccccaggcagctcct

SEQ ID NO: 5769990 - DNA, 21 bp, Homo sapiens
ggcaccccaggcagctcctgt

SEQ ID NO: 5769991 - DNA, 23 bp, Homo sapiens
ggcacccccacaagctgtccctg

SEQ ID NO: 5769992 - DNA, 13 bp, Homo sapiens
ggcacccccagaa

SEQ ID NO: 5769993 - DNA, 17 bp, Homo sapiens
ggcacccccagcctggg

SEQ ID NO: 5769994 - DNA, 21 bp, Homo sapiens
ggcacccccagcctgggccta

SEQ ID NO: 5769995 - DNA, 15 bp, Homo sapiens
ggcacccccatgctg

SEQ ID NO: 5769996 - DNA, 19 bp, Homo sapiens
ggcacccccggcccagtgc

SEQ ID NO: 5769997 - DNA, 13 bp, Homo sapiens
ggcaccccctgca

SEQ ID NO: 5769998 - DNA, 14 bp, Homo sapiens
ggcaccccctgcag

SEQ ID NO: 5769999 - DNA, 19 bp, Homo sapiens
ggcaccccctgcagcttgt

SEQ ID NO: 5770000 - DNA, 15 bp, Homo sapiens
ggcaccccctggaga

SEQ ID NO: 5770001 - DNA, 16 bp, Homo sapiens
ggcaccccctggagag

SEQ ID NO: 5770002 - DNA, 19 bp, Homo sapiens
ggcaccccctggagagaag

SEQ ID NO: 5770003 - DNA, 21 bp, Homo sapiens
ggcacccctccgtgtggagca

SEQ ID NO: 5770004 - DNA, 13 bp, Homo sapiens
ggcacccctgcct

SEQ ID NO: 5770005 - DNA, 15 bp, Homo sapiens
ggcacccctgcctcc

SEQ ID NO: 5770006 - DNA, 18 bp, Homo sapiens
ggcacccctgcctcctgc

SEQ ID NO: 5770007 - DNA, 18 bp, Homo sapiens
ggcacccctttccccagc

SEQ ID NO: 5770008 - DNA, 21 bp, Homo sapiens
ggcacccctttccccagcctc

SEQ ID NO: 5770009 - DNA, 16 bp, Homo sapiens
ggcacccggcccctgc

SEQ ID NO: 5770010 - DNA, 17 bp, Homo sapiens
ggcacccggcccctgct

SEQ ID NO: 5770011 - DNA, 18 bp, Homo sapiens
ggcacccggcccctgctg

SEQ ID NO: 5770012 - DNA, 19 bp, Homo sapiens
ggcacccggcccctgctgg

SEQ ID NO: 5770013 - DNA, 20 bp, Homo sapiens
ggcacccggcccctgctggt

SEQ ID NO: 5770014 - DNA, 22 bp, Homo sapiens
ggcacccggcccctgctggttc

SEQ ID NO: 5770015 - DNA, 17 bp, Homo sapiens
ggcacccggtcccctct

SEQ ID NO: 5770016 - DNA, 12 bp, Homo sapiens
ggcaccctcagg

SEQ ID NO: 5770017 - DNA, 20 bp, Homo sapiens
ggcaccctcagggagcctcc

SEQ ID NO: 5770018 - DNA, 21 bp, Homo sapiens
ggcaccctcagggagcctccc

SEQ ID NO: 5770019 - DNA, 23 bp, Homo sapiens
ggcaccctccaaacactgggctc

SEQ ID NO: 5770020 - DNA, 17 bp, Homo sapiens
ggcaccctgcaggcagg

SEQ ID NO: 5770021 - DNA, 19 bp, Homo sapiens
ggcaccctggtctgtggag

SEQ ID NO: 5770022 - DNA, 17 bp, Homo sapiens
ggcacccttctttcctc

SEQ ID NO: 5770023 - DNA, 20 bp, Homo sapiens
ggcacccttgactgttggga

SEQ ID NO: 5770024 - DNA, 20 bp, Homo sapiens
ggcaccgcctgcccccagcg

SEQ ID NO: 5770025 - DNA, 17 bp, Homo sapiens
ggcaccggacgctggag

SEQ ID NO: 5770026 - DNA, 24 bp, Homo sapiens
ggcaccggacgctggagaccctgc

SEQ ID NO: 5770027 - DNA, 14 bp, Homo sapiens
ggcaccggcctcta

SEQ ID NO: 5770028 - DNA, 14 bp, Homo sapiens
ggcaccggcgctgc

SEQ ID NO: 5770029 - DNA, 16 bp, Homo sapiens
ggcaccggcgctgcag

SEQ ID NO: 5770030 - DNA, 19 bp, Homo sapiens
ggcaccggcgctgcaggta

SEQ ID NO: 5770031 - DNA, 16 bp, Homo sapiens
ggcaccgggctccatg

SEQ ID NO: 5770032 - DNA, 19 bp, Homo sapiens
ggcaccgggctccatgcct

SEQ ID NO: 5770033 - DNA, 16 bp, Homo sapiens
ggcaccgttatccctg

SEQ ID NO: 5770034 - DNA, 19 bp, Homo sapiens
ggcacctaatccaggcaga

SEQ ID NO: 5770035 - DNA, 21 bp, Homo sapiens
ggcacctacactcacctgcac

SEQ ID NO: 5770036 - DNA, 17 bp, Homo sapiens
ggcacctacatccccag

SEQ ID NO: 5770037 - DNA, 14 bp, Homo sapiens
ggcacctcagaaag

SEQ ID NO: 5770038 - DNA, 18 bp, Homo sapiens
ggcacctccccgctctcc

SEQ ID NO: 5770039 - DNA, 21 bp, Homo sapiens
ggcacctccccgctctccctg

SEQ ID NO: 5770040 - DNA, 18 bp, Homo sapiens
ggcacctgaccagaatgc

SEQ ID NO: 5770041 - DNA, 22 bp, Homo sapiens
ggcacctgcacactccatctcc

SEQ ID NO: 5770042 - DNA, 14 bp, Homo sapiens
ggcacctgcctagc

SEQ ID NO: 5770043 - DNA, 21 bp, Homo sapiens
ggcacctgcctagctcttggg

SEQ ID NO: 5770044 - DNA, 12 bp, Homo sapiens
ggcacctgctcc

SEQ ID NO: 5770045 - DNA, 13 bp, Homo sapiens
ggcacctgctccc

SEQ ID NO: 5770046 - DNA, 12 bp, Homo sapiens
ggcacctggcct

SEQ ID NO: 5770047 - DNA, 14 bp, Homo sapiens
ggcacctggcctgc

SEQ ID NO: 5770048 - DNA, 17 bp, Homo sapiens
ggcacctggcctgctgg

SEQ ID NO: 5770049 - DNA, 19 bp, Homo sapiens
ggcacctggcctgctggga

SEQ ID NO: 5770050 - DNA, 22 bp, Homo sapiens
ggcacctgggccctggggcctg

SEQ ID NO: 5770051 - DNA, 14 bp, Homo sapiens
ggcacctggggagt

SEQ ID NO: 5770052 - DNA, 16 bp, Homo sapiens
ggcacctgtcgcccag

SEQ ID NO: 5770053 - DNA, 17 bp, Homo sapiens
ggcacctgtggccagag

SEQ ID NO: 5770054 - DNA, 20 bp, Homo sapiens
ggcacctgtggccagagcac

SEQ ID NO: 5770055 - DNA, 23 bp, Homo sapiens
ggcacctgtggccagagcacctc

SEQ ID NO: 5770056 - DNA, 19 bp, Homo sapiens
ggcacctgtgttccagccc

SEQ ID NO: 5770057 - DNA, 16 bp, Homo sapiens
ggcaccttaaaactta

SEQ ID NO: 5770058 - DNA, 17 bp, Homo sapiens
ggcaccttaactggaga

SEQ ID NO: 5770059 - DNA, 14 bp, Homo sapiens
ggcaccttgattgg

SEQ ID NO: 5770060 - DNA, 18 bp, Homo sapiens
ggcacctttgagagaggg

SEQ ID NO: 5770061 - DNA, 17 bp, Homo sapiens
ggcacgaacccacctgc

SEQ ID NO: 5770062 - DNA, 20 bp, Homo sapiens
ggcacgaacccacctgctga

SEQ ID NO: 5770063 - DNA, 17 bp, Homo sapiens
ggcacgcactgggttgc

SEQ ID NO: 5770064 - DNA, 19 bp, Homo sapiens
ggcacgcacttgcctgttg

SEQ ID NO: 5770065 - DNA, 20 bp, Homo sapiens
ggcacgccctactccactgc

SEQ ID NO: 5770066 - DNA, 23 bp, Homo sapiens
ggcacgccctactccactgccct

SEQ ID NO: 5770067 - DNA, 14 bp, Homo sapiens
ggcacgcctgccca

SEQ ID NO: 5770068 - DNA, 15 bp, Homo sapiens
ggcacggactgtcca

SEQ ID NO: 5770069 - DNA, 19 bp, Homo sapiens
ggcacggactgtccacctt

SEQ ID NO: 5770070 - DNA, 20 bp, Homo sapiens
ggcacggcgggatcctccac

SEQ ID NO: 5770071 - DNA, 16 bp, Homo sapiens
ggcacggctctggggt

SEQ ID NO: 5770072 - DNA, 16 bp, Homo sapiens
ggcacgggagagcgcc

SEQ ID NO: 5770073 - DNA, 19 bp, Homo sapiens
ggcacgggagagcgccacc

SEQ ID NO: 5770074 - DNA, 14 bp, Homo sapiens
ggcacggggacctg

SEQ ID NO: 5770075 - DNA, 15 bp, Homo sapiens
ggcacggggacctgg

SEQ ID NO: 5770076 - DNA, 15 bp, Homo sapiens
ggcacgggtggtccc

SEQ ID NO: 5770077 - DNA, 21 bp, Homo sapiens
ggcacgggtgtcgaggcagga

SEQ ID NO: 5770078 - DNA, 20 bp, Homo sapiens
ggcacggtcacacggccacc

SEQ ID NO: 5770079 - DNA, 22 bp, Homo sapiens
ggcacgtattgctgtgtctcct

SEQ ID NO: 5770080 - DNA, 18 bp, Homo sapiens
ggcacgtcatctagtttt

SEQ ID NO: 5770081 - DNA, 21 bp, Homo sapiens
ggcacgtcccatgtgcatgga

SEQ ID NO: 5770082 - DNA, 14 bp, Homo sapiens
ggcacgtcctccac

SEQ ID NO: 5770083 - DNA, 16 bp, Homo sapiens
ggcacgtctcctgctg

SEQ ID NO: 5770084 - DNA, 21 bp, Homo sapiens
ggcacgtctcctgctgcgtga

SEQ ID NO: 5770085 - DNA, 13 bp, Homo sapiens
ggcacgtggccag

SEQ ID NO: 5770086 - DNA, 15 bp, Homo sapiens
ggcacgtggccagga

SEQ ID NO: 5770087 - DNA, 17 bp, Homo sapiens
ggcacgtggccaggagc

SEQ ID NO: 5770088 - DNA, 18 bp, Homo sapiens
ggcacgtggccaggagcc

SEQ ID NO: 5770089 - DNA, 19 bp, Homo sapiens
ggcacgttgacccaacctt

SEQ ID NO: 5770090 - DNA, 21 bp, Homo sapiens
ggcactaaaccacttctctgc

SEQ ID NO: 5770091 - DNA, 14 bp, Homo sapiens
ggcactagaagatg

SEQ ID NO: 5770092 - DNA, 22 bp, Homo sapiens
ggcactagcattataccaagag

SEQ ID NO: 5770093 - DNA, 13 bp, Homo sapiens
ggcactagctaga

SEQ ID NO: 5770094 - DNA, 13 bp, Homo sapiens
ggcactatatttt

SEQ ID NO: 5770095 - DNA, 14 bp, Homo sapiens
ggcactatattttt

SEQ ID NO: 5770096 - DNA, 18 bp, Homo sapiens
ggcactatttatttacaa

SEQ ID NO: 5770097 - DNA, 15 bp, Homo sapiens
ggcactatttttatt

SEQ ID NO: 5770098 - DNA, 17 bp, Homo sapiens
ggcactcacagacctgg

SEQ ID NO: 5770099 - DNA, 21 bp, Homo sapiens
ggcactcacagacctggagcc

SEQ ID NO: 5770100 - DNA, 15 bp, Homo sapiens
ggcactcacatgccg

SEQ ID NO: 5770101 - DNA, 19 bp, Homo sapiens
ggcactcagaagacactga

SEQ ID NO: 5770102 - DNA, 23 bp, Homo sapiens
ggcactcagaagacactgatggg

SEQ ID NO: 5770103 - DNA, 18 bp, Homo sapiens
ggcactcagaagttgtgc

SEQ ID NO: 5770104 - DNA, 19 bp, Homo sapiens
ggcactcagtgagcctcct

SEQ ID NO: 5770105 - DNA, 23 bp, Homo sapiens
ggcactcatgacggcctgcctgc

SEQ ID NO: 5770106 - DNA, 14 bp, Homo sapiens
ggcactccaaccta

SEQ ID NO: 5770107 - DNA, 20 bp, Homo sapiens
ggcactccaacctaacctgt

SEQ ID NO: 5770108 - DNA, 16 bp, Homo sapiens
ggcactccctccagca

SEQ ID NO: 5770109 - DNA, 18 bp, Homo sapiens
ggcactccctccagcaca

SEQ ID NO: 5770110 - DNA, 21 bp, Homo sapiens
ggcactccgcgccgatgccac

SEQ ID NO: 5770111 - DNA, 22 bp, Homo sapiens
ggcactccgcgccgatgccacc

SEQ ID NO: 5770112 - DNA, 13 bp, Homo sapiens
ggcactctagatt

SEQ ID NO: 5770113 - DNA, 14 bp, Homo sapiens
ggcactctctgcca

SEQ ID NO: 5770114 - DNA, 22 bp, Homo sapiens
ggcactctctgccagctccaca

SEQ ID NO: 5770115 - DNA, 22 bp, Homo sapiens
ggcactctctgccattctgtgc

SEQ ID NO: 5770116 - DNA, 18 bp, Homo sapiens
ggcactgaacaggctggg

SEQ ID NO: 5770117 - DNA, 21 bp, Homo sapiens
ggcactgaacaggctggggcc

SEQ ID NO: 5770118 - DNA, 23 bp, Homo sapiens
ggcactgaagggatatgtgaaac

SEQ ID NO: 5770119 - DNA, 12 bp, Homo sapiens
ggcactgacagc

SEQ ID NO: 5770120 - DNA, 13 bp, Homo sapiens
ggcactgacagcc

SEQ ID NO: 5770121 - DNA, 19 bp, Homo sapiens
ggcactgagcccccccaac

SEQ ID NO: 5770122 - DNA, 15 bp, Homo sapiens
ggcactgccaccagc

SEQ ID NO: 5770123 - DNA, 16 bp, Homo sapiens
ggcactgccagactga

SEQ ID NO: 5770124 - DNA, 21 bp, Homo sapiens
ggcactgcccttttcaggaag

SEQ ID NO: 5770125 - DNA, 19 bp, Homo sapiens
ggcactgctgggtggccca

SEQ ID NO: 5770126 - DNA, 16 bp, Homo sapiens
ggcactgcttccagtg

SEQ ID NO: 5770127 - DNA, 22 bp, Homo sapiens
ggcactgcttccagtgaggctc

SEQ ID NO: 5770128 - DNA, 17 bp, Homo sapiens
ggcactggaccccagca

SEQ ID NO: 5770129 - DNA, 21 bp, Homo sapiens
ggcactggatcccatcaaaga

SEQ ID NO: 5770130 - DNA, 16 bp, Homo sapiens
ggcactggatggactt

SEQ ID NO: 5770131 - DNA, 13 bp, Homo sapiens
ggcactggcactg

SEQ ID NO: 5770132 - DNA, 19 bp, Homo sapiens
ggcactggccacccctccc

SEQ ID NO: 5770133 - DNA, 16 bp, Homo sapiens
ggcactggcgaggaga

SEQ ID NO: 5770134 - DNA, 14 bp, Homo sapiens
ggcactggctgctc

SEQ ID NO: 5770135 - DNA, 15 bp, Homo sapiens
ggcactggctgctct

SEQ ID NO: 5770136 - DNA, 16 bp, Homo sapiens
ggcactggctgctctg

SEQ ID NO: 5770137 - DNA, 16 bp, Homo sapiens
ggcactgggcatgagg

SEQ ID NO: 5770138 - DNA, 15 bp, Homo sapiens
ggcactgggccggca

SEQ ID NO: 5770139 - DNA, 13 bp, Homo sapiens
ggcactggtggca

SEQ ID NO: 5770140 - DNA, 12 bp, Homo sapiens
ggcactggtggg

SEQ ID NO: 5770141 - DNA, 13 bp, Homo sapiens
ggcactgtacaaa

SEQ ID NO: 5770142 - DNA, 24 bp, Homo sapiens
ggcactgtactaggcgtgagaagc

SEQ ID NO: 5770143 - DNA, 20 bp, Homo sapiens
ggcactgtagttctaagact

SEQ ID NO: 5770144 - DNA, 19 bp, Homo sapiens
ggcactgtcatgcccagct

SEQ ID NO: 5770145 - DNA, 15 bp, Homo sapiens
ggcagaggttgtagt

SEQ ID NO: 5770146 - DNA, 22 bp, Homo sapiens
ggcagaggttgtagtgagccca

SEQ ID NO: 5770147 - DNA, 22 bp, Homo sapiens
ggcagaggttttaatgtctgtt

SEQ ID NO: 5770148 - DNA, 15 bp, Homo sapiens
ggcagagtcctggag

SEQ ID NO: 5770149 - DNA, 14 bp, Homo sapiens
ggcagagtgaaata

SEQ ID NO: 5770150 - DNA, 18 bp, Homo sapiens
ggcagagtgaaataaaat

SEQ ID NO: 5770151 - DNA, 21 bp, Homo sapiens
ggcagagtgccccacctgcca

SEQ ID NO: 5770152 - DNA, 20 bp, Homo sapiens
ggcagagtggcctgtgagca

SEQ ID NO: 5770153 - DNA, 21 bp, Homo sapiens
ggcagagtggcgtggcctccc

SEQ ID NO: 5770154 - DNA, 18 bp, Homo sapiens
ggcagagtgggctgcctg

SEQ ID NO: 5770155 - DNA, 20 bp, Homo sapiens
ggcagagtgggctgcctggg

SEQ ID NO: 5770156 - DNA, 18 bp, Homo sapiens
ggcagagttacagttctg

SEQ ID NO: 5770157 - DNA, 13 bp, Homo sapiens
ggcagagttactt

SEQ ID NO: 5770158 - DNA, 21 bp, Homo sapiens
ggcagagttctataatgtaaa

SEQ ID NO: 5770159 - DNA, 23 bp, Homo sapiens
ggcagagttgaagacagagctac

SEQ ID NO: 5770160 - DNA, 18 bp, Homo sapiens
ggcagagttgtaaatata

SEQ ID NO: 5770161 - DNA, 17 bp, Homo sapiens
ggcagataagttggagc

SEQ ID NO: 5770162 - DNA, 20 bp, Homo sapiens
ggcagataagttggagcagg

SEQ ID NO: 5770163 - DNA, 19 bp, Homo sapiens
ggcagataatcagcctctt

SEQ ID NO: 5770164 - DNA, 23 bp, Homo sapiens
ggcagatacaggaaaagctgctg

SEQ ID NO: 5770165 - DNA, 18 bp, Homo sapiens
ggcagatcctctggacac

SEQ ID NO: 5770166 - DNA, 16 bp, Homo sapiens
ggcagatcgctcactg

SEQ ID NO: 5770167 - DNA, 20 bp, Homo sapiens
ggcagatctgagtctagaac

SEQ ID NO: 5770168 - DNA, 16 bp, Homo sapiens
ggcagatctgtgcccc

SEQ ID NO: 5770169 - DNA, 17 bp, Homo sapiens
ggcagatctgtgcccca

SEQ ID NO: 5770170 - DNA, 18 bp, Homo sapiens
ggcagatctgtgccccat

SEQ ID NO: 5770171 - DNA, 15 bp, Homo sapiens
ggcagatcttttctt

SEQ ID NO: 5770172 - DNA, 17 bp, Homo sapiens
ggcagatcttttcttta

SEQ ID NO: 5770173 - DNA, 18 bp, Homo sapiens
ggcagatcttttctttaa

SEQ ID NO: 5770174 - DNA, 17 bp, Homo sapiens
ggcagatgaaaagctac

SEQ ID NO: 5770175 - DNA, 21 bp, Homo sapiens
ggcagatgacctcgtactcag

SEQ ID NO: 5770176 - DNA, 19 bp, Homo sapiens
ggcagatgagcttatttca

SEQ ID NO: 5770177 - DNA, 19 bp, Homo sapiens
ggcagatgatttgggcaga

SEQ ID NO: 5770178 - DNA, 15 bp, Homo sapiens
ggcagatgcagctct

SEQ ID NO: 5770179 - DNA, 20 bp, Homo sapiens
ggcagatgcagctcttcctg

SEQ ID NO: 5770180 - DNA, 13 bp, Homo sapiens
ggcagatggagac

SEQ ID NO: 5770181 - DNA, 22 bp, Homo sapiens
ggcagatgtaaatgatgtgttg

SEQ ID NO: 5770182 - DNA, 14 bp, Homo sapiens
ggcagatgtaggag

SEQ ID NO: 5770183 - DNA, 18 bp, Homo sapiens
ggcagatgtcttccctgg

SEQ ID NO: 5770184 - DNA, 16 bp, Homo sapiens
ggcagatgtggggctg

SEQ ID NO: 5770185 - DNA, 19 bp, Homo sapiens
ggcagatgttttgggggaa

SEQ ID NO: 5770186 - DNA, 18 bp, Homo sapiens
ggcagattctgaattggc

SEQ ID NO: 5770187 - DNA, 13 bp, Homo sapiens
ggcagattgaaaa

SEQ ID NO: 5770188 - DNA, 21 bp, Homo sapiens
ggcagattggttcatgcctgg

SEQ ID NO: 5770189 - DNA, 24 bp, Homo sapiens
ggcagatttactgtcccaggagca

SEQ ID NO: 5770190 - DNA, 16 bp, Homo sapiens
ggcagcaaagaggggc

SEQ ID NO: 5770191 - DNA, 16 bp, Homo sapiens
ggcagcaaagtgtcag

SEQ ID NO: 5770192 - DNA, 21 bp, Homo sapiens
ggcagcaacaaaggatttgaa

SEQ ID NO: 5770193 - DNA, 15 bp, Homo sapiens
ggcagcaacaataaa

SEQ ID NO: 5770194 - DNA, 22 bp, Homo sapiens
ggcagcaacaggaccaggagcc

SEQ ID NO: 5770195 - DNA, 23 bp, Homo sapiens
ggcagcaacaggaccaggagcca

SEQ ID NO: 5770196 - DNA, 12 bp, Homo sapiens
ggcagcaaggcc

SEQ ID NO: 5770197 - DNA, 17 bp, Homo sapiens
ggcagcaaggcccgagc

SEQ ID NO: 5770198 - DNA, 22 bp, Homo sapiens
ggcagcaaggcccgagcagctg

SEQ ID NO: 5770199 - DNA, 12 bp, Homo sapiens
ggcagcaaggct

SEQ ID NO: 5770200 - DNA, 17 bp, Homo sapiens
ggcagcaaggctgctgc

SEQ ID NO: 5770201 - DNA, 15 bp, Homo sapiens
ggcagcaagggacct

SEQ ID NO: 5770202 - DNA, 18 bp, Homo sapiens
ggcagcacacctctgggg

SEQ ID NO: 5770203 - DNA, 20 bp, Homo sapiens
ggcagcacagcccagggcct

SEQ ID NO: 5770204 - DNA, 21 bp, Homo sapiens
ggcagcacagcccagggcctg

SEQ ID NO: 5770205 - DNA, 20 bp, Homo sapiens
ggcagcacagtgtgtgaact

SEQ ID NO: 5770206 - DNA, 15 bp, Homo sapiens
ggcagcaccacactg

SEQ ID NO: 5770207 - DNA, 17 bp, Homo sapiens
ggcagcaccacactggg

SEQ ID NO: 5770208 - DNA, 22 bp, Homo sapiens
ggcagcaccactgacgtttctg

SEQ ID NO: 5770209 - DNA, 18 bp, Homo sapiens
ggcagcacccactcagcc

SEQ ID NO: 5770210 - DNA, 13 bp, Homo sapiens
ggcagcacccagg

SEQ ID NO: 5770211 - DNA, 19 bp, Homo sapiens
ggcagcaccctataaatca

SEQ ID NO: 5770212 - DNA, 12 bp, Homo sapiens
ggcagcaccgcc

SEQ ID NO: 5770213 - DNA, 19 bp, Homo sapiens
ggcagcaccgcctcttccc

SEQ ID NO: 5770214 - DNA, 15 bp, Homo sapiens
ggcagcacctccggg

SEQ ID NO: 5770215 - DNA, 18 bp, Homo sapiens
ggcagcacctctggtcag

SEQ ID NO: 5770216 - DNA, 21 bp, Homo sapiens
ggcagcacctctggtcaggag

SEQ ID NO: 5770217 - DNA, 20 bp, Homo sapiens
ggcagcacgcaggcggggca

SEQ ID NO: 5770218 - DNA, 22 bp, Homo sapiens
ggcagcacggcccggcccctca

SEQ ID NO: 5770219 - DNA, 14 bp, Homo sapiens
ggcagcactcccca

SEQ ID NO: 5770220 - DNA, 22 bp, Homo sapiens
ggcagcactccccagagctgtg

SEQ ID NO: 5770221 - DNA, 16 bp, Homo sapiens
ggcagcactgggaagc

SEQ ID NO: 5770222 - DNA, 19 bp, Homo sapiens
ggcagcactgggaagctgg

SEQ ID NO: 5770223 - DNA, 14 bp, Homo sapiens
ggcagcagaaaact

SEQ ID NO: 5770224 - DNA, 18 bp, Homo sapiens
ggcagcagaagggggtgg

SEQ ID NO: 5770225 - DNA, 20 bp, Homo sapiens
ggcagcagactgtgtttcgt

SEQ ID NO: 5770226 - DNA, 12 bp, Homo sapiens
ggcagcagagag

SEQ ID NO: 5770227 - DNA, 15 bp, Homo sapiens
ggcagcagagagaga

SEQ ID NO: 5770228 - DNA, 22 bp, Homo sapiens
ggcagcagagagagaggacaga

SEQ ID NO: 5770229 - DNA, 10 bp, Homo sapiens
ggcagcagca

SEQ ID NO: 5770230 - DNA, 16 bp, Homo sapiens
ggcagcagcagccctg

SEQ ID NO: 5770231 - DNA, 16 bp, Homo sapiens
ggcagcagcatcccag

SEQ ID NO: 5770232 - DNA, 15 bp, Homo sapiens
ggcagcagccagccc

SEQ ID NO: 5770233 - DNA, 21 bp, Homo sapiens
ggcagcagccagccctgcctg

SEQ ID NO: 5770234 - DNA, 12 bp, Homo sapiens
ggcagcagcccc

SEQ ID NO: 5770235 - DNA, 13 bp, Homo sapiens
ggcagcagccccc

SEQ ID NO: 5770236 - DNA, 11 bp, Homo sapiens
ggcagcagccg

SEQ ID NO: 5770237 - DNA, 15 bp, Homo sapiens
ggcagcagcttttcc

SEQ ID NO: 5770238 - DNA, 13 bp, Homo sapiens
ggcagcagggcta

SEQ ID NO: 5770239 - DNA, 16 bp, Homo sapiens
ggcagcaggggctgct

SEQ ID NO: 5770240 - DNA, 23 bp, Homo sapiens
ggcagcaggggtaggggtaggga

SEQ ID NO: 5770241 - DNA, 22 bp, Homo sapiens
ggcagcaggggttggggaaaca

SEQ ID NO: 5770242 - DNA, 16 bp, Homo sapiens
ggcagcaggtgctgct

SEQ ID NO: 5770243 - DNA, 13 bp, Homo sapiens
ggcagcagtgaag

SEQ ID NO: 5770244 - DNA, 13 bp, Homo sapiens
ggcagcagtgtga

SEQ ID NO: 5770245 - DNA, 14 bp, Homo sapiens
ggcagcagtgtgag

SEQ ID NO: 5770246 - DNA, 19 bp, Homo sapiens
ggcagcatgcccagattcc

SEQ ID NO: 5770247 - DNA, 17 bp, Homo sapiens
ggcagcatggagacagg

SEQ ID NO: 5770248 - DNA, 15 bp, Homo sapiens
ggcagcatggagaga

SEQ ID NO: 5770249 - DNA, 16 bp, Homo sapiens
ggcagccacaccactg

SEQ ID NO: 5770250 - DNA, 20 bp, Homo sapiens
ggcagccacacgcaggcggc

SEQ ID NO: 5770251 - DNA, 21 bp, Homo sapiens
ggcagccacacgcaggcggcc

SEQ ID NO: 5770252 - DNA, 16 bp, Homo sapiens
ggcagccacaggactg

SEQ ID NO: 5770253 - DNA, 21 bp, Homo sapiens
ggcagccacaggactgagccc

SEQ ID NO: 5770254 - DNA, 22 bp, Homo sapiens
ggcagccacaggactgagccct

SEQ ID NO: 5770255 - DNA, 20 bp, Homo sapiens
ggcagccaccagtggaccta

SEQ ID NO: 5770256 - DNA, 14 bp, Homo sapiens
ggcagccacccaag

SEQ ID NO: 5770257 - DNA, 15 bp, Homo sapiens
ggcagccaccctgcc

SEQ ID NO: 5770258 - DNA, 16 bp, Homo sapiens
ggcagccaccctgcca

SEQ ID NO: 5770259 - DNA, 14 bp, Homo sapiens
ggcagccacggccc

SEQ ID NO: 5770260 - DNA, 21 bp, Homo sapiens
ggcagccacggccccgggtcc

SEQ ID NO: 5770261 - DNA, 11 bp, Homo sapiens
ggcagccagac

SEQ ID NO: 5770262 - DNA, 13 bp, Homo sapiens
ggcagccagaccc

SEQ ID NO: 5770263 - DNA, 13 bp, Homo sapiens
ggcagccagcaga

SEQ ID NO: 5770264 - DNA, 16 bp, Homo sapiens
ggcagccagcatctgg

SEQ ID NO: 5770265 - DNA, 20 bp, Homo sapiens
ggcagccagcatctgggcct

SEQ ID NO: 5770266 - DNA, 15 bp, Homo sapiens
ggcagccagccctgg

SEQ ID NO: 5770267 - DNA, 13 bp, Homo sapiens
ggcagccaggcca

SEQ ID NO: 5770268 - DNA, 15 bp, Homo sapiens
ggcagccaggccaca

SEQ ID NO: 5770269 - DNA, 14 bp, Homo sapiens
ggcagccaggctgg

SEQ ID NO: 5770270 - DNA, 13 bp, Homo sapiens
ggcagccagggag

SEQ ID NO: 5770271 - DNA, 17 bp, Homo sapiens
ggcagccagggagcccg

SEQ ID NO: 5770272 - DNA, 13 bp, Homo sapiens
ggcagccagggct

SEQ ID NO: 5770273 - DNA, 22 bp, Homo sapiens
ggcagccagtgagatgagggat

SEQ ID NO: 5770274 - DNA, 22 bp, Homo sapiens
ggcagccagtgccctgagccag

SEQ ID NO: 5770275 - DNA, 15 bp, Homo sapiens
ggcagccatgataat

SEQ ID NO: 5770276 - DNA, 15 bp, Homo sapiens
ggcagccatgcctca

SEQ ID NO: 5770277 - DNA, 19 bp, Homo sapiens
ggcagccatgcctcatgcc

SEQ ID NO: 5770278 - DNA, 12 bp, Homo sapiens
ggcagcccagag

SEQ ID NO: 5770279 - DNA, 13 bp, Homo sapiens
ggcagcccagaga

SEQ ID NO: 5770280 - DNA, 22 bp, Homo sapiens
ggcagcccagagactttgtaga

SEQ ID NO: 5770281 - DNA, 14 bp, Homo sapiens
ggcagcccagagag

SEQ ID NO: 5770282 - DNA, 23 bp, Homo sapiens
ggcagcccagagagaccctgcca

SEQ ID NO: 5770283 - DNA, 13 bp, Homo sapiens
ggcagcccagcag

SEQ ID NO: 5770284 - DNA, 14 bp, Homo sapiens
ggcagcccagcagt

SEQ ID NO: 5770285 - DNA, 16 bp, Homo sapiens
ggcagcccagccagcg

SEQ ID NO: 5770286 - DNA, 13 bp, Homo sapiens
ggcagcccagcct

SEQ ID NO: 5770287 - DNA, 14 bp, Homo sapiens
ggcagcccagcctc

SEQ ID NO: 5770288 - DNA, 18 bp, Homo sapiens
ggcagcccagcctctgtc

SEQ ID NO: 5770289 - DNA, 19 bp, Homo sapiens
ggcagcccagcctctgtcc

SEQ ID NO: 5770290 - DNA, 22 bp, Homo sapiens
ggcagcccagctcctgaataaa

SEQ ID NO: 5770291 - DNA, 15 bp, Homo sapiens
ggcagccccacagtc

SEQ ID NO: 5770292 - DNA, 12 bp, Homo sapiens
ggcagccccaga

SEQ ID NO: 5770293 - DNA, 13 bp, Homo sapiens
ggcagccccagag

SEQ ID NO: 5770294 - DNA, 14 bp, Homo sapiens
ggcagccccagaga

SEQ ID NO: 5770295 - DNA, 23 bp, Homo sapiens
ggcagccccagcaccaccaggtc

SEQ ID NO: 5770296 - DNA, 13 bp, Homo sapiens
ggcagccccagcc

SEQ ID NO: 5770297 - DNA, 17 bp, Homo sapiens
ggcagccccagcctgct

SEQ ID NO: 5770298 - DNA, 23 bp, Homo sapiens
ggcagccccattctgcctgccca

SEQ ID NO: 5770299 - DNA, 13 bp, Homo sapiens
ggcagccccccag

SEQ ID NO: 5770300 - DNA, 18 bp, Homo sapiens
ggcagcccccccctcaag

SEQ ID NO: 5770301 - DNA, 12 bp, Homo sapiens
ggcagccccctc

SEQ ID NO: 5770302 - DNA, 16 bp, Homo sapiens
ggcagccccctccaca

SEQ ID NO: 5770303 - DNA, 22 bp, Homo sapiens
ggcagccccgcgaccacccctg

SEQ ID NO: 5770304 - DNA, 13 bp, Homo sapiens
ggcagcccctccc

SEQ ID NO: 5770305 - DNA, 15 bp, Homo sapiens
ggcagcccctgcaga

SEQ ID NO: 5770306 - DNA, 18 bp, Homo sapiens
ggcagcccctgctggacc

SEQ ID NO: 5770307 - DNA, 20 bp, Homo sapiens
ggcagccctcacctctgagg

SEQ ID NO: 5770308 - DNA, 11 bp, Homo sapiens
ggcagccctcc

SEQ ID NO: 5770309 - DNA, 13 bp, Homo sapiens
ggcagccctcctt

SEQ ID NO: 5770310 - DNA, 11 bp, Homo sapiens
ggcagccctga

SEQ ID NO: 5770311 - DNA, 13 bp, Homo sapiens
ggcagccctgagt

SEQ ID NO: 5770312 - DNA, 22 bp, Homo sapiens
ggcagccctgagtggtcactgg

SEQ ID NO: 5770313 - DNA, 13 bp, Homo sapiens
ggcagccctgtag

SEQ ID NO: 5770314 - DNA, 15 bp, Homo sapiens
ggcagccctgtaggg

SEQ ID NO: 5770315 - DNA, 12 bp, Homo sapiens
ggcagccgaggc

SEQ ID NO: 5770316 - DNA, 18 bp, Homo sapiens
ggcagccgaggcctggcc

SEQ ID NO: 5770317 - DNA, 20 bp, Homo sapiens
ggcagccgaggtccctgctg

SEQ ID NO: 5770318 - DNA, 17 bp, Homo sapiens
ggcagccgctaggagag

SEQ ID NO: 5770319 - DNA, 21 bp, Homo sapiens
ggcagccgctaggagagactg

SEQ ID NO: 5770320 - DNA, 16 bp, Homo sapiens
ggcagccgtcccaggc

SEQ ID NO: 5770321 - DNA, 19 bp, Homo sapiens
ggcagccgtcccaggccac

SEQ ID NO: 5770322 - DNA, 17 bp, Homo sapiens
ggcagcctcagaggccc

SEQ ID NO: 5770323 - DNA, 16 bp, Homo sapiens
ggcagcctcagggctt

SEQ ID NO: 5770324 - DNA, 19 bp, Homo sapiens
ggcaggagtcaccatgcaa

SEQ ID NO: 5770325 - DNA, 14 bp, Homo sapiens
ggcaggagtctctg

SEQ ID NO: 5770326 - DNA, 14 bp, Homo sapiens
ggcaggagtgccag

SEQ ID NO: 5770327 - DNA, 23 bp, Homo sapiens
ggcaggagtgccaggaccagcct

SEQ ID NO: 5770328 - DNA, 16 bp, Homo sapiens
ggcaggagtggcagct

SEQ ID NO: 5770329 - DNA, 13 bp, Homo sapiens
ggcaggagtgggg

SEQ ID NO: 5770330 - DNA, 19 bp, Homo sapiens
ggcaggagttgggggcagg

SEQ ID NO: 5770331 - DNA, 20 bp, Homo sapiens
ggcaggagttgggggcaggt

SEQ ID NO: 5770332 - DNA, 17 bp, Homo sapiens
ggcaggatctcaagcca

SEQ ID NO: 5770333 - DNA, 19 bp, Homo sapiens
ggcaggatctcaagccagc

SEQ ID NO: 5770334 - DNA, 16 bp, Homo sapiens
ggcaggatggcctttc

SEQ ID NO: 5770335 - DNA, 20 bp, Homo sapiens
ggcaggattctctgcagccc

SEQ ID NO: 5770336 - DNA, 20 bp, Homo sapiens
ggcaggattcttcccatgga

SEQ ID NO: 5770337 - DNA, 15 bp, Homo sapiens
ggcaggattggggaa

SEQ ID NO: 5770338 - DNA, 17 bp, Homo sapiens
ggcaggcacacagcagc

SEQ ID NO: 5770339 - DNA, 18 bp, Homo sapiens
ggcaggcacacagcagcc

SEQ ID NO: 5770340 - DNA, 19 bp, Homo sapiens
ggcaggcacacagcagccc

SEQ ID NO: 5770341 - DNA, 20 bp, Homo sapiens
ggcaggcacacagcagcccc

SEQ ID NO: 5770342 - DNA, 22 bp, Homo sapiens
ggcaggcacacagcagcccccc

SEQ ID NO: 5770343 - DNA, 16 bp, Homo sapiens
ggcaggcactgtggcc

SEQ ID NO: 5770344 - DNA, 18 bp, Homo sapiens
ggcaggcactgtggccct

SEQ ID NO: 5770345 - DNA, 12 bp, Homo sapiens
ggcaggcagaga

SEQ ID NO: 5770346 - DNA, 13 bp, Homo sapiens
ggcaggcagagaa

SEQ ID NO: 5770347 - DNA, 21 bp, Homo sapiens
ggcaggcagagctcagcacag

SEQ ID NO: 5770348 - DNA, 22 bp, Homo sapiens
ggcaggcagagctcagcacagc

SEQ ID NO: 5770349 - DNA, 15 bp, Homo sapiens
ggcaggcagcgccaa

SEQ ID NO: 5770350 - DNA, 22 bp, Homo sapiens
ggcaggcagctaggcagggagg

SEQ ID NO: 5770351 - DNA, 11 bp, Homo sapiens
ggcaggcaggg

SEQ ID NO: 5770352 - DNA, 19 bp, Homo sapiens
ggcaggcagggctctcctg

SEQ ID NO: 5770353 - DNA, 23 bp, Homo sapiens
ggcaggcatcggggagccgggag

SEQ ID NO: 5770354 - DNA, 18 bp, Homo sapiens
ggcaggcatggccctggg

SEQ ID NO: 5770355 - DNA, 20 bp, Homo sapiens
ggcaggcatggctggtgcct

SEQ ID NO: 5770356 - DNA, 20 bp, Homo sapiens
ggcaggcattcctgaaggga

SEQ ID NO: 5770357 - DNA, 22 bp, Homo sapiens
ggcaggcattcctgaagggaac

SEQ ID NO: 5770358 - DNA, 19 bp, Homo sapiens
ggcaggccacctggctctc

SEQ ID NO: 5770359 - DNA, 15 bp, Homo sapiens
ggcaggccagctgtg

SEQ ID NO: 5770360 - DNA, 21 bp, Homo sapiens
ggcaggccagcttcgtgctgg

SEQ ID NO: 5770361 - DNA, 11 bp, Homo sapiens
ggcaggcccac

SEQ ID NO: 5770362 - DNA, 12 bp, Homo sapiens
ggcaggcccact

SEQ ID NO: 5770363 - DNA, 18 bp, Homo sapiens
ggcaggcccactccccag

SEQ ID NO: 5770364 - DNA, 17 bp, Homo sapiens
ggcaggcccagcctctg

SEQ ID NO: 5770365 - DNA, 19 bp, Homo sapiens
ggcaggcccctttggacct

SEQ ID NO: 5770366 - DNA, 21 bp, Homo sapiens
ggcaggcccctttggacctgc

SEQ ID NO: 5770367 - DNA, 22 bp, Homo sapiens
ggcaggcccctttggacctgca

SEQ ID NO: 5770368 - DNA, 13 bp, Homo sapiens
ggcaggccctgca

SEQ ID NO: 5770369 - DNA, 15 bp, Homo sapiens
ggcaggccctgcact

SEQ ID NO: 5770370 - DNA, 22 bp, Homo sapiens
ggcaggccctgcactgtcctgc

SEQ ID NO: 5770371 - DNA, 14 bp, Homo sapiens
ggcaggccctgcag

SEQ ID NO: 5770372 - DNA, 15 bp, Homo sapiens
ggcaggccctgccca

SEQ ID NO: 5770373 - DNA, 21 bp, Homo sapiens
ggcaggccctgcccagccagc

SEQ ID NO: 5770374 - DNA, 16 bp, Homo sapiens
ggcaggcctaggacct

SEQ ID NO: 5770375 - DNA, 10 bp, Homo sapiens
ggcaggcctg

SEQ ID NO: 5770376 - DNA, 15 bp, Homo sapiens
ggcaggcctgaccca

SEQ ID NO: 5770377 - DNA, 15 bp, Homo sapiens
ggcaggcctgagaat

SEQ ID NO: 5770378 - DNA, 18 bp, Homo sapiens
ggcaggccttgctggggt

SEQ ID NO: 5770379 - DNA, 13 bp, Homo sapiens
ggcaggcctttcc

SEQ ID NO: 5770380 - DNA, 20 bp, Homo sapiens
ggcaggcctttttgagccaa

SEQ ID NO: 5770381 - DNA, 17 bp, Homo sapiens
ggcaggcgatccccgct

SEQ ID NO: 5770382 - DNA, 22 bp, Homo sapiens
ggcaggcgcagaggtcccagcc

SEQ ID NO: 5770383 - DNA, 22 bp, Homo sapiens
ggcaggcgtgactcagcagcct

SEQ ID NO: 5770384 - DNA, 18 bp, Homo sapiens
ggcaggctagaacctggc

SEQ ID NO: 5770385 - DNA, 14 bp, Homo sapiens
ggcaggctccccct

SEQ ID NO: 5770386 - DNA, 15 bp, Homo sapiens
ggcaggctctctcct

SEQ ID NO: 5770387 - DNA, 17 bp, Homo sapiens
ggcaggctctctcctct

SEQ ID NO: 5770388 - DNA, 12 bp, Homo sapiens
ggcaggctgagg

SEQ ID NO: 5770389 - DNA, 16 bp, Homo sapiens
ggcaggctgaggtggg

SEQ ID NO: 5770390 - DNA, 12 bp, Homo sapiens
ggcaggctggcc

SEQ ID NO: 5770391 - DNA, 13 bp, Homo sapiens
ggcaggctggcca

SEQ ID NO: 5770392 - DNA, 20 bp, Homo sapiens
ggcaggctggccagtccagg

SEQ ID NO: 5770393 - DNA, 12 bp, Homo sapiens
ggcaggctgggc

SEQ ID NO: 5770394 - DNA, 13 bp, Homo sapiens
ggcaggctgggcc

SEQ ID NO: 5770395 - DNA, 16 bp, Homo sapiens
ggcaggcttggggaaa

SEQ ID NO: 5770396 - DNA, 19 bp, Homo sapiens
ggcagggaaaacacagatg

SEQ ID NO: 5770397 - DNA, 23 bp, Homo sapiens
ggcagggaaatgtatgtgtgtct

SEQ ID NO: 5770398 - DNA, 17 bp, Homo sapiens
ggcagggaaggacagga

SEQ ID NO: 5770399 - DNA, 21 bp, Homo sapiens
ggcagggaaggacaggaccct

SEQ ID NO: 5770400 - DNA, 23 bp, Homo sapiens
ggcagggaagggtgcctggctgg

SEQ ID NO: 5770401 - DNA, 14 bp, Homo sapiens
ggcagggacaagtc

SEQ ID NO: 5770402 - DNA, 20 bp, Homo sapiens
ggcagggacctaaagggact

SEQ ID NO: 5770403 - DNA, 14 bp, Homo sapiens
ggcagggagagcgc

SEQ ID NO: 5770404 - DNA, 17 bp, Homo sapiens
ggcagggagctgggccc

SEQ ID NO: 5770405 - DNA, 10 bp, Homo sapiens
ggcagggagg

SEQ ID NO: 5770406 - DNA, 15 bp, Homo sapiens
ggcagggaggcacca

SEQ ID NO: 5770407 - DNA, 18 bp, Homo sapiens
ggcagggagggcttgggg

SEQ ID NO: 5770408 - DNA, 13 bp, Homo sapiens
ggcagggagggga

SEQ ID NO: 5770409 - DNA, 15 bp, Homo sapiens
ggcagggaggggctg

SEQ ID NO: 5770410 - DNA, 16 bp, Homo sapiens
ggcagggaggggctgg

SEQ ID NO: 5770411 - DNA, 22 bp, Homo sapiens
ggcagggaggggctggggcagg

SEQ ID NO: 5770412 - DNA, 15 bp, Homo sapiens
ggcagggagggggct

SEQ ID NO: 5770413 - DNA, 17 bp, Homo sapiens
ggcagggaggtcaggcc

SEQ ID NO: 5770414 - DNA, 19 bp, Homo sapiens
ggcagggaggtcaggccct

SEQ ID NO: 5770415 - DNA, 22 bp, Homo sapiens
ggcagggatgatggcagagcca

SEQ ID NO: 5770416 - DNA, 14 bp, Homo sapiens
ggcagggatggggg

SEQ ID NO: 5770417 - DNA, 22 bp, Homo sapiens
ggcagggatgggggtggctggg

SEQ ID NO: 5770418 - DNA, 23 bp, Homo sapiens
ggcagggcaaatgacatgcactg

SEQ ID NO: 5770419 - DNA, 16 bp, Homo sapiens
ggcagggcacagggcc

SEQ ID NO: 5770420 - DNA, 17 bp, Homo sapiens
ggcagggcacagggcct

SEQ ID NO: 5770421 - DNA, 19 bp, Homo sapiens
ggcagggcacagggcctgg

SEQ ID NO: 5770422 - DNA, 14 bp, Homo sapiens
ggcagggcagaggg

SEQ ID NO: 5770423 - DNA, 16 bp, Homo sapiens
ggcagggcaggaccag

SEQ ID NO: 5770424 - DNA, 15 bp, Homo sapiens
ggcagggcaggcaga

SEQ ID NO: 5770425 - DNA, 18 bp, Homo sapiens
ggcagggccaacccttct

SEQ ID NO: 5770426 - DNA, 24 bp, Homo sapiens
ggcagggccactcaacagagagga

SEQ ID NO: 5770427 - DNA, 15 bp, Homo sapiens
ggcagggccaggcct

SEQ ID NO: 5770428 - DNA, 17 bp, Homo sapiens
ggcagggccaggcctct

SEQ ID NO: 5770429 - DNA, 18 bp, Homo sapiens
ggcagggccaggctggtc

SEQ ID NO: 5770430 - DNA, 14 bp, Homo sapiens
ggcagggccagggc

SEQ ID NO: 5770431 - DNA, 16 bp, Homo sapiens
ggcagggccagggcaa

SEQ ID NO: 5770432 - DNA, 18 bp, Homo sapiens
ggcagggccagggcaatg

SEQ ID NO: 5770433 - DNA, 19 bp, Homo sapiens
ggcagggccagggcaatgc

SEQ ID NO: 5770434 - DNA, 14 bp, Homo sapiens
ggcagggcccagca

SEQ ID NO: 5770435 - DNA, 15 bp, Homo sapiens
ggcagggcccccaat

SEQ ID NO: 5770436 - DNA, 17 bp, Homo sapiens
ggcagggcccccaataa

SEQ ID NO: 5770437 - DNA, 23 bp, Homo sapiens
ggcagggcccccaataaaccagt

SEQ ID NO: 5770438 - DNA, 15 bp, Homo sapiens
ggcagggccctgaaa

SEQ ID NO: 5770439 - DNA, 20 bp, Homo sapiens
ggcagggccctgtggctcca

SEQ ID NO: 5770440 - DNA, 22 bp, Homo sapiens
ggcagggccgcccgggcccaga

SEQ ID NO: 5770441 - DNA, 12 bp, Homo sapiens
ggcagggcctgg

SEQ ID NO: 5770442 - DNA, 13 bp, Homo sapiens
ggcagggcctggc

SEQ ID NO: 5770443 - DNA, 15 bp, Homo sapiens
ggcagggcctggcct

SEQ ID NO: 5770444 - DNA, 14 bp, Homo sapiens
ggcagggcctggcg

SEQ ID NO: 5770445 - DNA, 14 bp, Homo sapiens
ggcagggcctggct

SEQ ID NO: 5770446 - DNA, 21 bp, Homo sapiens
ggcagggcctgggcctcatgg

SEQ ID NO: 5770447 - DNA, 16 bp, Homo sapiens
ggcagggccttgccca

SEQ ID NO: 5770448 - DNA, 22 bp, Homo sapiens
ggcagggcggctaggccggcca

SEQ ID NO: 5770449 - DNA, 22 bp, Homo sapiens
ggcagggcgggcagagggctgg

SEQ ID NO: 5770450 - DNA, 23 bp, Homo sapiens
ggcagggcgggcagagggctgga

SEQ ID NO: 5770451 - DNA, 15 bp, Homo sapiens
ggcagggcggggggg

SEQ ID NO: 5770452 - DNA, 11 bp, Homo sapiens
ggcagggctca

SEQ ID NO: 5770453 - DNA, 13 bp, Homo sapiens
ggcagggctcaca

SEQ ID NO: 5770454 - DNA, 14 bp, Homo sapiens
ggcagggctcacac

SEQ ID NO: 5770455 - DNA, 16 bp, Homo sapiens
ggcagggctcacactc

SEQ ID NO: 5770456 - DNA, 21 bp, Homo sapiens
ggcagggctcccacagagaca

SEQ ID NO: 5770457 - DNA, 12 bp, Homo sapiens
ggcagggctcct

SEQ ID NO: 5770458 - DNA, 19 bp, Homo sapiens
ggcagggctcctccctgga

SEQ ID NO: 5770459 - DNA, 20 bp, Homo sapiens
ggcagggctcctccctggag

SEQ ID NO: 5770460 - DNA, 21 bp, Homo sapiens
ggcagggctcctccctggagc

SEQ ID NO: 5770461 - DNA, 12 bp, Homo sapiens
ggcagggctctc

SEQ ID NO: 5770462 - DNA, 13 bp, Homo sapiens
ggcagggctctcc

SEQ ID NO: 5770463 - DNA, 17 bp, Homo sapiens
ggcagggctctcctggc

SEQ ID NO: 5770464 - DNA, 18 bp, Homo sapiens
ggcagggctctcctggct

SEQ ID NO: 5770465 - DNA, 14 bp, Homo sapiens
ggcagggctctgat

SEQ ID NO: 5770466 - DNA, 15 bp, Homo sapiens
ggcagggctgaggcc

SEQ ID NO: 5770467 - DNA, 21 bp, Homo sapiens
ggcagggctggccccagggca

SEQ ID NO: 5770468 - DNA, 16 bp, Homo sapiens
ggcagggctgggccag

SEQ ID NO: 5770469 - DNA, 15 bp, Homo sapiens
ggcagggctgggcct

SEQ ID NO: 5770470 - DNA, 16 bp, Homo sapiens
ggcagggctgtgcttg

SEQ ID NO: 5770471 - DNA, 18 bp, Homo sapiens
ggcaggggagacaggagc

SEQ ID NO: 5770472 - DNA, 19 bp, Homo sapiens
ggcaggggagacaggagcc

SEQ ID NO: 5770473 - DNA, 22 bp, Homo sapiens
ggcaggggagacaggagcctag

SEQ ID NO: 5770474 - DNA, 13 bp, Homo sapiens
ggcaggggagcag

SEQ ID NO: 5770475 - DNA, 14 bp, Homo sapiens
ggcaggggagccag

SEQ ID NO: 5770476 - DNA, 15 bp, Homo sapiens
ggcaggggagccagg

SEQ ID NO: 5770477 - DNA, 17 bp, Homo sapiens
ggcaggggagccagggt

SEQ ID NO: 5770478 - DNA, 16 bp, Homo sapiens
ggcaggggaggccatc

SEQ ID NO: 5770479 - DNA, 19 bp, Homo sapiens
ggcaggggaggccatctgg

SEQ ID NO: 5770480 - DNA, 20 bp, Homo sapiens
ggcaggggagggtcagccag

SEQ ID NO: 5770481 - DNA, 13 bp, Homo sapiens
ggcaggggcagtg

SEQ ID NO: 5770482 - DNA, 15 bp, Homo sapiens
ggcaggggcatctgt

SEQ ID NO: 5770483 - DNA, 19 bp, Homo sapiens
ggcaggggcccacttgggg

SEQ ID NO: 5770484 - DNA, 22 bp, Homo sapiens
ggcaggggcccacttggggcct

SEQ ID NO: 5770485 - DNA, 14 bp, Homo sapiens
ggcaggggcccctc

SEQ ID NO: 5770486 - DNA, 19 bp, Homo sapiens
ggcaggggcccctcctctg

SEQ ID NO: 5770487 - DNA, 19 bp, Homo sapiens
ggcaggggccctgcagctc

SEQ ID NO: 5770488 - DNA, 18 bp, Homo sapiens
ggcaggggcctgggccgg

SEQ ID NO: 5770489 - DNA, 15 bp, Homo sapiens
ggcaggggccttgtc

SEQ ID NO: 5770490 - DNA, 12 bp, Homo sapiens
ggcaggggcgga

SEQ ID NO: 5770491 - DNA, 15 bp, Homo sapiens
ggcaggggctctgct

SEQ ID NO: 5770492 - DNA, 17 bp, Homo sapiens
ggcaggggctgctgcct

SEQ ID NO: 5770493 - DNA, 18 bp, Homo sapiens
ggcaggggctgggcagag

SEQ ID NO: 5770494 - DNA, 19 bp, Homo sapiens
ggcaggggcttggctgccc

SEQ ID NO: 5770495 - DNA, 20 bp, Homo sapiens
ggcaggggcttggctgcccc

SEQ ID NO: 5770496 - DNA, 16 bp, Homo sapiens
ggcagggggctgctgc

SEQ ID NO: 5770497 - DNA, 22 bp, Homo sapiens
ggcaggggtcctgcaggtcctg

SEQ ID NO: 5770498 - DNA, 14 bp, Homo sapiens
ggcaggggtgagag

SEQ ID NO: 5770499 - DNA, 20 bp, Homo sapiens
ggcaggggtgagagcaccca

SEQ ID NO: 5770500 - DNA, 22 bp, Homo sapiens
ggcaggggtgagagcacccact

SEQ ID NO: 5770501 - DNA, 15 bp, Homo sapiens
ggcaggggtgctgtg

SEQ ID NO: 5770502 - DNA, 20 bp, Homo sapiens
ggcaggggtgcttcctcctc

SEQ ID NO: 5770503 - DNA, 23 bp, Homo sapiens
ggcatatatgtactagtggcatg

SEQ ID NO: 5770504 - DNA, 20 bp, Homo sapiens
ggcatatattaaaagcaggc

SEQ ID NO: 5770505 - DNA, 23 bp, Homo sapiens
ggcatatccattgtggaaactgg

SEQ ID NO: 5770506 - DNA, 21 bp, Homo sapiens
ggcatatggtcctagacaaac

SEQ ID NO: 5770507 - DNA, 23 bp, Homo sapiens
ggcatatgtttccccatctctgt

SEQ ID NO: 5770508 - DNA, 17 bp, Homo sapiens
ggcatatgtttctgcta

SEQ ID NO: 5770509 - DNA, 22 bp, Homo sapiens
ggcatatttaacaaaatttgaa

SEQ ID NO: 5770510 - DNA, 11 bp, Homo sapiens
ggcatatttat

SEQ ID NO: 5770511 - DNA, 13 bp, Homo sapiens
ggcatcaaagatg

SEQ ID NO: 5770512 - DNA, 16 bp, Homo sapiens
ggcatcaaagatgaga

SEQ ID NO: 5770513 - DNA, 14 bp, Homo sapiens
ggcatcaaccacca

SEQ ID NO: 5770514 - DNA, 18 bp, Homo sapiens
ggcatcacagaccccagc

SEQ ID NO: 5770515 - DNA, 22 bp, Homo sapiens
ggcatcacagaccccagctggg

SEQ ID NO: 5770516 - DNA, 16 bp, Homo sapiens
ggcatcacagggcaga

SEQ ID NO: 5770517 - DNA, 22 bp, Homo sapiens
ggcatcacagggcagagccggg

SEQ ID NO: 5770518 - DNA, 23 bp, Homo sapiens
ggcatcacagggcagagccggga

SEQ ID NO: 5770519 - DNA, 13 bp, Homo sapiens
ggcatcagcagca

SEQ ID NO: 5770520 - DNA, 20 bp, Homo sapiens
ggcatcagctttccctggct

SEQ ID NO: 5770521 - DNA, 19 bp, Homo sapiens
ggcatcaggagctgctcag

SEQ ID NO: 5770522 - DNA, 17 bp, Homo sapiens
ggcatcatcaataaaac

SEQ ID NO: 5770523 - DNA, 17 bp, Homo sapiens
ggcatcatctcagctca

SEQ ID NO: 5770524 - DNA, 12 bp, Homo sapiens
ggcatcattcca

SEQ ID NO: 5770525 - DNA, 17 bp, Homo sapiens
ggcatcatttcccctcc

SEQ ID NO: 5770526 - DNA, 18 bp, Homo sapiens
ggcatccacccagtgctg

SEQ ID NO: 5770527 - DNA, 15 bp, Homo sapiens
ggcatccaccttcct

SEQ ID NO: 5770528 - DNA, 19 bp, Homo sapiens
ggcatccaccttcctgccc

SEQ ID NO: 5770529 - DNA, 21 bp, Homo sapiens
ggcatccaccttcctgcccag

SEQ ID NO: 5770530 - DNA, 22 bp, Homo sapiens
ggcatccaccttcctgcccagg

SEQ ID NO: 5770531 - DNA, 20 bp, Homo sapiens
ggcatccacgtagggggcag

SEQ ID NO: 5770532 - DNA, 23 bp, Homo sapiens
ggcatccacgtagggggcagggg

SEQ ID NO: 5770533 - DNA, 22 bp, Homo sapiens
ggcatccagagtccctgcctgg

SEQ ID NO: 5770534 - DNA, 13 bp, Homo sapiens
ggcatccatgggg

SEQ ID NO: 5770535 - DNA, 17 bp, Homo sapiens
ggcatcccaagacctca

SEQ ID NO: 5770536 - DNA, 17 bp, Homo sapiens
ggcatcccagcctgggg

SEQ ID NO: 5770537 - DNA, 13 bp, Homo sapiens
ggcatcccagctt

SEQ ID NO: 5770538 - DNA, 14 bp, Homo sapiens
ggcatcccatccct

SEQ ID NO: 5770539 - DNA, 24 bp, Homo sapiens
ggcatcccatgggggtgctgcagc

SEQ ID NO: 5770540 - DNA, 18 bp, Homo sapiens
ggcatccccagccccctg

SEQ ID NO: 5770541 - DNA, 19 bp, Homo sapiens
ggcatccccagccccctgg

SEQ ID NO: 5770542 - DNA, 21 bp, Homo sapiens
ggcatccccagccccctggcc

SEQ ID NO: 5770543 - DNA, 23 bp, Homo sapiens
ggcatccctgtgttaactcagga

SEQ ID NO: 5770544 - DNA, 17 bp, Homo sapiens
ggcatccgagcccctgt

SEQ ID NO: 5770545 - DNA, 14 bp, Homo sapiens
ggcatcctccagcc

SEQ ID NO: 5770546 - DNA, 16 bp, Homo sapiens
ggcatcctccagcccc

SEQ ID NO: 5770547 - DNA, 14 bp, Homo sapiens
ggcatcctccggag

SEQ ID NO: 5770548 - DNA, 21 bp, Homo sapiens
ggcatcctctgactccactca

SEQ ID NO: 5770549 - DNA, 21 bp, Homo sapiens
ggcatcctgaaagccagcaaa

SEQ ID NO: 5770550 - DNA, 12 bp, Homo sapiens
ggcatcctgcct

SEQ ID NO: 5770551 - DNA, 14 bp, Homo sapiens
ggcatcctgcctgg

SEQ ID NO: 5770552 - DNA, 15 bp, Homo sapiens
ggcatcctgcctggg

SEQ ID NO: 5770553 - DNA, 12 bp, Homo sapiens
ggcatcctgctt

SEQ ID NO: 5770554 - DNA, 16 bp, Homo sapiens
ggcatcctgcttcctg

SEQ ID NO: 5770555 - DNA, 20 bp, Homo sapiens
ggcatcctggcattctcaaa

SEQ ID NO: 5770556 - DNA, 13 bp, Homo sapiens
ggcatcctgtgaa

SEQ ID NO: 5770557 - DNA, 17 bp, Homo sapiens
ggcatccttgcctgtct

SEQ ID NO: 5770558 - DNA, 22 bp, Homo sapiens
ggcatccttgcctgtctaaagc

SEQ ID NO: 5770559 - DNA, 21 bp, Homo sapiens
ggcatcgaccacaccagcctc

SEQ ID NO: 5770560 - DNA, 22 bp, Homo sapiens
ggcatcgcatccgtcctgggcg

SEQ ID NO: 5770561 - DNA, 22 bp, Homo sapiens
ggcatcggggagccgggagcct

SEQ ID NO: 5770562 - DNA, 22 bp, Homo sapiens
ggcatcgtagaagagatgtggc

SEQ ID NO: 5770563 - DNA, 13 bp, Homo sapiens
ggcatctaagaca

SEQ ID NO: 5770564 - DNA, 16 bp, Homo sapiens
ggcatctacacagcct

SEQ ID NO: 5770565 - DNA, 17 bp, Homo sapiens
ggcatctacacagcctg

SEQ ID NO: 5770566 - DNA, 18 bp, Homo sapiens
ggcatctacacagcctgg

SEQ ID NO: 5770567 - DNA, 15 bp, Homo sapiens
ggcatctagccagag

SEQ ID NO: 5770568 - DNA, 20 bp, Homo sapiens
ggcatctagccagaggctgg

SEQ ID NO: 5770569 - DNA, 18 bp, Homo sapiens
ggcatctatctgtgctag

SEQ ID NO: 5770570 - DNA, 20 bp, Homo sapiens
ggcatctcaatggcatgggt

SEQ ID NO: 5770571 - DNA, 16 bp, Homo sapiens
ggcatctccatgtaga

SEQ ID NO: 5770572 - DNA, 13 bp, Homo sapiens
ggcatctccccca

SEQ ID NO: 5770573 - DNA, 19 bp, Homo sapiens
ggcatctccctgaccttct

SEQ ID NO: 5770574 - DNA, 17 bp, Homo sapiens
ggcatctcctgtgcatg

SEQ ID NO: 5770575 - DNA, 21 bp, Homo sapiens
ggcatctcctgtgcatgggtg

SEQ ID NO: 5770576 - DNA, 22 bp, Homo sapiens
ggcatctcgtgccagggcaggc

SEQ ID NO: 5770577 - DNA, 15 bp, Homo sapiens
ggcatctctaattgg

SEQ ID NO: 5770578 - DNA, 18 bp, Homo sapiens
ggcatctctaattggaag

SEQ ID NO: 5770579 - DNA, 16 bp, Homo sapiens
ggcatctctctgggat

SEQ ID NO: 5770580 - DNA, 22 bp, Homo sapiens
ggcatctctgagtgtctctgcc

SEQ ID NO: 5770581 - DNA, 23 bp, Homo sapiens
ggcatctctgagtgtctctgcct

SEQ ID NO: 5770582 - DNA, 13 bp, Homo sapiens
ggcatctctgggc

SEQ ID NO: 5770583 - DNA, 17 bp, Homo sapiens
ggcatctctgggctgga

SEQ ID NO: 5770584 - DNA, 23 bp, Homo sapiens
ggcatctctgtcccattccctgg

SEQ ID NO: 5770585 - DNA, 17 bp, Homo sapiens
ggcatctcttccccaga

SEQ ID NO: 5770586 - DNA, 16 bp, Homo sapiens
ggcatctgacacaaaa

SEQ ID NO: 5770587 - DNA, 14 bp, Homo sapiens
ggcatctgcaaagg

SEQ ID NO: 5770588 - DNA, 14 bp, Homo sapiens
ggcatctggccctg

SEQ ID NO: 5770589 - DNA, 17 bp, Homo sapiens
ggcatctggccctgctg

SEQ ID NO: 5770590 - DNA, 18 bp, Homo sapiens
ggcatctggccctgctgc

SEQ ID NO: 5770591 - DNA, 21 bp, Homo sapiens
ggcatctggccctgctgcccc

SEQ ID NO: 5770592 - DNA, 22 bp, Homo sapiens
ggcatctgtctgtctgtgggct

SEQ ID NO: 5770593 - DNA, 21 bp, Homo sapiens
ggcatctgttagcagagtctg

SEQ ID NO: 5770594 - DNA, 12 bp, Homo sapiens
ggcatcttctgg

SEQ ID NO: 5770595 - DNA, 15 bp, Homo sapiens
ggcatcttggaaaag

SEQ ID NO: 5770596 - DNA, 16 bp, Homo sapiens
ggcatcttggaaaagg

SEQ ID NO: 5770597 - DNA, 21 bp, Homo sapiens
ggcatctttgccttgggctgc

SEQ ID NO: 5770598 - DNA, 23 bp, Homo sapiens
ggcatctttgccttgggctgctc

SEQ ID NO: 5770599 - DNA, 13 bp, Homo sapiens
ggcatctttgggg

SEQ ID NO: 5770600 - DNA, 21 bp, Homo sapiens
ggcatcttttctagagacaca

SEQ ID NO: 5770601 - DNA, 14 bp, Homo sapiens
ggcatcttttggag

SEQ ID NO: 5770602 - DNA, 17 bp, Homo sapiens
ggcatcttttgtattaa

SEQ ID NO: 5770603 - DNA, 12 bp, Homo sapiens
ggcatgaaagtg

SEQ ID NO: 5770604 - DNA, 14 bp, Homo sapiens
ggcatgaacatgta

SEQ ID NO: 5770605 - DNA, 18 bp, Homo sapiens
ggcatgaacatgtactgt

SEQ ID NO: 5770606 - DNA, 17 bp, Homo sapiens
ggcatgaaccctcttgc

SEQ ID NO: 5770607 - DNA, 22 bp, Homo sapiens
ggcatgaaccctcttgccatcc

SEQ ID NO: 5770608 - DNA, 15 bp, Homo sapiens
ggcatgaacgcactt

SEQ ID NO: 5770609 - DNA, 20 bp, Homo sapiens
ggcatgaagagcaaaaatat

SEQ ID NO: 5770610 - DNA, 18 bp, Homo sapiens
ggcatgaatcgggctaag

SEQ ID NO: 5770611 - DNA, 14 bp, Homo sapiens
ggcatgacaaggtg

SEQ ID NO: 5770612 - DNA, 22 bp, Homo sapiens
ggcatgacaaggtgtgcagtgg

SEQ ID NO: 5770613 - DNA, 13 bp, Homo sapiens
ggcatgaccagat

SEQ ID NO: 5770614 - DNA, 19 bp, Homo sapiens
ggcatgacccagtgaagat

SEQ ID NO: 5770615 - DNA, 21 bp, Homo sapiens
ggcatgaccctggagcccggc

SEQ ID NO: 5770616 - DNA, 13 bp, Homo sapiens
ggcatgagaaaga

SEQ ID NO: 5770617 - DNA, 21 bp, Homo sapiens
ggcatgagactcagtgcagat

SEQ ID NO: 5770618 - DNA, 12 bp, Homo sapiens
ggcatgagatag

SEQ ID NO: 5770619 - DNA, 14 bp, Homo sapiens
ggcatgagccactg

SEQ ID NO: 5770620 - DNA, 22 bp, Homo sapiens
ggcatgagccactgagcctggc

SEQ ID NO: 5770621 - DNA, 15 bp, Homo sapiens
ggcatgagccactgc

SEQ ID NO: 5770622 - DNA, 16 bp, Homo sapiens
ggcatgagccactgca

SEQ ID NO: 5770623 - DNA, 21 bp, Homo sapiens
ggcatgaggccccgaggctcg

SEQ ID NO: 5770624 - DNA, 19 bp, Homo sapiens
ggcatgagggatcacaggg

SEQ ID NO: 5770625 - DNA, 13 bp, Homo sapiens
ggcatgagtctgt

SEQ ID NO: 5770626 - DNA, 22 bp, Homo sapiens
ggcatgataagccgaggaggca

SEQ ID NO: 5770627 - DNA, 15 bp, Homo sapiens
ggcatgatccaagca

SEQ ID NO: 5770628 - DNA, 16 bp, Homo sapiens
ggcatgatccaagcaa

SEQ ID NO: 5770629 - DNA, 21 bp, Homo sapiens
ggcatgatctgatccccaaga

SEQ ID NO: 5770630 - DNA, 22 bp, Homo sapiens
ggcatgatgggccgagccacct

SEQ ID NO: 5770631 - DNA, 17 bp, Homo sapiens
ggcatgatttatatatg

SEQ ID NO: 5770632 - DNA, 19 bp, Homo sapiens
ggcatgcacacggctggtc

SEQ ID NO: 5770633 - DNA, 22 bp, Homo sapiens
ggcatgcaccagtgccgcctgt

SEQ ID NO: 5770634 - DNA, 18 bp, Homo sapiens
ggcatgcacgggcatgca

SEQ ID NO: 5770635 - DNA, 21 bp, Homo sapiens
ggcatgcacgggcatgcacac

SEQ ID NO: 5770636 - DNA, 13 bp, Homo sapiens
ggcatgcagctgc

SEQ ID NO: 5770637 - DNA, 15 bp, Homo sapiens
ggcatgcagctgcct

SEQ ID NO: 5770638 - DNA, 16 bp, Homo sapiens
ggcatgcagctgcctg

SEQ ID NO: 5770639 - DNA, 23 bp, Homo sapiens
ggcatgcagctgcctggggccca

SEQ ID NO: 5770640 - DNA, 22 bp, Homo sapiens
ggcatgcatggaggactctcct

SEQ ID NO: 5770641 - DNA, 24 bp, Homo sapiens
ggcatgccaccctcacacacacag

SEQ ID NO: 5770642 - DNA, 15 bp, Homo sapiens
ggcatgccaggaccc

SEQ ID NO: 5770643 - DNA, 18 bp, Homo sapiens
ggcatgccgagtgcccca

SEQ ID NO: 5770644 - DNA, 23 bp, Homo sapiens
ggcatgcctctgatatgggactg

SEQ ID NO: 5770645 - DNA, 13 bp, Homo sapiens
ggcatgccttgtg

SEQ ID NO: 5770646 - DNA, 17 bp, Homo sapiens
ggcatgcgaatgagctg

SEQ ID NO: 5770647 - DNA, 23 bp, Homo sapiens
ggcatgcgaatgagctgggccct

SEQ ID NO: 5770648 - DNA, 16 bp, Homo sapiens
ggcatgcggtcgggca

SEQ ID NO: 5770649 - DNA, 15 bp, Homo sapiens
ggcatgctcccagca

SEQ ID NO: 5770650 - DNA, 12 bp, Homo sapiens
ggcatgctgaat

SEQ ID NO: 5770651 - DNA, 10 bp, Homo sapiens
ggcatgctgg

SEQ ID NO: 5770652 - DNA, 13 bp, Homo sapiens
ggcatgctggagt

SEQ ID NO: 5770653 - DNA, 12 bp, Homo sapiens
ggcatgctggcc

SEQ ID NO: 5770654 - DNA, 14 bp, Homo sapiens
ggcatgctggcctg

SEQ ID NO: 5770655 - DNA, 21 bp, Homo sapiens
ggcatgctggcctgtggcagg

SEQ ID NO: 5770656 - DNA, 22 bp, Homo sapiens
ggcatgctggctcccagggcca

SEQ ID NO: 5770657 - DNA, 16 bp, Homo sapiens
ggcatgctggggcaag

SEQ ID NO: 5770658 - DNA, 14 bp, Homo sapiens
ggcatggaaagatg

SEQ ID NO: 5770659 - DNA, 18 bp, Homo sapiens
ggcatggaagagggaggg

SEQ ID NO: 5770660 - DNA, 14 bp, Homo sapiens
ggcatggagactct

SEQ ID NO: 5770661 - DNA, 18 bp, Homo sapiens
ggcatggcaaatcagggg

SEQ ID NO: 5770662 - DNA, 19 bp, Homo sapiens
ggcatggcaaatcaggggc

SEQ ID NO: 5770663 - DNA, 23 bp, Homo sapiens
ggcatggcaaatcaggggccaga

SEQ ID NO: 5770664 - DNA, 13 bp, Homo sapiens
ggcatggcagccc

SEQ ID NO: 5770665 - DNA, 18 bp, Homo sapiens
ggcatggcccagcctgga

SEQ ID NO: 5770666 - DNA, 20 bp, Homo sapiens
ggcatggcccagcctggagc

SEQ ID NO: 5770667 - DNA, 17 bp, Homo sapiens
ggcatggccgcttctag

SEQ ID NO: 5770668 - DNA, 17 bp, Homo sapiens
ggcatggcgaggctgag

SEQ ID NO: 5770669 - DNA, 16 bp, Homo sapiens
ggcatggctccagtct

SEQ ID NO: 5770670 - DNA, 18 bp, Homo sapiens
ggcatgggaaggtgggcg

SEQ ID NO: 5770671 - DNA, 12 bp, Homo sapiens
ggcatgggcctc

SEQ ID NO: 5770672 - DNA, 17 bp, Homo sapiens
ggcatgggcctctctgg

SEQ ID NO: 5770673 - DNA, 18 bp, Homo sapiens
ggcatgggcgcaggccca

SEQ ID NO: 5770674 - DNA, 19 bp, Homo sapiens
ggcatgggcgcaggcccag

SEQ ID NO: 5770675 - DNA, 20 bp, Homo sapiens
ggcatgggcgcaggcccagt

SEQ ID NO: 5770676 - DNA, 16 bp, Homo sapiens
ggcatggggaggggag

SEQ ID NO: 5770677 - DNA, 15 bp, Homo sapiens
ggcatgggggcccaa

SEQ ID NO: 5770678 - DNA, 19 bp, Homo sapiens
ggcatgggggcccaaaggg

SEQ ID NO: 5770679 - DNA, 23 bp, Homo sapiens
ggcatgggggcctcagggcagcc

SEQ ID NO: 5770680 - DNA, 15 bp, Homo sapiens
ggccaaggacagggt

SEQ ID NO: 5770681 - DNA, 19 bp, Homo sapiens
ggccaaggacccaggcgct

SEQ ID NO: 5770682 - DNA, 20 bp, Homo sapiens
ggccaaggacccaggcgctg

SEQ ID NO: 5770683 - DNA, 15 bp, Homo sapiens
ggccaaggacctgag

SEQ ID NO: 5770684 - DNA, 13 bp, Homo sapiens
ggccaaggactcc

SEQ ID NO: 5770685 - DNA, 12 bp, Homo sapiens
ggccaaggactg

SEQ ID NO: 5770686 - DNA, 13 bp, Homo sapiens
ggccaaggactga

SEQ ID NO: 5770687 - DNA, 17 bp, Homo sapiens
ggccaaggactgccgac

SEQ ID NO: 5770688 - DNA, 13 bp, Homo sapiens
ggccaaggcaggt

SEQ ID NO: 5770689 - DNA, 15 bp, Homo sapiens
ggccaaggcaggtag

SEQ ID NO: 5770690 - DNA, 12 bp, Homo sapiens
ggccaaggcctc

SEQ ID NO: 5770691 - DNA, 17 bp, Homo sapiens
ggccaaggcctcaggag

SEQ ID NO: 5770692 - DNA, 16 bp, Homo sapiens
ggccaaggccttctcc

SEQ ID NO: 5770693 - DNA, 22 bp, Homo sapiens
ggccaaggctatgaagggacag

SEQ ID NO: 5770694 - DNA, 16 bp, Homo sapiens
ggccaaggctctctct

SEQ ID NO: 5770695 - DNA, 23 bp, Homo sapiens
ggccaaggggtgggcctgtgaat

SEQ ID NO: 5770696 - DNA, 15 bp, Homo sapiens
ggccaaggtcctgct

SEQ ID NO: 5770697 - DNA, 12 bp, Homo sapiens
ggccaaggtgcc

SEQ ID NO: 5770698 - DNA, 15 bp, Homo sapiens
ggccaaggtgtccta

SEQ ID NO: 5770699 - DNA, 19 bp, Homo sapiens
ggccaaggtgtcctacaga

SEQ ID NO: 5770700 - DNA, 17 bp, Homo sapiens
ggccaaggtttcccagt

SEQ ID NO: 5770701 - DNA, 16 bp, Homo sapiens
ggccaagtccactgtc

SEQ ID NO: 5770702 - DNA, 17 bp, Homo sapiens
ggccaagtccactgtcc

SEQ ID NO: 5770703 - DNA, 18 bp, Homo sapiens
ggccaagtgcaggctggc

SEQ ID NO: 5770704 - DNA, 20 bp, Homo sapiens
ggccaagtgcaggctggcac

SEQ ID NO: 5770705 - DNA, 14 bp, Homo sapiens
ggccaataaaaagt

SEQ ID NO: 5770706 - DNA, 15 bp, Homo sapiens
ggccaataaaaagtt

SEQ ID NO: 5770707 - DNA, 16 bp, Homo sapiens
ggccaataaaaagttc

SEQ ID NO: 5770708 - DNA, 17 bp, Homo sapiens
ggccaataataaagaca

SEQ ID NO: 5770709 - DNA, 13 bp, Homo sapiens
ggccaatagtttt

SEQ ID NO: 5770710 - DNA, 16 bp, Homo sapiens
ggccaatcagaagcta

SEQ ID NO: 5770711 - DNA, 13 bp, Homo sapiens
ggccaatccccag

SEQ ID NO: 5770712 - DNA, 17 bp, Homo sapiens
ggccaatcccttctcca

SEQ ID NO: 5770713 - DNA, 22 bp, Homo sapiens
ggccaatggaaacctcacgctg

SEQ ID NO: 5770714 - DNA, 17 bp, Homo sapiens
ggccaatggagaaaatg

SEQ ID NO: 5770715 - DNA, 19 bp, Homo sapiens
ggccaatggagaaaatgaa

SEQ ID NO: 5770716 - DNA, 17 bp, Homo sapiens
ggccaatggtgcttccc

SEQ ID NO: 5770717 - DNA, 18 bp, Homo sapiens
ggccaatggtgcttcccc

SEQ ID NO: 5770718 - DNA, 22 bp, Homo sapiens
ggccaatgtgactaccgtgcca

SEQ ID NO: 5770719 - DNA, 15 bp, Homo sapiens
ggccaatgttgctga

SEQ ID NO: 5770720 - DNA, 23 bp, Homo sapiens
ggccaatgttgctgatggcccct

SEQ ID NO: 5770721 - DNA, 16 bp, Homo sapiens
ggccaatttactggcc

SEQ ID NO: 5770722 - DNA, 18 bp, Homo sapiens
ggccaatttactggccac

SEQ ID NO: 5770723 - DNA, 15 bp, Homo sapiens
ggccacaaaaacaat

SEQ ID NO: 5770724 - DNA, 23 bp, Homo sapiens
ggccacaaatcaaagcaagggct

SEQ ID NO: 5770725 - DNA, 17 bp, Homo sapiens
ggccacaactgctgtgg

SEQ ID NO: 5770726 - DNA, 16 bp, Homo sapiens
ggccacaagacccttg

SEQ ID NO: 5770727 - DNA, 16 bp, Homo sapiens
ggccacacagctgccg

SEQ ID NO: 5770728 - DNA, 14 bp, Homo sapiens
ggccacacaggcag

SEQ ID NO: 5770729 - DNA, 19 bp, Homo sapiens
ggccacacaggcagggcct

SEQ ID NO: 5770730 - DNA, 16 bp, Homo sapiens
ggccacacccaggaag

SEQ ID NO: 5770731 - DNA, 14 bp, Homo sapiens
ggccacaccccaga

SEQ ID NO: 5770732 - DNA, 19 bp, Homo sapiens
ggccacacctgagcgctgt

SEQ ID NO: 5770733 - DNA, 19 bp, Homo sapiens
ggccacacgctgcccaggc

SEQ ID NO: 5770734 - DNA, 20 bp, Homo sapiens
ggccacacgctgcccaggct

SEQ ID NO: 5770735 - DNA, 14 bp, Homo sapiens
ggccacactctgcc

SEQ ID NO: 5770736 - DNA, 15 bp, Homo sapiens
ggccacactggggct

SEQ ID NO: 5770737 - DNA, 17 bp, Homo sapiens
ggccacactgtgacaca

SEQ ID NO: 5770738 - DNA, 20 bp, Homo sapiens
ggccacacttcaaactactt

SEQ ID NO: 5770739 - DNA, 22 bp, Homo sapiens
ggccacagaggactcacttgcc

SEQ ID NO: 5770740 - DNA, 21 bp, Homo sapiens
ggccacagcaagtacagcggc

SEQ ID NO: 5770741 - DNA, 13 bp, Homo sapiens
ggccacagcacta

SEQ ID NO: 5770742 - DNA, 18 bp, Homo sapiens
ggccacagcactagagtc

SEQ ID NO: 5770743 - DNA, 13 bp, Homo sapiens
ggccacagccagg

SEQ ID NO: 5770744 - DNA, 13 bp, Homo sapiens
ggccacagccccc

SEQ ID NO: 5770745 - DNA, 15 bp, Homo sapiens
ggccacagccccctt

SEQ ID NO: 5770746 - DNA, 15 bp, Homo sapiens
ggccacagccccgat

SEQ ID NO: 5770747 - DNA, 12 bp, Homo sapiens
ggccacagccgc

SEQ ID NO: 5770748 - DNA, 20 bp, Homo sapiens
ggccacagccttccctctgc

SEQ ID NO: 5770749 - DNA, 13 bp, Homo sapiens
ggccacagcgtgc

SEQ ID NO: 5770750 - DNA, 15 bp, Homo sapiens
ggccacagctgctgg

SEQ ID NO: 5770751 - DNA, 18 bp, Homo sapiens
ggccacaggcagtccagg

SEQ ID NO: 5770752 - DNA, 13 bp, Homo sapiens
ggccacagggcaa

SEQ ID NO: 5770753 - DNA, 22 bp, Homo sapiens
ggccacagtcatggtggccacg

SEQ ID NO: 5770754 - DNA, 15 bp, Homo sapiens
ggccacagtggggct

SEQ ID NO: 5770755 - DNA, 22 bp, Homo sapiens
ggccacagtggggctgcaggca

SEQ ID NO: 5770756 - DNA, 14 bp, Homo sapiens
ggccacatacctct

SEQ ID NO: 5770757 - DNA, 18 bp, Homo sapiens
ggccacatacctctctga

SEQ ID NO: 5770758 - DNA, 16 bp, Homo sapiens
ggccacatagatgctg

SEQ ID NO: 5770759 - DNA, 16 bp, Homo sapiens
ggccacatcaacttta

SEQ ID NO: 5770760 - DNA, 18 bp, Homo sapiens
ggccacatccaacatttc

SEQ ID NO: 5770761 - DNA, 18 bp, Homo sapiens
ggccacatgggaggctca

SEQ ID NO: 5770762 - DNA, 19 bp, Homo sapiens
ggccacatgggaggctcac

SEQ ID NO: 5770763 - DNA, 17 bp, Homo sapiens
ggccacatggggctggg

SEQ ID NO: 5770764 - DNA, 16 bp, Homo sapiens
ggccacattgctggct

SEQ ID NO: 5770765 - DNA, 17 bp, Homo sapiens
ggccacattgctggctg

SEQ ID NO: 5770766 - DNA, 19 bp, Homo sapiens
ggccacattgctggctgcc

SEQ ID NO: 5770767 - DNA, 13 bp, Homo sapiens
ggccaccaaagct

SEQ ID NO: 5770768 - DNA, 15 bp, Homo sapiens
ggccaccaaagctgc

SEQ ID NO: 5770769 - DNA, 17 bp, Homo sapiens
ggccaccaaagctgccc

SEQ ID NO: 5770770 - DNA, 13 bp, Homo sapiens
ggccaccacagag

SEQ ID NO: 5770771 - DNA, 19 bp, Homo sapiens
ggccaccacctttggctgg

SEQ ID NO: 5770772 - DNA, 15 bp, Homo sapiens
ggccaccagatgctg

SEQ ID NO: 5770773 - DNA, 15 bp, Homo sapiens
ggccaccagccatcc

SEQ ID NO: 5770774 - DNA, 21 bp, Homo sapiens
ggccaccagccatcctccctc

SEQ ID NO: 5770775 - DNA, 12 bp, Homo sapiens
ggccaccagctc

SEQ ID NO: 5770776 - DNA, 18 bp, Homo sapiens
ggccaccagctccactgg

SEQ ID NO: 5770777 - DNA, 21 bp, Homo sapiens
ggccaccagctccactggcct

SEQ ID NO: 5770778 - DNA, 23 bp, Homo sapiens
ggccaccagctccactggcctgc

SEQ ID NO: 5770779 - DNA, 11 bp, Homo sapiens
ggccaccagga

SEQ ID NO: 5770780 - DNA, 14 bp, Homo sapiens
ggccaccaggatgg

SEQ ID NO: 5770781 - DNA, 21 bp, Homo sapiens
ggccaccaggctggcgcagcc

SEQ ID NO: 5770782 - DNA, 14 bp, Homo sapiens
ggccaccatccctg

SEQ ID NO: 5770783 - DNA, 21 bp, Homo sapiens
ggccaccatctgtaccctgct

SEQ ID NO: 5770784 - DNA, 15 bp, Homo sapiens
ggccaccatgacccc

SEQ ID NO: 5770785 - DNA, 14 bp, Homo sapiens
ggccaccatggtca

SEQ ID NO: 5770786 - DNA, 12 bp, Homo sapiens
ggccacccacca

SEQ ID NO: 5770787 - DNA, 17 bp, Homo sapiens
ggccacccaccagggct

SEQ ID NO: 5770788 - DNA, 18 bp, Homo sapiens
ggccacccaccagggctc

SEQ ID NO: 5770789 - DNA, 20 bp, Homo sapiens
ggccacccaccagggctcag

SEQ ID NO: 5770790 - DNA, 23 bp, Homo sapiens
ggccacccaccagggctcagctc

SEQ ID NO: 5770791 - DNA, 13 bp, Homo sapiens
ggccacccaccct

SEQ ID NO: 5770792 - DNA, 16 bp, Homo sapiens
ggccaccccaaacccc

SEQ ID NO: 5770793 - DNA, 23 bp, Homo sapiens
ggccaccccaaaccccagcccca

SEQ ID NO: 5770794 - DNA, 18 bp, Homo sapiens
ggccaccccactctacct

SEQ ID NO: 5770795 - DNA, 20 bp, Homo sapiens
ggccacccccacctccctgc

SEQ ID NO: 5770796 - DNA, 21 bp, Homo sapiens
ggccacccccacctccctgca

SEQ ID NO: 5770797 - DNA, 15 bp, Homo sapiens
ggccaccccgtgcca

SEQ ID NO: 5770798 - DNA, 18 bp, Homo sapiens
ggccaccccgtgcccctg

SEQ ID NO: 5770799 - DNA, 15 bp, Homo sapiens
ggccaccccttgctc

SEQ ID NO: 5770800 - DNA, 20 bp, Homo sapiens
ggccaccccttgctctctgt

SEQ ID NO: 5770801 - DNA, 13 bp, Homo sapiens
ggccacccgggct

SEQ ID NO: 5770802 - DNA, 14 bp, Homo sapiens
ggccacccgggctg

SEQ ID NO: 5770803 - DNA, 10 bp, Homo sapiens
ggccaccctc

SEQ ID NO: 5770804 - DNA, 11 bp, Homo sapiens
ggccaccctga

SEQ ID NO: 5770805 - DNA, 14 bp, Homo sapiens
ggccaccctggccc

SEQ ID NO: 5770806 - DNA, 23 bp, Homo sapiens
ggccacccttcacgctggcttcc

SEQ ID NO: 5770807 - DNA, 19 bp, Homo sapiens
ggccacccttggcctgtcc

SEQ ID NO: 5770808 - DNA, 17 bp, Homo sapiens
ggccaccggggcaagag

SEQ ID NO: 5770809 - DNA, 18 bp, Homo sapiens
ggccaccggtgggcagtg

SEQ ID NO: 5770810 - DNA, 17 bp, Homo sapiens
ggccaccgtgcctggct

SEQ ID NO: 5770811 - DNA, 18 bp, Homo sapiens
ggccaccgtgcctggctg

SEQ ID NO: 5770812 - DNA, 22 bp, Homo sapiens
ggccacctagaagtctccctgc

SEQ ID NO: 5770813 - DNA, 13 bp, Homo sapiens
ggccacctcaccc

SEQ ID NO: 5770814 - DNA, 14 bp, Homo sapiens
ggccacctcagtct

SEQ ID NO: 5770815 - DNA, 21 bp, Homo sapiens
ggccacctcccactcctgctg

SEQ ID NO: 5770816 - DNA, 16 bp, Homo sapiens
ggccacctccccagca

SEQ ID NO: 5770817 - DNA, 17 bp, Homo sapiens
ggccacctccccagcat

SEQ ID NO: 5770818 - DNA, 15 bp, Homo sapiens
ggccacctcctaccc

SEQ ID NO: 5770819 - DNA, 20 bp, Homo sapiens
ggccacctcctaccccttcc

SEQ ID NO: 5770820 - DNA, 16 bp, Homo sapiens
ggccacctctgcctct

SEQ ID NO: 5770821 - DNA, 16 bp, Homo sapiens
ggccacctcttcctgg

SEQ ID NO: 5770822 - DNA, 20 bp, Homo sapiens
ggccacctgaggtgggccca

SEQ ID NO: 5770823 - DNA, 22 bp, Homo sapiens
ggccacctgccaggcctccctc

SEQ ID NO: 5770824 - DNA, 22 bp, Homo sapiens
ggccacctgcccccttctccca

SEQ ID NO: 5770825 - DNA, 21 bp, Homo sapiens
ggccacctgcctgcgtcttcc

SEQ ID NO: 5770826 - DNA, 17 bp, Homo sapiens
ggccacctggctctcac

SEQ ID NO: 5770827 - DNA, 22 bp, Homo sapiens
ggccacctggctctcacctcta

SEQ ID NO: 5770828 - DNA, 19 bp, Homo sapiens
ggccacctgtagccatctg

SEQ ID NO: 5770829 - DNA, 23 bp, Homo sapiens
ggccacctgtagccatctgcaca

SEQ ID NO: 5770830 - DNA, 17 bp, Homo sapiens
ggccaccttggaggagg

SEQ ID NO: 5770831 - DNA, 18 bp, Homo sapiens
ggccacgcactgggccac

SEQ ID NO: 5770832 - DNA, 18 bp, Homo sapiens
ggccacgcagccaggaca

SEQ ID NO: 5770833 - DNA, 14 bp, Homo sapiens
ggccacgccccagc

SEQ ID NO: 5770834 - DNA, 15 bp, Homo sapiens
ggccacgccccagcc

SEQ ID NO: 5770835 - DNA, 17 bp, Homo sapiens
ggccacgccccagcccg

SEQ ID NO: 5770836 - DNA, 14 bp, Homo sapiens
ggccacgctccagc

SEQ ID NO: 5770837 - DNA, 18 bp, Homo sapiens
ggccacgctccagctgcc

SEQ ID NO: 5770838 - DNA, 23 bp, Homo sapiens
ggccacggaggagggatgctgct

SEQ ID NO: 5770839 - DNA, 13 bp, Homo sapiens
ggccacggcccag

SEQ ID NO: 5770840 - DNA, 15 bp, Homo sapiens
ggccacggcctggga

SEQ ID NO: 5770841 - DNA, 16 bp, Homo sapiens
ggccacggcctgggag

SEQ ID NO: 5770842 - DNA, 16 bp, Homo sapiens
ggccacggctgagcct

SEQ ID NO: 5770843 - DNA, 17 bp, Homo sapiens
ggccacggctgagcctt

SEQ ID NO: 5770844 - DNA, 18 bp, Homo sapiens
ggccacgggggcagtgtg

SEQ ID NO: 5770845 - DNA, 20 bp, Homo sapiens
ggccacgggggcagtgtgag

SEQ ID NO: 5770846 - DNA, 21 bp, Homo sapiens
ggccacgggggcagtgtgagg

SEQ ID NO: 5770847 - DNA, 16 bp, Homo sapiens
ggccacgtccaggtcc

SEQ ID NO: 5770848 - DNA, 16 bp, Homo sapiens
ggccacgtcccacccc

SEQ ID NO: 5770849 - DNA, 19 bp, Homo sapiens
ggccacgtctgtgctctgt

SEQ ID NO: 5770850 - DNA, 12 bp, Homo sapiens
ggccacgtgcca

SEQ ID NO: 5770851 - DNA, 18 bp, Homo sapiens
ggccacgttcagggaggg

SEQ ID NO: 5770852 - DNA, 19 bp, Homo sapiens
ggccacgttcagggagggg

SEQ ID NO: 5770853 - DNA, 19 bp, Homo sapiens
ggccactaaagcttcagac

SEQ ID NO: 5770854 - DNA, 11 bp, Homo sapiens
ggccactaagc

SEQ ID NO: 5770855 - DNA, 15 bp, Homo sapiens
ggccactcagaggcc

SEQ ID NO: 5770856 - DNA, 23 bp, Homo sapiens
ggccactcagaggcccccagtgg

SEQ ID NO: 5770857 - DNA, 17 bp, Homo sapiens
ggccactccagacccct

SEQ ID NO: 5770858 - DNA, 14 bp, Homo sapiens
ggccactccctgcc

SEQ ID NO: 5770859 - DNA, 16 bp, Homo sapiens
ggccactccctgccaa

SEQ ID NO: 5770860 - DNA, 20 bp, Homo sapiens
ggccagctctggagttctct

SEQ ID NO: 5770861 - DNA, 20 bp, Homo sapiens
ggccagctgcatctactcag

SEQ ID NO: 5770862 - DNA, 14 bp, Homo sapiens
ggccagctgcccct

SEQ ID NO: 5770863 - DNA, 13 bp, Homo sapiens
ggccagctgcggc

SEQ ID NO: 5770864 - DNA, 22 bp, Homo sapiens
ggccagctgcggccaggcctgc

SEQ ID NO: 5770865 - DNA, 14 bp, Homo sapiens
ggccagctggcagc

SEQ ID NO: 5770866 - DNA, 23 bp, Homo sapiens
ggccagctgggatctgactgcac

SEQ ID NO: 5770867 - DNA, 14 bp, Homo sapiens
ggccagctggggag

SEQ ID NO: 5770868 - DNA, 13 bp, Homo sapiens
ggccagctggtgc

SEQ ID NO: 5770869 - DNA, 16 bp, Homo sapiens
ggccagctggtgctgc

SEQ ID NO: 5770870 - DNA, 21 bp, Homo sapiens
ggccagctgtcgcatctcagc

SEQ ID NO: 5770871 - DNA, 12 bp, Homo sapiens
ggccagctgtgc

SEQ ID NO: 5770872 - DNA, 19 bp, Homo sapiens
ggccaggaaggggacagga

SEQ ID NO: 5770873 - DNA, 19 bp, Homo sapiens
ggccaggaagtagcacagg

SEQ ID NO: 5770874 - DNA, 23 bp, Homo sapiens
ggccaggaagtagcacaggctga

SEQ ID NO: 5770875 - DNA, 17 bp, Homo sapiens
ggccaggaatctgccat

SEQ ID NO: 5770876 - DNA, 19 bp, Homo sapiens
ggccaggacaccagtccag

SEQ ID NO: 5770877 - DNA, 23 bp, Homo sapiens
ggccaggacagagctgacaaaat

SEQ ID NO: 5770878 - DNA, 16 bp, Homo sapiens
ggccaggacaggcccg

SEQ ID NO: 5770879 - DNA, 19 bp, Homo sapiens
ggccaggaccaagggcaga

SEQ ID NO: 5770880 - DNA, 21 bp, Homo sapiens
ggccaggaccaagggcagagg

SEQ ID NO: 5770881 - DNA, 20 bp, Homo sapiens
ggccaggacgggccacacgt

SEQ ID NO: 5770882 - DNA, 14 bp, Homo sapiens
ggccaggactctgc

SEQ ID NO: 5770883 - DNA, 18 bp, Homo sapiens
ggccaggactctgcagcc

SEQ ID NO: 5770884 - DNA, 15 bp, Homo sapiens
ggccaggagagtccg

SEQ ID NO: 5770885 - DNA, 21 bp, Homo sapiens
ggccaggagcaggcacgggtg

SEQ ID NO: 5770886 - DNA, 17 bp, Homo sapiens
ggccaggagccctggcc

SEQ ID NO: 5770887 - DNA, 16 bp, Homo sapiens
ggccaggagcctcctg

SEQ ID NO: 5770888 - DNA, 15 bp, Homo sapiens
ggccaggagctcagc

SEQ ID NO: 5770889 - DNA, 16 bp, Homo sapiens
ggccaggaggctgcca

SEQ ID NO: 5770890 - DNA, 17 bp, Homo sapiens
ggccaggaggtagtttc

SEQ ID NO: 5770891 - DNA, 21 bp, Homo sapiens
ggccaggaggttcccccgacc

SEQ ID NO: 5770892 - DNA, 20 bp, Homo sapiens
ggccaggagtaagcccaagc

SEQ ID NO: 5770893 - DNA, 21 bp, Homo sapiens
ggccaggatccccctctttgc

SEQ ID NO: 5770894 - DNA, 23 bp, Homo sapiens
ggccaggatgcctgagccccctg

SEQ ID NO: 5770895 - DNA, 23 bp, Homo sapiens
ggccaggattcaggcctctgagg

SEQ ID NO: 5770896 - DNA, 20 bp, Homo sapiens
ggccaggatttggttgttta

SEQ ID NO: 5770897 - DNA, 12 bp, Homo sapiens
ggccaggcacag

SEQ ID NO: 5770898 - DNA, 15 bp, Homo sapiens
ggccaggcacagggc

SEQ ID NO: 5770899 - DNA, 17 bp, Homo sapiens
ggccaggcacagggccc

SEQ ID NO: 5770900 - DNA, 15 bp, Homo sapiens
ggccaggcagatctg

SEQ ID NO: 5770901 - DNA, 11 bp, Homo sapiens
ggccaggcagg

SEQ ID NO: 5770902 - DNA, 16 bp, Homo sapiens
ggccaggcatggccca

SEQ ID NO: 5770903 - DNA, 23 bp, Homo sapiens
ggccaggcatggcccagcctgga

SEQ ID NO: 5770904 - DNA, 15 bp, Homo sapiens
ggccaggccaccagg

SEQ ID NO: 5770905 - DNA, 17 bp, Homo sapiens
ggccaggccaccaggat

SEQ ID NO: 5770906 - DNA, 12 bp, Homo sapiens
ggccaggccagc

SEQ ID NO: 5770907 - DNA, 17 bp, Homo sapiens
ggccaggccagctgcct

SEQ ID NO: 5770908 - DNA, 14 bp, Homo sapiens
ggccaggccaggac

SEQ ID NO: 5770909 - DNA, 15 bp, Homo sapiens
ggccaggccaggacc

SEQ ID NO: 5770910 - DNA, 18 bp, Homo sapiens
ggccaggccaggaccaca

SEQ ID NO: 5770911 - DNA, 12 bp, Homo sapiens
ggccaggccatg

SEQ ID NO: 5770912 - DNA, 12 bp, Homo sapiens
ggccaggcccag

SEQ ID NO: 5770913 - DNA, 20 bp, Homo sapiens
ggccaggcccaggcagagct

SEQ ID NO: 5770914 - DNA, 12 bp, Homo sapiens
ggccaggcccca

SEQ ID NO: 5770915 - DNA, 14 bp, Homo sapiens
ggccaggccccatg

SEQ ID NO: 5770916 - DNA, 12 bp, Homo sapiens
ggccaggccctc

SEQ ID NO: 5770917 - DNA, 20 bp, Homo sapiens
ggccaggccctcctgctggc

SEQ ID NO: 5770918 - DNA, 15 bp, Homo sapiens
ggccaggccctctgc

SEQ ID NO: 5770919 - DNA, 21 bp, Homo sapiens
ggccaggccctggagggcaga

SEQ ID NO: 5770920 - DNA, 18 bp, Homo sapiens
ggccaggccgcgcccagc

SEQ ID NO: 5770921 - DNA, 19 bp, Homo sapiens
ggccaggccgggcctgtac

SEQ ID NO: 5770922 - DNA, 21 bp, Homo sapiens
ggccaggcctctgctggctca

SEQ ID NO: 5770923 - DNA, 15 bp, Homo sapiens
ggccaggcctgcaga

SEQ ID NO: 5770924 - DNA, 22 bp, Homo sapiens
ggccaggcctgcgggcccctgg

SEQ ID NO: 5770925 - DNA, 16 bp, Homo sapiens
ggccaggcgagcctga

SEQ ID NO: 5770926 - DNA, 16 bp, Homo sapiens
ggccaggctccctgac

SEQ ID NO: 5770927 - DNA, 20 bp, Homo sapiens
ggccaggctccctgaccacc

SEQ ID NO: 5770928 - DNA, 13 bp, Homo sapiens
ggccaggctgagc

SEQ ID NO: 5770929 - DNA, 14 bp, Homo sapiens
ggccaggctgagcc

SEQ ID NO: 5770930 - DNA, 18 bp, Homo sapiens
ggccaggctgcctggcct

SEQ ID NO: 5770931 - DNA, 14 bp, Homo sapiens
ggccaggctgctct

SEQ ID NO: 5770932 - DNA, 17 bp, Homo sapiens
ggccaggctgctctcaa

SEQ ID NO: 5770933 - DNA, 18 bp, Homo sapiens
ggccaggctgggtcgccc

SEQ ID NO: 5770934 - DNA, 13 bp, Homo sapiens
ggccaggctggtc

SEQ ID NO: 5770935 - DNA, 16 bp, Homo sapiens
ggccaggctggtctca

SEQ ID NO: 5770936 - DNA, 18 bp, Homo sapiens
ggccagggacccccgagg

SEQ ID NO: 5770937 - DNA, 20 bp, Homo sapiens
ggccagggacccccgaggcc

SEQ ID NO: 5770938 - DNA, 10 bp, Homo sapiens
ggccagggag

SEQ ID NO: 5770939 - DNA, 16 bp, Homo sapiens
ggccagggagaagctc

SEQ ID NO: 5770940 - DNA, 12 bp, Homo sapiens
ggccagggaggc

SEQ ID NO: 5770941 - DNA, 16 bp, Homo sapiens
ggccagggaggcagag

SEQ ID NO: 5770942 - DNA, 21 bp, Homo sapiens
ggccagggaggcagagcggga

SEQ ID NO: 5770943 - DNA, 20 bp, Homo sapiens
ggccagggaggcagcctagc

SEQ ID NO: 5770944 - DNA, 14 bp, Homo sapiens
ggccagggaggcgc

SEQ ID NO: 5770945 - DNA, 17 bp, Homo sapiens
ggccagggaggcgcagg

SEQ ID NO: 5770946 - DNA, 19 bp, Homo sapiens
ggccagggaggcgcaggga

SEQ ID NO: 5770947 - DNA, 20 bp, Homo sapiens
ggccagggaggcgcagggac

SEQ ID NO: 5770948 - DNA, 22 bp, Homo sapiens
ggccagggatctctctacaaga

SEQ ID NO: 5770949 - DNA, 14 bp, Homo sapiens
ggccagggcagatg

SEQ ID NO: 5770950 - DNA, 16 bp, Homo sapiens
ggccagggcagatgtg

SEQ ID NO: 5770951 - DNA, 14 bp, Homo sapiens
ggccagggcagggc

SEQ ID NO: 5770952 - DNA, 20 bp, Homo sapiens
ggccagggccacgctccagc

SEQ ID NO: 5770953 - DNA, 15 bp, Homo sapiens
ggccagggcctctcc

SEQ ID NO: 5770954 - DNA, 17 bp, Homo sapiens
ggccagggcctctccaa

SEQ ID NO: 5770955 - DNA, 13 bp, Homo sapiens
ggccagggcctgg

SEQ ID NO: 5770956 - DNA, 23 bp, Homo sapiens
ggccagggcctggaagacagaga

SEQ ID NO: 5770957 - DNA, 16 bp, Homo sapiens
ggccagggcgtggctt

SEQ ID NO: 5770958 - DNA, 10 bp, Homo sapiens
ggccagggct

SEQ ID NO: 5770959 - DNA, 22 bp, Homo sapiens
ggccagggctcctgtggcagct

SEQ ID NO: 5770960 - DNA, 12 bp, Homo sapiens
ggccagggctct

SEQ ID NO: 5770961 - DNA, 17 bp, Homo sapiens
ggccagggctctggcag

SEQ ID NO: 5770962 - DNA, 11 bp, Homo sapiens
ggccagggctg

SEQ ID NO: 5770963 - DNA, 14 bp, Homo sapiens
ggccagggctgccc

SEQ ID NO: 5770964 - DNA, 18 bp, Homo sapiens
ggccagggctgggtcaca

SEQ ID NO: 5770965 - DNA, 19 bp, Homo sapiens
ggccagggctgggtcacag

SEQ ID NO: 5770966 - DNA, 22 bp, Homo sapiens
ggccagggctgggtcacaggaa

SEQ ID NO: 5770967 - DNA, 24 bp, Homo sapiens
ggccagggcttccccatcagctcc

SEQ ID NO: 5770968 - DNA, 23 bp, Homo sapiens
ggccaggggcttctccccctcag

SEQ ID NO: 5770969 - DNA, 21 bp, Homo sapiens
ggccaggggtgctcctgtgct

SEQ ID NO: 5770970 - DNA, 22 bp, Homo sapiens
ggccaggggtgctcctgtgctc

SEQ ID NO: 5770971 - DNA, 23 bp, Homo sapiens
ggccaggggttctgagaagcgct

SEQ ID NO: 5770972 - DNA, 22 bp, Homo sapiens
ggccagggtagacttggagctg

SEQ ID NO: 5770973 - DNA, 19 bp, Homo sapiens
ggccagggtctgtgtgaat

SEQ ID NO: 5770974 - DNA, 22 bp, Homo sapiens
ggccagggtctgtgtgaatgtg

SEQ ID NO: 5770975 - DNA, 11 bp, Homo sapiens
ggccagggtgg

SEQ ID NO: 5770976 - DNA, 18 bp, Homo sapiens
ggccaggtcctcacagca

SEQ ID NO: 5770977 - DNA, 19 bp, Homo sapiens
ggccaggtcctcacagcag

SEQ ID NO: 5770978 - DNA, 21 bp, Homo sapiens
ggccaggtcctcacagcagtc

SEQ ID NO: 5770979 - DNA, 14 bp, Homo sapiens
ggccaggtgcagtg

SEQ ID NO: 5770980 - DNA, 14 bp, Homo sapiens
ggccaggtgcctcc

SEQ ID NO: 5770981 - DNA, 15 bp, Homo sapiens
ggccaggtgcggcct

SEQ ID NO: 5770982 - DNA, 22 bp, Homo sapiens
ggccaggtgcggcctgggggga

SEQ ID NO: 5770983 - DNA, 19 bp, Homo sapiens
ggccaggtgcttttcccta

SEQ ID NO: 5770984 - DNA, 19 bp, Homo sapiens
ggccaggtggccactccag

SEQ ID NO: 5770985 - DNA, 15 bp, Homo sapiens
ggccaggtgggaacg

SEQ ID NO: 5770986 - DNA, 19 bp, Homo sapiens
ggccaggtgggcggacaaa

SEQ ID NO: 5770987 - DNA, 17 bp, Homo sapiens
ggccaggttatgcctca

SEQ ID NO: 5770988 - DNA, 21 bp, Homo sapiens
ggccaggttggaaaagaaatc

SEQ ID NO: 5770989 - DNA, 17 bp, Homo sapiens
ggccaggtttctgccca

SEQ ID NO: 5770990 - DNA, 18 bp, Homo sapiens
ggccagtacctttccatt

SEQ ID NO: 5770991 - DNA, 14 bp, Homo sapiens
ggccagtactttgc

SEQ ID NO: 5770992 - DNA, 19 bp, Homo sapiens
ggccagtagagagtgccct

SEQ ID NO: 5770993 - DNA, 21 bp, Homo sapiens
ggccagtatctatatatgtgt

SEQ ID NO: 5770994 - DNA, 15 bp, Homo sapiens
ggccagtccaggctg

SEQ ID NO: 5770995 - DNA, 16 bp, Homo sapiens
ggccagtccaggctgc

SEQ ID NO: 5770996 - DNA, 16 bp, Homo sapiens
ggccagtcctagagct

SEQ ID NO: 5770997 - DNA, 21 bp, Homo sapiens
ggccagtcctagagctcctgt

SEQ ID NO: 5770998 - DNA, 20 bp, Homo sapiens
ggccagtcctgcctggccag

SEQ ID NO: 5770999 - DNA, 22 bp, Homo sapiens
ggccagtcctgcctggccaggc

SEQ ID NO: 5771000 - DNA, 16 bp, Homo sapiens
ggccagtcctggtcct

SEQ ID NO: 5771001 - DNA, 22 bp, Homo sapiens
ggccagtcctggtcctggctgc

SEQ ID NO: 5771002 - DNA, 23 bp, Homo sapiens
ggccagtcctggttgtctgaacc

SEQ ID NO: 5771003 - DNA, 15 bp, Homo sapiens
ggccagtctgggctg

SEQ ID NO: 5771004 - DNA, 16 bp, Homo sapiens
ggccagtctgggctgc

SEQ ID NO: 5771005 - DNA, 13 bp, Homo sapiens
ggccagtctgtgg

SEQ ID NO: 5771006 - DNA, 14 bp, Homo sapiens
ggccagtctgtgga

SEQ ID NO: 5771007 - DNA, 16 bp, Homo sapiens
ggccagtgagaagctg

SEQ ID NO: 5771008 - DNA, 17 bp, Homo sapiens
ggccagtgagaagctga

SEQ ID NO: 5771009 - DNA, 20 bp, Homo sapiens
ggccagtgagaagctgaggc

SEQ ID NO: 5771010 - DNA, 21 bp, Homo sapiens
ggccagtgagaagctgaggcc

SEQ ID NO: 5771011 - DNA, 23 bp, Homo sapiens
ggccagtgagaagctgaggccta

SEQ ID NO: 5771012 - DNA, 16 bp, Homo sapiens
ggccagtgagggctgg

SEQ ID NO: 5771013 - DNA, 14 bp, Homo sapiens
ggccagtgatgatg

SEQ ID NO: 5771014 - DNA, 14 bp, Homo sapiens
ggccagtgccagga

SEQ ID NO: 5771015 - DNA, 19 bp, Homo sapiens
ggccagtgccctgatccca

SEQ ID NO: 5771016 - DNA, 15 bp, Homo sapiens
ggccagtgctccagc

SEQ ID NO: 5771017 - DNA, 15 bp, Homo sapiens
ggccagtggacagag

SEQ ID NO: 5771018 - DNA, 16 bp, Homo sapiens
ggccagtggacagagg

SEQ ID NO: 5771019 - DNA, 13 bp, Homo sapiens
ggccagtggcact

SEQ ID NO: 5771020 - DNA, 18 bp, Homo sapiens
ggccagtggcactctgtg

SEQ ID NO: 5771021 - DNA, 17 bp, Homo sapiens
ggccagtgggcgggcca

SEQ ID NO: 5771022 - DNA, 17 bp, Homo sapiens
ggccagtggggaactga

SEQ ID NO: 5771023 - DNA, 20 bp, Homo sapiens
ggccagtggggaactgaggg

SEQ ID NO: 5771024 - DNA, 15 bp, Homo sapiens
ggccagtggggcctg

SEQ ID NO: 5771025 - DNA, 17 bp, Homo sapiens
ggccagtggggcctgtg

SEQ ID NO: 5771026 - DNA, 13 bp, Homo sapiens
ggccagtgtctgg

SEQ ID NO: 5771027 - DNA, 18 bp, Homo sapiens
ggccagtgttgtgggctt

SEQ ID NO: 5771028 - DNA, 22 bp, Homo sapiens
ggccagtgttgtgggcttcctg

SEQ ID NO: 5771029 - DNA, 20 bp, Homo sapiens
ggccagttgatctgctctgt

SEQ ID NO: 5771030 - DNA, 19 bp, Homo sapiens
ggccagttgcccagagcac

SEQ ID NO: 5771031 - DNA, 24 bp, Homo sapiens
ggccagtttatatactgctattta

SEQ ID NO: 5771032 - DNA, 18 bp, Homo sapiens
ggccagtttgaagcctgt

SEQ ID NO: 5771033 - DNA, 22 bp, Homo sapiens
ggccagtttgaagcctgtgcct

SEQ ID NO: 5771034 - DNA, 17 bp, Homo sapiens
ggccataaacggttcct

SEQ ID NO: 5771035 - DNA, 18 bp, Homo sapiens
ggccataaacggttcctg

SEQ ID NO: 5771036 - DNA, 20 bp, Homo sapiens
ggccataaacggttcctggt

SEQ ID NO: 5771037 - DNA, 22 bp, Homo sapiens
ggccataaacggttcctggtga

SEQ ID NO: 5771038 - DNA, 22 bp, Homo sapiens
ggcccacattgcccacacctgc

SEQ ID NO: 5771039 - DNA, 15 bp, Homo sapiens
ggcccaccagagctg

SEQ ID NO: 5771040 - DNA, 18 bp, Homo sapiens
ggcccaccaggcccccct

SEQ ID NO: 5771041 - DNA, 20 bp, Homo sapiens
ggcccaccatcaccaccgcc

SEQ ID NO: 5771042 - DNA, 20 bp, Homo sapiens
ggcccacccaagcaggaggc

SEQ ID NO: 5771043 - DNA, 13 bp, Homo sapiens
ggcccacccacat

SEQ ID NO: 5771044 - DNA, 15 bp, Homo sapiens
ggcccacccacatga

SEQ ID NO: 5771045 - DNA, 23 bp, Homo sapiens
ggcccacccacatgacttttcca

SEQ ID NO: 5771046 - DNA, 20 bp, Homo sapiens
ggcccacccagtccatgctc

SEQ ID NO: 5771047 - DNA, 22 bp, Homo sapiens
ggcccacccagtccatgctcca

SEQ ID NO: 5771048 - DNA, 23 bp, Homo sapiens
ggcccacccagtccatgctccag

SEQ ID NO: 5771049 - DNA, 16 bp, Homo sapiens
ggcccaccccagcctc

SEQ ID NO: 5771050 - DNA, 18 bp, Homo sapiens
ggcccaccccagcctcgc

SEQ ID NO: 5771051 - DNA, 21 bp, Homo sapiens
ggcccacccggttcagtgttt

SEQ ID NO: 5771052 - DNA, 20 bp, Homo sapiens
ggcccaccctctgcccaggg

SEQ ID NO: 5771053 - DNA, 12 bp, Homo sapiens
ggcccaccctgc

SEQ ID NO: 5771054 - DNA, 21 bp, Homo sapiens
ggcccaccctgcttggcccag

SEQ ID NO: 5771055 - DNA, 15 bp, Homo sapiens
ggcccacgaggagca

SEQ ID NO: 5771056 - DNA, 17 bp, Homo sapiens
ggcccacgaggagcagc

SEQ ID NO: 5771057 - DNA, 19 bp, Homo sapiens
ggcccacgaggagcagcag

SEQ ID NO: 5771058 - DNA, 17 bp, Homo sapiens
ggcccacgcagagcccc

SEQ ID NO: 5771059 - DNA, 22 bp, Homo sapiens
ggcccacgcagagccccggagc

SEQ ID NO: 5771060 - DNA, 23 bp, Homo sapiens
ggcccacgcagagccccggagca

SEQ ID NO: 5771061 - DNA, 18 bp, Homo sapiens
ggcccacgccagctggcc

SEQ ID NO: 5771062 - DNA, 20 bp, Homo sapiens
ggcccacgccagctggccca

SEQ ID NO: 5771063 - DNA, 18 bp, Homo sapiens
ggcccacgggccggccag

SEQ ID NO: 5771064 - DNA, 17 bp, Homo sapiens
ggcccacggtttcagct

SEQ ID NO: 5771065 - DNA, 22 bp, Homo sapiens
ggcccacgtagggcggcactca

SEQ ID NO: 5771066 - DNA, 16 bp, Homo sapiens
ggcccactagagggcc

SEQ ID NO: 5771067 - DNA, 13 bp, Homo sapiens
ggcccactgctcg

SEQ ID NO: 5771068 - DNA, 18 bp, Homo sapiens
ggcccactgtgcctcaga

SEQ ID NO: 5771069 - DNA, 14 bp, Homo sapiens
ggcccactttcctg

SEQ ID NO: 5771070 - DNA, 12 bp, Homo sapiens
ggcccagaaact

SEQ ID NO: 5771071 - DNA, 18 bp, Homo sapiens
ggcccagaactgccccca

SEQ ID NO: 5771072 - DNA, 22 bp, Homo sapiens
ggcccagaagggtagctgggcg

SEQ ID NO: 5771073 - DNA, 16 bp, Homo sapiens
ggcccagacccactct

SEQ ID NO: 5771074 - DNA, 14 bp, Homo sapiens
ggcccagaccctgg

SEQ ID NO: 5771075 - DNA, 23 bp, Homo sapiens
ggcccagaccctgggcaaacaga

SEQ ID NO: 5771076 - DNA, 16 bp, Homo sapiens
ggcccagacctggcct

SEQ ID NO: 5771077 - DNA, 17 bp, Homo sapiens
ggcccagacctggcctc

SEQ ID NO: 5771078 - DNA, 18 bp, Homo sapiens
ggcccagacctggcctct

SEQ ID NO: 5771079 - DNA, 10 bp, Homo sapiens
ggcccagaga

SEQ ID NO: 5771080 - DNA, 22 bp, Homo sapiens
ggcccagagaccccttcctttc

SEQ ID NO: 5771081 - DNA, 23 bp, Homo sapiens
ggcccagagaccccttcctttcc

SEQ ID NO: 5771082 - DNA, 15 bp, Homo sapiens
ggcccagagagctga

SEQ ID NO: 5771083 - DNA, 12 bp, Homo sapiens
ggcccagagagg

SEQ ID NO: 5771084 - DNA, 15 bp, Homo sapiens
ggcccagagccatac

SEQ ID NO: 5771085 - DNA, 23 bp, Homo sapiens
ggcccagagccatactgcgtcca

SEQ ID NO: 5771086 - DNA, 12 bp, Homo sapiens
ggcccagagccc

SEQ ID NO: 5771087 - DNA, 16 bp, Homo sapiens
ggcccagagcccttga

SEQ ID NO: 5771088 - DNA, 22 bp, Homo sapiens
ggcccagagctggaacactctc

SEQ ID NO: 5771089 - DNA, 14 bp, Homo sapiens
ggcccagaggagag

SEQ ID NO: 5771090 - DNA, 22 bp, Homo sapiens
ggcccagaggagctgggagccg

SEQ ID NO: 5771091 - DNA, 16 bp, Homo sapiens
ggcccagaggcacagc

SEQ ID NO: 5771092 - DNA, 17 bp, Homo sapiens
ggcccagaggcacagcc

SEQ ID NO: 5771093 - DNA, 14 bp, Homo sapiens
ggcccagagggcct

SEQ ID NO: 5771094 - DNA, 19 bp, Homo sapiens
ggcccagagggcctgcaag

SEQ ID NO: 5771095 - DNA, 23 bp, Homo sapiens
ggcccagcacatggccatagagg

SEQ ID NO: 5771096 - DNA, 12 bp, Homo sapiens
ggcccagcaccc

SEQ ID NO: 5771097 - DNA, 21 bp, Homo sapiens
ggcccagcactgcccatccca

SEQ ID NO: 5771098 - DNA, 13 bp, Homo sapiens
ggcccagcagagc

SEQ ID NO: 5771099 - DNA, 14 bp, Homo sapiens
ggcccagcagagcc

SEQ ID NO: 5771100 - DNA, 23 bp, Homo sapiens
ggcccagcagagccgttcctggg

SEQ ID NO: 5771101 - DNA, 11 bp, Homo sapiens
ggcccagcagc

SEQ ID NO: 5771102 - DNA, 19 bp, Homo sapiens
ggcccagcagcggcccaga

SEQ ID NO: 5771103 - DNA, 16 bp, Homo sapiens
ggcccagcagcttggc

SEQ ID NO: 5771104 - DNA, 18 bp, Homo sapiens
ggcccagcagcttggctg

SEQ ID NO: 5771105 - DNA, 20 bp, Homo sapiens
ggcccagcagcttggctgag

SEQ ID NO: 5771106 - DNA, 14 bp, Homo sapiens
ggcccagcaggcag

SEQ ID NO: 5771107 - DNA, 13 bp, Homo sapiens
ggcccagcaggcg

SEQ ID NO: 5771108 - DNA, 15 bp, Homo sapiens
ggcccagcaggggcc

SEQ ID NO: 5771109 - DNA, 20 bp, Homo sapiens
ggcccagcattgctggttct

SEQ ID NO: 5771110 - DNA, 15 bp, Homo sapiens
ggcccagccactgca

SEQ ID NO: 5771111 - DNA, 12 bp, Homo sapiens
ggcccagccagc

SEQ ID NO: 5771112 - DNA, 15 bp, Homo sapiens
ggcccagccagcagg

SEQ ID NO: 5771113 - DNA, 17 bp, Homo sapiens
ggcccagccagccagga

SEQ ID NO: 5771114 - DNA, 14 bp, Homo sapiens
ggcccagccaggag

SEQ ID NO: 5771115 - DNA, 16 bp, Homo sapiens
ggcccagccagggtgt

SEQ ID NO: 5771116 - DNA, 19 bp, Homo sapiens
ggcccagccagttggtggg

SEQ ID NO: 5771117 - DNA, 15 bp, Homo sapiens
ggcccagccatggct

SEQ ID NO: 5771118 - DNA, 18 bp, Homo sapiens
ggcccagccatggctgga

SEQ ID NO: 5771119 - DNA, 21 bp, Homo sapiens
ggcccagccatgggccctctg

SEQ ID NO: 5771120 - DNA, 23 bp, Homo sapiens
ggcccagccatgggccctctgag

SEQ ID NO: 5771121 - DNA, 12 bp, Homo sapiens
ggcccagcccag

SEQ ID NO: 5771122 - DNA, 17 bp, Homo sapiens
ggcccagcccccacagt

SEQ ID NO: 5771123 - DNA, 12 bp, Homo sapiens
ggcccagcccct

SEQ ID NO: 5771124 - DNA, 14 bp, Homo sapiens
ggcccagcccctag

SEQ ID NO: 5771125 - DNA, 24 bp, Homo sapiens
ggcccagcccctagaaacccaagc

SEQ ID NO: 5771126 - DNA, 11 bp, Homo sapiens
ggcccagcccg

SEQ ID NO: 5771127 - DNA, 14 bp, Homo sapiens
ggcccagcccggct

SEQ ID NO: 5771128 - DNA, 15 bp, Homo sapiens
ggcccagcccggctc

SEQ ID NO: 5771129 - DNA, 16 bp, Homo sapiens
ggcccagcccggctcc

SEQ ID NO: 5771130 - DNA, 12 bp, Homo sapiens
ggcccagccctc

SEQ ID NO: 5771131 - DNA, 13 bp, Homo sapiens
ggcccagccctcc

SEQ ID NO: 5771132 - DNA, 14 bp, Homo sapiens
ggcccagccctgct

SEQ ID NO: 5771133 - DNA, 15 bp, Homo sapiens
ggcccagccctgctg

SEQ ID NO: 5771134 - DNA, 13 bp, Homo sapiens
ggcccagccctgg

SEQ ID NO: 5771135 - DNA, 16 bp, Homo sapiens
ggcccagccggcctct

SEQ ID NO: 5771136 - DNA, 17 bp, Homo sapiens
ggcccagccggcctctc

SEQ ID NO: 5771137 - DNA, 22 bp, Homo sapiens
ggcccagccggcctctctggcc

SEQ ID NO: 5771138 - DNA, 19 bp, Homo sapiens
ggcccagcctctctggctc

SEQ ID NO: 5771139 - DNA, 23 bp, Homo sapiens
ggcccagcctctctggctcagcc

SEQ ID NO: 5771140 - DNA, 17 bp, Homo sapiens
ggcccagcctctgcccc

SEQ ID NO: 5771141 - DNA, 23 bp, Homo sapiens
ggcccagcctctgccccacccat

SEQ ID NO: 5771142 - DNA, 14 bp, Homo sapiens
ggcccagcctcttg

SEQ ID NO: 5771143 - DNA, 15 bp, Homo sapiens
ggcccagcctcttgt

SEQ ID NO: 5771144 - DNA, 11 bp, Homo sapiens
ggcccagcctg

SEQ ID NO: 5771145 - DNA, 18 bp, Homo sapiens
ggcccagcctggccccaa

SEQ ID NO: 5771146 - DNA, 21 bp, Homo sapiens
ggcccagcctgtggcctcagc

SEQ ID NO: 5771147 - DNA, 15 bp, Homo sapiens
ggcccagcgcggcca

SEQ ID NO: 5771148 - DNA, 17 bp, Homo sapiens
ggcccagcgcggccagc

SEQ ID NO: 5771149 - DNA, 21 bp, Homo sapiens
ggcccagcgcggccagcgtcc

SEQ ID NO: 5771150 - DNA, 19 bp, Homo sapiens
ggcccagcgctctcctgga

SEQ ID NO: 5771151 - DNA, 16 bp, Homo sapiens
ggcccagcgggcagat

SEQ ID NO: 5771152 - DNA, 16 bp, Homo sapiens
ggcccagcggtccctg

SEQ ID NO: 5771153 - DNA, 15 bp, Homo sapiens
ggcccagctcctcac

SEQ ID NO: 5771154 - DNA, 12 bp, Homo sapiens
ggcccagctgcc

SEQ ID NO: 5771155 - DNA, 16 bp, Homo sapiens
ggcccagctgccaggg

SEQ ID NO: 5771156 - DNA, 21 bp, Homo sapiens
ggcccagctgggctctgccac

SEQ ID NO: 5771157 - DNA, 15 bp, Homo sapiens
ggcccagctgtagcc

SEQ ID NO: 5771158 - DNA, 20 bp, Homo sapiens
ggcccagctgtagccatggc

SEQ ID NO: 5771159 - DNA, 22 bp, Homo sapiens
ggcccaggaaggcggcaggcag

SEQ ID NO: 5771160 - DNA, 18 bp, Homo sapiens
ggcccaggaccagctggg

SEQ ID NO: 5771161 - DNA, 16 bp, Homo sapiens
ggcccaggagacctcc

SEQ ID NO: 5771162 - DNA, 20 bp, Homo sapiens
ggcccaggagacctccagct

SEQ ID NO: 5771163 - DNA, 13 bp, Homo sapiens
ggcccaggagcgc

SEQ ID NO: 5771164 - DNA, 12 bp, Homo sapiens
ggcccaggagct

SEQ ID NO: 5771165 - DNA, 13 bp, Homo sapiens
ggcccaggagctc

SEQ ID NO: 5771166 - DNA, 17 bp, Homo sapiens
ggcccaggagctctgcg

SEQ ID NO: 5771167 - DNA, 18 bp, Homo sapiens
ggcccaggagctctgcgc

SEQ ID NO: 5771168 - DNA, 23 bp, Homo sapiens
ggcccaggagctctgcgccaggc

SEQ ID NO: 5771169 - DNA, 23 bp, Homo sapiens
ggcccaggaggaggattgtgctg

SEQ ID NO: 5771170 - DNA, 19 bp, Homo sapiens
ggcccaggagtccaggccc

SEQ ID NO: 5771171 - DNA, 13 bp, Homo sapiens
ggcccaggagttt

SEQ ID NO: 5771172 - DNA, 22 bp, Homo sapiens
ggcccaggagtttggccagaag

SEQ ID NO: 5771173 - DNA, 21 bp, Homo sapiens
ggcccaggcaccaccaggagc

SEQ ID NO: 5771174 - DNA, 22 bp, Homo sapiens
ggcccaggcaccaccaggagca

SEQ ID NO: 5771175 - DNA, 23 bp, Homo sapiens
ggcccaggcaccaccaggagcag

SEQ ID NO: 5771176 - DNA, 16 bp, Homo sapiens
ggcccaggcagagctg

SEQ ID NO: 5771177 - DNA, 13 bp, Homo sapiens
ggcccaggcagca

SEQ ID NO: 5771178 - DNA, 15 bp, Homo sapiens
ggcccaggcagcctc

SEQ ID NO: 5771179 - DNA, 21 bp, Homo sapiens
ggcccaggcaggcccagcctc

SEQ ID NO: 5771180 - DNA, 13 bp, Homo sapiens
ggcccaggcaggt

SEQ ID NO: 5771181 - DNA, 15 bp, Homo sapiens
ggcccaggcaggtct

SEQ ID NO: 5771182 - DNA, 18 bp, Homo sapiens
ggcccaggcaggtctgca

SEQ ID NO: 5771183 - DNA, 11 bp, Homo sapiens
ggcccaggcca

SEQ ID NO: 5771184 - DNA, 15 bp, Homo sapiens
ggcccaggccagccc

SEQ ID NO: 5771185 - DNA, 17 bp, Homo sapiens
ggcccaggccagccccc

SEQ ID NO: 5771186 - DNA, 13 bp, Homo sapiens
ggcccaggcccag

SEQ ID NO: 5771187 - DNA, 14 bp, Homo sapiens
ggcccaggcccagc

SEQ ID NO: 5771188 - DNA, 15 bp, Homo sapiens
ggcccaggcccccgg

SEQ ID NO: 5771189 - DNA, 11 bp, Homo sapiens
ggcccaggcct

SEQ ID NO: 5771190 - DNA, 17 bp, Homo sapiens
ggcccaggcctggagcg

SEQ ID NO: 5771191 - DNA, 16 bp, Homo sapiens
ggcccaggcctgggtt

SEQ ID NO: 5771192 - DNA, 16 bp, Homo sapiens
ggcccaggccttgctg

SEQ ID NO: 5771193 - DNA, 11 bp, Homo sapiens
ggcccaggctc

SEQ ID NO: 5771194 - DNA, 19 bp, Homo sapiens
ggcccaggctctgggaagg

SEQ ID NO: 5771195 - DNA, 15 bp, Homo sapiens
ggcccaggctggccc

SEQ ID NO: 5771196 - DNA, 14 bp, Homo sapiens
ggcccaggctggga

SEQ ID NO: 5771197 - DNA, 20 bp, Homo sapiens
ggcccagggaatcagggagc

SEQ ID NO: 5771198 - DNA, 11 bp, Homo sapiens
ggcccagggac

SEQ ID NO: 5771199 - DNA, 15 bp, Homo sapiens
ggcccagggaggcag

SEQ ID NO: 5771200 - DNA, 17 bp, Homo sapiens
ggcccagggaggcagcg

SEQ ID NO: 5771201 - DNA, 17 bp, Homo sapiens
ggcccagggaggtggca

SEQ ID NO: 5771202 - DNA, 12 bp, Homo sapiens
ggcccagggcat

SEQ ID NO: 5771203 - DNA, 15 bp, Homo sapiens
ggcccagggcccaga

SEQ ID NO: 5771204 - DNA, 18 bp, Homo sapiens
ggcccagggcccagagcc

SEQ ID NO: 5771205 - DNA, 13 bp, Homo sapiens
ggcccaggggctt

SEQ ID NO: 5771206 - DNA, 15 bp, Homo sapiens
ggcccaggggctttg

SEQ ID NO: 5771207 - DNA, 15 bp, Homo sapiens
ggcccagggggcctg

SEQ ID NO: 5771208 - DNA, 19 bp, Homo sapiens
ggcccagggggcctggagc

SEQ ID NO: 5771209 - DNA, 21 bp, Homo sapiens
ggcccaggggtggggcccatg

SEQ ID NO: 5771210 - DNA, 11 bp, Homo sapiens
ggcccagggtg

SEQ ID NO: 5771211 - DNA, 14 bp, Homo sapiens
ggcccagggtgttt

SEQ ID NO: 5771212 - DNA, 19 bp, Homo sapiens
ggcccaggtaacatgttta

SEQ ID NO: 5771213 - DNA, 20 bp, Homo sapiens
ggcccaggtcagccactgtt

SEQ ID NO: 5771214 - DNA, 15 bp, Homo sapiens
ggcccaggtgagtcc

SEQ ID NO: 5771215 - DNA, 16 bp, Homo sapiens
ggcccagtagccccaa

SEQ ID NO: 5771216 - DNA, 20 bp, Homo sapiens
ggcccagtccactggggagt

SEQ ID NO: 5771217 - DNA, 14 bp, Homo sapiens
ggcccagtcctggc

SEQ ID NO: 5771218 - DNA, 16 bp, Homo sapiens
ggcccagtccttggct

SEQ ID NO: 5771219 - DNA, 21 bp, Homo sapiens
ggcccagtccttggctgtatc

SEQ ID NO: 5771220 - DNA, 14 bp, Homo sapiens
ggcccagtgccccc

SEQ ID NO: 5771221 - DNA, 16 bp, Homo sapiens
ggcccagtgccccctg

SEQ ID NO: 5771222 - DNA, 16 bp, Homo sapiens
ggcccagtgctggcca

SEQ ID NO: 5771223 - DNA, 19 bp, Homo sapiens
ggcccagtgtcaagttgtg

SEQ ID NO: 5771224 - DNA, 22 bp, Homo sapiens
ggcccagtgtcaagttgtgctt

SEQ ID NO: 5771225 - DNA, 23 bp, Homo sapiens
ggcccagtgtcaagttgtgcttg

SEQ ID NO: 5771226 - DNA, 19 bp, Homo sapiens
ggcccagttctcgtgccct

SEQ ID NO: 5771227 - DNA, 21 bp, Homo sapiens
ggcccagttctcgtgccctta

SEQ ID NO: 5771228 - DNA, 22 bp, Homo sapiens
ggcccataccttctggttgctt

SEQ ID NO: 5771229 - DNA, 22 bp, Homo sapiens
ggcccatagaaacatgacactg

SEQ ID NO: 5771230 - DNA, 20 bp, Homo sapiens
ggcccatagccttggggttg

SEQ ID NO: 5771231 - DNA, 19 bp, Homo sapiens
ggcccatcactcggctgtg

SEQ ID NO: 5771232 - DNA, 20 bp, Homo sapiens
ggcccatcactcggctgtgg

SEQ ID NO: 5771233 - DNA, 23 bp, Homo sapiens
ggcccatcactcggctgtggaga

SEQ ID NO: 5771234 - DNA, 15 bp, Homo sapiens
ggcccatcaggcagt

SEQ ID NO: 5771235 - DNA, 22 bp, Homo sapiens
ggcccatcaggcagtgttacct

SEQ ID NO: 5771236 - DNA, 18 bp, Homo sapiens
ggcccatcaggggcagga

SEQ ID NO: 5771237 - DNA, 19 bp, Homo sapiens
ggcccatcaggggcaggaa

SEQ ID NO: 5771238 - DNA, 14 bp, Homo sapiens
ggcccatcatgggg

SEQ ID NO: 5771239 - DNA, 19 bp, Homo sapiens
ggcccatcatggggggagc

SEQ ID NO: 5771240 - DNA, 19 bp, Homo sapiens
ggcccatcccccctcacca

SEQ ID NO: 5771241 - DNA, 17 bp, Homo sapiens
ggcccatcccgccttct

SEQ ID NO: 5771242 - DNA, 20 bp, Homo sapiens
ggcccatcccgccttctcca

SEQ ID NO: 5771243 - DNA, 23 bp, Homo sapiens
ggcccatcccgccttctccaggc

SEQ ID NO: 5771244 - DNA, 11 bp, Homo sapiens
ggcccatctca

SEQ ID NO: 5771245 - DNA, 13 bp, Homo sapiens
ggcccatctcagg

SEQ ID NO: 5771246 - DNA, 14 bp, Homo sapiens
ggcccatctccctg

SEQ ID NO: 5771247 - DNA, 19 bp, Homo sapiens
ggcccatctccctgctttg

SEQ ID NO: 5771248 - DNA, 21 bp, Homo sapiens
ggcccatctctccctgcgcac

SEQ ID NO: 5771249 - DNA, 20 bp, Homo sapiens
ggcccatctgtccatcctcc

SEQ ID NO: 5771250 - DNA, 15 bp, Homo sapiens
ggcccatgccccctt

SEQ ID NO: 5771251 - DNA, 14 bp, Homo sapiens
ggcccatgccctcc

SEQ ID NO: 5771252 - DNA, 15 bp, Homo sapiens
ggcccatggccccag

SEQ ID NO: 5771253 - DNA, 17 bp, Homo sapiens
ggcccatggccccagct

SEQ ID NO: 5771254 - DNA, 17 bp, Homo sapiens
ggcccatggccttgggc

SEQ ID NO: 5771255 - DNA, 20 bp, Homo sapiens
ggcccatggccttgggctct

SEQ ID NO: 5771256 - DNA, 17 bp, Homo sapiens
ggcccatgggcagaaga

SEQ ID NO: 5771257 - DNA, 17 bp, Homo sapiens
ggcccatggggtctctg

SEQ ID NO: 5771258 - DNA, 21 bp, Homo sapiens
ggcccatgtatggccaggaag

SEQ ID NO: 5771259 - DNA, 21 bp, Homo sapiens
ggcccattcagagctatggtg

SEQ ID NO: 5771260 - DNA, 15 bp, Homo sapiens
ggcccattctacttg

SEQ ID NO: 5771261 - DNA, 19 bp, Homo sapiens
ggcccattctacttgctct

SEQ ID NO: 5771262 - DNA, 23 bp, Homo sapiens
ggcccattctacttgctctggac

SEQ ID NO: 5771263 - DNA, 21 bp, Homo sapiens
ggcccattggagcacctgggc

SEQ ID NO: 5771264 - DNA, 23 bp, Homo sapiens
ggcccattggagcacctgggccc

SEQ ID NO: 5771265 - DNA, 16 bp, Homo sapiens
ggcccatttaatgatt

SEQ ID NO: 5771266 - DNA, 11 bp, Homo sapiens
ggccccaaagc

SEQ ID NO: 5771267 - DNA, 16 bp, Homo sapiens
ggccccaaagcccagc

SEQ ID NO: 5771268 - DNA, 19 bp, Homo sapiens
ggccccaaccctgtcctcc

SEQ ID NO: 5771269 - DNA, 17 bp, Homo sapiens
ggccccaactacacacc

SEQ ID NO: 5771270 - DNA, 18 bp, Homo sapiens
ggccccaactcgggctcc

SEQ ID NO: 5771271 - DNA, 13 bp, Homo sapiens
ggccccacaccag

SEQ ID NO: 5771272 - DNA, 14 bp, Homo sapiens
ggccccacaggagt

SEQ ID NO: 5771273 - DNA, 16 bp, Homo sapiens
ggccccacagtggtca

SEQ ID NO: 5771274 - DNA, 13 bp, Homo sapiens
ggccccacatggg

SEQ ID NO: 5771275 - DNA, 14 bp, Homo sapiens
ggccccaccaccta

SEQ ID NO: 5771276 - DNA, 15 bp, Homo sapiens
ggccccaccagtgcc

SEQ ID NO: 5771277 - DNA, 21 bp, Homo sapiens
ggccccacccaccctctggtc

SEQ ID NO: 5771278 - DNA, 17 bp, Homo sapiens
ggccccaccccctgggc

SEQ ID NO: 5771279 - DNA, 16 bp, Homo sapiens
ggccccaccccttccc

SEQ ID NO: 5771280 - DNA, 23 bp, Homo sapiens
ggccccaccctcgtggacacctg

SEQ ID NO: 5771281 - DNA, 15 bp, Homo sapiens
ggccccaccctgggc

SEQ ID NO: 5771282 - DNA, 12 bp, Homo sapiens
ggccccaccggc

SEQ ID NO: 5771283 - DNA, 16 bp, Homo sapiens
ggccccaccggccagg

SEQ ID NO: 5771284 - DNA, 21 bp, Homo sapiens
ggccccacctacttgtgactg

SEQ ID NO: 5771285 - DNA, 19 bp, Homo sapiens
ggccccacctcggcacaca

SEQ ID NO: 5771286 - DNA, 20 bp, Homo sapiens
ggccccacctcggcacacac

SEQ ID NO: 5771287 - DNA, 23 bp, Homo sapiens
ggccccacctcggcacacactgt

SEQ ID NO: 5771288 - DNA, 16 bp, Homo sapiens
ggccccacctgcagct

SEQ ID NO: 5771289 - DNA, 17 bp, Homo sapiens
ggccccacctgtgtccc

SEQ ID NO: 5771290 - DNA, 15 bp, Homo sapiens
ggccccacgccctct

SEQ ID NO: 5771291 - DNA, 13 bp, Homo sapiens
ggccccactggac

SEQ ID NO: 5771292 - DNA, 14 bp, Homo sapiens
ggccccactggaca

SEQ ID NO: 5771293 - DNA, 15 bp, Homo sapiens
ggccccactggacaa

SEQ ID NO: 5771294 - DNA, 17 bp, Homo sapiens
ggccccactggacaaca

SEQ ID NO: 5771295 - DNA, 21 bp, Homo sapiens
ggccccactggacaacactga

SEQ ID NO: 5771296 - DNA, 13 bp, Homo sapiens
ggccccactggct

SEQ ID NO: 5771297 - DNA, 19 bp, Homo sapiens
ggccccactttgaagggca

SEQ ID NO: 5771298 - DNA, 19 bp, Homo sapiens
ggccccagaaggcagggaa

SEQ ID NO: 5771299 - DNA, 18 bp, Homo sapiens
ggccccagaccccagggc

SEQ ID NO: 5771300 - DNA, 19 bp, Homo sapiens
ggccccagacgcatagact

SEQ ID NO: 5771301 - DNA, 14 bp, Homo sapiens
ggccccagagactc

SEQ ID NO: 5771302 - DNA, 14 bp, Homo sapiens
ggccccagaggccc

SEQ ID NO: 5771303 - DNA, 18 bp, Homo sapiens
ggccccagaggccctgga

SEQ ID NO: 5771304 - DNA, 19 bp, Homo sapiens
ggccccagaggccctggag

SEQ ID NO: 5771305 - DNA, 21 bp, Homo sapiens
ggccccagaggccctggaggt

SEQ ID NO: 5771306 - DNA, 15 bp, Homo sapiens
ggccccagatctgcc

SEQ ID NO: 5771307 - DNA, 23 bp, Homo sapiens
ggccccagatctgcctgggcctg

SEQ ID NO: 5771308 - DNA, 21 bp, Homo sapiens
ggccccagcaacacgtcattg

SEQ ID NO: 5771309 - DNA, 15 bp, Homo sapiens
ggccccagcacagct

SEQ ID NO: 5771310 - DNA, 20 bp, Homo sapiens
ggccccagcacctcagcctg

SEQ ID NO: 5771311 - DNA, 21 bp, Homo sapiens
ggccccagccctgctggggat

SEQ ID NO: 5771312 - DNA, 12 bp, Homo sapiens
ggccccagcctg

SEQ ID NO: 5771313 - DNA, 16 bp, Homo sapiens
ggccccagcctggccc

SEQ ID NO: 5771314 - DNA, 20 bp, Homo sapiens
ggccccagcctggcccagct

SEQ ID NO: 5771315 - DNA, 22 bp, Homo sapiens
ggccccagcctggcccagctcc

SEQ ID NO: 5771316 - DNA, 20 bp, Homo sapiens
ggccccagcgtctgcagggt

SEQ ID NO: 5771317 - DNA, 22 bp, Homo sapiens
ggccccagcgtctgcagggtga

SEQ ID NO: 5771318 - DNA, 14 bp, Homo sapiens
ggccccagctctga

SEQ ID NO: 5771319 - DNA, 15 bp, Homo sapiens
ggccccagctctgag

SEQ ID NO: 5771320 - DNA, 18 bp, Homo sapiens
ggccccagctggctgggt

SEQ ID NO: 5771321 - DNA, 19 bp, Homo sapiens
ggccccagctggctgggtc

SEQ ID NO: 5771322 - DNA, 16 bp, Homo sapiens
ggccccaggacctggc

SEQ ID NO: 5771323 - DNA, 21 bp, Homo sapiens
ggccccaggacctggctgcca

SEQ ID NO: 5771324 - DNA, 22 bp, Homo sapiens
ggccccaggcggaggggcttgg

SEQ ID NO: 5771325 - DNA, 15 bp, Homo sapiens
ggccccaggctggat

SEQ ID NO: 5771326 - DNA, 12 bp, Homo sapiens
ggccccagggac

SEQ ID NO: 5771327 - DNA, 18 bp, Homo sapiens
ggccccagggacagaggc

SEQ ID NO: 5771328 - DNA, 13 bp, Homo sapiens
ggccccagggcac

SEQ ID NO: 5771329 - DNA, 17 bp, Homo sapiens
ggccccagggctaccct

SEQ ID NO: 5771330 - DNA, 15 bp, Homo sapiens
ggccccaggggcagc

SEQ ID NO: 5771331 - DNA, 18 bp, Homo sapiens
ggccccaggggcagcaag

SEQ ID NO: 5771332 - DNA, 11 bp, Homo sapiens
ggccccaggtc

SEQ ID NO: 5771333 - DNA, 12 bp, Homo sapiens
ggccccaggtca

SEQ ID NO: 5771334 - DNA, 16 bp, Homo sapiens
ggccccagtcagcctc

SEQ ID NO: 5771335 - DNA, 17 bp, Homo sapiens
ggccccagtcagcctct

SEQ ID NO: 5771336 - DNA, 23 bp, Homo sapiens
ggccccagtcagcctctctccca

SEQ ID NO: 5771337 - DNA, 16 bp, Homo sapiens
ggccccatcagaggct

SEQ ID NO: 5771338 - DNA, 23 bp, Homo sapiens
ggccccatccaaccactgtacac

SEQ ID NO: 5771339 - DNA, 19 bp, Homo sapiens
ggccccatccagcatgtgt

SEQ ID NO: 5771340 - DNA, 21 bp, Homo sapiens
ggccccatcctcatccctgac

SEQ ID NO: 5771341 - DNA, 18 bp, Homo sapiens
ggccccatgacctccagc

SEQ ID NO: 5771342 - DNA, 22 bp, Homo sapiens
ggccccatgagggtgttttttt

SEQ ID NO: 5771343 - DNA, 12 bp, Homo sapiens
ggccccatgctc

SEQ ID NO: 5771344 - DNA, 18 bp, Homo sapiens
ggccccatgctctgcccc

SEQ ID NO: 5771345 - DNA, 22 bp, Homo sapiens
ggccccattcagaactctcaga

SEQ ID NO: 5771346 - DNA, 23 bp, Homo sapiens
ggccccattcagaactctcagac

SEQ ID NO: 5771347 - DNA, 22 bp, Homo sapiens
ggccccattctccctccatggc

SEQ ID NO: 5771348 - DNA, 21 bp, Homo sapiens
ggcccccaacccctcctccct

SEQ ID NO: 5771349 - DNA, 21 bp, Homo sapiens
ggcccccaataaaccagtgtg

SEQ ID NO: 5771350 - DNA, 15 bp, Homo sapiens
ggcccccaataaagg

SEQ ID NO: 5771351 - DNA, 16 bp, Homo sapiens
ggcccccaataaaggc

SEQ ID NO: 5771352 - DNA, 17 bp, Homo sapiens
ggcccccaataaaggca

SEQ ID NO: 5771353 - DNA, 20 bp, Homo sapiens
ggcccccaataaaggcagct

SEQ ID NO: 5771354 - DNA, 22 bp, Homo sapiens
ggcccccaataaaggcagctgc

SEQ ID NO: 5771355 - DNA, 23 bp, Homo sapiens
ggcccccaataaaggcagctgcc

SEQ ID NO: 5771356 - DNA, 11 bp, Homo sapiens
ggcccccacag

SEQ ID NO: 5771357 - DNA, 15 bp, Homo sapiens
ggcccccacagcgct

SEQ ID NO: 5771358 - DNA, 21 bp, Homo sapiens
ggcccccacaggccccccgca

SEQ ID NO: 5771359 - DNA, 17 bp, Homo sapiens
ggcccccacaggggatg

SEQ ID NO: 5771360 - DNA, 11 bp, Homo sapiens
ggcccccaccg

SEQ ID NO: 5771361 - DNA, 13 bp, Homo sapiens
ggcccccaccgcc

SEQ ID NO: 5771362 - DNA, 16 bp, Homo sapiens
ggcccccactggctgt

SEQ ID NO: 5771363 - DNA, 18 bp, Homo sapiens
ggcccccactggctgtgg

SEQ ID NO: 5771364 - DNA, 15 bp, Homo sapiens
ggcccccacttgcct

SEQ ID NO: 5771365 - DNA, 18 bp, Homo sapiens
ggcccccacttgcctctt

SEQ ID NO: 5771366 - DNA, 13 bp, Homo sapiens
ggcccccagagac

SEQ ID NO: 5771367 - DNA, 23 bp, Homo sapiens
ggcccccagcccagggctcctgc

SEQ ID NO: 5771368 - DNA, 21 bp, Homo sapiens
ggcccccagcccctcctccct

SEQ ID NO: 5771369 - DNA, 14 bp, Homo sapiens
ggcccccagcctgg

SEQ ID NO: 5771370 - DNA, 16 bp, Homo sapiens
ggcccccagcctggcc

SEQ ID NO: 5771371 - DNA, 18 bp, Homo sapiens
ggcccccagcctggccag

SEQ ID NO: 5771372 - DNA, 12 bp, Homo sapiens
ggcccccagctg

SEQ ID NO: 5771373 - DNA, 22 bp, Homo sapiens
ggcccccagtgggaccacatgc

SEQ ID NO: 5771374 - DNA, 19 bp, Homo sapiens
ggcccccagtggggacagg

SEQ ID NO: 5771375 - DNA, 21 bp, Homo sapiens
ggcccccatctcatgcccctg

SEQ ID NO: 5771376 - DNA, 13 bp, Homo sapiens
ggcccccatcttg

SEQ ID NO: 5771377 - DNA, 13 bp, Homo sapiens
ggccccccactcc

SEQ ID NO: 5771378 - DNA, 22 bp, Homo sapiens
ggccccccactcccccttccct

SEQ ID NO: 5771379 - DNA, 19 bp, Homo sapiens
ggccccccagaaagctgcc

SEQ ID NO: 5771380 - DNA, 21 bp, Homo sapiens
ggccccccagctcaggggcag

SEQ ID NO: 5771381 - DNA, 16 bp, Homo sapiens
ggcccccccagcccca

SEQ ID NO: 5771382 - DNA, 22 bp, Homo sapiens
ggcccccccagccccacaccct

SEQ ID NO: 5771383 - DNA, 21 bp, Homo sapiens
ggccccccctcttttggcctt

SEQ ID NO: 5771384 - DNA, 22 bp, Homo sapiens
ggccccccctcttttggccttg

SEQ ID NO: 5771385 - DNA, 21 bp, Homo sapiens
ggccccccgcgctcgcccagc

SEQ ID NO: 5771386 - DNA, 12 bp, Homo sapiens
ggcccccctcca

SEQ ID NO: 5771387 - DNA, 14 bp, Homo sapiens
ggcccccctccagg

SEQ ID NO: 5771388 - DNA, 20 bp, Homo sapiens
ggcccccctccttgctctgc

SEQ ID NO: 5771389 - DNA, 14 bp, Homo sapiens
ggcccccctctgcc

SEQ ID NO: 5771390 - DNA, 16 bp, Homo sapiens
ggcccccctgccctgt

SEQ ID NO: 5771391 - DNA, 19 bp, Homo sapiens
ggcccccgcccagccccag

SEQ ID NO: 5771392 - DNA, 14 bp, Homo sapiens
ggcccccgccctct

SEQ ID NO: 5771393 - DNA, 17 bp, Homo sapiens
ggcccccgccctctgcc

SEQ ID NO: 5771394 - DNA, 21 bp, Homo sapiens
ggcccgcttgcctcggctcct

SEQ ID NO: 5771395 - DNA, 18 bp, Homo sapiens
ggcccgctttgcctgctt

SEQ ID NO: 5771396 - DNA, 14 bp, Homo sapiens
ggcccggagcagca

SEQ ID NO: 5771397 - DNA, 23 bp, Homo sapiens
ggcccggagctgcccctctctgg

SEQ ID NO: 5771398 - DNA, 20 bp, Homo sapiens
ggcccggagtaatcaggcag

SEQ ID NO: 5771399 - DNA, 15 bp, Homo sapiens
ggcccggatccagga

SEQ ID NO: 5771400 - DNA, 17 bp, Homo sapiens
ggcccggatgctgcttc

SEQ ID NO: 5771401 - DNA, 14 bp, Homo sapiens
ggcccggcagggcg

SEQ ID NO: 5771402 - DNA, 15 bp, Homo sapiens
ggcccggcatgaggc

SEQ ID NO: 5771403 - DNA, 18 bp, Homo sapiens
ggcccggccacacccagc

SEQ ID NO: 5771404 - DNA, 20 bp, Homo sapiens
ggcccggccacacccagcgg

SEQ ID NO: 5771405 - DNA, 20 bp, Homo sapiens
ggcccggccagccatgtctg

SEQ ID NO: 5771406 - DNA, 21 bp, Homo sapiens
ggcccggccagcgggcacagg

SEQ ID NO: 5771407 - DNA, 13 bp, Homo sapiens
ggcccggcccacg

SEQ ID NO: 5771408 - DNA, 16 bp, Homo sapiens
ggcccggcccacgcag

SEQ ID NO: 5771409 - DNA, 17 bp, Homo sapiens
ggcccggcccacgcaga

SEQ ID NO: 5771410 - DNA, 22 bp, Homo sapiens
ggcccggcccacgcagagcccc

SEQ ID NO: 5771411 - DNA, 16 bp, Homo sapiens
ggcccggcccctcacc

SEQ ID NO: 5771412 - DNA, 16 bp, Homo sapiens
ggcccggcccctcctg

SEQ ID NO: 5771413 - DNA, 17 bp, Homo sapiens
ggcccggccggcctggc

SEQ ID NO: 5771414 - DNA, 13 bp, Homo sapiens
ggcccggctccag

SEQ ID NO: 5771415 - DNA, 15 bp, Homo sapiens
ggcccggctgagccc

SEQ ID NO: 5771416 - DNA, 20 bp, Homo sapiens
ggcccggctgagccccccat

SEQ ID NO: 5771417 - DNA, 15 bp, Homo sapiens
ggcccggctgggccc

SEQ ID NO: 5771418 - DNA, 16 bp, Homo sapiens
ggcccggctgggcccc

SEQ ID NO: 5771419 - DNA, 17 bp, Homo sapiens
ggcccggctgggcccga

SEQ ID NO: 5771420 - DNA, 22 bp, Homo sapiens
ggcccgggaggaggatccgggc

SEQ ID NO: 5771421 - DNA, 14 bp, Homo sapiens
ggcccgggcaccca

SEQ ID NO: 5771422 - DNA, 13 bp, Homo sapiens
ggcccgggcaggc

SEQ ID NO: 5771423 - DNA, 16 bp, Homo sapiens
ggcccgggcaggccag

SEQ ID NO: 5771424 - DNA, 16 bp, Homo sapiens
ggcccgggcccccgcc

SEQ ID NO: 5771425 - DNA, 13 bp, Homo sapiens
ggcccggggctgg

SEQ ID NO: 5771426 - DNA, 12 bp, Homo sapiens
ggcccggtccac

SEQ ID NO: 5771427 - DNA, 13 bp, Homo sapiens
ggcccggtccaca

SEQ ID NO: 5771428 - DNA, 16 bp, Homo sapiens
ggcccggtccacaggt

SEQ ID NO: 5771429 - DNA, 19 bp, Homo sapiens
ggcccggtccacaggtcca

SEQ ID NO: 5771430 - DNA, 23 bp, Homo sapiens
ggcccggtcccagtccggtgcct

SEQ ID NO: 5771431 - DNA, 14 bp, Homo sapiens
ggcccggtgcagct

SEQ ID NO: 5771432 - DNA, 16 bp, Homo sapiens
ggcccggtggcggcag

SEQ ID NO: 5771433 - DNA, 20 bp, Homo sapiens
ggcccgtcagcatcactgat

SEQ ID NO: 5771434 - DNA, 23 bp, Homo sapiens
ggcccgtcagcatcactgatggg

SEQ ID NO: 5771435 - DNA, 15 bp, Homo sapiens
ggcccgtcggagctg

SEQ ID NO: 5771436 - DNA, 21 bp, Homo sapiens
ggcccgtcggagctgcctgca

SEQ ID NO: 5771437 - DNA, 20 bp, Homo sapiens
ggcccgtctgtccatctgcc

SEQ ID NO: 5771438 - DNA, 14 bp, Homo sapiens
ggcccgtgcgcagc

SEQ ID NO: 5771439 - DNA, 15 bp, Homo sapiens
ggcccgtgcgcagcc

SEQ ID NO: 5771440 - DNA, 18 bp, Homo sapiens
ggcccgtggcctggcatc

SEQ ID NO: 5771441 - DNA, 21 bp, Homo sapiens
ggcccgtggcttggcatctgt

SEQ ID NO: 5771442 - DNA, 20 bp, Homo sapiens
ggcccgttgaggatgaggcc

SEQ ID NO: 5771443 - DNA, 19 bp, Homo sapiens
ggcccgttgtctccctggc

SEQ ID NO: 5771444 - DNA, 21 bp, Homo sapiens
ggccctaattcagccatgtac

SEQ ID NO: 5771445 - DNA, 15 bp, Homo sapiens
ggccctaccagaggg

SEQ ID NO: 5771446 - DNA, 13 bp, Homo sapiens
ggccctaccctcc

SEQ ID NO: 5771447 - DNA, 13 bp, Homo sapiens
ggccctacctggg

SEQ ID NO: 5771448 - DNA, 22 bp, Homo sapiens
ggccctagaagatcacagcagg

SEQ ID NO: 5771449 - DNA, 22 bp, Homo sapiens
ggccctagactcggggtgcttc

SEQ ID NO: 5771450 - DNA, 13 bp, Homo sapiens
ggccctagaggac

SEQ ID NO: 5771451 - DNA, 13 bp, Homo sapiens
ggccctaggcact

SEQ ID NO: 5771452 - DNA, 18 bp, Homo sapiens
ggccctaggcccctccta

SEQ ID NO: 5771453 - DNA, 16 bp, Homo sapiens
ggccctcaaggcctcc

SEQ ID NO: 5771454 - DNA, 19 bp, Homo sapiens
ggccctcaaggcctcccac

SEQ ID NO: 5771455 - DNA, 18 bp, Homo sapiens
ggccctcactaagccccg

SEQ ID NO: 5771456 - DNA, 12 bp, Homo sapiens
ggccctcactca

SEQ ID NO: 5771457 - DNA, 13 bp, Homo sapiens
ggccctcagagga

SEQ ID NO: 5771458 - DNA, 14 bp, Homo sapiens
ggccctcagaggaa

SEQ ID NO: 5771459 - DNA, 12 bp, Homo sapiens
ggccctcagcat

SEQ ID NO: 5771460 - DNA, 20 bp, Homo sapiens
ggccctcagcatatttgtat

SEQ ID NO: 5771461 - DNA, 14 bp, Homo sapiens
ggccctcagccctc

SEQ ID NO: 5771462 - DNA, 17 bp, Homo sapiens
ggccctcagcgtctccc

SEQ ID NO: 5771463 - DNA, 22 bp, Homo sapiens
ggccctcagcgtctccccatgc

SEQ ID NO: 5771464 - DNA, 12 bp, Homo sapiens
ggccctcaggcc

SEQ ID NO: 5771465 - DNA, 18 bp, Homo sapiens
ggccctcaggccattccc

SEQ ID NO: 5771466 - DNA, 16 bp, Homo sapiens
ggccctccacacctgc

SEQ ID NO: 5771467 - DNA, 23 bp, Homo sapiens
ggccctccagagccccacagccc

SEQ ID NO: 5771468 - DNA, 14 bp, Homo sapiens
ggccctccatgggc

SEQ ID NO: 5771469 - DNA, 18 bp, Homo sapiens
ggccctcccaaagaggcc

SEQ ID NO: 5771470 - DNA, 11 bp, Homo sapiens
ggccctcccac

SEQ ID NO: 5771471 - DNA, 21 bp, Homo sapiens
ggccctcccagaacctcagca

SEQ ID NO: 5771472 - DNA, 14 bp, Homo sapiens
ggccctcccagccc

SEQ ID NO: 5771473 - DNA, 12 bp, Homo sapiens
ggccctcccagt

SEQ ID NO: 5771474 - DNA, 14 bp, Homo sapiens
ggccctcccagtac

SEQ ID NO: 5771475 - DNA, 18 bp, Homo sapiens
ggccctcccccagctcct

SEQ ID NO: 5771476 - DNA, 11 bp, Homo sapiens
ggccctccctc

SEQ ID NO: 5771477 - DNA, 14 bp, Homo sapiens
ggccctccctccca

SEQ ID NO: 5771478 - DNA, 23 bp, Homo sapiens
ggccctccctcccagcgctctgg

SEQ ID NO: 5771479 - DNA, 18 bp, Homo sapiens
ggccctccctccctagcc

SEQ ID NO: 5771480 - DNA, 13 bp, Homo sapiens
ggccctccctcta

SEQ ID NO: 5771481 - DNA, 23 bp, Homo sapiens
ggccctccctgactccctgtggg

SEQ ID NO: 5771482 - DNA, 13 bp, Homo sapiens
ggccctccctgcg

SEQ ID NO: 5771483 - DNA, 19 bp, Homo sapiens
ggccctccctgtctccagg

SEQ ID NO: 5771484 - DNA, 22 bp, Homo sapiens
ggccctccctgttccccagaga

SEQ ID NO: 5771485 - DNA, 13 bp, Homo sapiens
ggccctcccttgg

SEQ ID NO: 5771486 - DNA, 15 bp, Homo sapiens
ggccctcccttggaa

SEQ ID NO: 5771487 - DNA, 20 bp, Homo sapiens
ggccctcctcagctccctgc

SEQ ID NO: 5771488 - DNA, 22 bp, Homo sapiens
ggccctcctgctggctgaggct

SEQ ID NO: 5771489 - DNA, 11 bp, Homo sapiens
ggccctcctgg

SEQ ID NO: 5771490 - DNA, 15 bp, Homo sapiens
ggccctcctgggcac

SEQ ID NO: 5771491 - DNA, 18 bp, Homo sapiens
ggccctccttccctcctg

SEQ ID NO: 5771492 - DNA, 22 bp, Homo sapiens
ggccctccttccctcctgtgcc

SEQ ID NO: 5771493 - DNA, 15 bp, Homo sapiens
ggccctcgacactca

SEQ ID NO: 5771494 - DNA, 23 bp, Homo sapiens
ggccctcgacactcaccatgaag

SEQ ID NO: 5771495 - DNA, 15 bp, Homo sapiens
ggccctcgctgccag

SEQ ID NO: 5771496 - DNA, 22 bp, Homo sapiens
ggccctcgctgccagctctgta

SEQ ID NO: 5771497 - DNA, 16 bp, Homo sapiens
ggccctcggagctggc

SEQ ID NO: 5771498 - DNA, 19 bp, Homo sapiens
ggccctcggagctggctgt

SEQ ID NO: 5771499 - DNA, 21 bp, Homo sapiens
ggccctcggagctggctgtgc

SEQ ID NO: 5771500 - DNA, 17 bp, Homo sapiens
ggccctcgggccctctc

SEQ ID NO: 5771501 - DNA, 12 bp, Homo sapiens
ggccctctcccc

SEQ ID NO: 5771502 - DNA, 20 bp, Homo sapiens
ggccctctctccgccccgga

SEQ ID NO: 5771503 - DNA, 21 bp, Homo sapiens
ggccctctcttaatgccacgg

SEQ ID NO: 5771504 - DNA, 20 bp, Homo sapiens
ggccctctcttctcaccttt

SEQ ID NO: 5771505 - DNA, 14 bp, Homo sapiens
ggccctctgaggct

SEQ ID NO: 5771506 - DNA, 20 bp, Homo sapiens
ggccctctgaggctcagccc

SEQ ID NO: 5771507 - DNA, 16 bp, Homo sapiens
ggccctctgcccactc

SEQ ID NO: 5771508 - DNA, 19 bp, Homo sapiens
ggccctctggagtggccac

SEQ ID NO: 5771509 - DNA, 14 bp, Homo sapiens
ggccctctggggct

SEQ ID NO: 5771510 - DNA, 20 bp, Homo sapiens
ggccctctggggctcagccc

SEQ ID NO: 5771511 - DNA, 14 bp, Homo sapiens
ggccctctgtagct

SEQ ID NO: 5771512 - DNA, 20 bp, Homo sapiens
ggccctctgtggcctgtctc

SEQ ID NO: 5771513 - DNA, 19 bp, Homo sapiens
ggccctcttcttattcatg

SEQ ID NO: 5771514 - DNA, 11 bp, Homo sapiens
ggccctcttgc

SEQ ID NO: 5771515 - DNA, 17 bp, Homo sapiens
ggccctcttgccagcct

SEQ ID NO: 5771516 - DNA, 18 bp, Homo sapiens
ggccctcttgccagcctc

SEQ ID NO: 5771517 - DNA, 21 bp, Homo sapiens
ggccctcttgccagcctcctt

SEQ ID NO: 5771518 - DNA, 21 bp, Homo sapiens
ggccctcttgcgggcctggac

SEQ ID NO: 5771519 - DNA, 17 bp, Homo sapiens
ggccctgaaatggcctg

SEQ ID NO: 5771520 - DNA, 16 bp, Homo sapiens
ggccctgaaccacgag

SEQ ID NO: 5771521 - DNA, 18 bp, Homo sapiens
ggccctgaaccacgaggc

SEQ ID NO: 5771522 - DNA, 13 bp, Homo sapiens
ggccctgaccccc

SEQ ID NO: 5771523 - DNA, 16 bp, Homo sapiens
ggccctgactcctctg

SEQ ID NO: 5771524 - DNA, 22 bp, Homo sapiens
ggccctgactcctctggctttc

SEQ ID NO: 5771525 - DNA, 14 bp, Homo sapiens
ggccctgagctgag

SEQ ID NO: 5771526 - DNA, 19 bp, Homo sapiens
ggccctgaggaataaagct

SEQ ID NO: 5771527 - DNA, 21 bp, Homo sapiens
ggccctgaggcggaggctgtg

SEQ ID NO: 5771528 - DNA, 15 bp, Homo sapiens
ggccctgaggtgtgg

SEQ ID NO: 5771529 - DNA, 17 bp, Homo sapiens
ggccctgaggtgtgggg

SEQ ID NO: 5771530 - DNA, 22 bp, Homo sapiens
ggccctgaggtgtgggggctgc

SEQ ID NO: 5771531 - DNA, 18 bp, Homo sapiens
ggccctgagtctgggcag

SEQ ID NO: 5771532 - DNA, 19 bp, Homo sapiens
ggccctgcaaaaggactct

SEQ ID NO: 5771533 - DNA, 20 bp, Homo sapiens
ggccctgcacagacctggag

SEQ ID NO: 5771534 - DNA, 14 bp, Homo sapiens
ggccctgcactgtc

SEQ ID NO: 5771535 - DNA, 17 bp, Homo sapiens
ggccctgcactgtcctg

SEQ ID NO: 5771536 - DNA, 19 bp, Homo sapiens
ggccctgcactgtcctgct

SEQ ID NO: 5771537 - DNA, 21 bp, Homo sapiens
ggccctgcactgtcctgctcc

SEQ ID NO: 5771538 - DNA, 15 bp, Homo sapiens
ggccctgcaggagca

SEQ ID NO: 5771539 - DNA, 20 bp, Homo sapiens
ggccctgcaggagcagggcg

SEQ ID NO: 5771540 - DNA, 14 bp, Homo sapiens
ggccctgcaggagg

SEQ ID NO: 5771541 - DNA, 15 bp, Homo sapiens
ggccctgcagtgttc

SEQ ID NO: 5771542 - DNA, 22 bp, Homo sapiens
ggccctgcagtgttcgcttggc

SEQ ID NO: 5771543 - DNA, 16 bp, Homo sapiens
ggccctgccagagcag

SEQ ID NO: 5771544 - DNA, 16 bp, Homo sapiens
ggccctgccattggcc

SEQ ID NO: 5771545 - DNA, 16 bp, Homo sapiens
ggccctgcccagccag

SEQ ID NO: 5771546 - DNA, 15 bp, Homo sapiens
ggccctgcccagccc

SEQ ID NO: 5771547 - DNA, 13 bp, Homo sapiens
ggccctgccccac

SEQ ID NO: 5771548 - DNA, 14 bp, Homo sapiens
ggccctgccccaca

SEQ ID NO: 5771549 - DNA, 16 bp, Homo sapiens
ggccctgccccacccc

SEQ ID NO: 5771550 - DNA, 17 bp, Homo sapiens
ggccctgccccacccca

SEQ ID NO: 5771551 - DNA, 17 bp, Homo sapiens
ggccctgccccagcccc

SEQ ID NO: 5771552 - DNA, 18 bp, Homo sapiens
ggccctgccccagcccct

SEQ ID NO: 5771553 - DNA, 19 bp, Homo sapiens
ggccctgccccatcctggg

SEQ ID NO: 5771554 - DNA, 12 bp, Homo sapiens
ggccctgccccc

SEQ ID NO: 5771555 - DNA, 13 bp, Homo sapiens
ggccctgccccca

SEQ ID NO: 5771556 - DNA, 14 bp, Homo sapiens
ggccctgcccctcc

SEQ ID NO: 5771557 - DNA, 18 bp, Homo sapiens
ggccctgcccctccccct

SEQ ID NO: 5771558 - DNA, 23 bp, Homo sapiens
ggccctgcccctccccctaccgc

SEQ ID NO: 5771559 - DNA, 13 bp, Homo sapiens
ggccctgccctcc

SEQ ID NO: 5771560 - DNA, 15 bp, Homo sapiens
ggccctgccctcccc

SEQ ID NO: 5771561 - DNA, 14 bp, Homo sapiens
ggccctgccctgag

SEQ ID NO: 5771562 - DNA, 19 bp, Homo sapiens
ggccctgccctgaggaagg

SEQ ID NO: 5771563 - DNA, 20 bp, Homo sapiens
ggccctgccctgcccaacct

SEQ ID NO: 5771564 - DNA, 13 bp, Homo sapiens
ggccctgccctgg

SEQ ID NO: 5771565 - DNA, 22 bp, Homo sapiens
ggccctgccctggtttcctgcc

SEQ ID NO: 5771566 - DNA, 18 bp, Homo sapiens
ggccctgcccttggcacc

SEQ ID NO: 5771567 - DNA, 19 bp, Homo sapiens
ggccctgcccttggcacca

SEQ ID NO: 5771568 - DNA, 21 bp, Homo sapiens
ggccctgcctgacccatccct

SEQ ID NO: 5771569 - DNA, 15 bp, Homo sapiens
ggccctgcctgaggg

SEQ ID NO: 5771570 - DNA, 16 bp, Homo sapiens
ggccctgcctgagggt

SEQ ID NO: 5771571 - DNA, 19 bp, Homo sapiens
ggccctgcctgcagccagg

SEQ ID NO: 5771572 - DNA, 16 bp, Homo sapiens
ggccctgcctgcctct

SEQ ID NO: 5771573 - DNA, 18 bp, Homo sapiens
ggccgcaagtccccagcc

SEQ ID NO: 5771574 - DNA, 18 bp, Homo sapiens
ggccgcactgggagcagc

SEQ ID NO: 5771575 - DNA, 12 bp, Homo sapiens
ggccgcagcccc

SEQ ID NO: 5771576 - DNA, 15 bp, Homo sapiens
ggccgcagcccccac

SEQ ID NO: 5771577 - DNA, 17 bp, Homo sapiens
ggccgcaggagggaggc

SEQ ID NO: 5771578 - DNA, 21 bp, Homo sapiens
ggccgcagggcccaccttgga

SEQ ID NO: 5771579 - DNA, 14 bp, Homo sapiens
ggccgcagggcgct

SEQ ID NO: 5771580 - DNA, 17 bp, Homo sapiens
ggccgcagggcgctccg

SEQ ID NO: 5771581 - DNA, 19 bp, Homo sapiens
ggccgcagggcgctccggc

SEQ ID NO: 5771582 - DNA, 18 bp, Homo sapiens
ggccgcagggcggggctg

SEQ ID NO: 5771583 - DNA, 13 bp, Homo sapiens
ggccgcatggccc

SEQ ID NO: 5771584 - DNA, 19 bp, Homo sapiens
ggccgcatggcccctccag

SEQ ID NO: 5771585 - DNA, 22 bp, Homo sapiens
ggccgcatggcccctccaggaa

SEQ ID NO: 5771586 - DNA, 16 bp, Homo sapiens
ggccgcattccctgag

SEQ ID NO: 5771587 - DNA, 16 bp, Homo sapiens
ggccgccatccgggac

SEQ ID NO: 5771588 - DNA, 21 bp, Homo sapiens
ggccgcccccacctgcggccg

SEQ ID NO: 5771589 - DNA, 16 bp, Homo sapiens
ggccgccccctgcccc

SEQ ID NO: 5771590 - DNA, 18 bp, Homo sapiens
ggccgccccctgcccccc

SEQ ID NO: 5771591 - DNA, 16 bp, Homo sapiens
ggccgcccctgaggct

SEQ ID NO: 5771592 - DNA, 16 bp, Homo sapiens
ggccgcccctggccac

SEQ ID NO: 5771593 - DNA, 17 bp, Homo sapiens
ggccgcccggcagtgca

SEQ ID NO: 5771594 - DNA, 14 bp, Homo sapiens
ggccgccctcggac

SEQ ID NO: 5771595 - DNA, 14 bp, Homo sapiens
ggccgcctgccctg

SEQ ID NO: 5771596 - DNA, 17 bp, Homo sapiens
ggccgcctgccctgcct

SEQ ID NO: 5771597 - DNA, 17 bp, Homo sapiens
ggccgcctgcgggctgc

SEQ ID NO: 5771598 - DNA, 13 bp, Homo sapiens
ggccgcctgggtc

SEQ ID NO: 5771599 - DNA, 13 bp, Homo sapiens
ggccgcctgtcct

SEQ ID NO: 5771600 - DNA, 15 bp, Homo sapiens
ggccgcctgtccttg

SEQ ID NO: 5771601 - DNA, 17 bp, Homo sapiens
ggccgccttctcccctc

SEQ ID NO: 5771602 - DNA, 18 bp, Homo sapiens
ggccgccttctcccctct

SEQ ID NO: 5771603 - DNA, 19 bp, Homo sapiens
ggccgccttctcccctctc

SEQ ID NO: 5771604 - DNA, 16 bp, Homo sapiens
ggccgcggagcctgca

SEQ ID NO: 5771605 - DNA, 19 bp, Homo sapiens
ggccgcggccctggggcgg

SEQ ID NO: 5771606 - DNA, 22 bp, Homo sapiens
ggccgcggccctggggcgggca

SEQ ID NO: 5771607 - DNA, 18 bp, Homo sapiens
ggccgcggcctccccgag

SEQ ID NO: 5771608 - DNA, 19 bp, Homo sapiens
ggccgcggcctccccgagg

SEQ ID NO: 5771609 - DNA, 20 bp, Homo sapiens
ggccgcgtgccgggccccca

SEQ ID NO: 5771610 - DNA, 21 bp, Homo sapiens
ggccgcgtgccgggcccccac

SEQ ID NO: 5771611 - DNA, 14 bp, Homo sapiens
ggccgctagaggcc

SEQ ID NO: 5771612 - DNA, 17 bp, Homo sapiens
ggccgctagaggcctga

SEQ ID NO: 5771613 - DNA, 18 bp, Homo sapiens
ggccgctagaggcctgag

SEQ ID NO: 5771614 - DNA, 21 bp, Homo sapiens
ggccgctagaggcctgaggat

SEQ ID NO: 5771615 - DNA, 16 bp, Homo sapiens
ggccgctagatgggca

SEQ ID NO: 5771616 - DNA, 19 bp, Homo sapiens
ggccgctagatgggcatgg

SEQ ID NO: 5771617 - DNA, 16 bp, Homo sapiens
ggccgctccaccagca

SEQ ID NO: 5771618 - DNA, 17 bp, Homo sapiens
ggccgctcctccctgct

SEQ ID NO: 5771619 - DNA, 23 bp, Homo sapiens
ggccgctcctccctgctcctcat

SEQ ID NO: 5771620 - DNA, 17 bp, Homo sapiens
ggccgctctccccctgc

SEQ ID NO: 5771621 - DNA, 21 bp, Homo sapiens
ggccgctctccccctgcagcc

SEQ ID NO: 5771622 - DNA, 15 bp, Homo sapiens
ggccgctctccgccc

SEQ ID NO: 5771623 - DNA, 18 bp, Homo sapiens
ggccgctgaacccacccg

SEQ ID NO: 5771624 - DNA, 19 bp, Homo sapiens
ggccgctgaacccacccgg

SEQ ID NO: 5771625 - DNA, 12 bp, Homo sapiens
ggccgctgcagg

SEQ ID NO: 5771626 - DNA, 13 bp, Homo sapiens
ggccgctgcaggg

SEQ ID NO: 5771627 - DNA, 14 bp, Homo sapiens
ggccgctgcagggt

SEQ ID NO: 5771628 - DNA, 18 bp, Homo sapiens
ggccgctgccccagcccc

SEQ ID NO: 5771629 - DNA, 13 bp, Homo sapiens
ggccgctgcccct

SEQ ID NO: 5771630 - DNA, 14 bp, Homo sapiens
ggccgctgcccctg

SEQ ID NO: 5771631 - DNA, 16 bp, Homo sapiens
ggccgctgctgtgaca

SEQ ID NO: 5771632 - DNA, 19 bp, Homo sapiens
ggccgctgctgtgacaggc

SEQ ID NO: 5771633 - DNA, 18 bp, Homo sapiens
ggccgctgctttgcgctg

SEQ ID NO: 5771634 - DNA, 20 bp, Homo sapiens
ggccgctgctttgcgctggt

SEQ ID NO: 5771635 - DNA, 13 bp, Homo sapiens
ggccgctggccca

SEQ ID NO: 5771636 - DNA, 16 bp, Homo sapiens
ggccgctggcccaggg

SEQ ID NO: 5771637 - DNA, 24 bp, Homo sapiens
ggccgctggcccagggtaggggag

SEQ ID NO: 5771638 - DNA, 22 bp, Homo sapiens
ggccgctggctggtgggccccc

SEQ ID NO: 5771639 - DNA, 19 bp, Homo sapiens
ggccgctgttcacccacag

SEQ ID NO: 5771640 - DNA, 20 bp, Homo sapiens
ggccgcttcagacacgcact

SEQ ID NO: 5771641 - DNA, 18 bp, Homo sapiens
ggccgcttcgccatgtgc

SEQ ID NO: 5771642 - DNA, 16 bp, Homo sapiens
ggccggaaccacaggg

SEQ ID NO: 5771643 - DNA, 23 bp, Homo sapiens
ggccggaaccacagggccagagg

SEQ ID NO: 5771644 - DNA, 22 bp, Homo sapiens
ggccggacccccgtcagctgct

SEQ ID NO: 5771645 - DNA, 19 bp, Homo sapiens
ggccggacgcaggtgctgc

SEQ ID NO: 5771646 - DNA, 19 bp, Homo sapiens
ggccggagacccacagccc

SEQ ID NO: 5771647 - DNA, 15 bp, Homo sapiens
ggccggagagctggt

SEQ ID NO: 5771648 - DNA, 13 bp, Homo sapiens
ggccggagcccag

SEQ ID NO: 5771649 - DNA, 15 bp, Homo sapiens
ggccggagggcagga

SEQ ID NO: 5771650 - DNA, 21 bp, Homo sapiens
ggccggcagccccagcctgct

SEQ ID NO: 5771651 - DNA, 15 bp, Homo sapiens
ggccggcagcctggt

SEQ ID NO: 5771652 - DNA, 12 bp, Homo sapiens
ggccggccagcc

SEQ ID NO: 5771653 - DNA, 14 bp, Homo sapiens
ggccggccagccag

SEQ ID NO: 5771654 - DNA, 16 bp, Homo sapiens
ggccggccagccagcc

SEQ ID NO: 5771655 - DNA, 19 bp, Homo sapiens
ggccggccagccagccact

SEQ ID NO: 5771656 - DNA, 18 bp, Homo sapiens
ggccggccagctccccct

SEQ ID NO: 5771657 - DNA, 14 bp, Homo sapiens
ggccggccaggtgg

SEQ ID NO: 5771658 - DNA, 15 bp, Homo sapiens
ggccggccaggtggg

SEQ ID NO: 5771659 - DNA, 20 bp, Homo sapiens
ggccggcccacgtcctgggt

SEQ ID NO: 5771660 - DNA, 16 bp, Homo sapiens
ggccggccccaggctc

SEQ ID NO: 5771661 - DNA, 17 bp, Homo sapiens
ggccggcccccttcctg

SEQ ID NO: 5771662 - DNA, 16 bp, Homo sapiens
ggccggccctgccccc

SEQ ID NO: 5771663 - DNA, 12 bp, Homo sapiens
ggccggccctgg

SEQ ID NO: 5771664 - DNA, 18 bp, Homo sapiens
ggccggccggacctctga

SEQ ID NO: 5771665 - DNA, 13 bp, Homo sapiens
ggccggcctcctc

SEQ ID NO: 5771666 - DNA, 16 bp, Homo sapiens
ggccggcctggcaccg

SEQ ID NO: 5771667 - DNA, 18 bp, Homo sapiens
ggccggcggcctcagagt

SEQ ID NO: 5771668 - DNA, 14 bp, Homo sapiens
ggccggcggctctg

SEQ ID NO: 5771669 - DNA, 17 bp, Homo sapiens
ggccggcggctctgagc

SEQ ID NO: 5771670 - DNA, 21 bp, Homo sapiens
ggccggcggggcccacgcacg

SEQ ID NO: 5771671 - DNA, 13 bp, Homo sapiens
ggccggctctggt

SEQ ID NO: 5771672 - DNA, 13 bp, Homo sapiens
ggccggctgagtg

SEQ ID NO: 5771673 - DNA, 22 bp, Homo sapiens
ggccggctggccggtccacccc

SEQ ID NO: 5771674 - DNA, 17 bp, Homo sapiens
ggccgggcacagtggct

SEQ ID NO: 5771675 - DNA, 19 bp, Homo sapiens
ggccgggcaggcgtgactc

SEQ ID NO: 5771676 - DNA, 14 bp, Homo sapiens
ggccgggcaggggg

SEQ ID NO: 5771677 - DNA, 15 bp, Homo sapiens
ggccgggcaggtcct

SEQ ID NO: 5771678 - DNA, 13 bp, Homo sapiens
ggccgggccagga

SEQ ID NO: 5771679 - DNA, 22 bp, Homo sapiens
ggccgggcccagggcctctggc

SEQ ID NO: 5771680 - DNA, 21 bp, Homo sapiens
ggccgggcctgctgtcacctc

SEQ ID NO: 5771681 - DNA, 14 bp, Homo sapiens
ggccgggcctgggg

SEQ ID NO: 5771682 - DNA, 23 bp, Homo sapiens
ggccgggcctgtacagtctgtct

SEQ ID NO: 5771683 - DNA, 13 bp, Homo sapiens
ggccgggctgccc

SEQ ID NO: 5771684 - DNA, 14 bp, Homo sapiens
ggccgggctgccct

SEQ ID NO: 5771685 - DNA, 14 bp, Homo sapiens
ggccgggctgctgc

SEQ ID NO: 5771686 - DNA, 23 bp, Homo sapiens
ggccgggctgtagatcaggtttg

SEQ ID NO: 5771687 - DNA, 19 bp, Homo sapiens
ggccggggaactggccaag

SEQ ID NO: 5771688 - DNA, 20 bp, Homo sapiens
ggccggggaactggccaagc

SEQ ID NO: 5771689 - DNA, 13 bp, Homo sapiens
ggccggggagggg

SEQ ID NO: 5771690 - DNA, 21 bp, Homo sapiens
ggccggggagggggcacggca

SEQ ID NO: 5771691 - DNA, 16 bp, Homo sapiens
ggccggggatggatct

SEQ ID NO: 5771692 - DNA, 13 bp, Homo sapiens
ggccggggccggg

SEQ ID NO: 5771693 - DNA, 16 bp, Homo sapiens
ggccggggctgaagcc

SEQ ID NO: 5771694 - DNA, 13 bp, Homo sapiens
ggccggggctgag

SEQ ID NO: 5771695 - DNA, 16 bp, Homo sapiens
ggccgggggaggtggg

SEQ ID NO: 5771696 - DNA, 16 bp, Homo sapiens
ggccggggggagggga

SEQ ID NO: 5771697 - DNA, 20 bp, Homo sapiens
ggccggggggaggggacaga

SEQ ID NO: 5771698 - DNA, 21 bp, Homo sapiens
ggccggggggggtaggagagg

SEQ ID NO: 5771699 - DNA, 22 bp, Homo sapiens
ggccggggggggtaggagagga

SEQ ID NO: 5771700 - DNA, 17 bp, Homo sapiens
ggccggggtccaggccc

SEQ ID NO: 5771701 - DNA, 20 bp, Homo sapiens
ggccgggttggaggcctcac

SEQ ID NO: 5771702 - DNA, 17 bp, Homo sapiens
ggccggtctgcaagtca

SEQ ID NO: 5771703 - DNA, 18 bp, Homo sapiens
ggccggtctgcaagtcag

SEQ ID NO: 5771704 - DNA, 23 bp, Homo sapiens
ggccggtctgcaagtcagaggat

SEQ ID NO: 5771705 - DNA, 19 bp, Homo sapiens
ggccggtgaggggaggggc

SEQ ID NO: 5771706 - DNA, 15 bp, Homo sapiens
ggccggtgtggccct

SEQ ID NO: 5771707 - DNA, 24 bp, Homo sapiens
ggccggttttcctcagctctaggc

SEQ ID NO: 5771708 - DNA, 14 bp, Homo sapiens
ggccgtaccccacc

SEQ ID NO: 5771709 - DNA, 21 bp, Homo sapiens
ggccgtagactcacggctgca

SEQ ID NO: 5771710 - DNA, 22 bp, Homo sapiens
ggccgtagactcacggctgcac

SEQ ID NO: 5771711 - DNA, 20 bp, Homo sapiens
ggccgtatgaagacagaggc

SEQ ID NO: 5771712 - DNA, 12 bp, Homo sapiens
ggccgtcaggac

SEQ ID NO: 5771713 - DNA, 18 bp, Homo sapiens
ggccgtcccgcctgcaga

SEQ ID NO: 5771714 - DNA, 20 bp, Homo sapiens
ggccgtcctcccgggccctc

SEQ ID NO: 5771715 - DNA, 13 bp, Homo sapiens
ggccgtcctgagg

SEQ ID NO: 5771716 - DNA, 15 bp, Homo sapiens
ggccgtcctgagggg

SEQ ID NO: 5771717 - DNA, 22 bp, Homo sapiens
ggccgtctcccttggcccagag

SEQ ID NO: 5771718 - DNA, 14 bp, Homo sapiens
ggccgtgcccttgc

SEQ ID NO: 5771719 - DNA, 14 bp, Homo sapiens
ggccgtgccttgtt

SEQ ID NO: 5771720 - DNA, 22 bp, Homo sapiens
ggccgtggccatcagggtgggc

SEQ ID NO: 5771721 - DNA, 19 bp, Homo sapiens
ggccgtggcttgggctggt

SEQ ID NO: 5771722 - DNA, 14 bp, Homo sapiens
ggccgtgggcctgg

SEQ ID NO: 5771723 - DNA, 17 bp, Homo sapiens
ggccgtgggcctggggt

SEQ ID NO: 5771724 - DNA, 18 bp, Homo sapiens
ggccgtggtccagctctt

SEQ ID NO: 5771725 - DNA, 12 bp, Homo sapiens
ggccgtgtcccg

SEQ ID NO: 5771726 - DNA, 13 bp, Homo sapiens
ggccgtgtcccgc

SEQ ID NO: 5771727 - DNA, 13 bp, Homo sapiens
ggccgtgtctctg

SEQ ID NO: 5771728 - DNA, 18 bp, Homo sapiens
ggccgtgtctctgaggac

SEQ ID NO: 5771729 - DNA, 20 bp, Homo sapiens
ggccgtgtgacactctcgtg

SEQ ID NO: 5771730 - DNA, 15 bp, Homo sapiens
ggccgttcagcctgt

SEQ ID NO: 5771731 - DNA, 18 bp, Homo sapiens
ggccgttccccttggctt

SEQ ID NO: 5771732 - DNA, 15 bp, Homo sapiens
ggccgttgcctctct

SEQ ID NO: 5771733 - DNA, 15 bp, Homo sapiens
ggcctaaagccagca

SEQ ID NO: 5771734 - DNA, 23 bp, Homo sapiens
ggcctaaataaatgagctgttgg

SEQ ID NO: 5771735 - DNA, 14 bp, Homo sapiens
ggcctaagacatgt

SEQ ID NO: 5771736 - DNA, 18 bp, Homo sapiens
ggcctaatattgaaaatg

SEQ ID NO: 5771737 - DNA, 15 bp, Homo sapiens
ggcctaatcactctg

SEQ ID NO: 5771738 - DNA, 16 bp, Homo sapiens
ggcctaatccacctgg

SEQ ID NO: 5771739 - DNA, 23 bp, Homo sapiens
ggcctaattttttaaagaatcca

SEQ ID NO: 5771740 - DNA, 16 bp, Homo sapiens
ggcctacaaatcagta

SEQ ID NO: 5771741 - DNA, 18 bp, Homo sapiens
ggcctacatgctttgtga

SEQ ID NO: 5771742 - DNA, 14 bp, Homo sapiens
ggcctaccacagct

SEQ ID NO: 5771743 - DNA, 21 bp, Homo sapiens
ggcctaccacagctgcctccg

SEQ ID NO: 5771744 - DNA, 12 bp, Homo sapiens
ggcctactcctg

SEQ ID NO: 5771745 - DNA, 14 bp, Homo sapiens
ggcctactcctgtc

SEQ ID NO: 5771746 - DNA, 23 bp, Homo sapiens
ggcctactcctgtcttctgcttt

SEQ ID NO: 5771747 - DNA, 16 bp, Homo sapiens
ggcctagagcactctc

SEQ ID NO: 5771748 - DNA, 22 bp, Homo sapiens
ggcctagagtggcagccaagag

SEQ ID NO: 5771749 - DNA, 20 bp, Homo sapiens
ggcctagcatacgtacacat

SEQ ID NO: 5771750 - DNA, 18 bp, Homo sapiens
ggcctagcccaccctgct

SEQ ID NO: 5771751 - DNA, 22 bp, Homo sapiens
ggcctagcgatctctcctggcc

SEQ ID NO: 5771752 - DNA, 21 bp, Homo sapiens
ggcctccgtccaggagcctgg

SEQ ID NO: 5771753 - DNA, 20 bp, Homo sapiens
ggcctccgtcctgtcactga

SEQ ID NO: 5771754 - DNA, 24 bp, Homo sapiens
ggcctccgtcctgtcactgatgga

SEQ ID NO: 5771755 - DNA, 21 bp, Homo sapiens
ggcctcctaaggctccccacc

SEQ ID NO: 5771756 - DNA, 18 bp, Homo sapiens
ggcctcctagcctctccg

SEQ ID NO: 5771757 - DNA, 17 bp, Homo sapiens
ggcctcctaggggaagg

SEQ ID NO: 5771758 - DNA, 20 bp, Homo sapiens
ggcctcctcagcctctgcaa

SEQ ID NO: 5771759 - DNA, 19 bp, Homo sapiens
ggcctcctcctcacccttc

SEQ ID NO: 5771760 - DNA, 20 bp, Homo sapiens
ggcctcctcctcacccttcc

SEQ ID NO: 5771761 - DNA, 18 bp, Homo sapiens
ggcctcctcggagagcag

SEQ ID NO: 5771762 - DNA, 22 bp, Homo sapiens
ggcctcctcggagagcagcagc

SEQ ID NO: 5771763 - DNA, 18 bp, Homo sapiens
ggcctcctctgtccaggg

SEQ ID NO: 5771764 - DNA, 19 bp, Homo sapiens
ggcctcctctgtccagggc

SEQ ID NO: 5771765 - DNA, 17 bp, Homo sapiens
ggcctcctgggggacct

SEQ ID NO: 5771766 - DNA, 22 bp, Homo sapiens
ggcctccttcaccaaagatctg

SEQ ID NO: 5771767 - DNA, 19 bp, Homo sapiens
ggcctccttcccatgcctg

SEQ ID NO: 5771768 - DNA, 19 bp, Homo sapiens
ggcctcgacgtcccttgga

SEQ ID NO: 5771769 - DNA, 23 bp, Homo sapiens
ggcctcgcacttgcagaggagcc

SEQ ID NO: 5771770 - DNA, 19 bp, Homo sapiens
ggcctcgcctccccaccct

SEQ ID NO: 5771771 - DNA, 18 bp, Homo sapiens
ggcctcgcctgccctcct

SEQ ID NO: 5771772 - DNA, 21 bp, Homo sapiens
ggcctcgcctgccctcctctc

SEQ ID NO: 5771773 - DNA, 14 bp, Homo sapiens
ggcctcgcctggcc

SEQ ID NO: 5771774 - DNA, 16 bp, Homo sapiens
ggcctcgcctggcctg

SEQ ID NO: 5771775 - DNA, 17 bp, Homo sapiens
ggcctcgcctggcctga

SEQ ID NO: 5771776 - DNA, 15 bp, Homo sapiens
ggcctcgcctgggcc

SEQ ID NO: 5771777 - DNA, 22 bp, Homo sapiens
ggcctcggacttagctgggaga

SEQ ID NO: 5771778 - DNA, 17 bp, Homo sapiens
ggcctcggaggctcctc

SEQ ID NO: 5771779 - DNA, 14 bp, Homo sapiens
ggcctcggcagaac

SEQ ID NO: 5771780 - DNA, 15 bp, Homo sapiens
ggcctcggcctccca

SEQ ID NO: 5771781 - DNA, 14 bp, Homo sapiens
ggcctcggcctggc

SEQ ID NO: 5771782 - DNA, 20 bp, Homo sapiens
ggcctcggcctggcttcacc

SEQ ID NO: 5771783 - DNA, 16 bp, Homo sapiens
ggcctcggcgggcttt

SEQ ID NO: 5771784 - DNA, 17 bp, Homo sapiens
ggcctcggctgtctcct

SEQ ID NO: 5771785 - DNA, 23 bp, Homo sapiens
ggcctcgggacacctgccctgcc

SEQ ID NO: 5771786 - DNA, 19 bp, Homo sapiens
ggcctcggggcagggcagg

SEQ ID NO: 5771787 - DNA, 20 bp, Homo sapiens
ggcctcggtgtggagaagcg

SEQ ID NO: 5771788 - DNA, 16 bp, Homo sapiens
ggcctcgtgaggggca

SEQ ID NO: 5771789 - DNA, 14 bp, Homo sapiens
ggcctcgtgccatg

SEQ ID NO: 5771790 - DNA, 20 bp, Homo sapiens
ggcctcgtgccatgatctgt

SEQ ID NO: 5771791 - DNA, 21 bp, Homo sapiens
ggcctcgtgctccgcagggcg

SEQ ID NO: 5771792 - DNA, 19 bp, Homo sapiens
ggcctctaaccccaggccc

SEQ ID NO: 5771793 - DNA, 20 bp, Homo sapiens
ggcctctaaccccaggcccc

SEQ ID NO: 5771794 - DNA, 24 bp, Homo sapiens
ggcctctactaggtctgctcctga

SEQ ID NO: 5771795 - DNA, 18 bp, Homo sapiens
ggcctctagaacacccac

SEQ ID NO: 5771796 - DNA, 22 bp, Homo sapiens
ggcctctagaacacccactggc

SEQ ID NO: 5771797 - DNA, 16 bp, Homo sapiens
ggcctctagttccaga

SEQ ID NO: 5771798 - DNA, 23 bp, Homo sapiens
ggcctctccaaccactgtgccac

SEQ ID NO: 5771799 - DNA, 12 bp, Homo sapiens
ggcctctccagt

SEQ ID NO: 5771800 - DNA, 16 bp, Homo sapiens
ggcctctccctgcctg

SEQ ID NO: 5771801 - DNA, 20 bp, Homo sapiens
ggcctctccctgcctgtggc

SEQ ID NO: 5771802 - DNA, 22 bp, Homo sapiens
ggcctctccttggaaggtcttt

SEQ ID NO: 5771803 - DNA, 19 bp, Homo sapiens
ggcctctcgagttctccta

SEQ ID NO: 5771804 - DNA, 17 bp, Homo sapiens
ggcctctcggtgctcca

SEQ ID NO: 5771805 - DNA, 22 bp, Homo sapiens
ggcctctctatcctctcttcct

SEQ ID NO: 5771806 - DNA, 18 bp, Homo sapiens
ggcctctctcctgcctgc

SEQ ID NO: 5771807 - DNA, 14 bp, Homo sapiens
ggcctctctctagg

SEQ ID NO: 5771808 - DNA, 20 bp, Homo sapiens
ggcctctctctctctcctca

SEQ ID NO: 5771809 - DNA, 16 bp, Homo sapiens
ggcctctctctgcctg

SEQ ID NO: 5771810 - DNA, 17 bp, Homo sapiens
ggcctctctctgcctga

SEQ ID NO: 5771811 - DNA, 17 bp, Homo sapiens
ggcctctctctgctcca

SEQ ID NO: 5771812 - DNA, 15 bp, Homo sapiens
ggcctctctgcctgg

SEQ ID NO: 5771813 - DNA, 22 bp, Homo sapiens
ggcctctctggaagagggaggg

SEQ ID NO: 5771814 - DNA, 13 bp, Homo sapiens
ggcctctctggcc

SEQ ID NO: 5771815 - DNA, 13 bp, Homo sapiens
ggcctctctgggg

SEQ ID NO: 5771816 - DNA, 16 bp, Homo sapiens
ggcctctctgggggag

SEQ ID NO: 5771817 - DNA, 22 bp, Homo sapiens
ggcctctcttggaactgcacca

SEQ ID NO: 5771818 - DNA, 17 bp, Homo sapiens
ggcctctcttttccccg

SEQ ID NO: 5771819 - DNA, 22 bp, Homo sapiens
ggcctctgaaatttcccacacc

SEQ ID NO: 5771820 - DNA, 17 bp, Homo sapiens
ggcctctgactctgagt

SEQ ID NO: 5771821 - DNA, 13 bp, Homo sapiens
ggcctctgagccc

SEQ ID NO: 5771822 - DNA, 21 bp, Homo sapiens
ggcctctgcaaaggaaatacc

SEQ ID NO: 5771823 - DNA, 23 bp, Homo sapiens
ggcctctgcaactgctcagctct

SEQ ID NO: 5771824 - DNA, 16 bp, Homo sapiens
ggcctctgcactcccc

SEQ ID NO: 5771825 - DNA, 22 bp, Homo sapiens
ggcctctgcactcccctgctgg

SEQ ID NO: 5771826 - DNA, 20 bp, Homo sapiens
ggcctctgccccaagagcag

SEQ ID NO: 5771827 - DNA, 14 bp, Homo sapiens
ggcctctgcccctc

SEQ ID NO: 5771828 - DNA, 21 bp, Homo sapiens
ggcctctgcctccaccctcct

SEQ ID NO: 5771829 - DNA, 22 bp, Homo sapiens
ggcctctgcctccaccctcctc

SEQ ID NO: 5771830 - DNA, 12 bp, Homo sapiens
ggcctctgcctg

SEQ ID NO: 5771831 - DNA, 14 bp, Homo sapiens
ggcctctgctgccc

SEQ ID NO: 5771832 - DNA, 15 bp, Homo sapiens
ggcctctgctgcccc

SEQ ID NO: 5771833 - DNA, 17 bp, Homo sapiens
ggcctctgctgccccct

SEQ ID NO: 5771834 - DNA, 22 bp, Homo sapiens
ggcctctgctggctcaggagga

SEQ ID NO: 5771835 - DNA, 16 bp, Homo sapiens
ggcctctgcttgccag

SEQ ID NO: 5771836 - DNA, 17 bp, Homo sapiens
ggcctctgcttgccagc

SEQ ID NO: 5771837 - DNA, 19 bp, Homo sapiens
ggcctctgcttgccagcca

SEQ ID NO: 5771838 - DNA, 18 bp, Homo sapiens
ggcctctggactggcctg

SEQ ID NO: 5771839 - DNA, 15 bp, Homo sapiens
ggcctctggccctcg

SEQ ID NO: 5771840 - DNA, 16 bp, Homo sapiens
ggcctctggcctggga

SEQ ID NO: 5771841 - DNA, 21 bp, Homo sapiens
ggcctctggctgcctggccca

SEQ ID NO: 5771842 - DNA, 17 bp, Homo sapiens
ggcctctggcttccctg

SEQ ID NO: 5771843 - DNA, 18 bp, Homo sapiens
ggcctctggcttccctgc

SEQ ID NO: 5771844 - DNA, 12 bp, Homo sapiens
ggcctctgggac

SEQ ID NO: 5771845 - DNA, 20 bp, Homo sapiens
ggcctctgggacccacagaa

SEQ ID NO: 5771846 - DNA, 13 bp, Homo sapiens
ggcctctgggcag

SEQ ID NO: 5771847 - DNA, 17 bp, Homo sapiens
ggcctctgggcagtgtg

SEQ ID NO: 5771848 - DNA, 12 bp, Homo sapiens
ggcctctggggc

SEQ ID NO: 5771849 - DNA, 13 bp, Homo sapiens
ggcctctggggca

SEQ ID NO: 5771850 - DNA, 18 bp, Homo sapiens
ggcctctggtgttcctgg

SEQ ID NO: 5771851 - DNA, 21 bp, Homo sapiens
ggcctctggttctgacacttt

SEQ ID NO: 5771852 - DNA, 17 bp, Homo sapiens
ggcctctgtaccgcccg

SEQ ID NO: 5771853 - DNA, 13 bp, Homo sapiens
ggcctctgtcaat

SEQ ID NO: 5771854 - DNA, 17 bp, Homo sapiens
ggcctcttatgggctgg

SEQ ID NO: 5771855 - DNA, 18 bp, Homo sapiens
ggcctcttatgggctggg

SEQ ID NO: 5771856 - DNA, 12 bp, Homo sapiens
ggcctcttccct

SEQ ID NO: 5771857 - DNA, 18 bp, Homo sapiens
ggcctcttgagagcccca

SEQ ID NO: 5771858 - DNA, 19 bp, Homo sapiens
ggcctcttgagagccccac

SEQ ID NO: 5771859 - DNA, 22 bp, Homo sapiens
ggcctcttggataccagctcag

SEQ ID NO: 5771860 - DNA, 16 bp, Homo sapiens
ggcctcttggcacctg

SEQ ID NO: 5771861 - DNA, 19 bp, Homo sapiens
ggcctcttggcacctgcct

SEQ ID NO: 5771862 - DNA, 21 bp, Homo sapiens
ggcctcttggcacctgcctag

SEQ ID NO: 5771863 - DNA, 22 bp, Homo sapiens
ggcctcttggcacctgcctagc

SEQ ID NO: 5771864 - DNA, 20 bp, Homo sapiens
ggcctcttggctatttctgt

SEQ ID NO: 5771865 - DNA, 19 bp, Homo sapiens
ggcctcttgggtcccccac

SEQ ID NO: 5771866 - DNA, 18 bp, Homo sapiens
ggcctcttgtcccttggc

SEQ ID NO: 5771867 - DNA, 22 bp, Homo sapiens
ggcctgaaagcaacagctggac

SEQ ID NO: 5771868 - DNA, 22 bp, Homo sapiens
ggcctgaaaggagcccttatct

SEQ ID NO: 5771869 - DNA, 16 bp, Homo sapiens
ggcctgaaatcctggt

SEQ ID NO: 5771870 - DNA, 21 bp, Homo sapiens
ggcctgaaatgtttccaggca

SEQ ID NO: 5771871 - DNA, 24 bp, Homo sapiens
ggcctgaaatgtttccaggcatga

SEQ ID NO: 5771872 - DNA, 19 bp, Homo sapiens
ggcctgaacagatgtaaat

SEQ ID NO: 5771873 - DNA, 21 bp, Homo sapiens
ggcctgaaccacagcggagga

SEQ ID NO: 5771874 - DNA, 18 bp, Homo sapiens
ggcctgaaccacaggaga

SEQ ID NO: 5771875 - DNA, 21 bp, Homo sapiens
ggcctgaactaggtgctggca

SEQ ID NO: 5771876 - DNA, 17 bp, Homo sapiens
ggcctgaatcatgagcc

SEQ ID NO: 5771877 - DNA, 21 bp, Homo sapiens
ggcctgaatcatgagcctgct

SEQ ID NO: 5771878 - DNA, 22 bp, Homo sapiens
ggcctgaatccaaaagaaaaac

SEQ ID NO: 5771879 - DNA, 23 bp, Homo sapiens
ggcctgaatgcttataggtggcc

SEQ ID NO: 5771880 - DNA, 15 bp, Homo sapiens
ggcctgacacaggcc

SEQ ID NO: 5771881 - DNA, 16 bp, Homo sapiens
ggcctgacacaggcca

SEQ ID NO: 5771882 - DNA, 14 bp, Homo sapiens
ggcctgacaccccc

SEQ ID NO: 5771883 - DNA, 21 bp, Homo sapiens
ggcctgacaggttcccagcag

SEQ ID NO: 5771884 - DNA, 21 bp, Homo sapiens
ggcctgacagtgtgggacagg

SEQ ID NO: 5771885 - DNA, 17 bp, Homo sapiens
ggcctgaccagggggcc

SEQ ID NO: 5771886 - DNA, 17 bp, Homo sapiens
ggcctgacccacggggc

SEQ ID NO: 5771887 - DNA, 16 bp, Homo sapiens
ggcctgacctccccct

SEQ ID NO: 5771888 - DNA, 12 bp, Homo sapiens
ggcctgactccc

SEQ ID NO: 5771889 - DNA, 13 bp, Homo sapiens
ggcctgactgctc

SEQ ID NO: 5771890 - DNA, 19 bp, Homo sapiens
ggcctgactggttgtcaga

SEQ ID NO: 5771891 - DNA, 14 bp, Homo sapiens
ggcctgacttgagc

SEQ ID NO: 5771892 - DNA, 17 bp, Homo sapiens
ggcctgagacccaggac

SEQ ID NO: 5771893 - DNA, 18 bp, Homo sapiens
ggcctgagaggggaagcg

SEQ ID NO: 5771894 - DNA, 18 bp, Homo sapiens
ggcctgagagtcagctct

SEQ ID NO: 5771895 - DNA, 15 bp, Homo sapiens
ggcctgagcctcccg

SEQ ID NO: 5771896 - DNA, 22 bp, Homo sapiens
ggcctgagcgcagcgcctccac

SEQ ID NO: 5771897 - DNA, 12 bp, Homo sapiens
ggcctgagctgg

SEQ ID NO: 5771898 - DNA, 15 bp, Homo sapiens
ggcctgagctgggat

SEQ ID NO: 5771899 - DNA, 18 bp, Homo sapiens
ggcctgaggatgagctgg

SEQ ID NO: 5771900 - DNA, 18 bp, Homo sapiens
ggcctgaggcctgtgcct

SEQ ID NO: 5771901 - DNA, 10 bp, Homo sapiens
ggcctgaggg

SEQ ID NO: 5771902 - DNA, 17 bp, Homo sapiens
ggcctgagggaagccca

SEQ ID NO: 5771903 - DNA, 18 bp, Homo sapiens
ggcctgagggaagcccac

SEQ ID NO: 5771904 - DNA, 23 bp, Homo sapiens
ggcctgagggaagcccacccgcc

SEQ ID NO: 5771905 - DNA, 21 bp, Homo sapiens
ggcctgagggtccacctggag

SEQ ID NO: 5771906 - DNA, 14 bp, Homo sapiens
ggcctgaggtcaat

SEQ ID NO: 5771907 - DNA, 18 bp, Homo sapiens
ggcctgaggtctcgctga

SEQ ID NO: 5771908 - DNA, 21 bp, Homo sapiens
ggcctgaggtctggctgcttg

SEQ ID NO: 5771909 - DNA, 23 bp, Homo sapiens
ggcctgagtcctggtccctctga

SEQ ID NO: 5771910 - DNA, 18 bp, Homo sapiens
ggcctgagttagctgttt

SEQ ID NO: 5771911 - DNA, 20 bp, Homo sapiens
ggcctgatcagaccacggct

SEQ ID NO: 5771912 - DNA, 18 bp, Homo sapiens
ggcctgatgacagagcga

SEQ ID NO: 5771913 - DNA, 21 bp, Homo sapiens
ggcctgatgagactccactca

SEQ ID NO: 5771914 - DNA, 22 bp, Homo sapiens
ggcctgatgagactccactcag

SEQ ID NO: 5771915 - DNA, 20 bp, Homo sapiens
ggcctgatgctccctcccct

SEQ ID NO: 5771916 - DNA, 19 bp, Homo sapiens
ggcctgattcactggcctg

SEQ ID NO: 5771917 - DNA, 20 bp, Homo sapiens
ggcctgattcactggcctgg

SEQ ID NO: 5771918 - DNA, 19 bp, Homo sapiens
ggcctgcaaaccttcctgg

SEQ ID NO: 5771919 - DNA, 15 bp, Homo sapiens
ggcctgcaaactggg

SEQ ID NO: 5771920 - DNA, 16 bp, Homo sapiens
ggcctgcaaactggga

SEQ ID NO: 5771921 - DNA, 19 bp, Homo sapiens
ggcctgcacagatacctca

SEQ ID NO: 5771922 - DNA, 22 bp, Homo sapiens
ggcctgcacagatacctcatca

SEQ ID NO: 5771923 - DNA, 14 bp, Homo sapiens
ggcctgcacagtga

SEQ ID NO: 5771924 - DNA, 18 bp, Homo sapiens
ggcctgcaccgaccccgg

SEQ ID NO: 5771925 - DNA, 21 bp, Homo sapiens
ggcctgcacggtgggccttgc

SEQ ID NO: 5771926 - DNA, 14 bp, Homo sapiens
ggcctgcagaagga

SEQ ID NO: 5771927 - DNA, 15 bp, Homo sapiens
ggcctggggggaacg

SEQ ID NO: 5771928 - DNA, 23 bp, Homo sapiens
ggcctggggtaggaggaacaggt

SEQ ID NO: 5771929 - DNA, 18 bp, Homo sapiens
ggcctggggtgacccggc

SEQ ID NO: 5771930 - DNA, 20 bp, Homo sapiens
ggcctggggtgcatcctcct

SEQ ID NO: 5771931 - DNA, 17 bp, Homo sapiens
ggcctggggtgggacag

SEQ ID NO: 5771932 - DNA, 16 bp, Homo sapiens
ggcctgggtcccaggg

SEQ ID NO: 5771933 - DNA, 19 bp, Homo sapiens
ggcctgggtcccagggctg

SEQ ID NO: 5771934 - DNA, 19 bp, Homo sapiens
ggcctgggtccccctcctg

SEQ ID NO: 5771935 - DNA, 21 bp, Homo sapiens
ggcctgggtccccctcctgca

SEQ ID NO: 5771936 - DNA, 17 bp, Homo sapiens
ggcctgggtcctcggcc

SEQ ID NO: 5771937 - DNA, 19 bp, Homo sapiens
ggcctgggtgatctgctgc

SEQ ID NO: 5771938 - DNA, 23 bp, Homo sapiens
ggcctgggtggatcggcctcctc

SEQ ID NO: 5771939 - DNA, 20 bp, Homo sapiens
ggcctgggtggggcagggcc

SEQ ID NO: 5771940 - DNA, 21 bp, Homo sapiens
ggcctgggtggggcagggcct

SEQ ID NO: 5771941 - DNA, 17 bp, Homo sapiens
ggcctggtaggtctgga

SEQ ID NO: 5771942 - DNA, 15 bp, Homo sapiens
ggcctggtcaccaca

SEQ ID NO: 5771943 - DNA, 19 bp, Homo sapiens
ggcctggtcagcagagccg

SEQ ID NO: 5771944 - DNA, 11 bp, Homo sapiens
ggcctggtccc

SEQ ID NO: 5771945 - DNA, 20 bp, Homo sapiens
ggcctggtccctggtccttc

SEQ ID NO: 5771946 - DNA, 11 bp, Homo sapiens
ggcctggtctg

SEQ ID NO: 5771947 - DNA, 11 bp, Homo sapiens
ggcctggtggg

SEQ ID NO: 5771948 - DNA, 22 bp, Homo sapiens
ggcctggtgggtcagggggagt

SEQ ID NO: 5771949 - DNA, 19 bp, Homo sapiens
ggcctggtgtgaggctggg

SEQ ID NO: 5771950 - DNA, 23 bp, Homo sapiens
ggcctggttaaataaggcagggt

SEQ ID NO: 5771951 - DNA, 22 bp, Homo sapiens
ggcctggttcaaagtaaagcag

SEQ ID NO: 5771952 - DNA, 19 bp, Homo sapiens
ggcctggttgaagaagatg

SEQ ID NO: 5771953 - DNA, 16 bp, Homo sapiens
ggcctgtacagtctgt

SEQ ID NO: 5771954 - DNA, 18 bp, Homo sapiens
ggcctgtacagtctgtct

SEQ ID NO: 5771955 - DNA, 14 bp, Homo sapiens
ggcctgtactgcct

SEQ ID NO: 5771956 - DNA, 17 bp, Homo sapiens
ggcctgtactgcctgct

SEQ ID NO: 5771957 - DNA, 17 bp, Homo sapiens
ggcctgtagagttgctg

SEQ ID NO: 5771958 - DNA, 16 bp, Homo sapiens
ggcctgtatgcctggg

SEQ ID NO: 5771959 - DNA, 15 bp, Homo sapiens
ggcctgtccacaggc

SEQ ID NO: 5771960 - DNA, 12 bp, Homo sapiens
ggcctgtcccaa

SEQ ID NO: 5771961 - DNA, 22 bp, Homo sapiens
ggcctgtcccaattctgcccgc

SEQ ID NO: 5771962 - DNA, 19 bp, Homo sapiens
ggcctgtccctagggctct

SEQ ID NO: 5771963 - DNA, 21 bp, Homo sapiens
ggcctgtccctggccatctct

SEQ ID NO: 5771964 - DNA, 14 bp, Homo sapiens
ggcctgtcctccaa

SEQ ID NO: 5771965 - DNA, 16 bp, Homo sapiens
ggcctgtctcagtgat

SEQ ID NO: 5771966 - DNA, 18 bp, Homo sapiens
ggcctgtctcatccccag

SEQ ID NO: 5771967 - DNA, 20 bp, Homo sapiens
ggcctgtctcatccccaggg

SEQ ID NO: 5771968 - DNA, 19 bp, Homo sapiens
ggcctgtctccctagggaa

SEQ ID NO: 5771969 - DNA, 19 bp, Homo sapiens
ggcctgtctcggaacctgt

SEQ ID NO: 5771970 - DNA, 14 bp, Homo sapiens
ggcctgtctgtgac

SEQ ID NO: 5771971 - DNA, 13 bp, Homo sapiens
ggcctgtgagcaa

SEQ ID NO: 5771972 - DNA, 19 bp, Homo sapiens
ggcctgtgagcaagagcca

SEQ ID NO: 5771973 - DNA, 15 bp, Homo sapiens
ggcctgtgagccatt

SEQ ID NO: 5771974 - DNA, 13 bp, Homo sapiens
ggcctgtgcagca

SEQ ID NO: 5771975 - DNA, 15 bp, Homo sapiens
ggcctgtgcccactc

SEQ ID NO: 5771976 - DNA, 21 bp, Homo sapiens
ggcctgtgctgggccagtggc

SEQ ID NO: 5771977 - DNA, 22 bp, Homo sapiens
ggcctgtgcttggaggcctcag

SEQ ID NO: 5771978 - DNA, 18 bp, Homo sapiens
ggcctgtggaatgagtgt

SEQ ID NO: 5771979 - DNA, 22 bp, Homo sapiens
ggcctgtggaatgagtgtgcat

SEQ ID NO: 5771980 - DNA, 17 bp, Homo sapiens
ggcctgtggcacagccc

SEQ ID NO: 5771981 - DNA, 19 bp, Homo sapiens
ggcctgtggcacagccctg

SEQ ID NO: 5771982 - DNA, 13 bp, Homo sapiens
ggcctgtggcagg

SEQ ID NO: 5771983 - DNA, 21 bp, Homo sapiens
ggcctgtggcaggcctaggac

SEQ ID NO: 5771984 - DNA, 18 bp, Homo sapiens
ggcctgtggcctgtgtcc

SEQ ID NO: 5771985 - DNA, 16 bp, Homo sapiens
ggcctgtggctgccct

SEQ ID NO: 5771986 - DNA, 15 bp, Homo sapiens
ggcctgtggctgtcg

SEQ ID NO: 5771987 - DNA, 17 bp, Homo sapiens
ggcctgtgggagcctgc

SEQ ID NO: 5771988 - DNA, 14 bp, Homo sapiens
ggcctgtgggcctc

SEQ ID NO: 5771989 - DNA, 16 bp, Homo sapiens
ggcctgtggggagccg

SEQ ID NO: 5771990 - DNA, 18 bp, Homo sapiens
ggcctgtgggtctctgaa

SEQ ID NO: 5771991 - DNA, 21 bp, Homo sapiens
ggcctgtgggtctctgaaggg

SEQ ID NO: 5771992 - DNA, 17 bp, Homo sapiens
ggcctgtggtggctccc

SEQ ID NO: 5771993 - DNA, 17 bp, Homo sapiens
ggcctgtgtagctgtga

SEQ ID NO: 5771994 - DNA, 21 bp, Homo sapiens
ggcctgtgtagctgtgacctg

SEQ ID NO: 5771995 - DNA, 17 bp, Homo sapiens
ggcctgtgtccagcagc

SEQ ID NO: 5771996 - DNA, 20 bp, Homo sapiens
ggcctgtgtcccatgaccca

SEQ ID NO: 5771997 - DNA, 22 bp, Homo sapiens
ggcctgtgtcccatgacccacc

SEQ ID NO: 5771998 - DNA, 22 bp, Homo sapiens
ggcctgtgtgtaagctgactgg

SEQ ID NO: 5771999 - DNA, 21 bp, Homo sapiens
ggcctgtgttcttcctggccg

SEQ ID NO: 5772000 - DNA, 23 bp, Homo sapiens
ggcctgttccccaaatggccatt

SEQ ID NO: 5772001 - DNA, 14 bp, Homo sapiens
ggcctgttccctag

SEQ ID NO: 5772002 - DNA, 17 bp, Homo sapiens
ggcctgttccctagaga

SEQ ID NO: 5772003 - DNA, 20 bp, Homo sapiens
ggcctgttctcttggctgca

SEQ ID NO: 5772004 - DNA, 19 bp, Homo sapiens
ggcctgtttctgcagccct

SEQ ID NO: 5772005 - DNA, 18 bp, Homo sapiens
ggcctgtttggcctctct

SEQ ID NO: 5772006 - DNA, 19 bp, Homo sapiens
ggcctgtttggtgaggacc

SEQ ID NO: 5772007 - DNA, 23 bp, Homo sapiens
ggccttaaaattacttggctttt

SEQ ID NO: 5772008 - DNA, 19 bp, Homo sapiens
ggccttaaagagggacagg

SEQ ID NO: 5772009 - DNA, 17 bp, Homo sapiens
ggccttaacacactggc

SEQ ID NO: 5772010 - DNA, 19 bp, Homo sapiens
ggccttaactggccctcgg

SEQ ID NO: 5772011 - DNA, 16 bp, Homo sapiens
ggccttaactgttgtt

SEQ ID NO: 5772012 - DNA, 13 bp, Homo sapiens
ggccttaagaact

SEQ ID NO: 5772013 - DNA, 15 bp, Homo sapiens
ggccttaatttcctt

SEQ ID NO: 5772014 - DNA, 17 bp, Homo sapiens
ggccttaatttcctttt

SEQ ID NO: 5772015 - DNA, 20 bp, Homo sapiens
ggccttaatttcctttttga

SEQ ID NO: 5772016 - DNA, 18 bp, Homo sapiens
ggccttacatctggctgg

SEQ ID NO: 5772017 - DNA, 19 bp, Homo sapiens
ggccttacatctggctgga

SEQ ID NO: 5772018 - DNA, 15 bp, Homo sapiens
ggccttacccctgcc

SEQ ID NO: 5772019 - DNA, 18 bp, Homo sapiens
ggccttacctcccctgcc

SEQ ID NO: 5772020 - DNA, 23 bp, Homo sapiens
ggccttacctcccctgccagggc

SEQ ID NO: 5772021 - DNA, 19 bp, Homo sapiens
ggccttacttaaacccagc

SEQ ID NO: 5772022 - DNA, 20 bp, Homo sapiens
ggccttagggcactgggctg

SEQ ID NO: 5772023 - DNA, 20 bp, Homo sapiens
ggccttagtacggctgctgc

SEQ ID NO: 5772024 - DNA, 21 bp, Homo sapiens
ggccttatctgaaaggccagc

SEQ ID NO: 5772025 - DNA, 23 bp, Homo sapiens
ggccttcagacacatgctatgtt

SEQ ID NO: 5772026 - DNA, 17 bp, Homo sapiens
ggccttcagggagtgag

SEQ ID NO: 5772027 - DNA, 19 bp, Homo sapiens
ggccttcagtttatttcca

SEQ ID NO: 5772028 - DNA, 14 bp, Homo sapiens
ggccttcataatgg

SEQ ID NO: 5772029 - DNA, 17 bp, Homo sapiens
ggccttcatcctcctcc

SEQ ID NO: 5772030 - DNA, 18 bp, Homo sapiens
ggccttccacgtcttcct

SEQ ID NO: 5772031 - DNA, 15 bp, Homo sapiens
ggccttccagctgct

SEQ ID NO: 5772032 - DNA, 14 bp, Homo sapiens
ggccttccccagca

SEQ ID NO: 5772033 - DNA, 17 bp, Homo sapiens
ggccttccccagcctct

SEQ ID NO: 5772034 - DNA, 19 bp, Homo sapiens
ggccttccccttttgcctg

SEQ ID NO: 5772035 - DNA, 21 bp, Homo sapiens
ggccttccccttttgcctggc

SEQ ID NO: 5772036 - DNA, 22 bp, Homo sapiens
ggccttccccttttgcctggct

SEQ ID NO: 5772037 - DNA, 12 bp, Homo sapiens
ggccttcccgcc

SEQ ID NO: 5772038 - DNA, 18 bp, Homo sapiens
ggccttcccgccggaggc

SEQ ID NO: 5772039 - DNA, 22 bp, Homo sapiens
ggccttccctgttttcccccca

SEQ ID NO: 5772040 - DNA, 23 bp, Homo sapiens
ggccttccctttacagctctcct

SEQ ID NO: 5772041 - DNA, 13 bp, Homo sapiens
ggccttcctggct

SEQ ID NO: 5772042 - DNA, 23 bp, Homo sapiens
ggccttccttttgaggagctgga

SEQ ID NO: 5772043 - DNA, 16 bp, Homo sapiens
ggccttcggcctccat

SEQ ID NO: 5772044 - DNA, 23 bp, Homo sapiens
ggccttcggcctccatcctgagg

SEQ ID NO: 5772045 - DNA, 18 bp, Homo sapiens
ggccttctcagcctacag

SEQ ID NO: 5772046 - DNA, 23 bp, Homo sapiens
ggccttctcccctcttctgagct

SEQ ID NO: 5772047 - DNA, 18 bp, Homo sapiens
ggccttctcttgaggcct

SEQ ID NO: 5772048 - DNA, 20 bp, Homo sapiens
ggccttctcttgaggcctgt

SEQ ID NO: 5772049 - DNA, 17 bp, Homo sapiens
ggccttctgctgcccag

SEQ ID NO: 5772050 - DNA, 18 bp, Homo sapiens
ggccttctgctgcccagg

SEQ ID NO: 5772051 - DNA, 19 bp, Homo sapiens
ggccttctgctgcccaggc

SEQ ID NO: 5772052 - DNA, 22 bp, Homo sapiens
ggccttctgctgcccaggccac

SEQ ID NO: 5772053 - DNA, 23 bp, Homo sapiens
ggccttctgctgcccaggccaca

SEQ ID NO: 5772054 - DNA, 16 bp, Homo sapiens
ggccttctgtggggct

SEQ ID NO: 5772055 - DNA, 18 bp, Homo sapiens
ggccttctgtggggctgg

SEQ ID NO: 5772056 - DNA, 18 bp, Homo sapiens
ggccttgaagacagagca

SEQ ID NO: 5772057 - DNA, 19 bp, Homo sapiens
ggccttgaagactccctga

SEQ ID NO: 5772058 - DNA, 12 bp, Homo sapiens
ggccttgaagtg

SEQ ID NO: 5772059 - DNA, 16 bp, Homo sapiens
ggccttgagtccccca

SEQ ID NO: 5772060 - DNA, 18 bp, Homo sapiens
ggccttgcagctggccca

SEQ ID NO: 5772061 - DNA, 19 bp, Homo sapiens
ggccttgccccaggccctg

SEQ ID NO: 5772062 - DNA, 14 bp, Homo sapiens
ggccttgcccgtcg

SEQ ID NO: 5772063 - DNA, 18 bp, Homo sapiens
ggccttgcggaagccata

SEQ ID NO: 5772064 - DNA, 20 bp, Homo sapiens
ggccttgcggaagccatagg

SEQ ID NO: 5772065 - DNA, 18 bp, Homo sapiens
ggccttgctcttctcctt

SEQ ID NO: 5772066 - DNA, 18 bp, Homo sapiens
ggccttgctgactctctg

SEQ ID NO: 5772067 - DNA, 20 bp, Homo sapiens
ggccttgctgactctctgag

SEQ ID NO: 5772068 - DNA, 22 bp, Homo sapiens
ggccttgctgactctctgagct

SEQ ID NO: 5772069 - DNA, 13 bp, Homo sapiens
ggccttgctgctg

SEQ ID NO: 5772070 - DNA, 12 bp, Homo sapiens
ggccttgctggg

SEQ ID NO: 5772071 - DNA, 21 bp, Homo sapiens
ggccttgctggggtccagggc

SEQ ID NO: 5772072 - DNA, 13 bp, Homo sapiens
ggccttgctgtca

SEQ ID NO: 5772073 - DNA, 16 bp, Homo sapiens
ggccttgctgtggagc

SEQ ID NO: 5772074 - DNA, 10 bp, Homo sapiens
ggccttgctt

SEQ ID NO: 5772075 - DNA, 14 bp, Homo sapiens
ggccttgcttctct

SEQ ID NO: 5772076 - DNA, 21 bp, Homo sapiens
ggccttgcttctcttctttcc

SEQ ID NO: 5772077 - DNA, 23 bp, Homo sapiens
ggccttgctttgtctggcctcac

SEQ ID NO: 5772078 - DNA, 20 bp, Homo sapiens
ggccttggacggggacacgg

SEQ ID NO: 5772079 - DNA, 13 bp, Homo sapiens
ggccttggcaggc

SEQ ID NO: 5772080 - DNA, 13 bp, Homo sapiens
ggccttggccctg

SEQ ID NO: 5772081 - DNA, 17 bp, Homo sapiens
ggccttggccctgaccc

SEQ ID NO: 5772082 - DNA, 12 bp, Homo sapiens
ggccttgggctc

SEQ ID NO: 5772083 - DNA, 13 bp, Homo sapiens
ggccttgggctcc

SEQ ID NO: 5772084 - DNA, 24 bp, Homo sapiens
ggccttggggccagactggctgca

SEQ ID NO: 5772085 - DNA, 21 bp, Homo sapiens
ggccttggggtgggggccagg

SEQ ID NO: 5772086 - DNA, 18 bp, Homo sapiens
ggccttggtggagcagcc

SEQ ID NO: 5772087 - DNA, 22 bp, Homo sapiens
ggccttggtggagcagccagag

SEQ ID NO: 5772088 - DNA, 13 bp, Homo sapiens
ggccttgtacttg

SEQ ID NO: 5772089 - DNA, 19 bp, Homo sapiens
ggccttgtcaggacccagg

SEQ ID NO: 5772090 - DNA, 12 bp, Homo sapiens
ggccttgtccca

SEQ ID NO: 5772091 - DNA, 16 bp, Homo sapiens
ggccttgtctcttcct

SEQ ID NO: 5772092 - DNA, 19 bp, Homo sapiens
ggccttgtgacattcactc

SEQ ID NO: 5772093 - DNA, 17 bp, Homo sapiens
ggccttgtgtgctggct

SEQ ID NO: 5772094 - DNA, 17 bp, Homo sapiens
ggccttgtgtgtcaggc

SEQ ID NO: 5772095 - DNA, 18 bp, Homo sapiens
ggccttgtgtgtcaggcc

SEQ ID NO: 5772096 - DNA, 19 bp, Homo sapiens
ggccttgtgtgtgtgtttt

SEQ ID NO: 5772097 - DNA, 18 bp, Homo sapiens
ggcctttatgttctttca

SEQ ID NO: 5772098 - DNA, 22 bp, Homo sapiens
ggcctttatgttctttcaccca

SEQ ID NO: 5772099 - DNA, 21 bp, Homo sapiens
ggcctttcaggaagggagagg

SEQ ID NO: 5772100 - DNA, 15 bp, Homo sapiens
ggcctttccctaagc

SEQ ID NO: 5772101 - DNA, 15 bp, Homo sapiens
ggcctttccctgccg

SEQ ID NO: 5772102 - DNA, 15 bp, Homo sapiens
ggcctttcctctgca

SEQ ID NO: 5772103 - DNA, 14 bp, Homo sapiens
ggctgggcgcctct

SEQ ID NO: 5772104 - DNA, 16 bp, Homo sapiens
ggctgggctcacaggc

SEQ ID NO: 5772105 - DNA, 22 bp, Homo sapiens
ggctgggctcacaggcctctct

SEQ ID NO: 5772106 - DNA, 11 bp, Homo sapiens
ggctgggctcc

SEQ ID NO: 5772107 - DNA, 17 bp, Homo sapiens
ggctgggctcccttccc

SEQ ID NO: 5772108 - DNA, 18 bp, Homo sapiens
ggctgggctcccttccca

SEQ ID NO: 5772109 - DNA, 20 bp, Homo sapiens
ggctgggctcccttcccacc

SEQ ID NO: 5772110 - DNA, 16 bp, Homo sapiens
ggctgggctcctcatt

SEQ ID NO: 5772111 - DNA, 21 bp, Homo sapiens
ggctgggctctgtcttcctgg

SEQ ID NO: 5772112 - DNA, 20 bp, Homo sapiens
ggctgggctgagccaaagcc

SEQ ID NO: 5772113 - DNA, 15 bp, Homo sapiens
ggctgggctggctga

SEQ ID NO: 5772114 - DNA, 13 bp, Homo sapiens
ggctgggctgggc

SEQ ID NO: 5772115 - DNA, 18 bp, Homo sapiens
ggctgggctgggcactgc

SEQ ID NO: 5772116 - DNA, 19 bp, Homo sapiens
ggctgggctgggctgggct

SEQ ID NO: 5772117 - DNA, 22 bp, Homo sapiens
ggctgggcttcagtggcagctg

SEQ ID NO: 5772118 - DNA, 18 bp, Homo sapiens
ggctggggaagtcctctg

SEQ ID NO: 5772119 - DNA, 12 bp, Homo sapiens
ggctggggacac

SEQ ID NO: 5772120 - DNA, 13 bp, Homo sapiens
ggctggggaccca

SEQ ID NO: 5772121 - DNA, 20 bp, Homo sapiens
ggctggggacccacccagcc

SEQ ID NO: 5772122 - DNA, 21 bp, Homo sapiens
ggctggggacccacccagccc

SEQ ID NO: 5772123 - DNA, 21 bp, Homo sapiens
ggctggggactctggcacagt

SEQ ID NO: 5772124 - DNA, 13 bp, Homo sapiens
ggctggggactgg

SEQ ID NO: 5772125 - DNA, 14 bp, Homo sapiens
ggctggggactggg

SEQ ID NO: 5772126 - DNA, 14 bp, Homo sapiens
ggctggggacttcg

SEQ ID NO: 5772127 - DNA, 23 bp, Homo sapiens
ggctggggaggaccagggccctg

SEQ ID NO: 5772128 - DNA, 15 bp, Homo sapiens
ggctggggaggacct

SEQ ID NO: 5772129 - DNA, 15 bp, Homo sapiens
ggctggggaggcctg

SEQ ID NO: 5772130 - DNA, 12 bp, Homo sapiens
ggctggggaggg

SEQ ID NO: 5772131 - DNA, 13 bp, Homo sapiens
ggctggggagggg

SEQ ID NO: 5772132 - DNA, 14 bp, Homo sapiens
ggctggggaggtgc

SEQ ID NO: 5772133 - DNA, 12 bp, Homo sapiens
ggctggggcaga

SEQ ID NO: 5772134 - DNA, 13 bp, Homo sapiens
ggctggggcagag

SEQ ID NO: 5772135 - DNA, 15 bp, Homo sapiens
ggctggggcagaggg

SEQ ID NO: 5772136 - DNA, 22 bp, Homo sapiens
ggctggggcagaggggcagccg

SEQ ID NO: 5772137 - DNA, 12 bp, Homo sapiens
ggctggggcagc

SEQ ID NO: 5772138 - DNA, 14 bp, Homo sapiens
ggctggggcagcct

SEQ ID NO: 5772139 - DNA, 16 bp, Homo sapiens
ggctggggcaggaggg

SEQ ID NO: 5772140 - DNA, 13 bp, Homo sapiens
ggctggggcaggc

SEQ ID NO: 5772141 - DNA, 20 bp, Homo sapiens
ggctggggcaggctctctcc

SEQ ID NO: 5772142 - DNA, 13 bp, Homo sapiens
ggctggggcatgg

SEQ ID NO: 5772143 - DNA, 16 bp, Homo sapiens
ggctggggccaagagg

SEQ ID NO: 5772144 - DNA, 19 bp, Homo sapiens
ggctggggccacctttgtg

SEQ ID NO: 5772145 - DNA, 13 bp, Homo sapiens
ggctggggccagt

SEQ ID NO: 5772146 - DNA, 14 bp, Homo sapiens
ggctggggccagtg

SEQ ID NO: 5772147 - DNA, 16 bp, Homo sapiens
ggctggggccggggct

SEQ ID NO: 5772148 - DNA, 14 bp, Homo sapiens
ggctggggcctggc

SEQ ID NO: 5772149 - DNA, 23 bp, Homo sapiens
ggctggggccttttgacggcctt

SEQ ID NO: 5772150 - DNA, 16 bp, Homo sapiens
ggctggggctgacctt

SEQ ID NO: 5772151 - DNA, 14 bp, Homo sapiens
ggctggggctgctc

SEQ ID NO: 5772152 - DNA, 19 bp, Homo sapiens
ggctggggctgctccccta

SEQ ID NO: 5772153 - DNA, 22 bp, Homo sapiens
ggctggggcttttgtgccagga

SEQ ID NO: 5772154 - DNA, 12 bp, Homo sapiens
ggctgggggact

SEQ ID NO: 5772155 - DNA, 15 bp, Homo sapiens
ggctgggggactggg

SEQ ID NO: 5772156 - DNA, 20 bp, Homo sapiens
ggctgggggaggtccaagca

SEQ ID NO: 5772157 - DNA, 18 bp, Homo sapiens
ggctgggggatgggcctg

SEQ ID NO: 5772158 - DNA, 14 bp, Homo sapiens
ggctgggggcagga

SEQ ID NO: 5772159 - DNA, 18 bp, Homo sapiens
ggctgggggcaggagggc

SEQ ID NO: 5772160 - DNA, 21 bp, Homo sapiens
ggctgggggcatgggggaggc

SEQ ID NO: 5772161 - DNA, 20 bp, Homo sapiens
ggctgggggccagggctgga

SEQ ID NO: 5772162 - DNA, 23 bp, Homo sapiens
ggctgggggccagggctggatgg

SEQ ID NO: 5772163 - DNA, 15 bp, Homo sapiens
ggctgggggcctcag

SEQ ID NO: 5772164 - DNA, 21 bp, Homo sapiens
ggctgggggcgggggagccaa

SEQ ID NO: 5772165 - DNA, 18 bp, Homo sapiens
ggctgggggctgcagggc

SEQ ID NO: 5772166 - DNA, 20 bp, Homo sapiens
ggctgggggctgcagggctg

SEQ ID NO: 5772167 - DNA, 14 bp, Homo sapiens
ggctggggggatga

SEQ ID NO: 5772168 - DNA, 17 bp, Homo sapiens
ggctggggggtctcagc

SEQ ID NO: 5772169 - DNA, 18 bp, Homo sapiens
ggctgggggtagcctgga

SEQ ID NO: 5772170 - DNA, 23 bp, Homo sapiens
ggctgggggtgaggggccaggcc

SEQ ID NO: 5772171 - DNA, 14 bp, Homo sapiens
ggctgggggtgctg

SEQ ID NO: 5772172 - DNA, 14 bp, Homo sapiens
ggctggggtcacag

SEQ ID NO: 5772173 - DNA, 16 bp, Homo sapiens
ggctggggtcacagag

SEQ ID NO: 5772174 - DNA, 21 bp, Homo sapiens
ggctggggtcccagcagctgc

SEQ ID NO: 5772175 - DNA, 13 bp, Homo sapiens
ggctggggtcctc

SEQ ID NO: 5772176 - DNA, 17 bp, Homo sapiens
ggctggggtgagcctga

SEQ ID NO: 5772177 - DNA, 17 bp, Homo sapiens
ggctggggttgccagag

SEQ ID NO: 5772178 - DNA, 23 bp, Homo sapiens
ggctggggttgccagaggccctg

SEQ ID NO: 5772179 - DNA, 15 bp, Homo sapiens
ggctgggtaggcagg

SEQ ID NO: 5772180 - DNA, 18 bp, Homo sapiens
ggctgggtaggcaggtgt

SEQ ID NO: 5772181 - DNA, 14 bp, Homo sapiens
ggctgggtcaccag

SEQ ID NO: 5772182 - DNA, 20 bp, Homo sapiens
ggctgggtccaccctgtcct

SEQ ID NO: 5772183 - DNA, 16 bp, Homo sapiens
ggctgggtccagggga

SEQ ID NO: 5772184 - DNA, 15 bp, Homo sapiens
ggctgggtcctgcca

SEQ ID NO: 5772185 - DNA, 16 bp, Homo sapiens
ggctgggtcctgccag

SEQ ID NO: 5772186 - DNA, 17 bp, Homo sapiens
ggctgggtcctgccagc

SEQ ID NO: 5772187 - DNA, 18 bp, Homo sapiens
ggctgggtccttgggcct

SEQ ID NO: 5772188 - DNA, 16 bp, Homo sapiens
ggctgggtcgcccctc

SEQ ID NO: 5772189 - DNA, 19 bp, Homo sapiens
ggctgggtcgcccctcctc

SEQ ID NO: 5772190 - DNA, 21 bp, Homo sapiens
ggctgggtcgcccctcctcgg

SEQ ID NO: 5772191 - DNA, 15 bp, Homo sapiens
ggctgggtgcccaca

SEQ ID NO: 5772192 - DNA, 14 bp, Homo sapiens
ggctgggtgccctc

SEQ ID NO: 5772193 - DNA, 13 bp, Homo sapiens
ggctgggtgctgg

SEQ ID NO: 5772194 - DNA, 20 bp, Homo sapiens
ggctgggtggcacaccaccc

SEQ ID NO: 5772195 - DNA, 17 bp, Homo sapiens
ggctgggtgggcccaga

SEQ ID NO: 5772196 - DNA, 19 bp, Homo sapiens
ggctgggtgggcccagaac

SEQ ID NO: 5772197 - DNA, 19 bp, Homo sapiens
ggctgggtggggggagaag

SEQ ID NO: 5772198 - DNA, 14 bp, Homo sapiens
ggctgggttggagg

SEQ ID NO: 5772199 - DNA, 21 bp, Homo sapiens
ggctgggttgtcactgagact

SEQ ID NO: 5772200 - DNA, 19 bp, Homo sapiens
ggctgggtttgggcagtgg

SEQ ID NO: 5772201 - DNA, 15 bp, Homo sapiens
ggctggtaagagaag

SEQ ID NO: 5772202 - DNA, 15 bp, Homo sapiens
ggctggtaagggacc

SEQ ID NO: 5772203 - DNA, 15 bp, Homo sapiens
ggctggtagcagcag

SEQ ID NO: 5772204 - DNA, 17 bp, Homo sapiens
ggctggtagcagcaggc

SEQ ID NO: 5772205 - DNA, 21 bp, Homo sapiens
ggctggtagcagcaggctcag

SEQ ID NO: 5772206 - DNA, 17 bp, Homo sapiens
ggctggtagctcaggtg

SEQ ID NO: 5772207 - DNA, 21 bp, Homo sapiens
ggctggtagctcaggtgggcg

SEQ ID NO: 5772208 - DNA, 16 bp, Homo sapiens
ggctggtatctcagaa

SEQ ID NO: 5772209 - DNA, 14 bp, Homo sapiens
ggctggtattctct

SEQ ID NO: 5772210 - DNA, 16 bp, Homo sapiens
ggctggtattctctct

SEQ ID NO: 5772211 - DNA, 13 bp, Homo sapiens
ggctggtcactct

SEQ ID NO: 5772212 - DNA, 16 bp, Homo sapiens
ggctggtccgagctga

SEQ ID NO: 5772213 - DNA, 16 bp, Homo sapiens
ggctggtccttattta

SEQ ID NO: 5772214 - DNA, 20 bp, Homo sapiens
ggctggtcttgaactcctgg

SEQ ID NO: 5772215 - DNA, 21 bp, Homo sapiens
ggctggtcttggggaggcagg

SEQ ID NO: 5772216 - DNA, 23 bp, Homo sapiens
ggctggtgagaccccgcactgca

SEQ ID NO: 5772217 - DNA, 13 bp, Homo sapiens
ggctggtgcaggg

SEQ ID NO: 5772218 - DNA, 16 bp, Homo sapiens
ggctggtgcccatgaa

SEQ ID NO: 5772219 - DNA, 15 bp, Homo sapiens
ggctggtgccccaca

SEQ ID NO: 5772220 - DNA, 14 bp, Homo sapiens
ggctggtgcctgag

SEQ ID NO: 5772221 - DNA, 14 bp, Homo sapiens
ggctggtggccttg

SEQ ID NO: 5772222 - DNA, 21 bp, Homo sapiens
ggctggtggctcccggagggc

SEQ ID NO: 5772223 - DNA, 22 bp, Homo sapiens
ggctggtgggataggagggtgc

SEQ ID NO: 5772224 - DNA, 12 bp, Homo sapiens
ggctggtgtccc

SEQ ID NO: 5772225 - DNA, 22 bp, Homo sapiens
ggctggtgtccccttcccctgc

SEQ ID NO: 5772226 - DNA, 16 bp, Homo sapiens
ggctggtgtggctgct

SEQ ID NO: 5772227 - DNA, 16 bp, Homo sapiens
ggctggtgtggtacag

SEQ ID NO: 5772228 - DNA, 22 bp, Homo sapiens
ggctggtgtggtacagagaagc

SEQ ID NO: 5772229 - DNA, 17 bp, Homo sapiens
ggctggtgttaacagaa

SEQ ID NO: 5772230 - DNA, 16 bp, Homo sapiens
ggctggttccatctag

SEQ ID NO: 5772231 - DNA, 23 bp, Homo sapiens
ggctggttcggatttggggtgga

SEQ ID NO: 5772232 - DNA, 20 bp, Homo sapiens
ggctggtttcaaactcctga

SEQ ID NO: 5772233 - DNA, 23 bp, Homo sapiens
ggctggtttcaaactcctgacct

SEQ ID NO: 5772234 - DNA, 23 bp, Homo sapiens
ggctggtttgcccagagccaagc

SEQ ID NO: 5772235 - DNA, 14 bp, Homo sapiens
ggctgtaaaaacac

SEQ ID NO: 5772236 - DNA, 16 bp, Homo sapiens
ggctgtaaaatgcatg

SEQ ID NO: 5772237 - DNA, 14 bp, Homo sapiens
ggctgtaaattgaa

SEQ ID NO: 5772238 - DNA, 21 bp, Homo sapiens
ggctgtaaattgaacttccca

SEQ ID NO: 5772239 - DNA, 14 bp, Homo sapiens
ggctgtaaggctct

SEQ ID NO: 5772240 - DNA, 16 bp, Homo sapiens
ggctgtaatgtaacag

SEQ ID NO: 5772241 - DNA, 22 bp, Homo sapiens
ggctgtacacaccctccagcac

SEQ ID NO: 5772242 - DNA, 12 bp, Homo sapiens
ggctgtacatag

SEQ ID NO: 5772243 - DNA, 17 bp, Homo sapiens
ggctgtacatagtcctt

SEQ ID NO: 5772244 - DNA, 18 bp, Homo sapiens
ggctgtacatcagacaga

SEQ ID NO: 5772245 - DNA, 21 bp, Homo sapiens
ggctgtaggactcgcagtcag

SEQ ID NO: 5772246 - DNA, 23 bp, Homo sapiens
ggctgtagttacattaatgccca

SEQ ID NO: 5772247 - DNA, 23 bp, Homo sapiens
ggctgtagttgggcctaaataaa

SEQ ID NO: 5772248 - DNA, 22 bp, Homo sapiens
ggctgtatcccatgagcctcag

SEQ ID NO: 5772249 - DNA, 14 bp, Homo sapiens
ggctgtatttgctg

SEQ ID NO: 5772250 - DNA, 18 bp, Homo sapiens
ggctgtcaaatccatgtg

SEQ ID NO: 5772251 - DNA, 18 bp, Homo sapiens
ggctgtcagtatgacatt

SEQ ID NO: 5772252 - DNA, 14 bp, Homo sapiens
ggctgtccacccgc

SEQ ID NO: 5772253 - DNA, 23 bp, Homo sapiens
ggctgtccagttcccagaaggca

SEQ ID NO: 5772254 - DNA, 18 bp, Homo sapiens
ggctgtcccctccatctg

SEQ ID NO: 5772255 - DNA, 14 bp, Homo sapiens
ggctgtcccctgca

SEQ ID NO: 5772256 - DNA, 21 bp, Homo sapiens
ggctgtccgtgtgcctcctgt

SEQ ID NO: 5772257 - DNA, 22 bp, Homo sapiens
ggctgtccgtgtgcctcctgtg

SEQ ID NO: 5772258 - DNA, 18 bp, Homo sapiens
ggctgtcctaccatcagc

SEQ ID NO: 5772259 - DNA, 13 bp, Homo sapiens
ggctgtcctgctc

SEQ ID NO: 5772260 - DNA, 15 bp, Homo sapiens
ggctgtcctgctgcc

SEQ ID NO: 5772261 - DNA, 19 bp, Homo sapiens
ggctgtccttccccttccc

SEQ ID NO: 5772262 - DNA, 21 bp, Homo sapiens
ggctgtcgggggctgtggatg

SEQ ID NO: 5772263 - DNA, 13 bp, Homo sapiens
ggctgtctgcctg

SEQ ID NO: 5772264 - DNA, 13 bp, Homo sapiens
ggctgtctggggc

SEQ ID NO: 5772265 - DNA, 19 bp, Homo sapiens
ggctgtctgtctgcagtgc

SEQ ID NO: 5772266 - DNA, 15 bp, Homo sapiens
ggctgtcttctccca

SEQ ID NO: 5772267 - DNA, 19 bp, Homo sapiens
ggctgtcttctcccagagc

SEQ ID NO: 5772268 - DNA, 19 bp, Homo sapiens
ggctgtgaatgccaaagcc

SEQ ID NO: 5772269 - DNA, 18 bp, Homo sapiens
ggctgtgactctgggcag

SEQ ID NO: 5772270 - DNA, 19 bp, Homo sapiens
ggctgtgactctgggcagg

SEQ ID NO: 5772271 - DNA, 17 bp, Homo sapiens
ggctgtgactcttctct

SEQ ID NO: 5772272 - DNA, 19 bp, Homo sapiens
ggctgtgactcttctctca

SEQ ID NO: 5772273 - DNA, 20 bp, Homo sapiens
ggctgtgactcttctctcaa

SEQ ID NO: 5772274 - DNA, 23 bp, Homo sapiens
ggctgtgagacgaggcaggggct

SEQ ID NO: 5772275 - DNA, 17 bp, Homo sapiens
ggctgtgagcagcctcc

SEQ ID NO: 5772276 - DNA, 19 bp, Homo sapiens
ggctgtgcacattctccct

SEQ ID NO: 5772277 - DNA, 22 bp, Homo sapiens
ggctgtgcagtcctgggtcctc

SEQ ID NO: 5772278 - DNA, 14 bp, Homo sapiens
ggctgtgccaggct

SEQ ID NO: 5772279 - DNA, 16 bp, Homo sapiens
ggctgtgccaggctgg

SEQ ID NO: 5772280 - DNA, 18 bp, Homo sapiens
ggctgtgcccagcaggcc

SEQ ID NO: 5772281 - DNA, 22 bp, Homo sapiens
ggcttccgtgtcctctccccca

SEQ ID NO: 5772282 - DNA, 21 bp, Homo sapiens
ggcttcctcagttcctgccct

SEQ ID NO: 5772283 - DNA, 21 bp, Homo sapiens
ggcttcctcattccttgtctt

SEQ ID NO: 5772284 - DNA, 16 bp, Homo sapiens
ggcttcctccctccac

SEQ ID NO: 5772285 - DNA, 20 bp, Homo sapiens
ggcttcctccgtccacccag

SEQ ID NO: 5772286 - DNA, 22 bp, Homo sapiens
ggcttcctccgtccacccaggc

SEQ ID NO: 5772287 - DNA, 23 bp, Homo sapiens
ggcttcctccgtccacccaggct

SEQ ID NO: 5772288 - DNA, 12 bp, Homo sapiens
ggcttcctctgc

SEQ ID NO: 5772289 - DNA, 17 bp, Homo sapiens
ggcttcctctgctgcat

SEQ ID NO: 5772290 - DNA, 22 bp, Homo sapiens
ggcttcctcttccgggcagaaa

SEQ ID NO: 5772291 - DNA, 14 bp, Homo sapiens
ggcttcctgactga

SEQ ID NO: 5772292 - DNA, 19 bp, Homo sapiens
ggcttcctgactgacacag

SEQ ID NO: 5772293 - DNA, 16 bp, Homo sapiens
ggcttcctgccctagc

SEQ ID NO: 5772294 - DNA, 18 bp, Homo sapiens
ggcttcctgccctagcag

SEQ ID NO: 5772295 - DNA, 19 bp, Homo sapiens
ggcttcctgcgtcctcctc

SEQ ID NO: 5772296 - DNA, 18 bp, Homo sapiens
ggcttcctgctgggactg

SEQ ID NO: 5772297 - DNA, 21 bp, Homo sapiens
ggcttcctggagcagaagcag

SEQ ID NO: 5772298 - DNA, 15 bp, Homo sapiens
ggcttcctggcgccc

SEQ ID NO: 5772299 - DNA, 12 bp, Homo sapiens
ggcttcctgggc

SEQ ID NO: 5772300 - DNA, 13 bp, Homo sapiens
ggcttcctggtgc

SEQ ID NO: 5772301 - DNA, 12 bp, Homo sapiens
ggcttcctgtcc

SEQ ID NO: 5772302 - DNA, 20 bp, Homo sapiens
ggcttcctgtggctttgttt

SEQ ID NO: 5772303 - DNA, 17 bp, Homo sapiens
ggcttcctttagagacc

SEQ ID NO: 5772304 - DNA, 22 bp, Homo sapiens
ggcttcggaacacggagtggcc

SEQ ID NO: 5772305 - DNA, 14 bp, Homo sapiens
ggcttcggagggcc

SEQ ID NO: 5772306 - DNA, 18 bp, Homo sapiens
ggcttcggagggccgcag

SEQ ID NO: 5772307 - DNA, 17 bp, Homo sapiens
ggcttcggagtgaatgt

SEQ ID NO: 5772308 - DNA, 17 bp, Homo sapiens
ggcttcgttaattaatg

SEQ ID NO: 5772309 - DNA, 21 bp, Homo sapiens
ggcttcgttttcagtcttctg

SEQ ID NO: 5772310 - DNA, 19 bp, Homo sapiens
ggcttctaatgacccagat

SEQ ID NO: 5772311 - DNA, 16 bp, Homo sapiens
ggcttctacctgcagg

SEQ ID NO: 5772312 - DNA, 21 bp, Homo sapiens
ggcttctcatacgtccaccat

SEQ ID NO: 5772313 - DNA, 23 bp, Homo sapiens
ggcttctccagggaattcttaca

SEQ ID NO: 5772314 - DNA, 15 bp, Homo sapiens
ggcttctccccctca

SEQ ID NO: 5772315 - DNA, 20 bp, Homo sapiens
ggcttctccctggactctgt

SEQ ID NO: 5772316 - DNA, 14 bp, Homo sapiens
ggcttctccctggg

SEQ ID NO: 5772317 - DNA, 16 bp, Homo sapiens
ggcttctccgccagcc

SEQ ID NO: 5772318 - DNA, 14 bp, Homo sapiens
ggcttctcctcctc

SEQ ID NO: 5772319 - DNA, 13 bp, Homo sapiens
ggcttctcctgac

SEQ ID NO: 5772320 - DNA, 16 bp, Homo sapiens
ggcttctcctgaccca

SEQ ID NO: 5772321 - DNA, 22 bp, Homo sapiens
ggcttctcctgttttatatatt

SEQ ID NO: 5772322 - DNA, 15 bp, Homo sapiens
ggcttctctccacag

SEQ ID NO: 5772323 - DNA, 14 bp, Homo sapiens
ggcttctctctgtg

SEQ ID NO: 5772324 - DNA, 14 bp, Homo sapiens
ggcttctctctttt

SEQ ID NO: 5772325 - DNA, 16 bp, Homo sapiens
ggcttctctgaggaag

SEQ ID NO: 5772326 - DNA, 11 bp, Homo sapiens
ggcttctctgg

SEQ ID NO: 5772327 - DNA, 21 bp, Homo sapiens
ggcttctgagtttatattctg

SEQ ID NO: 5772328 - DNA, 16 bp, Homo sapiens
ggcttctgatgaatct

SEQ ID NO: 5772329 - DNA, 19 bp, Homo sapiens
ggcttctgatttttctctt

SEQ ID NO: 5772330 - DNA, 20 bp, Homo sapiens
ggcttctgatttttctcttt

SEQ ID NO: 5772331 - DNA, 15 bp, Homo sapiens
ggcttctgcaccctc

SEQ ID NO: 5772332 - DNA, 18 bp, Homo sapiens
ggcttctgcaccctccac

SEQ ID NO: 5772333 - DNA, 12 bp, Homo sapiens
ggcttctgcagg

SEQ ID NO: 5772334 - DNA, 18 bp, Homo sapiens
ggcttctgcgtccaccag

SEQ ID NO: 5772335 - DNA, 22 bp, Homo sapiens
ggcttctgcgtccaccaggcct

SEQ ID NO: 5772336 - DNA, 19 bp, Homo sapiens
ggcttctgctggggcctgg

SEQ ID NO: 5772337 - DNA, 18 bp, Homo sapiens
ggcttctgcttgtcatcc

SEQ ID NO: 5772338 - DNA, 24 bp, Homo sapiens
ggcttctgggacaggcaccatgct

SEQ ID NO: 5772339 - DNA, 19 bp, Homo sapiens
ggcttctgggtggctcctg

SEQ ID NO: 5772340 - DNA, 18 bp, Homo sapiens
ggcttctgtggttgtgga

SEQ ID NO: 5772341 - DNA, 16 bp, Homo sapiens
ggcttctgttctctgc

SEQ ID NO: 5772342 - DNA, 12 bp, Homo sapiens
ggcttcttcctc

SEQ ID NO: 5772343 - DNA, 13 bp, Homo sapiens
ggcttcttcctca

SEQ ID NO: 5772344 - DNA, 20 bp, Homo sapiens
ggcttcttcctcacactgct

SEQ ID NO: 5772345 - DNA, 14 bp, Homo sapiens
ggcttcttcctgga

SEQ ID NO: 5772346 - DNA, 22 bp, Homo sapiens
ggcttcttcctggatggggcag

SEQ ID NO: 5772347 - DNA, 13 bp, Homo sapiens
ggcttcttcttat

SEQ ID NO: 5772348 - DNA, 22 bp, Homo sapiens
ggcttctttgctttctcgtggg

SEQ ID NO: 5772349 - DNA, 18 bp, Homo sapiens
ggcttcttttctttgtat

SEQ ID NO: 5772350 - DNA, 12 bp, Homo sapiens
ggcttgaacctt

SEQ ID NO: 5772351 - DNA, 14 bp, Homo sapiens
ggcttgaaggactg

SEQ ID NO: 5772352 - DNA, 15 bp, Homo sapiens
ggcttgaatttgcat

SEQ ID NO: 5772353 - DNA, 15 bp, Homo sapiens
ggcttgactcaggat

SEQ ID NO: 5772354 - DNA, 17 bp, Homo sapiens
ggcttgactttggctga

SEQ ID NO: 5772355 - DNA, 17 bp, Homo sapiens
ggcttgaggtgaatttc

SEQ ID NO: 5772356 - DNA, 19 bp, Homo sapiens
ggcttgagtgagaagagct

SEQ ID NO: 5772357 - DNA, 22 bp, Homo sapiens
ggcttgagtttaaattgtaata

SEQ ID NO: 5772358 - DNA, 16 bp, Homo sapiens
ggcttgagttttcatt

SEQ ID NO: 5772359 - DNA, 16 bp, Homo sapiens
ggcttgcaagaggagg

SEQ ID NO: 5772360 - DNA, 14 bp, Homo sapiens
ggcttgccacaccc

SEQ ID NO: 5772361 - DNA, 15 bp, Homo sapiens
ggcttgccacacccc

SEQ ID NO: 5772362 - DNA, 16 bp, Homo sapiens
ggcttgccacagctct

SEQ ID NO: 5772363 - DNA, 14 bp, Homo sapiens
ggcttgcccaggag

SEQ ID NO: 5772364 - DNA, 21 bp, Homo sapiens
ggcttgccccaggactctggc

SEQ ID NO: 5772365 - DNA, 12 bp, Homo sapiens
ggcttgccctgg

SEQ ID NO: 5772366 - DNA, 15 bp, Homo sapiens
ggcttgccctgggtc

SEQ ID NO: 5772367 - DNA, 13 bp, Homo sapiens
ggcttgcctgcag

SEQ ID NO: 5772368 - DNA, 16 bp, Homo sapiens
ggcttgcctgggctgg

SEQ ID NO: 5772369 - DNA, 12 bp, Homo sapiens
ggcttgcctgta

SEQ ID NO: 5772370 - DNA, 15 bp, Homo sapiens
ggcttgctccagggt

SEQ ID NO: 5772371 - DNA, 22 bp, Homo sapiens
ggcttgctccagggtcttgggc

SEQ ID NO: 5772372 - DNA, 21 bp, Homo sapiens
ggcttgctcccgccccagggt

SEQ ID NO: 5772373 - DNA, 15 bp, Homo sapiens
ggcttgctgagaggg

SEQ ID NO: 5772374 - DNA, 17 bp, Homo sapiens
ggcttgctgatggctgc

SEQ ID NO: 5772375 - DNA, 11 bp, Homo sapiens
ggcttgctgcc

SEQ ID NO: 5772376 - DNA, 14 bp, Homo sapiens
ggcttgctgctccg

SEQ ID NO: 5772377 - DNA, 11 bp, Homo sapiens
ggcttgctgtt

SEQ ID NO: 5772378 - DNA, 18 bp, Homo sapiens
ggcttgcttatgtgtagg

SEQ ID NO: 5772379 - DNA, 21 bp, Homo sapiens
ggcttggagaggtatgtgccc

SEQ ID NO: 5772380 - DNA, 22 bp, Homo sapiens
ggcttggagaggtatgtgcccc

SEQ ID NO: 5772381 - DNA, 15 bp, Homo sapiens
ggcttggagcagaga

SEQ ID NO: 5772382 - DNA, 23 bp, Homo sapiens
ggcttggagcagagacggcagcc

SEQ ID NO: 5772383 - DNA, 12 bp, Homo sapiens
ggcttggaggaa

SEQ ID NO: 5772384 - DNA, 17 bp, Homo sapiens
ggcttggagtggccaaa

SEQ ID NO: 5772385 - DNA, 15 bp, Homo sapiens
ggcttggagtgggtt

SEQ ID NO: 5772386 - DNA, 24 bp, Homo sapiens
ggcttggatttcgtgtgccgctgc

SEQ ID NO: 5772387 - DNA, 14 bp, Homo sapiens
ggcttggcatctgt

SEQ ID NO: 5772388 - DNA, 17 bp, Homo sapiens
ggcttggcatctgtgtg

SEQ ID NO: 5772389 - DNA, 21 bp, Homo sapiens
ggcttggccacaacctgaaag

SEQ ID NO: 5772390 - DNA, 20 bp, Homo sapiens
ggcttggcccgcggcctgca

SEQ ID NO: 5772391 - DNA, 13 bp, Homo sapiens
ggcttggccctgg

SEQ ID NO: 5772392 - DNA, 16 bp, Homo sapiens
ggcttggcctgctgtg

SEQ ID NO: 5772393 - DNA, 12 bp, Homo sapiens
ggcttggccttg

SEQ ID NO: 5772394 - DNA, 18 bp, Homo sapiens
ggcttggctcgcaccccc

SEQ ID NO: 5772395 - DNA, 15 bp, Homo sapiens
ggcttggctgcccca

SEQ ID NO: 5772396 - DNA, 12 bp, Homo sapiens
ggcttgggattt

SEQ ID NO: 5772397 - DNA, 16 bp, Homo sapiens
ggcttgggccctgcac

SEQ ID NO: 5772398 - DNA, 19 bp, Homo sapiens
ggcttggggaccagagctg

SEQ ID NO: 5772399 - DNA, 21 bp, Homo sapiens
ggcttggggaccagagctgcc

SEQ ID NO: 5772400 - DNA, 21 bp, Homo sapiens
ggcttggggagcaggtctctg

SEQ ID NO: 5772401 - DNA, 23 bp, Homo sapiens
ggcttggggagcaggtctctggc

SEQ ID NO: 5772402 - DNA, 22 bp, Homo sapiens
ggcttggggctcacacacctgt

SEQ ID NO: 5772403 - DNA, 19 bp, Homo sapiens
ggcttggggtagagaggac

SEQ ID NO: 5772404 - DNA, 21 bp, Homo sapiens
ggcttggggtagagaggacag

SEQ ID NO: 5772405 - DNA, 14 bp, Homo sapiens
ggcttggtgtctgc

SEQ ID NO: 5772406 - DNA, 17 bp, Homo sapiens
ggcttgtacatttttaa

SEQ ID NO: 5772407 - DNA, 21 bp, Homo sapiens
ggcttgtacatttttaaattc

SEQ ID NO: 5772408 - DNA, 16 bp, Homo sapiens
ggcttgtagggtgagg

SEQ ID NO: 5772409 - DNA, 13 bp, Homo sapiens
ggcttgtcacagt

SEQ ID NO: 5772410 - DNA, 12 bp, Homo sapiens
ggcttgtgaact

SEQ ID NO: 5772411 - DNA, 17 bp, Homo sapiens
ggcttgtgattctggga

SEQ ID NO: 5772412 - DNA, 18 bp, Homo sapiens
ggcttgtggggcctggga

SEQ ID NO: 5772413 - DNA, 17 bp, Homo sapiens
ggcttgtggtggctgct

SEQ ID NO: 5772414 - DNA, 15 bp, Homo sapiens
ggcttgttgtaaagc

SEQ ID NO: 5772415 - DNA, 17 bp, Homo sapiens
ggcttgttttattttgg

SEQ ID NO: 5772416 - DNA, 18 bp, Homo sapiens
ggcttgtttttcttcagc

SEQ ID NO: 5772417 - DNA, 12 bp, Homo sapiens
ggctttaaaatt

SEQ ID NO: 5772418 - DNA, 15 bp, Homo sapiens
ggctttaaacatgat

SEQ ID NO: 5772419 - DNA, 24 bp, Homo sapiens
ggctttaaagctgagagaccctgg

SEQ ID NO: 5772420 - DNA, 16 bp, Homo sapiens
ggctttaaataaaaga

SEQ ID NO: 5772421 - DNA, 17 bp, Homo sapiens
ggctttaaataaaagag

SEQ ID NO: 5772422 - DNA, 18 bp, Homo sapiens
ggctttacaaataatttt

SEQ ID NO: 5772423 - DNA, 23 bp, Homo sapiens
ggctttacctttttgtatgtgaa

SEQ ID NO: 5772424 - DNA, 14 bp, Homo sapiens
ggctttatgcaaat

SEQ ID NO: 5772425 - DNA, 11 bp, Homo sapiens
ggctttcaaag

SEQ ID NO: 5772426 - DNA, 17 bp, Homo sapiens
ggctttcacgggcccca

SEQ ID NO: 5772427 - DNA, 19 bp, Homo sapiens
ggctttcagcgcccccagg

SEQ ID NO: 5772428 - DNA, 23 bp, Homo sapiens
ggctttcagcgcccccaggcctg

SEQ ID NO: 5772429 - DNA, 12 bp, Homo sapiens
ggctttcagctt

SEQ ID NO: 5772430 - DNA, 22 bp, Homo sapiens
ggctttcagggcagcccctgca

SEQ ID NO: 5772431 - DNA, 23 bp, Homo sapiens
ggctttcagtgatatctttctca

SEQ ID NO: 5772432 - DNA, 20 bp, Homo sapiens
ggctttcatgaggaggcaga

SEQ ID NO: 5772433 - DNA, 20 bp, Homo sapiens
ggctttcattttctctcagg

SEQ ID NO: 5772434 - DNA, 14 bp, Homo sapiens
ggctttccaggcac

SEQ ID NO: 5772435 - DNA, 15 bp, Homo sapiens
ggctttcccaacagc

SEQ ID NO: 5772436 - DNA, 19 bp, Homo sapiens
ggctttcctgtgccaggtg

SEQ ID NO: 5772437 - DNA, 13 bp, Homo sapiens
ggctttccttgtg

SEQ ID NO: 5772438 - DNA, 20 bp, Homo sapiens
ggctttccttgtggcagagg

SEQ ID NO: 5772439 - DNA, 19 bp, Homo sapiens
ggctttcgtccacagcttc

SEQ ID NO: 5772440 - DNA, 21 bp, Homo sapiens
ggctttctaccacacacagcc

SEQ ID NO: 5772441 - DNA, 13 bp, Homo sapiens
ggctttctctctg

SEQ ID NO: 5772442 - DNA, 20 bp, Homo sapiens
ggctttctctgcctctgggc

SEQ ID NO: 5772443 - DNA, 23 bp, Homo sapiens
ggctttctctgcctctgggcagc

SEQ ID NO: 5772444 - DNA, 22 bp, Homo sapiens
ggctttctcttccccttcctgt

SEQ ID NO: 5772445 - DNA, 13 bp, Homo sapiens
ggctttctggaat

SEQ ID NO: 5772446 - DNA, 16 bp, Homo sapiens
ggctttctgggctctg

SEQ ID NO: 5772447 - DNA, 18 bp, Homo sapiens
ggctttctgggctctgga

SEQ ID NO: 5772448 - DNA, 21 bp, Homo sapiens
ggctttgaaacctcagggctg

SEQ ID NO: 5772449 - DNA, 16 bp, Homo sapiens
ggctttgatgttcctt

SEQ ID NO: 5772450 - DNA, 15 bp, Homo sapiens
ggctttgcaaccatt

SEQ ID NO: 5772451 - DNA, 14 bp, Homo sapiens
ggctttgcagctgc

SEQ ID NO: 5772452 - DNA, 16 bp, Homo sapiens
ggctttgcagctgctg

SEQ ID NO: 5772453 - DNA, 20 bp, Homo sapiens
ggctttgcagctgctgtctg

SEQ ID NO: 5772454 - DNA, 14 bp, Homo sapiens
ggctttgcaggctc

SEQ ID NO: 5772455 - DNA, 16 bp, Homo sapiens
ggctttgcaggctctg

SEQ ID NO: 5772456 - DNA, 17 bp, Homo sapiens
ggctttgcaggctctgg

SEQ ID NO: 5772457 - DNA, 13 bp, Homo sapiens
ggctttgcaggga

SEQ ID NO: 5772458 - DNA, 20 bp, Homo sapiens
ggctttgcatagctttcaca

SEQ ID NO: 5772459 - DNA, 14 bp, Homo sapiens
ggctttgccagctt

SEQ ID NO: 5772460 - DNA, 22 bp, Homo sapiens
gggaagagagcctgcaggatct

SEQ ID NO: 5772461 - DNA, 11 bp, Homo sapiens
gggaagagagg

SEQ ID NO: 5772462 - DNA, 21 bp, Homo sapiens
gggaagagaggagttcaatga

SEQ ID NO: 5772463 - DNA, 24 bp, Homo sapiens
gggaagagaggagttcaatgatct

SEQ ID NO: 5772464 - DNA, 20 bp, Homo sapiens
gggaagagatcccaggaggt

SEQ ID NO: 5772465 - DNA, 14 bp, Homo sapiens
gggaagagcacagc

SEQ ID NO: 5772466 - DNA, 20 bp, Homo sapiens
gggaagagcacagccctccc

SEQ ID NO: 5772467 - DNA, 12 bp, Homo sapiens
gggaagaggaga

SEQ ID NO: 5772468 - DNA, 13 bp, Homo sapiens
gggaagaggcctt

SEQ ID NO: 5772469 - DNA, 18 bp, Homo sapiens
gggaagagggagaccaaa

SEQ ID NO: 5772470 - DNA, 19 bp, Homo sapiens
gggaagagggttaggaggg

SEQ ID NO: 5772471 - DNA, 21 bp, Homo sapiens
gggaagagtgactctccaggg

SEQ ID NO: 5772472 - DNA, 18 bp, Homo sapiens
gggaagagtggaggtgga

SEQ ID NO: 5772473 - DNA, 21 bp, Homo sapiens
gggaagatcctccttccaggc

SEQ ID NO: 5772474 - DNA, 22 bp, Homo sapiens
gggaagatcctccttccaggcc

SEQ ID NO: 5772475 - DNA, 23 bp, Homo sapiens
gggaagatgaggttctgagacca

SEQ ID NO: 5772476 - DNA, 12 bp, Homo sapiens
gggaagatgctg

SEQ ID NO: 5772477 - DNA, 16 bp, Homo sapiens
gggaagatggtagcag

SEQ ID NO: 5772478 - DNA, 17 bp, Homo sapiens
gggaagatggtagcaga

SEQ ID NO: 5772479 - DNA, 19 bp, Homo sapiens
gggaagatggttcaaagat

SEQ ID NO: 5772480 - DNA, 16 bp, Homo sapiens
gggaagatgtctcaga

SEQ ID NO: 5772481 - DNA, 23 bp, Homo sapiens
gggaagatgtctcagagccttcc

SEQ ID NO: 5772482 - DNA, 14 bp, Homo sapiens
gggaagattagaaa

SEQ ID NO: 5772483 - DNA, 22 bp, Homo sapiens
gggaagattttatgcacagcct

SEQ ID NO: 5772484 - DNA, 17 bp, Homo sapiens
gggaagcaaagggggga

SEQ ID NO: 5772485 - DNA, 15 bp, Homo sapiens
gggaagcaagcaggg

SEQ ID NO: 5772486 - DNA, 19 bp, Homo sapiens
gggaagcagagcctggggt

SEQ ID NO: 5772487 - DNA, 12 bp, Homo sapiens
gggaagcaggca

SEQ ID NO: 5772488 - DNA, 12 bp, Homo sapiens
gggaagcaggga

SEQ ID NO: 5772489 - DNA, 17 bp, Homo sapiens
gggaagcatcctcccca

SEQ ID NO: 5772490 - DNA, 18 bp, Homo sapiens
gggaagcatcctccccac

SEQ ID NO: 5772491 - DNA, 23 bp, Homo sapiens
gggaagcatgtgacacccacaat

SEQ ID NO: 5772492 - DNA, 18 bp, Homo sapiens
gggaagcccacccgcccc

SEQ ID NO: 5772493 - DNA, 19 bp, Homo sapiens
gggaagcccacccgcccca

SEQ ID NO: 5772494 - DNA, 23 bp, Homo sapiens
gggaagcccacccgccccagaga

SEQ ID NO: 5772495 - DNA, 15 bp, Homo sapiens
gggaagcccagcctg

SEQ ID NO: 5772496 - DNA, 16 bp, Homo sapiens
gggaagcccagcctgc

SEQ ID NO: 5772497 - DNA, 19 bp, Homo sapiens
gggaagcccatcctgacca

SEQ ID NO: 5772498 - DNA, 12 bp, Homo sapiens
gggaagccctga

SEQ ID NO: 5772499 - DNA, 12 bp, Homo sapiens
gggaagcctggg

SEQ ID NO: 5772500 - DNA, 14 bp, Homo sapiens
gggaagcctgggtg

SEQ ID NO: 5772501 - DNA, 19 bp, Homo sapiens
gggaagcctgtgccagcac

SEQ ID NO: 5772502 - DNA, 15 bp, Homo sapiens
gggaagccttttgca

SEQ ID NO: 5772503 - DNA, 18 bp, Homo sapiens
gggaagcgctcagaacag

SEQ ID NO: 5772504 - DNA, 21 bp, Homo sapiens
gggaagcgtcgccccagtggc

SEQ ID NO: 5772505 - DNA, 23 bp, Homo sapiens
gggaagctcccaccccactcagg

SEQ ID NO: 5772506 - DNA, 16 bp, Homo sapiens
gggaagctgaggccca

SEQ ID NO: 5772507 - DNA, 23 bp, Homo sapiens
gggaagctgaggcccatggccac

SEQ ID NO: 5772508 - DNA, 21 bp, Homo sapiens
gggaagctgaggcgggagaat

SEQ ID NO: 5772509 - DNA, 11 bp, Homo sapiens
gggaagctgat

SEQ ID NO: 5772510 - DNA, 13 bp, Homo sapiens
gggaagctgcagc

SEQ ID NO: 5772511 - DNA, 19 bp, Homo sapiens
gggaagctgcagcttggga

SEQ ID NO: 5772512 - DNA, 22 bp, Homo sapiens
gggaagctgcagcttgggagag

SEQ ID NO: 5772513 - DNA, 18 bp, Homo sapiens
gggaagctgccagcccag

SEQ ID NO: 5772514 - DNA, 14 bp, Homo sapiens
gggaagctgggccc

SEQ ID NO: 5772515 - DNA, 21 bp, Homo sapiens
gggaagcttctgtctccagct

SEQ ID NO: 5772516 - DNA, 20 bp, Homo sapiens
gggaagcttcttaaatgaga

SEQ ID NO: 5772517 - DNA, 12 bp, Homo sapiens
gggaaggaaaaa

SEQ ID NO: 5772518 - DNA, 16 bp, Homo sapiens
gggaaggaaataacat

SEQ ID NO: 5772519 - DNA, 12 bp, Homo sapiens
gggaaggacaca

SEQ ID NO: 5772520 - DNA, 17 bp, Homo sapiens
gggaaggacacagcagt

SEQ ID NO: 5772521 - DNA, 19 bp, Homo sapiens
gggaaggacacagcagtat

SEQ ID NO: 5772522 - DNA, 21 bp, Homo sapiens
gggaaggacacagcagtattg

SEQ ID NO: 5772523 - DNA, 14 bp, Homo sapiens
gggaaggacagaaa

SEQ ID NO: 5772524 - DNA, 16 bp, Homo sapiens
gggaaggacagctgtg

SEQ ID NO: 5772525 - DNA, 14 bp, Homo sapiens
gggaaggacaggac

SEQ ID NO: 5772526 - DNA, 19 bp, Homo sapiens
gggaaggacagtccctgct

SEQ ID NO: 5772527 - DNA, 20 bp, Homo sapiens
gggaaggacagtccctgctg

SEQ ID NO: 5772528 - DNA, 15 bp, Homo sapiens
gggaaggaggagcct

SEQ ID NO: 5772529 - DNA, 17 bp, Homo sapiens
gggaaggaggctggctt

SEQ ID NO: 5772530 - DNA, 16 bp, Homo sapiens
gggaaggatacaaaag

SEQ ID NO: 5772531 - DNA, 23 bp, Homo sapiens
gggaaggatacaaaagcatgtga

SEQ ID NO: 5772532 - DNA, 15 bp, Homo sapiens
gggaaggcacctgct

SEQ ID NO: 5772533 - DNA, 24 bp, Homo sapiens
gggaaggcacctgctcccacagaa

SEQ ID NO: 5772534 - DNA, 13 bp, Homo sapiens
gggaaggccacct

SEQ ID NO: 5772535 - DNA, 14 bp, Homo sapiens
gggaaggccacctc

SEQ ID NO: 5772536 - DNA, 15 bp, Homo sapiens
gggaaggccacctcc

SEQ ID NO: 5772537 - DNA, 15 bp, Homo sapiens
gggaaggccacctgc

SEQ ID NO: 5772538 - DNA, 12 bp, Homo sapiens
gggaaggccagc

SEQ ID NO: 5772539 - DNA, 22 bp, Homo sapiens
gggaaggccggcagcgggcgga

SEQ ID NO: 5772540 - DNA, 11 bp, Homo sapiens
gggaaggcctc

SEQ ID NO: 5772541 - DNA, 15 bp, Homo sapiens
gggaaggcctgactt

SEQ ID NO: 5772542 - DNA, 19 bp, Homo sapiens
gggaaggcctgagggaagc

SEQ ID NO: 5772543 - DNA, 23 bp, Homo sapiens
gggaaggcctgagggaagcccac

SEQ ID NO: 5772544 - DNA, 16 bp, Homo sapiens
gggaaggcgagtctgg

SEQ ID NO: 5772545 - DNA, 14 bp, Homo sapiens
gggaaggctgcaaa

SEQ ID NO: 5772546 - DNA, 14 bp, Homo sapiens
gggaaggctgctgt

SEQ ID NO: 5772547 - DNA, 14 bp, Homo sapiens
gggaagggacacac

SEQ ID NO: 5772548 - DNA, 13 bp, Homo sapiens
gggaagggagagc

SEQ ID NO: 5772549 - DNA, 16 bp, Homo sapiens
gggaagggagagcggg

SEQ ID NO: 5772550 - DNA, 14 bp, Homo sapiens
gggaagggagccaa

SEQ ID NO: 5772551 - DNA, 16 bp, Homo sapiens
gggaagggagccaagg

SEQ ID NO: 5772552 - DNA, 16 bp, Homo sapiens
gggaagggccaccctg

SEQ ID NO: 5772553 - DNA, 20 bp, Homo sapiens
gggaagggccaccctgctgc

SEQ ID NO: 5772554 - DNA, 21 bp, Homo sapiens
gggaagggccaccctgctgca

SEQ ID NO: 5772555 - DNA, 12 bp, Homo sapiens
gggaagggccag

SEQ ID NO: 5772556 - DNA, 13 bp, Homo sapiens
gggaagggccagt

SEQ ID NO: 5772557 - DNA, 22 bp, Homo sapiens
gggaagggccagtctgggctgc

SEQ ID NO: 5772558 - DNA, 18 bp, Homo sapiens
gggaaggggacccccgcc

SEQ ID NO: 5772559 - DNA, 19 bp, Homo sapiens
gggaaggggatggacaccc

SEQ ID NO: 5772560 - DNA, 16 bp, Homo sapiens
gggaaggggatggagg

SEQ ID NO: 5772561 - DNA, 19 bp, Homo sapiens
gggaaggggatggaggcca

SEQ ID NO: 5772562 - DNA, 21 bp, Homo sapiens
gggaaggggatggaggccaga

SEQ ID NO: 5772563 - DNA, 13 bp, Homo sapiens
gggaaggggccgg

SEQ ID NO: 5772564 - DNA, 15 bp, Homo sapiens
gggaaggggcctccc

SEQ ID NO: 5772565 - DNA, 17 bp, Homo sapiens
gggaaggggcctccctc

SEQ ID NO: 5772566 - DNA, 17 bp, Homo sapiens
gggaaggggcctgggct

SEQ ID NO: 5772567 - DNA, 14 bp, Homo sapiens
gggaaggggctgag

SEQ ID NO: 5772568 - DNA, 18 bp, Homo sapiens
gggaaggggggtcagaag

SEQ ID NO: 5772569 - DNA, 19 bp, Homo sapiens
gggaaggggtcctgcaggg

SEQ ID NO: 5772570 - DNA, 19 bp, Homo sapiens
gggaagggtcccttttgca

SEQ ID NO: 5772571 - DNA, 14 bp, Homo sapiens
gggaagggtgcctg

SEQ ID NO: 5772572 - DNA, 15 bp, Homo sapiens
gggaagggtgcctgg

SEQ ID NO: 5772573 - DNA, 20 bp, Homo sapiens
gggaagggtgcctggctggg

SEQ ID NO: 5772574 - DNA, 21 bp, Homo sapiens
gggaagggtgcctggctgggc

SEQ ID NO: 5772575 - DNA, 13 bp, Homo sapiens
gggaagggtgggc

SEQ ID NO: 5772576 - DNA, 15 bp, Homo sapiens
gggaagggtgggccc

SEQ ID NO: 5772577 - DNA, 20 bp, Homo sapiens
gggaaggtatatcaggaggg

SEQ ID NO: 5772578 - DNA, 19 bp, Homo sapiens
gggaaggtcaccagcacca

SEQ ID NO: 5772579 - DNA, 21 bp, Homo sapiens
gggaaggtggggtcctggagc

SEQ ID NO: 5772580 - DNA, 11 bp, Homo sapiens
gggaaggttcc

SEQ ID NO: 5772581 - DNA, 19 bp, Homo sapiens
gggaaggtttttaagggcc

SEQ ID NO: 5772582 - DNA, 14 bp, Homo sapiens
gggaagtaaaaaaa

SEQ ID NO: 5772583 - DNA, 20 bp, Homo sapiens
gggaagtagttatcatgtta

SEQ ID NO: 5772584 - DNA, 14 bp, Homo sapiens
gggaagtccccagg

SEQ ID NO: 5772585 - DNA, 19 bp, Homo sapiens
gggaagtccctgggaggcc

SEQ ID NO: 5772586 - DNA, 16 bp, Homo sapiens
gggaagtcctgggagg

SEQ ID NO: 5772587 - DNA, 20 bp, Homo sapiens
gggaagtcgggcatggtggc

SEQ ID NO: 5772588 - DNA, 21 bp, Homo sapiens
gggaagtcttacttaaaaaaa

SEQ ID NO: 5772589 - DNA, 14 bp, Homo sapiens
gggaagtgaagccc

SEQ ID NO: 5772590 - DNA, 17 bp, Homo sapiens
gggaagtgaggaagcca

SEQ ID NO: 5772591 - DNA, 14 bp, Homo sapiens
gggaagtgaggccc

SEQ ID NO: 5772592 - DNA, 16 bp, Homo sapiens
gggaagtgctccccac

SEQ ID NO: 5772593 - DNA, 13 bp, Homo sapiens
gggaagtggggag

SEQ ID NO: 5772594 - DNA, 15 bp, Homo sapiens
gggaagtgtgctgag

SEQ ID NO: 5772595 - DNA, 17 bp, Homo sapiens
gggaagtgtgctgaggt

SEQ ID NO: 5772596 - DNA, 17 bp, Homo sapiens
gggaagttaaagggaag

SEQ ID NO: 5772597 - DNA, 22 bp, Homo sapiens
gggaagttaaagggaagaaaac

SEQ ID NO: 5772598 - DNA, 18 bp, Homo sapiens
gggaagttgtctccttcc

SEQ ID NO: 5772599 - DNA, 14 bp, Homo sapiens
gggaataaatatgc

SEQ ID NO: 5772600 - DNA, 14 bp, Homo sapiens
gggaataaccttcc

SEQ ID NO: 5772601 - DNA, 16 bp, Homo sapiens
gggaatattgtttctt

SEQ ID NO: 5772602 - DNA, 13 bp, Homo sapiens
gggaatcagaaag

SEQ ID NO: 5772603 - DNA, 19 bp, Homo sapiens
gggaatcatgtccatccct

SEQ ID NO: 5772604 - DNA, 18 bp, Homo sapiens
gggaatcattctggctta

SEQ ID NO: 5772605 - DNA, 13 bp, Homo sapiens
gggaatcattttt

SEQ ID NO: 5772606 - DNA, 18 bp, Homo sapiens
gggaatccaagcctccac

SEQ ID NO: 5772607 - DNA, 22 bp, Homo sapiens
gggaatccaagcctccacagcg

SEQ ID NO: 5772608 - DNA, 19 bp, Homo sapiens
gggaatccccgaaggtgct

SEQ ID NO: 5772609 - DNA, 22 bp, Homo sapiens
gggaatccccgaaggtgctgga

SEQ ID NO: 5772610 - DNA, 12 bp, Homo sapiens
gggaatccgcct

SEQ ID NO: 5772611 - DNA, 19 bp, Homo sapiens
gggaatctaagtgggagac

SEQ ID NO: 5772612 - DNA, 22 bp, Homo sapiens
gggaatctagcccaacctacat

SEQ ID NO: 5772613 - DNA, 23 bp, Homo sapiens
gggaatctgatcccataaagaaa

SEQ ID NO: 5772614 - DNA, 14 bp, Homo sapiens
gggaatctggatta

SEQ ID NO: 5772615 - DNA, 18 bp, Homo sapiens
gggaatgaaccatggcac

SEQ ID NO: 5772616 - DNA, 21 bp, Homo sapiens
gggaatgaaccatggcacctt

SEQ ID NO: 5772617 - DNA, 14 bp, Homo sapiens
gggaatgaacctgg

SEQ ID NO: 5772618 - DNA, 14 bp, Homo sapiens
gggaatgaagcttg

SEQ ID NO: 5772619 - DNA, 24 bp, Homo sapiens
gggaatgaagcttgtgtatccatt

SEQ ID NO: 5772620 - DNA, 17 bp, Homo sapiens
gggaatgagcccagaga

SEQ ID NO: 5772621 - DNA, 11 bp, Homo sapiens
gggaatgaggg

SEQ ID NO: 5772622 - DNA, 22 bp, Homo sapiens
gggaatgatagcccagaacaaa

SEQ ID NO: 5772623 - DNA, 15 bp, Homo sapiens
gggaatgatatgcat

SEQ ID NO: 5772624 - DNA, 15 bp, Homo sapiens
gggaatgcagcagga

SEQ ID NO: 5772625 - DNA, 13 bp, Homo sapiens
gggaatgcctagg

SEQ ID NO: 5772626 - DNA, 15 bp, Homo sapiens
gggaatgcctggagg

SEQ ID NO: 5772627 - DNA, 22 bp, Homo sapiens
gggaatgcgctcttcaccagga

SEQ ID NO: 5772628 - DNA, 20 bp, Homo sapiens
gggaatggatggggagaatg

SEQ ID NO: 5772629 - DNA, 22 bp, Homo sapiens
gggaatggcacagcccaaagaa

SEQ ID NO: 5772630 - DNA, 13 bp, Homo sapiens
gggaatgggactg

SEQ ID NO: 5772631 - DNA, 21 bp, Homo sapiens
gggaatgtaactgctgaaaac

SEQ ID NO: 5772632 - DNA, 15 bp, Homo sapiens
gggaatgtgctttca

SEQ ID NO: 5772633 - DNA, 17 bp, Homo sapiens
gggaatgttccctgcac

SEQ ID NO: 5772634 - DNA, 21 bp, Homo sapiens
gggaatgttccctgcaccctg

SEQ ID NO: 5772635 - DNA, 22 bp, Homo sapiens
gggaattaaaaagaagatgaat

SEQ ID NO: 5772636 - DNA, 16 bp, Homo sapiens
gggaattccctccccc

SEQ ID NO: 5772637 - DNA, 17 bp, Homo sapiens
gggaattccctccccct

SEQ ID NO: 5772638 - DNA, 16 bp, Homo sapiens
gggacctcaggggcac

SEQ ID NO: 5772639 - DNA, 18 bp, Homo sapiens
gggacctccccagcccag

SEQ ID NO: 5772640 - DNA, 19 bp, Homo sapiens
gggacctccccagcccagg

SEQ ID NO: 5772641 - DNA, 22 bp, Homo sapiens
gggacctcccctgaggctcagg

SEQ ID NO: 5772642 - DNA, 15 bp, Homo sapiens
gggacctcctccctc

SEQ ID NO: 5772643 - DNA, 14 bp, Homo sapiens
gggacctcgggctg

SEQ ID NO: 5772644 - DNA, 18 bp, Homo sapiens
gggacctctccacacagg

SEQ ID NO: 5772645 - DNA, 12 bp, Homo sapiens
gggacctctccc

SEQ ID NO: 5772646 - DNA, 16 bp, Homo sapiens
gggacctctcccaggg

SEQ ID NO: 5772647 - DNA, 19 bp, Homo sapiens
gggacctgccaggcagggg

SEQ ID NO: 5772648 - DNA, 13 bp, Homo sapiens
gggacctgctgct

SEQ ID NO: 5772649 - DNA, 17 bp, Homo sapiens
gggacctgctgctcagt

SEQ ID NO: 5772650 - DNA, 16 bp, Homo sapiens
gggacctggagctgcc

SEQ ID NO: 5772651 - DNA, 13 bp, Homo sapiens
gggacctggatag

SEQ ID NO: 5772652 - DNA, 23 bp, Homo sapiens
gggaccttggtctgatcgacgtg

SEQ ID NO: 5772653 - DNA, 15 bp, Homo sapiens
gggacctttaaaaag

SEQ ID NO: 5772654 - DNA, 19 bp, Homo sapiens
gggacgaagaagagccaca

SEQ ID NO: 5772655 - DNA, 20 bp, Homo sapiens
gggacgacgctgactgccct

SEQ ID NO: 5772656 - DNA, 16 bp, Homo sapiens
gggacgatcaggagga

SEQ ID NO: 5772657 - DNA, 14 bp, Homo sapiens
gggacgcctgccct

SEQ ID NO: 5772658 - DNA, 20 bp, Homo sapiens
gggacgcctgccctgcccag

SEQ ID NO: 5772659 - DNA, 15 bp, Homo sapiens
gggacgcggaggagg

SEQ ID NO: 5772660 - DNA, 19 bp, Homo sapiens
gggacgcggcaggcttctc

SEQ ID NO: 5772661 - DNA, 11 bp, Homo sapiens
gggacgcttcc

SEQ ID NO: 5772662 - DNA, 16 bp, Homo sapiens
gggacgcttccagacc

SEQ ID NO: 5772663 - DNA, 17 bp, Homo sapiens
gggacgcttccagacca

SEQ ID NO: 5772664 - DNA, 18 bp, Homo sapiens
gggacgcttccagaccac

SEQ ID NO: 5772665 - DNA, 19 bp, Homo sapiens
gggacgcttccagaccacc

SEQ ID NO: 5772666 - DNA, 21 bp, Homo sapiens
gggacgcttccagaccacctg

SEQ ID NO: 5772667 - DNA, 17 bp, Homo sapiens
gggacggaccagcatct

SEQ ID NO: 5772668 - DNA, 14 bp, Homo sapiens
gggacggagcactg

SEQ ID NO: 5772669 - DNA, 14 bp, Homo sapiens
gggacggcttctca

SEQ ID NO: 5772670 - DNA, 19 bp, Homo sapiens
gggacgggcaagtgagagg

SEQ ID NO: 5772671 - DNA, 14 bp, Homo sapiens
gggacggggctgac

SEQ ID NO: 5772672 - DNA, 17 bp, Homo sapiens
gggacgggggctgcttc

SEQ ID NO: 5772673 - DNA, 18 bp, Homo sapiens
gggacgggggtgggaggt

SEQ ID NO: 5772674 - DNA, 14 bp, Homo sapiens
gggacgtggctcag

SEQ ID NO: 5772675 - DNA, 19 bp, Homo sapiens
gggacgtgtacagcacaga

SEQ ID NO: 5772676 - DNA, 22 bp, Homo sapiens
gggacgtttctggaactgtctg

SEQ ID NO: 5772677 - DNA, 22 bp, Homo sapiens
gggacgtttttcttcttgggcc

SEQ ID NO: 5772678 - DNA, 16 bp, Homo sapiens
gggactaaagccagga

SEQ ID NO: 5772679 - DNA, 20 bp, Homo sapiens
gggactacaggcgtgagcca

SEQ ID NO: 5772680 - DNA, 19 bp, Homo sapiens
gggactagtgagtcagcac

SEQ ID NO: 5772681 - DNA, 21 bp, Homo sapiens
gggactagtgagtcagcacct

SEQ ID NO: 5772682 - DNA, 12 bp, Homo sapiens
gggactcagccc

SEQ ID NO: 5772683 - DNA, 16 bp, Homo sapiens
gggactcagccctgag

SEQ ID NO: 5772684 - DNA, 22 bp, Homo sapiens
gggactcagccttcagacagag

SEQ ID NO: 5772685 - DNA, 13 bp, Homo sapiens
gggactcagggac

SEQ ID NO: 5772686 - DNA, 20 bp, Homo sapiens
gggactcagttcttggcctg

SEQ ID NO: 5772687 - DNA, 17 bp, Homo sapiens
gggactcagttgttctg

SEQ ID NO: 5772688 - DNA, 17 bp, Homo sapiens
gggactcatccttgccc

SEQ ID NO: 5772689 - DNA, 19 bp, Homo sapiens
gggactcatctttccctcc

SEQ ID NO: 5772690 - DNA, 16 bp, Homo sapiens
gggactccaagccctg

SEQ ID NO: 5772691 - DNA, 17 bp, Homo sapiens
gggactccaagccctgg

SEQ ID NO: 5772692 - DNA, 23 bp, Homo sapiens
gggactccaagccctggggcagg

SEQ ID NO: 5772693 - DNA, 22 bp, Homo sapiens
gggactccagaagcagcagcta

SEQ ID NO: 5772694 - DNA, 18 bp, Homo sapiens
gggactccatagctcctt

SEQ ID NO: 5772695 - DNA, 17 bp, Homo sapiens
gggactccggctgtgct

SEQ ID NO: 5772696 - DNA, 18 bp, Homo sapiens
gggactccggctgtgctg

SEQ ID NO: 5772697 - DNA, 19 bp, Homo sapiens
gggactcctcaaaccactt

SEQ ID NO: 5772698 - DNA, 22 bp, Homo sapiens
gggactcctcaaaccacttgcc

SEQ ID NO: 5772699 - DNA, 13 bp, Homo sapiens
gggactcctccct

SEQ ID NO: 5772700 - DNA, 17 bp, Homo sapiens
gggactcctccctgggg

SEQ ID NO: 5772701 - DNA, 23 bp, Homo sapiens
gggactcctccctgggggtgggg

SEQ ID NO: 5772702 - DNA, 22 bp, Homo sapiens
gggactcctggtgcccctcgcc

SEQ ID NO: 5772703 - DNA, 20 bp, Homo sapiens
gggactcctgtctaggtgcc

SEQ ID NO: 5772704 - DNA, 21 bp, Homo sapiens
gggactcggagggtgccgtgc

SEQ ID NO: 5772705 - DNA, 19 bp, Homo sapiens
gggactcggcccagggccg

SEQ ID NO: 5772706 - DNA, 23 bp, Homo sapiens
gggactctatactaccctgggct

SEQ ID NO: 5772707 - DNA, 19 bp, Homo sapiens
gggactctgaagcctctgg

SEQ ID NO: 5772708 - DNA, 19 bp, Homo sapiens
gggactctgagcgggaggc

SEQ ID NO: 5772709 - DNA, 12 bp, Homo sapiens
gggactctgccg

SEQ ID NO: 5772710 - DNA, 16 bp, Homo sapiens
gggactctggcacagt

SEQ ID NO: 5772711 - DNA, 20 bp, Homo sapiens
gggactctgggctgtgcctg

SEQ ID NO: 5772712 - DNA, 22 bp, Homo sapiens
gggactctgggctgtgcctgag

SEQ ID NO: 5772713 - DNA, 17 bp, Homo sapiens
gggactctgtctggcca

SEQ ID NO: 5772714 - DNA, 21 bp, Homo sapiens
gggactctgtctggccaggga

SEQ ID NO: 5772715 - DNA, 18 bp, Homo sapiens
gggactgaaaacctctcc

SEQ ID NO: 5772716 - DNA, 19 bp, Homo sapiens
gggactgaaaacctctcct

SEQ ID NO: 5772717 - DNA, 12 bp, Homo sapiens
gggactgagaga

SEQ ID NO: 5772718 - DNA, 23 bp, Homo sapiens
gggactgagagatgcagaaatat

SEQ ID NO: 5772719 - DNA, 13 bp, Homo sapiens
gggactgagccag

SEQ ID NO: 5772720 - DNA, 13 bp, Homo sapiens
gggactgagctgg

SEQ ID NO: 5772721 - DNA, 16 bp, Homo sapiens
gggactgcatgcaagc

SEQ ID NO: 5772722 - DNA, 17 bp, Homo sapiens
gggactgccaggctgtt

SEQ ID NO: 5772723 - DNA, 14 bp, Homo sapiens
gggactgccagggc

SEQ ID NO: 5772724 - DNA, 23 bp, Homo sapiens
gggactgccagtccccctgcccc

SEQ ID NO: 5772725 - DNA, 15 bp, Homo sapiens
gggactgcctctgcc

SEQ ID NO: 5772726 - DNA, 17 bp, Homo sapiens
gggactgcctctgccac

SEQ ID NO: 5772727 - DNA, 15 bp, Homo sapiens
gggactgctgctctc

SEQ ID NO: 5772728 - DNA, 15 bp, Homo sapiens
gggactgctgctgcc

SEQ ID NO: 5772729 - DNA, 22 bp, Homo sapiens
gggactgctgtgaacatgcctc

SEQ ID NO: 5772730 - DNA, 19 bp, Homo sapiens
gggactgctttcagtgcct

SEQ ID NO: 5772731 - DNA, 21 bp, Homo sapiens
gggactggacagccagggcag

SEQ ID NO: 5772732 - DNA, 22 bp, Homo sapiens
gggactggacagccagggcagg

SEQ ID NO: 5772733 - DNA, 12 bp, Homo sapiens
gggactggagaa

SEQ ID NO: 5772734 - DNA, 19 bp, Homo sapiens
gggactggcccacccctct

SEQ ID NO: 5772735 - DNA, 21 bp, Homo sapiens
gggactggcccacccctcttc

SEQ ID NO: 5772736 - DNA, 23 bp, Homo sapiens
gggactggcccacccctcttccc

SEQ ID NO: 5772737 - DNA, 17 bp, Homo sapiens
gggactgggagtcagag

SEQ ID NO: 5772738 - DNA, 18 bp, Homo sapiens
gggactgggagtcagagc

SEQ ID NO: 5772739 - DNA, 12 bp, Homo sapiens
gggactgggcca

SEQ ID NO: 5772740 - DNA, 17 bp, Homo sapiens
gggactggggaagggga

SEQ ID NO: 5772741 - DNA, 20 bp, Homo sapiens
gggactgggtttggacccca

SEQ ID NO: 5772742 - DNA, 16 bp, Homo sapiens
gggactggtccaggca

SEQ ID NO: 5772743 - DNA, 13 bp, Homo sapiens
gggactgtaagtt

SEQ ID NO: 5772744 - DNA, 18 bp, Homo sapiens
gggactgtacctgtagga

SEQ ID NO: 5772745 - DNA, 15 bp, Homo sapiens
gggactgtcaatgga

SEQ ID NO: 5772746 - DNA, 23 bp, Homo sapiens
gggactgtcctagccaggtctcc

SEQ ID NO: 5772747 - DNA, 17 bp, Homo sapiens
gggactgtcgctgcttc

SEQ ID NO: 5772748 - DNA, 12 bp, Homo sapiens
gggactgtctca

SEQ ID NO: 5772749 - DNA, 15 bp, Homo sapiens
gggactgtctcagaa

SEQ ID NO: 5772750 - DNA, 18 bp, Homo sapiens
gggactgtgcctggctcc

SEQ ID NO: 5772751 - DNA, 24 bp, Homo sapiens
gggacttcaaaatcagtgatggga

SEQ ID NO: 5772752 - DNA, 18 bp, Homo sapiens
gggacttcaactgcccag

SEQ ID NO: 5772753 - DNA, 19 bp, Homo sapiens
gggacttcaactgcccagc

SEQ ID NO: 5772754 - DNA, 20 bp, Homo sapiens
gggacttccttgctctccct

SEQ ID NO: 5772755 - DNA, 15 bp, Homo sapiens
gggacttgaacaaag

SEQ ID NO: 5772756 - DNA, 19 bp, Homo sapiens
gggacttgaacaaagacat

SEQ ID NO: 5772757 - DNA, 18 bp, Homo sapiens
gggacttgaatctttcca

SEQ ID NO: 5772758 - DNA, 18 bp, Homo sapiens
gggacttggaagctccgc

SEQ ID NO: 5772759 - DNA, 23 bp, Homo sapiens
gggacttggaagctccgctttct

SEQ ID NO: 5772760 - DNA, 16 bp, Homo sapiens
gggacttgggagctgg

SEQ ID NO: 5772761 - DNA, 12 bp, Homo sapiens
gggacttgggga

SEQ ID NO: 5772762 - DNA, 24 bp, Homo sapiens
gggacttgtaggaatctgccttcc

SEQ ID NO: 5772763 - DNA, 13 bp, Homo sapiens
gggacttgtgcca

SEQ ID NO: 5772764 - DNA, 17 bp, Homo sapiens
gggactttcccacccag

SEQ ID NO: 5772765 - DNA, 22 bp, Homo sapiens
gggactttgctggtgtagtctt

SEQ ID NO: 5772766 - DNA, 16 bp, Homo sapiens
gggagaaaaaaaaagc

SEQ ID NO: 5772767 - DNA, 15 bp, Homo sapiens
gggagaaaaagaaac

SEQ ID NO: 5772768 - DNA, 19 bp, Homo sapiens
gggagaaaaagaaacacaa

SEQ ID NO: 5772769 - DNA, 20 bp, Homo sapiens
gggagaaaaagaaacacaag

SEQ ID NO: 5772770 - DNA, 10 bp, Homo sapiens
gggagaaaac

SEQ ID NO: 5772771 - DNA, 18 bp, Homo sapiens
gggagaaaagacggatgg

SEQ ID NO: 5772772 - DNA, 16 bp, Homo sapiens
gggagaaaagccagat

SEQ ID NO: 5772773 - DNA, 15 bp, Homo sapiens
gggagaaaatcaact

SEQ ID NO: 5772774 - DNA, 13 bp, Homo sapiens
gggagaaaattca

SEQ ID NO: 5772775 - DNA, 18 bp, Homo sapiens
gggagaaaattgttgcaa

SEQ ID NO: 5772776 - DNA, 15 bp, Homo sapiens
gggagaaagggcaaa

SEQ ID NO: 5772777 - DNA, 16 bp, Homo sapiens
gggagaacatggccaa

SEQ ID NO: 5772778 - DNA, 14 bp, Homo sapiens
gggagaagaaagaa

SEQ ID NO: 5772779 - DNA, 12 bp, Homo sapiens
gggagaagctcc

SEQ ID NO: 5772780 - DNA, 19 bp, Homo sapiens
gggagaaggaagggcagag

SEQ ID NO: 5772781 - DNA, 20 bp, Homo sapiens
gggagaaggaagggcagaga

SEQ ID NO: 5772782 - DNA, 17 bp, Homo sapiens
gggagaaggcctcccct

SEQ ID NO: 5772783 - DNA, 15 bp, Homo sapiens
gggagaagggacagc

SEQ ID NO: 5772784 - DNA, 18 bp, Homo sapiens
gggagaagggccagccct

SEQ ID NO: 5772785 - DNA, 21 bp, Homo sapiens
gggagaagtgatatggtgaag

SEQ ID NO: 5772786 - DNA, 15 bp, Homo sapiens
gggagaatcatgtga

SEQ ID NO: 5772787 - DNA, 17 bp, Homo sapiens
gggagaatgcagcccac

SEQ ID NO: 5772788 - DNA, 23 bp, Homo sapiens
gggagaattgcacacagatgtga

SEQ ID NO: 5772789 - DNA, 19 bp, Homo sapiens
gggagacaattagcagaat

SEQ ID NO: 5772790 - DNA, 19 bp, Homo sapiens
gggagacactggcccctca

SEQ ID NO: 5772791 - DNA, 13 bp, Homo sapiens
gggagacagacca

SEQ ID NO: 5772792 - DNA, 20 bp, Homo sapiens
gggagacagaggttgcagtg

SEQ ID NO: 5772793 - DNA, 12 bp, Homo sapiens
gggagacagcag

SEQ ID NO: 5772794 - DNA, 15 bp, Homo sapiens
gggagacaggccttt

SEQ ID NO: 5772795 - DNA, 22 bp, Homo sapiens
gggagacagggcaatcttgtcc

SEQ ID NO: 5772796 - DNA, 19 bp, Homo sapiens
gggagacagttgagagcgg

SEQ ID NO: 5772797 - DNA, 17 bp, Homo sapiens
gggagacatggaccagc

SEQ ID NO: 5772798 - DNA, 15 bp, Homo sapiens
gggagaccaggcttc

SEQ ID NO: 5772799 - DNA, 20 bp, Homo sapiens
gggagaccctgaactcagaa

SEQ ID NO: 5772800 - DNA, 12 bp, Homo sapiens
gggagaccctgg

SEQ ID NO: 5772801 - DNA, 17 bp, Homo sapiens
gggagaccggcctgcca

SEQ ID NO: 5772802 - DNA, 21 bp, Homo sapiens
gggagaccggcctgccaggag

SEQ ID NO: 5772803 - DNA, 19 bp, Homo sapiens
gggagacctcagaagtaaa

SEQ ID NO: 5772804 - DNA, 13 bp, Homo sapiens
gggagacctggac

SEQ ID NO: 5772805 - DNA, 20 bp, Homo sapiens
gggagacggaggttgcagtg

SEQ ID NO: 5772806 - DNA, 17 bp, Homo sapiens
gggagactgacccattc

SEQ ID NO: 5772807 - DNA, 14 bp, Homo sapiens
gggagactgggctg

SEQ ID NO: 5772808 - DNA, 13 bp, Homo sapiens
gggagacttgttc

SEQ ID NO: 5772809 - DNA, 14 bp, Homo sapiens
gggagactttgatg

SEQ ID NO: 5772810 - DNA, 20 bp, Homo sapiens
gggagagacaggcagcccag

SEQ ID NO: 5772811 - DNA, 22 bp, Homo sapiens
gggagagacttggatgaggagt

SEQ ID NO: 5772812 - DNA, 19 bp, Homo sapiens
gggagagagaaccaccact

SEQ ID NO: 5772813 - DNA, 13 bp, Homo sapiens
gggagagagaagc

SEQ ID NO: 5772814 - DNA, 18 bp, Homo sapiens
gggagagagaagcaggca

SEQ ID NO: 5772815 - DNA, 13 bp, Homo sapiens
gggaggaggggga

SEQ ID NO: 5772816 - DNA, 14 bp, Homo sapiens
gggaggagggggag

SEQ ID NO: 5772817 - DNA, 20 bp, Homo sapiens
gggaggagtcaggggctctg

SEQ ID NO: 5772818 - DNA, 22 bp, Homo sapiens
gggaggagtggattcctcccca

SEQ ID NO: 5772819 - DNA, 14 bp, Homo sapiens
gggaggagtggccc

SEQ ID NO: 5772820 - DNA, 21 bp, Homo sapiens
gggaggagttgtctgtcctgg

SEQ ID NO: 5772821 - DNA, 22 bp, Homo sapiens
gggaggatcactggagcccagg

SEQ ID NO: 5772822 - DNA, 13 bp, Homo sapiens
gggaggatcctgg

SEQ ID NO: 5772823 - DNA, 14 bp, Homo sapiens
gggaggatcctgga

SEQ ID NO: 5772824 - DNA, 16 bp, Homo sapiens
gggaggatgccacagc

SEQ ID NO: 5772825 - DNA, 13 bp, Homo sapiens
gggaggcaaatgg

SEQ ID NO: 5772826 - DNA, 12 bp, Homo sapiens
gggaggcacact

SEQ ID NO: 5772827 - DNA, 20 bp, Homo sapiens
gggaggcacactttctggca

SEQ ID NO: 5772828 - DNA, 12 bp, Homo sapiens
gggaggcaccag

SEQ ID NO: 5772829 - DNA, 20 bp, Homo sapiens
gggaggcaccatgcaaatgt

SEQ ID NO: 5772830 - DNA, 18 bp, Homo sapiens
gggaggcacttcctcccc

SEQ ID NO: 5772831 - DNA, 12 bp, Homo sapiens
gggaggcagagc

SEQ ID NO: 5772832 - DNA, 17 bp, Homo sapiens
gggaggcagagcgggag

SEQ ID NO: 5772833 - DNA, 19 bp, Homo sapiens
gggaggcagagcgggaggg

SEQ ID NO: 5772834 - DNA, 20 bp, Homo sapiens
gggaggcagaggttgcagtg

SEQ ID NO: 5772835 - DNA, 19 bp, Homo sapiens
gggaggcagatggagccca

SEQ ID NO: 5772836 - DNA, 13 bp, Homo sapiens
gggaggcagcaga

SEQ ID NO: 5772837 - DNA, 14 bp, Homo sapiens
gggaggcagccaca

SEQ ID NO: 5772838 - DNA, 19 bp, Homo sapiens
gggaggcagcgtgggctct

SEQ ID NO: 5772839 - DNA, 13 bp, Homo sapiens
gggaggcagggct

SEQ ID NO: 5772840 - DNA, 14 bp, Homo sapiens
gggaggcagggctc

SEQ ID NO: 5772841 - DNA, 11 bp, Homo sapiens
gggaggcaggt

SEQ ID NO: 5772842 - DNA, 14 bp, Homo sapiens
gggaggcaggtgga

SEQ ID NO: 5772843 - DNA, 13 bp, Homo sapiens
gggaggccaagga

SEQ ID NO: 5772844 - DNA, 16 bp, Homo sapiens
gggaggccaaggcagg

SEQ ID NO: 5772845 - DNA, 20 bp, Homo sapiens
gggaggccaaggtgggcgga

SEQ ID NO: 5772846 - DNA, 16 bp, Homo sapiens
gggaggccaccccaaa

SEQ ID NO: 5772847 - DNA, 18 bp, Homo sapiens
gggaggccacgtcccacc

SEQ ID NO: 5772848 - DNA, 20 bp, Homo sapiens
gggaggccaggcgagcctga

SEQ ID NO: 5772849 - DNA, 16 bp, Homo sapiens
gggaggccaggcgggc

SEQ ID NO: 5772850 - DNA, 23 bp, Homo sapiens
gggaggccatttgctgccctggg

SEQ ID NO: 5772851 - DNA, 17 bp, Homo sapiens
gggaggccccagctctg

SEQ ID NO: 5772852 - DNA, 14 bp, Homo sapiens
gggaggccccaggg

SEQ ID NO: 5772853 - DNA, 19 bp, Homo sapiens
gggaggcccctcctgccca

SEQ ID NO: 5772854 - DNA, 11 bp, Homo sapiens
gggaggccctg

SEQ ID NO: 5772855 - DNA, 17 bp, Homo sapiens
gggaggccctggccctt

SEQ ID NO: 5772856 - DNA, 16 bp, Homo sapiens
gggaggccgaggcagg

SEQ ID NO: 5772857 - DNA, 16 bp, Homo sapiens
gggaggccgggcggtc

SEQ ID NO: 5772858 - DNA, 17 bp, Homo sapiens
gggaggcgatgccagcc

SEQ ID NO: 5772859 - DNA, 14 bp, Homo sapiens
gggaggcgcaggga

SEQ ID NO: 5772860 - DNA, 20 bp, Homo sapiens
gggaggcggagcttgcagtg

SEQ ID NO: 5772861 - DNA, 12 bp, Homo sapiens
gggaggcggcct

SEQ ID NO: 5772862 - DNA, 21 bp, Homo sapiens
gggaggctcccagacccaggg

SEQ ID NO: 5772863 - DNA, 23 bp, Homo sapiens
gggaggctcccggggcctggaca

SEQ ID NO: 5772864 - DNA, 21 bp, Homo sapiens
gggaggctcggggctccccac

SEQ ID NO: 5772865 - DNA, 20 bp, Homo sapiens
gggaggctgactcctggtcc

SEQ ID NO: 5772866 - DNA, 17 bp, Homo sapiens
gggaggctgagacagga

SEQ ID NO: 5772867 - DNA, 16 bp, Homo sapiens
gggaggctgaggcagg

SEQ ID NO: 5772868 - DNA, 19 bp, Homo sapiens
gggaggctgaggcaggaga

SEQ ID NO: 5772869 - DNA, 20 bp, Homo sapiens
gggaggctgaggcaggagaa

SEQ ID NO: 5772870 - DNA, 17 bp, Homo sapiens
gggaggctgaggcaggc

SEQ ID NO: 5772871 - DNA, 20 bp, Homo sapiens
gggaggctgaggtgggcaga

SEQ ID NO: 5772872 - DNA, 20 bp, Homo sapiens
gggaggctgctttctgccct

SEQ ID NO: 5772873 - DNA, 12 bp, Homo sapiens
gggaggctgggc

SEQ ID NO: 5772874 - DNA, 15 bp, Homo sapiens
gggagggaagggcca

SEQ ID NO: 5772875 - DNA, 20 bp, Homo sapiens
gggagggaagggccaccctg

SEQ ID NO: 5772876 - DNA, 15 bp, Homo sapiens
gggagggaaggggga

SEQ ID NO: 5772877 - DNA, 16 bp, Homo sapiens
gggagggacacagagg

SEQ ID NO: 5772878 - DNA, 20 bp, Homo sapiens
gggagggactgctgacccac

SEQ ID NO: 5772879 - DNA, 15 bp, Homo sapiens
gggagggagcaagcc

SEQ ID NO: 5772880 - DNA, 16 bp, Homo sapiens
gggagggagccatgga

SEQ ID NO: 5772881 - DNA, 13 bp, Homo sapiens
gggagggcacccc

SEQ ID NO: 5772882 - DNA, 11 bp, Homo sapiens
gggagggcagc

SEQ ID NO: 5772883 - DNA, 16 bp, Homo sapiens
gggagggcagctggcc

SEQ ID NO: 5772884 - DNA, 13 bp, Homo sapiens
gggagggccaggg

SEQ ID NO: 5772885 - DNA, 16 bp, Homo sapiens
gggagggccagggagg

SEQ ID NO: 5772886 - DNA, 20 bp, Homo sapiens
gggagggccggcggctctga

SEQ ID NO: 5772887 - DNA, 22 bp, Homo sapiens
gggagggccggcggctctgagc

SEQ ID NO: 5772888 - DNA, 12 bp, Homo sapiens
gggagggcctct

SEQ ID NO: 5772889 - DNA, 16 bp, Homo sapiens
gggagggcgaggcggg

SEQ ID NO: 5772890 - DNA, 17 bp, Homo sapiens
gggagggctccagacac

SEQ ID NO: 5772891 - DNA, 14 bp, Homo sapiens
gggagggctcctgg

SEQ ID NO: 5772892 - DNA, 21 bp, Homo sapiens
gggagggctcctggggcagag

SEQ ID NO: 5772893 - DNA, 14 bp, Homo sapiens
gggagggctgcgac

SEQ ID NO: 5772894 - DNA, 14 bp, Homo sapiens
gggaggggaagaaa

SEQ ID NO: 5772895 - DNA, 17 bp, Homo sapiens
gggaggggaagcttctg

SEQ ID NO: 5772896 - DNA, 12 bp, Homo sapiens
gggaggggaagt

SEQ ID NO: 5772897 - DNA, 16 bp, Homo sapiens
gggaggggacagaggc

SEQ ID NO: 5772898 - DNA, 16 bp, Homo sapiens
gggaggggagagaagg

SEQ ID NO: 5772899 - DNA, 11 bp, Homo sapiens
gggaggggagg

SEQ ID NO: 5772900 - DNA, 12 bp, Homo sapiens
gggaggggaggc

SEQ ID NO: 5772901 - DNA, 14 bp, Homo sapiens
gggaggggaggcat

SEQ ID NO: 5772902 - DNA, 16 bp, Homo sapiens
gggaggggaggcattg

SEQ ID NO: 5772903 - DNA, 15 bp, Homo sapiens
gggaggggcagaaca

SEQ ID NO: 5772904 - DNA, 12 bp, Homo sapiens
gggaggggcagg

SEQ ID NO: 5772905 - DNA, 13 bp, Homo sapiens
gggaggggcaggc

SEQ ID NO: 5772906 - DNA, 17 bp, Homo sapiens
gggaggggcaggctgac

SEQ ID NO: 5772907 - DNA, 15 bp, Homo sapiens
gggaggggccctcag

SEQ ID NO: 5772908 - DNA, 18 bp, Homo sapiens
gggaggggccctcaggcc

SEQ ID NO: 5772909 - DNA, 13 bp, Homo sapiens
gggaggggcctgg

SEQ ID NO: 5772910 - DNA, 10 bp, Homo sapiens
gggaggggcg

SEQ ID NO: 5772911 - DNA, 17 bp, Homo sapiens
gggaggggcgcacccca

SEQ ID NO: 5772912 - DNA, 22 bp, Homo sapiens
gggaggggcgcaccccacagct

SEQ ID NO: 5772913 - DNA, 20 bp, Homo sapiens
gggaggggcgctggcccagc

SEQ ID NO: 5772914 - DNA, 23 bp, Homo sapiens
gggaggggcggcaggagggaggt

SEQ ID NO: 5772915 - DNA, 15 bp, Homo sapiens
gggaggggctccttt

SEQ ID NO: 5772916 - DNA, 12 bp, Homo sapiens
gggaggggctga

SEQ ID NO: 5772917 - DNA, 18 bp, Homo sapiens
gggaggggctgagtctgg

SEQ ID NO: 5772918 - DNA, 13 bp, Homo sapiens
gggagggggcaga

SEQ ID NO: 5772919 - DNA, 15 bp, Homo sapiens
gggaggggggcggtg

SEQ ID NO: 5772920 - DNA, 20 bp, Homo sapiens
gggagggggtacctcatgag

SEQ ID NO: 5772921 - DNA, 22 bp, Homo sapiens
gggagggggtcctgactcacac

SEQ ID NO: 5772922 - DNA, 20 bp, Homo sapiens
gggagggggtgggggatctg

SEQ ID NO: 5772923 - DNA, 17 bp, Homo sapiens
gggaggggtcagctctg

SEQ ID NO: 5772924 - DNA, 13 bp, Homo sapiens
gggaggggtcctg

SEQ ID NO: 5772925 - DNA, 17 bp, Homo sapiens
gggaggggttgttttgg

SEQ ID NO: 5772926 - DNA, 16 bp, Homo sapiens
gggagggtaggcagga

SEQ ID NO: 5772927 - DNA, 15 bp, Homo sapiens
gggagggtcagtgcc

SEQ ID NO: 5772928 - DNA, 19 bp, Homo sapiens
gggagggtcttttaccctg

SEQ ID NO: 5772929 - DNA, 20 bp, Homo sapiens
gggagggtgttcagaggcag

SEQ ID NO: 5772930 - DNA, 15 bp, Homo sapiens
gggagggtgttttgg

SEQ ID NO: 5772931 - DNA, 17 bp, Homo sapiens
gggagggttggggaggg

SEQ ID NO: 5772932 - DNA, 21 bp, Homo sapiens
gggaggtatgggctgggggct

SEQ ID NO: 5772933 - DNA, 16 bp, Homo sapiens
gggaggtcaggccctg

SEQ ID NO: 5772934 - DNA, 22 bp, Homo sapiens
gggaggtcaggccctggaactc

SEQ ID NO: 5772935 - DNA, 13 bp, Homo sapiens
gggaggtccaagc

SEQ ID NO: 5772936 - DNA, 16 bp, Homo sapiens
gggaggtccaggcagg

SEQ ID NO: 5772937 - DNA, 17 bp, Homo sapiens
gggaggtcgaggcagga

SEQ ID NO: 5772938 - DNA, 24 bp, Homo sapiens
gggaggtctccactgaggatgtga

SEQ ID NO: 5772939 - DNA, 23 bp, Homo sapiens
gggaggtgaaaagggcagaggca

SEQ ID NO: 5772940 - DNA, 16 bp, Homo sapiens
gggaggtgaccccagg

SEQ ID NO: 5772941 - DNA, 19 bp, Homo sapiens
gggaggtgcctgagctggg

SEQ ID NO: 5772942 - DNA, 15 bp, Homo sapiens
gggaggtgctggttc

SEQ ID NO: 5772943 - DNA, 23 bp, Homo sapiens
gggaggtgcttctagttctgcca

SEQ ID NO: 5772944 - DNA, 17 bp, Homo sapiens
gggaggtggcagggaag

SEQ ID NO: 5772945 - DNA, 13 bp, Homo sapiens
gggaggtggccag

SEQ ID NO: 5772946 - DNA, 14 bp, Homo sapiens
gggaggtggctggg

SEQ ID NO: 5772947 - DNA, 20 bp, Homo sapiens
gggaggtgggatcctccagg

SEQ ID NO: 5772948 - DNA, 13 bp, Homo sapiens
gggaggtgttcac

SEQ ID NO: 5772949 - DNA, 19 bp, Homo sapiens
gggaggttcctcgcaggtc

SEQ ID NO: 5772950 - DNA, 15 bp, Homo sapiens
gggaggtttgtttgt

SEQ ID NO: 5772951 - DNA, 23 bp, Homo sapiens
gggaggttttattctgacttcct

SEQ ID NO: 5772952 - DNA, 19 bp, Homo sapiens
gggaggttttctcccccag

SEQ ID NO: 5772953 - DNA, 18 bp, Homo sapiens
gggagtaaacggcccagg

SEQ ID NO: 5772954 - DNA, 23 bp, Homo sapiens
gggagtaagaatgtgtgtgcaga

SEQ ID NO: 5772955 - DNA, 19 bp, Homo sapiens
gggagtaagtagaggtggc

SEQ ID NO: 5772956 - DNA, 20 bp, Homo sapiens
gggagtaagtagaggtggct

SEQ ID NO: 5772957 - DNA, 24 bp, Homo sapiens
gggagtaagtagaggtggcttcag

SEQ ID NO: 5772958 - DNA, 18 bp, Homo sapiens
gggagtacatatggtaga

SEQ ID NO: 5772959 - DNA, 17 bp, Homo sapiens
gggagtacctgctgccc

SEQ ID NO: 5772960 - DNA, 23 bp, Homo sapiens
gggagtacctgctgccccagctg

SEQ ID NO: 5772961 - DNA, 21 bp, Homo sapiens
gggagtagcaaggaaggacac

SEQ ID NO: 5772962 - DNA, 21 bp, Homo sapiens
gggagtatgcaaaagttctga

SEQ ID NO: 5772963 - DNA, 14 bp, Homo sapiens
gggagtcagagccc

SEQ ID NO: 5772964 - DNA, 17 bp, Homo sapiens
gggagtcagagccctgg

SEQ ID NO: 5772965 - DNA, 22 bp, Homo sapiens
gggagtcagagccctggctggg

SEQ ID NO: 5772966 - DNA, 19 bp, Homo sapiens
gggagtcaggcctgggcag

SEQ ID NO: 5772967 - DNA, 23 bp, Homo sapiens
gggagtcattgccttgggcctgg

SEQ ID NO: 5772968 - DNA, 23 bp, Homo sapiens
gggagtccactttcctctctctc

SEQ ID NO: 5772969 - DNA, 16 bp, Homo sapiens
gggagtccaggcacag

SEQ ID NO: 5772970 - DNA, 20 bp, Homo sapiens
gggagtccagggctcccgga

SEQ ID NO: 5772971 - DNA, 16 bp, Homo sapiens
gggagtcccctccccg

SEQ ID NO: 5772972 - DNA, 20 bp, Homo sapiens
gggagtccctacctgcttca

SEQ ID NO: 5772973 - DNA, 16 bp, Homo sapiens
gggagtcggttagtca

SEQ ID NO: 5772974 - DNA, 16 bp, Homo sapiens
gggagtctcaggagga

SEQ ID NO: 5772975 - DNA, 19 bp, Homo sapiens
gggagtctcaggaggaggc

SEQ ID NO: 5772976 - DNA, 21 bp, Homo sapiens
gggagtctcaggaggaggctg

SEQ ID NO: 5772977 - DNA, 20 bp, Homo sapiens
gggagtctccctccgactcc

SEQ ID NO: 5772978 - DNA, 20 bp, Homo sapiens
gggagtctcctcactgccac

SEQ ID NO: 5772979 - DNA, 21 bp, Homo sapiens
gggagtctcctcactgccact

SEQ ID NO: 5772980 - DNA, 20 bp, Homo sapiens
gggagtcttaataaaataaa

SEQ ID NO: 5772981 - DNA, 20 bp, Homo sapiens
gggagtgaaacagagaaaga

SEQ ID NO: 5772982 - DNA, 21 bp, Homo sapiens
gggagtgaaacagagaaagaa

SEQ ID NO: 5772983 - DNA, 19 bp, Homo sapiens
gggagtgagacagaagtaa

SEQ ID NO: 5772984 - DNA, 13 bp, Homo sapiens
gggagtgagcagc

SEQ ID NO: 5772985 - DNA, 15 bp, Homo sapiens
gggagtgagcagcta

SEQ ID NO: 5772986 - DNA, 14 bp, Homo sapiens
gggagtgagcttgg

SEQ ID NO: 5772987 - DNA, 15 bp, Homo sapiens
gggagtgctggctca

SEQ ID NO: 5772988 - DNA, 16 bp, Homo sapiens
gggagtgctggctcac

SEQ ID NO: 5772989 - DNA, 23 bp, Homo sapiens
gggagtgctggctcacagtacag

SEQ ID NO: 5772990 - DNA, 17 bp, Homo sapiens
gggagtggcacttctgc

SEQ ID NO: 5772991 - DNA, 15 bp, Homo sapiens
gggagtggccacaga

SEQ ID NO: 5772992 - DNA, 12 bp, Homo sapiens
gggagtggcgcg

SEQ ID NO: 5772993 - DNA, 18 bp, Homo sapiens
gggagtgggacagagtct

SEQ ID NO: 5772994 - DNA, 16 bp, Homo sapiens
gggagtgggagaggaa

SEQ ID NO: 5772995 - DNA, 12 bp, Homo sapiens
gggagtgggcac

SEQ ID NO: 5772996 - DNA, 15 bp, Homo sapiens
gggagtgggcacctc

SEQ ID NO: 5772997 - DNA, 20 bp, Homo sapiens
gggagtgggcacctcagaaa

SEQ ID NO: 5772998 - DNA, 22 bp, Homo sapiens
gggagtggggcctttgccagca

SEQ ID NO: 5772999 - DNA, 14 bp, Homo sapiens
gggagtggggtaga

SEQ ID NO: 5773000 - DNA, 21 bp, Homo sapiens
gggagtggggtagaggaagac

SEQ ID NO: 5773001 - DNA, 11 bp, Homo sapiens
gggagtgggtg

SEQ ID NO: 5773002 - DNA, 20 bp, Homo sapiens
gggagtgtacagacccctgc

SEQ ID NO: 5773003 - DNA, 18 bp, Homo sapiens
gggagtgtgatgcaggaa

SEQ ID NO: 5773004 - DNA, 18 bp, Homo sapiens
gggagtgtgggctgccct

SEQ ID NO: 5773005 - DNA, 21 bp, Homo sapiens
gggagtgtgggggtgccatgg

SEQ ID NO: 5773006 - DNA, 11 bp, Homo sapiens
gggagtgtgta

SEQ ID NO: 5773007 - DNA, 17 bp, Homo sapiens
gggagtgttcccgtgcc

SEQ ID NO: 5773008 - DNA, 18 bp, Homo sapiens
gggagtgttctgtgggct

SEQ ID NO: 5773009 - DNA, 15 bp, Homo sapiens
gggagttaagacctg

SEQ ID NO: 5773010 - DNA, 23 bp, Homo sapiens
gggagttaagacctggcagctct

SEQ ID NO: 5773011 - DNA, 21 bp, Homo sapiens
gggagttagcactgaactgct

SEQ ID NO: 5773012 - DNA, 20 bp, Homo sapiens
gggagttagggagagagaag

SEQ ID NO: 5773013 - DNA, 23 bp, Homo sapiens
gggagttcgagaccaacctgacc

SEQ ID NO: 5773014 - DNA, 16 bp, Homo sapiens
gggagttgctgttaat

SEQ ID NO: 5773015 - DNA, 21 bp, Homo sapiens
gggagttgctgttaatctgat

SEQ ID NO: 5773016 - DNA, 15 bp, Homo sapiens
gggataaaatgacta

SEQ ID NO: 5773017 - DNA, 17 bp, Homo sapiens
gggataacagaggcagg

SEQ ID NO: 5773018 - DNA, 22 bp, Homo sapiens
gggataacccaaacaaaaatga

SEQ ID NO: 5773019 - DNA, 19 bp, Homo sapiens
gggataaccccaggcactg

SEQ ID NO: 5773020 - DNA, 23 bp, Homo sapiens
gggataaccccaggcactgtttg

SEQ ID NO: 5773021 - DNA, 16 bp, Homo sapiens
gggataactgatttct

SEQ ID NO: 5773022 - DNA, 23 bp, Homo sapiens
gggataagaattgtctctgggct

SEQ ID NO: 5773023 - DNA, 18 bp, Homo sapiens
gggataatgggagacagt

SEQ ID NO: 5773024 - DNA, 17 bp, Homo sapiens
gggatagtctgggtcag

SEQ ID NO: 5773025 - DNA, 23 bp, Homo sapiens
gggatatctttacaagcaggcac

SEQ ID NO: 5773026 - DNA, 21 bp, Homo sapiens
gggatatgatttaaatcagcc

SEQ ID NO: 5773027 - DNA, 21 bp, Homo sapiens
gggatatttcctaaggcatgt

SEQ ID NO: 5773028 - DNA, 20 bp, Homo sapiens
gggatcacagcctcacccct

SEQ ID NO: 5773029 - DNA, 14 bp, Homo sapiens
gggatcagagcagg

SEQ ID NO: 5773030 - DNA, 14 bp, Homo sapiens
gggatcaggagccc

SEQ ID NO: 5773031 - DNA, 22 bp, Homo sapiens
gggatccaatatgactcagaga

SEQ ID NO: 5773032 - DNA, 17 bp, Homo sapiens
gggatccacgctgggcc

SEQ ID NO: 5773033 - DNA, 16 bp, Homo sapiens
gggatccacttcttgg

SEQ ID NO: 5773034 - DNA, 22 bp, Homo sapiens
gggatccacttcttggttcctg

SEQ ID NO: 5773035 - DNA, 13 bp, Homo sapiens
gggatccagagag

SEQ ID NO: 5773036 - DNA, 19 bp, Homo sapiens
gggatcccaccctggggac

SEQ ID NO: 5773037 - DNA, 22 bp, Homo sapiens
gggatccccgcctggccaggag

SEQ ID NO: 5773038 - DNA, 20 bp, Homo sapiens
gggatccctcccccccatgc

SEQ ID NO: 5773039 - DNA, 18 bp, Homo sapiens
gggatccgagggcccctc

SEQ ID NO: 5773040 - DNA, 17 bp, Homo sapiens
gggatcctccacagaga

SEQ ID NO: 5773041 - DNA, 19 bp, Homo sapiens
gggatcctccacagagagg

SEQ ID NO: 5773042 - DNA, 15 bp, Homo sapiens
gggatcctccaggtg

SEQ ID NO: 5773043 - DNA, 16 bp, Homo sapiens
gggatcctccaggtgc

SEQ ID NO: 5773044 - DNA, 14 bp, Homo sapiens
gggatcctgcctgc

SEQ ID NO: 5773045 - DNA, 17 bp, Homo sapiens
gggatcctggagcccct

SEQ ID NO: 5773046 - DNA, 18 bp, Homo sapiens
gggatcctggagcccctg

SEQ ID NO: 5773047 - DNA, 22 bp, Homo sapiens
gggatcggggcaagagaggctg

SEQ ID NO: 5773048 - DNA, 15 bp, Homo sapiens
gggatcgtgcatttg

SEQ ID NO: 5773049 - DNA, 17 bp, Homo sapiens
gggatctaaaaggagga

SEQ ID NO: 5773050 - DNA, 16 bp, Homo sapiens
gggatctaggagagga

SEQ ID NO: 5773051 - DNA, 14 bp, Homo sapiens
gggatctcaggggc

SEQ ID NO: 5773052 - DNA, 20 bp, Homo sapiens
gggatctgcattccccgctg

SEQ ID NO: 5773053 - DNA, 13 bp, Homo sapiens
gggatctgccccc

SEQ ID NO: 5773054 - DNA, 15 bp, Homo sapiens
gggatctgcccctcc

SEQ ID NO: 5773055 - DNA, 13 bp, Homo sapiens
gggatctgggcaa

SEQ ID NO: 5773056 - DNA, 21 bp, Homo sapiens
gggatctggggggtggggagg

SEQ ID NO: 5773057 - DNA, 19 bp, Homo sapiens
gggatctgttttctggaag

SEQ ID NO: 5773058 - DNA, 19 bp, Homo sapiens
gggatcttacccacttccc

SEQ ID NO: 5773059 - DNA, 16 bp, Homo sapiens
gggatcttcccacagg

SEQ ID NO: 5773060 - DNA, 19 bp, Homo sapiens
gggatcttcccacaggagg

SEQ ID NO: 5773061 - DNA, 23 bp, Homo sapiens
gggatcttcccacaggagggcca

SEQ ID NO: 5773062 - DNA, 22 bp, Homo sapiens
gggatcttctccctcccctcac

SEQ ID NO: 5773063 - DNA, 15 bp, Homo sapiens
gggatgaaaagccat

SEQ ID NO: 5773064 - DNA, 17 bp, Homo sapiens
gggatgaagagggtaga

SEQ ID NO: 5773065 - DNA, 20 bp, Homo sapiens
gggatgacatgcactcagct

SEQ ID NO: 5773066 - DNA, 16 bp, Homo sapiens
gggatgacctccagaa

SEQ ID NO: 5773067 - DNA, 23 bp, Homo sapiens
gggatgacctccagaagtccctt

SEQ ID NO: 5773068 - DNA, 15 bp, Homo sapiens
gggatgactgtgatt

SEQ ID NO: 5773069 - DNA, 13 bp, Homo sapiens
gggatgagaaagg

SEQ ID NO: 5773070 - DNA, 16 bp, Homo sapiens
gggatgagaagagggg

SEQ ID NO: 5773071 - DNA, 14 bp, Homo sapiens
gggatgagagtggc

SEQ ID NO: 5773072 - DNA, 15 bp, Homo sapiens
gggatgagagttttg

SEQ ID NO: 5773073 - DNA, 22 bp, Homo sapiens
gggatgatgccacaccaagctg

SEQ ID NO: 5773074 - DNA, 16 bp, Homo sapiens
gggatgattcaagcca

SEQ ID NO: 5773075 - DNA, 17 bp, Homo sapiens
gggatgattgaagaaac

SEQ ID NO: 5773076 - DNA, 20 bp, Homo sapiens
gggatgcaaataaagcctgc

SEQ ID NO: 5773077 - DNA, 21 bp, Homo sapiens
gggatgccaacaccttcttgg

SEQ ID NO: 5773078 - DNA, 15 bp, Homo sapiens
gggatgcccagaaga

SEQ ID NO: 5773079 - DNA, 12 bp, Homo sapiens
gggatgcccagt

SEQ ID NO: 5773080 - DNA, 19 bp, Homo sapiens
gggatgcccccaggcagcc

SEQ ID NO: 5773081 - DNA, 15 bp, Homo sapiens
gggatgcccctggcc

SEQ ID NO: 5773082 - DNA, 16 bp, Homo sapiens
gggatgccctggaggt

SEQ ID NO: 5773083 - DNA, 15 bp, Homo sapiens
gggatgcccttcccc

SEQ ID NO: 5773084 - DNA, 13 bp, Homo sapiens
gggatgcctcacc

SEQ ID NO: 5773085 - DNA, 19 bp, Homo sapiens
gggatgcctcaccacaccc

SEQ ID NO: 5773086 - DNA, 14 bp, Homo sapiens
gggatgcctgtctt

SEQ ID NO: 5773087 - DNA, 18 bp, Homo sapiens
gggatgcggatcctgctg

SEQ ID NO: 5773088 - DNA, 17 bp, Homo sapiens
gggatgcgtgggaggca

SEQ ID NO: 5773089 - DNA, 20 bp, Homo sapiens
gggatgcgtgggaggcagaa

SEQ ID NO: 5773090 - DNA, 16 bp, Homo sapiens
gggatgctatttcagc

SEQ ID NO: 5773091 - DNA, 19 bp, Homo sapiens
gggatgctatttcagccaa

SEQ ID NO: 5773092 - DNA, 12 bp, Homo sapiens
gggatgctgctc

SEQ ID NO: 5773093 - DNA, 13 bp, Homo sapiens
gggatgctgctcc

SEQ ID NO: 5773094 - DNA, 22 bp, Homo sapiens
gggatgctgctccgcccgctcc

SEQ ID NO: 5773095 - DNA, 14 bp, Homo sapiens
gggatgctgggctg

SEQ ID NO: 5773096 - DNA, 13 bp, Homo sapiens
gggatgctggtgg

SEQ ID NO: 5773097 - DNA, 19 bp, Homo sapiens
gggatgctggtggctggtg

SEQ ID NO: 5773098 - DNA, 12 bp, Homo sapiens
gggatgcttcat

SEQ ID NO: 5773099 - DNA, 16 bp, Homo sapiens
gggatggacatcttgt

SEQ ID NO: 5773100 - DNA, 19 bp, Homo sapiens
gggatggacgatctcccac

SEQ ID NO: 5773101 - DNA, 21 bp, Homo sapiens
gggatggagaatgccagccca

SEQ ID NO: 5773102 - DNA, 18 bp, Homo sapiens
gggatggaggagaagaat

SEQ ID NO: 5773103 - DNA, 13 bp, Homo sapiens
gggatggaggcca

SEQ ID NO: 5773104 - DNA, 12 bp, Homo sapiens
gggatggcagac

SEQ ID NO: 5773105 - DNA, 18 bp, Homo sapiens
gggatggccgatggggcc

SEQ ID NO: 5773106 - DNA, 17 bp, Homo sapiens
gggatgggacagggagg

SEQ ID NO: 5773107 - DNA, 16 bp, Homo sapiens
gggatgggagccgggc

SEQ ID NO: 5773108 - DNA, 13 bp, Homo sapiens
gggatgggcacag

SEQ ID NO: 5773109 - DNA, 15 bp, Homo sapiens
gggatgggcacaggc

SEQ ID NO: 5773110 - DNA, 17 bp, Homo sapiens
gggatgggcacaggctg

SEQ ID NO: 5773111 - DNA, 16 bp, Homo sapiens
gggatgggccaccgcc

SEQ ID NO: 5773112 - DNA, 13 bp, Homo sapiens
gggatgggtcctc

SEQ ID NO: 5773113 - DNA, 16 bp, Homo sapiens
gggatgggtggggagg

SEQ ID NO: 5773114 - DNA, 18 bp, Homo sapiens
gggatggtccaggatctc

SEQ ID NO: 5773115 - DNA, 17 bp, Homo sapiens
gggatggtgcccctagg

SEQ ID NO: 5773116 - DNA, 18 bp, Homo sapiens
gggatggtggagggccac

SEQ ID NO: 5773117 - DNA, 18 bp, Homo sapiens
gggatggtggcacaggca

SEQ ID NO: 5773118 - DNA, 19 bp, Homo sapiens
gggatggtgggcttcaggg

SEQ ID NO: 5773119 - DNA, 19 bp, Homo sapiens
gggatggttccccaggagg

SEQ ID NO: 5773120 - DNA, 22 bp, Homo sapiens
gggatgtacaaggcgatcccat

SEQ ID NO: 5773121 - DNA, 23 bp, Homo sapiens
gggatgtatccatgggggcaggg

SEQ ID NO: 5773122 - DNA, 16 bp, Homo sapiens
gggatgtatttttctt

SEQ ID NO: 5773123 - DNA, 13 bp, Homo sapiens
gggatgtcagcag

SEQ ID NO: 5773124 - DNA, 17 bp, Homo sapiens
gggatgtcagcagacac

SEQ ID NO: 5773125 - DNA, 23 bp, Homo sapiens
gggatgtcagcagacacacatgg

SEQ ID NO: 5773126 - DNA, 14 bp, Homo sapiens
gggatgtgaagaaa

SEQ ID NO: 5773127 - DNA, 15 bp, Homo sapiens
gggatgtgaagaaat

SEQ ID NO: 5773128 - DNA, 14 bp, Homo sapiens
gggatgtgacatgc

SEQ ID NO: 5773129 - DNA, 15 bp, Homo sapiens
gggatgtgagcccca

SEQ ID NO: 5773130 - DNA, 15 bp, Homo sapiens
gggatgtggagtgag

SEQ ID NO: 5773131 - DNA, 22 bp, Homo sapiens
gggatgtggtattggtgctttg

SEQ ID NO: 5773132 - DNA, 19 bp, Homo sapiens
gggatgtttacctggtgct

SEQ ID NO: 5773133 - DNA, 17 bp, Homo sapiens
gggatgtttgtgctgca

SEQ ID NO: 5773134 - DNA, 20 bp, Homo sapiens
gggattaatatgaaaactta

SEQ ID NO: 5773135 - DNA, 19 bp, Homo sapiens
gggattacagacatgagcc

SEQ ID NO: 5773136 - DNA, 20 bp, Homo sapiens
gggattacaggcgtgagcca

SEQ ID NO: 5773137 - DNA, 21 bp, Homo sapiens
gggattacaggctcctgccac

SEQ ID NO: 5773138 - DNA, 15 bp, Homo sapiens
gggattacaggtgtg

SEQ ID NO: 5773139 - DNA, 15 bp, Homo sapiens
gggattacccaagca

SEQ ID NO: 5773140 - DNA, 17 bp, Homo sapiens
gggattatgggtcacag

SEQ ID NO: 5773141 - DNA, 16 bp, Homo sapiens
gggattcaggctgctt

SEQ ID NO: 5773142 - DNA, 18 bp, Homo sapiens
gggattcatggctttgta

SEQ ID NO: 5773143 - DNA, 19 bp, Homo sapiens
gggattcctgacccaggcc

SEQ ID NO: 5773144 - DNA, 21 bp, Homo sapiens
gggattctactttaagcacta

SEQ ID NO: 5773145 - DNA, 19 bp, Homo sapiens
gggattctgagcagtgcct

SEQ ID NO: 5773146 - DNA, 17 bp, Homo sapiens
gggattgaacacaggca

SEQ ID NO: 5773147 - DNA, 18 bp, Homo sapiens
gggattgaggggccctgg

SEQ ID NO: 5773148 - DNA, 14 bp, Homo sapiens
gggattgctgaggc

SEQ ID NO: 5773149 - DNA, 15 bp, Homo sapiens
gggattgctgccact

SEQ ID NO: 5773150 - DNA, 20 bp, Homo sapiens
gggattggaccgagctggaa

SEQ ID NO: 5773151 - DNA, 17 bp, Homo sapiens
gggattgggagggacag

SEQ ID NO: 5773152 - DNA, 19 bp, Homo sapiens
gggattgggagggacaggg

SEQ ID NO: 5773153 - DNA, 16 bp, Homo sapiens
gggattgtaaaatggt

SEQ ID NO: 5773154 - DNA, 20 bp, Homo sapiens
gggatttaatttccagggtt

SEQ ID NO: 5773155 - DNA, 15 bp, Homo sapiens
gggatttccatgatg

SEQ ID NO: 5773156 - DNA, 15 bp, Homo sapiens
gggatttctcccagc

SEQ ID NO: 5773157 - DNA, 13 bp, Homo sapiens
gggatttcttagg

SEQ ID NO: 5773158 - DNA, 19 bp, Homo sapiens
gggatttgaaccaggcctt

SEQ ID NO: 5773159 - DNA, 12 bp, Homo sapiens
gggatttgagat

SEQ ID NO: 5773160 - DNA, 18 bp, Homo sapiens
gggattttagcctcttcc

SEQ ID NO: 5773161 - DNA, 21 bp, Homo sapiens
gggattttcagccctcagaat

SEQ ID NO: 5773162 - DNA, 19 bp, Homo sapiens
gggattttctagtttcctg

SEQ ID NO: 5773163 - DNA, 22 bp, Homo sapiens
gggattttttactgccctttca

SEQ ID NO: 5773164 - DNA, 16 bp, Homo sapiens
gggattttttcccttt

SEQ ID NO: 5773165 - DNA, 23 bp, Homo sapiens
gggattttttccctttttatgtg

SEQ ID NO: 5773166 - DNA, 20 bp, Homo sapiens
gggatttttttgttcttgtt

SEQ ID NO: 5773167 - DNA, 21 bp, Homo sapiens
gggcaaaacccaggacatctc

SEQ ID NO: 5773168 - DNA, 16 bp, Homo sapiens
gggcaaaactgaatta

SEQ ID NO: 5773169 - DNA, 14 bp, Homo sapiens
gggcaaacaggcag

SEQ ID NO: 5773170 - DNA, 22 bp, Homo sapiens
gggcaaaccctggtgctttcct

SEQ ID NO: 5773171 - DNA, 11 bp, Homo sapiens
gggcagaggaa

SEQ ID NO: 5773172 - DNA, 21 bp, Homo sapiens
gggcagaggaatgtagggcct

SEQ ID NO: 5773173 - DNA, 21 bp, Homo sapiens
gggcagaggagaacttgctgc

SEQ ID NO: 5773174 - DNA, 14 bp, Homo sapiens
gggcagaggcaagg

SEQ ID NO: 5773175 - DNA, 18 bp, Homo sapiens
gggcagaggcaaggatgg

SEQ ID NO: 5773176 - DNA, 21 bp, Homo sapiens
gggcagaggcagtacctgggc

SEQ ID NO: 5773177 - DNA, 23 bp, Homo sapiens
gggcagagggaatgttccctgca

SEQ ID NO: 5773178 - DNA, 14 bp, Homo sapiens
gggcagagggctgg

SEQ ID NO: 5773179 - DNA, 22 bp, Homo sapiens
gggcagagggctggaggcccag

SEQ ID NO: 5773180 - DNA, 14 bp, Homo sapiens
gggcagaggggaga

SEQ ID NO: 5773181 - DNA, 19 bp, Homo sapiens
gggcagaggggagaggaag

SEQ ID NO: 5773182 - DNA, 23 bp, Homo sapiens
gggcagaggggagaggaagcaca

SEQ ID NO: 5773183 - DNA, 14 bp, Homo sapiens
gggcagaggggcag

SEQ ID NO: 5773184 - DNA, 16 bp, Homo sapiens
gggcagagtcacacgg

SEQ ID NO: 5773185 - DNA, 16 bp, Homo sapiens
gggcagagtcctgcct

SEQ ID NO: 5773186 - DNA, 17 bp, Homo sapiens
gggcagagtcctgcctt

SEQ ID NO: 5773187 - DNA, 17 bp, Homo sapiens
gggcagagtgagaccca

SEQ ID NO: 5773188 - DNA, 16 bp, Homo sapiens
gggcagagtgggctgc

SEQ ID NO: 5773189 - DNA, 21 bp, Homo sapiens
gggcagatgtcccccactgct

SEQ ID NO: 5773190 - DNA, 13 bp, Homo sapiens
gggcagatgtggg

SEQ ID NO: 5773191 - DNA, 15 bp, Homo sapiens
gggcagcaaggctgc

SEQ ID NO: 5773192 - DNA, 19 bp, Homo sapiens
gggcagcaaggctgctgcc

SEQ ID NO: 5773193 - DNA, 23 bp, Homo sapiens
gggcagcaattcacgctgtctct

SEQ ID NO: 5773194 - DNA, 16 bp, Homo sapiens
gggcagcacagagagg

SEQ ID NO: 5773195 - DNA, 14 bp, Homo sapiens
gggcagcacagcaa

SEQ ID NO: 5773196 - DNA, 13 bp, Homo sapiens
gggcagcaccctc

SEQ ID NO: 5773197 - DNA, 14 bp, Homo sapiens
gggcagcaccctcc

SEQ ID NO: 5773198 - DNA, 15 bp, Homo sapiens
gggcagcaccctccc

SEQ ID NO: 5773199 - DNA, 17 bp, Homo sapiens
gggcagcaccctccccc

SEQ ID NO: 5773200 - DNA, 11 bp, Homo sapiens
gggcagcactc

SEQ ID NO: 5773201 - DNA, 14 bp, Homo sapiens
gggcagcactcccc

SEQ ID NO: 5773202 - DNA, 20 bp, Homo sapiens
gggcagcagaagggggtggt

SEQ ID NO: 5773203 - DNA, 15 bp, Homo sapiens
gggcagcagagagag

SEQ ID NO: 5773204 - DNA, 16 bp, Homo sapiens
gggcagcagatcttct

SEQ ID NO: 5773205 - DNA, 19 bp, Homo sapiens
gggcagcagcagccctgcc

SEQ ID NO: 5773206 - DNA, 16 bp, Homo sapiens
gggcagcagcatccca

SEQ ID NO: 5773207 - DNA, 18 bp, Homo sapiens
gggcagcagcatcccagc

SEQ ID NO: 5773208 - DNA, 23 bp, Homo sapiens
gggcagcagcatcccagccttga

SEQ ID NO: 5773209 - DNA, 12 bp, Homo sapiens
gggcagcagcca

SEQ ID NO: 5773210 - DNA, 15 bp, Homo sapiens
gggcagcagccagcc

SEQ ID NO: 5773211 - DNA, 18 bp, Homo sapiens
gggcagcagccagccctg

SEQ ID NO: 5773212 - DNA, 23 bp, Homo sapiens
gggcagcagccagccctgcctgg

SEQ ID NO: 5773213 - DNA, 23 bp, Homo sapiens
gggcagcaggaggctttctgggc

SEQ ID NO: 5773214 - DNA, 12 bp, Homo sapiens
gggcagcaggcc

SEQ ID NO: 5773215 - DNA, 14 bp, Homo sapiens
gggcagcaggccag

SEQ ID NO: 5773216 - DNA, 19 bp, Homo sapiens
gggcagcaggccagagaaa

SEQ ID NO: 5773217 - DNA, 13 bp, Homo sapiens
gggcagcagtggg

SEQ ID NO: 5773218 - DNA, 17 bp, Homo sapiens
gggcagcagtggggtga

SEQ ID NO: 5773219 - DNA, 16 bp, Homo sapiens
gggcagcatgcccaga

SEQ ID NO: 5773220 - DNA, 17 bp, Homo sapiens
gggcagccaaacccatg

SEQ ID NO: 5773221 - DNA, 18 bp, Homo sapiens
gggcagccacaccactgc

SEQ ID NO: 5773222 - DNA, 15 bp, Homo sapiens
gggcagccacaggac

SEQ ID NO: 5773223 - DNA, 18 bp, Homo sapiens
gggcagccacaggactga

SEQ ID NO: 5773224 - DNA, 19 bp, Homo sapiens
gggcagccacaggactgag

SEQ ID NO: 5773225 - DNA, 18 bp, Homo sapiens
gggcagccacccaagcct

SEQ ID NO: 5773226 - DNA, 12 bp, Homo sapiens
gggcagccagga

SEQ ID NO: 5773227 - DNA, 12 bp, Homo sapiens
gggcagccaggc

SEQ ID NO: 5773228 - DNA, 13 bp, Homo sapiens
gggcagccaggct

SEQ ID NO: 5773229 - DNA, 14 bp, Homo sapiens
gggcagccaggctg

SEQ ID NO: 5773230 - DNA, 19 bp, Homo sapiens
gggcagccaggctgggccg

SEQ ID NO: 5773231 - DNA, 18 bp, Homo sapiens
gggcagccagggagagcc

SEQ ID NO: 5773232 - DNA, 19 bp, Homo sapiens
gggcagccagggagagccc

SEQ ID NO: 5773233 - DNA, 20 bp, Homo sapiens
gggcagccagggagagccca

SEQ ID NO: 5773234 - DNA, 14 bp, Homo sapiens
gggcagcccagaga

SEQ ID NO: 5773235 - DNA, 15 bp, Homo sapiens
gggcagcccagagag

SEQ ID NO: 5773236 - DNA, 22 bp, Homo sapiens
gggcagcccagagagaccctgc

SEQ ID NO: 5773237 - DNA, 23 bp, Homo sapiens
gggcagccccacagtcccattcc

SEQ ID NO: 5773238 - DNA, 14 bp, Homo sapiens
gggcagccccagag

SEQ ID NO: 5773239 - DNA, 15 bp, Homo sapiens
gggcagccccagaga

SEQ ID NO: 5773240 - DNA, 15 bp, Homo sapiens
gggcagccccctccc

SEQ ID NO: 5773241 - DNA, 11 bp, Homo sapiens
gggcagcccct

SEQ ID NO: 5773242 - DNA, 14 bp, Homo sapiens
gggcagcccctccc

SEQ ID NO: 5773243 - DNA, 15 bp, Homo sapiens
gggcagcccctgctg

SEQ ID NO: 5773244 - DNA, 12 bp, Homo sapiens
gggcagccctcc

SEQ ID NO: 5773245 - DNA, 14 bp, Homo sapiens
gggcagccctcctt

SEQ ID NO: 5773246 - DNA, 12 bp, Homo sapiens
gggcagccctga

SEQ ID NO: 5773247 - DNA, 14 bp, Homo sapiens
gggcagccctgagt

SEQ ID NO: 5773248 - DNA, 18 bp, Homo sapiens
gggcagccgctaggagag

SEQ ID NO: 5773249 - DNA, 22 bp, Homo sapiens
gggcagcctccaccttgctctt

SEQ ID NO: 5773250 - DNA, 18 bp, Homo sapiens
gggcagcctccagtctgc

SEQ ID NO: 5773251 - DNA, 24 bp, Homo sapiens
gggcagcctccagtctgctctcag

SEQ ID NO: 5773252 - DNA, 18 bp, Homo sapiens
gggcagcctcccccggct

SEQ ID NO: 5773253 - DNA, 18 bp, Homo sapiens
gggcagcctcgttaggac

SEQ ID NO: 5773254 - DNA, 11 bp, Homo sapiens
gggcagcctgc

SEQ ID NO: 5773255 - DNA, 23 bp, Homo sapiens
gggcagcctggctcccaggacac

SEQ ID NO: 5773256 - DNA, 15 bp, Homo sapiens
gggcagcctgtgcct

SEQ ID NO: 5773257 - DNA, 20 bp, Homo sapiens
gggcagcctgtgggagaagg

SEQ ID NO: 5773258 - DNA, 16 bp, Homo sapiens
gggcagcgcccttcct

SEQ ID NO: 5773259 - DNA, 21 bp, Homo sapiens
gggcagcgcccttcctctcca

SEQ ID NO: 5773260 - DNA, 15 bp, Homo sapiens
gggcagcggccccgc

SEQ ID NO: 5773261 - DNA, 18 bp, Homo sapiens
gggcagcggccccgcacc

SEQ ID NO: 5773262 - DNA, 22 bp, Homo sapiens
gggcagcggccccgcacccctc

SEQ ID NO: 5773263 - DNA, 21 bp, Homo sapiens
gggcagcgggagcctccctgc

SEQ ID NO: 5773264 - DNA, 14 bp, Homo sapiens
gggcagcgggccag

SEQ ID NO: 5773265 - DNA, 18 bp, Homo sapiens
gggcagcgggccaggccc

SEQ ID NO: 5773266 - DNA, 14 bp, Homo sapiens
gggcagctcctctg

SEQ ID NO: 5773267 - DNA, 22 bp, Homo sapiens
gggcagctcctctgtctcgagc

SEQ ID NO: 5773268 - DNA, 12 bp, Homo sapiens
gggcagctcctg

SEQ ID NO: 5773269 - DNA, 12 bp, Homo sapiens
gggcagctgagg

SEQ ID NO: 5773270 - DNA, 14 bp, Homo sapiens
gggcagctgaggac

SEQ ID NO: 5773271 - DNA, 16 bp, Homo sapiens
gggcagctgccagaga

SEQ ID NO: 5773272 - DNA, 18 bp, Homo sapiens
gggcagctgccagagaag

SEQ ID NO: 5773273 - DNA, 13 bp, Homo sapiens
gggcagctgcctc

SEQ ID NO: 5773274 - DNA, 19 bp, Homo sapiens
gggcagctgcctcccctcc

SEQ ID NO: 5773275 - DNA, 20 bp, Homo sapiens
gggcagctgcctcccctcct

SEQ ID NO: 5773276 - DNA, 20 bp, Homo sapiens
gggcagctggcccccagccc

SEQ ID NO: 5773277 - DNA, 16 bp, Homo sapiens
gggcagctggctctga

SEQ ID NO: 5773278 - DNA, 19 bp, Homo sapiens
gggcagctgggcccaaccc

SEQ ID NO: 5773279 - DNA, 13 bp, Homo sapiens
gggcagctgtgat

SEQ ID NO: 5773280 - DNA, 18 bp, Homo sapiens
gggcagcttgggctggcg

SEQ ID NO: 5773281 - DNA, 23 bp, Homo sapiens
gggcagcttgggctggcgggccc

SEQ ID NO: 5773282 - DNA, 13 bp, Homo sapiens
gggcaggaccact

SEQ ID NO: 5773283 - DNA, 13 bp, Homo sapiens
gggcaggaccagc

SEQ ID NO: 5773284 - DNA, 15 bp, Homo sapiens
gggcaggaccagccc

SEQ ID NO: 5773285 - DNA, 16 bp, Homo sapiens
gggcaggaccagccca

SEQ ID NO: 5773286 - DNA, 21 bp, Homo sapiens
gggcaggaccagcccacgctg

SEQ ID NO: 5773287 - DNA, 19 bp, Homo sapiens
gggcaggaccctgctgact

SEQ ID NO: 5773288 - DNA, 20 bp, Homo sapiens
gggcaggaccctgctgactc

SEQ ID NO: 5773289 - DNA, 14 bp, Homo sapiens
gggcaggagaggct

SEQ ID NO: 5773290 - DNA, 18 bp, Homo sapiens
gggcaggagcctagagga

SEQ ID NO: 5773291 - DNA, 22 bp, Homo sapiens
gggcaggagctcacaccgcacc

SEQ ID NO: 5773292 - DNA, 13 bp, Homo sapiens
gggcaggagctgc

SEQ ID NO: 5773293 - DNA, 17 bp, Homo sapiens
gggcaggaggcctggcc

SEQ ID NO: 5773294 - DNA, 14 bp, Homo sapiens
gggcaggagtagct

SEQ ID NO: 5773295 - DNA, 15 bp, Homo sapiens
gggcaggagtagctg

SEQ ID NO: 5773296 - DNA, 16 bp, Homo sapiens
gggcaggagtgccagg

SEQ ID NO: 5773297 - DNA, 18 bp, Homo sapiens
gggcaggatctcaagcca

SEQ ID NO: 5773298 - DNA, 20 bp, Homo sapiens
gggcaggatctcaagccagc

SEQ ID NO: 5773299 - DNA, 16 bp, Homo sapiens
gggcaggcaagccctt

SEQ ID NO: 5773300 - DNA, 17 bp, Homo sapiens
gggcaggcaagcccttc

SEQ ID NO: 5773301 - DNA, 12 bp, Homo sapiens
gggcaggcacag

SEQ ID NO: 5773302 - DNA, 17 bp, Homo sapiens
gggcaggcacagcacag

SEQ ID NO: 5773303 - DNA, 18 bp, Homo sapiens
gggcaggcagctaggcag

SEQ ID NO: 5773304 - DNA, 12 bp, Homo sapiens
gggcaggcaggg

SEQ ID NO: 5773305 - DNA, 13 bp, Homo sapiens
gggcaggcagggc

SEQ ID NO: 5773306 - DNA, 15 bp, Homo sapiens
gggcaggcatgaagt

SEQ ID NO: 5773307 - DNA, 23 bp, Homo sapiens
gggcaggccacctggctctcacc

SEQ ID NO: 5773308 - DNA, 12 bp, Homo sapiens
gggcaggccagc

SEQ ID NO: 5773309 - DNA, 17 bp, Homo sapiens
gggcaggccctgcactg

SEQ ID NO: 5773310 - DNA, 21 bp, Homo sapiens
gggcaggccctgcactgtcct

SEQ ID NO: 5773311 - DNA, 12 bp, Homo sapiens
gggcaggcctgg

SEQ ID NO: 5773312 - DNA, 13 bp, Homo sapiens
gggcaggcctggg

SEQ ID NO: 5773313 - DNA, 21 bp, Homo sapiens
gggcaggcctgggacccagct

SEQ ID NO: 5773314 - DNA, 19 bp, Homo sapiens
gggcaggcggtccccatcc

SEQ ID NO: 5773315 - DNA, 22 bp, Homo sapiens
gggcaggcgtgactcagcagcc

SEQ ID NO: 5773316 - DNA, 16 bp, Homo sapiens
gggcaggctacccctt

SEQ ID NO: 5773317 - DNA, 13 bp, Homo sapiens
gggcaggctgaca

SEQ ID NO: 5773318 - DNA, 16 bp, Homo sapiens
gggcaggctgggccat

SEQ ID NO: 5773319 - DNA, 12 bp, Homo sapiens
gggcaggcttgg

SEQ ID NO: 5773320 - DNA, 13 bp, Homo sapiens
gggcagggaagga

SEQ ID NO: 5773321 - DNA, 14 bp, Homo sapiens
gggcagggaaggac

SEQ ID NO: 5773322 - DNA, 15 bp, Homo sapiens
gggcagggagctggg

SEQ ID NO: 5773323 - DNA, 13 bp, Homo sapiens
gggcagggaggca

SEQ ID NO: 5773324 - DNA, 21 bp, Homo sapiens
gggcagggccaccccactcta

SEQ ID NO: 5773325 - DNA, 19 bp, Homo sapiens
gggcagggcccagggaggt

SEQ ID NO: 5773326 - DNA, 20 bp, Homo sapiens
gggcagggcccagggaggtg

SEQ ID NO: 5773327 - DNA, 13 bp, Homo sapiens
gggcagggcccct

SEQ ID NO: 5773328 - DNA, 11 bp, Homo sapiens
gggcagggccg

SEQ ID NO: 5773329 - DNA, 18 bp, Homo sapiens
gggcagggccgcagggcg

SEQ ID NO: 5773330 - DNA, 23 bp, Homo sapiens
gggcagggccgcccgggcccaga

SEQ ID NO: 5773331 - DNA, 15 bp, Homo sapiens
gggcagggcgagctg

SEQ ID NO: 5773332 - DNA, 12 bp, Homo sapiens
gggcagggctgt

SEQ ID NO: 5773333 - DNA, 12 bp, Homo sapiens
gggcaggggcct

SEQ ID NO: 5773334 - DNA, 16 bp, Homo sapiens
gggcaggggcctgggc

SEQ ID NO: 5773335 - DNA, 22 bp, Homo sapiens
gggcaggggcgggcggagggag

SEQ ID NO: 5773336 - DNA, 14 bp, Homo sapiens
gggcaggggtgctg

SEQ ID NO: 5773337 - DNA, 22 bp, Homo sapiens
gggcaggggtggtggagggggc

SEQ ID NO: 5773338 - DNA, 13 bp, Homo sapiens
gggcagggtctgg

SEQ ID NO: 5773339 - DNA, 15 bp, Homo sapiens
gggcagggtctgggc

SEQ ID NO: 5773340 - DNA, 17 bp, Homo sapiens
gggcagggtctgggctg

SEQ ID NO: 5773341 - DNA, 18 bp, Homo sapiens
gggcagggtgggcagcct

SEQ ID NO: 5773342 - DNA, 18 bp, Homo sapiens
gggcaggtccagctctgt

SEQ ID NO: 5773343 - DNA, 13 bp, Homo sapiens
gggcaggtcctgg

SEQ ID NO: 5773344 - DNA, 22 bp, Homo sapiens
gggcaggtgctggagcactggg

SEQ ID NO: 5773345 - DNA, 21 bp, Homo sapiens
gggcaggtggccacagcagga

SEQ ID NO: 5773346 - DNA, 15 bp, Homo sapiens
gggcaggtggccgcc

SEQ ID NO: 5773347 - DNA, 19 bp, Homo sapiens
gggcaggtggcctctgctg

SEQ ID NO: 5773348 - DNA, 17 bp, Homo sapiens
gggcaggtgggagcttg

SEQ ID NO: 5773349 - DNA, 14 bp, Homo sapiens
gggcaggtggggtg

SEQ ID NO: 5773350 - DNA, 11 bp, Homo sapiens
gggcaggtggt

SEQ ID NO: 5773351 - DNA, 22 bp, Homo sapiens
gggcaggtggtggcactgagcc

SEQ ID NO: 5773352 - DNA, 23 bp, Homo sapiens
gggccagagctagggctgctgct

SEQ ID NO: 5773353 - DNA, 22 bp, Homo sapiens
gggccagaggaactgtccagag

SEQ ID NO: 5773354 - DNA, 13 bp, Homo sapiens
gggccagagggac

SEQ ID NO: 5773355 - DNA, 20 bp, Homo sapiens
gggccagagtattggtctcc

SEQ ID NO: 5773356 - DNA, 20 bp, Homo sapiens
gggccagatgattttcctcc

SEQ ID NO: 5773357 - DNA, 18 bp, Homo sapiens
gggccagatgctgggcag

SEQ ID NO: 5773358 - DNA, 12 bp, Homo sapiens
gggccagcactg

SEQ ID NO: 5773359 - DNA, 12 bp, Homo sapiens
gggccagcagag

SEQ ID NO: 5773360 - DNA, 13 bp, Homo sapiens
gggccagcagagg

SEQ ID NO: 5773361 - DNA, 18 bp, Homo sapiens
gggccagcaggcagcgcc

SEQ ID NO: 5773362 - DNA, 21 bp, Homo sapiens
gggccagcatactccgtgagg

SEQ ID NO: 5773363 - DNA, 19 bp, Homo sapiens
gggccagcataggggggag

SEQ ID NO: 5773364 - DNA, 14 bp, Homo sapiens
gggccagccaggcg

SEQ ID NO: 5773365 - DNA, 18 bp, Homo sapiens
gggccagccaggcgggct

SEQ ID NO: 5773366 - DNA, 14 bp, Homo sapiens
gggccagcccagga

SEQ ID NO: 5773367 - DNA, 22 bp, Homo sapiens
gggccagccccacccccagcca

SEQ ID NO: 5773368 - DNA, 23 bp, Homo sapiens
gggccagccccacccccagccag

SEQ ID NO: 5773369 - DNA, 16 bp, Homo sapiens
gggccagcccctccat

SEQ ID NO: 5773370 - DNA, 18 bp, Homo sapiens
gggccagcccctccccgc

SEQ ID NO: 5773371 - DNA, 22 bp, Homo sapiens
gggccagccctacatcttcagc

SEQ ID NO: 5773372 - DNA, 15 bp, Homo sapiens
gggccagcccttgct

SEQ ID NO: 5773373 - DNA, 19 bp, Homo sapiens
gggccagcccttgctctac

SEQ ID NO: 5773374 - DNA, 14 bp, Homo sapiens
gggccagcctagcc

SEQ ID NO: 5773375 - DNA, 15 bp, Homo sapiens
gggccagcctagccc

SEQ ID NO: 5773376 - DNA, 11 bp, Homo sapiens
gggccagcctc

SEQ ID NO: 5773377 - DNA, 17 bp, Homo sapiens
gggccagcctcagctca

SEQ ID NO: 5773378 - DNA, 20 bp, Homo sapiens
gggccagcgatttttgagga

SEQ ID NO: 5773379 - DNA, 19 bp, Homo sapiens
gggccagcggccctcccag

SEQ ID NO: 5773380 - DNA, 22 bp, Homo sapiens
gggccagcggggctgctcaccc

SEQ ID NO: 5773381 - DNA, 21 bp, Homo sapiens
gggccagctccaggagggctt

SEQ ID NO: 5773382 - DNA, 12 bp, Homo sapiens
gggccagctgcc

SEQ ID NO: 5773383 - DNA, 22 bp, Homo sapiens
gggccagctgcccctcatttat

SEQ ID NO: 5773384 - DNA, 17 bp, Homo sapiens
gggccagctggggagat

SEQ ID NO: 5773385 - DNA, 22 bp, Homo sapiens
gggccagctggtgctgcaagga

SEQ ID NO: 5773386 - DNA, 13 bp, Homo sapiens
gggccaggaagga

SEQ ID NO: 5773387 - DNA, 22 bp, Homo sapiens
gggccaggaaggacagactggc

SEQ ID NO: 5773388 - DNA, 18 bp, Homo sapiens
gggccaggaaggggacag

SEQ ID NO: 5773389 - DNA, 16 bp, Homo sapiens
gggccaggacaggccc

SEQ ID NO: 5773390 - DNA, 17 bp, Homo sapiens
gggccaggacaggcccg

SEQ ID NO: 5773391 - DNA, 11 bp, Homo sapiens
gggccaggaga

SEQ ID NO: 5773392 - DNA, 12 bp, Homo sapiens
gggccaggagaa

SEQ ID NO: 5773393 - DNA, 19 bp, Homo sapiens
gggccaggagaatctccgc

SEQ ID NO: 5773394 - DNA, 13 bp, Homo sapiens
gggccaggagaga

SEQ ID NO: 5773395 - DNA, 16 bp, Homo sapiens
gggccaggagagagat

SEQ ID NO: 5773396 - DNA, 12 bp, Homo sapiens
gggccaggagcc

SEQ ID NO: 5773397 - DNA, 21 bp, Homo sapiens
gggccaggagccgggcctccc

SEQ ID NO: 5773398 - DNA, 15 bp, Homo sapiens
gggccaggagctcag

SEQ ID NO: 5773399 - DNA, 17 bp, Homo sapiens
gggccaggagtggggag

SEQ ID NO: 5773400 - DNA, 19 bp, Homo sapiens
gggccaggagtggggagag

SEQ ID NO: 5773401 - DNA, 18 bp, Homo sapiens
gggccaggattcaggcct

SEQ ID NO: 5773402 - DNA, 19 bp, Homo sapiens
gggccaggattcaggcctc

SEQ ID NO: 5773403 - DNA, 12 bp, Homo sapiens
gggccaggcagg

SEQ ID NO: 5773404 - DNA, 20 bp, Homo sapiens
gggccaggcaggtgcctgga

SEQ ID NO: 5773405 - DNA, 15 bp, Homo sapiens
gggccaggccaggac

SEQ ID NO: 5773406 - DNA, 17 bp, Homo sapiens
gggccaggccaggacca

SEQ ID NO: 5773407 - DNA, 18 bp, Homo sapiens
gggccaggcccaggcaga

SEQ ID NO: 5773408 - DNA, 17 bp, Homo sapiens
gggccaggcccaggcct

SEQ ID NO: 5773409 - DNA, 18 bp, Homo sapiens
gggccaggcccaggcctc

SEQ ID NO: 5773410 - DNA, 18 bp, Homo sapiens
gggccaggccccatggag

SEQ ID NO: 5773411 - DNA, 16 bp, Homo sapiens
gggccaggccctggag

SEQ ID NO: 5773412 - DNA, 19 bp, Homo sapiens
gggccaggccctggagggc

SEQ ID NO: 5773413 - DNA, 16 bp, Homo sapiens
gggccaggcctctgct

SEQ ID NO: 5773414 - DNA, 21 bp, Homo sapiens
gggccaggcctctgctggctc

SEQ ID NO: 5773415 - DNA, 13 bp, Homo sapiens
gggccaggcctgg

SEQ ID NO: 5773416 - DNA, 12 bp, Homo sapiens
gggccaggctga

SEQ ID NO: 5773417 - DNA, 15 bp, Homo sapiens
gggccaggctgagcc

SEQ ID NO: 5773418 - DNA, 15 bp, Homo sapiens
gggccaggctgggtc

SEQ ID NO: 5773419 - DNA, 16 bp, Homo sapiens
gggccagggacccagg

SEQ ID NO: 5773420 - DNA, 23 bp, Homo sapiens
gggccagggacccaggtgtgcct

SEQ ID NO: 5773421 - DNA, 11 bp, Homo sapiens
gggccagggag

SEQ ID NO: 5773422 - DNA, 14 bp, Homo sapiens
gggccagggaggca

SEQ ID NO: 5773423 - DNA, 12 bp, Homo sapiens
gggccagggcaa

SEQ ID NO: 5773424 - DNA, 16 bp, Homo sapiens
gggccagggcaatgcc

SEQ ID NO: 5773425 - DNA, 16 bp, Homo sapiens
gggccagggccctgca

SEQ ID NO: 5773426 - DNA, 18 bp, Homo sapiens
gggccagggccctgcaga

SEQ ID NO: 5773427 - DNA, 11 bp, Homo sapiens
gggccagggcg

SEQ ID NO: 5773428 - DNA, 12 bp, Homo sapiens
gggccagggctc

SEQ ID NO: 5773429 - DNA, 21 bp, Homo sapiens
gggccagggctgccctgagaa

SEQ ID NO: 5773430 - DNA, 14 bp, Homo sapiens
gggccagggctgga

SEQ ID NO: 5773431 - DNA, 12 bp, Homo sapiens
gggccaggggac

SEQ ID NO: 5773432 - DNA, 14 bp, Homo sapiens
gggccaggggcagg

SEQ ID NO: 5773433 - DNA, 15 bp, Homo sapiens
gggccaggggcaggc

SEQ ID NO: 5773434 - DNA, 18 bp, Homo sapiens
gggccagggtgggaagag

SEQ ID NO: 5773435 - DNA, 22 bp, Homo sapiens
gggccagggtgggaagagaaga

SEQ ID NO: 5773436 - DNA, 19 bp, Homo sapiens
gggccaggtcctcacagca

SEQ ID NO: 5773437 - DNA, 23 bp, Homo sapiens
gggccaggtcctcacagcagtca

SEQ ID NO: 5773438 - DNA, 20 bp, Homo sapiens
gggccagtcatggctgtccc

SEQ ID NO: 5773439 - DNA, 21 bp, Homo sapiens
gggccagtccctgaggcaggt

SEQ ID NO: 5773440 - DNA, 18 bp, Homo sapiens
gggccagtcctcctggga

SEQ ID NO: 5773441 - DNA, 20 bp, Homo sapiens
gggccagtcctcctgggagc

SEQ ID NO: 5773442 - DNA, 19 bp, Homo sapiens
gggccagtcctgcctggcc

SEQ ID NO: 5773443 - DNA, 20 bp, Homo sapiens
gggccagtcctgcctggcca

SEQ ID NO: 5773444 - DNA, 17 bp, Homo sapiens
gggccagtgagggctgg

SEQ ID NO: 5773445 - DNA, 22 bp, Homo sapiens
gggccagtgagggctgggccca

SEQ ID NO: 5773446 - DNA, 17 bp, Homo sapiens
gggccagtggggcctgt

SEQ ID NO: 5773447 - DNA, 14 bp, Homo sapiens
gggccagttggtcc

SEQ ID NO: 5773448 - DNA, 22 bp, Homo sapiens
gggccagttggtcccccttcca

SEQ ID NO: 5773449 - DNA, 17 bp, Homo sapiens
gggccatactggcctcg

SEQ ID NO: 5773450 - DNA, 22 bp, Homo sapiens
gggccatcacaggatgccagcc

SEQ ID NO: 5773451 - DNA, 16 bp, Homo sapiens
gggccatccactgtga

SEQ ID NO: 5773452 - DNA, 23 bp, Homo sapiens
gggccatctgactgccaagccag

SEQ ID NO: 5773453 - DNA, 18 bp, Homo sapiens
gggccatgaactttgtcc

SEQ ID NO: 5773454 - DNA, 12 bp, Homo sapiens
gggccatgaggg

SEQ ID NO: 5773455 - DNA, 16 bp, Homo sapiens
gggccatgagggacag

SEQ ID NO: 5773456 - DNA, 17 bp, Homo sapiens
gggccatgccccacccc

SEQ ID NO: 5773457 - DNA, 13 bp, Homo sapiens
gggccatgcctcc

SEQ ID NO: 5773458 - DNA, 15 bp, Homo sapiens
gggccatgctgagag

SEQ ID NO: 5773459 - DNA, 15 bp, Homo sapiens
gggccatgctgaggc

SEQ ID NO: 5773460 - DNA, 19 bp, Homo sapiens
gggccatgctgaggcctgg

SEQ ID NO: 5773461 - DNA, 19 bp, Homo sapiens
gggccatggaagctggcag

SEQ ID NO: 5773462 - DNA, 15 bp, Homo sapiens
gggccatggctcagg

SEQ ID NO: 5773463 - DNA, 13 bp, Homo sapiens
gggccatgggtcc

SEQ ID NO: 5773464 - DNA, 14 bp, Homo sapiens
gggccatgggtcct

SEQ ID NO: 5773465 - DNA, 22 bp, Homo sapiens
gggccatgggtcctcggcccat

SEQ ID NO: 5773466 - DNA, 17 bp, Homo sapiens
gggccatgtcagacaca

SEQ ID NO: 5773467 - DNA, 22 bp, Homo sapiens
gggccatgtccaaagaggctgc

SEQ ID NO: 5773468 - DNA, 18 bp, Homo sapiens
gggccatgttcccagaac

SEQ ID NO: 5773469 - DNA, 17 bp, Homo sapiens
gggccatgttgtgcctc

SEQ ID NO: 5773470 - DNA, 16 bp, Homo sapiens
gggccattaccccata

SEQ ID NO: 5773471 - DNA, 23 bp, Homo sapiens
gggccatttccttttctctgccc

SEQ ID NO: 5773472 - DNA, 21 bp, Homo sapiens
gggccatttggccggctctgg

SEQ ID NO: 5773473 - DNA, 20 bp, Homo sapiens
gggcccaaaggcccagggag

SEQ ID NO: 5773474 - DNA, 15 bp, Homo sapiens
gggcccaaaggggag

SEQ ID NO: 5773475 - DNA, 14 bp, Homo sapiens
gggcccaaccctgt

SEQ ID NO: 5773476 - DNA, 17 bp, Homo sapiens
gggcccaagaactgcag

SEQ ID NO: 5773477 - DNA, 18 bp, Homo sapiens
gggcccaagcatgcccca

SEQ ID NO: 5773478 - DNA, 18 bp, Homo sapiens
gggcccaagccccatctc

SEQ ID NO: 5773479 - DNA, 12 bp, Homo sapiens
gggcccaagtgg

SEQ ID NO: 5773480 - DNA, 16 bp, Homo sapiens
gggcccacaaagggga

SEQ ID NO: 5773481 - DNA, 12 bp, Homo sapiens
gggcccacaccc

SEQ ID NO: 5773482 - DNA, 14 bp, Homo sapiens
gggcccacacctgg

SEQ ID NO: 5773483 - DNA, 14 bp, Homo sapiens
gggcccacagagcc

SEQ ID NO: 5773484 - DNA, 15 bp, Homo sapiens
gggcccacagagcct

SEQ ID NO: 5773485 - DNA, 17 bp, Homo sapiens
gggcccacagcccccac

SEQ ID NO: 5773486 - DNA, 20 bp, Homo sapiens
gggcccacagcccccacccc

SEQ ID NO: 5773487 - DNA, 17 bp, Homo sapiens
gggcccaccccagcctc

SEQ ID NO: 5773488 - DNA, 10 bp, Homo sapiens
gggcccacct

SEQ ID NO: 5773489 - DNA, 14 bp, Homo sapiens
gggcccacctggcc

SEQ ID NO: 5773490 - DNA, 19 bp, Homo sapiens
gggcccacgtggttggggc

SEQ ID NO: 5773491 - DNA, 22 bp, Homo sapiens
gggcccacttggggccttcccc

SEQ ID NO: 5773492 - DNA, 21 bp, Homo sapiens
gggcccagaactgcccccact

SEQ ID NO: 5773493 - DNA, 23 bp, Homo sapiens
gggcccagaactgcccccactgt

SEQ ID NO: 5773494 - DNA, 11 bp, Homo sapiens
gggcccagaga

SEQ ID NO: 5773495 - DNA, 22 bp, Homo sapiens
gggcccagagagaggcgtcctg

SEQ ID NO: 5773496 - DNA, 15 bp, Homo sapiens
gggcccagagcccag

SEQ ID NO: 5773497 - DNA, 16 bp, Homo sapiens
gggcccagagcccagc

SEQ ID NO: 5773498 - DNA, 18 bp, Homo sapiens
gggcccagagcccttgac

SEQ ID NO: 5773499 - DNA, 14 bp, Homo sapiens
gggcccagaggagc

SEQ ID NO: 5773500 - DNA, 14 bp, Homo sapiens
gggcccagattcta

SEQ ID NO: 5773501 - DNA, 18 bp, Homo sapiens
gggcccagccaggagcag

SEQ ID NO: 5773502 - DNA, 16 bp, Homo sapiens
gggcccagcccagagc

SEQ ID NO: 5773503 - DNA, 20 bp, Homo sapiens
gggcccagcgctctcctgga

SEQ ID NO: 5773504 - DNA, 20 bp, Homo sapiens
gggcccagctgtagccatgg

SEQ ID NO: 5773505 - DNA, 9 bp, Homo sapiens
gggcccagg

SEQ ID NO: 5773506 - DNA, 16 bp, Homo sapiens
gggcccaggaagccca

SEQ ID NO: 5773507 - DNA, 19 bp, Homo sapiens
gggcccaggaagcccacac

SEQ ID NO: 5773508 - DNA, 16 bp, Homo sapiens
gggcccaggaccagct

SEQ ID NO: 5773509 - DNA, 19 bp, Homo sapiens
gggcccaggaccagctggg

SEQ ID NO: 5773510 - DNA, 20 bp, Homo sapiens
gggcccaggagagcccccac

SEQ ID NO: 5773511 - DNA, 13 bp, Homo sapiens
gggcccaggaggt

SEQ ID NO: 5773512 - DNA, 14 bp, Homo sapiens
gggcccaggcaaat

SEQ ID NO: 5773513 - DNA, 18 bp, Homo sapiens
gggcccaggcagcacctg

SEQ ID NO: 5773514 - DNA, 19 bp, Homo sapiens
gggcccaggcagcacctgg

SEQ ID NO: 5773515 - DNA, 22 bp, Homo sapiens
gggcccaggcagcacctggagc

SEQ ID NO: 5773516 - DNA, 13 bp, Homo sapiens
gggcccaggcagg

SEQ ID NO: 5773517 - DNA, 16 bp, Homo sapiens
gggcccaggccatgtg

SEQ ID NO: 5773518 - DNA, 13 bp, Homo sapiens
gggcccaggcctg

SEQ ID NO: 5773519 - DNA, 18 bp, Homo sapiens
gggcccaggcctggagcg

SEQ ID NO: 5773520 - DNA, 11 bp, Homo sapiens
gggcccaggct

SEQ ID NO: 5773521 - DNA, 18 bp, Homo sapiens
gggcccagggacaccagc

SEQ ID NO: 5773522 - DNA, 14 bp, Homo sapiens
gggcccagggacat

SEQ ID NO: 5773523 - DNA, 18 bp, Homo sapiens
gggcccagggaggtggca

SEQ ID NO: 5773524 - DNA, 22 bp, Homo sapiens
gggcccataatagttagccctc

SEQ ID NO: 5773525 - DNA, 13 bp, Homo sapiens
gggcccatctctt

SEQ ID NO: 5773526 - DNA, 21 bp, Homo sapiens
gggcccatggaggagacagga

SEQ ID NO: 5773527 - DNA, 14 bp, Homo sapiens
gggcccatggcccc

SEQ ID NO: 5773528 - DNA, 21 bp, Homo sapiens
gggcccatggccccagctggc

SEQ ID NO: 5773529 - DNA, 15 bp, Homo sapiens
gggcccatgggaggg

SEQ ID NO: 5773530 - DNA, 17 bp, Homo sapiens
gggcccatgtagctggc

SEQ ID NO: 5773531 - DNA, 14 bp, Homo sapiens
gggccgcggccgcc

SEQ ID NO: 5773532 - DNA, 20 bp, Homo sapiens
gggccgcgtggtgccatccc

SEQ ID NO: 5773533 - DNA, 16 bp, Homo sapiens
gggccgctctgatttc

SEQ ID NO: 5773534 - DNA, 12 bp, Homo sapiens
gggccgctgcca

SEQ ID NO: 5773535 - DNA, 13 bp, Homo sapiens
gggccgctgccac

SEQ ID NO: 5773536 - DNA, 14 bp, Homo sapiens
gggccgctgccacc

SEQ ID NO: 5773537 - DNA, 12 bp, Homo sapiens
gggccgctggcc

SEQ ID NO: 5773538 - DNA, 13 bp, Homo sapiens
gggccgctggccc

SEQ ID NO: 5773539 - DNA, 15 bp, Homo sapiens
gggccgcttcgccat

SEQ ID NO: 5773540 - DNA, 16 bp, Homo sapiens
gggccgcttcgccatg

SEQ ID NO: 5773541 - DNA, 16 bp, Homo sapiens
gggccgcttctcctgc

SEQ ID NO: 5773542 - DNA, 22 bp, Homo sapiens
gggccggacccccgtcagctgc

SEQ ID NO: 5773543 - DNA, 15 bp, Homo sapiens
gggccggcagcctgg

SEQ ID NO: 5773544 - DNA, 13 bp, Homo sapiens
gggccggccagct

SEQ ID NO: 5773545 - DNA, 14 bp, Homo sapiens
gggccggccagctg

SEQ ID NO: 5773546 - DNA, 20 bp, Homo sapiens
gggccggccagctgggtgcc

SEQ ID NO: 5773547 - DNA, 15 bp, Homo sapiens
gggccggccaggtgg

SEQ ID NO: 5773548 - DNA, 17 bp, Homo sapiens
gggccggccccaggctc

SEQ ID NO: 5773549 - DNA, 18 bp, Homo sapiens
gggccggcccccttcctg

SEQ ID NO: 5773550 - DNA, 20 bp, Homo sapiens
gggccggctgagtggcagca

SEQ ID NO: 5773551 - DNA, 21 bp, Homo sapiens
gggccggctgagtggcagcag

SEQ ID NO: 5773552 - DNA, 20 bp, Homo sapiens
gggccgggcaggtcctgccc

SEQ ID NO: 5773553 - DNA, 21 bp, Homo sapiens
gggccgggcaggtcctgccca

SEQ ID NO: 5773554 - DNA, 23 bp, Homo sapiens
gggccgggcaggtcctgcccatg

SEQ ID NO: 5773555 - DNA, 13 bp, Homo sapiens
gggccgggcccag

SEQ ID NO: 5773556 - DNA, 20 bp, Homo sapiens
gggccgggcccagggcctct

SEQ ID NO: 5773557 - DNA, 20 bp, Homo sapiens
gggccgggcgcggtggctca

SEQ ID NO: 5773558 - DNA, 13 bp, Homo sapiens
gggccgggctgta

SEQ ID NO: 5773559 - DNA, 19 bp, Homo sapiens
gggccggggaactggccaa

SEQ ID NO: 5773560 - DNA, 17 bp, Homo sapiens
gggccggggaagctgcc

SEQ ID NO: 5773561 - DNA, 21 bp, Homo sapiens
gggccggggagggggcacggc

SEQ ID NO: 5773562 - DNA, 14 bp, Homo sapiens
gggccggggggagg

SEQ ID NO: 5773563 - DNA, 17 bp, Homo sapiens
gggccggggggagggga

SEQ ID NO: 5773564 - DNA, 20 bp, Homo sapiens
gggccgggtgaaaatgccag

SEQ ID NO: 5773565 - DNA, 20 bp, Homo sapiens
gggccggtgaggggaggggc

SEQ ID NO: 5773566 - DNA, 12 bp, Homo sapiens
gggccggtgctg

SEQ ID NO: 5773567 - DNA, 18 bp, Homo sapiens
gggccggttttcctcagc

SEQ ID NO: 5773568 - DNA, 21 bp, Homo sapiens
gggccgtaggggctcctgagt

SEQ ID NO: 5773569 - DNA, 16 bp, Homo sapiens
gggccgtatctccggc

SEQ ID NO: 5773570 - DNA, 19 bp, Homo sapiens
gggccgtatctccggctcc

SEQ ID NO: 5773571 - DNA, 24 bp, Homo sapiens
gggccgtatctccggctcccagcc

SEQ ID NO: 5773572 - DNA, 17 bp, Homo sapiens
gggccgtcccctctccc

SEQ ID NO: 5773573 - DNA, 18 bp, Homo sapiens
gggccgtgagggcaagag

SEQ ID NO: 5773574 - DNA, 15 bp, Homo sapiens
gggccgtgcccttgc

SEQ ID NO: 5773575 - DNA, 18 bp, Homo sapiens
gggccgtgcccttgccct

SEQ ID NO: 5773576 - DNA, 12 bp, Homo sapiens
gggccgtgtccc

SEQ ID NO: 5773577 - DNA, 19 bp, Homo sapiens
gggccgttacatctgtgca

SEQ ID NO: 5773578 - DNA, 21 bp, Homo sapiens
gggcctagcgatctctcctgg

SEQ ID NO: 5773579 - DNA, 23 bp, Homo sapiens
gggcctagctgctacaaagaaga

SEQ ID NO: 5773580 - DNA, 15 bp, Homo sapiens
gggcctaggccagga

SEQ ID NO: 5773581 - DNA, 17 bp, Homo sapiens
gggcctaggccaggagt

SEQ ID NO: 5773582 - DNA, 20 bp, Homo sapiens
gggcctatcagtgtgccccc

SEQ ID NO: 5773583 - DNA, 21 bp, Homo sapiens
gggcctatggagagccctggg

SEQ ID NO: 5773584 - DNA, 22 bp, Homo sapiens
gggcctatggagagccctggga

SEQ ID NO: 5773585 - DNA, 18 bp, Homo sapiens
gggcctcaatctaaggcc

SEQ ID NO: 5773586 - DNA, 13 bp, Homo sapiens
gggcctcacccag

SEQ ID NO: 5773587 - DNA, 16 bp, Homo sapiens
gggcctcacccagaag

SEQ ID NO: 5773588 - DNA, 18 bp, Homo sapiens
gggcctcacctgcccctc

SEQ ID NO: 5773589 - DNA, 21 bp, Homo sapiens
gggcctcacctttcccacagt

SEQ ID NO: 5773590 - DNA, 13 bp, Homo sapiens
gggcctcactcca

SEQ ID NO: 5773591 - DNA, 14 bp, Homo sapiens
gggcctcactccag

SEQ ID NO: 5773592 - DNA, 13 bp, Homo sapiens
gggcctcagagac

SEQ ID NO: 5773593 - DNA, 14 bp, Homo sapiens
gggcctcagagaca

SEQ ID NO: 5773594 - DNA, 12 bp, Homo sapiens
gggcctcagcct

SEQ ID NO: 5773595 - DNA, 17 bp, Homo sapiens
gggcctcagcctccagg

SEQ ID NO: 5773596 - DNA, 14 bp, Homo sapiens
gggcctcagcctgg

SEQ ID NO: 5773597 - DNA, 19 bp, Homo sapiens
gggcctcaggctccgggca

SEQ ID NO: 5773598 - DNA, 17 bp, Homo sapiens
gggcctcaggctctgca

SEQ ID NO: 5773599 - DNA, 20 bp, Homo sapiens
gggcctcaggctctgcacag

SEQ ID NO: 5773600 - DNA, 16 bp, Homo sapiens
gggcctcagggtcctg

SEQ ID NO: 5773601 - DNA, 14 bp, Homo sapiens
gggcctcagtgccc

SEQ ID NO: 5773602 - DNA, 16 bp, Homo sapiens
gggcctcagtgcccca

SEQ ID NO: 5773603 - DNA, 21 bp, Homo sapiens
gggcctcagtgtgcccatctg

SEQ ID NO: 5773604 - DNA, 12 bp, Homo sapiens
gggcctcagttt

SEQ ID NO: 5773605 - DNA, 14 bp, Homo sapiens
gggcctcagtttcc

SEQ ID NO: 5773606 - DNA, 18 bp, Homo sapiens
gggcctcatgaataaatg

SEQ ID NO: 5773607 - DNA, 16 bp, Homo sapiens
gggcctccacctctgt

SEQ ID NO: 5773608 - DNA, 18 bp, Homo sapiens
gggcctccacctctgtgc

SEQ ID NO: 5773609 - DNA, 17 bp, Homo sapiens
gggcctccagaagctgc

SEQ ID NO: 5773610 - DNA, 12 bp, Homo sapiens
gggcctccagga

SEQ ID NO: 5773611 - DNA, 13 bp, Homo sapiens
gggcctccagggc

SEQ ID NO: 5773612 - DNA, 23 bp, Homo sapiens
gggcctccatgccccagctctgg

SEQ ID NO: 5773613 - DNA, 12 bp, Homo sapiens
gggcctcccact

SEQ ID NO: 5773614 - DNA, 20 bp, Homo sapiens
gggcctcccactcccatggc

SEQ ID NO: 5773615 - DNA, 16 bp, Homo sapiens
gggcctcccactcctg

SEQ ID NO: 5773616 - DNA, 13 bp, Homo sapiens
gggcctcccctcc

SEQ ID NO: 5773617 - DNA, 13 bp, Homo sapiens
gggcctcccctgg

SEQ ID NO: 5773618 - DNA, 22 bp, Homo sapiens
gggcctcccctgggcagggttc

SEQ ID NO: 5773619 - DNA, 13 bp, Homo sapiens
gggcctccctccg

SEQ ID NO: 5773620 - DNA, 20 bp, Homo sapiens
gggcctccgcttatcctgct

SEQ ID NO: 5773621 - DNA, 21 bp, Homo sapiens
gggcctcctctccctgcacct

SEQ ID NO: 5773622 - DNA, 14 bp, Homo sapiens
gggcctcctgcctc

SEQ ID NO: 5773623 - DNA, 20 bp, Homo sapiens
gggcctcctgcctccgggca

SEQ ID NO: 5773624 - DNA, 22 bp, Homo sapiens
gggcctcctgcctccgggcagg

SEQ ID NO: 5773625 - DNA, 18 bp, Homo sapiens
gggcctccttcccatgcc

SEQ ID NO: 5773626 - DNA, 23 bp, Homo sapiens
gggcctcggaccccactccggcc

SEQ ID NO: 5773627 - DNA, 15 bp, Homo sapiens
gggcctcggagcctc

SEQ ID NO: 5773628 - DNA, 17 bp, Homo sapiens
gggcctcggagcctcat

SEQ ID NO: 5773629 - DNA, 14 bp, Homo sapiens
gggcctcggcctgg

SEQ ID NO: 5773630 - DNA, 16 bp, Homo sapiens
gggcctcgggacctca

SEQ ID NO: 5773631 - DNA, 22 bp, Homo sapiens
gggcctcggtgtggagaagcgg

SEQ ID NO: 5773632 - DNA, 18 bp, Homo sapiens
gggcctctccttggaagg

SEQ ID NO: 5773633 - DNA, 13 bp, Homo sapiens
gggcctctctcct

SEQ ID NO: 5773634 - DNA, 19 bp, Homo sapiens
gggcctctctcctgcctgc

SEQ ID NO: 5773635 - DNA, 22 bp, Homo sapiens
gggcctctctggaagagggagg

SEQ ID NO: 5773636 - DNA, 13 bp, Homo sapiens
gggcctctctggg

SEQ ID NO: 5773637 - DNA, 16 bp, Homo sapiens
gggcctctctggggga

SEQ ID NO: 5773638 - DNA, 22 bp, Homo sapiens
gggcctctctgggggaggcagg

SEQ ID NO: 5773639 - DNA, 21 bp, Homo sapiens
gggcctctcttggaccctggg

SEQ ID NO: 5773640 - DNA, 17 bp, Homo sapiens
gggcctctgcctccagg

SEQ ID NO: 5773641 - DNA, 18 bp, Homo sapiens
gggcctctgcctccagga

SEQ ID NO: 5773642 - DNA, 16 bp, Homo sapiens
gggcctctgcctggga

SEQ ID NO: 5773643 - DNA, 23 bp, Homo sapiens
gggcctctgcggagcacactggc

SEQ ID NO: 5773644 - DNA, 12 bp, Homo sapiens
gggcctctggct

SEQ ID NO: 5773645 - DNA, 14 bp, Homo sapiens
gggcctctggctgc

SEQ ID NO: 5773646 - DNA, 21 bp, Homo sapiens
gggcctctgttcctttctctg

SEQ ID NO: 5773647 - DNA, 17 bp, Homo sapiens
gggcctcttccctcagt

SEQ ID NO: 5773648 - DNA, 22 bp, Homo sapiens
gggcctgaaacccgccctcagg

SEQ ID NO: 5773649 - DNA, 15 bp, Homo sapiens
gggcctgacaccccc

SEQ ID NO: 5773650 - DNA, 20 bp, Homo sapiens
gggcctgacaggttcccagc

SEQ ID NO: 5773651 - DNA, 23 bp, Homo sapiens
gggcctgacaggttcccagcagc

SEQ ID NO: 5773652 - DNA, 18 bp, Homo sapiens
gggcctgacctccccctc

SEQ ID NO: 5773653 - DNA, 20 bp, Homo sapiens
gggcctgacttgagccactc

SEQ ID NO: 5773654 - DNA, 22 bp, Homo sapiens
gggcctgacttgagccactcct

SEQ ID NO: 5773655 - DNA, 12 bp, Homo sapiens
gggcctgagcag

SEQ ID NO: 5773656 - DNA, 14 bp, Homo sapiens
gggcctgagcagct

SEQ ID NO: 5773657 - DNA, 16 bp, Homo sapiens
gggcctgagcctggcc

SEQ ID NO: 5773658 - DNA, 17 bp, Homo sapiens
gggcctgaggctcctta

SEQ ID NO: 5773659 - DNA, 23 bp, Homo sapiens
gggcctgagggtccacctggaga

SEQ ID NO: 5773660 - DNA, 20 bp, Homo sapiens
gggcctgagtggaggattat

SEQ ID NO: 5773661 - DNA, 16 bp, Homo sapiens
gggcctgatggagagg

SEQ ID NO: 5773662 - DNA, 20 bp, Homo sapiens
gggcctgatggagaggagaa

SEQ ID NO: 5773663 - DNA, 16 bp, Homo sapiens
gggcctgatggggagg

SEQ ID NO: 5773664 - DNA, 18 bp, Homo sapiens
gggcctgcaggacctgcc

SEQ ID NO: 5773665 - DNA, 14 bp, Homo sapiens
gggcctgcaggcca

SEQ ID NO: 5773666 - DNA, 15 bp, Homo sapiens
gggcctgcaggccag

SEQ ID NO: 5773667 - DNA, 14 bp, Homo sapiens
gggcctgcaggccc

SEQ ID NO: 5773668 - DNA, 15 bp, Homo sapiens
gggcctgcaggcccc

SEQ ID NO: 5773669 - DNA, 17 bp, Homo sapiens
gggcctgcaggccccag

SEQ ID NO: 5773670 - DNA, 19 bp, Homo sapiens
gggcctgcaggccccagcc

SEQ ID NO: 5773671 - DNA, 11 bp, Homo sapiens
gggcctgccac

SEQ ID NO: 5773672 - DNA, 16 bp, Homo sapiens
gggcctgccacctgga

SEQ ID NO: 5773673 - DNA, 23 bp, Homo sapiens
gggcctgccacctggacccctgc

SEQ ID NO: 5773674 - DNA, 14 bp, Homo sapiens
gggcctgccactct

SEQ ID NO: 5773675 - DNA, 22 bp, Homo sapiens
gggcctgccactctcctgagga

SEQ ID NO: 5773676 - DNA, 15 bp, Homo sapiens
gggcctgcccaatgc

SEQ ID NO: 5773677 - DNA, 17 bp, Homo sapiens
gggcctgccccctgggg

SEQ ID NO: 5773678 - DNA, 20 bp, Homo sapiens
gggcctgccgggctgagggc

SEQ ID NO: 5773679 - DNA, 21 bp, Homo sapiens
gggcctgccgggctgagggcc

SEQ ID NO: 5773680 - DNA, 17 bp, Homo sapiens
gggcctgcctgcctcca

SEQ ID NO: 5773681 - DNA, 21 bp, Homo sapiens
gggcctgcctggtctctagag

SEQ ID NO: 5773682 - DNA, 16 bp, Homo sapiens
gggcctgcgcccagag

SEQ ID NO: 5773683 - DNA, 22 bp, Homo sapiens
gggcctgcggggttccctgcgc

SEQ ID NO: 5773684 - DNA, 14 bp, Homo sapiens
gggcctgctccaga

SEQ ID NO: 5773685 - DNA, 17 bp, Homo sapiens
gggcctgctccagacct

SEQ ID NO: 5773686 - DNA, 18 bp, Homo sapiens
gggcctgctccagacctg

SEQ ID NO: 5773687 - DNA, 12 bp, Homo sapiens
gggcctgctgcg

SEQ ID NO: 5773688 - DNA, 15 bp, Homo sapiens
gggcctgctgctgag

SEQ ID NO: 5773689 - DNA, 16 bp, Homo sapiens
gggcctgctgctgaga

SEQ ID NO: 5773690 - DNA, 15 bp, Homo sapiens
gggcctgctggaggc

SEQ ID NO: 5773691 - DNA, 15 bp, Homo sapiens
gggcctgctggagtt

SEQ ID NO: 5773692 - DNA, 15 bp, Homo sapiens
gggcctgctgtgggt

SEQ ID NO: 5773693 - DNA, 16 bp, Homo sapiens
gggcctggacaggcgg

SEQ ID NO: 5773694 - DNA, 19 bp, Homo sapiens
gggcctggacaggcgggct

SEQ ID NO: 5773695 - DNA, 21 bp, Homo sapiens
gggcctggacctatgcaggga

SEQ ID NO: 5773696 - DNA, 16 bp, Homo sapiens
gggcctggacctgcct

SEQ ID NO: 5773697 - DNA, 11 bp, Homo sapiens
gggcctggact

SEQ ID NO: 5773698 - DNA, 12 bp, Homo sapiens
gggcctggagat

SEQ ID NO: 5773699 - DNA, 21 bp, Homo sapiens
gggcctggagatcctcctgca

SEQ ID NO: 5773700 - DNA, 11 bp, Homo sapiens
gggcctggagg

SEQ ID NO: 5773701 - DNA, 20 bp, Homo sapiens
gggcctggattcatttcctg

SEQ ID NO: 5773702 - DNA, 16 bp, Homo sapiens
gggcctggcaggccag

SEQ ID NO: 5773703 - DNA, 22 bp, Homo sapiens
gggcctggcaggccagtgtctg

SEQ ID NO: 5773704 - DNA, 13 bp, Homo sapiens
gggcctggcaggg

SEQ ID NO: 5773705 - DNA, 12 bp, Homo sapiens
gggcctggcata

SEQ ID NO: 5773706 - DNA, 16 bp, Homo sapiens
gggcctggccagtcct

SEQ ID NO: 5773707 - DNA, 11 bp, Homo sapiens
gggcctggcct

SEQ ID NO: 5773708 - DNA, 18 bp, Homo sapiens
gggcctggcctatttaag

SEQ ID NO: 5773709 - DNA, 15 bp, Homo sapiens
gggcctggcctgagc

SEQ ID NO: 5773710 - DNA, 15 bp, Homo sapiens
gggcgtctgagctgg

SEQ ID NO: 5773711 - DNA, 16 bp, Homo sapiens
gggcgtgaaacacaat

SEQ ID NO: 5773712 - DNA, 19 bp, Homo sapiens
gggcgtgagacctgcccct

SEQ ID NO: 5773713 - DNA, 16 bp, Homo sapiens
gggcgtgaggtcccag

SEQ ID NO: 5773714 - DNA, 13 bp, Homo sapiens
gggcgtggagggc

SEQ ID NO: 5773715 - DNA, 20 bp, Homo sapiens
gggcgtggatcgagtgtagc

SEQ ID NO: 5773716 - DNA, 19 bp, Homo sapiens
gggcgtggtcactgctgtc

SEQ ID NO: 5773717 - DNA, 15 bp, Homo sapiens
gggcgtggtggcagg

SEQ ID NO: 5773718 - DNA, 21 bp, Homo sapiens
gggcgttatgtaagtttctaa

SEQ ID NO: 5773719 - DNA, 14 bp, Homo sapiens
gggcgttgggagcc

SEQ ID NO: 5773720 - DNA, 19 bp, Homo sapiens
gggcgtttcctactgcgcc

SEQ ID NO: 5773721 - DNA, 17 bp, Homo sapiens
gggctaactggccccag

SEQ ID NO: 5773722 - DNA, 13 bp, Homo sapiens
gggctaaggcccc

SEQ ID NO: 5773723 - DNA, 15 bp, Homo sapiens
gggctaaggcctctt

SEQ ID NO: 5773724 - DNA, 22 bp, Homo sapiens
gggctaaggcctcttgctggtg

SEQ ID NO: 5773725 - DNA, 20 bp, Homo sapiens
gggctaattctgggaaggga

SEQ ID NO: 5773726 - DNA, 13 bp, Homo sapiens
gggctaatttaac

SEQ ID NO: 5773727 - DNA, 16 bp, Homo sapiens
gggctacaaaggagga

SEQ ID NO: 5773728 - DNA, 21 bp, Homo sapiens
gggctacaaaggaggacaaga

SEQ ID NO: 5773729 - DNA, 15 bp, Homo sapiens
gggctacaaggaccc

SEQ ID NO: 5773730 - DNA, 15 bp, Homo sapiens
gggctacacagaccc

SEQ ID NO: 5773731 - DNA, 16 bp, Homo sapiens
gggctacacagaccct

SEQ ID NO: 5773732 - DNA, 14 bp, Homo sapiens
gggctacaggatgg

SEQ ID NO: 5773733 - DNA, 22 bp, Homo sapiens
gggctacaggatggtgggcagg

SEQ ID NO: 5773734 - DNA, 23 bp, Homo sapiens
gggctaccccccctcctgctgcc

SEQ ID NO: 5773735 - DNA, 21 bp, Homo sapiens
gggctaccctgagctgaggca

SEQ ID NO: 5773736 - DNA, 20 bp, Homo sapiens
gggctaccctgggaagctgc

SEQ ID NO: 5773737 - DNA, 20 bp, Homo sapiens
gggctacgttagcagcccag

SEQ ID NO: 5773738 - DNA, 18 bp, Homo sapiens
gggctactcagcagtaag

SEQ ID NO: 5773739 - DNA, 20 bp, Homo sapiens
gggctactgccactgtgtgc

SEQ ID NO: 5773740 - DNA, 17 bp, Homo sapiens
gggctactggcagctcc

SEQ ID NO: 5773741 - DNA, 23 bp, Homo sapiens
gggctagaaagaccactggcaga

SEQ ID NO: 5773742 - DNA, 14 bp, Homo sapiens
gggctagaacctgg

SEQ ID NO: 5773743 - DNA, 15 bp, Homo sapiens
gggctagaacctgga

SEQ ID NO: 5773744 - DNA, 17 bp, Homo sapiens
gggctagaacctggagg

SEQ ID NO: 5773745 - DNA, 16 bp, Homo sapiens
gggctagaacctggca

SEQ ID NO: 5773746 - DNA, 12 bp, Homo sapiens
gggctagaatct

SEQ ID NO: 5773747 - DNA, 12 bp, Homo sapiens
gggctagccctg

SEQ ID NO: 5773748 - DNA, 13 bp, Homo sapiens
gggctagccctga

SEQ ID NO: 5773749 - DNA, 15 bp, Homo sapiens
gggctagccctgagc

SEQ ID NO: 5773750 - DNA, 19 bp, Homo sapiens
gggctagccctgagcccgg

SEQ ID NO: 5773751 - DNA, 20 bp, Homo sapiens
gggctaggaaatccagggtg

SEQ ID NO: 5773752 - DNA, 16 bp, Homo sapiens
gggctaggggctgggg

SEQ ID NO: 5773753 - DNA, 18 bp, Homo sapiens
gggctaggggctggtcct

SEQ ID NO: 5773754 - DNA, 22 bp, Homo sapiens
gggctaggggctggtccttctc

SEQ ID NO: 5773755 - DNA, 17 bp, Homo sapiens
gggctaggtagaaaaag

SEQ ID NO: 5773756 - DNA, 16 bp, Homo sapiens
gggctagtgaagtggc

SEQ ID NO: 5773757 - DNA, 17 bp, Homo sapiens
gggctagtgaagtggcc

SEQ ID NO: 5773758 - DNA, 18 bp, Homo sapiens
gggctagtgggtttctga

SEQ ID NO: 5773759 - DNA, 15 bp, Homo sapiens
gggctatcctgggac

SEQ ID NO: 5773760 - DNA, 19 bp, Homo sapiens
gggctatgccactaggccc

SEQ ID NO: 5773761 - DNA, 16 bp, Homo sapiens
gggctatggacacagg

SEQ ID NO: 5773762 - DNA, 17 bp, Homo sapiens
gggctatggacacaggg

SEQ ID NO: 5773763 - DNA, 14 bp, Homo sapiens
gggctatggcaagg

SEQ ID NO: 5773764 - DNA, 13 bp, Homo sapiens
gggctatttctct

SEQ ID NO: 5773765 - DNA, 20 bp, Homo sapiens
gggctcaagcaatcctcctg

SEQ ID NO: 5773766 - DNA, 22 bp, Homo sapiens
gggctcaagcaatcctcctgcc

SEQ ID NO: 5773767 - DNA, 18 bp, Homo sapiens
gggctcaagcagtcctcc

SEQ ID NO: 5773768 - DNA, 16 bp, Homo sapiens
gggctcaagcagtcta

SEQ ID NO: 5773769 - DNA, 21 bp, Homo sapiens
gggctcacactcctgggctct

SEQ ID NO: 5773770 - DNA, 19 bp, Homo sapiens
gggctcacaggcctctctt

SEQ ID NO: 5773771 - DNA, 16 bp, Homo sapiens
gggctcacagggcagg

SEQ ID NO: 5773772 - DNA, 18 bp, Homo sapiens
gggctcacagggcaggcc

SEQ ID NO: 5773773 - DNA, 23 bp, Homo sapiens
gggctcacttttcatccttcccc

SEQ ID NO: 5773774 - DNA, 16 bp, Homo sapiens
gggctcagaagagcag

SEQ ID NO: 5773775 - DNA, 14 bp, Homo sapiens
gggctcagacatcc

SEQ ID NO: 5773776 - DNA, 23 bp, Homo sapiens
gggctcagagctttgtcacttgc

SEQ ID NO: 5773777 - DNA, 11 bp, Homo sapiens
gggctcagagg

SEQ ID NO: 5773778 - DNA, 12 bp, Homo sapiens
gggctcagaggg

SEQ ID NO: 5773779 - DNA, 13 bp, Homo sapiens
gggctcagagggg

SEQ ID NO: 5773780 - DNA, 14 bp, Homo sapiens
gggctcagatcctg

SEQ ID NO: 5773781 - DNA, 18 bp, Homo sapiens
gggctcagatggactggg

SEQ ID NO: 5773782 - DNA, 10 bp, Homo sapiens
gggctcagca

SEQ ID NO: 5773783 - DNA, 18 bp, Homo sapiens
gggctcagcaaaagatgc

SEQ ID NO: 5773784 - DNA, 20 bp, Homo sapiens
gggctcagcaaggccacctc

SEQ ID NO: 5773785 - DNA, 17 bp, Homo sapiens
gggctcagcaaggtgtg

SEQ ID NO: 5773786 - DNA, 13 bp, Homo sapiens
gggctcagcaatg

SEQ ID NO: 5773787 - DNA, 17 bp, Homo sapiens
gggctcagcggggacag

SEQ ID NO: 5773788 - DNA, 19 bp, Homo sapiens
gggctcagcggggacagct

SEQ ID NO: 5773789 - DNA, 21 bp, Homo sapiens
gggctcagcggggacagctcc

SEQ ID NO: 5773790 - DNA, 21 bp, Homo sapiens
gggctcagctagacattgcaa

SEQ ID NO: 5773791 - DNA, 14 bp, Homo sapiens
gggctcagctctgg

SEQ ID NO: 5773792 - DNA, 17 bp, Homo sapiens
gggctcagggaccacag

SEQ ID NO: 5773793 - DNA, 11 bp, Homo sapiens
gggctcagggc

SEQ ID NO: 5773794 - DNA, 22 bp, Homo sapiens
gggctcaggtcacataaaactt

SEQ ID NO: 5773795 - DNA, 16 bp, Homo sapiens
gggctccacacagcag

SEQ ID NO: 5773796 - DNA, 22 bp, Homo sapiens
gggctccacacagcagtgtccc

SEQ ID NO: 5773797 - DNA, 19 bp, Homo sapiens
gggctccacgggggcctag

SEQ ID NO: 5773798 - DNA, 19 bp, Homo sapiens
gggctccacttcatccaga

SEQ ID NO: 5773799 - DNA, 13 bp, Homo sapiens
gggctccagacac

SEQ ID NO: 5773800 - DNA, 12 bp, Homo sapiens
gggctccagagt

SEQ ID NO: 5773801 - DNA, 13 bp, Homo sapiens
gggctccagcatc

SEQ ID NO: 5773802 - DNA, 20 bp, Homo sapiens
gggctccagcatccagcctg

SEQ ID NO: 5773803 - DNA, 21 bp, Homo sapiens
gggctccagcatccagcctgt

SEQ ID NO: 5773804 - DNA, 13 bp, Homo sapiens
gggctccagccat

SEQ ID NO: 5773805 - DNA, 16 bp, Homo sapiens
gggctccaggctggct

SEQ ID NO: 5773806 - DNA, 16 bp, Homo sapiens
gggctccagggagtgg

SEQ ID NO: 5773807 - DNA, 17 bp, Homo sapiens
gggctccagggagtggg

SEQ ID NO: 5773808 - DNA, 17 bp, Homo sapiens
gggctccatggaggagg

SEQ ID NO: 5773809 - DNA, 15 bp, Homo sapiens
gggctcccacgccct

SEQ ID NO: 5773810 - DNA, 13 bp, Homo sapiens
gggctcccagctc

SEQ ID NO: 5773811 - DNA, 13 bp, Homo sapiens
gggctcccagggg

SEQ ID NO: 5773812 - DNA, 14 bp, Homo sapiens
gggctcccaggggt

SEQ ID NO: 5773813 - DNA, 22 bp, Homo sapiens
gggctcccaggggtctccctgg

SEQ ID NO: 5773814 - DNA, 20 bp, Homo sapiens
gggctccccccagtgggatg

SEQ ID NO: 5773815 - DNA, 16 bp, Homo sapiens
gggctcccctcttcct

SEQ ID NO: 5773816 - DNA, 18 bp, Homo sapiens
gggctcccctcttcctct

SEQ ID NO: 5773817 - DNA, 15 bp, Homo sapiens
gggctcccctggaca

SEQ ID NO: 5773818 - DNA, 15 bp, Homo sapiens
gggctccccttgccc

SEQ ID NO: 5773819 - DNA, 19 bp, Homo sapiens
gggctccccttgcccttcc

SEQ ID NO: 5773820 - DNA, 17 bp, Homo sapiens
gggctcccggcatcctg

SEQ ID NO: 5773821 - DNA, 18 bp, Homo sapiens
gggctcccggcatcctga

SEQ ID NO: 5773822 - DNA, 14 bp, Homo sapiens
gggctccctccgcc

SEQ ID NO: 5773823 - DNA, 17 bp, Homo sapiens
gggctccctcctctggc

SEQ ID NO: 5773824 - DNA, 15 bp, Homo sapiens
gggctccctctctgg

SEQ ID NO: 5773825 - DNA, 12 bp, Homo sapiens
gggctccctgac

SEQ ID NO: 5773826 - DNA, 16 bp, Homo sapiens
gggctccctgcctgga

SEQ ID NO: 5773827 - DNA, 16 bp, Homo sapiens
gggctccctggcccag

SEQ ID NO: 5773828 - DNA, 20 bp, Homo sapiens
gggctccctttaagccaaga

SEQ ID NO: 5773829 - DNA, 18 bp, Homo sapiens
gggctccctttgctgctg

SEQ ID NO: 5773830 - DNA, 17 bp, Homo sapiens
gggctcctacctggggg

SEQ ID NO: 5773831 - DNA, 14 bp, Homo sapiens
gggctcctcccagc

SEQ ID NO: 5773832 - DNA, 11 bp, Homo sapiens
gggctcctctt

SEQ ID NO: 5773833 - DNA, 12 bp, Homo sapiens
gggctcctctta

SEQ ID NO: 5773834 - DNA, 10 bp, Homo sapiens
gggctcctga

SEQ ID NO: 5773835 - DNA, 22 bp, Homo sapiens
gggctcctgcccaggccacaga

SEQ ID NO: 5773836 - DNA, 23 bp, Homo sapiens
gggctcctgcccaggccacagag

SEQ ID NO: 5773837 - DNA, 13 bp, Homo sapiens
gggctcctgcccc

SEQ ID NO: 5773838 - DNA, 21 bp, Homo sapiens
gggctcctgccttctgtcctg

SEQ ID NO: 5773839 - DNA, 19 bp, Homo sapiens
gggctcctggctgccaggc

SEQ ID NO: 5773840 - DNA, 12 bp, Homo sapiens
gggctcctgggt

SEQ ID NO: 5773841 - DNA, 18 bp, Homo sapiens
gggctcctgggttggagg

SEQ ID NO: 5773842 - DNA, 17 bp, Homo sapiens
gggctcctggtggcctt

SEQ ID NO: 5773843 - DNA, 22 bp, Homo sapiens
gggctcctggtggccttctgct

SEQ ID NO: 5773844 - DNA, 19 bp, Homo sapiens
gggctcctgtggcagctgc

SEQ ID NO: 5773845 - DNA, 12 bp, Homo sapiens
gggctccttccc

SEQ ID NO: 5773846 - DNA, 13 bp, Homo sapiens
gggctccttcccc

SEQ ID NO: 5773847 - DNA, 23 bp, Homo sapiens
gggctccttcccctgcacctggc

SEQ ID NO: 5773848 - DNA, 18 bp, Homo sapiens
gggctcctttctccagcc

SEQ ID NO: 5773849 - DNA, 22 bp, Homo sapiens
gggctcctttctccagccagca

SEQ ID NO: 5773850 - DNA, 23 bp, Homo sapiens
gggctcgaagaaaataattctct

SEQ ID NO: 5773851 - DNA, 18 bp, Homo sapiens
gggctcgaggggtgggct

SEQ ID NO: 5773852 - DNA, 20 bp, Homo sapiens
gggctcgaggggtgggctgg

SEQ ID NO: 5773853 - DNA, 20 bp, Homo sapiens
gggctcgagtgcccctgcag

SEQ ID NO: 5773854 - DNA, 15 bp, Homo sapiens
gggctcgcactgccc

SEQ ID NO: 5773855 - DNA, 17 bp, Homo sapiens
gggctcgcactgcccac

SEQ ID NO: 5773856 - DNA, 18 bp, Homo sapiens
gggctcgccccacccagg

SEQ ID NO: 5773857 - DNA, 21 bp, Homo sapiens
gggctcggaggctacccgctg

SEQ ID NO: 5773858 - DNA, 23 bp, Homo sapiens
gggctcggaggctacccgctgtg

SEQ ID NO: 5773859 - DNA, 13 bp, Homo sapiens
gggctcggggagg

SEQ ID NO: 5773860 - DNA, 14 bp, Homo sapiens
gggctcggggaggc

SEQ ID NO: 5773861 - DNA, 17 bp, Homo sapiens
gggctcggggaggcaga

SEQ ID NO: 5773862 - DNA, 17 bp, Homo sapiens
gggctcgtggccttccc

SEQ ID NO: 5773863 - DNA, 17 bp, Homo sapiens
gggctctaggatggggc

SEQ ID NO: 5773864 - DNA, 22 bp, Homo sapiens
gggctctaggatggggcacggc

SEQ ID NO: 5773865 - DNA, 17 bp, Homo sapiens
gggctctcaaagtataa

SEQ ID NO: 5773866 - DNA, 22 bp, Homo sapiens
gggctctcacccagtccccacc

SEQ ID NO: 5773867 - DNA, 22 bp, Homo sapiens
gggctctcatggtacttcctct

SEQ ID NO: 5773868 - DNA, 23 bp, Homo sapiens
gggctctcatgttttcaactgcc

SEQ ID NO: 5773869 - DNA, 19 bp, Homo sapiens
gggctctccaaaggggctg

SEQ ID NO: 5773870 - DNA, 15 bp, Homo sapiens
gggctctccaagcac

SEQ ID NO: 5773871 - DNA, 18 bp, Homo sapiens
gggctctccacctcagcc

SEQ ID NO: 5773872 - DNA, 19 bp, Homo sapiens
gggctctccacctcagcct

SEQ ID NO: 5773873 - DNA, 11 bp, Homo sapiens
gggctctcctg

SEQ ID NO: 5773874 - DNA, 22 bp, Homo sapiens
gggctctcctggcttcccatcc

SEQ ID NO: 5773875 - DNA, 21 bp, Homo sapiens
gggctctctcacccagcctgg

SEQ ID NO: 5773876 - DNA, 21 bp, Homo sapiens
gggctctctctagctccccaa

SEQ ID NO: 5773877 - DNA, 13 bp, Homo sapiens
gggctctctgacc

SEQ ID NO: 5773878 - DNA, 15 bp, Homo sapiens
gggctctctggacct

SEQ ID NO: 5773879 - DNA, 20 bp, Homo sapiens
gggctctgaacacacacgcc

SEQ ID NO: 5773880 - DNA, 19 bp, Homo sapiens
gggctctgactctgccagg

SEQ ID NO: 5773881 - DNA, 20 bp, Homo sapiens
gggctctgagttctggggtg

SEQ ID NO: 5773882 - DNA, 18 bp, Homo sapiens
gggctctgatctaacaaa

SEQ ID NO: 5773883 - DNA, 21 bp, Homo sapiens
gggctctgcaattcccctctg

SEQ ID NO: 5773884 - DNA, 13 bp, Homo sapiens
gggctctgcccca

SEQ ID NO: 5773885 - DNA, 21 bp, Homo sapiens
gggctctgccccagctctggc

SEQ ID NO: 5773886 - DNA, 16 bp, Homo sapiens
gggctctgccctccct

SEQ ID NO: 5773887 - DNA, 21 bp, Homo sapiens
gggctctgccctccctccttc

SEQ ID NO: 5773888 - DNA, 15 bp, Homo sapiens
gggctggggcaggct

SEQ ID NO: 5773889 - DNA, 16 bp, Homo sapiens
gggctggggcaggctc

SEQ ID NO: 5773890 - DNA, 16 bp, Homo sapiens
gggctggggcaggggc

SEQ ID NO: 5773891 - DNA, 17 bp, Homo sapiens
gggctggggcaggggcc

SEQ ID NO: 5773892 - DNA, 22 bp, Homo sapiens
gggctggggccaaataaagtct

SEQ ID NO: 5773893 - DNA, 14 bp, Homo sapiens
gggctggggccacc

SEQ ID NO: 5773894 - DNA, 19 bp, Homo sapiens
gggctgggggctgcagggc

SEQ ID NO: 5773895 - DNA, 18 bp, Homo sapiens
gggctgggggctgccgag

SEQ ID NO: 5773896 - DNA, 19 bp, Homo sapiens
gggctgggggtagcctgga

SEQ ID NO: 5773897 - DNA, 13 bp, Homo sapiens
gggctggggttgc

SEQ ID NO: 5773898 - DNA, 22 bp, Homo sapiens
gggctggggttgccagaggccc

SEQ ID NO: 5773899 - DNA, 17 bp, Homo sapiens
gggctggggtttattta

SEQ ID NO: 5773900 - DNA, 14 bp, Homo sapiens
gggctgggtcacag

SEQ ID NO: 5773901 - DNA, 16 bp, Homo sapiens
gggctgggtcacagga

SEQ ID NO: 5773902 - DNA, 22 bp, Homo sapiens
gggctgggtgcgaccccatctg

SEQ ID NO: 5773903 - DNA, 13 bp, Homo sapiens
gggctgggtggca

SEQ ID NO: 5773904 - DNA, 22 bp, Homo sapiens
gggctgggttctacccaggtgc

SEQ ID NO: 5773905 - DNA, 16 bp, Homo sapiens
gggctgggttggcgca

SEQ ID NO: 5773906 - DNA, 17 bp, Homo sapiens
gggctggtagctcaggt

SEQ ID NO: 5773907 - DNA, 13 bp, Homo sapiens
gggctggtcacct

SEQ ID NO: 5773908 - DNA, 16 bp, Homo sapiens
gggctggtcctgggag

SEQ ID NO: 5773909 - DNA, 20 bp, Homo sapiens
gggctggtcctgggagccac

SEQ ID NO: 5773910 - DNA, 21 bp, Homo sapiens
gggctggtgacccagtcagag

SEQ ID NO: 5773911 - DNA, 16 bp, Homo sapiens
gggctggtgccagcct

SEQ ID NO: 5773912 - DNA, 19 bp, Homo sapiens
gggctggtgccccacagct

SEQ ID NO: 5773913 - DNA, 15 bp, Homo sapiens
gggctggtgggacag

SEQ ID NO: 5773914 - DNA, 18 bp, Homo sapiens
gggctggtgggataggag

SEQ ID NO: 5773915 - DNA, 23 bp, Homo sapiens
gggctggtttggtggccaggctg

SEQ ID NO: 5773916 - DNA, 18 bp, Homo sapiens
gggctgtaactgccaggc

SEQ ID NO: 5773917 - DNA, 18 bp, Homo sapiens
gggctgtccgtgtgcctc

SEQ ID NO: 5773918 - DNA, 19 bp, Homo sapiens
gggctgtcctccttcctgg

SEQ ID NO: 5773919 - DNA, 13 bp, Homo sapiens
gggctgtctgggt

SEQ ID NO: 5773920 - DNA, 19 bp, Homo sapiens
gggctgtctgggtgtccgc

SEQ ID NO: 5773921 - DNA, 14 bp, Homo sapiens
gggctgtctgtcac

SEQ ID NO: 5773922 - DNA, 18 bp, Homo sapiens
gggctgtctttgcagggc

SEQ ID NO: 5773923 - DNA, 13 bp, Homo sapiens
gggctgtgaggac

SEQ ID NO: 5773924 - DNA, 21 bp, Homo sapiens
gggctgtgcccggccccaccc

SEQ ID NO: 5773925 - DNA, 17 bp, Homo sapiens
gggctgtgcctgaggct

SEQ ID NO: 5773926 - DNA, 19 bp, Homo sapiens
gggctgtgcctgaggctgg

SEQ ID NO: 5773927 - DNA, 13 bp, Homo sapiens
gggctgtgcctgg

SEQ ID NO: 5773928 - DNA, 23 bp, Homo sapiens
gggctgtgctgcttttgagcctc

SEQ ID NO: 5773929 - DNA, 18 bp, Homo sapiens
gggctgtggccctgccct

SEQ ID NO: 5773930 - DNA, 19 bp, Homo sapiens
gggctgtggctctgggtgg

SEQ ID NO: 5773931 - DNA, 13 bp, Homo sapiens
gggctgttacttg

SEQ ID NO: 5773932 - DNA, 18 bp, Homo sapiens
gggctgttagctcagagg

SEQ ID NO: 5773933 - DNA, 18 bp, Homo sapiens
gggctgttccctccaggc

SEQ ID NO: 5773934 - DNA, 19 bp, Homo sapiens
gggctgttccctccaggca

SEQ ID NO: 5773935 - DNA, 18 bp, Homo sapiens
gggctgttgctagggaga

SEQ ID NO: 5773936 - DNA, 20 bp, Homo sapiens
gggctgttgctagggagagg

SEQ ID NO: 5773937 - DNA, 22 bp, Homo sapiens
gggctgttgctagggagaggga

SEQ ID NO: 5773938 - DNA, 17 bp, Homo sapiens
gggctgttggacagctg

SEQ ID NO: 5773939 - DNA, 18 bp, Homo sapiens
gggctgttggaggacccc

SEQ ID NO: 5773940 - DNA, 23 bp, Homo sapiens
gggctgttgtgtctggagcctgc

SEQ ID NO: 5773941 - DNA, 20 bp, Homo sapiens
gggcttaaagcagaagcccc

SEQ ID NO: 5773942 - DNA, 14 bp, Homo sapiens
gggcttagaatggg

SEQ ID NO: 5773943 - DNA, 14 bp, Homo sapiens
gggcttagagcagt

SEQ ID NO: 5773944 - DNA, 18 bp, Homo sapiens
gggcttagtatttctcag

SEQ ID NO: 5773945 - DNA, 20 bp, Homo sapiens
gggcttataataaaggactg

SEQ ID NO: 5773946 - DNA, 18 bp, Homo sapiens
gggcttatttagaaaaaa

SEQ ID NO: 5773947 - DNA, 22 bp, Homo sapiens
gggcttcaccagtctgtctact

SEQ ID NO: 5773948 - DNA, 14 bp, Homo sapiens
gggcttcagggcag

SEQ ID NO: 5773949 - DNA, 17 bp, Homo sapiens
gggcttcaggtctctgt

SEQ ID NO: 5773950 - DNA, 14 bp, Homo sapiens
gggcttcagtggca

SEQ ID NO: 5773951 - DNA, 15 bp, Homo sapiens
gggcttcagtggcag

SEQ ID NO: 5773952 - DNA, 19 bp, Homo sapiens
gggcttcatacacatgaga

SEQ ID NO: 5773953 - DNA, 17 bp, Homo sapiens
gggcttcatctctttag

SEQ ID NO: 5773954 - DNA, 20 bp, Homo sapiens
gggcttcattccggactggc

SEQ ID NO: 5773955 - DNA, 16 bp, Homo sapiens
gggcttcccaagggct

SEQ ID NO: 5773956 - DNA, 15 bp, Homo sapiens
gggcttcccactttg

SEQ ID NO: 5773957 - DNA, 20 bp, Homo sapiens
gggcttcccagtggctgctg

SEQ ID NO: 5773958 - DNA, 21 bp, Homo sapiens
gggcttcccagtggctgctgc

SEQ ID NO: 5773959 - DNA, 22 bp, Homo sapiens
gggcttcccagtggctgctgcc

SEQ ID NO: 5773960 - DNA, 18 bp, Homo sapiens
gggcttccccatcagctc

SEQ ID NO: 5773961 - DNA, 15 bp, Homo sapiens
gggcttccctggcct

SEQ ID NO: 5773962 - DNA, 17 bp, Homo sapiens
gggcttccctggcctcc

SEQ ID NO: 5773963 - DNA, 17 bp, Homo sapiens
gggcttccctgggcctc

SEQ ID NO: 5773964 - DNA, 20 bp, Homo sapiens
gggcttcccttctccccagc

SEQ ID NO: 5773965 - DNA, 21 bp, Homo sapiens
gggcttcccttctccccagcc

SEQ ID NO: 5773966 - DNA, 12 bp, Homo sapiens
gggcttcctgcc

SEQ ID NO: 5773967 - DNA, 15 bp, Homo sapiens
gggcttcctgccctt

SEQ ID NO: 5773968 - DNA, 17 bp, Homo sapiens
gggcttcctgcccttcc

SEQ ID NO: 5773969 - DNA, 22 bp, Homo sapiens
gggcttcctgcccttccctctg

SEQ ID NO: 5773970 - DNA, 11 bp, Homo sapiens
gggcttcctgg

SEQ ID NO: 5773971 - DNA, 16 bp, Homo sapiens
gggcttcctggagcag

SEQ ID NO: 5773972 - DNA, 17 bp, Homo sapiens
gggcttcctgggtcctg

SEQ ID NO: 5773973 - DNA, 20 bp, Homo sapiens
gggcttctaatgacccagat

SEQ ID NO: 5773974 - DNA, 15 bp, Homo sapiens
gggcttctccccctc

SEQ ID NO: 5773975 - DNA, 20 bp, Homo sapiens
gggcttctccccctcagctc

SEQ ID NO: 5773976 - DNA, 14 bp, Homo sapiens
gggcttctcctcct

SEQ ID NO: 5773977 - DNA, 13 bp, Homo sapiens
gggcttctcctga

SEQ ID NO: 5773978 - DNA, 15 bp, Homo sapiens
gggcttctctgggac

SEQ ID NO: 5773979 - DNA, 17 bp, Homo sapiens
gggcttctcttgggtgg

SEQ ID NO: 5773980 - DNA, 19 bp, Homo sapiens
gggcttctcttgggtggga

SEQ ID NO: 5773981 - DNA, 21 bp, Homo sapiens
gggcttctcttgggtgggaca

SEQ ID NO: 5773982 - DNA, 14 bp, Homo sapiens
gggcttctgcaccc

SEQ ID NO: 5773983 - DNA, 21 bp, Homo sapiens
gggcttctgcgtccaccaggc

SEQ ID NO: 5773984 - DNA, 13 bp, Homo sapiens
gggcttctgggtg

SEQ ID NO: 5773985 - DNA, 18 bp, Homo sapiens
gggcttctgggtggctcc

SEQ ID NO: 5773986 - DNA, 19 bp, Homo sapiens
gggcttctgggtggctcct

SEQ ID NO: 5773987 - DNA, 19 bp, Homo sapiens
gggcttctgtaccacacta

SEQ ID NO: 5773988 - DNA, 19 bp, Homo sapiens
gggcttctgtgcacctggg

SEQ ID NO: 5773989 - DNA, 14 bp, Homo sapiens
gggcttcttcctca

SEQ ID NO: 5773990 - DNA, 22 bp, Homo sapiens
gggcttcttcctcacactgctg

SEQ ID NO: 5773991 - DNA, 13 bp, Homo sapiens
gggcttgaagcca

SEQ ID NO: 5773992 - DNA, 15 bp, Homo sapiens
gggcttgaagccaaa

SEQ ID NO: 5773993 - DNA, 17 bp, Homo sapiens
gggcttgaagccaaaga

SEQ ID NO: 5773994 - DNA, 20 bp, Homo sapiens
gggcttgatggtgacagctg

SEQ ID NO: 5773995 - DNA, 16 bp, Homo sapiens
gggcttggacttcctg

SEQ ID NO: 5773996 - DNA, 18 bp, Homo sapiens
gggcttggacttcctggg

SEQ ID NO: 5773997 - DNA, 13 bp, Homo sapiens
gggcttggccagc

SEQ ID NO: 5773998 - DNA, 15 bp, Homo sapiens
gggcttggcccagcg

SEQ ID NO: 5773999 - DNA, 17 bp, Homo sapiens
gggcttggcctggagag

SEQ ID NO: 5774000 - DNA, 20 bp, Homo sapiens
gggcttggcgtggagcaggc

SEQ ID NO: 5774001 - DNA, 21 bp, Homo sapiens
gggcttggctcgcacccccac

SEQ ID NO: 5774002 - DNA, 11 bp, Homo sapiens
gggcttgggcc

SEQ ID NO: 5774003 - DNA, 12 bp, Homo sapiens
gggcttggggag

SEQ ID NO: 5774004 - DNA, 14 bp, Homo sapiens
gggcttggggagca

SEQ ID NO: 5774005 - DNA, 20 bp, Homo sapiens
gggcttggggagcaggtctc

SEQ ID NO: 5774006 - DNA, 16 bp, Homo sapiens
gggcttggggtagaga

SEQ ID NO: 5774007 - DNA, 19 bp, Homo sapiens
gggcttggggtagagagga

SEQ ID NO: 5774008 - DNA, 21 bp, Homo sapiens
gggcttggggtagagaggaca

SEQ ID NO: 5774009 - DNA, 14 bp, Homo sapiens
gggcttggtggcca

SEQ ID NO: 5774010 - DNA, 19 bp, Homo sapiens
gggcttggtggccaagcct

SEQ ID NO: 5774011 - DNA, 17 bp, Homo sapiens
gggcttgtcatagccag

SEQ ID NO: 5774012 - DNA, 14 bp, Homo sapiens
gggcttgtcctaga

SEQ ID NO: 5774013 - DNA, 13 bp, Homo sapiens
gggcttgtgaaca

SEQ ID NO: 5774014 - DNA, 20 bp, Homo sapiens
gggcttgtggactctctgcc

SEQ ID NO: 5774015 - DNA, 23 bp, Homo sapiens
gggcttgttgctgttgatgtttt

SEQ ID NO: 5774016 - DNA, 23 bp, Homo sapiens
gggctttaacaaaacaagaaaga

SEQ ID NO: 5774017 - DNA, 18 bp, Homo sapiens
gggctttcctctgtgacc

SEQ ID NO: 5774018 - DNA, 16 bp, Homo sapiens
gggctttcggggaggg

SEQ ID NO: 5774019 - DNA, 12 bp, Homo sapiens
gggctttctcct

SEQ ID NO: 5774020 - DNA, 14 bp, Homo sapiens
gggctttctcctgg

SEQ ID NO: 5774021 - DNA, 15 bp, Homo sapiens
gggctttctcctgga

SEQ ID NO: 5774022 - DNA, 16 bp, Homo sapiens
gggctttctcctggag

SEQ ID NO: 5774023 - DNA, 17 bp, Homo sapiens
gggctttctcctggaga

SEQ ID NO: 5774024 - DNA, 12 bp, Homo sapiens
gggctttctctt

SEQ ID NO: 5774025 - DNA, 14 bp, Homo sapiens
gggctttctcttcc

SEQ ID NO: 5774026 - DNA, 21 bp, Homo sapiens
gggctttctcttccccttcct

SEQ ID NO: 5774027 - DNA, 15 bp, Homo sapiens
gggctttgcaggctc

SEQ ID NO: 5774028 - DNA, 20 bp, Homo sapiens
gggctttgcaggctctgggc

SEQ ID NO: 5774029 - DNA, 18 bp, Homo sapiens
gggctttgccttgcagcc

SEQ ID NO: 5774030 - DNA, 14 bp, Homo sapiens
gggctttggggctg

SEQ ID NO: 5774031 - DNA, 18 bp, Homo sapiens
gggctttggttccttctc

SEQ ID NO: 5774032 - DNA, 15 bp, Homo sapiens
gggctttgtgtgaag

SEQ ID NO: 5774033 - DNA, 18 bp, Homo sapiens
gggcttttccctgggtgg

SEQ ID NO: 5774034 - DNA, 21 bp, Homo sapiens
gggcttttccctgggtggagc

SEQ ID NO: 5774035 - DNA, 18 bp, Homo sapiens
gggcttttctctttcctc

SEQ ID NO: 5774036 - DNA, 20 bp, Homo sapiens
gggcttttctggggcccagg

SEQ ID NO: 5774037 - DNA, 15 bp, Homo sapiens
gggcttttgccactc

SEQ ID NO: 5774038 - DNA, 15 bp, Homo sapiens
gggcttttgttctga

SEQ ID NO: 5774039 - DNA, 18 bp, Homo sapiens
gggcttttgttctgaggg

SEQ ID NO: 5774040 - DNA, 17 bp, Homo sapiens
ggggaaaaaaaagaaaa

SEQ ID NO: 5774041 - DNA, 15 bp, Homo sapiens
ggggaaaagagatga

SEQ ID NO: 5774042 - DNA, 16 bp, Homo sapiens
ggggaaaatcagcctg

SEQ ID NO: 5774043 - DNA, 21 bp, Homo sapiens
ggggaaaatcagcctgctcca

SEQ ID NO: 5774044 - DNA, 15 bp, Homo sapiens
ggggaaaatgcattt

SEQ ID NO: 5774045 - DNA, 23 bp, Homo sapiens
ggggaaaatggccatgcaggagg

SEQ ID NO: 5774046 - DNA, 18 bp, Homo sapiens
ggggaaaatgtgaagctg

SEQ ID NO: 5774047 - DNA, 19 bp, Homo sapiens
ggggaaacgtctcccagat

SEQ ID NO: 5774048 - DNA, 13 bp, Homo sapiens
ggggaaagcacag

SEQ ID NO: 5774049 - DNA, 18 bp, Homo sapiens
ggggaaatgtggagaaca

SEQ ID NO: 5774050 - DNA, 14 bp, Homo sapiens
ggggaacagaccag

SEQ ID NO: 5774051 - DNA, 11 bp, Homo sapiens
ggggaacagat

SEQ ID NO: 5774052 - DNA, 18 bp, Homo sapiens
ggggaacccagccctggg

SEQ ID NO: 5774053 - DNA, 21 bp, Homo sapiens
ggggaacctgccatgccagga

SEQ ID NO: 5774054 - DNA, 12 bp, Homo sapiens
ggggaacgcaga

SEQ ID NO: 5774055 - DNA, 18 bp, Homo sapiens
ggggaactgacgctggag

SEQ ID NO: 5774056 - DNA, 20 bp, Homo sapiens
ggggaactgacgctggagat

SEQ ID NO: 5774057 - DNA, 12 bp, Homo sapiens
ggggaactgagg

SEQ ID NO: 5774058 - DNA, 23 bp, Homo sapiens
ggggaactgcatatcggaggtgg

SEQ ID NO: 5774059 - DNA, 13 bp, Homo sapiens
ggggaactggcca

SEQ ID NO: 5774060 - DNA, 12 bp, Homo sapiens
ggggaagaaaaa

SEQ ID NO: 5774061 - DNA, 17 bp, Homo sapiens
ggggaagaagcagagag

SEQ ID NO: 5774062 - DNA, 21 bp, Homo sapiens
ggggaagacccattccttccc

SEQ ID NO: 5774063 - DNA, 16 bp, Homo sapiens
ggggaagagagcctgc

SEQ ID NO: 5774064 - DNA, 19 bp, Homo sapiens
ggggaagagagcctgcagg

SEQ ID NO: 5774065 - DNA, 20 bp, Homo sapiens
ggggaagagagcctgcagga

SEQ ID NO: 5774066 - DNA, 21 bp, Homo sapiens
ggggataatgtccccactccc

SEQ ID NO: 5774067 - DNA, 14 bp, Homo sapiens
ggggataccagctg

SEQ ID NO: 5774068 - DNA, 13 bp, Homo sapiens
ggggatatgctta

SEQ ID NO: 5774069 - DNA, 13 bp, Homo sapiens
ggggatcacagag

SEQ ID NO: 5774070 - DNA, 21 bp, Homo sapiens
ggggatcacagcctcacccct

SEQ ID NO: 5774071 - DNA, 13 bp, Homo sapiens
ggggatcacagcg

SEQ ID NO: 5774072 - DNA, 22 bp, Homo sapiens
ggggatcatctgccgtgcctgg

SEQ ID NO: 5774073 - DNA, 17 bp, Homo sapiens
ggggatccagctcaagg

SEQ ID NO: 5774074 - DNA, 15 bp, Homo sapiens
ggggatccagtgaga

SEQ ID NO: 5774075 - DNA, 22 bp, Homo sapiens
ggggatccccgcctggccagga

SEQ ID NO: 5774076 - DNA, 20 bp, Homo sapiens
ggggatcccgtgctggaaga

SEQ ID NO: 5774077 - DNA, 23 bp, Homo sapiens
ggggatccctcccccccatgcac

SEQ ID NO: 5774078 - DNA, 14 bp, Homo sapiens
ggggatcctggagc

SEQ ID NO: 5774079 - DNA, 18 bp, Homo sapiens
ggggatcctggagcccct

SEQ ID NO: 5774080 - DNA, 13 bp, Homo sapiens
ggggatctcaggg

SEQ ID NO: 5774081 - DNA, 20 bp, Homo sapiens
ggggatcttcccacaggagg

SEQ ID NO: 5774082 - DNA, 22 bp, Homo sapiens
ggggatcttcccacaggagggc

SEQ ID NO: 5774083 - DNA, 16 bp, Homo sapiens
ggggatgacggccagg

SEQ ID NO: 5774084 - DNA, 19 bp, Homo sapiens
ggggatgacggccaggctc

SEQ ID NO: 5774085 - DNA, 21 bp, Homo sapiens
ggggatgactagaggcaggga

SEQ ID NO: 5774086 - DNA, 22 bp, Homo sapiens
ggggatgcaaataaagcctgct

SEQ ID NO: 5774087 - DNA, 12 bp, Homo sapiens
ggggatgcaggc

SEQ ID NO: 5774088 - DNA, 13 bp, Homo sapiens
ggggatgccttca

SEQ ID NO: 5774089 - DNA, 15 bp, Homo sapiens
ggggatggagaatgc

SEQ ID NO: 5774090 - DNA, 21 bp, Homo sapiens
ggggatggagaatgccagccc

SEQ ID NO: 5774091 - DNA, 13 bp, Homo sapiens
ggggatgggccag

SEQ ID NO: 5774092 - DNA, 14 bp, Homo sapiens
ggggatgggccagg

SEQ ID NO: 5774093 - DNA, 14 bp, Homo sapiens
ggggatggggaggg

SEQ ID NO: 5774094 - DNA, 16 bp, Homo sapiens
ggggatggggcctccc

SEQ ID NO: 5774095 - DNA, 13 bp, Homo sapiens
ggggatgggtggg

SEQ ID NO: 5774096 - DNA, 18 bp, Homo sapiens
ggggatggtggcacaggc

SEQ ID NO: 5774097 - DNA, 14 bp, Homo sapiens
ggggatgtgggagg

SEQ ID NO: 5774098 - DNA, 15 bp, Homo sapiens
ggggatgtttgcccc

SEQ ID NO: 5774099 - DNA, 13 bp, Homo sapiens
ggggattaattag

SEQ ID NO: 5774100 - DNA, 19 bp, Homo sapiens
ggggattcaaaaacaggtt

SEQ ID NO: 5774101 - DNA, 23 bp, Homo sapiens
ggggattcaggggctttgggccc

SEQ ID NO: 5774102 - DNA, 20 bp, Homo sapiens
ggggattcttccatctgatt

SEQ ID NO: 5774103 - DNA, 15 bp, Homo sapiens
ggggattgcccctgg

SEQ ID NO: 5774104 - DNA, 18 bp, Homo sapiens
ggggattgggagggacag

SEQ ID NO: 5774105 - DNA, 23 bp, Homo sapiens
ggggattgggagggacagggctt

SEQ ID NO: 5774106 - DNA, 23 bp, Homo sapiens
ggggatttcaaacttaaacaaaa

SEQ ID NO: 5774107 - DNA, 14 bp, Homo sapiens
ggggatttctggga

SEQ ID NO: 5774108 - DNA, 14 bp, Homo sapiens
ggggatttttttgt

SEQ ID NO: 5774109 - DNA, 22 bp, Homo sapiens
ggggcaaacctagccggaaggc

SEQ ID NO: 5774110 - DNA, 16 bp, Homo sapiens
ggggcaaagcctcctt

SEQ ID NO: 5774111 - DNA, 21 bp, Homo sapiens
ggggcaaagctgctgggccag

SEQ ID NO: 5774112 - DNA, 16 bp, Homo sapiens
ggggcaaccctggtga

SEQ ID NO: 5774113 - DNA, 13 bp, Homo sapiens
ggggcaagccagg

SEQ ID NO: 5774114 - DNA, 15 bp, Homo sapiens
ggggcaagccagggc

SEQ ID NO: 5774115 - DNA, 18 bp, Homo sapiens
ggggcaagccagggccca

SEQ ID NO: 5774116 - DNA, 21 bp, Homo sapiens
ggggcaagccagggcccagag

SEQ ID NO: 5774117 - DNA, 23 bp, Homo sapiens
ggggcaagccagggcccagagcc

SEQ ID NO: 5774118 - DNA, 13 bp, Homo sapiens
ggggcaagctagg

SEQ ID NO: 5774119 - DNA, 14 bp, Homo sapiens
ggggcaatggggag

SEQ ID NO: 5774120 - DNA, 22 bp, Homo sapiens
ggggcacaagactgacgccagg

SEQ ID NO: 5774121 - DNA, 20 bp, Homo sapiens
ggggcacaccactgccctgc

SEQ ID NO: 5774122 - DNA, 21 bp, Homo sapiens
ggggcacaccactgccctgcc

SEQ ID NO: 5774123 - DNA, 13 bp, Homo sapiens
ggggcacagtcat

SEQ ID NO: 5774124 - DNA, 19 bp, Homo sapiens
ggggcacagtccaggaaca

SEQ ID NO: 5774125 - DNA, 14 bp, Homo sapiens
ggggcacccagccc

SEQ ID NO: 5774126 - DNA, 21 bp, Homo sapiens
ggggcacgccctcctcagcga

SEQ ID NO: 5774127 - DNA, 23 bp, Homo sapiens
ggggcacggcaggcgtgtggcag

SEQ ID NO: 5774128 - DNA, 17 bp, Homo sapiens
ggggcactgaccaggcc

SEQ ID NO: 5774129 - DNA, 13 bp, Homo sapiens
ggggcagaacagc

SEQ ID NO: 5774130 - DNA, 17 bp, Homo sapiens
ggggcagaacagccgct

SEQ ID NO: 5774131 - DNA, 15 bp, Homo sapiens
ggggcagaactccta

SEQ ID NO: 5774132 - DNA, 16 bp, Homo sapiens
ggggcagaccagagag

SEQ ID NO: 5774133 - DNA, 15 bp, Homo sapiens
ggggcagagaataaa

SEQ ID NO: 5774134 - DNA, 13 bp, Homo sapiens
ggggcagagccag

SEQ ID NO: 5774135 - DNA, 16 bp, Homo sapiens
ggggcagagccaggaa

SEQ ID NO: 5774136 - DNA, 15 bp, Homo sapiens
ggggcagagcctccc

SEQ ID NO: 5774137 - DNA, 12 bp, Homo sapiens
ggggcagagctt

SEQ ID NO: 5774138 - DNA, 23 bp, Homo sapiens
ggggcagagcttctcctgaccag

SEQ ID NO: 5774139 - DNA, 18 bp, Homo sapiens
ggggcagagggctttcag

SEQ ID NO: 5774140 - DNA, 20 bp, Homo sapiens
ggggcagaggggcagccgct

SEQ ID NO: 5774141 - DNA, 21 bp, Homo sapiens
ggggcagatgttcccggagca

SEQ ID NO: 5774142 - DNA, 14 bp, Homo sapiens
ggggcagcaaggcc

SEQ ID NO: 5774143 - DNA, 24 bp, Homo sapiens
ggggcagcaaggccttggtggagc

SEQ ID NO: 5774144 - DNA, 15 bp, Homo sapiens
ggggcagcagcagcc

SEQ ID NO: 5774145 - DNA, 16 bp, Homo sapiens
ggggcagcagcagccc

SEQ ID NO: 5774146 - DNA, 19 bp, Homo sapiens
ggggcagcagcagccctgc

SEQ ID NO: 5774147 - DNA, 20 bp, Homo sapiens
ggggcagcagcagccctgcc

SEQ ID NO: 5774148 - DNA, 15 bp, Homo sapiens
ggggcagcaggagga

SEQ ID NO: 5774149 - DNA, 15 bp, Homo sapiens
ggggcagccctgagt

SEQ ID NO: 5774150 - DNA, 19 bp, Homo sapiens
ggggcagcctgccttgccc

SEQ ID NO: 5774151 - DNA, 13 bp, Homo sapiens
ggggcagctgacc

SEQ ID NO: 5774152 - DNA, 14 bp, Homo sapiens
ggggcagctgccag

SEQ ID NO: 5774153 - DNA, 21 bp, Homo sapiens
ggggcaggaaagccacatctt

SEQ ID NO: 5774154 - DNA, 21 bp, Homo sapiens
ggggcaggaatcaaggagcct

SEQ ID NO: 5774155 - DNA, 17 bp, Homo sapiens
ggggcaggactgagtcc

SEQ ID NO: 5774156 - DNA, 21 bp, Homo sapiens
ggggcaggagaggctgggctg

SEQ ID NO: 5774157 - DNA, 20 bp, Homo sapiens
ggggcaggaggcctggcctt

SEQ ID NO: 5774158 - DNA, 16 bp, Homo sapiens
ggggcaggagggccct

SEQ ID NO: 5774159 - DNA, 13 bp, Homo sapiens
ggggcaggagtgc

SEQ ID NO: 5774160 - DNA, 23 bp, Homo sapiens
ggggcaggagtgccaggaccagc

SEQ ID NO: 5774161 - DNA, 19 bp, Homo sapiens
ggggcaggattctctgcag

SEQ ID NO: 5774162 - DNA, 22 bp, Homo sapiens
ggggcaggattctctgcagccc

SEQ ID NO: 5774163 - DNA, 10 bp, Homo sapiens
ggggcaggca

SEQ ID NO: 5774164 - DNA, 17 bp, Homo sapiens
ggggcaggcacagcaca

SEQ ID NO: 5774165 - DNA, 12 bp, Homo sapiens
ggggcaggcagc

SEQ ID NO: 5774166 - DNA, 14 bp, Homo sapiens
ggggcaggcagggc

SEQ ID NO: 5774167 - DNA, 19 bp, Homo sapiens
ggggcaggccagggcagtt

SEQ ID NO: 5774168 - DNA, 22 bp, Homo sapiens
ggggcaggccaggggaggggtg

SEQ ID NO: 5774169 - DNA, 22 bp, Homo sapiens
ggggcaggcccctttggacctg

SEQ ID NO: 5774170 - DNA, 16 bp, Homo sapiens
ggggcaggccctgcac

SEQ ID NO: 5774171 - DNA, 18 bp, Homo sapiens
ggggcaggccctgcactg

SEQ ID NO: 5774172 - DNA, 23 bp, Homo sapiens
ggggcaggccctgcactgtcctg

SEQ ID NO: 5774173 - DNA, 20 bp, Homo sapiens
ggggcaggcctcccaagctg

SEQ ID NO: 5774174 - DNA, 13 bp, Homo sapiens
ggggcaggcctgg

SEQ ID NO: 5774175 - DNA, 13 bp, Homo sapiens
ggggcaggcgcag

SEQ ID NO: 5774176 - DNA, 16 bp, Homo sapiens
ggggcaggctgggcca

SEQ ID NO: 5774177 - DNA, 18 bp, Homo sapiens
ggggcagggaaggacagg

SEQ ID NO: 5774178 - DNA, 17 bp, Homo sapiens
ggggcagggacttgcct

SEQ ID NO: 5774179 - DNA, 13 bp, Homo sapiens
ggggcagggcagg

SEQ ID NO: 5774180 - DNA, 16 bp, Homo sapiens
ggggcagggcagggcg

SEQ ID NO: 5774181 - DNA, 14 bp, Homo sapiens
ggggcagggcctgg

SEQ ID NO: 5774182 - DNA, 17 bp, Homo sapiens
ggggcagggccttcctg

SEQ ID NO: 5774183 - DNA, 12 bp, Homo sapiens
ggggcagggctg

SEQ ID NO: 5774184 - DNA, 21 bp, Homo sapiens
ggggcaggggagtgccaaggt

SEQ ID NO: 5774185 - DNA, 14 bp, Homo sapiens
ggggcaggggcctg

SEQ ID NO: 5774186 - DNA, 16 bp, Homo sapiens
ggggcaggggcctggg

SEQ ID NO: 5774187 - DNA, 19 bp, Homo sapiens
ggggcaggggcctgggccg

SEQ ID NO: 5774188 - DNA, 12 bp, Homo sapiens
ggggcagggggt

SEQ ID NO: 5774189 - DNA, 13 bp, Homo sapiens
ggggcaggggtgc

SEQ ID NO: 5774190 - DNA, 11 bp, Homo sapiens
ggggcagggtg

SEQ ID NO: 5774191 - DNA, 14 bp, Homo sapiens
ggggcaggtcagga

SEQ ID NO: 5774192 - DNA, 12 bp, Homo sapiens
ggggcaggtgaa

SEQ ID NO: 5774193 - DNA, 14 bp, Homo sapiens
ggggcagtctcccc

SEQ ID NO: 5774194 - DNA, 19 bp, Homo sapiens
ggggcagtctgagagaggc

SEQ ID NO: 5774195 - DNA, 17 bp, Homo sapiens
ggggcagtctggagggg

SEQ ID NO: 5774196 - DNA, 23 bp, Homo sapiens
ggggcagtcttgcaacagtgcca

SEQ ID NO: 5774197 - DNA, 18 bp, Homo sapiens
ggggcagtgactggcagg

SEQ ID NO: 5774198 - DNA, 13 bp, Homo sapiens
ggggcagtgctca

SEQ ID NO: 5774199 - DNA, 17 bp, Homo sapiens
ggggcagtgctcaccca

SEQ ID NO: 5774200 - DNA, 13 bp, Homo sapiens
ggggcagtggcaa

SEQ ID NO: 5774201 - DNA, 21 bp, Homo sapiens
ggggcagtggcctggatgcac

SEQ ID NO: 5774202 - DNA, 17 bp, Homo sapiens
ggggcagttagagcagc

SEQ ID NO: 5774203 - DNA, 15 bp, Homo sapiens
ggggcagttgggtag

SEQ ID NO: 5774204 - DNA, 23 bp, Homo sapiens
ggggcatccaccttcctgcccag

SEQ ID NO: 5774205 - DNA, 15 bp, Homo sapiens
ggggcatcctgcttc

SEQ ID NO: 5774206 - DNA, 23 bp, Homo sapiens
ggggcatcctgcttcctgaaagc

SEQ ID NO: 5774207 - DNA, 14 bp, Homo sapiens
ggggcatcctggat

SEQ ID NO: 5774208 - DNA, 22 bp, Homo sapiens
ggggcatctgagtccagctccc

SEQ ID NO: 5774209 - DNA, 20 bp, Homo sapiens
ggggcatctgcccctccccc

SEQ ID NO: 5774210 - DNA, 15 bp, Homo sapiens
ggggcatgcctgtag

SEQ ID NO: 5774211 - DNA, 15 bp, Homo sapiens
ggggcatgggggagg

SEQ ID NO: 5774212 - DNA, 18 bp, Homo sapiens
ggggcatggttccttccc

SEQ ID NO: 5774213 - DNA, 21 bp, Homo sapiens
ggggccaaagaaggcagggaa

SEQ ID NO: 5774214 - DNA, 18 bp, Homo sapiens
ggggccaaataaagtctc

SEQ ID NO: 5774215 - DNA, 18 bp, Homo sapiens
ggggccaactcacccttg

SEQ ID NO: 5774216 - DNA, 21 bp, Homo sapiens
ggggccacagccagaaccccg

SEQ ID NO: 5774217 - DNA, 16 bp, Homo sapiens
ggggccacccaaatgt

SEQ ID NO: 5774218 - DNA, 19 bp, Homo sapiens
ggggccaccccgtgcccct

SEQ ID NO: 5774219 - DNA, 19 bp, Homo sapiens
ggggccacctcctccccct

SEQ ID NO: 5774220 - DNA, 15 bp, Homo sapiens
ggggccacctgcctg

SEQ ID NO: 5774221 - DNA, 16 bp, Homo sapiens
ggggccacctgcctgc

SEQ ID NO: 5774222 - DNA, 21 bp, Homo sapiens
ggggccactacctcctttcct

SEQ ID NO: 5774223 - DNA, 22 bp, Homo sapiens
ggggccactctctactggtagg

SEQ ID NO: 5774224 - DNA, 23 bp, Homo sapiens
ggggccactttcagagcccccag

SEQ ID NO: 5774225 - DNA, 19 bp, Homo sapiens
ggggccacttttgactagg

SEQ ID NO: 5774226 - DNA, 14 bp, Homo sapiens
ggggccagagacat

SEQ ID NO: 5774227 - DNA, 18 bp, Homo sapiens
ggggccagagagcagggg

SEQ ID NO: 5774228 - DNA, 12 bp, Homo sapiens
ggggccagagga

SEQ ID NO: 5774229 - DNA, 14 bp, Homo sapiens
ggggccagatccag

SEQ ID NO: 5774230 - DNA, 17 bp, Homo sapiens
ggggccagcagagggcg

SEQ ID NO: 5774231 - DNA, 12 bp, Homo sapiens
ggggccagcccc

SEQ ID NO: 5774232 - DNA, 13 bp, Homo sapiens
ggggccagcccct

SEQ ID NO: 5774233 - DNA, 22 bp, Homo sapiens
ggggccagcccctccccgcctc

SEQ ID NO: 5774234 - DNA, 14 bp, Homo sapiens
ggggccagctgggg

SEQ ID NO: 5774235 - DNA, 12 bp, Homo sapiens
ggggccaggaaa

SEQ ID NO: 5774236 - DNA, 20 bp, Homo sapiens
ggggccaggatggcgtgtcc

SEQ ID NO: 5774237 - DNA, 12 bp, Homo sapiens
ggggccaggcca

SEQ ID NO: 5774238 - DNA, 13 bp, Homo sapiens
ggggccaggccag

SEQ ID NO: 5774239 - DNA, 14 bp, Homo sapiens
ggggccaggccagg

SEQ ID NO: 5774240 - DNA, 17 bp, Homo sapiens
ggggccaggccaggacc

SEQ ID NO: 5774241 - DNA, 14 bp, Homo sapiens
ggggccaggcccag

SEQ ID NO: 5774242 - DNA, 16 bp, Homo sapiens
ggggccaggcccaggc

SEQ ID NO: 5774243 - DNA, 19 bp, Homo sapiens
ggggccaggcccaggcaga

SEQ ID NO: 5774244 - DNA, 22 bp, Homo sapiens
ggggccaggccccatggagggt

SEQ ID NO: 5774245 - DNA, 16 bp, Homo sapiens
ggggctcccggcatcc

SEQ ID NO: 5774246 - DNA, 18 bp, Homo sapiens
ggggctcccggcatcctg

SEQ ID NO: 5774247 - DNA, 20 bp, Homo sapiens
ggggctcccggcatcctgaa

SEQ ID NO: 5774248 - DNA, 16 bp, Homo sapiens
ggggctccctacattc

SEQ ID NO: 5774249 - DNA, 12 bp, Homo sapiens
ggggctccctct

SEQ ID NO: 5774250 - DNA, 19 bp, Homo sapiens
ggggctccgggtcactgct

SEQ ID NO: 5774251 - DNA, 15 bp, Homo sapiens
ggggctcctacctgg

SEQ ID NO: 5774252 - DNA, 21 bp, Homo sapiens
ggggctcctacctgggggcag

SEQ ID NO: 5774253 - DNA, 17 bp, Homo sapiens
ggggctcctcctgaagg

SEQ ID NO: 5774254 - DNA, 19 bp, Homo sapiens
ggggctcctcctgaaggag

SEQ ID NO: 5774255 - DNA, 16 bp, Homo sapiens
ggggctcctgcccagg

SEQ ID NO: 5774256 - DNA, 11 bp, Homo sapiens
ggggctcctgg

SEQ ID NO: 5774257 - DNA, 12 bp, Homo sapiens
ggggctcctgga

SEQ ID NO: 5774258 - DNA, 21 bp, Homo sapiens
ggggctcctggaaaggctcag

SEQ ID NO: 5774259 - DNA, 16 bp, Homo sapiens
ggggctcctggcagtg

SEQ ID NO: 5774260 - DNA, 14 bp, Homo sapiens
ggggctcctgggag

SEQ ID NO: 5774261 - DNA, 16 bp, Homo sapiens
ggggctcctgggttgg

SEQ ID NO: 5774262 - DNA, 20 bp, Homo sapiens
ggggctcctgggttggaggg

SEQ ID NO: 5774263 - DNA, 22 bp, Homo sapiens
ggggctcctgggttggagggaa

SEQ ID NO: 5774264 - DNA, 16 bp, Homo sapiens
ggggctcgagtgcccc

SEQ ID NO: 5774265 - DNA, 23 bp, Homo sapiens
ggggctcgagtgcccctgcaggg

SEQ ID NO: 5774266 - DNA, 17 bp, Homo sapiens
ggggctcgccccaccca

SEQ ID NO: 5774267 - DNA, 13 bp, Homo sapiens
ggggctcggggag

SEQ ID NO: 5774268 - DNA, 17 bp, Homo sapiens
ggggctcggggaggcag

SEQ ID NO: 5774269 - DNA, 18 bp, Homo sapiens
ggggctcgtggccttccc

SEQ ID NO: 5774270 - DNA, 20 bp, Homo sapiens
ggggctctcagctcagcgcc

SEQ ID NO: 5774271 - DNA, 15 bp, Homo sapiens
ggggctctctgaccc

SEQ ID NO: 5774272 - DNA, 16 bp, Homo sapiens
ggggctctgccccagg

SEQ ID NO: 5774273 - DNA, 23 bp, Homo sapiens
ggggctctgccctccctccttcc

SEQ ID NO: 5774274 - DNA, 13 bp, Homo sapiens
ggggctctgcctt

SEQ ID NO: 5774275 - DNA, 21 bp, Homo sapiens
ggggctctgcgttggcttctc

SEQ ID NO: 5774276 - DNA, 14 bp, Homo sapiens
ggggctctgcttcc

SEQ ID NO: 5774277 - DNA, 21 bp, Homo sapiens
ggggctctgcttcctcagccc

SEQ ID NO: 5774278 - DNA, 16 bp, Homo sapiens
ggggctctggccaagg

SEQ ID NO: 5774279 - DNA, 12 bp, Homo sapiens
ggggctctggga

SEQ ID NO: 5774280 - DNA, 17 bp, Homo sapiens
ggggctctgtggcaaaa

SEQ ID NO: 5774281 - DNA, 13 bp, Homo sapiens
ggggctctgtgtt

SEQ ID NO: 5774282 - DNA, 12 bp, Homo sapiens
ggggctctttcc

SEQ ID NO: 5774283 - DNA, 20 bp, Homo sapiens
ggggctgaacatgcctgcca

SEQ ID NO: 5774284 - DNA, 13 bp, Homo sapiens
ggggctgaagcca

SEQ ID NO: 5774285 - DNA, 14 bp, Homo sapiens
ggggctgaagccac

SEQ ID NO: 5774286 - DNA, 18 bp, Homo sapiens
ggggctgaagccacacag

SEQ ID NO: 5774287 - DNA, 22 bp, Homo sapiens
ggggctgaagccacacagccca

SEQ ID NO: 5774288 - DNA, 17 bp, Homo sapiens
ggggctgacctttcaaa

SEQ ID NO: 5774289 - DNA, 18 bp, Homo sapiens
ggggctgagccctcctga

SEQ ID NO: 5774290 - DNA, 14 bp, Homo sapiens
ggggctgagctggg

SEQ ID NO: 5774291 - DNA, 22 bp, Homo sapiens
ggggctgcaccggctggcctgg

SEQ ID NO: 5774292 - DNA, 23 bp, Homo sapiens
ggggctgcaccggctggcctggc

SEQ ID NO: 5774293 - DNA, 18 bp, Homo sapiens
ggggctgcagcagaggcc

SEQ ID NO: 5774294 - DNA, 18 bp, Homo sapiens
ggggctgcagccccctgc

SEQ ID NO: 5774295 - DNA, 15 bp, Homo sapiens
ggggctgcagggctg

SEQ ID NO: 5774296 - DNA, 16 bp, Homo sapiens
ggggctgcagggctgg

SEQ ID NO: 5774297 - DNA, 14 bp, Homo sapiens
ggggctgccagggg

SEQ ID NO: 5774298 - DNA, 20 bp, Homo sapiens
ggggctgccatagggtctgc

SEQ ID NO: 5774299 - DNA, 23 bp, Homo sapiens
ggggctgcccagctgctcccctg

SEQ ID NO: 5774300 - DNA, 16 bp, Homo sapiens
ggggctgcccgctccc

SEQ ID NO: 5774301 - DNA, 12 bp, Homo sapiens
ggggctgccctc

SEQ ID NO: 5774302 - DNA, 20 bp, Homo sapiens
ggggctgccgcatctgcctg

SEQ ID NO: 5774303 - DNA, 21 bp, Homo sapiens
ggggctgcgctagcagccctt

SEQ ID NO: 5774304 - DNA, 17 bp, Homo sapiens
ggggctgcgtccctgct

SEQ ID NO: 5774305 - DNA, 20 bp, Homo sapiens
ggggctgctcacccacctct

SEQ ID NO: 5774306 - DNA, 14 bp, Homo sapiens
ggggctgctcccac

SEQ ID NO: 5774307 - DNA, 16 bp, Homo sapiens
ggggctgctcctccag

SEQ ID NO: 5774308 - DNA, 20 bp, Homo sapiens
ggggctgctcctccagggcc

SEQ ID NO: 5774309 - DNA, 13 bp, Homo sapiens
ggggctgctgcct

SEQ ID NO: 5774310 - DNA, 12 bp, Homo sapiens
ggggctgctggg

SEQ ID NO: 5774311 - DNA, 13 bp, Homo sapiens
ggggctgctgggg

SEQ ID NO: 5774312 - DNA, 15 bp, Homo sapiens
ggggctgctggggca

SEQ ID NO: 5774313 - DNA, 14 bp, Homo sapiens
ggggctgctggggg

SEQ ID NO: 5774314 - DNA, 13 bp, Homo sapiens
ggggctgcttagg

SEQ ID NO: 5774315 - DNA, 21 bp, Homo sapiens
ggggctgcttctccacctccc

SEQ ID NO: 5774316 - DNA, 15 bp, Homo sapiens
ggggctggaagcaga

SEQ ID NO: 5774317 - DNA, 17 bp, Homo sapiens
ggggctggacctgctga

SEQ ID NO: 5774318 - DNA, 17 bp, Homo sapiens
ggggctggaggagccca

SEQ ID NO: 5774319 - DNA, 19 bp, Homo sapiens
ggggctggagggctgggca

SEQ ID NO: 5774320 - DNA, 15 bp, Homo sapiens
ggggctggaggtggc

SEQ ID NO: 5774321 - DNA, 18 bp, Homo sapiens
ggggctggcaccagcagg

SEQ ID NO: 5774322 - DNA, 19 bp, Homo sapiens
ggggctggcaccagcaggc

SEQ ID NO: 5774323 - DNA, 16 bp, Homo sapiens
ggggctggccagctgt

SEQ ID NO: 5774324 - DNA, 19 bp, Homo sapiens
ggggctggccagctgtgcg

SEQ ID NO: 5774325 - DNA, 16 bp, Homo sapiens
ggggctggccctgccc

SEQ ID NO: 5774326 - DNA, 12 bp, Homo sapiens
ggggctggccta

SEQ ID NO: 5774327 - DNA, 15 bp, Homo sapiens
ggggctggctcccag

SEQ ID NO: 5774328 - DNA, 21 bp, Homo sapiens
ggggctgggaaagaacttgga

SEQ ID NO: 5774329 - DNA, 11 bp, Homo sapiens
ggggctgggcc

SEQ ID NO: 5774330 - DNA, 11 bp, Homo sapiens
ggggctgggct

SEQ ID NO: 5774331 - DNA, 16 bp, Homo sapiens
ggggctgggctcacag

SEQ ID NO: 5774332 - DNA, 12 bp, Homo sapiens
ggggctgggctg

SEQ ID NO: 5774333 - DNA, 11 bp, Homo sapiens
ggggctggggg

SEQ ID NO: 5774334 - DNA, 12 bp, Homo sapiens
ggggctgggggg

SEQ ID NO: 5774335 - DNA, 23 bp, Homo sapiens
ggggctgggggtgaggggccagg

SEQ ID NO: 5774336 - DNA, 22 bp, Homo sapiens
ggggctggggtcacagaggcat

SEQ ID NO: 5774337 - DNA, 22 bp, Homo sapiens
ggggctgtacacaccctccagc

SEQ ID NO: 5774338 - DNA, 20 bp, Homo sapiens
ggggctgtcctccttcctgg

SEQ ID NO: 5774339 - DNA, 22 bp, Homo sapiens
ggggctgtcctgctgccctccc

SEQ ID NO: 5774340 - DNA, 12 bp, Homo sapiens
ggggctgtggat

SEQ ID NO: 5774341 - DNA, 13 bp, Homo sapiens
ggggctgtggccc

SEQ ID NO: 5774342 - DNA, 15 bp, Homo sapiens
ggggctgtggccctg

SEQ ID NO: 5774343 - DNA, 17 bp, Homo sapiens
ggggctgtggccctgcc

SEQ ID NO: 5774344 - DNA, 17 bp, Homo sapiens
ggggctgtggctctggg

SEQ ID NO: 5774345 - DNA, 19 bp, Homo sapiens
ggggctgtggctctgggtg

SEQ ID NO: 5774346 - DNA, 20 bp, Homo sapiens
ggggctgtggctctgggtgg

SEQ ID NO: 5774347 - DNA, 15 bp, Homo sapiens
ggggcttatgggtgg

SEQ ID NO: 5774348 - DNA, 12 bp, Homo sapiens
ggggcttatttt

SEQ ID NO: 5774349 - DNA, 18 bp, Homo sapiens
ggggcttccatggtggtt

SEQ ID NO: 5774350 - DNA, 23 bp, Homo sapiens
ggggcttctctgggaccaggctc

SEQ ID NO: 5774351 - DNA, 19 bp, Homo sapiens
ggggcttctcttgggtggg

SEQ ID NO: 5774352 - DNA, 23 bp, Homo sapiens
ggggcttctcttgggtgggacag

SEQ ID NO: 5774353 - DNA, 19 bp, Homo sapiens
ggggcttctgggtggctcc

SEQ ID NO: 5774354 - DNA, 21 bp, Homo sapiens
ggggcttctgggtggctcctg

SEQ ID NO: 5774355 - DNA, 21 bp, Homo sapiens
ggggcttctgtgcacctgggc

SEQ ID NO: 5774356 - DNA, 14 bp, Homo sapiens
ggggcttgccctgg

SEQ ID NO: 5774357 - DNA, 14 bp, Homo sapiens
ggggcttggagcag

SEQ ID NO: 5774358 - DNA, 16 bp, Homo sapiens
ggggcttggagcagag

SEQ ID NO: 5774359 - DNA, 24 bp, Homo sapiens
ggggcttggagcagagacggcagc

SEQ ID NO: 5774360 - DNA, 19 bp, Homo sapiens
ggggcttggcgtggagcag

SEQ ID NO: 5774361 - DNA, 13 bp, Homo sapiens
ggggcttggggat

SEQ ID NO: 5774362 - DNA, 14 bp, Homo sapiens
ggggcttggggctc

SEQ ID NO: 5774363 - DNA, 20 bp, Homo sapiens
ggggcttggggtagagagga

SEQ ID NO: 5774364 - DNA, 21 bp, Homo sapiens
ggggcttggggtagagaggac

SEQ ID NO: 5774365 - DNA, 18 bp, Homo sapiens
ggggctttcggggagggc

SEQ ID NO: 5774366 - DNA, 20 bp, Homo sapiens
ggggctttcgtccacagctt

SEQ ID NO: 5774367 - DNA, 15 bp, Homo sapiens
ggggctttgggccca

SEQ ID NO: 5774368 - DNA, 19 bp, Homo sapiens
gggggaaaaaaaaaaaaga

SEQ ID NO: 5774369 - DNA, 14 bp, Homo sapiens
gggggaacaatgag

SEQ ID NO: 5774370 - DNA, 22 bp, Homo sapiens
gggggaacactgagaaagaggc

SEQ ID NO: 5774371 - DNA, 18 bp, Homo sapiens
gggggaacgatgtgtctg

SEQ ID NO: 5774372 - DNA, 23 bp, Homo sapiens
gggggaagattttatgcacagcc

SEQ ID NO: 5774373 - DNA, 17 bp, Homo sapiens
gggggaaggccttgctg

SEQ ID NO: 5774374 - DNA, 14 bp, Homo sapiens
gggggaaggcgctg

SEQ ID NO: 5774375 - DNA, 12 bp, Homo sapiens
gggggaatgagc

SEQ ID NO: 5774376 - DNA, 16 bp, Homo sapiens
gggggaatgagcccag

SEQ ID NO: 5774377 - DNA, 13 bp, Homo sapiens
gggggacactcca

SEQ ID NO: 5774378 - DNA, 14 bp, Homo sapiens
gggggacagcaggg

SEQ ID NO: 5774379 - DNA, 22 bp, Homo sapiens
gggggacaggaacacccagccc

SEQ ID NO: 5774380 - DNA, 22 bp, Homo sapiens
gggggacagggctggcccagcc

SEQ ID NO: 5774381 - DNA, 23 bp, Homo sapiens
gggggacagggctggcccagccc

SEQ ID NO: 5774382 - DNA, 15 bp, Homo sapiens
gggggaccccttccc

SEQ ID NO: 5774383 - DNA, 17 bp, Homo sapiens
gggggaccgggcccctc

SEQ ID NO: 5774384 - DNA, 19 bp, Homo sapiens
gggggacgagggccaggca

SEQ ID NO: 5774385 - DNA, 18 bp, Homo sapiens
gggggacgcccagccccc

SEQ ID NO: 5774386 - DNA, 11 bp, Homo sapiens
gggggactggg

SEQ ID NO: 5774387 - DNA, 19 bp, Homo sapiens
gggggagaaccactgaccc

SEQ ID NO: 5774388 - DNA, 16 bp, Homo sapiens
gggggagaaggcctcc

SEQ ID NO: 5774389 - DNA, 11 bp, Homo sapiens
gggggagaggg

SEQ ID NO: 5774390 - DNA, 15 bp, Homo sapiens
gggggagagggctgc

SEQ ID NO: 5774391 - DNA, 14 bp, Homo sapiens
gggggagaggggga

SEQ ID NO: 5774392 - DNA, 18 bp, Homo sapiens
gggggagcaccctgaggg

SEQ ID NO: 5774393 - DNA, 19 bp, Homo sapiens
gggggagcaccctgagggc

SEQ ID NO: 5774394 - DNA, 17 bp, Homo sapiens
gggggagcagagagagc

SEQ ID NO: 5774395 - DNA, 14 bp, Homo sapiens
gggggagcaggcag

SEQ ID NO: 5774396 - DNA, 20 bp, Homo sapiens
gggggagcaggcagtggggc

SEQ ID NO: 5774397 - DNA, 16 bp, Homo sapiens
gggggagccaacagca

SEQ ID NO: 5774398 - DNA, 10 bp, Homo sapiens
gggggagccc

SEQ ID NO: 5774399 - DNA, 21 bp, Homo sapiens
gggggagcccagtgaagcctc

SEQ ID NO: 5774400 - DNA, 12 bp, Homo sapiens
gggggagcctgg

SEQ ID NO: 5774401 - DNA, 15 bp, Homo sapiens
gggggaggagtcagg

SEQ ID NO: 5774402 - DNA, 19 bp, Homo sapiens
gggggaggagtcaggggct

SEQ ID NO: 5774403 - DNA, 22 bp, Homo sapiens
gggggaggagtggattcctccc

SEQ ID NO: 5774404 - DNA, 12 bp, Homo sapiens
gggggaggccat

SEQ ID NO: 5774405 - DNA, 15 bp, Homo sapiens
gggggagggagggct

SEQ ID NO: 5774406 - DNA, 22 bp, Homo sapiens
gggggaggtgggatcctccagg

SEQ ID NO: 5774407 - DNA, 22 bp, Homo sapiens
gggggagtctgaagcagatgca

SEQ ID NO: 5774408 - DNA, 14 bp, Homo sapiens
gggggagtctttgc

SEQ ID NO: 5774409 - DNA, 12 bp, Homo sapiens
gggggagtggag

SEQ ID NO: 5774410 - DNA, 17 bp, Homo sapiens
gggggatcacagcctct

SEQ ID NO: 5774411 - DNA, 21 bp, Homo sapiens
gggggatgccactcctccctc

SEQ ID NO: 5774412 - DNA, 22 bp, Homo sapiens
gggggattctgagcagtgcctc

SEQ ID NO: 5774413 - DNA, 21 bp, Homo sapiens
gggggcaagagctcaggagaa

SEQ ID NO: 5774414 - DNA, 14 bp, Homo sapiens
gggggcaaggtggg

SEQ ID NO: 5774415 - DNA, 20 bp, Homo sapiens
gggggcaaggtgggggagcc

SEQ ID NO: 5774416 - DNA, 20 bp, Homo sapiens
gggggcaattgacttcctcc

SEQ ID NO: 5774417 - DNA, 15 bp, Homo sapiens
gggggcacagccaga

SEQ ID NO: 5774418 - DNA, 16 bp, Homo sapiens
gggggcacagccagaa

SEQ ID NO: 5774419 - DNA, 14 bp, Homo sapiens
gggggcaccgggct

SEQ ID NO: 5774420 - DNA, 15 bp, Homo sapiens
gggggcactcagcca

SEQ ID NO: 5774421 - DNA, 20 bp, Homo sapiens
gggggcactcagccacgacc

SEQ ID NO: 5774422 - DNA, 19 bp, Homo sapiens
gggggcactgtggtcaggc

SEQ ID NO: 5774423 - DNA, 22 bp, Homo sapiens
gggggcacttggaggacctggc

SEQ ID NO: 5774424 - DNA, 12 bp, Homo sapiens
ggggtctttgtg

SEQ ID NO: 5774425 - DNA, 17 bp, Homo sapiens
ggggtcttttggctctg

SEQ ID NO: 5774426 - DNA, 14 bp, Homo sapiens
ggggtgaagctggg

SEQ ID NO: 5774427 - DNA, 18 bp, Homo sapiens
ggggtgaatacttatttt

SEQ ID NO: 5774428 - DNA, 11 bp, Homo sapiens
ggggtgacaga

SEQ ID NO: 5774429 - DNA, 18 bp, Homo sapiens
ggggtgacgcctgccctc

SEQ ID NO: 5774430 - DNA, 18 bp, Homo sapiens
ggggtgacggccctcatc

SEQ ID NO: 5774431 - DNA, 13 bp, Homo sapiens
ggggtgactggaa

SEQ ID NO: 5774432 - DNA, 21 bp, Homo sapiens
ggggtgagaagtacagggcag

SEQ ID NO: 5774433 - DNA, 19 bp, Homo sapiens
ggggtgagaggcaggaatg

SEQ ID NO: 5774434 - DNA, 20 bp, Homo sapiens
ggggtgagaggcaggaatgg

SEQ ID NO: 5774435 - DNA, 16 bp, Homo sapiens
ggggtgagcctgactg

SEQ ID NO: 5774436 - DNA, 15 bp, Homo sapiens
ggggtgaggagctgg

SEQ ID NO: 5774437 - DNA, 23 bp, Homo sapiens
ggggtgatgagggcagcagccag

SEQ ID NO: 5774438 - DNA, 16 bp, Homo sapiens
ggggtgatggccagag

SEQ ID NO: 5774439 - DNA, 18 bp, Homo sapiens
ggggtgatttcagagagg

SEQ ID NO: 5774440 - DNA, 16 bp, Homo sapiens
ggggtgcacaggaggg

SEQ ID NO: 5774441 - DNA, 16 bp, Homo sapiens
ggggtgcagaggctgt

SEQ ID NO: 5774442 - DNA, 23 bp, Homo sapiens
ggggtgcatcctcctcagccccc

SEQ ID NO: 5774443 - DNA, 18 bp, Homo sapiens
ggggtgccaaaatgccta

SEQ ID NO: 5774444 - DNA, 13 bp, Homo sapiens
ggggtgccccaca

SEQ ID NO: 5774445 - DNA, 13 bp, Homo sapiens
ggggtgccccctc

SEQ ID NO: 5774446 - DNA, 12 bp, Homo sapiens
ggggtgcccgtg

SEQ ID NO: 5774447 - DNA, 19 bp, Homo sapiens
ggggtgcccgtgtggcctg

SEQ ID NO: 5774448 - DNA, 22 bp, Homo sapiens
ggggtgcccgtgtggcctgggt

SEQ ID NO: 5774449 - DNA, 24 bp, Homo sapiens
ggggtgcccgtgtggcctgggtcc

SEQ ID NO: 5774450 - DNA, 18 bp, Homo sapiens
ggggtgccctcccagacc

SEQ ID NO: 5774451 - DNA, 17 bp, Homo sapiens
ggggtgccgcctgcccg

SEQ ID NO: 5774452 - DNA, 21 bp, Homo sapiens
ggggtgccttcactgggccag

SEQ ID NO: 5774453 - DNA, 19 bp, Homo sapiens
ggggtgcggcggtcccagc

SEQ ID NO: 5774454 - DNA, 22 bp, Homo sapiens
ggggtgcggcggtcccagctcc

SEQ ID NO: 5774455 - DNA, 14 bp, Homo sapiens
ggggtgctgagtga

SEQ ID NO: 5774456 - DNA, 13 bp, Homo sapiens
ggggtgctgcctt

SEQ ID NO: 5774457 - DNA, 19 bp, Homo sapiens
ggggtgctgccttgtagat

SEQ ID NO: 5774458 - DNA, 19 bp, Homo sapiens
ggggtgctggggctgcatg

SEQ ID NO: 5774459 - DNA, 15 bp, Homo sapiens
ggggtgctgtggaca

SEQ ID NO: 5774460 - DNA, 14 bp, Homo sapiens
ggggtgcttgctgt

SEQ ID NO: 5774461 - DNA, 15 bp, Homo sapiens
ggggtggaataaagg

SEQ ID NO: 5774462 - DNA, 16 bp, Homo sapiens
ggggtggagtcccaga

SEQ ID NO: 5774463 - DNA, 12 bp, Homo sapiens
ggggtggccagg

SEQ ID NO: 5774464 - DNA, 13 bp, Homo sapiens
ggggtggccaggc

SEQ ID NO: 5774465 - DNA, 14 bp, Homo sapiens
ggggtggccagggc

SEQ ID NO: 5774466 - DNA, 15 bp, Homo sapiens
ggggtggcccagagc

SEQ ID NO: 5774467 - DNA, 17 bp, Homo sapiens
ggggtggcctgcagtga

SEQ ID NO: 5774468 - DNA, 19 bp, Homo sapiens
ggggtggcgcgcctgcctt

SEQ ID NO: 5774469 - DNA, 18 bp, Homo sapiens
ggggtggctgcagcctca

SEQ ID NO: 5774470 - DNA, 16 bp, Homo sapiens
ggggtgggagccacag

SEQ ID NO: 5774471 - DNA, 14 bp, Homo sapiens
ggggtgggccaggc

SEQ ID NO: 5774472 - DNA, 13 bp, Homo sapiens
ggggtgggctggt

SEQ ID NO: 5774473 - DNA, 17 bp, Homo sapiens
ggggtggggacctcagg

SEQ ID NO: 5774474 - DNA, 14 bp, Homo sapiens
ggggtggggagatg

SEQ ID NO: 5774475 - DNA, 13 bp, Homo sapiens
ggggtggggagct

SEQ ID NO: 5774476 - DNA, 15 bp, Homo sapiens
ggggtggggagggtg

SEQ ID NO: 5774477 - DNA, 12 bp, Homo sapiens
ggggtggggcag

SEQ ID NO: 5774478 - DNA, 14 bp, Homo sapiens
ggggtggggcagga

SEQ ID NO: 5774479 - DNA, 15 bp, Homo sapiens
ggggtggggctccta

SEQ ID NO: 5774480 - DNA, 17 bp, Homo sapiens
ggggtgggggatctggg

SEQ ID NO: 5774481 - DNA, 17 bp, Homo sapiens
ggggtgggggccaggcc

SEQ ID NO: 5774482 - DNA, 20 bp, Homo sapiens
ggggtggggggggtgctggg

SEQ ID NO: 5774483 - DNA, 12 bp, Homo sapiens
ggggtggggtgc

SEQ ID NO: 5774484 - DNA, 15 bp, Homo sapiens
ggggtggggtgcctg

SEQ ID NO: 5774485 - DNA, 15 bp, Homo sapiens
ggggtgggtataaaa

SEQ ID NO: 5774486 - DNA, 18 bp, Homo sapiens
ggggtgtccgagaggctg

SEQ ID NO: 5774487 - DNA, 16 bp, Homo sapiens
ggggttagagccaagc

SEQ ID NO: 5774488 - DNA, 15 bp, Homo sapiens
ggggttatctctgtg

SEQ ID NO: 5774489 - DNA, 13 bp, Homo sapiens
ggggttatgtgga

SEQ ID NO: 5774490 - DNA, 16 bp, Homo sapiens
ggggttcagcccctcc

SEQ ID NO: 5774491 - DNA, 22 bp, Homo sapiens
ggggttcagcccctcctctgcc

SEQ ID NO: 5774492 - DNA, 19 bp, Homo sapiens
ggggttccagcacaaagtt

SEQ ID NO: 5774493 - DNA, 19 bp, Homo sapiens
ggggttcccactggctcct

SEQ ID NO: 5774494 - DNA, 17 bp, Homo sapiens
ggggttccccacacagg

SEQ ID NO: 5774495 - DNA, 22 bp, Homo sapiens
ggggttcccgtgtgcctgagcg

SEQ ID NO: 5774496 - DNA, 20 bp, Homo sapiens
ggggttctagaaaatatagt

SEQ ID NO: 5774497 - DNA, 15 bp, Homo sapiens
ggggttctggcagga

SEQ ID NO: 5774498 - DNA, 14 bp, Homo sapiens
ggggttgccagagg

SEQ ID NO: 5774499 - DNA, 17 bp, Homo sapiens
ggggttgccagaggccc

SEQ ID NO: 5774500 - DNA, 21 bp, Homo sapiens
ggggttgccagaggccctgga

SEQ ID NO: 5774501 - DNA, 17 bp, Homo sapiens
ggggttgccctggggga

SEQ ID NO: 5774502 - DNA, 19 bp, Homo sapiens
ggggttggcttccctggca

SEQ ID NO: 5774503 - DNA, 12 bp, Homo sapiens
ggggttgggcgg

SEQ ID NO: 5774504 - DNA, 17 bp, Homo sapiens
ggggttggggcaaagcc

SEQ ID NO: 5774505 - DNA, 18 bp, Homo sapiens
ggggttgggggacagcct

SEQ ID NO: 5774506 - DNA, 13 bp, Homo sapiens
ggggttggggtgg

SEQ ID NO: 5774507 - DNA, 18 bp, Homo sapiens
ggggttgggttccagaca

SEQ ID NO: 5774508 - DNA, 15 bp, Homo sapiens
ggggttgtgttgtca

SEQ ID NO: 5774509 - DNA, 17 bp, Homo sapiens
ggggtttccacacaggc

SEQ ID NO: 5774510 - DNA, 18 bp, Homo sapiens
ggggtttccacacaggcc

SEQ ID NO: 5774511 - DNA, 21 bp, Homo sapiens
ggggtttccacacaggcccat

SEQ ID NO: 5774512 - DNA, 13 bp, Homo sapiens
ggggtttcctgca

SEQ ID NO: 5774513 - DNA, 21 bp, Homo sapiens
ggggtttcctgcatggacagt

SEQ ID NO: 5774514 - DNA, 18 bp, Homo sapiens
ggggtttgccatttgata

SEQ ID NO: 5774515 - DNA, 20 bp, Homo sapiens
ggggtttgcttttgttttgt

SEQ ID NO: 5774516 - DNA, 18 bp, Homo sapiens
ggggtttgttttgcaatg

SEQ ID NO: 5774517 - DNA, 11 bp, Homo sapiens
ggggtttttct

SEQ ID NO: 5774518 - DNA, 23 bp, Homo sapiens
ggggttttttttttctgaataaa

SEQ ID NO: 5774519 - DNA, 18 bp, Homo sapiens
gggtaaaaagagaaggca

SEQ ID NO: 5774520 - DNA, 15 bp, Homo sapiens
gggtaaaaagtggct

SEQ ID NO: 5774521 - DNA, 21 bp, Homo sapiens
gggtaaaatacttttactctg

SEQ ID NO: 5774522 - DNA, 22 bp, Homo sapiens
gggtaaaattccttagcttaga

SEQ ID NO: 5774523 - DNA, 13 bp, Homo sapiens
gggtaaactgtgg

SEQ ID NO: 5774524 - DNA, 23 bp, Homo sapiens
gggtaaagccctcagatcccagg

SEQ ID NO: 5774525 - DNA, 13 bp, Homo sapiens
gggtaaataaatg

SEQ ID NO: 5774526 - DNA, 12 bp, Homo sapiens
gggtaaatatac

SEQ ID NO: 5774527 - DNA, 14 bp, Homo sapiens
gggtaaatatatgt

SEQ ID NO: 5774528 - DNA, 16 bp, Homo sapiens
gggtaaatatatgttt

SEQ ID NO: 5774529 - DNA, 23 bp, Homo sapiens
gggtaaatatatgttttgagaaa

SEQ ID NO: 5774530 - DNA, 13 bp, Homo sapiens
gggtaaattattc

SEQ ID NO: 5774531 - DNA, 19 bp, Homo sapiens
gggtaactaactaaaacaa

SEQ ID NO: 5774532 - DNA, 17 bp, Homo sapiens
gggtaagaggagcagag

SEQ ID NO: 5774533 - DNA, 14 bp, Homo sapiens
gggtaagccagagc

SEQ ID NO: 5774534 - DNA, 18 bp, Homo sapiens
gggtaagccagagcctgg

SEQ ID NO: 5774535 - DNA, 19 bp, Homo sapiens
gggtaagccagagcctggg

SEQ ID NO: 5774536 - DNA, 15 bp, Homo sapiens
gggtaaggaggagaa

SEQ ID NO: 5774537 - DNA, 22 bp, Homo sapiens
gggtaagggactccagaagcag

SEQ ID NO: 5774538 - DNA, 16 bp, Homo sapiens
gggtaagggatttctt

SEQ ID NO: 5774539 - DNA, 22 bp, Homo sapiens
gggtaatcagcattattcttca

SEQ ID NO: 5774540 - DNA, 17 bp, Homo sapiens
gggtaatccgttcatag

SEQ ID NO: 5774541 - DNA, 16 bp, Homo sapiens
gggtaatgagaggtgg

SEQ ID NO: 5774542 - DNA, 18 bp, Homo sapiens
gggtaatgtgaaggccca

SEQ ID NO: 5774543 - DNA, 18 bp, Homo sapiens
gggtaattgtacaataaa

SEQ ID NO: 5774544 - DNA, 20 bp, Homo sapiens
gggtaattgtacaataaatt

SEQ ID NO: 5774545 - DNA, 20 bp, Homo sapiens
gggtaatttagattgtaaac

SEQ ID NO: 5774546 - DNA, 22 bp, Homo sapiens
gggtacacagagctaaggccaa

SEQ ID NO: 5774547 - DNA, 18 bp, Homo sapiens
gggtacagatccccagcc

SEQ ID NO: 5774548 - DNA, 16 bp, Homo sapiens
gggtacagcccaggcg

SEQ ID NO: 5774549 - DNA, 20 bp, Homo sapiens
gggtacagcgcggaggagga

SEQ ID NO: 5774550 - DNA, 17 bp, Homo sapiens
gggtacatggtgctggg

SEQ ID NO: 5774551 - DNA, 11 bp, Homo sapiens
gggtacatgtg

SEQ ID NO: 5774552 - DNA, 18 bp, Homo sapiens
gggtaccaatcctggcag

SEQ ID NO: 5774553 - DNA, 13 bp, Homo sapiens
gggtaccaggcac

SEQ ID NO: 5774554 - DNA, 14 bp, Homo sapiens
gggtacccaggctg

SEQ ID NO: 5774555 - DNA, 13 bp, Homo sapiens
gggtacctcagtt

SEQ ID NO: 5774556 - DNA, 14 bp, Homo sapiens
gggtacctcagttt

SEQ ID NO: 5774557 - DNA, 14 bp, Homo sapiens
gggtacctcatgag

SEQ ID NO: 5774558 - DNA, 19 bp, Homo sapiens
gggtacctggtccccactg

SEQ ID NO: 5774559 - DNA, 18 bp, Homo sapiens
gggtagaaaactccaggg

SEQ ID NO: 5774560 - DNA, 15 bp, Homo sapiens
gggtagaaacctgcc

SEQ ID NO: 5774561 - DNA, 22 bp, Homo sapiens
gggtagaagcaaaggcaggagg

SEQ ID NO: 5774562 - DNA, 20 bp, Homo sapiens
gggtagaagccacccttccc

SEQ ID NO: 5774563 - DNA, 20 bp, Homo sapiens
gggtagaccttgagggtggg

SEQ ID NO: 5774564 - DNA, 17 bp, Homo sapiens
gggtagacttggagctg

SEQ ID NO: 5774565 - DNA, 15 bp, Homo sapiens
gggtagagaggacag

SEQ ID NO: 5774566 - DNA, 22 bp, Homo sapiens
gggtagaggaagacgagacagg

SEQ ID NO: 5774567 - DNA, 22 bp, Homo sapiens
gggtagaggctgggaggagccc

SEQ ID NO: 5774568 - DNA, 19 bp, Homo sapiens
gggtagagtttacagctct

SEQ ID NO: 5774569 - DNA, 22 bp, Homo sapiens
gggtagatgatttctagcaggc

SEQ ID NO: 5774570 - DNA, 14 bp, Homo sapiens
gggtagatgtgcaa

SEQ ID NO: 5774571 - DNA, 21 bp, Homo sapiens
gggtagatttcagggagacaa

SEQ ID NO: 5774572 - DNA, 14 bp, Homo sapiens
gggtagatttctct

SEQ ID NO: 5774573 - DNA, 16 bp, Homo sapiens
gggtagatttctcttg

SEQ ID NO: 5774574 - DNA, 14 bp, Homo sapiens
gggtagcactacta

SEQ ID NO: 5774575 - DNA, 14 bp, Homo sapiens
gggtagcagcagag

SEQ ID NO: 5774576 - DNA, 13 bp, Homo sapiens
gggtagcagctgg

SEQ ID NO: 5774577 - DNA, 15 bp, Homo sapiens
gggtagcagctggac

SEQ ID NO: 5774578 - DNA, 22 bp, Homo sapiens
gggtagcagctggactacccac

SEQ ID NO: 5774579 - DNA, 12 bp, Homo sapiens
gggtagcccgcc

SEQ ID NO: 5774580 - DNA, 18 bp, Homo sapiens
gggtagcccgcctgccag

SEQ ID NO: 5774581 - DNA, 20 bp, Homo sapiens
gggtagctgccacttgaaca

SEQ ID NO: 5774582 - DNA, 21 bp, Homo sapiens
gggtagcttctgacctcagca

SEQ ID NO: 5774583 - DNA, 17 bp, Homo sapiens
gggtaggacggagatga

SEQ ID NO: 5774584 - DNA, 21 bp, Homo sapiens
gggtaggagagcactgcctct

SEQ ID NO: 5774585 - DNA, 13 bp, Homo sapiens
gggtaggagagga

SEQ ID NO: 5774586 - DNA, 15 bp, Homo sapiens
gggtaggaggaacag

SEQ ID NO: 5774587 - DNA, 19 bp, Homo sapiens
gggtaggagggtgggaagg

SEQ ID NO: 5774588 - DNA, 17 bp, Homo sapiens
gggtaggcaggtgtctt

SEQ ID NO: 5774589 - DNA, 14 bp, Homo sapiens
gggtagggatttgg

SEQ ID NO: 5774590 - DNA, 18 bp, Homo sapiens
gggtagggggctggagga

SEQ ID NO: 5774591 - DNA, 15 bp, Homo sapiens
gggtagggtaaatca

SEQ ID NO: 5774592 - DNA, 14 bp, Homo sapiens
gggtagtgccatgg

SEQ ID NO: 5774593 - DNA, 21 bp, Homo sapiens
gggtatacagcattgactcag

SEQ ID NO: 5774594 - DNA, 13 bp, Homo sapiens
gggtatattcatt

SEQ ID NO: 5774595 - DNA, 23 bp, Homo sapiens
gggtatatttttgtttgttttgt

SEQ ID NO: 5774596 - DNA, 14 bp, Homo sapiens
gggtatcccacctc

SEQ ID NO: 5774597 - DNA, 15 bp, Homo sapiens
gggtatcccctgcct

SEQ ID NO: 5774598 - DNA, 16 bp, Homo sapiens
gggtatcccctgcctc

SEQ ID NO: 5774599 - DNA, 18 bp, Homo sapiens
gggtatcccctgcctcct

SEQ ID NO: 5774600 - DNA, 23 bp, Homo sapiens
gggtatcccctgcctcctgccac

SEQ ID NO: 5774601 - DNA, 21 bp, Homo sapiens
gggtatgaagagcttgctttg

SEQ ID NO: 5774602 - DNA, 20 bp, Homo sapiens
gggtatgaagtgtggggcgg

SEQ ID NO: 5774603 - DNA, 18 bp, Homo sapiens
gggtctctgctgccgccc

SEQ ID NO: 5774604 - DNA, 16 bp, Homo sapiens
gggtctgaaaagggca

SEQ ID NO: 5774605 - DNA, 23 bp, Homo sapiens
gggtctgaaggaatagccagaga

SEQ ID NO: 5774606 - DNA, 21 bp, Homo sapiens
gggtctgagtcatggccgggt

SEQ ID NO: 5774607 - DNA, 20 bp, Homo sapiens
gggtctgagtctatgttcaa

SEQ ID NO: 5774608 - DNA, 17 bp, Homo sapiens
gggtctgattttctcac

SEQ ID NO: 5774609 - DNA, 14 bp, Homo sapiens
gggtctgcagggaa

SEQ ID NO: 5774610 - DNA, 20 bp, Homo sapiens
gggtctgccaccatcctgct

SEQ ID NO: 5774611 - DNA, 11 bp, Homo sapiens
gggtctgccct

SEQ ID NO: 5774612 - DNA, 12 bp, Homo sapiens
gggtctgccctg

SEQ ID NO: 5774613 - DNA, 16 bp, Homo sapiens
gggtctgccctgccca

SEQ ID NO: 5774614 - DNA, 12 bp, Homo sapiens
gggtctgctcct

SEQ ID NO: 5774615 - DNA, 20 bp, Homo sapiens
gggtctgctctttctctgcc

SEQ ID NO: 5774616 - DNA, 21 bp, Homo sapiens
gggtctgctctttctctgcca

SEQ ID NO: 5774617 - DNA, 11 bp, Homo sapiens
gggtctgcttc

SEQ ID NO: 5774618 - DNA, 16 bp, Homo sapiens
gggtctggatgggagg

SEQ ID NO: 5774619 - DNA, 22 bp, Homo sapiens
gggtctggcagagcctctgaga

SEQ ID NO: 5774620 - DNA, 22 bp, Homo sapiens
gggtctggcagcctcccatcca

SEQ ID NO: 5774621 - DNA, 13 bp, Homo sapiens
gggtctggctggt

SEQ ID NO: 5774622 - DNA, 14 bp, Homo sapiens
gggtctggctggtg

SEQ ID NO: 5774623 - DNA, 18 bp, Homo sapiens
gggtctgggaggcaggtc

SEQ ID NO: 5774624 - DNA, 22 bp, Homo sapiens
gggtctgggagggggtgagagg

SEQ ID NO: 5774625 - DNA, 17 bp, Homo sapiens
gggtctgggcagtgcca

SEQ ID NO: 5774626 - DNA, 14 bp, Homo sapiens
gggtctgggcgtcc

SEQ ID NO: 5774627 - DNA, 12 bp, Homo sapiens
gggtctgggctg

SEQ ID NO: 5774628 - DNA, 17 bp, Homo sapiens
gggtctgggggcagctg

SEQ ID NO: 5774629 - DNA, 21 bp, Homo sapiens
gggtctgggggcagctgtcct

SEQ ID NO: 5774630 - DNA, 13 bp, Homo sapiens
gggtctgtaaaat

SEQ ID NO: 5774631 - DNA, 15 bp, Homo sapiens
gggtctgtaaaatct

SEQ ID NO: 5774632 - DNA, 16 bp, Homo sapiens
gggtctgtaaaatctt

SEQ ID NO: 5774633 - DNA, 20 bp, Homo sapiens
gggtctgtaaaatctttctt

SEQ ID NO: 5774634 - DNA, 13 bp, Homo sapiens
gggtctgtcctct

SEQ ID NO: 5774635 - DNA, 16 bp, Homo sapiens
gggtctgtctgctttg

SEQ ID NO: 5774636 - DNA, 20 bp, Homo sapiens
gggtctgtgactggatcttc

SEQ ID NO: 5774637 - DNA, 17 bp, Homo sapiens
gggtctgtgctgtgcct

SEQ ID NO: 5774638 - DNA, 15 bp, Homo sapiens
gggtctgtgtgaatg

SEQ ID NO: 5774639 - DNA, 24 bp, Homo sapiens
gggtctgtgtgaatgtgggcactg

SEQ ID NO: 5774640 - DNA, 22 bp, Homo sapiens
gggtcttgcaaaattcctgacg

SEQ ID NO: 5774641 - DNA, 21 bp, Homo sapiens
gggtcttgctctgtcccccag

SEQ ID NO: 5774642 - DNA, 17 bp, Homo sapiens
gggtcttgggctactgg

SEQ ID NO: 5774643 - DNA, 22 bp, Homo sapiens
gggtcttgggctactggcagct

SEQ ID NO: 5774644 - DNA, 18 bp, Homo sapiens
gggtcttgggttcctgta

SEQ ID NO: 5774645 - DNA, 18 bp, Homo sapiens
gggtctttactgggaagc

SEQ ID NO: 5774646 - DNA, 22 bp, Homo sapiens
gggtctttgtggtagcttatct

SEQ ID NO: 5774647 - DNA, 18 bp, Homo sapiens
gggtctttttctcttctg

SEQ ID NO: 5774648 - DNA, 13 bp, Homo sapiens
gggtgaagagctt

SEQ ID NO: 5774649 - DNA, 13 bp, Homo sapiens
gggtgaagggaga

SEQ ID NO: 5774650 - DNA, 17 bp, Homo sapiens
gggtgaagtgcctgctg

SEQ ID NO: 5774651 - DNA, 12 bp, Homo sapiens
gggtgaatcttg

SEQ ID NO: 5774652 - DNA, 13 bp, Homo sapiens
gggtgacaagata

SEQ ID NO: 5774653 - DNA, 13 bp, Homo sapiens
gggtgacacagac

SEQ ID NO: 5774654 - DNA, 20 bp, Homo sapiens
gggtgacagtcatcatcagg

SEQ ID NO: 5774655 - DNA, 22 bp, Homo sapiens
gggtgacagtcatcatcagggc

SEQ ID NO: 5774656 - DNA, 14 bp, Homo sapiens
gggtgacagtcctc

SEQ ID NO: 5774657 - DNA, 18 bp, Homo sapiens
gggtgacagtgccttctc

SEQ ID NO: 5774658 - DNA, 11 bp, Homo sapiens
gggtgaccagg

SEQ ID NO: 5774659 - DNA, 19 bp, Homo sapiens
gggtgacccacagctctgg

SEQ ID NO: 5774660 - DNA, 20 bp, Homo sapiens
gggtgacccggcaccccctg

SEQ ID NO: 5774661 - DNA, 22 bp, Homo sapiens
gggtgaccgactaccccagtcc

SEQ ID NO: 5774662 - DNA, 13 bp, Homo sapiens
gggtgacgcccag

SEQ ID NO: 5774663 - DNA, 16 bp, Homo sapiens
gggtgacgcccagctc

SEQ ID NO: 5774664 - DNA, 15 bp, Homo sapiens
gggtgacgcctgaga

SEQ ID NO: 5774665 - DNA, 18 bp, Homo sapiens
gggtgacggccctcatct

SEQ ID NO: 5774666 - DNA, 20 bp, Homo sapiens
gggtgactgaatttgggcct

SEQ ID NO: 5774667 - DNA, 22 bp, Homo sapiens
gggtgactgaatttgggcctct

SEQ ID NO: 5774668 - DNA, 21 bp, Homo sapiens
gggtgacttccctggtcacca

SEQ ID NO: 5774669 - DNA, 16 bp, Homo sapiens
gggtgagaagggcagg

SEQ ID NO: 5774670 - DNA, 22 bp, Homo sapiens
gggtgagaagtacagggcagaa

SEQ ID NO: 5774671 - DNA, 17 bp, Homo sapiens
gggtgagacagtggggg

SEQ ID NO: 5774672 - DNA, 15 bp, Homo sapiens
gggtgagagacctgc

SEQ ID NO: 5774673 - DNA, 24 bp, Homo sapiens
gggtgagagacctgctcaggcgtc

SEQ ID NO: 5774674 - DNA, 13 bp, Homo sapiens
gggtgagagagga

SEQ ID NO: 5774675 - DNA, 15 bp, Homo sapiens
gggtgagagcaccca

SEQ ID NO: 5774676 - DNA, 15 bp, Homo sapiens
gggtgagatgctgga

SEQ ID NO: 5774677 - DNA, 13 bp, Homo sapiens
gggtgagccaagg

SEQ ID NO: 5774678 - DNA, 14 bp, Homo sapiens
gggtgagcctgact

SEQ ID NO: 5774679 - DNA, 20 bp, Homo sapiens
gggtgagctctcaggccgag

SEQ ID NO: 5774680 - DNA, 23 bp, Homo sapiens
gggtgaggacccgccggatgaca

SEQ ID NO: 5774681 - DNA, 16 bp, Homo sapiens
gggtgaggaggacaag

SEQ ID NO: 5774682 - DNA, 22 bp, Homo sapiens
gggtgaggcgtgggatccagag

SEQ ID NO: 5774683 - DNA, 16 bp, Homo sapiens
gggtgagggagttagg

SEQ ID NO: 5774684 - DNA, 16 bp, Homo sapiens
gggtgagggccacctc

SEQ ID NO: 5774685 - DNA, 16 bp, Homo sapiens
gggtgagggccttctt

SEQ ID NO: 5774686 - DNA, 22 bp, Homo sapiens
gggtgaggggccaggccatggc

SEQ ID NO: 5774687 - DNA, 17 bp, Homo sapiens
gggtgagggtcccatgt

SEQ ID NO: 5774688 - DNA, 13 bp, Homo sapiens
gggtgagggtgac

SEQ ID NO: 5774689 - DNA, 13 bp, Homo sapiens
gggtgaggtaggc

SEQ ID NO: 5774690 - DNA, 19 bp, Homo sapiens
gggtgagtccattctccca

SEQ ID NO: 5774691 - DNA, 18 bp, Homo sapiens
gggtgagtcctccagaac

SEQ ID NO: 5774692 - DNA, 23 bp, Homo sapiens
gggtgatcagaaggctggggcca

SEQ ID NO: 5774693 - DNA, 19 bp, Homo sapiens
gggtgatgagggcagcagc

SEQ ID NO: 5774694 - DNA, 22 bp, Homo sapiens
gggtgatgcacccattgtgatt

SEQ ID NO: 5774695 - DNA, 20 bp, Homo sapiens
gggtgatgcttttgctgctg

SEQ ID NO: 5774696 - DNA, 22 bp, Homo sapiens
gggtgatttcagagagggcaga

SEQ ID NO: 5774697 - DNA, 15 bp, Homo sapiens
gggtgatttctagaa

SEQ ID NO: 5774698 - DNA, 23 bp, Homo sapiens
gggtgattttatgatcagtgttg

SEQ ID NO: 5774699 - DNA, 16 bp, Homo sapiens
gggtgcaaagactctg

SEQ ID NO: 5774700 - DNA, 21 bp, Homo sapiens
gggtgcaaagactctgagcca

SEQ ID NO: 5774701 - DNA, 21 bp, Homo sapiens
gggtgcaatgataatgaagaa

SEQ ID NO: 5774702 - DNA, 16 bp, Homo sapiens
gggtgcacaggagggg

SEQ ID NO: 5774703 - DNA, 19 bp, Homo sapiens
gggtgcacccactcaccag

SEQ ID NO: 5774704 - DNA, 22 bp, Homo sapiens
gggtgcagatggtactgctgag

SEQ ID NO: 5774705 - DNA, 13 bp, Homo sapiens
gggtgcagcccaa

SEQ ID NO: 5774706 - DNA, 15 bp, Homo sapiens
gggtgcagctgagaa

SEQ ID NO: 5774707 - DNA, 13 bp, Homo sapiens
gggtgcagctggg

SEQ ID NO: 5774708 - DNA, 16 bp, Homo sapiens
gggtgcagctgggtgg

SEQ ID NO: 5774709 - DNA, 19 bp, Homo sapiens
gggtgcaggcagccttgac

SEQ ID NO: 5774710 - DNA, 23 bp, Homo sapiens
gggtgcagtatcatgccctgtgc

SEQ ID NO: 5774711 - DNA, 20 bp, Homo sapiens
gggtgcatatgtacagaaga

SEQ ID NO: 5774712 - DNA, 20 bp, Homo sapiens
gggtgcatcctcctcagccc

SEQ ID NO: 5774713 - DNA, 22 bp, Homo sapiens
gggtgcatcctcctcagccccc

SEQ ID NO: 5774714 - DNA, 22 bp, Homo sapiens
gggtgcatggcttggggagcag

SEQ ID NO: 5774715 - DNA, 18 bp, Homo sapiens
gggtgccaaataaatgct

SEQ ID NO: 5774716 - DNA, 23 bp, Homo sapiens
gggtgccaaccacctctggccct

SEQ ID NO: 5774717 - DNA, 17 bp, Homo sapiens
gggtgccaagtcctagc

SEQ ID NO: 5774718 - DNA, 20 bp, Homo sapiens
gggtgccacggtggacttag

SEQ ID NO: 5774719 - DNA, 13 bp, Homo sapiens
gggtgccaggtgc

SEQ ID NO: 5774720 - DNA, 19 bp, Homo sapiens
gggtgccatgtggagtgga

SEQ ID NO: 5774721 - DNA, 19 bp, Homo sapiens
gggtgccccacaaggccca

SEQ ID NO: 5774722 - DNA, 20 bp, Homo sapiens
gggtgccccacaaggcccag

SEQ ID NO: 5774723 - DNA, 21 bp, Homo sapiens
gggtgccccccttgccagaca

SEQ ID NO: 5774724 - DNA, 15 bp, Homo sapiens
gggtgccccctcctc

SEQ ID NO: 5774725 - DNA, 13 bp, Homo sapiens
gggtgcccctggg

SEQ ID NO: 5774726 - DNA, 14 bp, Homo sapiens
gggtgcccctggga

SEQ ID NO: 5774727 - DNA, 23 bp, Homo sapiens
gggtgcccgtaatcccagctact

SEQ ID NO: 5774728 - DNA, 18 bp, Homo sapiens
gggtgcccgtgtggcctg

SEQ ID NO: 5774729 - DNA, 12 bp, Homo sapiens
gggtgccctccc

SEQ ID NO: 5774730 - DNA, 14 bp, Homo sapiens
gggtgccctcccag

SEQ ID NO: 5774731 - DNA, 13 bp, Homo sapiens
gggtgccctctcc

SEQ ID NO: 5774732 - DNA, 22 bp, Homo sapiens
gggtgccctctgctcaggcctc

SEQ ID NO: 5774733 - DNA, 12 bp, Homo sapiens
gggtgccctgaa

SEQ ID NO: 5774734 - DNA, 21 bp, Homo sapiens
gggtgccgctctctctgaggg

SEQ ID NO: 5774735 - DNA, 12 bp, Homo sapiens
gggtgcctgagc

SEQ ID NO: 5774736 - DNA, 13 bp, Homo sapiens
gggtgcctgagcc

SEQ ID NO: 5774737 - DNA, 21 bp, Homo sapiens
gggtgcctgcagcgcctccct

SEQ ID NO: 5774738 - DNA, 17 bp, Homo sapiens
gggtgcctggctgggct

SEQ ID NO: 5774739 - DNA, 13 bp, Homo sapiens
gggtgccttcact

SEQ ID NO: 5774740 - DNA, 20 bp, Homo sapiens
gggtgccttgcatgcacgga

SEQ ID NO: 5774741 - DNA, 19 bp, Homo sapiens
gggtgcgaccccatctgcc

SEQ ID NO: 5774742 - DNA, 22 bp, Homo sapiens
gggtgcgaccccatctgcccag

SEQ ID NO: 5774743 - DNA, 14 bp, Homo sapiens
gggtgcgagagagg

SEQ ID NO: 5774744 - DNA, 18 bp, Homo sapiens
gggtgcgctcacctgcag

SEQ ID NO: 5774745 - DNA, 15 bp, Homo sapiens
gggtgcggcaggagc

SEQ ID NO: 5774746 - DNA, 16 bp, Homo sapiens
gggtgcggcaggagca

SEQ ID NO: 5774747 - DNA, 18 bp, Homo sapiens
gggtgctaggcccctgtg

SEQ ID NO: 5774748 - DNA, 19 bp, Homo sapiens
gggtgctagggacatggga

SEQ ID NO: 5774749 - DNA, 21 bp, Homo sapiens
gggtgctagggacatgggaaa

SEQ ID NO: 5774750 - DNA, 23 bp, Homo sapiens
gggtgctcaataaacttgtgcct

SEQ ID NO: 5774751 - DNA, 10 bp, Homo sapiens
gggtgctcag

SEQ ID NO: 5774752 - DNA, 16 bp, Homo sapiens
gggtgctccctaccac

SEQ ID NO: 5774753 - DNA, 15 bp, Homo sapiens
gggtgctcctgtgct

SEQ ID NO: 5774754 - DNA, 18 bp, Homo sapiens
gggtgctctgaggtcaat

SEQ ID NO: 5774755 - DNA, 13 bp, Homo sapiens
gggtgctgccagc

SEQ ID NO: 5774756 - DNA, 17 bp, Homo sapiens
gggtgctgccatgacag

SEQ ID NO: 5774757 - DNA, 21 bp, Homo sapiens
gggtgctgcttccctctgcct

SEQ ID NO: 5774758 - DNA, 18 bp, Homo sapiens
gggtgctggcccccagga

SEQ ID NO: 5774759 - DNA, 18 bp, Homo sapiens
gggtgctgggaggaggga

SEQ ID NO: 5774760 - DNA, 17 bp, Homo sapiens
gggtgctgggcccctgc

SEQ ID NO: 5774761 - DNA, 20 bp, Homo sapiens
gggtgcttttatagaggcta

SEQ ID NO: 5774762 - DNA, 22 bp, Homo sapiens
gggtggaagcctcagaggcctt

SEQ ID NO: 5774763 - DNA, 14 bp, Homo sapiens
gggtggaagggcag

SEQ ID NO: 5774764 - DNA, 18 bp, Homo sapiens
gggtggaagggcaggagc

SEQ ID NO: 5774765 - DNA, 17 bp, Homo sapiens
gggtggaagtgcccagc

SEQ ID NO: 5774766 - DNA, 22 bp, Homo sapiens
gggtggaatgccgctgtctctg

SEQ ID NO: 5774767 - DNA, 20 bp, Homo sapiens
gggtggaccacgccgccctc

SEQ ID NO: 5774768 - DNA, 21 bp, Homo sapiens
gggtggaccacgccgccctcc

SEQ ID NO: 5774769 - DNA, 23 bp, Homo sapiens
gggtggaccaggcctggagggca

SEQ ID NO: 5774770 - DNA, 15 bp, Homo sapiens
gggtggacgagggag

SEQ ID NO: 5774771 - DNA, 12 bp, Homo sapiens
gggtggagaagc

SEQ ID NO: 5774772 - DNA, 16 bp, Homo sapiens
gggtggagaagccatt

SEQ ID NO: 5774773 - DNA, 14 bp, Homo sapiens
gggtggagaaggga

SEQ ID NO: 5774774 - DNA, 16 bp, Homo sapiens
gggtggaggcttcctg

SEQ ID NO: 5774775 - DNA, 14 bp, Homo sapiens
gggtggaggggtgt

SEQ ID NO: 5774776 - DNA, 13 bp, Homo sapiens
gggtggagtccca

SEQ ID NO: 5774777 - DNA, 21 bp, Homo sapiens
gggtggatataaatatatata

SEQ ID NO: 5774778 - DNA, 15 bp, Homo sapiens
gggtggatcacctgt

SEQ ID NO: 5774779 - DNA, 17 bp, Homo sapiens
gggtggatgtgagcaga

SEQ ID NO: 5774780 - DNA, 21 bp, Homo sapiens
gggttgcgggggagctggaaa

SEQ ID NO: 5774781 - DNA, 23 bp, Homo sapiens
gggttggacgggatgacctccag

SEQ ID NO: 5774782 - DNA, 21 bp, Homo sapiens
gggttggagcagtagctggag

SEQ ID NO: 5774783 - DNA, 14 bp, Homo sapiens
gggttggcacctgc

SEQ ID NO: 5774784 - DNA, 16 bp, Homo sapiens
gggttggcagcgcctc

SEQ ID NO: 5774785 - DNA, 23 bp, Homo sapiens
gggttggccagagggcccctcac

SEQ ID NO: 5774786 - DNA, 19 bp, Homo sapiens
gggttggcccctgcccggc

SEQ ID NO: 5774787 - DNA, 17 bp, Homo sapiens
gggttggctgttccaga

SEQ ID NO: 5774788 - DNA, 17 bp, Homo sapiens
gggttggcttccctggc

SEQ ID NO: 5774789 - DNA, 12 bp, Homo sapiens
gggttgggccca

SEQ ID NO: 5774790 - DNA, 22 bp, Homo sapiens
gggttgggcccagatctggtcc

SEQ ID NO: 5774791 - DNA, 15 bp, Homo sapiens
gggttggggccgggc

SEQ ID NO: 5774792 - DNA, 17 bp, Homo sapiens
gggttgggggcactcag

SEQ ID NO: 5774793 - DNA, 18 bp, Homo sapiens
gggttgggggcactcagc

SEQ ID NO: 5774794 - DNA, 12 bp, Homo sapiens
gggttggggggg

SEQ ID NO: 5774795 - DNA, 12 bp, Homo sapiens
gggttggggtgg

SEQ ID NO: 5774796 - DNA, 23 bp, Homo sapiens
gggttggtcaggagaatgaaaca

SEQ ID NO: 5774797 - DNA, 21 bp, Homo sapiens
gggttgtgaggcctggccagg

SEQ ID NO: 5774798 - DNA, 15 bp, Homo sapiens
gggttgtgtgtctgt

SEQ ID NO: 5774799 - DNA, 14 bp, Homo sapiens
gggttgtttccagg

SEQ ID NO: 5774800 - DNA, 23 bp, Homo sapiens
gggtttaagctctgccccttccc

SEQ ID NO: 5774801 - DNA, 19 bp, Homo sapiens
gggtttaatccccagtaaa

SEQ ID NO: 5774802 - DNA, 22 bp, Homo sapiens
gggtttaatccccagtaaaatt

SEQ ID NO: 5774803 - DNA, 23 bp, Homo sapiens
gggtttaatccccagtaaaattg

SEQ ID NO: 5774804 - DNA, 20 bp, Homo sapiens
gggtttacccagtgggacag

SEQ ID NO: 5774805 - DNA, 20 bp, Homo sapiens
gggtttagaaccccaggtga

SEQ ID NO: 5774806 - DNA, 20 bp, Homo sapiens
gggtttcaccatgttagccg

SEQ ID NO: 5774807 - DNA, 20 bp, Homo sapiens
gggtttcaccatgttggcca

SEQ ID NO: 5774808 - DNA, 15 bp, Homo sapiens
gggtttccacacagc

SEQ ID NO: 5774809 - DNA, 16 bp, Homo sapiens
gggtttccacacaggc

SEQ ID NO: 5774810 - DNA, 15 bp, Homo sapiens
gggtttcctgcaggc

SEQ ID NO: 5774811 - DNA, 19 bp, Homo sapiens
gggtttcgactggtccagc

SEQ ID NO: 5774812 - DNA, 13 bp, Homo sapiens
gggtttctctccc

SEQ ID NO: 5774813 - DNA, 16 bp, Homo sapiens
gggtttctctgtggct

SEQ ID NO: 5774814 - DNA, 15 bp, Homo sapiens
gggtttctgccctgc

SEQ ID NO: 5774815 - DNA, 14 bp, Homo sapiens
gggtttgaattgtt

SEQ ID NO: 5774816 - DNA, 16 bp, Homo sapiens
gggtttgagacagaca

SEQ ID NO: 5774817 - DNA, 18 bp, Homo sapiens
gggtttgaggataggagt

SEQ ID NO: 5774818 - DNA, 18 bp, Homo sapiens
gggtttgcactccacaca

SEQ ID NO: 5774819 - DNA, 17 bp, Homo sapiens
gggtttgccatttgata

SEQ ID NO: 5774820 - DNA, 13 bp, Homo sapiens
gggtttgcccagt

SEQ ID NO: 5774821 - DNA, 15 bp, Homo sapiens
gggtttgctcatgta

SEQ ID NO: 5774822 - DNA, 15 bp, Homo sapiens
gggtttggacagacc

SEQ ID NO: 5774823 - DNA, 19 bp, Homo sapiens
gggtttggaccccagctgg

SEQ ID NO: 5774824 - DNA, 13 bp, Homo sapiens
gggtttggccagg

SEQ ID NO: 5774825 - DNA, 13 bp, Homo sapiens
gggtttggcccaa

SEQ ID NO: 5774826 - DNA, 14 bp, Homo sapiens
gggtttgggcagtg

SEQ ID NO: 5774827 - DNA, 16 bp, Homo sapiens
gggtttgggcccctca

SEQ ID NO: 5774828 - DNA, 20 bp, Homo sapiens
gggtttgggcccctcagagc

SEQ ID NO: 5774829 - DNA, 14 bp, Homo sapiens
gggtttgggtgcct

SEQ ID NO: 5774830 - DNA, 15 bp, Homo sapiens
gggtttgtcagagga

SEQ ID NO: 5774831 - DNA, 21 bp, Homo sapiens
gggtttgtgtttgattggctt

SEQ ID NO: 5774832 - DNA, 23 bp, Homo sapiens
gggtttgtgtttgattggctttc

SEQ ID NO: 5774833 - DNA, 16 bp, Homo sapiens
gggttttaactttgtt

SEQ ID NO: 5774834 - DNA, 18 bp, Homo sapiens
gggttttccaatgtgact

SEQ ID NO: 5774835 - DNA, 17 bp, Homo sapiens
gggttttccgcccacag

SEQ ID NO: 5774836 - DNA, 12 bp, Homo sapiens
gggttttctctc

SEQ ID NO: 5774837 - DNA, 12 bp, Homo sapiens
gggttttggcct

SEQ ID NO: 5774838 - DNA, 12 bp, Homo sapiens
gggttttgtatt

SEQ ID NO: 5774839 - DNA, 19 bp, Homo sapiens
gggtttttagagaatgtgt

SEQ ID NO: 5774840 - DNA, 19 bp, Homo sapiens
gggtttttattatttttac

SEQ ID NO: 5774841 - DNA, 23 bp, Homo sapiens
gggtttttatttcctatgatgta

SEQ ID NO: 5774842 - DNA, 14 bp, Homo sapiens
gggtttttcttgtg

SEQ ID NO: 5774843 - DNA, 14 bp, Homo sapiens
gggtttttgctgtt

SEQ ID NO: 5774844 - DNA, 16 bp, Homo sapiens
gggttttttgggaaga

SEQ ID NO: 5774845 - DNA, 12 bp, Homo sapiens
ggtaaaaacagc

SEQ ID NO: 5774846 - DNA, 18 bp, Homo sapiens
ggtaaaaaggatgaaagt

SEQ ID NO: 5774847 - DNA, 18 bp, Homo sapiens
ggtaaaaagtggctgcgg

SEQ ID NO: 5774848 - DNA, 13 bp, Homo sapiens
ggtaaaacacttg

SEQ ID NO: 5774849 - DNA, 18 bp, Homo sapiens
ggtaaaacagggccacat

SEQ ID NO: 5774850 - DNA, 14 bp, Homo sapiens
ggtaaaacagtttc

SEQ ID NO: 5774851 - DNA, 17 bp, Homo sapiens
ggtaaaagcagggcagc

SEQ ID NO: 5774852 - DNA, 19 bp, Homo sapiens
ggtaaaatcctctccagaa

SEQ ID NO: 5774853 - DNA, 13 bp, Homo sapiens
ggtaaaatgccat

SEQ ID NO: 5774854 - DNA, 16 bp, Homo sapiens
ggtaaaattagatgca

SEQ ID NO: 5774855 - DNA, 22 bp, Homo sapiens
ggtaaaattagatgcatgttga

SEQ ID NO: 5774856 - DNA, 13 bp, Homo sapiens
ggtaaaattttgt

SEQ ID NO: 5774857 - DNA, 20 bp, Homo sapiens
ggtaaacccattttgaatat

SEQ ID NO: 5774858 - DNA, 19 bp, Homo sapiens
ggtaaactagctttgctct

SEQ ID NO: 5774859 - DNA, 23 bp, Homo sapiens
ggtaaagccatgttaaatgactt

SEQ ID NO: 5774860 - DNA, 20 bp, Homo sapiens
ggtaaagccctcagatccca

SEQ ID NO: 5774861 - DNA, 22 bp, Homo sapiens
ggtaaagccctcagatcccagg

SEQ ID NO: 5774862 - DNA, 22 bp, Homo sapiens
ggtaaaggagcatttttttatt

SEQ ID NO: 5774863 - DNA, 20 bp, Homo sapiens
ggtaaataaaccactgtgcg

SEQ ID NO: 5774864 - DNA, 13 bp, Homo sapiens
ggtaaataaatgc

SEQ ID NO: 5774865 - DNA, 14 bp, Homo sapiens
ggtaaataaatgct

SEQ ID NO: 5774866 - DNA, 18 bp, Homo sapiens
ggtaaatatatgttttga

SEQ ID NO: 5774867 - DNA, 22 bp, Homo sapiens
ggtaaatatatgttttgagaaa

SEQ ID NO: 5774868 - DNA, 23 bp, Homo sapiens
ggtaaatatatgttttgagaaaa

SEQ ID NO: 5774869 - DNA, 21 bp, Homo sapiens
ggtaaatatgactcctttctc

SEQ ID NO: 5774870 - DNA, 15 bp, Homo sapiens
ggtaaatcccacatc

SEQ ID NO: 5774871 - DNA, 16 bp, Homo sapiens
ggtaaatctagagttt

SEQ ID NO: 5774872 - DNA, 20 bp, Homo sapiens
ggtaaatggttaaattttac

SEQ ID NO: 5774873 - DNA, 16 bp, Homo sapiens
ggtaaattataaatgt

SEQ ID NO: 5774874 - DNA, 22 bp, Homo sapiens
ggtaaatttccccaacagtgtg

SEQ ID NO: 5774875 - DNA, 13 bp, Homo sapiens
ggtaaatttctgt

SEQ ID NO: 5774876 - DNA, 20 bp, Homo sapiens
ggtaaattttataatgtcat

SEQ ID NO: 5774877 - DNA, 20 bp, Homo sapiens
ggtaaatttttaggcaaaga

SEQ ID NO: 5774878 - DNA, 17 bp, Homo sapiens
ggtaaatttttgaaaaa

SEQ ID NO: 5774879 - DNA, 20 bp, Homo sapiens
ggtaaatttttgaaaaatat

SEQ ID NO: 5774880 - DNA, 21 bp, Homo sapiens
ggtaaatttttgaaaaatatt

SEQ ID NO: 5774881 - DNA, 15 bp, Homo sapiens
ggtaacagaacagct

SEQ ID NO: 5774882 - DNA, 21 bp, Homo sapiens
ggtaacagaacagcttcaggt

SEQ ID NO: 5774883 - DNA, 19 bp, Homo sapiens
ggtaacagatttgctccta

SEQ ID NO: 5774884 - DNA, 18 bp, Homo sapiens
ggtaacagggagactgca

SEQ ID NO: 5774885 - DNA, 21 bp, Homo sapiens
ggtaacagttcatgtttgctt

SEQ ID NO: 5774886 - DNA, 16 bp, Homo sapiens
ggtaacatagatgcct

SEQ ID NO: 5774887 - DNA, 19 bp, Homo sapiens
ggtaacatagatgcctggg

SEQ ID NO: 5774888 - DNA, 23 bp, Homo sapiens
ggtaacatagatgcctgggcctg

SEQ ID NO: 5774889 - DNA, 20 bp, Homo sapiens
ggtaacatgtttattgagct

SEQ ID NO: 5774890 - DNA, 12 bp, Homo sapiens
ggtaaccagccc

SEQ ID NO: 5774891 - DNA, 22 bp, Homo sapiens
ggtaacgtgattgattcagtat

SEQ ID NO: 5774892 - DNA, 13 bp, Homo sapiens
ggtaactaactgc

SEQ ID NO: 5774893 - DNA, 14 bp, Homo sapiens
ggtaactaactgct

SEQ ID NO: 5774894 - DNA, 17 bp, Homo sapiens
ggtaactaattggaagg

SEQ ID NO: 5774895 - DNA, 16 bp, Homo sapiens
ggtaactcgaggtgga

SEQ ID NO: 5774896 - DNA, 19 bp, Homo sapiens
ggtaactcttggccagagc

SEQ ID NO: 5774897 - DNA, 21 bp, Homo sapiens
ggtaactgcacctgggcagct

SEQ ID NO: 5774898 - DNA, 13 bp, Homo sapiens
ggtaactgccagc

SEQ ID NO: 5774899 - DNA, 20 bp, Homo sapiens
ggtaactgcctggcctggca

SEQ ID NO: 5774900 - DNA, 18 bp, Homo sapiens
ggtaactgctttctgttc

SEQ ID NO: 5774901 - DNA, 12 bp, Homo sapiens
ggtaactgtcct

SEQ ID NO: 5774902 - DNA, 13 bp, Homo sapiens
ggtaactgtcctg

SEQ ID NO: 5774903 - DNA, 16 bp, Homo sapiens
ggtaacttgcacctct

SEQ ID NO: 5774904 - DNA, 17 bp, Homo sapiens
ggtaactttatttaaaa

SEQ ID NO: 5774905 - DNA, 23 bp, Homo sapiens
ggtaagaaagccaccttgttaca

SEQ ID NO: 5774906 - DNA, 13 bp, Homo sapiens
ggtaagaagaaag

SEQ ID NO: 5774907 - DNA, 23 bp, Homo sapiens
ggtaagaagccgggaacagacaa

SEQ ID NO: 5774908 - DNA, 19 bp, Homo sapiens
ggtaagaatagtagatgtg

SEQ ID NO: 5774909 - DNA, 16 bp, Homo sapiens
ggtaagatgactctga

SEQ ID NO: 5774910 - DNA, 18 bp, Homo sapiens
ggtaagatgactctgaga

SEQ ID NO: 5774911 - DNA, 22 bp, Homo sapiens
ggtaagatgttaatctcccagc

SEQ ID NO: 5774912 - DNA, 18 bp, Homo sapiens
ggtaagattgttattaaa

SEQ ID NO: 5774913 - DNA, 20 bp, Homo sapiens
ggtaagcacttaatgaatga

SEQ ID NO: 5774914 - DNA, 13 bp, Homo sapiens
ggtaagggaggga

SEQ ID NO: 5774915 - DNA, 23 bp, Homo sapiens
ggtaagtgttctcatgaagcagg

SEQ ID NO: 5774916 - DNA, 19 bp, Homo sapiens
ggtaagtttcagtggagct

SEQ ID NO: 5774917 - DNA, 20 bp, Homo sapiens
ggtaatcttgctctgcttga

SEQ ID NO: 5774918 - DNA, 18 bp, Homo sapiens
ggtaatgcacatcctcat

SEQ ID NO: 5774919 - DNA, 20 bp, Homo sapiens
ggtaatgcacgacattgatt

SEQ ID NO: 5774920 - DNA, 16 bp, Homo sapiens
ggtaatggaggccaag

SEQ ID NO: 5774921 - DNA, 23 bp, Homo sapiens
ggtaatgttttgtatatacagtt

SEQ ID NO: 5774922 - DNA, 15 bp, Homo sapiens
ggtaattaaggcagc

SEQ ID NO: 5774923 - DNA, 23 bp, Homo sapiens
ggtaattattttggtacttttat

SEQ ID NO: 5774924 - DNA, 13 bp, Homo sapiens
ggtaattgtacaa

SEQ ID NO: 5774925 - DNA, 20 bp, Homo sapiens
ggtaattgtacaataaattt

SEQ ID NO: 5774926 - DNA, 20 bp, Homo sapiens
ggtaattgttttttaaagca

SEQ ID NO: 5774927 - DNA, 20 bp, Homo sapiens
ggtaatttttaccctaatgt

SEQ ID NO: 5774928 - DNA, 15 bp, Homo sapiens
ggtaatttttgtaca

SEQ ID NO: 5774929 - DNA, 21 bp, Homo sapiens
ggtacaacctttattcttttc

SEQ ID NO: 5774930 - DNA, 14 bp, Homo sapiens
ggtacaactgtatt

SEQ ID NO: 5774931 - DNA, 13 bp, Homo sapiens
ggtacaagagcca

SEQ ID NO: 5774932 - DNA, 17 bp, Homo sapiens
ggtacaatctggctcac

SEQ ID NO: 5774933 - DNA, 19 bp, Homo sapiens
ggtacacaactagttttgt

SEQ ID NO: 5774934 - DNA, 14 bp, Homo sapiens
ggtacacctccccc

SEQ ID NO: 5774935 - DNA, 15 bp, Homo sapiens
ggtacacctccccct

SEQ ID NO: 5774936 - DNA, 15 bp, Homo sapiens
ggtacacttgtgaat

SEQ ID NO: 5774937 - DNA, 12 bp, Homo sapiens
ggtacagatccc

SEQ ID NO: 5774938 - DNA, 18 bp, Homo sapiens
ggtacagatccccagccc

SEQ ID NO: 5774939 - DNA, 21 bp, Homo sapiens
ggtacagcagggtcttgctgt

SEQ ID NO: 5774940 - DNA, 16 bp, Homo sapiens
ggtacagcgggctgtg

SEQ ID NO: 5774941 - DNA, 17 bp, Homo sapiens
ggtacagcgggctgtgc

SEQ ID NO: 5774942 - DNA, 19 bp, Homo sapiens
ggtacagcgggctgtgccc

SEQ ID NO: 5774943 - DNA, 14 bp, Homo sapiens
ggtacagcttctgg

SEQ ID NO: 5774944 - DNA, 16 bp, Homo sapiens
ggtacaggagaggcag

SEQ ID NO: 5774945 - DNA, 19 bp, Homo sapiens
ggtacagttcataattcac

SEQ ID NO: 5774946 - DNA, 20 bp, Homo sapiens
ggtacatcattattgtagtt

SEQ ID NO: 5774947 - DNA, 16 bp, Homo sapiens
ggtacatggtgctggg

SEQ ID NO: 5774948 - DNA, 14 bp, Homo sapiens
ggtacattcacagc

SEQ ID NO: 5774949 - DNA, 19 bp, Homo sapiens
ggtacatttataattgcat

SEQ ID NO: 5774950 - DNA, 15 bp, Homo sapiens
ggtacatttccctgt

SEQ ID NO: 5774951 - DNA, 18 bp, Homo sapiens
ggtacatttccctgtgct

SEQ ID NO: 5774952 - DNA, 16 bp, Homo sapiens
ggtacatttttcaact

SEQ ID NO: 5774953 - DNA, 17 bp, Homo sapiens
ggtacatttttcaactt

SEQ ID NO: 5774954 - DNA, 23 bp, Homo sapiens
ggtacatttttcaactttgaata

SEQ ID NO: 5774955 - DNA, 16 bp, Homo sapiens
ggtaccaaaaaagaaa

SEQ ID NO: 5774956 - DNA, 15 bp, Homo sapiens
ggtaccaatgctgca

SEQ ID NO: 5774957 - DNA, 22 bp, Homo sapiens
ggtaccacccttcagaccccag

SEQ ID NO: 5774958 - DNA, 14 bp, Homo sapiens
ggtaccactgattt

SEQ ID NO: 5774959 - DNA, 22 bp, Homo sapiens
ggtaccagatgcagctcaagag

SEQ ID NO: 5774960 - DNA, 13 bp, Homo sapiens
ggtaccagccact

SEQ ID NO: 5774961 - DNA, 15 bp, Homo sapiens
ggtaccagctgcgct

SEQ ID NO: 5774962 - DNA, 18 bp, Homo sapiens
ggtaccaggccacccact

SEQ ID NO: 5774963 - DNA, 20 bp, Homo sapiens
ggtaccaggtctcctccacc

SEQ ID NO: 5774964 - DNA, 21 bp, Homo sapiens
ggtaccagtgttagtgggaag

SEQ ID NO: 5774965 - DNA, 22 bp, Homo sapiens
ggtaccagtgttagtgggaaga

SEQ ID NO: 5774966 - DNA, 14 bp, Homo sapiens
ggtacccaaaacac

SEQ ID NO: 5774967 - DNA, 20 bp, Homo sapiens
ggtacccagccatctgccca

SEQ ID NO: 5774968 - DNA, 21 bp, Homo sapiens
ggtacccagccatctgcccag

SEQ ID NO: 5774969 - DNA, 19 bp, Homo sapiens
ggtacccctttctggctct

SEQ ID NO: 5774970 - DNA, 15 bp, Homo sapiens
ggtaccctggcagag

SEQ ID NO: 5774971 - DNA, 20 bp, Homo sapiens
ggtaccctttggggagcagg

SEQ ID NO: 5774972 - DNA, 15 bp, Homo sapiens
ggtaccgatttctgc

SEQ ID NO: 5774973 - DNA, 18 bp, Homo sapiens
ggtaccgtctacatttca

SEQ ID NO: 5774974 - DNA, 16 bp, Homo sapiens
ggtacctcaagcccca

SEQ ID NO: 5774975 - DNA, 14 bp, Homo sapiens
ggtacctcatgagg

SEQ ID NO: 5774976 - DNA, 17 bp, Homo sapiens
ggtacctgcaagcagaa

SEQ ID NO: 5774977 - DNA, 19 bp, Homo sapiens
ggtacctggtccccactgc

SEQ ID NO: 5774978 - DNA, 13 bp, Homo sapiens
ggtacctgtgctt

SEQ ID NO: 5774979 - DNA, 24 bp, Homo sapiens
ggtaccttgcacacatcatctgta

SEQ ID NO: 5774980 - DNA, 22 bp, Homo sapiens
ggtacctttccacccagaccct

SEQ ID NO: 5774981 - DNA, 23 bp, Homo sapiens
ggtacctttccacccagaccctc

SEQ ID NO: 5774982 - DNA, 14 bp, Homo sapiens
ggtacgcacagaca

SEQ ID NO: 5774983 - DNA, 15 bp, Homo sapiens
ggtacgcacagacag

SEQ ID NO: 5774984 - DNA, 18 bp, Homo sapiens
ggtacgcagcccagagca

SEQ ID NO: 5774985 - DNA, 13 bp, Homo sapiens
ggtacggagaaga

SEQ ID NO: 5774986 - DNA, 15 bp, Homo sapiens
ggtactaaggagaat

SEQ ID NO: 5774987 - DNA, 22 bp, Homo sapiens
ggtactactgctgcaaagtgca

SEQ ID NO: 5774988 - DNA, 17 bp, Homo sapiens
ggtactcccaaactgac

SEQ ID NO: 5774989 - DNA, 22 bp, Homo sapiens
ggtactcccaaactgacaattt

SEQ ID NO: 5774990 - DNA, 22 bp, Homo sapiens
ggtactcgcacctcttggcttt

SEQ ID NO: 5774991 - DNA, 19 bp, Homo sapiens
ggtactctccaaaggccct

SEQ ID NO: 5774992 - DNA, 12 bp, Homo sapiens
ggtactctccta

SEQ ID NO: 5774993 - DNA, 14 bp, Homo sapiens
ggtactctcctaga

SEQ ID NO: 5774994 - DNA, 16 bp, Homo sapiens
ggtactctcctagaga

SEQ ID NO: 5774995 - DNA, 12 bp, Homo sapiens
ggtactctgtgt

SEQ ID NO: 5774996 - DNA, 15 bp, Homo sapiens
ggtactctgtgtctg

SEQ ID NO: 5774997 - DNA, 15 bp, Homo sapiens
ggtactcttgttgag

SEQ ID NO: 5774998 - DNA, 18 bp, Homo sapiens
ggtactgactttgcttgc

SEQ ID NO: 5774999 - DNA, 16 bp, Homo sapiens
ggtactgcacattttg

SEQ ID NO: 5775000 - DNA, 20 bp, Homo sapiens
ggtactgtacagctggctct

SEQ ID NO: 5775001 - DNA, 14 bp, Homo sapiens
ggtactgtagcagg

SEQ ID NO: 5775002 - DNA, 20 bp, Homo sapiens
ggtactgtatgatcaaatgt

SEQ ID NO: 5775003 - DNA, 19 bp, Homo sapiens
ggtactgtctcggcagagg

SEQ ID NO: 5775004 - DNA, 20 bp, Homo sapiens
ggtactgtctcggcagaggt

SEQ ID NO: 5775005 - DNA, 18 bp, Homo sapiens
ggtactgtctgcttctct

SEQ ID NO: 5775006 - DNA, 17 bp, Homo sapiens
ggtactgtggggtggac

SEQ ID NO: 5775007 - DNA, 21 bp, Homo sapiens
ggtacttcctcctgatggcca

SEQ ID NO: 5775008 - DNA, 16 bp, Homo sapiens
ggtacttgtcatttcg

SEQ ID NO: 5775009 - DNA, 21 bp, Homo sapiens
ggtacttgtggacacagctct

SEQ ID NO: 5775010 - DNA, 22 bp, Homo sapiens
ggtacttgtggacacagctctt

SEQ ID NO: 5775011 - DNA, 15 bp, Homo sapiens
ggtactttctgaaaa

SEQ ID NO: 5775012 - DNA, 11 bp, Homo sapiens
ggtagaaaaac

SEQ ID NO: 5775013 - DNA, 15 bp, Homo sapiens
ggtagaaaatgtttt

SEQ ID NO: 5775014 - DNA, 16 bp, Homo sapiens
ggtagaaactttggaa

SEQ ID NO: 5775015 - DNA, 22 bp, Homo sapiens
ggtagaaactttggaagtttta

SEQ ID NO: 5775016 - DNA, 20 bp, Homo sapiens
ggtagaaagagatacagagg

SEQ ID NO: 5775017 - DNA, 22 bp, Homo sapiens
ggtagaaatatctgaaaatgta

SEQ ID NO: 5775018 - DNA, 15 bp, Homo sapiens
ggtagaaatgattca

SEQ ID NO: 5775019 - DNA, 11 bp, Homo sapiens
ggtagaaatgc

SEQ ID NO: 5775020 - DNA, 15 bp, Homo sapiens
ggtagaacactgcta

SEQ ID NO: 5775021 - DNA, 14 bp, Homo sapiens
ggtagaacgccagg

SEQ ID NO: 5775022 - DNA, 18 bp, Homo sapiens
ggtagaagccacccttcc

SEQ ID NO: 5775023 - DNA, 22 bp, Homo sapiens
ggtagaagccacccttccctgc

SEQ ID NO: 5775024 - DNA, 18 bp, Homo sapiens
ggtagaagctgaagagca

SEQ ID NO: 5775025 - DNA, 18 bp, Homo sapiens
ggtagaattgggaagctg

SEQ ID NO: 5775026 - DNA, 23 bp, Homo sapiens
ggtagaattgggaagctggggga

SEQ ID NO: 5775027 - DNA, 14 bp, Homo sapiens
ggtagacctgtctc

SEQ ID NO: 5775028 - DNA, 17 bp, Homo sapiens
ggtagaccttgagggtg

SEQ ID NO: 5775029 - DNA, 19 bp, Homo sapiens
ggtagaccttgagggtggg

SEQ ID NO: 5775030 - DNA, 18 bp, Homo sapiens
ggtagacctttattgggt

SEQ ID NO: 5775031 - DNA, 15 bp, Homo sapiens
ggtagactgagggat

SEQ ID NO: 5775032 - DNA, 14 bp, Homo sapiens
ggtagactttgctt

SEQ ID NO: 5775033 - DNA, 15 bp, Homo sapiens
ggtagagacccccag

SEQ ID NO: 5775034 - DNA, 22 bp, Homo sapiens
ggtagagaggtttttcttggga

SEQ ID NO: 5775035 - DNA, 18 bp, Homo sapiens
ggtagagcaaaggagaca

SEQ ID NO: 5775036 - DNA, 14 bp, Homo sapiens
ggtagaggagggca

SEQ ID NO: 5775037 - DNA, 17 bp, Homo sapiens
ggtagaggatgaggaaa

SEQ ID NO: 5775038 - DNA, 13 bp, Homo sapiens
ggtagaggcctgg

SEQ ID NO: 5775039 - DNA, 22 bp, Homo sapiens
ggtagaggctccccagggctcc

SEQ ID NO: 5775040 - DNA, 20 bp, Homo sapiens
ggtagaggtgcatgcctaat

SEQ ID NO: 5775041 - DNA, 14 bp, Homo sapiens
ggtagagttggaaa

SEQ ID NO: 5775042 - DNA, 18 bp, Homo sapiens
ggtagagtttacagctct

SEQ ID NO: 5775043 - DNA, 23 bp, Homo sapiens
ggtagagtttgaaggaggtgagg

SEQ ID NO: 5775044 - DNA, 18 bp, Homo sapiens
ggtagatcgcttgagccc

SEQ ID NO: 5775045 - DNA, 21 bp, Homo sapiens
ggtagatcgcttgagcccagg

SEQ ID NO: 5775046 - DNA, 15 bp, Homo sapiens
ggtagatgctgaggc

SEQ ID NO: 5775047 - DNA, 18 bp, Homo sapiens
ggtagatgggtgggggct

SEQ ID NO: 5775048 - DNA, 14 bp, Homo sapiens
ggtagatgttcaga

SEQ ID NO: 5775049 - DNA, 20 bp, Homo sapiens
ggtagcacagattttgaatc

SEQ ID NO: 5775050 - DNA, 19 bp, Homo sapiens
ggtagcagataaagacagc

SEQ ID NO: 5775051 - DNA, 20 bp, Homo sapiens
ggtagcagataaagacagct

SEQ ID NO: 5775052 - DNA, 21 bp, Homo sapiens
ggtagcagataaagacagctg

SEQ ID NO: 5775053 - DNA, 22 bp, Homo sapiens
ggtagcagataaagacagctga

SEQ ID NO: 5775054 - DNA, 13 bp, Homo sapiens
ggtagcagcaggc

SEQ ID NO: 5775055 - DNA, 21 bp, Homo sapiens
ggtagcataaataaaactgaa

SEQ ID NO: 5775056 - DNA, 16 bp, Homo sapiens
ggtagcatgacctttt

SEQ ID NO: 5775057 - DNA, 22 bp, Homo sapiens
ggtagcatgggtccaagagaca

SEQ ID NO: 5775058 - DNA, 23 bp, Homo sapiens
ggtagccaccaccggggcactgg

SEQ ID NO: 5775059 - DNA, 22 bp, Homo sapiens
ggtagccatcaagcacttccca

SEQ ID NO: 5775060 - DNA, 12 bp, Homo sapiens
ggtagccatccc

SEQ ID NO: 5775061 - DNA, 20 bp, Homo sapiens
ggtagcccagcactgtgaag

SEQ ID NO: 5775062 - DNA, 19 bp, Homo sapiens
ggtagccccctcttccctg

SEQ ID NO: 5775063 - DNA, 18 bp, Homo sapiens
ggtagccctggccagagg

SEQ ID NO: 5775064 - DNA, 14 bp, Homo sapiens
ggtagcctgctgtg

SEQ ID NO: 5775065 - DNA, 18 bp, Homo sapiens
ggtagccttgtgttctga

SEQ ID NO: 5775066 - DNA, 17 bp, Homo sapiens
ggtagctcaggtgggcg

SEQ ID NO: 5775067 - DNA, 13 bp, Homo sapiens
ggtagctccagcg

SEQ ID NO: 5775068 - DNA, 16 bp, Homo sapiens
ggtagctcccagcact

SEQ ID NO: 5775069 - DNA, 15 bp, Homo sapiens
ggtagctctgaaggg

SEQ ID NO: 5775070 - DNA, 19 bp, Homo sapiens
ggtagctctgaagggaggg

SEQ ID NO: 5775071 - DNA, 12 bp, Homo sapiens
ggtagctctgag

SEQ ID NO: 5775072 - DNA, 17 bp, Homo sapiens
ggtagctctgagccctc

SEQ ID NO: 5775073 - DNA, 12 bp, Homo sapiens
ggtagctgaggg

SEQ ID NO: 5775074 - DNA, 19 bp, Homo sapiens
ggtagctgcccctggctct

SEQ ID NO: 5775075 - DNA, 22 bp, Homo sapiens
ggtagctgggattacaggtgtg

SEQ ID NO: 5775076 - DNA, 13 bp, Homo sapiens
ggtagctggggag

SEQ ID NO: 5775077 - DNA, 21 bp, Homo sapiens
ggtagctgtaaggcatgaagg

SEQ ID NO: 5775078 - DNA, 19 bp, Homo sapiens
ggtagcttgtatcaaatgt

SEQ ID NO: 5775079 - DNA, 14 bp, Homo sapiens
ggtagcttttccct

SEQ ID NO: 5775080 - DNA, 20 bp, Homo sapiens
ggtaggaaaccaccctgagg

SEQ ID NO: 5775081 - DNA, 12 bp, Homo sapiens
ggtaggaaatgt

SEQ ID NO: 5775082 - DNA, 21 bp, Homo sapiens
ggtaggaatattatatttgga

SEQ ID NO: 5775083 - DNA, 12 bp, Homo sapiens
ggtaggaatttc

SEQ ID NO: 5775084 - DNA, 20 bp, Homo sapiens
ggtaggagaggagaaaaaaa

SEQ ID NO: 5775085 - DNA, 18 bp, Homo sapiens
ggtaggagcccttctctt

SEQ ID NO: 5775086 - DNA, 20 bp, Homo sapiens
ggtaggagcccttctctttg

SEQ ID NO: 5775087 - DNA, 13 bp, Homo sapiens
ggtaggaggaaca

SEQ ID NO: 5775088 - DNA, 16 bp, Homo sapiens
ggtaggaggcaaaggt

SEQ ID NO: 5775089 - DNA, 17 bp, Homo sapiens
ggtaggatgttgcttct

SEQ ID NO: 5775090 - DNA, 14 bp, Homo sapiens
ggtaggcagagcct

SEQ ID NO: 5775091 - DNA, 22 bp, Homo sapiens
ggtaggccaagctgaagtgaag

SEQ ID NO: 5775092 - DNA, 11 bp, Homo sapiens
ggtaggccctt

SEQ ID NO: 5775093 - DNA, 16 bp, Homo sapiens
ggtaggcccttgtcct

SEQ ID NO: 5775094 - DNA, 20 bp, Homo sapiens
ggtaggcccttgtcctgcca

SEQ ID NO: 5775095 - DNA, 21 bp, Homo sapiens
ggtaggcccttgtcctgccag

SEQ ID NO: 5775096 - DNA, 19 bp, Homo sapiens
ggtaggctgctccctgagg

SEQ ID NO: 5775097 - DNA, 18 bp, Homo sapiens
ggtaggctgctgccctgc

SEQ ID NO: 5775098 - DNA, 13 bp, Homo sapiens
ggtaggctgctgg

SEQ ID NO: 5775099 - DNA, 15 bp, Homo sapiens
ggtaggctgctggcg

SEQ ID NO: 5775100 - DNA, 18 bp, Homo sapiens
ggtaggctgctggcgcct

SEQ ID NO: 5775101 - DNA, 18 bp, Homo sapiens
ggtaggctgtctgtgcca

SEQ ID NO: 5775102 - DNA, 19 bp, Homo sapiens
ggtaggctgtctgtgccat

SEQ ID NO: 5775103 - DNA, 19 bp, Homo sapiens
ggtaggctgtggggtgggc

SEQ ID NO: 5775104 - DNA, 16 bp, Homo sapiens
ggtagggaaataatag

SEQ ID NO: 5775105 - DNA, 16 bp, Homo sapiens
ggtagggagctaagga

SEQ ID NO: 5775106 - DNA, 13 bp, Homo sapiens
ggtagggcagcag

SEQ ID NO: 5775107 - DNA, 14 bp, Homo sapiens
ggtagggctctgac

SEQ ID NO: 5775108 - DNA, 23 bp, Homo sapiens
ggtagggctggctggaggaagga

SEQ ID NO: 5775109 - DNA, 17 bp, Homo sapiens
ggtaggggagggtgggg

SEQ ID NO: 5775110 - DNA, 14 bp, Homo sapiens
ggtaggggcaggga

SEQ ID NO: 5775111 - DNA, 19 bp, Homo sapiens
ggtaggggcccctctcagc

SEQ ID NO: 5775112 - DNA, 11 bp, Homo sapiens
ggtaggggctg

SEQ ID NO: 5775113 - DNA, 13 bp, Homo sapiens
ggtaggggctggg

SEQ ID NO: 5775114 - DNA, 13 bp, Homo sapiens
ggtagggggcctg

SEQ ID NO: 5775115 - DNA, 23 bp, Homo sapiens
ggtaggggggaaacaggttggga

SEQ ID NO: 5775116 - DNA, 13 bp, Homo sapiens
ggtaggggttggg

SEQ ID NO: 5775117 - DNA, 15 bp, Homo sapiens
ggtagggtaaatcag

SEQ ID NO: 5775118 - DNA, 16 bp, Homo sapiens
ggtagggtaaatcagt

SEQ ID NO: 5775119 - DNA, 11 bp, Homo sapiens
ggtagggtggg

SEQ ID NO: 5775120 - DNA, 16 bp, Homo sapiens
ggtaggttcagccaag

SEQ ID NO: 5775121 - DNA, 17 bp, Homo sapiens
ggtaggttcagccaagg

SEQ ID NO: 5775122 - DNA, 16 bp, Homo sapiens
ggtaggttctgtctgt

SEQ ID NO: 5775123 - DNA, 18 bp, Homo sapiens
ggtaggttgggacaccag

SEQ ID NO: 5775124 - DNA, 14 bp, Homo sapiens
ggtagtactgggaa

SEQ ID NO: 5775125 - DNA, 19 bp, Homo sapiens
ggtagtagaatctcagcac

SEQ ID NO: 5775126 - DNA, 13 bp, Homo sapiens
ggtagtcctccca

SEQ ID NO: 5775127 - DNA, 16 bp, Homo sapiens
ggtagtcctcccaagc

SEQ ID NO: 5775128 - DNA, 22 bp, Homo sapiens
ggtagtcctcccaagctgtgct

SEQ ID NO: 5775129 - DNA, 16 bp, Homo sapiens
ggtagtgcagggcaca

SEQ ID NO: 5775130 - DNA, 20 bp, Homo sapiens
ggtagtgccatggccaggag

SEQ ID NO: 5775131 - DNA, 12 bp, Homo sapiens
ggtagtgcccca

SEQ ID NO: 5775132 - DNA, 18 bp, Homo sapiens
ggtagtggcaaagagagg

SEQ ID NO: 5775133 - DNA, 19 bp, Homo sapiens
ggtagtgggatggtggggt

SEQ ID NO: 5775134 - DNA, 14 bp, Homo sapiens
ggtagttcaagaaa

SEQ ID NO: 5775135 - DNA, 17 bp, Homo sapiens
ggtcagagggactgtca

SEQ ID NO: 5775136 - DNA, 14 bp, Homo sapiens
ggtcagagtgccac

SEQ ID NO: 5775137 - DNA, 16 bp, Homo sapiens
ggtcagagtgccactg

SEQ ID NO: 5775138 - DNA, 14 bp, Homo sapiens
ggtcagatatttga

SEQ ID NO: 5775139 - DNA, 22 bp, Homo sapiens
ggtcagatgtggcttctggctc

SEQ ID NO: 5775140 - DNA, 23 bp, Homo sapiens
ggtcagattagggcggggagaag

SEQ ID NO: 5775141 - DNA, 18 bp, Homo sapiens
ggtcagattagttggctt

SEQ ID NO: 5775142 - DNA, 20 bp, Homo sapiens
ggtcagatttatttgtttga

SEQ ID NO: 5775143 - DNA, 18 bp, Homo sapiens
ggtcagcacatctcaaca

SEQ ID NO: 5775144 - DNA, 23 bp, Homo sapiens
ggtcagcaccgtggtgtgaggcc

SEQ ID NO: 5775145 - DNA, 20 bp, Homo sapiens
ggtcagcagaaacccccagg

SEQ ID NO: 5775146 - DNA, 12 bp, Homo sapiens
ggtcagcaggcc

SEQ ID NO: 5775147 - DNA, 16 bp, Homo sapiens
ggtcagcaggcccagg

SEQ ID NO: 5775148 - DNA, 18 bp, Homo sapiens
ggtcagcaggcccaggag

SEQ ID NO: 5775149 - DNA, 19 bp, Homo sapiens
ggtcagcaggcccaggaga

SEQ ID NO: 5775150 - DNA, 20 bp, Homo sapiens
ggtcagcaggcccaggagaa

SEQ ID NO: 5775151 - DNA, 12 bp, Homo sapiens
ggtcagccaggg

SEQ ID NO: 5775152 - DNA, 18 bp, Homo sapiens
ggtcagccatttttaatg

SEQ ID NO: 5775153 - DNA, 12 bp, Homo sapiens
ggtcagcccagc

SEQ ID NO: 5775154 - DNA, 21 bp, Homo sapiens
ggtcagcccagcacctgctcc

SEQ ID NO: 5775155 - DNA, 16 bp, Homo sapiens
ggtcagccccaagggc

SEQ ID NO: 5775156 - DNA, 19 bp, Homo sapiens
ggtcagccccaagggctgg

SEQ ID NO: 5775157 - DNA, 23 bp, Homo sapiens
ggtcagccccaagggctggggcg

SEQ ID NO: 5775158 - DNA, 14 bp, Homo sapiens
ggtcagccctagga

SEQ ID NO: 5775159 - DNA, 14 bp, Homo sapiens
ggtcagccctgtgt

SEQ ID NO: 5775160 - DNA, 15 bp, Homo sapiens
ggtcagccctgtgtc

SEQ ID NO: 5775161 - DNA, 14 bp, Homo sapiens
ggtcagcctggaag

SEQ ID NO: 5775162 - DNA, 11 bp, Homo sapiens
ggtcagccttg

SEQ ID NO: 5775163 - DNA, 23 bp, Homo sapiens
ggtcagcgattcctgccaagtag

SEQ ID NO: 5775164 - DNA, 12 bp, Homo sapiens
ggtcagctctgg

SEQ ID NO: 5775165 - DNA, 16 bp, Homo sapiens
ggtcagctctggccac

SEQ ID NO: 5775166 - DNA, 18 bp, Homo sapiens
ggtcagctgggagccagt

SEQ ID NO: 5775167 - DNA, 18 bp, Homo sapiens
ggtcagctgttactttct

SEQ ID NO: 5775168 - DNA, 21 bp, Homo sapiens
ggtcaggaccaggacccaggg

SEQ ID NO: 5775169 - DNA, 13 bp, Homo sapiens
ggtcaggagggtg

SEQ ID NO: 5775170 - DNA, 24 bp, Homo sapiens
ggtcaggagttcgagagcagcctg

SEQ ID NO: 5775171 - DNA, 22 bp, Homo sapiens
ggtcaggatgcacatttctgga

SEQ ID NO: 5775172 - DNA, 22 bp, Homo sapiens
ggtcaggatgtaggggttaact

SEQ ID NO: 5775173 - DNA, 13 bp, Homo sapiens
ggtcaggcccagc

SEQ ID NO: 5775174 - DNA, 14 bp, Homo sapiens
ggtcaggcccagcc

SEQ ID NO: 5775175 - DNA, 19 bp, Homo sapiens
ggtcaggcccgtcagcatc

SEQ ID NO: 5775176 - DNA, 16 bp, Homo sapiens
ggtcaggccctggaac

SEQ ID NO: 5775177 - DNA, 14 bp, Homo sapiens
ggtcaggccctggt

SEQ ID NO: 5775178 - DNA, 17 bp, Homo sapiens
ggtcaggccgggcagag

SEQ ID NO: 5775179 - DNA, 18 bp, Homo sapiens
ggtcaggcggagctgctg

SEQ ID NO: 5775180 - DNA, 22 bp, Homo sapiens
ggtcaggcggggtgctgtggtg

SEQ ID NO: 5775181 - DNA, 15 bp, Homo sapiens
ggtcaggctggtctc

SEQ ID NO: 5775182 - DNA, 17 bp, Homo sapiens
ggtcagggaccaaggac

SEQ ID NO: 5775183 - DNA, 12 bp, Homo sapiens
ggtcagggcagt

SEQ ID NO: 5775184 - DNA, 14 bp, Homo sapiens
ggtcagggcagtgg

SEQ ID NO: 5775185 - DNA, 16 bp, Homo sapiens
ggtcagggcagtggcc

SEQ ID NO: 5775186 - DNA, 20 bp, Homo sapiens
ggtcagggcagtggccaagc

SEQ ID NO: 5775187 - DNA, 14 bp, Homo sapiens
ggtcagggctatgg

SEQ ID NO: 5775188 - DNA, 16 bp, Homo sapiens
ggtcaggggctcccta

SEQ ID NO: 5775189 - DNA, 17 bp, Homo sapiens
ggtcaggggctccctac

SEQ ID NO: 5775190 - DNA, 16 bp, Homo sapiens
ggtcaggtcatttttt

SEQ ID NO: 5775191 - DNA, 16 bp, Homo sapiens
ggtcaggtgccactga

SEQ ID NO: 5775192 - DNA, 17 bp, Homo sapiens
ggtcaggtggactctgg

SEQ ID NO: 5775193 - DNA, 19 bp, Homo sapiens
ggtcaggtgttcaagacca

SEQ ID NO: 5775194 - DNA, 20 bp, Homo sapiens
ggtcaggttatactcctcct

SEQ ID NO: 5775195 - DNA, 19 bp, Homo sapiens
ggtcaggttctaccctcca

SEQ ID NO: 5775196 - DNA, 17 bp, Homo sapiens
ggtcaggttcttgcctt

SEQ ID NO: 5775197 - DNA, 15 bp, Homo sapiens
ggtcaggtttaacat

SEQ ID NO: 5775198 - DNA, 19 bp, Homo sapiens
ggtcaggtttaacatttgc

SEQ ID NO: 5775199 - DNA, 12 bp, Homo sapiens
ggtcagtaccca

SEQ ID NO: 5775200 - DNA, 17 bp, Homo sapiens
ggtcagtacccacctga

SEQ ID NO: 5775201 - DNA, 21 bp, Homo sapiens
ggtcagtagtttaaaagttct

SEQ ID NO: 5775202 - DNA, 21 bp, Homo sapiens
ggtcagtgaagcccaggagga

SEQ ID NO: 5775203 - DNA, 17 bp, Homo sapiens
ggtcagtgcagcagagg

SEQ ID NO: 5775204 - DNA, 12 bp, Homo sapiens
ggtcagtgcctt

SEQ ID NO: 5775205 - DNA, 22 bp, Homo sapiens
ggtcagtgccttttggaactgt

SEQ ID NO: 5775206 - DNA, 17 bp, Homo sapiens
ggtcagtggaagcccca

SEQ ID NO: 5775207 - DNA, 13 bp, Homo sapiens
ggtcagtggccag

SEQ ID NO: 5775208 - DNA, 24 bp, Homo sapiens
ggtcagtgtccaaagcagggtctg

SEQ ID NO: 5775209 - DNA, 17 bp, Homo sapiens
ggtcagtgtgccaccct

SEQ ID NO: 5775210 - DNA, 22 bp, Homo sapiens
ggtcataaagaggcgttgcttt

SEQ ID NO: 5775211 - DNA, 15 bp, Homo sapiens
ggtcataaagcattg

SEQ ID NO: 5775212 - DNA, 21 bp, Homo sapiens
ggtcatactatctactctcct

SEQ ID NO: 5775213 - DNA, 22 bp, Homo sapiens
ggtcatactatctactctcctc

SEQ ID NO: 5775214 - DNA, 22 bp, Homo sapiens
ggtcatagacaattcctccaga

SEQ ID NO: 5775215 - DNA, 15 bp, Homo sapiens
ggtcatagattcttg

SEQ ID NO: 5775216 - DNA, 16 bp, Homo sapiens
ggtcatagtttcctga

SEQ ID NO: 5775217 - DNA, 20 bp, Homo sapiens
ggtcatataaaatatattta

SEQ ID NO: 5775218 - DNA, 22 bp, Homo sapiens
ggtcatatgtttattcaaaata

SEQ ID NO: 5775219 - DNA, 22 bp, Homo sapiens
ggtcatatgtttgcttgtattt

SEQ ID NO: 5775220 - DNA, 17 bp, Homo sapiens
ggtcatcatgaaaggtt

SEQ ID NO: 5775221 - DNA, 18 bp, Homo sapiens
ggtcatcccccactgtaa

SEQ ID NO: 5775222 - DNA, 14 bp, Homo sapiens
ggtcatcctgcccc

SEQ ID NO: 5775223 - DNA, 17 bp, Homo sapiens
ggtcatccttgcccatc

SEQ ID NO: 5775224 - DNA, 20 bp, Homo sapiens
ggtcatccttggtgctcttg

SEQ ID NO: 5775225 - DNA, 17 bp, Homo sapiens
ggtcatcgattcaaact

SEQ ID NO: 5775226 - DNA, 18 bp, Homo sapiens
ggtcatctgctgggatct

SEQ ID NO: 5775227 - DNA, 16 bp, Homo sapiens
ggtcatgaagggctgg

SEQ ID NO: 5775228 - DNA, 19 bp, Homo sapiens
ggtcatgatgctctttccc

SEQ ID NO: 5775229 - DNA, 17 bp, Homo sapiens
ggtcatgccgggggagc

SEQ ID NO: 5775230 - DNA, 13 bp, Homo sapiens
ggtcatggagcag

SEQ ID NO: 5775231 - DNA, 14 bp, Homo sapiens
ggtcatggagcagc

SEQ ID NO: 5775232 - DNA, 15 bp, Homo sapiens
ggtcatggagcagcc

SEQ ID NO: 5775233 - DNA, 17 bp, Homo sapiens
ggtcatggagcagcccc

SEQ ID NO: 5775234 - DNA, 18 bp, Homo sapiens
ggtcatggagcagccccc

SEQ ID NO: 5775235 - DNA, 13 bp, Homo sapiens
ggtcatggccaca

SEQ ID NO: 5775236 - DNA, 16 bp, Homo sapiens
ggtcatgggccactgc

SEQ ID NO: 5775237 - DNA, 15 bp, Homo sapiens
ggtcatgtaacaggt

SEQ ID NO: 5775238 - DNA, 16 bp, Homo sapiens
ggtcatgtatgatgag

SEQ ID NO: 5775239 - DNA, 14 bp, Homo sapiens
ggtcatgtcctgag

SEQ ID NO: 5775240 - DNA, 19 bp, Homo sapiens
ggtcatgtgagtctgggat

SEQ ID NO: 5775241 - DNA, 18 bp, Homo sapiens
ggtcatgtgggtcttcca

SEQ ID NO: 5775242 - DNA, 12 bp, Homo sapiens
ggtcatgtgtgt

SEQ ID NO: 5775243 - DNA, 22 bp, Homo sapiens
ggtcattacttctgagccccag

SEQ ID NO: 5775244 - DNA, 20 bp, Homo sapiens
ggtcattcctaatgcattag

SEQ ID NO: 5775245 - DNA, 19 bp, Homo sapiens
ggtcattcctgtcaacaag

SEQ ID NO: 5775246 - DNA, 21 bp, Homo sapiens
ggtcattcttttgccacatcc

SEQ ID NO: 5775247 - DNA, 18 bp, Homo sapiens
ggtcattgacctctcagg

SEQ ID NO: 5775248 - DNA, 21 bp, Homo sapiens
ggtcatttccatgtatgcata

SEQ ID NO: 5775249 - DNA, 15 bp, Homo sapiens
ggtcattttctattc

SEQ ID NO: 5775250 - DNA, 21 bp, Homo sapiens
ggtcattttttttgcttctgg

SEQ ID NO: 5775251 - DNA, 17 bp, Homo sapiens
ggtccaaaaaaaggaaa

SEQ ID NO: 5775252 - DNA, 19 bp, Homo sapiens
ggtccaaaaaaaggaaaaa

SEQ ID NO: 5775253 - DNA, 20 bp, Homo sapiens
ggtccaaaaaaaggaaaaat

SEQ ID NO: 5775254 - DNA, 23 bp, Homo sapiens
ggtccaaaaaaggctgccctggg

SEQ ID NO: 5775255 - DNA, 21 bp, Homo sapiens
ggtccaaaataaaacctcagc

SEQ ID NO: 5775256 - DNA, 17 bp, Homo sapiens
ggtccaaataaaaacta

SEQ ID NO: 5775257 - DNA, 17 bp, Homo sapiens
ggtccaacaagaatgca

SEQ ID NO: 5775258 - DNA, 13 bp, Homo sapiens
ggtccaacagttt

SEQ ID NO: 5775259 - DNA, 19 bp, Homo sapiens
ggtccaacccagcctgagt

SEQ ID NO: 5775260 - DNA, 16 bp, Homo sapiens
ggtccaactgcaactc

SEQ ID NO: 5775261 - DNA, 15 bp, Homo sapiens
ggtccaagattctgg

SEQ ID NO: 5775262 - DNA, 16 bp, Homo sapiens
ggtccaatgagctttc

SEQ ID NO: 5775263 - DNA, 22 bp, Homo sapiens
ggtccaatgagctttctgaaca

SEQ ID NO: 5775264 - DNA, 16 bp, Homo sapiens
ggtccacaacacacag

SEQ ID NO: 5775265 - DNA, 17 bp, Homo sapiens
ggtccacacctgggcat

SEQ ID NO: 5775266 - DNA, 14 bp, Homo sapiens
ggtccacagggcac

SEQ ID NO: 5775267 - DNA, 13 bp, Homo sapiens
ggtccacaggtcc

SEQ ID NO: 5775268 - DNA, 10 bp, Homo sapiens
ggtccacatt

SEQ ID NO: 5775269 - DNA, 15 bp, Homo sapiens
ggtccaccagtgtgt

SEQ ID NO: 5775270 - DNA, 22 bp, Homo sapiens
ggtccaccagtgtgtgggggag

SEQ ID NO: 5775271 - DNA, 15 bp, Homo sapiens
ggtccaccctagcct

SEQ ID NO: 5775272 - DNA, 16 bp, Homo sapiens
ggtccaccggcccctg

SEQ ID NO: 5775273 - DNA, 20 bp, Homo sapiens
ggtccaccggcccctggcag

SEQ ID NO: 5775274 - DNA, 12 bp, Homo sapiens
ggtccacgcctc

SEQ ID NO: 5775275 - DNA, 20 bp, Homo sapiens
ggtccactcagggctgccac

SEQ ID NO: 5775276 - DNA, 11 bp, Homo sapiens
ggtccacttcc

SEQ ID NO: 5775277 - DNA, 14 bp, Homo sapiens
ggtccacttgccag

SEQ ID NO: 5775278 - DNA, 17 bp, Homo sapiens
ggtccagaagaaattat

SEQ ID NO: 5775279 - DNA, 20 bp, Homo sapiens
ggtccagaaggagacaggca

SEQ ID NO: 5775280 - DNA, 21 bp, Homo sapiens
ggtccagaaggagcaggccct

SEQ ID NO: 5775281 - DNA, 20 bp, Homo sapiens
ggtccagagaccacaccact

SEQ ID NO: 5775282 - DNA, 12 bp, Homo sapiens
ggtccagccccc

SEQ ID NO: 5775283 - DNA, 20 bp, Homo sapiens
ggtccagccccccaggctgc

SEQ ID NO: 5775284 - DNA, 12 bp, Homo sapiens
ggtccagccctc

SEQ ID NO: 5775285 - DNA, 15 bp, Homo sapiens
ggtccagccctccgc

SEQ ID NO: 5775286 - DNA, 17 bp, Homo sapiens
ggtccagccctggctga

SEQ ID NO: 5775287 - DNA, 19 bp, Homo sapiens
ggtccagccctggctgaag

SEQ ID NO: 5775288 - DNA, 22 bp, Homo sapiens
ggtccagccctggctgaaggac

SEQ ID NO: 5775289 - DNA, 22 bp, Homo sapiens
ggtccagcctcgttggaagagg

SEQ ID NO: 5775290 - DNA, 13 bp, Homo sapiens
ggtccagctctga

SEQ ID NO: 5775291 - DNA, 18 bp, Homo sapiens
ggtccagctctgacatcc

SEQ ID NO: 5775292 - DNA, 21 bp, Homo sapiens
ggtccagctctgacatccctt

SEQ ID NO: 5775293 - DNA, 16 bp, Homo sapiens
ggtccagctctggagg

SEQ ID NO: 5775294 - DNA, 13 bp, Homo sapiens
ggtccagctctgt

SEQ ID NO: 5775295 - DNA, 16 bp, Homo sapiens
ggtccagctctgtggg

SEQ ID NO: 5775296 - DNA, 19 bp, Homo sapiens
ggtccagctctgtgggccc

SEQ ID NO: 5775297 - DNA, 19 bp, Homo sapiens
ggtccagctcttggcccct

SEQ ID NO: 5775298 - DNA, 23 bp, Homo sapiens
ggtccagctcttggcccctgtgt

SEQ ID NO: 5775299 - DNA, 17 bp, Homo sapiens
ggtccagctgggcctcc

SEQ ID NO: 5775300 - DNA, 22 bp, Homo sapiens
ggtccagctgggcctcctgcct

SEQ ID NO: 5775301 - DNA, 15 bp, Homo sapiens
ggtccaggaaggcag

SEQ ID NO: 5775302 - DNA, 21 bp, Homo sapiens
ggtccaggaatggtgctttat

SEQ ID NO: 5775303 - DNA, 11 bp, Homo sapiens
ggtccaggaga

SEQ ID NO: 5775304 - DNA, 19 bp, Homo sapiens
ggtccaggagaagtgctcc

SEQ ID NO: 5775305 - DNA, 21 bp, Homo sapiens
ggtccaggagaagtgctccct

SEQ ID NO: 5775306 - DNA, 16 bp, Homo sapiens
ggtccaggagagcctg

SEQ ID NO: 5775307 - DNA, 17 bp, Homo sapiens
ggtccaggagagcctgg

SEQ ID NO: 5775308 - DNA, 18 bp, Homo sapiens
ggtccaggagagcctggg

SEQ ID NO: 5775309 - DNA, 21 bp, Homo sapiens
ggtccaggagatgaggctgga

SEQ ID NO: 5775310 - DNA, 13 bp, Homo sapiens
ggtccaggcagga

SEQ ID NO: 5775311 - DNA, 14 bp, Homo sapiens
ggtccaggcaggag

SEQ ID NO: 5775312 - DNA, 16 bp, Homo sapiens
ggtccaggcaggagga

SEQ ID NO: 5775313 - DNA, 14 bp, Homo sapiens
ggtcctcctccagg

SEQ ID NO: 5775314 - DNA, 17 bp, Homo sapiens
ggtcctcctccagggac

SEQ ID NO: 5775315 - DNA, 22 bp, Homo sapiens
ggtcctcctggcctgagcgcag

SEQ ID NO: 5775316 - DNA, 19 bp, Homo sapiens
ggtcctcctgtgctatttg

SEQ ID NO: 5775317 - DNA, 21 bp, Homo sapiens
ggtcctcggcccatctgtcca

SEQ ID NO: 5775318 - DNA, 22 bp, Homo sapiens
ggtcctcggccctgtagccctg

SEQ ID NO: 5775319 - DNA, 22 bp, Homo sapiens
ggtcctcgggatgccgttctgt

SEQ ID NO: 5775320 - DNA, 23 bp, Homo sapiens
ggtcctcgggatgccgttctgtt

SEQ ID NO: 5775321 - DNA, 21 bp, Homo sapiens
ggtcctctcagttctctccct

SEQ ID NO: 5775322 - DNA, 14 bp, Homo sapiens
ggtcctctctctgt

SEQ ID NO: 5775323 - DNA, 19 bp, Homo sapiens
ggtcctctctgagtcaaat

SEQ ID NO: 5775324 - DNA, 23 bp, Homo sapiens
ggtcctctctgagtcaaatccag

SEQ ID NO: 5775325 - DNA, 14 bp, Homo sapiens
ggtcctctcttcca

SEQ ID NO: 5775326 - DNA, 15 bp, Homo sapiens
ggtcctctgaggcac

SEQ ID NO: 5775327 - DNA, 17 bp, Homo sapiens
ggtcctctgcttcctga

SEQ ID NO: 5775328 - DNA, 13 bp, Homo sapiens
ggtcctctgtcag

SEQ ID NO: 5775329 - DNA, 23 bp, Homo sapiens
ggtcctctgtcagtcacagccac

SEQ ID NO: 5775330 - DNA, 21 bp, Homo sapiens
ggtcctcttaggtcccgggag

SEQ ID NO: 5775331 - DNA, 19 bp, Homo sapiens
ggtcctcttctgggcctga

SEQ ID NO: 5775332 - DNA, 22 bp, Homo sapiens
ggtcctcttctgggcctgacca

SEQ ID NO: 5775333 - DNA, 15 bp, Homo sapiens
ggtcctcttgcctcc

SEQ ID NO: 5775334 - DNA, 18 bp, Homo sapiens
ggtcctgaagaattaaga

SEQ ID NO: 5775335 - DNA, 20 bp, Homo sapiens
ggtcctgaagtgacctcact

SEQ ID NO: 5775336 - DNA, 16 bp, Homo sapiens
ggtcctgagcactgcc

SEQ ID NO: 5775337 - DNA, 23 bp, Homo sapiens
ggtcctgagcactgccaggaggg

SEQ ID NO: 5775338 - DNA, 17 bp, Homo sapiens
ggtcctgaggctggggc

SEQ ID NO: 5775339 - DNA, 16 bp, Homo sapiens
ggtcctgagtggctga

SEQ ID NO: 5775340 - DNA, 18 bp, Homo sapiens
ggtcctgcaatctccagg

SEQ ID NO: 5775341 - DNA, 19 bp, Homo sapiens
ggtcctgcaatctccaggg

SEQ ID NO: 5775342 - DNA, 23 bp, Homo sapiens
ggtcctgcaatctccagggctgc

SEQ ID NO: 5775343 - DNA, 22 bp, Homo sapiens
ggtcctgcacagattcccaggc

SEQ ID NO: 5775344 - DNA, 12 bp, Homo sapiens
ggtcctgcacat

SEQ ID NO: 5775345 - DNA, 14 bp, Homo sapiens
ggtcctgcaggggg

SEQ ID NO: 5775346 - DNA, 14 bp, Homo sapiens
ggtcctgcaggtcc

SEQ ID NO: 5775347 - DNA, 20 bp, Homo sapiens
ggtcctgcagtctggctgag

SEQ ID NO: 5775348 - DNA, 20 bp, Homo sapiens
ggtcctgcccatgtgtcccc

SEQ ID NO: 5775349 - DNA, 13 bp, Homo sapiens
ggtcctgcctgca

SEQ ID NO: 5775350 - DNA, 22 bp, Homo sapiens
ggtcctgctatttcccaagctg

SEQ ID NO: 5775351 - DNA, 13 bp, Homo sapiens
ggtcctgctcagc

SEQ ID NO: 5775352 - DNA, 19 bp, Homo sapiens
ggtcctgctccgctgcctg

SEQ ID NO: 5775353 - DNA, 20 bp, Homo sapiens
ggtcctgctccgctgcctgg

SEQ ID NO: 5775354 - DNA, 14 bp, Homo sapiens
ggtcctgctttctc

SEQ ID NO: 5775355 - DNA, 12 bp, Homo sapiens
ggtcctggaaca

SEQ ID NO: 5775356 - DNA, 23 bp, Homo sapiens
ggtcctggacacctcccagggga

SEQ ID NO: 5775357 - DNA, 13 bp, Homo sapiens
ggtcctggccatc

SEQ ID NO: 5775358 - DNA, 21 bp, Homo sapiens
ggtcctggccatcccacaagt

SEQ ID NO: 5775359 - DNA, 13 bp, Homo sapiens
ggtcctggcctcc

SEQ ID NO: 5775360 - DNA, 22 bp, Homo sapiens
ggtcctggccttgtgtcactgg

SEQ ID NO: 5775361 - DNA, 15 bp, Homo sapiens
ggtcctggctcctga

SEQ ID NO: 5775362 - DNA, 11 bp, Homo sapiens
ggtcctggctg

SEQ ID NO: 5775363 - DNA, 16 bp, Homo sapiens
ggtcctggctgcactc

SEQ ID NO: 5775364 - DNA, 13 bp, Homo sapiens
ggtcctggcttct

SEQ ID NO: 5775365 - DNA, 11 bp, Homo sapiens
ggtcctgggag

SEQ ID NO: 5775366 - DNA, 12 bp, Homo sapiens
ggtcctgggagg

SEQ ID NO: 5775367 - DNA, 15 bp, Homo sapiens
ggtcctgggaggaga

SEQ ID NO: 5775368 - DNA, 19 bp, Homo sapiens
ggtcctgggaggctgcagc

SEQ ID NO: 5775369 - DNA, 23 bp, Homo sapiens
ggtcctgggaggctgcagccagg

SEQ ID NO: 5775370 - DNA, 17 bp, Homo sapiens
ggtcctgggctggggcc

SEQ ID NO: 5775371 - DNA, 15 bp, Homo sapiens
ggtcctggggaggct

SEQ ID NO: 5775372 - DNA, 16 bp, Homo sapiens
ggtcctggggaggctg

SEQ ID NO: 5775373 - DNA, 23 bp, Homo sapiens
ggtcctggggctctgtgcaggga

SEQ ID NO: 5775374 - DNA, 17 bp, Homo sapiens
ggtcctgggggctgctg

SEQ ID NO: 5775375 - DNA, 13 bp, Homo sapiens
ggtcctggtgccc

SEQ ID NO: 5775376 - DNA, 15 bp, Homo sapiens
ggtcctggtgctgcc

SEQ ID NO: 5775377 - DNA, 21 bp, Homo sapiens
ggtcctggtgggtcagcccag

SEQ ID NO: 5775378 - DNA, 21 bp, Homo sapiens
ggtcctgtcaccctggcccca

SEQ ID NO: 5775379 - DNA, 21 bp, Homo sapiens
ggtcctgtctcccctctgctg

SEQ ID NO: 5775380 - DNA, 13 bp, Homo sapiens
ggtcctgtctctg

SEQ ID NO: 5775381 - DNA, 19 bp, Homo sapiens
ggtcctgtctctgcacaga

SEQ ID NO: 5775382 - DNA, 12 bp, Homo sapiens
ggtcctgtgccc

SEQ ID NO: 5775383 - DNA, 12 bp, Homo sapiens
ggtcctgtggat

SEQ ID NO: 5775384 - DNA, 15 bp, Homo sapiens
ggtcctgtggatggg

SEQ ID NO: 5775385 - DNA, 14 bp, Homo sapiens
ggtcctgtggcagg

SEQ ID NO: 5775386 - DNA, 17 bp, Homo sapiens
ggtcctgtggcaggcag

SEQ ID NO: 5775387 - DNA, 22 bp, Homo sapiens
ggtcctgttaacgtcatctcag

SEQ ID NO: 5775388 - DNA, 22 bp, Homo sapiens
ggtccttaggagacgctgcact

SEQ ID NO: 5775389 - DNA, 10 bp, Homo sapiens
ggtccttcaa

SEQ ID NO: 5775390 - DNA, 15 bp, Homo sapiens
ggtccttccaggccc

SEQ ID NO: 5775391 - DNA, 14 bp, Homo sapiens
ggtccttctccaca

SEQ ID NO: 5775392 - DNA, 15 bp, Homo sapiens
ggtccttctgacccc

SEQ ID NO: 5775393 - DNA, 13 bp, Homo sapiens
ggtccttggcccc

SEQ ID NO: 5775394 - DNA, 15 bp, Homo sapiens
ggtccttgggcctgg

SEQ ID NO: 5775395 - DNA, 19 bp, Homo sapiens
ggtccttgtctgcaccctc

SEQ ID NO: 5775396 - DNA, 16 bp, Homo sapiens
ggtcctttccttctcg

SEQ ID NO: 5775397 - DNA, 15 bp, Homo sapiens
ggtcctttggggtga

SEQ ID NO: 5775398 - DNA, 15 bp, Homo sapiens
ggtcgagctgtgctc

SEQ ID NO: 5775399 - DNA, 22 bp, Homo sapiens
ggtcgaggagtaacaatacaaa

SEQ ID NO: 5775400 - DNA, 16 bp, Homo sapiens
ggtcgcagctaccctc

SEQ ID NO: 5775401 - DNA, 20 bp, Homo sapiens
ggtcgcagctaccctcagcc

SEQ ID NO: 5775402 - DNA, 21 bp, Homo sapiens
ggtcgcagctaccctcagcct

SEQ ID NO: 5775403 - DNA, 13 bp, Homo sapiens
ggtcgccacaccc

SEQ ID NO: 5775404 - DNA, 13 bp, Homo sapiens
ggtcgcccaggag

SEQ ID NO: 5775405 - DNA, 12 bp, Homo sapiens
ggtcgcccctcc

SEQ ID NO: 5775406 - DNA, 18 bp, Homo sapiens
ggtcgccctaccctcact

SEQ ID NO: 5775407 - DNA, 12 bp, Homo sapiens
ggtcgctcctgc

SEQ ID NO: 5775408 - DNA, 16 bp, Homo sapiens
ggtcggaagcctgtcc

SEQ ID NO: 5775409 - DNA, 17 bp, Homo sapiens
ggtcggaagcctgtcct

SEQ ID NO: 5775410 - DNA, 16 bp, Homo sapiens
ggtcggaggcttggga

SEQ ID NO: 5775411 - DNA, 18 bp, Homo sapiens
ggtcggagtgcctggagt

SEQ ID NO: 5775412 - DNA, 15 bp, Homo sapiens
ggtcggccctgccca

SEQ ID NO: 5775413 - DNA, 20 bp, Homo sapiens
ggtcggccgccatagcccca

SEQ ID NO: 5775414 - DNA, 23 bp, Homo sapiens
ggtcggccgccatagccccagta

SEQ ID NO: 5775415 - DNA, 15 bp, Homo sapiens
ggtcggctcctgatg

SEQ ID NO: 5775416 - DNA, 18 bp, Homo sapiens
ggtcgggcagccagcaga

SEQ ID NO: 5775417 - DNA, 14 bp, Homo sapiens
ggtcgggctcagct

SEQ ID NO: 5775418 - DNA, 16 bp, Homo sapiens
ggtcgggctgccagcc

SEQ ID NO: 5775419 - DNA, 22 bp, Homo sapiens
ggtcgggctgccagcccagctg

SEQ ID NO: 5775420 - DNA, 14 bp, Homo sapiens
ggtcggggcatctg

SEQ ID NO: 5775421 - DNA, 21 bp, Homo sapiens
ggtcgtcatgctgtccgtgct

SEQ ID NO: 5775422 - DNA, 12 bp, Homo sapiens
ggtcgtctttgt

SEQ ID NO: 5775423 - DNA, 17 bp, Homo sapiens
ggtcgtgctcatgtctg

SEQ ID NO: 5775424 - DNA, 19 bp, Homo sapiens
ggtcgtggagagctaggag

SEQ ID NO: 5775425 - DNA, 20 bp, Homo sapiens
ggtcgtggagagctaggagc

SEQ ID NO: 5775426 - DNA, 16 bp, Homo sapiens
ggtcgtgggaaagggg

SEQ ID NO: 5775427 - DNA, 22 bp, Homo sapiens
ggtcgtgggaaaggggagtagg

SEQ ID NO: 5775428 - DNA, 16 bp, Homo sapiens
ggtcgtggtggagaat

SEQ ID NO: 5775429 - DNA, 14 bp, Homo sapiens
ggtcgttttccaaa

SEQ ID NO: 5775430 - DNA, 20 bp, Homo sapiens
ggtctaactgtggaatataa

SEQ ID NO: 5775431 - DNA, 21 bp, Homo sapiens
ggtctaaggagcgctagtgcc

SEQ ID NO: 5775432 - DNA, 13 bp, Homo sapiens
ggtctaatgtttg

SEQ ID NO: 5775433 - DNA, 21 bp, Homo sapiens
ggtctacactgcaatcatatg

SEQ ID NO: 5775434 - DNA, 15 bp, Homo sapiens
ggtctagaaggccag

SEQ ID NO: 5775435 - DNA, 16 bp, Homo sapiens
ggtctagaaggccagg

SEQ ID NO: 5775436 - DNA, 20 bp, Homo sapiens
ggtctagaaggccaggcctc

SEQ ID NO: 5775437 - DNA, 13 bp, Homo sapiens
ggtctagaccagg

SEQ ID NO: 5775438 - DNA, 17 bp, Homo sapiens
ggtctagaccagggctg

SEQ ID NO: 5775439 - DNA, 14 bp, Homo sapiens
ggtctagagagaac

SEQ ID NO: 5775440 - DNA, 16 bp, Homo sapiens
ggtctataaaataaac

SEQ ID NO: 5775441 - DNA, 21 bp, Homo sapiens
ggtctataattccttaaaatt

SEQ ID NO: 5775442 - DNA, 22 bp, Homo sapiens
ggtctataattccttaaaattt

SEQ ID NO: 5775443 - DNA, 15 bp, Homo sapiens
ggtctatacattcct

SEQ ID NO: 5775444 - DNA, 19 bp, Homo sapiens
ggtctatacattcctgaga

SEQ ID NO: 5775445 - DNA, 14 bp, Homo sapiens
ggtctatggctcat

SEQ ID NO: 5775446 - DNA, 18 bp, Homo sapiens
ggtctatggctcatgtct

SEQ ID NO: 5775447 - DNA, 23 bp, Homo sapiens
ggtctatgtaaatgcatctgtcc

SEQ ID NO: 5775448 - DNA, 20 bp, Homo sapiens
ggtctatgtcgagagctggc

SEQ ID NO: 5775449 - DNA, 15 bp, Homo sapiens
ggtctattccagctc

SEQ ID NO: 5775450 - DNA, 20 bp, Homo sapiens
ggtctattccagctcattca

SEQ ID NO: 5775451 - DNA, 14 bp, Homo sapiens
ggtctattgtcgct

SEQ ID NO: 5775452 - DNA, 15 bp, Homo sapiens
ggtctattgtctgta

SEQ ID NO: 5775453 - DNA, 19 bp, Homo sapiens
ggtctattgtctgtatttg

SEQ ID NO: 5775454 - DNA, 18 bp, Homo sapiens
ggtctatttctcccttca

SEQ ID NO: 5775455 - DNA, 21 bp, Homo sapiens
ggtctcaaactcctgggctca

SEQ ID NO: 5775456 - DNA, 21 bp, Homo sapiens
ggtctcacactcctcctgcca

SEQ ID NO: 5775457 - DNA, 22 bp, Homo sapiens
ggtctcacactcctcctgccag

SEQ ID NO: 5775458 - DNA, 20 bp, Homo sapiens
ggtctcacagtgttgcccag

SEQ ID NO: 5775459 - DNA, 21 bp, Homo sapiens
ggtctcacagtgttgcccagg

SEQ ID NO: 5775460 - DNA, 21 bp, Homo sapiens
ggtctcaccctggaggcacct

SEQ ID NO: 5775461 - DNA, 22 bp, Homo sapiens
ggtctcactatgttgcccaggc

SEQ ID NO: 5775462 - DNA, 23 bp, Homo sapiens
ggtctcactatgttgcccaggct

SEQ ID NO: 5775463 - DNA, 12 bp, Homo sapiens
ggtctcactctg

SEQ ID NO: 5775464 - DNA, 15 bp, Homo sapiens
ggtctcactctgtca

SEQ ID NO: 5775465 - DNA, 19 bp, Homo sapiens
ggtctcactctgtcgctca

SEQ ID NO: 5775466 - DNA, 15 bp, Homo sapiens
ggtctcactgctttg

SEQ ID NO: 5775467 - DNA, 18 bp, Homo sapiens
ggtctcagaatctttcct

SEQ ID NO: 5775468 - DNA, 14 bp, Homo sapiens
ggtctcagcttcat

SEQ ID NO: 5775469 - DNA, 14 bp, Homo sapiens
ggtctcaggtccag

SEQ ID NO: 5775470 - DNA, 15 bp, Homo sapiens
ggtctcaggtccagc

SEQ ID NO: 5775471 - DNA, 16 bp, Homo sapiens
ggtctcatctcccagg

SEQ ID NO: 5775472 - DNA, 19 bp, Homo sapiens
ggtctcatctcctttgcta

SEQ ID NO: 5775473 - DNA, 16 bp, Homo sapiens
ggtctcatgcccactc

SEQ ID NO: 5775474 - DNA, 22 bp, Homo sapiens
ggtctcatgccccgccatggtc

SEQ ID NO: 5775475 - DNA, 15 bp, Homo sapiens
ggtctcatgcctgag

SEQ ID NO: 5775476 - DNA, 21 bp, Homo sapiens
ggtctcatgtaacacataaac

SEQ ID NO: 5775477 - DNA, 19 bp, Homo sapiens
ggtctcattgcttctgact

SEQ ID NO: 5775478 - DNA, 12 bp, Homo sapiens
ggtctccaaggg

SEQ ID NO: 5775479 - DNA, 11 bp, Homo sapiens
ggtctccaccc

SEQ ID NO: 5775480 - DNA, 18 bp, Homo sapiens
ggtctccaccccagggtc

SEQ ID NO: 5775481 - DNA, 14 bp, Homo sapiens
ggtctccacccctc

SEQ ID NO: 5775482 - DNA, 18 bp, Homo sapiens
ggtctccacccctcaagc

SEQ ID NO: 5775483 - DNA, 15 bp, Homo sapiens
ggtctccacctcagg

SEQ ID NO: 5775484 - DNA, 19 bp, Homo sapiens
ggtctccacctcaggggag

SEQ ID NO: 5775485 - DNA, 14 bp, Homo sapiens
ggtctccacctgca

SEQ ID NO: 5775486 - DNA, 14 bp, Homo sapiens
ggtctccagctcct

SEQ ID NO: 5775487 - DNA, 13 bp, Homo sapiens
ggtctccagggag

SEQ ID NO: 5775488 - DNA, 21 bp, Homo sapiens
ggtctccatatcagctctctg

SEQ ID NO: 5775489 - DNA, 18 bp, Homo sapiens
ggtctccatttttcccag

SEQ ID NO: 5775490 - DNA, 23 bp, Homo sapiens
ggtctccatttttcccaggacag

SEQ ID NO: 5775491 - DNA, 18 bp, Homo sapiens
ggtcttcctactcttctc

SEQ ID NO: 5775492 - DNA, 19 bp, Homo sapiens
ggtcttcctactcttctct

SEQ ID NO: 5775493 - DNA, 17 bp, Homo sapiens
ggtcttcctgctttcca

SEQ ID NO: 5775494 - DNA, 18 bp, Homo sapiens
ggtcttcctgtggctccc

SEQ ID NO: 5775495 - DNA, 19 bp, Homo sapiens
ggtcttcctgtggctccct

SEQ ID NO: 5775496 - DNA, 10 bp, Homo sapiens
ggtcttcctt

SEQ ID NO: 5775497 - DNA, 13 bp, Homo sapiens
ggtcttctgcatc

SEQ ID NO: 5775498 - DNA, 16 bp, Homo sapiens
ggtcttcttgtgtcct

SEQ ID NO: 5775499 - DNA, 13 bp, Homo sapiens
ggtcttgaagtcc

SEQ ID NO: 5775500 - DNA, 22 bp, Homo sapiens
ggtcttgaatagattttctctg

SEQ ID NO: 5775501 - DNA, 20 bp, Homo sapiens
ggtcttgactcatggcagct

SEQ ID NO: 5775502 - DNA, 19 bp, Homo sapiens
ggtcttgcaaaattcctga

SEQ ID NO: 5775503 - DNA, 16 bp, Homo sapiens
ggtcttgcatttaaaa

SEQ ID NO: 5775504 - DNA, 14 bp, Homo sapiens
ggtcttgccccatc

SEQ ID NO: 5775505 - DNA, 13 bp, Homo sapiens
ggtcttgctctgt

SEQ ID NO: 5775506 - DNA, 15 bp, Homo sapiens
ggtcttgctctgtcc

SEQ ID NO: 5775507 - DNA, 13 bp, Homo sapiens
ggtcttggagagg

SEQ ID NO: 5775508 - DNA, 18 bp, Homo sapiens
ggtcttggccgactcagg

SEQ ID NO: 5775509 - DNA, 20 bp, Homo sapiens
ggtcttggccgactcaggga

SEQ ID NO: 5775510 - DNA, 13 bp, Homo sapiens
ggtcttgggaaat

SEQ ID NO: 5775511 - DNA, 16 bp, Homo sapiens
ggtcttgggctactgg

SEQ ID NO: 5775512 - DNA, 14 bp, Homo sapiens
ggtcttgggttcct

SEQ ID NO: 5775513 - DNA, 16 bp, Homo sapiens
ggtcttggtcatttgc

SEQ ID NO: 5775514 - DNA, 19 bp, Homo sapiens
ggtcttggtcatttgccaa

SEQ ID NO: 5775515 - DNA, 14 bp, Homo sapiens
ggtctttcagaaca

SEQ ID NO: 5775516 - DNA, 20 bp, Homo sapiens
ggtctttcagtactttttta

SEQ ID NO: 5775517 - DNA, 21 bp, Homo sapiens
ggtctttcatggggtgatgct

SEQ ID NO: 5775518 - DNA, 18 bp, Homo sapiens
ggtctttctaatgtagct

SEQ ID NO: 5775519 - DNA, 16 bp, Homo sapiens
ggtctttctcctcagg

SEQ ID NO: 5775520 - DNA, 17 bp, Homo sapiens
ggtctttctcctcagga

SEQ ID NO: 5775521 - DNA, 12 bp, Homo sapiens
ggtctttgaata

SEQ ID NO: 5775522 - DNA, 15 bp, Homo sapiens
ggtctttgaataaag

SEQ ID NO: 5775523 - DNA, 15 bp, Homo sapiens
ggtctttgtaagaac

SEQ ID NO: 5775524 - DNA, 15 bp, Homo sapiens
ggtctttgtaagagt

SEQ ID NO: 5775525 - DNA, 14 bp, Homo sapiens
ggtctttgtatctt

SEQ ID NO: 5775526 - DNA, 21 bp, Homo sapiens
ggtctttgttatgacagtgaa

SEQ ID NO: 5775527 - DNA, 23 bp, Homo sapiens
ggtcttttaccctgtgtcagagc

SEQ ID NO: 5775528 - DNA, 13 bp, Homo sapiens
ggtcttttcaaat

SEQ ID NO: 5775529 - DNA, 19 bp, Homo sapiens
ggtcttttcatctgggaaa

SEQ ID NO: 5775530 - DNA, 13 bp, Homo sapiens
ggtcttttctcct

SEQ ID NO: 5775531 - DNA, 15 bp, Homo sapiens
ggtcttttggctctg

SEQ ID NO: 5775532 - DNA, 20 bp, Homo sapiens
ggtcttttgtatttttgatt

SEQ ID NO: 5775533 - DNA, 15 bp, Homo sapiens
ggtctttttaaacca

SEQ ID NO: 5775534 - DNA, 17 bp, Homo sapiens
ggtctttttatgcattt

SEQ ID NO: 5775535 - DNA, 22 bp, Homo sapiens
ggtctttttctagggtccctga

SEQ ID NO: 5775536 - DNA, 17 bp, Homo sapiens
ggtctttttctcttctg

SEQ ID NO: 5775537 - DNA, 22 bp, Homo sapiens
ggtgaaaagggcagaggcaagg

SEQ ID NO: 5775538 - DNA, 17 bp, Homo sapiens
ggtgaaaagtatggcag

SEQ ID NO: 5775539 - DNA, 22 bp, Homo sapiens
ggtgaaaagtatggcagtggga

SEQ ID NO: 5775540 - DNA, 19 bp, Homo sapiens
ggtgaaaataagaaagaat

SEQ ID NO: 5775541 - DNA, 18 bp, Homo sapiens
ggtgaaaattagggttgg

SEQ ID NO: 5775542 - DNA, 13 bp, Homo sapiens
ggtgaaaattatt

SEQ ID NO: 5775543 - DNA, 14 bp, Homo sapiens
ggtgaaaattattt

SEQ ID NO: 5775544 - DNA, 13 bp, Homo sapiens
ggtgaaacacaca

SEQ ID NO: 5775545 - DNA, 19 bp, Homo sapiens
ggtgaaacattttctccct

SEQ ID NO: 5775546 - DNA, 20 bp, Homo sapiens
ggtgaaacattttctccctg

SEQ ID NO: 5775547 - DNA, 20 bp, Homo sapiens
ggtgaaacgactcaaaatga

SEQ ID NO: 5775548 - DNA, 22 bp, Homo sapiens
ggtgaaacgactcaaaatgaca

SEQ ID NO: 5775549 - DNA, 19 bp, Homo sapiens
ggtgaaagaaagggaccca

SEQ ID NO: 5775550 - DNA, 19 bp, Homo sapiens
ggtgaaagaaatcatgtta

SEQ ID NO: 5775551 - DNA, 23 bp, Homo sapiens
ggtgaaagagtaaaaccaaaggt

SEQ ID NO: 5775552 - DNA, 16 bp, Homo sapiens
ggtgaaagtgctgctc

SEQ ID NO: 5775553 - DNA, 17 bp, Homo sapiens
ggtgaaagtgctgctct

SEQ ID NO: 5775554 - DNA, 13 bp, Homo sapiens
ggtgaaataataa

SEQ ID NO: 5775555 - DNA, 19 bp, Homo sapiens
ggtgaaataataaaatgca

SEQ ID NO: 5775556 - DNA, 22 bp, Homo sapiens
ggtgaaataataaaatgcaaat

SEQ ID NO: 5775557 - DNA, 15 bp, Homo sapiens
ggtgaaatctgctct

SEQ ID NO: 5775558 - DNA, 23 bp, Homo sapiens
ggtgaaatttattagttaatata

SEQ ID NO: 5775559 - DNA, 15 bp, Homo sapiens
ggtgaacactgtgac

SEQ ID NO: 5775560 - DNA, 15 bp, Homo sapiens
ggtgaacagctggtg

SEQ ID NO: 5775561 - DNA, 22 bp, Homo sapiens
ggtgaacagtcacgcctgaaac

SEQ ID NO: 5775562 - DNA, 23 bp, Homo sapiens
ggtgaaccatgtcagcaaaaagc

SEQ ID NO: 5775563 - DNA, 15 bp, Homo sapiens
ggtgaactgaagcag

SEQ ID NO: 5775564 - DNA, 17 bp, Homo sapiens
ggtgaactgaagcagag

SEQ ID NO: 5775565 - DNA, 15 bp, Homo sapiens
ggtgaactgcaaagc

SEQ ID NO: 5775566 - DNA, 17 bp, Homo sapiens
ggtgaactgcaaagctt

SEQ ID NO: 5775567 - DNA, 17 bp, Homo sapiens
ggtgaagctatttatct

SEQ ID NO: 5775568 - DNA, 18 bp, Homo sapiens
ggtgaagctatttatctg

SEQ ID NO: 5775569 - DNA, 21 bp, Homo sapiens
ggtgaagctcacttctgggct

SEQ ID NO: 5775570 - DNA, 16 bp, Homo sapiens
ggtgaagctggggaca

SEQ ID NO: 5775571 - DNA, 19 bp, Homo sapiens
ggtgaagctggggacagct

SEQ ID NO: 5775572 - DNA, 18 bp, Homo sapiens
ggtgaaggaggctccagg

SEQ ID NO: 5775573 - DNA, 21 bp, Homo sapiens
ggtgaaggaggtcaggcccca

SEQ ID NO: 5775574 - DNA, 18 bp, Homo sapiens
ggtgaaggcctggctgga

SEQ ID NO: 5775575 - DNA, 16 bp, Homo sapiens
ggtgaaggctctcacc

SEQ ID NO: 5775576 - DNA, 13 bp, Homo sapiens
ggtgaagggatgg

SEQ ID NO: 5775577 - DNA, 16 bp, Homo sapiens
ggtgaaggggctggtg

SEQ ID NO: 5775578 - DNA, 18 bp, Homo sapiens
ggtgaagtgaagacaatg

SEQ ID NO: 5775579 - DNA, 18 bp, Homo sapiens
ggtgaagtgcctgctggg

SEQ ID NO: 5775580 - DNA, 13 bp, Homo sapiens
ggtgaagtgtggc

SEQ ID NO: 5775581 - DNA, 15 bp, Homo sapiens
ggtgaagtgtggctg

SEQ ID NO: 5775582 - DNA, 16 bp, Homo sapiens
ggtgaagtgtggctgg

SEQ ID NO: 5775583 - DNA, 20 bp, Homo sapiens
ggtgaagtgtggctggtgtc

SEQ ID NO: 5775584 - DNA, 23 bp, Homo sapiens
ggtgaagttaaaacacctttcct

SEQ ID NO: 5775585 - DNA, 13 bp, Homo sapiens
ggtgaatatggaa

SEQ ID NO: 5775586 - DNA, 16 bp, Homo sapiens
ggtgaatcttgtctaa

SEQ ID NO: 5775587 - DNA, 21 bp, Homo sapiens
ggtgacaaagatggctcagag

SEQ ID NO: 5775588 - DNA, 17 bp, Homo sapiens
ggtgacaagatagagag

SEQ ID NO: 5775589 - DNA, 20 bp, Homo sapiens
ggtgacacagactcatcctg

SEQ ID NO: 5775590 - DNA, 18 bp, Homo sapiens
ggtgacacaggtcagggc

SEQ ID NO: 5775591 - DNA, 13 bp, Homo sapiens
ggtgacacatcca

SEQ ID NO: 5775592 - DNA, 16 bp, Homo sapiens
ggtgacacctccccct

SEQ ID NO: 5775593 - DNA, 17 bp, Homo sapiens
ggtgacacctccccctt

SEQ ID NO: 5775594 - DNA, 20 bp, Homo sapiens
ggtgacacgcttctgagcag

SEQ ID NO: 5775595 - DNA, 16 bp, Homo sapiens
ggtgacagagcaagac

SEQ ID NO: 5775596 - DNA, 13 bp, Homo sapiens
ggtgacagaggga

SEQ ID NO: 5775597 - DNA, 12 bp, Homo sapiens
ggtgacaggcag

SEQ ID NO: 5775598 - DNA, 12 bp, Homo sapiens
ggtgacagtcat

SEQ ID NO: 5775599 - DNA, 22 bp, Homo sapiens
ggtgacagtcatcatcagggcc

SEQ ID NO: 5775600 - DNA, 14 bp, Homo sapiens
ggtgacagtcctcc

SEQ ID NO: 5775601 - DNA, 16 bp, Homo sapiens
ggtgacatatacatac

SEQ ID NO: 5775602 - DNA, 20 bp, Homo sapiens
ggtgacatcccaggaggggc

SEQ ID NO: 5775603 - DNA, 15 bp, Homo sapiens
ggtgacatccgtccc

SEQ ID NO: 5775604 - DNA, 17 bp, Homo sapiens
ggtgacatcggaaaaat

SEQ ID NO: 5775605 - DNA, 14 bp, Homo sapiens
ggtgacatttccca

SEQ ID NO: 5775606 - DNA, 21 bp, Homo sapiens
ggtgaccaaaatccccttctc

SEQ ID NO: 5775607 - DNA, 22 bp, Homo sapiens
ggtgaccaatactactgtaaat

SEQ ID NO: 5775608 - DNA, 23 bp, Homo sapiens
ggtgaccaccccctgttccctgt

SEQ ID NO: 5775609 - DNA, 17 bp, Homo sapiens
ggtgaccagtttcttaa

SEQ ID NO: 5775610 - DNA, 18 bp, Homo sapiens
ggtgacccacagctctgg

SEQ ID NO: 5775611 - DNA, 23 bp, Homo sapiens
ggtgacccacagctctgggcctc

SEQ ID NO: 5775612 - DNA, 13 bp, Homo sapiens
ggtgaccccaggg

SEQ ID NO: 5775613 - DNA, 15 bp, Homo sapiens
ggtgaccccagggca

SEQ ID NO: 5775614 - DNA, 16 bp, Homo sapiens
ggtgaccccagggcac

SEQ ID NO: 5775615 - DNA, 20 bp, Homo sapiens
ggtgaccccagggcacagga

SEQ ID NO: 5775616 - DNA, 22 bp, Homo sapiens
ggtgacccggcaccccctgcag

SEQ ID NO: 5775617 - DNA, 23 bp, Homo sapiens
ggtgacccggcaccccctgcagc

SEQ ID NO: 5775618 - DNA, 19 bp, Homo sapiens
ggtgacctcacacacctct

SEQ ID NO: 5775619 - DNA, 20 bp, Homo sapiens
ggtgacctcacacacctctg

SEQ ID NO: 5775620 - DNA, 23 bp, Homo sapiens
ggtgacctcacacacctctgccc

SEQ ID NO: 5775621 - DNA, 20 bp, Homo sapiens
ggtgacctccggccaggtgc

SEQ ID NO: 5775622 - DNA, 14 bp, Homo sapiens
ggtgacctcctgca

SEQ ID NO: 5775623 - DNA, 24 bp, Homo sapiens
ggtgacctcctgtcactcactgag

SEQ ID NO: 5775624 - DNA, 19 bp, Homo sapiens
ggtgaccttccaagagcct

SEQ ID NO: 5775625 - DNA, 20 bp, Homo sapiens
ggtgacgatgggtgttgctg

SEQ ID NO: 5775626 - DNA, 13 bp, Homo sapiens
ggtgacgcccagc

SEQ ID NO: 5775627 - DNA, 17 bp, Homo sapiens
ggtgacgcccagctccg

SEQ ID NO: 5775628 - DNA, 13 bp, Homo sapiens
ggtgacgcctgag

SEQ ID NO: 5775629 - DNA, 14 bp, Homo sapiens
ggtgacgcctgaga

SEQ ID NO: 5775630 - DNA, 17 bp, Homo sapiens
ggtgacgcctgagacag

SEQ ID NO: 5775631 - DNA, 17 bp, Homo sapiens
ggtgacggactcagact

SEQ ID NO: 5775632 - DNA, 21 bp, Homo sapiens
ggtgacgggactcaggcggga

SEQ ID NO: 5775633 - DNA, 22 bp, Homo sapiens
ggtgacggtcctttaggcagcc

SEQ ID NO: 5775634 - DNA, 15 bp, Homo sapiens
ggtgactgaacgagg

SEQ ID NO: 5775635 - DNA, 18 bp, Homo sapiens
ggtgactgaattcacaga

SEQ ID NO: 5775636 - DNA, 14 bp, Homo sapiens
ggtgactgtctggg

SEQ ID NO: 5775637 - DNA, 21 bp, Homo sapiens
ggtgactgtctggggagcggg

SEQ ID NO: 5775638 - DNA, 12 bp, Homo sapiens
ggtgactgtgct

SEQ ID NO: 5775639 - DNA, 16 bp, Homo sapiens
ggtgactgtgctgtgc

SEQ ID NO: 5775640 - DNA, 19 bp, Homo sapiens
ggtgacttcacagtgaagt

SEQ ID NO: 5775641 - DNA, 21 bp, Homo sapiens
ggtgacttcaggtggagagca

SEQ ID NO: 5775642 - DNA, 14 bp, Homo sapiens
ggtgacttcctctg

SEQ ID NO: 5775643 - DNA, 15 bp, Homo sapiens
ggtgacttctgctgc

SEQ ID NO: 5775644 - DNA, 18 bp, Homo sapiens
ggtgacttgcctggggcc

SEQ ID NO: 5775645 - DNA, 15 bp, Homo sapiens
ggtgacttgtctgcc

SEQ ID NO: 5775646 - DNA, 21 bp, Homo sapiens
ggtgacttgtctgcctcctgc

SEQ ID NO: 5775647 - DNA, 13 bp, Homo sapiens
ggtgactttctga

SEQ ID NO: 5775648 - DNA, 13 bp, Homo sapiens
ggtgagaaaactc

SEQ ID NO: 5775649 - DNA, 15 bp, Homo sapiens
ggtgagaaatttaaa

SEQ ID NO: 5775650 - DNA, 19 bp, Homo sapiens
ggtgagaactcagaagaga

SEQ ID NO: 5775651 - DNA, 17 bp, Homo sapiens
ggtgagaagtacagggc

SEQ ID NO: 5775652 - DNA, 18 bp, Homo sapiens
ggtgagaatcctgcctct

SEQ ID NO: 5775653 - DNA, 21 bp, Homo sapiens
ggtgagaattgggcggctctg

SEQ ID NO: 5775654 - DNA, 16 bp, Homo sapiens
ggtgagacagtggggg

SEQ ID NO: 5775655 - DNA, 18 bp, Homo sapiens
ggtgagacagttgcccga

SEQ ID NO: 5775656 - DNA, 15 bp, Homo sapiens
ggtgagactccatct

SEQ ID NO: 5775657 - DNA, 21 bp, Homo sapiens
ggtgagagaccacacatttta

SEQ ID NO: 5775658 - DNA, 14 bp, Homo sapiens
ggtgagagagacag

SEQ ID NO: 5775659 - DNA, 14 bp, Homo sapiens
ggtgagaggcagga

SEQ ID NO: 5775660 - DNA, 18 bp, Homo sapiens
ggtgagaggcaggaatgg

SEQ ID NO: 5775661 - DNA, 20 bp, Homo sapiens
ggtgagagggccgggcagag

SEQ ID NO: 5775662 - DNA, 17 bp, Homo sapiens
ggtgagagtgggaggga

SEQ ID NO: 5775663 - DNA, 24 bp, Homo sapiens
ggtgagcaggcagggctgggccag

SEQ ID NO: 5775664 - DNA, 21 bp, Homo sapiens
ggtgagcagggccctcagagg

SEQ ID NO: 5775665 - DNA, 20 bp, Homo sapiens
ggtgagccaaggacagggct

SEQ ID NO: 5775666 - DNA, 14 bp, Homo sapiens
ggtgagccaagggg

SEQ ID NO: 5775667 - DNA, 12 bp, Homo sapiens
ggtgagccagtg

SEQ ID NO: 5775668 - DNA, 14 bp, Homo sapiens
ggtgagccccgccg

SEQ ID NO: 5775669 - DNA, 16 bp, Homo sapiens
ggtgccccacctgcct

SEQ ID NO: 5775670 - DNA, 13 bp, Homo sapiens
ggtgccccaggac

SEQ ID NO: 5775671 - DNA, 16 bp, Homo sapiens
ggtgccccaggaccag

SEQ ID NO: 5775672 - DNA, 23 bp, Homo sapiens
ggtgccccaggaccagctcagga

SEQ ID NO: 5775673 - DNA, 23 bp, Homo sapiens
ggtgcccccagacagctgctcag

SEQ ID NO: 5775674 - DNA, 22 bp, Homo sapiens
ggtgccccccatgccctccctg

SEQ ID NO: 5775675 - DNA, 12 bp, Homo sapiens
ggtgccccctcc

SEQ ID NO: 5775676 - DNA, 18 bp, Homo sapiens
ggtgccccctggggggca

SEQ ID NO: 5775677 - DNA, 21 bp, Homo sapiens
ggtgccccgtggtacattcac

SEQ ID NO: 5775678 - DNA, 13 bp, Homo sapiens
ggtgcccctggga

SEQ ID NO: 5775679 - DNA, 15 bp, Homo sapiens
ggtgcccgggcaggg

SEQ ID NO: 5775680 - DNA, 13 bp, Homo sapiens
ggtgccctccact

SEQ ID NO: 5775681 - DNA, 19 bp, Homo sapiens
ggtgccctcgcctcctcct

SEQ ID NO: 5775682 - DNA, 14 bp, Homo sapiens
ggtgccctctcagg

SEQ ID NO: 5775683 - DNA, 13 bp, Homo sapiens
ggtgccctctgga

SEQ ID NO: 5775684 - DNA, 17 bp, Homo sapiens
ggtgccctctggatcct

SEQ ID NO: 5775685 - DNA, 20 bp, Homo sapiens
ggtgccctctggatcctgct

SEQ ID NO: 5775686 - DNA, 23 bp, Homo sapiens
ggtgccctctggatcctgctgtg

SEQ ID NO: 5775687 - DNA, 16 bp, Homo sapiens
ggtgccctgaaagggc

SEQ ID NO: 5775688 - DNA, 19 bp, Homo sapiens
ggtgccctgaaagggccct

SEQ ID NO: 5775689 - DNA, 13 bp, Homo sapiens
ggtgccctggccc

SEQ ID NO: 5775690 - DNA, 17 bp, Homo sapiens
ggtgccctggtggcctg

SEQ ID NO: 5775691 - DNA, 13 bp, Homo sapiens
ggtgccctgtggg

SEQ ID NO: 5775692 - DNA, 19 bp, Homo sapiens
ggtgccctgttctctacca

SEQ ID NO: 5775693 - DNA, 23 bp, Homo sapiens
ggtgccctgttgacctaccctgg

SEQ ID NO: 5775694 - DNA, 17 bp, Homo sapiens
ggtgcccttccctggag

SEQ ID NO: 5775695 - DNA, 19 bp, Homo sapiens
ggtgcccttccctggaggt

SEQ ID NO: 5775696 - DNA, 21 bp, Homo sapiens
ggtgcccttggtagcagcctg

SEQ ID NO: 5775697 - DNA, 19 bp, Homo sapiens
ggtgccgcgggcgagaagg

SEQ ID NO: 5775698 - DNA, 17 bp, Homo sapiens
ggtgccgctctctctga

SEQ ID NO: 5775699 - DNA, 15 bp, Homo sapiens
ggtgccgctgtctct

SEQ ID NO: 5775700 - DNA, 17 bp, Homo sapiens
ggtgccgctgtctctga

SEQ ID NO: 5775701 - DNA, 20 bp, Homo sapiens
ggtgccggaaagagagctgg

SEQ ID NO: 5775702 - DNA, 22 bp, Homo sapiens
ggtgccggaaagagagctggag

SEQ ID NO: 5775703 - DNA, 17 bp, Homo sapiens
ggtgccggggaggggca

SEQ ID NO: 5775704 - DNA, 14 bp, Homo sapiens
ggtgccgtgagcag

SEQ ID NO: 5775705 - DNA, 19 bp, Homo sapiens
ggtgccgtgcgggcgaggc

SEQ ID NO: 5775706 - DNA, 20 bp, Homo sapiens
ggtgcctaagaagttatttt

SEQ ID NO: 5775707 - DNA, 16 bp, Homo sapiens
ggtgcctaggcctggg

SEQ ID NO: 5775708 - DNA, 18 bp, Homo sapiens
ggtgcctatttattgggg

SEQ ID NO: 5775709 - DNA, 13 bp, Homo sapiens
ggtgcctcagact

SEQ ID NO: 5775710 - DNA, 23 bp, Homo sapiens
ggtgcctcagactccgccctcct

SEQ ID NO: 5775711 - DNA, 17 bp, Homo sapiens
ggtgcctcagagcaggc

SEQ ID NO: 5775712 - DNA, 21 bp, Homo sapiens
ggtgcctcatagcatagccag

SEQ ID NO: 5775713 - DNA, 12 bp, Homo sapiens
ggtgcctcccag

SEQ ID NO: 5775714 - DNA, 20 bp, Homo sapiens
ggtgcctcctccccaggtgg

SEQ ID NO: 5775715 - DNA, 11 bp, Homo sapiens
ggtgcctcctg

SEQ ID NO: 5775716 - DNA, 12 bp, Homo sapiens
ggtgcctcctgc

SEQ ID NO: 5775717 - DNA, 13 bp, Homo sapiens
ggtgcctcctgca

SEQ ID NO: 5775718 - DNA, 12 bp, Homo sapiens
ggtgcctcctgt

SEQ ID NO: 5775719 - DNA, 12 bp, Homo sapiens
ggtgcctctgtg

SEQ ID NO: 5775720 - DNA, 13 bp, Homo sapiens
ggtgcctctgtgc

SEQ ID NO: 5775721 - DNA, 15 bp, Homo sapiens
ggtgcctgagctggg

SEQ ID NO: 5775722 - DNA, 18 bp, Homo sapiens
ggtgcctgccatagccag

SEQ ID NO: 5775723 - DNA, 20 bp, Homo sapiens
ggtgcctgccatagccagga

SEQ ID NO: 5775724 - DNA, 22 bp, Homo sapiens
ggtgcctgccatagccaggagc

SEQ ID NO: 5775725 - DNA, 23 bp, Homo sapiens
ggtgcctgcctctgccatgccca

SEQ ID NO: 5775726 - DNA, 22 bp, Homo sapiens
ggtgcctgctttgacgggccag

SEQ ID NO: 5775727 - DNA, 21 bp, Homo sapiens
ggtgcctggcttgctgtggct

SEQ ID NO: 5775728 - DNA, 12 bp, Homo sapiens
ggtgcctggggc

SEQ ID NO: 5775729 - DNA, 19 bp, Homo sapiens
ggtgcctggggctggctgc

SEQ ID NO: 5775730 - DNA, 19 bp, Homo sapiens
ggtgcctgggtggggctgc

SEQ ID NO: 5775731 - DNA, 13 bp, Homo sapiens
ggtgcctgtccca

SEQ ID NO: 5775732 - DNA, 17 bp, Homo sapiens
ggtgcctgtcccacccc

SEQ ID NO: 5775733 - DNA, 21 bp, Homo sapiens
ggtgcctgtccttgaaaaaca

SEQ ID NO: 5775734 - DNA, 11 bp, Homo sapiens
ggtgcctgtgg

SEQ ID NO: 5775735 - DNA, 20 bp, Homo sapiens
ggtgccttacatcttttcta

SEQ ID NO: 5775736 - DNA, 16 bp, Homo sapiens
ggtgccttcactgggc

SEQ ID NO: 5775737 - DNA, 18 bp, Homo sapiens
ggtgccttcactgggcca

SEQ ID NO: 5775738 - DNA, 23 bp, Homo sapiens
ggtgccttccaccctgccctggc

SEQ ID NO: 5775739 - DNA, 20 bp, Homo sapiens
ggtgccttcttcagggcctg

SEQ ID NO: 5775740 - DNA, 17 bp, Homo sapiens
ggtgcctttatttccac

SEQ ID NO: 5775741 - DNA, 14 bp, Homo sapiens
ggtgcgaccccatc

SEQ ID NO: 5775742 - DNA, 21 bp, Homo sapiens
ggtgcgagagaggtgggcagc

SEQ ID NO: 5775743 - DNA, 16 bp, Homo sapiens
ggtgcgctcacctgca

SEQ ID NO: 5775744 - DNA, 14 bp, Homo sapiens
ggtgcgctgtgctc

SEQ ID NO: 5775745 - DNA, 19 bp, Homo sapiens
ggtgcgctgtgctccagca

SEQ ID NO: 5775746 - DNA, 14 bp, Homo sapiens
ggtgcggcaggagc

SEQ ID NO: 5775747 - DNA, 22 bp, Homo sapiens
ggtgcggcagggcaggagcttg

SEQ ID NO: 5775748 - DNA, 17 bp, Homo sapiens
ggtgcgggcacctgtag

SEQ ID NO: 5775749 - DNA, 13 bp, Homo sapiens
ggtgcgggccagg

SEQ ID NO: 5775750 - DNA, 13 bp, Homo sapiens
ggtgcgggcctgg

SEQ ID NO: 5775751 - DNA, 14 bp, Homo sapiens
ggtgcgggcctggc

SEQ ID NO: 5775752 - DNA, 21 bp, Homo sapiens
ggtgcggtaggtgctggcctc

SEQ ID NO: 5775753 - DNA, 22 bp, Homo sapiens
ggtgcgtcccccgttgtgcctg

SEQ ID NO: 5775754 - DNA, 14 bp, Homo sapiens
ggtgcgtctccagt

SEQ ID NO: 5775755 - DNA, 18 bp, Homo sapiens
ggtgcgtggctgtggcac

SEQ ID NO: 5775756 - DNA, 18 bp, Homo sapiens
ggtgctaaaaatgaaaat

SEQ ID NO: 5775757 - DNA, 20 bp, Homo sapiens
ggtgctaaatggtcgcccag

SEQ ID NO: 5775758 - DNA, 18 bp, Homo sapiens
ggtgctactggggaaact

SEQ ID NO: 5775759 - DNA, 14 bp, Homo sapiens
ggtgctagctctta

SEQ ID NO: 5775760 - DNA, 22 bp, Homo sapiens
ggtgctaggcccctgtgtagta

SEQ ID NO: 5775761 - DNA, 15 bp, Homo sapiens
ggtgctagggtgcct

SEQ ID NO: 5775762 - DNA, 18 bp, Homo sapiens
ggtgctagggtgcctgct

SEQ ID NO: 5775763 - DNA, 24 bp, Homo sapiens
ggtgctagtgggccctctctctgg

SEQ ID NO: 5775764 - DNA, 22 bp, Homo sapiens
ggtgctatatccagttcctgct

SEQ ID NO: 5775765 - DNA, 14 bp, Homo sapiens
ggtgctatgaagcc

SEQ ID NO: 5775766 - DNA, 20 bp, Homo sapiens
ggtgctatgtcccaagagcc

SEQ ID NO: 5775767 - DNA, 19 bp, Homo sapiens
ggtgctcacaccccattgg

SEQ ID NO: 5775768 - DNA, 17 bp, Homo sapiens
ggtgctcaccgcctgct

SEQ ID NO: 5775769 - DNA, 23 bp, Homo sapiens
ggtgctcagaataaggcaggcat

SEQ ID NO: 5775770 - DNA, 14 bp, Homo sapiens
ggtgctcagggggc

SEQ ID NO: 5775771 - DNA, 23 bp, Homo sapiens
ggtgctcataactagagtatgtg

SEQ ID NO: 5775772 - DNA, 15 bp, Homo sapiens
ggtgctccaggcagg

SEQ ID NO: 5775773 - DNA, 19 bp, Homo sapiens
ggtgctcctgcccagccac

SEQ ID NO: 5775774 - DNA, 16 bp, Homo sapiens
ggtgctctctttctgt

SEQ ID NO: 5775775 - DNA, 15 bp, Homo sapiens
ggtgctctgaggtca

SEQ ID NO: 5775776 - DNA, 20 bp, Homo sapiens
ggtgctctggcggcttcctg

SEQ ID NO: 5775777 - DNA, 13 bp, Homo sapiens
ggtgctctgtgtt

SEQ ID NO: 5775778 - DNA, 23 bp, Homo sapiens
ggtgctctgtgttcccagaggca

SEQ ID NO: 5775779 - DNA, 17 bp, Homo sapiens
ggtgctgaactgtgcat

SEQ ID NO: 5775780 - DNA, 20 bp, Homo sapiens
ggtgctgaatgaagctgcca

SEQ ID NO: 5775781 - DNA, 18 bp, Homo sapiens
ggtgctgactgaggcctg

SEQ ID NO: 5775782 - DNA, 19 bp, Homo sapiens
ggtgctgactggcttcagc

SEQ ID NO: 5775783 - DNA, 21 bp, Homo sapiens
ggtgctgacttcatctcccac

SEQ ID NO: 5775784 - DNA, 13 bp, Homo sapiens
ggtgctgagaagc

SEQ ID NO: 5775785 - DNA, 12 bp, Homo sapiens
ggtgctgagctt

SEQ ID NO: 5775786 - DNA, 18 bp, Homo sapiens
ggtgctgagtgtacagag

SEQ ID NO: 5775787 - DNA, 12 bp, Homo sapiens
ggtgctgatgga

SEQ ID NO: 5775788 - DNA, 16 bp, Homo sapiens
ggtgctgatgggaagg

SEQ ID NO: 5775789 - DNA, 14 bp, Homo sapiens
ggtgctgcaaggaa

SEQ ID NO: 5775790 - DNA, 20 bp, Homo sapiens
ggtgctgcaaggaagggtgg

SEQ ID NO: 5775791 - DNA, 12 bp, Homo sapiens
ggtgctgcagga

SEQ ID NO: 5775792 - DNA, 15 bp, Homo sapiens
ggtgctgcaggagtg

SEQ ID NO: 5775793 - DNA, 12 bp, Homo sapiens
ggtgctgccacc

SEQ ID NO: 5775794 - DNA, 21 bp, Homo sapiens
ggtgctgccatccaggttcag

SEQ ID NO: 5775795 - DNA, 12 bp, Homo sapiens
ggtgctgccctg

SEQ ID NO: 5775796 - DNA, 16 bp, Homo sapiens
ggtgctgccctgtgta

SEQ ID NO: 5775797 - DNA, 14 bp, Homo sapiens
ggtgctgccgaggg

SEQ ID NO: 5775798 - DNA, 19 bp, Homo sapiens
ggtgctgccgagggctggc

SEQ ID NO: 5775799 - DNA, 19 bp, Homo sapiens
ggtgctgctaccctccctg

SEQ ID NO: 5775800 - DNA, 23 bp, Homo sapiens
ggtgctgctaccctccctgctgt

SEQ ID NO: 5775801 - DNA, 14 bp, Homo sapiens
ggtgctgcttccct

SEQ ID NO: 5775802 - DNA, 21 bp, Homo sapiens
ggtgctgcttccctctgcctg

SEQ ID NO: 5775803 - DNA, 15 bp, Homo sapiens
ggtgctgctttgctt

SEQ ID NO: 5775804 - DNA, 19 bp, Homo sapiens
ggtgctgctttggctgact

SEQ ID NO: 5775805 - DNA, 18 bp, Homo sapiens
ggtgctggagcactgggc

SEQ ID NO: 5775806 - DNA, 16 bp, Homo sapiens
ggtgctggaggtggga

SEQ ID NO: 5775807 - DNA, 21 bp, Homo sapiens
ggtgctggaggtgggagcagg

SEQ ID NO: 5775808 - DNA, 22 bp, Homo sapiens
ggtgctggaggtgggagcagga

SEQ ID NO: 5775809 - DNA, 23 bp, Homo sapiens
ggtgctggaggttggatcttgat

SEQ ID NO: 5775810 - DNA, 16 bp, Homo sapiens
ggtgctggatattttc

SEQ ID NO: 5775811 - DNA, 11 bp, Homo sapiens
ggtgctggccc

SEQ ID NO: 5775812 - DNA, 14 bp, Homo sapiens
ggtgctggccccca

SEQ ID NO: 5775813 - DNA, 12 bp, Homo sapiens
ggtgctgggact

SEQ ID NO: 5775814 - DNA, 20 bp, Homo sapiens
ggtgctgggaggagggagag

SEQ ID NO: 5775815 - DNA, 15 bp, Homo sapiens
ggtgctgggcccctg

SEQ ID NO: 5775816 - DNA, 20 bp, Homo sapiens
ggtgctgggcccctgcctct

SEQ ID NO: 5775817 - DNA, 15 bp, Homo sapiens
ggtgctggggcagag

SEQ ID NO: 5775818 - DNA, 12 bp, Homo sapiens
ggtgctggggcc

SEQ ID NO: 5775819 - DNA, 17 bp, Homo sapiens
ggtgctggggccagggc

SEQ ID NO: 5775820 - DNA, 18 bp, Homo sapiens
ggtgctggggccagggca

SEQ ID NO: 5775821 - DNA, 13 bp, Homo sapiens
ggtgctggggctg

SEQ ID NO: 5775822 - DNA, 17 bp, Homo sapiens
ggtgctgggggcacagc

SEQ ID NO: 5775823 - DNA, 19 bp, Homo sapiens
ggtgctgggggcacagctg

SEQ ID NO: 5775824 - DNA, 18 bp, Homo sapiens
ggtgctgggtccttaaaa

SEQ ID NO: 5775825 - DNA, 16 bp, Homo sapiens
ggtgctggtagctgag

SEQ ID NO: 5775826 - DNA, 20 bp, Homo sapiens
ggtgctggtagctgagggga

SEQ ID NO: 5775827 - DNA, 19 bp, Homo sapiens
ggtgctggtgggtctgagc

SEQ ID NO: 5775828 - DNA, 22 bp, Homo sapiens
ggtgctggtgggtctgagctgg

SEQ ID NO: 5775829 - DNA, 18 bp, Homo sapiens
ggtgctgtcatgcccagc

SEQ ID NO: 5775830 - DNA, 19 bp, Homo sapiens
ggtgctgtcatgcccagct

SEQ ID NO: 5775831 - DNA, 11 bp, Homo sapiens
ggtgctgtcca

SEQ ID NO: 5775832 - DNA, 23 bp, Homo sapiens
ggtgctgtcctcaggtggccatg

SEQ ID NO: 5775833 - DNA, 23 bp, Homo sapiens
ggtgctgtgacaccccccttctg

SEQ ID NO: 5775834 - DNA, 20 bp, Homo sapiens
ggtgctgtgaggcttgccca

SEQ ID NO: 5775835 - DNA, 12 bp, Homo sapiens
ggtgctgtgtgc

SEQ ID NO: 5775836 - DNA, 18 bp, Homo sapiens
ggtgctgtgtgccccact

SEQ ID NO: 5775837 - DNA, 18 bp, Homo sapiens
ggtgcttaagcagaagca

SEQ ID NO: 5775838 - DNA, 21 bp, Homo sapiens
ggtgcttattaagaccaaaga

SEQ ID NO: 5775839 - DNA, 18 bp, Homo sapiens
ggtgcttccaacaaggac

SEQ ID NO: 5775840 - DNA, 15 bp, Homo sapiens
ggtgcttccctttca

SEQ ID NO: 5775841 - DNA, 20 bp, Homo sapiens
ggtgcttcctcctcaggccc

SEQ ID NO: 5775842 - DNA, 22 bp, Homo sapiens
ggtgcttctagttctgccagga

SEQ ID NO: 5775843 - DNA, 13 bp, Homo sapiens
ggtgcttgctgtg

SEQ ID NO: 5775844 - DNA, 13 bp, Homo sapiens
ggtgcttggaggg

SEQ ID NO: 5775845 - DNA, 15 bp, Homo sapiens
ggtgcttggaggggg

SEQ ID NO: 5775846 - DNA, 14 bp, Homo sapiens
ggtgcttgggcttc

SEQ ID NO: 5775847 - DNA, 14 bp, Homo sapiens
ggtggctcactact

SEQ ID NO: 5775848 - DNA, 15 bp, Homo sapiens
ggtggctcactactg

SEQ ID NO: 5775849 - DNA, 19 bp, Homo sapiens
ggtggctcatgcctgtaat

SEQ ID NO: 5775850 - DNA, 15 bp, Homo sapiens
ggtggctccccctct

SEQ ID NO: 5775851 - DNA, 13 bp, Homo sapiens
ggtggctcctcct

SEQ ID NO: 5775852 - DNA, 14 bp, Homo sapiens
ggtggctcctgcca

SEQ ID NO: 5775853 - DNA, 17 bp, Homo sapiens
ggtggctcctgccactg

SEQ ID NO: 5775854 - DNA, 23 bp, Homo sapiens
ggtggctcctgccactgacctca

SEQ ID NO: 5775855 - DNA, 14 bp, Homo sapiens
ggtggctctggaat

SEQ ID NO: 5775856 - DNA, 12 bp, Homo sapiens
ggtggctctggg

SEQ ID NO: 5775857 - DNA, 15 bp, Homo sapiens
ggtggctctggggta

SEQ ID NO: 5775858 - DNA, 21 bp, Homo sapiens
ggtggctctggggtatgtgtg

SEQ ID NO: 5775859 - DNA, 15 bp, Homo sapiens
ggtggctgacccagt

SEQ ID NO: 5775860 - DNA, 18 bp, Homo sapiens
ggtggctgacccagtccc

SEQ ID NO: 5775861 - DNA, 13 bp, Homo sapiens
ggtggctgagctt

SEQ ID NO: 5775862 - DNA, 21 bp, Homo sapiens
ggtggctgcaggcaccgctgg

SEQ ID NO: 5775863 - DNA, 16 bp, Homo sapiens
ggtggctgccccggcc

SEQ ID NO: 5775864 - DNA, 12 bp, Homo sapiens
ggtggctgcctt

SEQ ID NO: 5775865 - DNA, 14 bp, Homo sapiens
ggtggctgcctttg

SEQ ID NO: 5775866 - DNA, 22 bp, Homo sapiens
ggtggctggagacgggtgggcg

SEQ ID NO: 5775867 - DNA, 14 bp, Homo sapiens
ggtggctggagccc

SEQ ID NO: 5775868 - DNA, 11 bp, Homo sapiens
ggtggctgggc

SEQ ID NO: 5775869 - DNA, 13 bp, Homo sapiens
ggtggctgggcag

SEQ ID NO: 5775870 - DNA, 16 bp, Homo sapiens
ggtggctgggctgctc

SEQ ID NO: 5775871 - DNA, 22 bp, Homo sapiens
ggtggctgtgacaaccctggcc

SEQ ID NO: 5775872 - DNA, 23 bp, Homo sapiens
ggtggcttaagtgagcagaacag

SEQ ID NO: 5775873 - DNA, 14 bp, Homo sapiens
ggtggcttcagctc

SEQ ID NO: 5775874 - DNA, 16 bp, Homo sapiens
ggtggcttcggcctgc

SEQ ID NO: 5775875 - DNA, 21 bp, Homo sapiens
ggtggcttcttttctttgtat

SEQ ID NO: 5775876 - DNA, 21 bp, Homo sapiens
ggtggctttccttgtggcaga

SEQ ID NO: 5775877 - DNA, 22 bp, Homo sapiens
ggtggctttccttgtggcagag

SEQ ID NO: 5775878 - DNA, 21 bp, Homo sapiens
ggtgggaaccatgaagacagg

SEQ ID NO: 5775879 - DNA, 19 bp, Homo sapiens
ggtgggaagcaagcagggg

SEQ ID NO: 5775880 - DNA, 12 bp, Homo sapiens
ggtgggaaggaa

SEQ ID NO: 5775881 - DNA, 23 bp, Homo sapiens
ggtgggaaggggagcacaatttc

SEQ ID NO: 5775882 - DNA, 14 bp, Homo sapiens
ggtgggacacagag

SEQ ID NO: 5775883 - DNA, 17 bp, Homo sapiens
ggtgggacaccctgtga

SEQ ID NO: 5775884 - DNA, 14 bp, Homo sapiens
ggtgggacagcccc

SEQ ID NO: 5775885 - DNA, 16 bp, Homo sapiens
ggtgggacagccccag

SEQ ID NO: 5775886 - DNA, 14 bp, Homo sapiens
ggtgggacagcctc

SEQ ID NO: 5775887 - DNA, 14 bp, Homo sapiens
ggtgggacagggag

SEQ ID NO: 5775888 - DNA, 14 bp, Homo sapiens
ggtgggacagggct

SEQ ID NO: 5775889 - DNA, 15 bp, Homo sapiens
ggtgggacagggctt

SEQ ID NO: 5775890 - DNA, 15 bp, Homo sapiens
ggtgggagagcccag

SEQ ID NO: 5775891 - DNA, 16 bp, Homo sapiens
ggtgggagagcccagc

SEQ ID NO: 5775892 - DNA, 18 bp, Homo sapiens
ggtgggagctcctccgca

SEQ ID NO: 5775893 - DNA, 20 bp, Homo sapiens
ggtgggaggagatgaaaata

SEQ ID NO: 5775894 - DNA, 15 bp, Homo sapiens
ggtgggaggccaggc

SEQ ID NO: 5775895 - DNA, 24 bp, Homo sapiens
ggtgggaggcccctggtggcatgg

SEQ ID NO: 5775896 - DNA, 16 bp, Homo sapiens
ggtgggaggctcccag

SEQ ID NO: 5775897 - DNA, 12 bp, Homo sapiens
ggtgggagggga

SEQ ID NO: 5775898 - DNA, 14 bp, Homo sapiens
ggtgggagggtctg

SEQ ID NO: 5775899 - DNA, 18 bp, Homo sapiens
ggtgggaggtaggctgtg

SEQ ID NO: 5775900 - DNA, 19 bp, Homo sapiens
ggtgggatcctccaggtgc

SEQ ID NO: 5775901 - DNA, 17 bp, Homo sapiens
ggtgggcacccaccctg

SEQ ID NO: 5775902 - DNA, 20 bp, Homo sapiens
ggtgggcagatcacgaggtc

SEQ ID NO: 5775903 - DNA, 20 bp, Homo sapiens
ggtgggcagcagcatcccag

SEQ ID NO: 5775904 - DNA, 14 bp, Homo sapiens
ggtgggcagccatg

SEQ ID NO: 5775905 - DNA, 13 bp, Homo sapiens
ggtgggcagggag

SEQ ID NO: 5775906 - DNA, 17 bp, Homo sapiens
ggtgggcagggaggggc

SEQ ID NO: 5775907 - DNA, 18 bp, Homo sapiens
ggtgggcagggaggggct

SEQ ID NO: 5775908 - DNA, 12 bp, Homo sapiens
ggtgggcagggc

SEQ ID NO: 5775909 - DNA, 15 bp, Homo sapiens
ggtgggcagggctgg

SEQ ID NO: 5775910 - DNA, 14 bp, Homo sapiens
ggtgggcagtgagt

SEQ ID NO: 5775911 - DNA, 12 bp, Homo sapiens
ggtgggcagtgg

SEQ ID NO: 5775912 - DNA, 12 bp, Homo sapiens
ggtgggccagag

SEQ ID NO: 5775913 - DNA, 14 bp, Homo sapiens
ggtgggccagagct

SEQ ID NO: 5775914 - DNA, 12 bp, Homo sapiens
ggtgggccaggc

SEQ ID NO: 5775915 - DNA, 20 bp, Homo sapiens
ggtgggccatatgcctacag

SEQ ID NO: 5775916 - DNA, 20 bp, Homo sapiens
ggtgggcccagaactgcccc

SEQ ID NO: 5775917 - DNA, 21 bp, Homo sapiens
ggtgggcccagaccactgtct

SEQ ID NO: 5775918 - DNA, 20 bp, Homo sapiens
ggtgggcccaggaccagctg

SEQ ID NO: 5775919 - DNA, 21 bp, Homo sapiens
ggtgggcccaggaccagctgg

SEQ ID NO: 5775920 - DNA, 18 bp, Homo sapiens
ggtgggccccacagtggt

SEQ ID NO: 5775921 - DNA, 23 bp, Homo sapiens
ggtgggccccacagtggtcagcg

SEQ ID NO: 5775922 - DNA, 11 bp, Homo sapiens
ggtgggccctg

SEQ ID NO: 5775923 - DNA, 16 bp, Homo sapiens
ggtgggccgcaggcgg

SEQ ID NO: 5775924 - DNA, 13 bp, Homo sapiens
ggtgggcctctgg

SEQ ID NO: 5775925 - DNA, 18 bp, Homo sapiens
ggtgggcctggccctgct

SEQ ID NO: 5775926 - DNA, 15 bp, Homo sapiens
ggtgggcctggcctg

SEQ ID NO: 5775927 - DNA, 13 bp, Homo sapiens
ggtgggcctggga

SEQ ID NO: 5775928 - DNA, 17 bp, Homo sapiens
ggtgggcggacaaaagg

SEQ ID NO: 5775929 - DNA, 13 bp, Homo sapiens
ggtgggctccaga

SEQ ID NO: 5775930 - DNA, 15 bp, Homo sapiens
ggtgggctccagagt

SEQ ID NO: 5775931 - DNA, 16 bp, Homo sapiens
ggtgggctctgtgcag

SEQ ID NO: 5775932 - DNA, 15 bp, Homo sapiens
ggtgggctgagccct

SEQ ID NO: 5775933 - DNA, 18 bp, Homo sapiens
ggtgggctgagccctggc

SEQ ID NO: 5775934 - DNA, 14 bp, Homo sapiens
ggtgggctgcctgc

SEQ ID NO: 5775935 - DNA, 13 bp, Homo sapiens
ggtgggctgggga

SEQ ID NO: 5775936 - DNA, 21 bp, Homo sapiens
ggtgggctggggactctggca

SEQ ID NO: 5775937 - DNA, 14 bp, Homo sapiens
ggtgggctggggct

SEQ ID NO: 5775938 - DNA, 20 bp, Homo sapiens
ggtgggcttcccagtggctg

SEQ ID NO: 5775939 - DNA, 21 bp, Homo sapiens
ggtgggctttgttgtgagaat

SEQ ID NO: 5775940 - DNA, 20 bp, Homo sapiens
ggtgggcttttccctgggtg

SEQ ID NO: 5775941 - DNA, 20 bp, Homo sapiens
ggtggggaagagagcctgcc

SEQ ID NO: 5775942 - DNA, 13 bp, Homo sapiens
ggtggggaatgtt

SEQ ID NO: 5775943 - DNA, 13 bp, Homo sapiens
ggtggggactggg

SEQ ID NO: 5775944 - DNA, 14 bp, Homo sapiens
ggtggggactgggc

SEQ ID NO: 5775945 - DNA, 11 bp, Homo sapiens
ggtggggaggc

SEQ ID NO: 5775946 - DNA, 23 bp, Homo sapiens
ggtggggaggccctgcctgaccc

SEQ ID NO: 5775947 - DNA, 13 bp, Homo sapiens
ggtggggagggcc

SEQ ID NO: 5775948 - DNA, 20 bp, Homo sapiens
ggtggggagggcctctggac

SEQ ID NO: 5775949 - DNA, 13 bp, Homo sapiens
ggtggggagggtg

SEQ ID NO: 5775950 - DNA, 14 bp, Homo sapiens
ggtggggatcctgc

SEQ ID NO: 5775951 - DNA, 22 bp, Homo sapiens
ggtggggcagaaaggctgcaac

SEQ ID NO: 5775952 - DNA, 17 bp, Homo sapiens
ggtggggcagcttgagg

SEQ ID NO: 5775953 - DNA, 12 bp, Homo sapiens
ggtggggcagga

SEQ ID NO: 5775954 - DNA, 18 bp, Homo sapiens
ggtggggcagtgcttggc

SEQ ID NO: 5775955 - DNA, 15 bp, Homo sapiens
ggtggggccagcgct

SEQ ID NO: 5775956 - DNA, 13 bp, Homo sapiens
ggtggggccaggc

SEQ ID NO: 5775957 - DNA, 17 bp, Homo sapiens
ggtggggccaggccagg

SEQ ID NO: 5775958 - DNA, 19 bp, Homo sapiens
ggtggggccaggccaggac

SEQ ID NO: 5775959 - DNA, 13 bp, Homo sapiens
ggtggggcccatg

SEQ ID NO: 5775960 - DNA, 20 bp, Homo sapiens
ggtggggcccatggaggaga

SEQ ID NO: 5775961 - DNA, 14 bp, Homo sapiens
ggtggggcccccag

SEQ ID NO: 5775962 - DNA, 15 bp, Homo sapiens
ggtggggcctcagcc

SEQ ID NO: 5775963 - DNA, 18 bp, Homo sapiens
ggtggggcctcagcctgg

SEQ ID NO: 5775964 - DNA, 15 bp, Homo sapiens
ggtggggcctggggt

SEQ ID NO: 5775965 - DNA, 12 bp, Homo sapiens
ggtggggctcgt

SEQ ID NO: 5775966 - DNA, 15 bp, Homo sapiens
ggtggggctgcatcc

SEQ ID NO: 5775967 - DNA, 17 bp, Homo sapiens
ggtggggctgctcctcc

SEQ ID NO: 5775968 - DNA, 22 bp, Homo sapiens
ggtggggctgctcctccagggc

SEQ ID NO: 5775969 - DNA, 12 bp, Homo sapiens
ggtggggcttct

SEQ ID NO: 5775970 - DNA, 22 bp, Homo sapiens
ggtggggcttggaagggcgctg

SEQ ID NO: 5775971 - DNA, 21 bp, Homo sapiens
ggtgggggagaaaaaatcact

SEQ ID NO: 5775972 - DNA, 14 bp, Homo sapiens
ggtgggggagcctc

SEQ ID NO: 5775973 - DNA, 17 bp, Homo sapiens
ggtgggggagcctctgg

SEQ ID NO: 5775974 - DNA, 14 bp, Homo sapiens
ggtgggggagggag

SEQ ID NO: 5775975 - DNA, 17 bp, Homo sapiens
ggtgggggcctcctcag

SEQ ID NO: 5775976 - DNA, 13 bp, Homo sapiens
ggtgggggcctgc

SEQ ID NO: 5775977 - DNA, 21 bp, Homo sapiens
ggtgggggcctgctgtgggtc

SEQ ID NO: 5775978 - DNA, 18 bp, Homo sapiens
ggtgggggctcctggtgg

SEQ ID NO: 5775979 - DNA, 20 bp, Homo sapiens
ggtgggggctcctggtggcc

SEQ ID NO: 5775980 - DNA, 21 bp, Homo sapiens
ggtgggggctgtggccctgcc

SEQ ID NO: 5775981 - DNA, 20 bp, Homo sapiens
ggtggggggatcacaaggtc

SEQ ID NO: 5775982 - DNA, 16 bp, Homo sapiens
ggtggggggcttcata

SEQ ID NO: 5775983 - DNA, 19 bp, Homo sapiens
ggtgggggggcagagccct

SEQ ID NO: 5775984 - DNA, 22 bp, Homo sapiens
ggtggggggggggcgcggctgg

SEQ ID NO: 5775985 - DNA, 18 bp, Homo sapiens
ggtggggggtccagtctg

SEQ ID NO: 5775986 - DNA, 10 bp, Homo sapiens
ggtgggggta

SEQ ID NO: 5775987 - DNA, 22 bp, Homo sapiens
ggtgggggtgccgctctctctg

SEQ ID NO: 5775988 - DNA, 21 bp, Homo sapiens
ggtgggggtgccgctgtctct

SEQ ID NO: 5775989 - DNA, 19 bp, Homo sapiens
ggtgggggtgctctctctg

SEQ ID NO: 5775990 - DNA, 13 bp, Homo sapiens
ggtgggggtgctg

SEQ ID NO: 5775991 - DNA, 15 bp, Homo sapiens
ggtgggggtggaatt

SEQ ID NO: 5775992 - DNA, 16 bp, Homo sapiens
ggtgggggtggaggct

SEQ ID NO: 5775993 - DNA, 22 bp, Homo sapiens
ggtgggggttctggcaggacct

SEQ ID NO: 5775994 - DNA, 15 bp, Homo sapiens
ggtggggtcactctg

SEQ ID NO: 5775995 - DNA, 14 bp, Homo sapiens
ggtggggtctggga

SEQ ID NO: 5775996 - DNA, 15 bp, Homo sapiens
ggtggggtgccccag

SEQ ID NO: 5775997 - DNA, 18 bp, Homo sapiens
ggtggggtgccccagcta

SEQ ID NO: 5775998 - DNA, 16 bp, Homo sapiens
ggtggggtggcacctg

SEQ ID NO: 5775999 - DNA, 16 bp, Homo sapiens
ggtggggtttcctgca

SEQ ID NO: 5776000 - DNA, 23 bp, Homo sapiens
ggtgggtatcccacctccagccc

SEQ ID NO: 5776001 - DNA, 20 bp, Homo sapiens
ggtgggtcaactccaaggca

SEQ ID NO: 5776002 - DNA, 17 bp, Homo sapiens
ggtgggtcagcccagca

SEQ ID NO: 5776003 - DNA, 19 bp, Homo sapiens
ggtgggtcagcccagcacc

SEQ ID NO: 5776004 - DNA, 20 bp, Homo sapiens
ggtgggtccaggaaggcagc

SEQ ID NO: 5776005 - DNA, 23 bp, Homo sapiens
ggtgggtccaggaaggcagctgc

SEQ ID NO: 5776006 - DNA, 20 bp, Homo sapiens
ggtgggtcccggctctgtgg

SEQ ID NO: 5776007 - DNA, 16 bp, Homo sapiens
ggtgggtctgagctgg

SEQ ID NO: 5776008 - DNA, 18 bp, Homo sapiens
ggtgggtctgagctggac

SEQ ID NO: 5776009 - DNA, 19 bp, Homo sapiens
ggtgggtctttaataaaac

SEQ ID NO: 5776010 - DNA, 21 bp, Homo sapiens
ggtgggtgaaggcctggctgg

SEQ ID NO: 5776011 - DNA, 13 bp, Homo sapiens
ggtgggtgctcag

SEQ ID NO: 5776012 - DNA, 19 bp, Homo sapiens
ggtgggtgctgccctgtgt

SEQ ID NO: 5776013 - DNA, 17 bp, Homo sapiens
ggtgggtgggcagggag

SEQ ID NO: 5776014 - DNA, 14 bp, Homo sapiens
ggtgggtgggcctg

SEQ ID NO: 5776015 - DNA, 15 bp, Homo sapiens
ggtgggtgggcctga

SEQ ID NO: 5776016 - DNA, 14 bp, Homo sapiens
ggtgggtggtgggg

SEQ ID NO: 5776017 - DNA, 19 bp, Homo sapiens
ggtgggtgtgagcagggtg

SEQ ID NO: 5776018 - DNA, 15 bp, Homo sapiens
ggtgggtgttcataa

SEQ ID NO: 5776019 - DNA, 19 bp, Homo sapiens
ggtgggttctttggaagga

SEQ ID NO: 5776020 - DNA, 17 bp, Homo sapiens
ggtgggtttagcaggct

SEQ ID NO: 5776021 - DNA, 17 bp, Homo sapiens
ggtgggttttcttccca

SEQ ID NO: 5776022 - DNA, 16 bp, Homo sapiens
ggtggtaccaggtctc

SEQ ID NO: 5776023 - DNA, 17 bp, Homo sapiens
ggtggtacttggcacca

SEQ ID NO: 5776024 - DNA, 18 bp, Homo sapiens
ggtggtagatttcctcct

SEQ ID NO: 5776025 - DNA, 16 bp, Homo sapiens
ggtggtattctgtcat

SEQ ID NO: 5776026 - DNA, 22 bp, Homo sapiens
ggtggtattggccgatgagctg

SEQ ID NO: 5776027 - DNA, 14 bp, Homo sapiens
ggtgtgtccagggg

SEQ ID NO: 5776028 - DNA, 19 bp, Homo sapiens
ggtgtgtccctggacacag

SEQ ID NO: 5776029 - DNA, 16 bp, Homo sapiens
ggtgtgtgcagggctg

SEQ ID NO: 5776030 - DNA, 17 bp, Homo sapiens
ggtgtgtgcagggctgc

SEQ ID NO: 5776031 - DNA, 19 bp, Homo sapiens
ggtgtgtggccgcctggca

SEQ ID NO: 5776032 - DNA, 19 bp, Homo sapiens
ggtgtgtggtgaggggctt

SEQ ID NO: 5776033 - DNA, 15 bp, Homo sapiens
ggtgtgtgtctctga

SEQ ID NO: 5776034 - DNA, 13 bp, Homo sapiens
ggtgtgtgttaca

SEQ ID NO: 5776035 - DNA, 14 bp, Homo sapiens
ggtgtgtgttcacc

SEQ ID NO: 5776036 - DNA, 18 bp, Homo sapiens
ggtgtgtgttcaccttca

SEQ ID NO: 5776037 - DNA, 22 bp, Homo sapiens
ggtgtgttcaagaccagcctgg

SEQ ID NO: 5776038 - DNA, 18 bp, Homo sapiens
ggtgtgttccaactgccc

SEQ ID NO: 5776039 - DNA, 16 bp, Homo sapiens
ggtgtgttcgtggagc

SEQ ID NO: 5776040 - DNA, 21 bp, Homo sapiens
ggtgtgttcgttgcacagctg

SEQ ID NO: 5776041 - DNA, 16 bp, Homo sapiens
ggtgtgttgcccgtgg

SEQ ID NO: 5776042 - DNA, 21 bp, Homo sapiens
ggtgtgtttggcttggccttg

SEQ ID NO: 5776043 - DNA, 14 bp, Homo sapiens
ggtgtgtttttggg

SEQ ID NO: 5776044 - DNA, 12 bp, Homo sapiens
ggtgttaatgag

SEQ ID NO: 5776045 - DNA, 16 bp, Homo sapiens
ggtgttacaaggcact

SEQ ID NO: 5776046 - DNA, 14 bp, Homo sapiens
ggtgttacattttc

SEQ ID NO: 5776047 - DNA, 17 bp, Homo sapiens
ggtgttagtgtcagcca

SEQ ID NO: 5776048 - DNA, 22 bp, Homo sapiens
ggtgttatttggaaccttgttt

SEQ ID NO: 5776049 - DNA, 16 bp, Homo sapiens
ggtgttcataatttca

SEQ ID NO: 5776050 - DNA, 22 bp, Homo sapiens
ggtgttccaaagagaaggcctg

SEQ ID NO: 5776051 - DNA, 19 bp, Homo sapiens
ggtgttccacctggaaact

SEQ ID NO: 5776052 - DNA, 17 bp, Homo sapiens
ggtgttcgtttccatca

SEQ ID NO: 5776053 - DNA, 11 bp, Homo sapiens
ggtgttctaag

SEQ ID NO: 5776054 - DNA, 15 bp, Homo sapiens
ggtgttctggcctct

SEQ ID NO: 5776055 - DNA, 22 bp, Homo sapiens
ggtgttctggcctctggcctgg

SEQ ID NO: 5776056 - DNA, 23 bp, Homo sapiens
ggtgttctggcctctggcctggg

SEQ ID NO: 5776057 - DNA, 15 bp, Homo sapiens
ggtgttctgtctggg

SEQ ID NO: 5776058 - DNA, 19 bp, Homo sapiens
ggtgttctttcctgccctg

SEQ ID NO: 5776059 - DNA, 13 bp, Homo sapiens
ggtgttgaatcca

SEQ ID NO: 5776060 - DNA, 15 bp, Homo sapiens
ggtgttgacacacca

SEQ ID NO: 5776061 - DNA, 17 bp, Homo sapiens
ggtgttgacatgtgctt

SEQ ID NO: 5776062 - DNA, 22 bp, Homo sapiens
ggtgttgaccactccagagaag

SEQ ID NO: 5776063 - DNA, 21 bp, Homo sapiens
ggtgttgactggactgcttgg

SEQ ID NO: 5776064 - DNA, 17 bp, Homo sapiens
ggtgttgcacagactgg

SEQ ID NO: 5776065 - DNA, 13 bp, Homo sapiens
ggtgttgcagccg

SEQ ID NO: 5776066 - DNA, 15 bp, Homo sapiens
ggtgttgcagccgca

SEQ ID NO: 5776067 - DNA, 23 bp, Homo sapiens
ggtgttgcagccgcagagaaatg

SEQ ID NO: 5776068 - DNA, 22 bp, Homo sapiens
ggtgttgccaaatatgtcctgg

SEQ ID NO: 5776069 - DNA, 12 bp, Homo sapiens
ggtgttgctgtt

SEQ ID NO: 5776070 - DNA, 17 bp, Homo sapiens
ggtgttggtgtatttgc

SEQ ID NO: 5776071 - DNA, 20 bp, Homo sapiens
ggtgttgtactcaattttaa

SEQ ID NO: 5776072 - DNA, 16 bp, Homo sapiens
ggtgttgtcagcaggc

SEQ ID NO: 5776073 - DNA, 15 bp, Homo sapiens
ggtgttgtgcatttg

SEQ ID NO: 5776074 - DNA, 19 bp, Homo sapiens
ggtgtttatgtgaacattc

SEQ ID NO: 5776075 - DNA, 23 bp, Homo sapiens
ggtgtttattacaagtggctccc

SEQ ID NO: 5776076 - DNA, 12 bp, Homo sapiens
ggtgtttattgc

SEQ ID NO: 5776077 - DNA, 17 bp, Homo sapiens
ggtgtttcaaaagtgga

SEQ ID NO: 5776078 - DNA, 17 bp, Homo sapiens
ggtgtttcccttcctcg

SEQ ID NO: 5776079 - DNA, 15 bp, Homo sapiens
ggtgtttcctctaaa

SEQ ID NO: 5776080 - DNA, 17 bp, Homo sapiens
ggtgtttcctggcactg

SEQ ID NO: 5776081 - DNA, 19 bp, Homo sapiens
ggtgtttcctggcactgct

SEQ ID NO: 5776082 - DNA, 18 bp, Homo sapiens
ggtgtttctagcactggc

SEQ ID NO: 5776083 - DNA, 13 bp, Homo sapiens
ggtgtttgaaaat

SEQ ID NO: 5776084 - DNA, 13 bp, Homo sapiens
ggtgtttgagtgt

SEQ ID NO: 5776085 - DNA, 13 bp, Homo sapiens
ggtgtttggcacc

SEQ ID NO: 5776086 - DNA, 22 bp, Homo sapiens
ggtgttttccttcacaatggtt

SEQ ID NO: 5776087 - DNA, 20 bp, Homo sapiens
ggtgttttgttcaccattat

SEQ ID NO: 5776088 - DNA, 14 bp, Homo sapiens
ggtgtttttctctc

SEQ ID NO: 5776089 - DNA, 17 bp, Homo sapiens
ggtgtttttctctctgg

SEQ ID NO: 5776090 - DNA, 18 bp, Homo sapiens
ggtgtttttctctctgga

SEQ ID NO: 5776091 - DNA, 19 bp, Homo sapiens
ggtgtttttctctctggac

SEQ ID NO: 5776092 - DNA, 20 bp, Homo sapiens
ggttaaaaaaatggcagtga

SEQ ID NO: 5776093 - DNA, 17 bp, Homo sapiens
ggttaaaaaacaaatgt

SEQ ID NO: 5776094 - DNA, 22 bp, Homo sapiens
ggttaaaactgtacatttaaaa

SEQ ID NO: 5776095 - DNA, 18 bp, Homo sapiens
ggttaaaatataaattaa

SEQ ID NO: 5776096 - DNA, 23 bp, Homo sapiens
ggttaaacaaaatgaaaatatct

SEQ ID NO: 5776097 - DNA, 17 bp, Homo sapiens
ggttaaaggaaaagcac

SEQ ID NO: 5776098 - DNA, 20 bp, Homo sapiens
ggttaaatagtatgggaaaa

SEQ ID NO: 5776099 - DNA, 21 bp, Homo sapiens
ggttaacaaataacaactttt

SEQ ID NO: 5776100 - DNA, 13 bp, Homo sapiens
ggttaacaaatga

SEQ ID NO: 5776101 - DNA, 14 bp, Homo sapiens
ggttaacaaatgag

SEQ ID NO: 5776102 - DNA, 21 bp, Homo sapiens
ggttaacaataaagtgacaaa

SEQ ID NO: 5776103 - DNA, 22 bp, Homo sapiens
ggttaacccttcatcttcctgt

SEQ ID NO: 5776104 - DNA, 16 bp, Homo sapiens
ggttaagaaatacctt

SEQ ID NO: 5776105 - DNA, 17 bp, Homo sapiens
ggttaagccatatgaca

SEQ ID NO: 5776106 - DNA, 16 bp, Homo sapiens
ggttaaggccagggcc

SEQ ID NO: 5776107 - DNA, 15 bp, Homo sapiens
ggttaaggctgagga

SEQ ID NO: 5776108 - DNA, 18 bp, Homo sapiens
ggttaaggggatctaaaa

SEQ ID NO: 5776109 - DNA, 16 bp, Homo sapiens
ggttaagtctgtttta

SEQ ID NO: 5776110 - DNA, 22 bp, Homo sapiens
ggttaagtttctcttcacccct

SEQ ID NO: 5776111 - DNA, 23 bp, Homo sapiens
ggttaatccaatcaatttaaatg

SEQ ID NO: 5776112 - DNA, 12 bp, Homo sapiens
ggttaatctctt

SEQ ID NO: 5776113 - DNA, 22 bp, Homo sapiens
ggttaatgaaaaatctgaattt

SEQ ID NO: 5776114 - DNA, 12 bp, Homo sapiens
ggttaatggcta

SEQ ID NO: 5776115 - DNA, 12 bp, Homo sapiens
ggttaatttcta

SEQ ID NO: 5776116 - DNA, 22 bp, Homo sapiens
ggttaatttttacatggagaaa

SEQ ID NO: 5776117 - DNA, 15 bp, Homo sapiens
ggttaatttttcctg

SEQ ID NO: 5776118 - DNA, 17 bp, Homo sapiens
ggttaatttttcctgca

SEQ ID NO: 5776119 - DNA, 13 bp, Homo sapiens
ggttacactgtta

SEQ ID NO: 5776120 - DNA, 15 bp, Homo sapiens
ggttacactgttaga

SEQ ID NO: 5776121 - DNA, 21 bp, Homo sapiens
ggttacactgttagaacacta

SEQ ID NO: 5776122 - DNA, 18 bp, Homo sapiens
ggttacagtgcagacagg

SEQ ID NO: 5776123 - DNA, 16 bp, Homo sapiens
ggttaccaagaagcct

SEQ ID NO: 5776124 - DNA, 14 bp, Homo sapiens
ggttaccaggcact

SEQ ID NO: 5776125 - DNA, 16 bp, Homo sapiens
ggttaccatgggtgtg

SEQ ID NO: 5776126 - DNA, 21 bp, Homo sapiens
ggttaccgagtatctgtaacc

SEQ ID NO: 5776127 - DNA, 23 bp, Homo sapiens
ggttacctgttccattgttgtca

SEQ ID NO: 5776128 - DNA, 19 bp, Homo sapiens
ggttacgtggggtgcggga

SEQ ID NO: 5776129 - DNA, 17 bp, Homo sapiens
ggttactaagatgaaat

SEQ ID NO: 5776130 - DNA, 22 bp, Homo sapiens
ggttactcagggttcatctgtc

SEQ ID NO: 5776131 - DNA, 15 bp, Homo sapiens
ggttacttcttctct

SEQ ID NO: 5776132 - DNA, 17 bp, Homo sapiens
ggttacttcttctctta

SEQ ID NO: 5776133 - DNA, 12 bp, Homo sapiens
ggttactttaca

SEQ ID NO: 5776134 - DNA, 14 bp, Homo sapiens
ggttactttcaaaa

SEQ ID NO: 5776135 - DNA, 16 bp, Homo sapiens
ggttactttggactga

SEQ ID NO: 5776136 - DNA, 13 bp, Homo sapiens
ggttactttgtgt

SEQ ID NO: 5776137 - DNA, 18 bp, Homo sapiens
ggttagacaagcctggag

SEQ ID NO: 5776138 - DNA, 13 bp, Homo sapiens
ggttagacctaca

SEQ ID NO: 5776139 - DNA, 20 bp, Homo sapiens
ggttagacctacagggggtc

SEQ ID NO: 5776140 - DNA, 19 bp, Homo sapiens
ggttagagacagtatgtat

SEQ ID NO: 5776141 - DNA, 18 bp, Homo sapiens
ggttagagccaagctgca

SEQ ID NO: 5776142 - DNA, 14 bp, Homo sapiens
ggttagatatagag

SEQ ID NO: 5776143 - DNA, 22 bp, Homo sapiens
ggttagatatttcgaccctggg

SEQ ID NO: 5776144 - DNA, 23 bp, Homo sapiens
ggttagatatttcgaccctgggg

SEQ ID NO: 5776145 - DNA, 21 bp, Homo sapiens
ggttagcaagactgcaagaga

SEQ ID NO: 5776146 - DNA, 17 bp, Homo sapiens
ggttagcatcctgcccg

SEQ ID NO: 5776147 - DNA, 20 bp, Homo sapiens
ggttaggagttcgagaccag

SEQ ID NO: 5776148 - DNA, 23 bp, Homo sapiens
ggttaggtggccgctcctccctg

SEQ ID NO: 5776149 - DNA, 17 bp, Homo sapiens
ggttagtcgggtgccag

SEQ ID NO: 5776150 - DNA, 15 bp, Homo sapiens
ggttagtgatgcagt

SEQ ID NO: 5776151 - DNA, 22 bp, Homo sapiens
ggttagtggatggaaggggctg

SEQ ID NO: 5776152 - DNA, 12 bp, Homo sapiens
ggttataatttt

SEQ ID NO: 5776153 - DNA, 14 bp, Homo sapiens
ggttatacatgaca

SEQ ID NO: 5776154 - DNA, 15 bp, Homo sapiens
ggttatagtgcaata

SEQ ID NO: 5776155 - DNA, 17 bp, Homo sapiens
ggttatagtgcaatata

SEQ ID NO: 5776156 - DNA, 23 bp, Homo sapiens
ggttatatcattctgggtgtgtt

SEQ ID NO: 5776157 - DNA, 15 bp, Homo sapiens
ggttatcctattttt

SEQ ID NO: 5776158 - DNA, 20 bp, Homo sapiens
ggttatcctatttttaaaca

SEQ ID NO: 5776159 - DNA, 23 bp, Homo sapiens
ggttatcctttcattaggcaaag

SEQ ID NO: 5776160 - DNA, 17 bp, Homo sapiens
ggttatcgaaataacaa

SEQ ID NO: 5776161 - DNA, 14 bp, Homo sapiens
ggttatctctgtgt

SEQ ID NO: 5776162 - DNA, 13 bp, Homo sapiens
ggttatctgcctg

SEQ ID NO: 5776163 - DNA, 15 bp, Homo sapiens
ggttatctgtcccag

SEQ ID NO: 5776164 - DNA, 21 bp, Homo sapiens
ggttatgaaagaatatattta

SEQ ID NO: 5776165 - DNA, 13 bp, Homo sapiens
ggttatgatgtca

SEQ ID NO: 5776166 - DNA, 17 bp, Homo sapiens
ggttatggagtcttgtg

SEQ ID NO: 5776167 - DNA, 11 bp, Homo sapiens
ggttatgtttt

SEQ ID NO: 5776168 - DNA, 15 bp, Homo sapiens
ggttattacttctgt

SEQ ID NO: 5776169 - DNA, 14 bp, Homo sapiens
ggttattagaaagt

SEQ ID NO: 5776170 - DNA, 13 bp, Homo sapiens
ggttattggactc

SEQ ID NO: 5776171 - DNA, 12 bp, Homo sapiens
ggttatttaaaa

SEQ ID NO: 5776172 - DNA, 16 bp, Homo sapiens
ggttatttaaaatgta

SEQ ID NO: 5776173 - DNA, 19 bp, Homo sapiens
ggttatttattttttaaga

SEQ ID NO: 5776174 - DNA, 24 bp, Homo sapiens
ggttatttctcaacaaagcacagt

SEQ ID NO: 5776175 - DNA, 18 bp, Homo sapiens
ggttatttggtattaaac

SEQ ID NO: 5776176 - DNA, 19 bp, Homo sapiens
ggttattttaaatataaat

SEQ ID NO: 5776177 - DNA, 16 bp, Homo sapiens
ggttattttacttttt

SEQ ID NO: 5776178 - DNA, 23 bp, Homo sapiens
ggttattttgatgtaaagatgtt

SEQ ID NO: 5776179 - DNA, 12 bp, Homo sapiens
ggttatttttat

SEQ ID NO: 5776180 - DNA, 19 bp, Homo sapiens
ggttatttttgtccctgct

SEQ ID NO: 5776181 - DNA, 17 bp, Homo sapiens
ggttcaaacctgtgaag

SEQ ID NO: 5776182 - DNA, 21 bp, Homo sapiens
ggttcaaagatattttgcttt

SEQ ID NO: 5776183 - DNA, 13 bp, Homo sapiens
ggttcaaattcct

SEQ ID NO: 5776184 - DNA, 16 bp, Homo sapiens
ggttcaaattctctat

SEQ ID NO: 5776185 - DNA, 14 bp, Homo sapiens
ggttcaagagactc

SEQ ID NO: 5776186 - DNA, 15 bp, Homo sapiens
ggttcaagcccaggc

SEQ ID NO: 5776187 - DNA, 17 bp, Homo sapiens
ggttcaagcccaggctt

SEQ ID NO: 5776188 - DNA, 19 bp, Homo sapiens
ggttcaagccttccaggga

SEQ ID NO: 5776189 - DNA, 21 bp, Homo sapiens
ggttcaagcgattcttctgct

SEQ ID NO: 5776190 - DNA, 22 bp, Homo sapiens
ggttcaagcgattcttctgctt

SEQ ID NO: 5776191 - DNA, 23 bp, Homo sapiens
ggttcaaggaatccatcctgcaa

SEQ ID NO: 5776192 - DNA, 23 bp, Homo sapiens
ggttcaagtgactctcctgcctc

SEQ ID NO: 5776193 - DNA, 13 bp, Homo sapiens
ggttcaatttttt

SEQ ID NO: 5776194 - DNA, 15 bp, Homo sapiens
ggttcacacagccca

SEQ ID NO: 5776195 - DNA, 19 bp, Homo sapiens
ggttcacactcagaaagag

SEQ ID NO: 5776196 - DNA, 20 bp, Homo sapiens
ggttcacactcagaaagagg

SEQ ID NO: 5776197 - DNA, 12 bp, Homo sapiens
ggttcaccagcc

SEQ ID NO: 5776198 - DNA, 14 bp, Homo sapiens
ggttcaccagcctc

SEQ ID NO: 5776199 - DNA, 18 bp, Homo sapiens
ggttcacctgtgactcct

SEQ ID NO: 5776200 - DNA, 21 bp, Homo sapiens
ggttcacgccattctcctgcc

SEQ ID NO: 5776201 - DNA, 21 bp, Homo sapiens
ggttcacgcctgtaatcccag

SEQ ID NO: 5776202 - DNA, 20 bp, Homo sapiens
ggttcacgtgcagctcaagg

SEQ ID NO: 5776203 - DNA, 15 bp, Homo sapiens
ggttcactaaagcag

SEQ ID NO: 5776204 - DNA, 17 bp, Homo sapiens
ggttcactagagctggg

SEQ ID NO: 5776205 - DNA, 18 bp, Homo sapiens
ggttcactagagctggga

SEQ ID NO: 5776206 - DNA, 17 bp, Homo sapiens
ggttcactccccgcctc

SEQ ID NO: 5776207 - DNA, 21 bp, Homo sapiens
ggttcactccccgcctcccca

SEQ ID NO: 5776208 - DNA, 19 bp, Homo sapiens
ggttcagaaatgctgcctg

SEQ ID NO: 5776209 - DNA, 18 bp, Homo sapiens
ggttcagacccctgcctg

SEQ ID NO: 5776210 - DNA, 16 bp, Homo sapiens
ggttcagcccctcctc

SEQ ID NO: 5776211 - DNA, 19 bp, Homo sapiens
ggttcagcccctcctctgc

SEQ ID NO: 5776212 - DNA, 22 bp, Homo sapiens
ggttcagcccctcctctgccac

SEQ ID NO: 5776213 - DNA, 12 bp, Homo sapiens
ggttcagcctgg

SEQ ID NO: 5776214 - DNA, 16 bp, Homo sapiens
ggttcagcctggcctg

SEQ ID NO: 5776215 - DNA, 17 bp, Homo sapiens
ggttcagcctggcctgc

SEQ ID NO: 5776216 - DNA, 13 bp, Homo sapiens
ggttcaggcccgg

SEQ ID NO: 5776217 - DNA, 13 bp, Homo sapiens
ggttcaggcctgg

SEQ ID NO: 5776218 - DNA, 18 bp, Homo sapiens
ggttcagggttggcccct

SEQ ID NO: 5776219 - DNA, 13 bp, Homo sapiens
ggttcagtgcctt

SEQ ID NO: 5776220 - DNA, 14 bp, Homo sapiens
ggttcagtttcttc

SEQ ID NO: 5776221 - DNA, 22 bp, Homo sapiens
ggttcatacgcatcccatctct

SEQ ID NO: 5776222 - DNA, 17 bp, Homo sapiens
ggttcataggggcaggt

SEQ ID NO: 5776223 - DNA, 14 bp, Homo sapiens
ggttcatcagtgtt

SEQ ID NO: 5776224 - DNA, 15 bp, Homo sapiens
ggttcatctgagcaa

SEQ ID NO: 5776225 - DNA, 22 bp, Homo sapiens
ggttcatctgtccatggccttt

SEQ ID NO: 5776226 - DNA, 14 bp, Homo sapiens
ggttcatgatgcag

SEQ ID NO: 5776227 - DNA, 14 bp, Homo sapiens
ggttcatgcctggg

SEQ ID NO: 5776228 - DNA, 15 bp, Homo sapiens
ggttcatgcctgggg

SEQ ID NO: 5776229 - DNA, 11 bp, Homo sapiens
ggttcatgctt

SEQ ID NO: 5776230 - DNA, 16 bp, Homo sapiens
ggttcattattggaat

SEQ ID NO: 5776231 - DNA, 16 bp, Homo sapiens
ggttcattccacagga

SEQ ID NO: 5776232 - DNA, 11 bp, Homo sapiens
ggttccaaacc

SEQ ID NO: 5776233 - DNA, 16 bp, Homo sapiens
ggttccaatcctggct

SEQ ID NO: 5776234 - DNA, 12 bp, Homo sapiens
ggttccacagac

SEQ ID NO: 5776235 - DNA, 22 bp, Homo sapiens
ggttccagaacagccctcggcc

SEQ ID NO: 5776236 - DNA, 12 bp, Homo sapiens
ggttccagacag

SEQ ID NO: 5776237 - DNA, 19 bp, Homo sapiens
ggttccagacagagtggat

SEQ ID NO: 5776238 - DNA, 11 bp, Homo sapiens
ggttccagagg

SEQ ID NO: 5776239 - DNA, 23 bp, Homo sapiens
ggttccagcaattctcctgcctc

SEQ ID NO: 5776240 - DNA, 13 bp, Homo sapiens
ggttccatgcctg

SEQ ID NO: 5776241 - DNA, 14 bp, Homo sapiens
ggttccatgcctga

SEQ ID NO: 5776242 - DNA, 16 bp, Homo sapiens
ggttccatgcctgagg

SEQ ID NO: 5776243 - DNA, 19 bp, Homo sapiens
ggttccatgcctgctctcg

SEQ ID NO: 5776244 - DNA, 16 bp, Homo sapiens
ggttccatgttgactg

SEQ ID NO: 5776245 - DNA, 16 bp, Homo sapiens
ggttcccaagctcaga

SEQ ID NO: 5776246 - DNA, 15 bp, Homo sapiens
ggttcccacaagcct

SEQ ID NO: 5776247 - DNA, 20 bp, Homo sapiens
ggttcccactggctcctcca

SEQ ID NO: 5776248 - DNA, 14 bp, Homo sapiens
ggttcccagaaaac

SEQ ID NO: 5776249 - DNA, 17 bp, Homo sapiens
ggttcccatttgctcct

SEQ ID NO: 5776250 - DNA, 14 bp, Homo sapiens
ggttccccacacag

SEQ ID NO: 5776251 - DNA, 12 bp, Homo sapiens
ggttccccaccg

SEQ ID NO: 5776252 - DNA, 13 bp, Homo sapiens
ggttccccaggag

SEQ ID NO: 5776253 - DNA, 17 bp, Homo sapiens
ggttcccccagacagag

SEQ ID NO: 5776254 - DNA, 21 bp, Homo sapiens
ggttccccgcaacccacagct

SEQ ID NO: 5776255 - DNA, 18 bp, Homo sapiens
ggttcccgacaccagaag

SEQ ID NO: 5776256 - DNA, 17 bp, Homo sapiens
ggttcccgtgtgcctga

SEQ ID NO: 5776257 - DNA, 19 bp, Homo sapiens
ggttccctccccagctcct

SEQ ID NO: 5776258 - DNA, 12 bp, Homo sapiens
ggttccctcttt

SEQ ID NO: 5776259 - DNA, 14 bp, Homo sapiens
ggttccctgctgcg

SEQ ID NO: 5776260 - DNA, 16 bp, Homo sapiens
ggttcccttcctattc

SEQ ID NO: 5776261 - DNA, 15 bp, Homo sapiens
ggttccctttcccca

SEQ ID NO: 5776262 - DNA, 22 bp, Homo sapiens
ggttccctttgacgccatccca

SEQ ID NO: 5776263 - DNA, 23 bp, Homo sapiens
ggttccctttgacgccatcccag

SEQ ID NO: 5776264 - DNA, 22 bp, Homo sapiens
ggttcccttttttggctgctga

SEQ ID NO: 5776265 - DNA, 16 bp, Homo sapiens
ggttccgggaggcaga

SEQ ID NO: 5776266 - DNA, 24 bp, Homo sapiens
ggttccgtatctccctggagaagc

SEQ ID NO: 5776267 - DNA, 15 bp, Homo sapiens
ggttcctataattgt

SEQ ID NO: 5776268 - DNA, 13 bp, Homo sapiens
ggttcctccagca

SEQ ID NO: 5776269 - DNA, 16 bp, Homo sapiens
ggttcctcccctcctc

SEQ ID NO: 5776270 - DNA, 16 bp, Homo sapiens
ggttcctcctctccta

SEQ ID NO: 5776271 - DNA, 17 bp, Homo sapiens
ggttcctctgcctgccc

SEQ ID NO: 5776272 - DNA, 24 bp, Homo sapiens
ggttcctcttggagtctagaacat

SEQ ID NO: 5776273 - DNA, 20 bp, Homo sapiens
ggttcctgaaatatccagga

SEQ ID NO: 5776274 - DNA, 22 bp, Homo sapiens
ggttcctggggccgcctgccct

SEQ ID NO: 5776275 - DNA, 18 bp, Homo sapiens
ggttcctggtgactcctg

SEQ ID NO: 5776276 - DNA, 21 bp, Homo sapiens
ggttcctggttgttcctgcat

SEQ ID NO: 5776277 - DNA, 13 bp, Homo sapiens
ggttcctgtttga

SEQ ID NO: 5776278 - DNA, 15 bp, Homo sapiens
ggttccttccctggg

SEQ ID NO: 5776279 - DNA, 19 bp, Homo sapiens
ggttccttcctatgcccag

SEQ ID NO: 5776280 - DNA, 20 bp, Homo sapiens
ggttccttcctctgagcctt

SEQ ID NO: 5776281 - DNA, 16 bp, Homo sapiens
ggttccttccttagtt

SEQ ID NO: 5776282 - DNA, 20 bp, Homo sapiens
ggttccttttgaagctcaac

SEQ ID NO: 5776283 - DNA, 14 bp, Homo sapiens
ggttcgaggggaaa

SEQ ID NO: 5776284 - DNA, 17 bp, Homo sapiens
ggttcgatacctggagc

SEQ ID NO: 5776285 - DNA, 20 bp, Homo sapiens
ggttcgggattccctggtgg

SEQ ID NO: 5776286 - DNA, 19 bp, Homo sapiens
ggttcgtgctgtgctctgg

SEQ ID NO: 5776287 - DNA, 15 bp, Homo sapiens
ggttcgttggggaca

SEQ ID NO: 5776288 - DNA, 14 bp, Homo sapiens
ggttctaaaaggtg

SEQ ID NO: 5776289 - DNA, 15 bp, Homo sapiens
ggttctaaagttcta

SEQ ID NO: 5776290 - DNA, 14 bp, Homo sapiens
ggttctaaatgcaa

SEQ ID NO: 5776291 - DNA, 12 bp, Homo sapiens
ggttctaacttc

SEQ ID NO: 5776292 - DNA, 14 bp, Homo sapiens
ggttctaacttctg

SEQ ID NO: 5776293 - DNA, 12 bp, Homo sapiens
ggttctaaggcc

SEQ ID NO: 5776294 - DNA, 17 bp, Homo sapiens
ggttctaatattcacat

SEQ ID NO: 5776295 - DNA, 23 bp, Homo sapiens
ggttctacagccttgtccccctc

SEQ ID NO: 5776296 - DNA, 20 bp, Homo sapiens
ggttctagacgcccctccca

SEQ ID NO: 5776297 - DNA, 21 bp, Homo sapiens
ggttctaggcatctctgtact

SEQ ID NO: 5776298 - DNA, 15 bp, Homo sapiens
ggttctaggtttcaa

SEQ ID NO: 5776299 - DNA, 14 bp, Homo sapiens
ggttctataataag

SEQ ID NO: 5776300 - DNA, 20 bp, Homo sapiens
ggttctatttattcctgtta

SEQ ID NO: 5776301 - DNA, 13 bp, Homo sapiens
ggttctatttgga

SEQ ID NO: 5776302 - DNA, 12 bp, Homo sapiens
ggttctatttta

SEQ ID NO: 5776303 - DNA, 22 bp, Homo sapiens
ggttctattttactttgtactt

SEQ ID NO: 5776304 - DNA, 14 bp, Homo sapiens
ggttctcaatgaaa

SEQ ID NO: 5776305 - DNA, 21 bp, Homo sapiens
ggttctcaattccaacagttt

SEQ ID NO: 5776306 - DNA, 14 bp, Homo sapiens
ggttctcagacctc

SEQ ID NO: 5776307 - DNA, 13 bp, Homo sapiens
ggttctcagagcc

SEQ ID NO: 5776308 - DNA, 15 bp, Homo sapiens
ggttctcagcaagtg

SEQ ID NO: 5776309 - DNA, 18 bp, Homo sapiens
ggttctcaggtgttgcca

SEQ ID NO: 5776310 - DNA, 23 bp, Homo sapiens
ggttctcatttggtctgccagaa

SEQ ID NO: 5776311 - DNA, 13 bp, Homo sapiens
ggttctccatccc

SEQ ID NO: 5776312 - DNA, 16 bp, Homo sapiens
ggttctccatccccat

SEQ ID NO: 5776313 - DNA, 22 bp, Homo sapiens
ggttctcccatgatttggggtg

SEQ ID NO: 5776314 - DNA, 18 bp, Homo sapiens
ggttctccccctttctct

SEQ ID NO: 5776315 - DNA, 21 bp, Homo sapiens
ggttctccgttagctcctgtg

SEQ ID NO: 5776316 - DNA, 17 bp, Homo sapiens
ggttctcctctcccctc

SEQ ID NO: 5776317 - DNA, 20 bp, Homo sapiens
ggttctctctgacctttcat

SEQ ID NO: 5776318 - DNA, 14 bp, Homo sapiens
ggttctctgctgtc

SEQ ID NO: 5776319 - DNA, 16 bp, Homo sapiens
ggttctctgctgtcct

SEQ ID NO: 5776320 - DNA, 20 bp, Homo sapiens
ggttctgagaagcgctgccc

SEQ ID NO: 5776321 - DNA, 22 bp, Homo sapiens
ggttctgagaagcgctgccctg

SEQ ID NO: 5776322 - DNA, 17 bp, Homo sapiens
ggttctgagatggctcc

SEQ ID NO: 5776323 - DNA, 18 bp, Homo sapiens
ggttctgagatggctccc

SEQ ID NO: 5776324 - DNA, 15 bp, Homo sapiens
ggttctgaggccaga

SEQ ID NO: 5776325 - DNA, 13 bp, Homo sapiens
ggttctgccctgc

SEQ ID NO: 5776326 - DNA, 20 bp, Homo sapiens
ggttctgccctgcctgagga

SEQ ID NO: 5776327 - DNA, 21 bp, Homo sapiens
ggttctgcccttatggagctc

SEQ ID NO: 5776328 - DNA, 20 bp, Homo sapiens
ggttctgcgccacttccttt

SEQ ID NO: 5776329 - DNA, 21 bp, Homo sapiens
ggttctgctagagcagacagg

SEQ ID NO: 5776330 - DNA, 19 bp, Homo sapiens
ggttctgcttcaaggcttc

SEQ ID NO: 5776331 - DNA, 23 bp, Homo sapiens
ggttctggggaggaagggccagg

SEQ ID NO: 5776332 - DNA, 13 bp, Homo sapiens
ggttctggggctg

SEQ ID NO: 5776333 - DNA, 12 bp, Homo sapiens
ggttctgggtgg

SEQ ID NO: 5776334 - DNA, 18 bp, Homo sapiens
ggttctggttagctcagc

SEQ ID NO: 5776335 - DNA, 20 bp, Homo sapiens
ggttctgtgctaatcaaaac

SEQ ID NO: 5776336 - DNA, 13 bp, Homo sapiens
ggttcttcctcac

SEQ ID NO: 5776337 - DNA, 19 bp, Homo sapiens
ggttcttcctcgggattgg

SEQ ID NO: 5776338 - DNA, 19 bp, Homo sapiens
ggttcttcctttccctgga

SEQ ID NO: 5776339 - DNA, 22 bp, Homo sapiens
ggttcttcctttccctggagct

SEQ ID NO: 5776340 - DNA, 22 bp, Homo sapiens
ggttcttgagccagccaggccc

SEQ ID NO: 5776341 - DNA, 20 bp, Homo sapiens
ggttcttgaggggaccagga

SEQ ID NO: 5776342 - DNA, 10 bp, Homo sapiens
ggttcttgtt

SEQ ID NO: 5776343 - DNA, 23 bp, Homo sapiens
ggttctttcccacactgaaattc

SEQ ID NO: 5776344 - DNA, 17 bp, Homo sapiens
ggttctttcttcctctg

SEQ ID NO: 5776345 - DNA, 23 bp, Homo sapiens
ggttctttgagggactgcctctg

SEQ ID NO: 5776346 - DNA, 15 bp, Homo sapiens
ggttctttgttttaa

SEQ ID NO: 5776347 - DNA, 20 bp, Homo sapiens
ggttcttttttcagttattt

SEQ ID NO: 5776348 - DNA, 16 bp, Homo sapiens
ggttgaaagacatcaa

SEQ ID NO: 5776349 - DNA, 11 bp, Homo sapiens
ggttgaagaaa

SEQ ID NO: 5776350 - DNA, 21 bp, Homo sapiens
ggttgaagaaaggaacctggg

SEQ ID NO: 5776351 - DNA, 17 bp, Homo sapiens
ggttgaagccatgtcta

SEQ ID NO: 5776352 - DNA, 15 bp, Homo sapiens
ggttgaaggcagtct

SEQ ID NO: 5776353 - DNA, 16 bp, Homo sapiens
ggttgaaggcagtctg

SEQ ID NO: 5776354 - DNA, 22 bp, Homo sapiens
ggttgaatatagcctgcctcag

SEQ ID NO: 5776355 - DNA, 19 bp, Homo sapiens
ggttgaatgaataaaacaa

SEQ ID NO: 5776356 - DNA, 21 bp, Homo sapiens
ggttgacaccattctcctgcc

SEQ ID NO: 5776357 - DNA, 22 bp, Homo sapiens
ggttgacctttaaatgcaacag

SEQ ID NO: 5776358 - DNA, 13 bp, Homo sapiens
ggttgactaagaa

SEQ ID NO: 5776359 - DNA, 15 bp, Homo sapiens
ggttgactttaccca

SEQ ID NO: 5776360 - DNA, 16 bp, Homo sapiens
ggttgactttcaggta

SEQ ID NO: 5776361 - DNA, 13 bp, Homo sapiens
ggttgagaaatga

SEQ ID NO: 5776362 - DNA, 21 bp, Homo sapiens
ggttgaggtccagccctggct

SEQ ID NO: 5776363 - DNA, 19 bp, Homo sapiens
ggttgaggtggaagccctc

SEQ ID NO: 5776364 - DNA, 13 bp, Homo sapiens
ggttgaggtttca

SEQ ID NO: 5776365 - DNA, 15 bp, Homo sapiens
ggttgagtgtgtggt

SEQ ID NO: 5776366 - DNA, 21 bp, Homo sapiens
ggttgagtgtgtggtctctgc

SEQ ID NO: 5776367 - DNA, 20 bp, Homo sapiens
ggttgagttacattaaaata

SEQ ID NO: 5776368 - DNA, 17 bp, Homo sapiens
ggttgataactttgctt

SEQ ID NO: 5776369 - DNA, 23 bp, Homo sapiens
ggttgatgccttttttttcatga

SEQ ID NO: 5776370 - DNA, 16 bp, Homo sapiens
ggttgatggaaaataa

SEQ ID NO: 5776371 - DNA, 20 bp, Homo sapiens
ggttgattaaggcagtacaa

SEQ ID NO: 5776372 - DNA, 14 bp, Homo sapiens
ggttgattgtgcat

SEQ ID NO: 5776373 - DNA, 13 bp, Homo sapiens
ggttgcacagcaa

SEQ ID NO: 5776374 - DNA, 15 bp, Homo sapiens
ggttgcactttgtag

SEQ ID NO: 5776375 - DNA, 23 bp, Homo sapiens
ggttgcagagaagcatcctccac

SEQ ID NO: 5776376 - DNA, 17 bp, Homo sapiens
ggttgcagctgctcttg

SEQ ID NO: 5776377 - DNA, 13 bp, Homo sapiens
ggttgcagtcact

SEQ ID NO: 5776378 - DNA, 18 bp, Homo sapiens
ggttgcagtctttccccc

SEQ ID NO: 5776379 - DNA, 17 bp, Homo sapiens
ggttgccaatgtctgat

SEQ ID NO: 5776380 - DNA, 12 bp, Homo sapiens
ggttgccacagg

SEQ ID NO: 5776381 - DNA, 18 bp, Homo sapiens
ggttgccacaggcctccc

SEQ ID NO: 5776382 - DNA, 16 bp, Homo sapiens
ggttgccagaggccct

SEQ ID NO: 5776383 - DNA, 21 bp, Homo sapiens
ggttgccagaggccctggagg

SEQ ID NO: 5776384 - DNA, 15 bp, Homo sapiens
ggtttctcttctccc

SEQ ID NO: 5776385 - DNA, 22 bp, Homo sapiens
ggtttctgatctgtactttgtg

SEQ ID NO: 5776386 - DNA, 14 bp, Homo sapiens
ggtttctgccctgc

SEQ ID NO: 5776387 - DNA, 18 bp, Homo sapiens
ggtttctgcgtgctttat

SEQ ID NO: 5776388 - DNA, 15 bp, Homo sapiens
ggtttctggtctcta

SEQ ID NO: 5776389 - DNA, 15 bp, Homo sapiens
ggtttctgttctgtt

SEQ ID NO: 5776390 - DNA, 14 bp, Homo sapiens
ggtttctgtttgaa

SEQ ID NO: 5776391 - DNA, 22 bp, Homo sapiens
ggtttcttcaacaggagaattt

SEQ ID NO: 5776392 - DNA, 12 bp, Homo sapiens
ggtttcttctct

SEQ ID NO: 5776393 - DNA, 15 bp, Homo sapiens
ggtttcttttggaaa

SEQ ID NO: 5776394 - DNA, 18 bp, Homo sapiens
ggtttcttttttctttct

SEQ ID NO: 5776395 - DNA, 18 bp, Homo sapiens
ggtttctttttttttcct

SEQ ID NO: 5776396 - DNA, 20 bp, Homo sapiens
ggtttctttttttttccttt

SEQ ID NO: 5776397 - DNA, 12 bp, Homo sapiens
ggtttgaagctg

SEQ ID NO: 5776398 - DNA, 18 bp, Homo sapiens
ggtttgaaggagaatggc

SEQ ID NO: 5776399 - DNA, 11 bp, Homo sapiens
ggtttgacaat

SEQ ID NO: 5776400 - DNA, 13 bp, Homo sapiens
ggtttgacaattt

SEQ ID NO: 5776401 - DNA, 22 bp, Homo sapiens
ggtttgactccgctggaggtgg

SEQ ID NO: 5776402 - DNA, 19 bp, Homo sapiens
ggtttgacttgtttgtgca

SEQ ID NO: 5776403 - DNA, 12 bp, Homo sapiens
ggtttgagaaat

SEQ ID NO: 5776404 - DNA, 15 bp, Homo sapiens
ggtttgagatgtttg

SEQ ID NO: 5776405 - DNA, 22 bp, Homo sapiens
ggtttgagattgccccaggtct

SEQ ID NO: 5776406 - DNA, 18 bp, Homo sapiens
ggtttgagcacaatctgt

SEQ ID NO: 5776407 - DNA, 21 bp, Homo sapiens
ggtttgaggaccctcccaggt

SEQ ID NO: 5776408 - DNA, 18 bp, Homo sapiens
ggtttgcagatgacaaaa

SEQ ID NO: 5776409 - DNA, 23 bp, Homo sapiens
ggtttgcatttaaacatgtttaa

SEQ ID NO: 5776410 - DNA, 16 bp, Homo sapiens
ggtttgccaagccctt

SEQ ID NO: 5776411 - DNA, 22 bp, Homo sapiens
ggtttgcccacttgattgagaa

SEQ ID NO: 5776412 - DNA, 20 bp, Homo sapiens
ggtttgcccagtcctgggtt

SEQ ID NO: 5776413 - DNA, 17 bp, Homo sapiens
ggtttgccggtggtgca

SEQ ID NO: 5776414 - DNA, 16 bp, Homo sapiens
ggtttgcctgagggcg

SEQ ID NO: 5776415 - DNA, 21 bp, Homo sapiens
ggtttgccttttatgtaaatt

SEQ ID NO: 5776416 - DNA, 15 bp, Homo sapiens
ggtttgctcatgtaa

SEQ ID NO: 5776417 - DNA, 14 bp, Homo sapiens
ggtttgctgacagg

SEQ ID NO: 5776418 - DNA, 16 bp, Homo sapiens
ggtttgctgtcttggg

SEQ ID NO: 5776419 - DNA, 16 bp, Homo sapiens
ggtttggaaaactaac

SEQ ID NO: 5776420 - DNA, 19 bp, Homo sapiens
ggtttggaaaactaactca

SEQ ID NO: 5776421 - DNA, 13 bp, Homo sapiens
ggtttggaagagt

SEQ ID NO: 5776422 - DNA, 15 bp, Homo sapiens
ggtttggaatgcttc

SEQ ID NO: 5776423 - DNA, 20 bp, Homo sapiens
ggtttggaccccagctggga

SEQ ID NO: 5776424 - DNA, 13 bp, Homo sapiens
ggtttggagctga

SEQ ID NO: 5776425 - DNA, 15 bp, Homo sapiens
ggtttggagtaatca

SEQ ID NO: 5776426 - DNA, 21 bp, Homo sapiens
ggtttggattactattgcaaa

SEQ ID NO: 5776427 - DNA, 22 bp, Homo sapiens
ggtttggcaagaacttgtttac

SEQ ID NO: 5776428 - DNA, 23 bp, Homo sapiens
ggtttggcaagaacttgtttaca

SEQ ID NO: 5776429 - DNA, 13 bp, Homo sapiens
ggtttggccaggg

SEQ ID NO: 5776430 - DNA, 17 bp, Homo sapiens
ggtttggcgggccaagg

SEQ ID NO: 5776431 - DNA, 14 bp, Homo sapiens
ggtttggctcctgc

SEQ ID NO: 5776432 - DNA, 14 bp, Homo sapiens
ggtttgggacccct

SEQ ID NO: 5776433 - DNA, 14 bp, Homo sapiens
ggtttgggagccag

SEQ ID NO: 5776434 - DNA, 18 bp, Homo sapiens
ggtttgggagccaggact

SEQ ID NO: 5776435 - DNA, 22 bp, Homo sapiens
ggtttgggagccaggactccca

SEQ ID NO: 5776436 - DNA, 14 bp, Homo sapiens
ggtttgggcagtgg

SEQ ID NO: 5776437 - DNA, 20 bp, Homo sapiens
ggtttgggcagtggagaggg

SEQ ID NO: 5776438 - DNA, 17 bp, Homo sapiens
ggtttggggagaaataa

SEQ ID NO: 5776439 - DNA, 17 bp, Homo sapiens
ggtttggggccatggtg

SEQ ID NO: 5776440 - DNA, 13 bp, Homo sapiens
ggtttggggctgc

SEQ ID NO: 5776441 - DNA, 17 bp, Homo sapiens
ggtttgggggcgccctc

SEQ ID NO: 5776442 - DNA, 15 bp, Homo sapiens
ggtttggtctgggac

SEQ ID NO: 5776443 - DNA, 18 bp, Homo sapiens
ggtttggtggccaggctg

SEQ ID NO: 5776444 - DNA, 17 bp, Homo sapiens
ggtttggttcctctctg

SEQ ID NO: 5776445 - DNA, 19 bp, Homo sapiens
ggtttggttttgttttttg

SEQ ID NO: 5776446 - DNA, 20 bp, Homo sapiens
ggtttgtaaattaactttta

SEQ ID NO: 5776447 - DNA, 16 bp, Homo sapiens
ggtttgtaatggtgct

SEQ ID NO: 5776448 - DNA, 13 bp, Homo sapiens
ggtttgtcaacaa

SEQ ID NO: 5776449 - DNA, 19 bp, Homo sapiens
ggtttgtcaacacaaagac

SEQ ID NO: 5776450 - DNA, 20 bp, Homo sapiens
ggtttgtcaacacaaagaca

SEQ ID NO: 5776451 - DNA, 17 bp, Homo sapiens
ggtttgtcatatattca

SEQ ID NO: 5776452 - DNA, 23 bp, Homo sapiens
ggtttgtctgtaagctgcagtgt

SEQ ID NO: 5776453 - DNA, 21 bp, Homo sapiens
ggtttgtgagccttgctgcca

SEQ ID NO: 5776454 - DNA, 14 bp, Homo sapiens
ggtttgtgtggatg

SEQ ID NO: 5776455 - DNA, 19 bp, Homo sapiens
ggtttgttatcagtacaat

SEQ ID NO: 5776456 - DNA, 22 bp, Homo sapiens
ggtttgttattcttttccagaa

SEQ ID NO: 5776457 - DNA, 23 bp, Homo sapiens
ggtttgttggtcacatggagctc

SEQ ID NO: 5776458 - DNA, 14 bp, Homo sapiens
ggtttgtttgctta

SEQ ID NO: 5776459 - DNA, 12 bp, Homo sapiens
ggttttaaaata

SEQ ID NO: 5776460 - DNA, 18 bp, Homo sapiens
ggttttaaacctttaatg

SEQ ID NO: 5776461 - DNA, 16 bp, Homo sapiens
ggttttaaagtgatta

SEQ ID NO: 5776462 - DNA, 17 bp, Homo sapiens
ggttttaagttgtttgc

SEQ ID NO: 5776463 - DNA, 21 bp, Homo sapiens
ggttttaatttagtaaaccaa

SEQ ID NO: 5776464 - DNA, 14 bp, Homo sapiens
ggttttacatttta

SEQ ID NO: 5776465 - DNA, 17 bp, Homo sapiens
ggttttaccccagctcc

SEQ ID NO: 5776466 - DNA, 21 bp, Homo sapiens
ggttttacttacaaaaatggg

SEQ ID NO: 5776467 - DNA, 13 bp, Homo sapiens
ggttttagcattg

SEQ ID NO: 5776468 - DNA, 18 bp, Homo sapiens
ggttttaggaaacttgta

SEQ ID NO: 5776469 - DNA, 16 bp, Homo sapiens
ggttttaggatactta

SEQ ID NO: 5776470 - DNA, 17 bp, Homo sapiens
ggttttaggtagaaaaa

SEQ ID NO: 5776471 - DNA, 18 bp, Homo sapiens
ggttttaggtagaaaaac

SEQ ID NO: 5776472 - DNA, 21 bp, Homo sapiens
ggttttataactatataaatg

SEQ ID NO: 5776473 - DNA, 17 bp, Homo sapiens
ggttttataaggctgat

SEQ ID NO: 5776474 - DNA, 22 bp, Homo sapiens
ggttttatctgagtgaaatact

SEQ ID NO: 5776475 - DNA, 11 bp, Homo sapiens
ggttttatgat

SEQ ID NO: 5776476 - DNA, 23 bp, Homo sapiens
ggttttattactctcacccataa

SEQ ID NO: 5776477 - DNA, 22 bp, Homo sapiens
ggttttattctgacttcctctg

SEQ ID NO: 5776478 - DNA, 21 bp, Homo sapiens
ggttttcacataaatgcagcc

SEQ ID NO: 5776479 - DNA, 20 bp, Homo sapiens
ggttttcacattggaaacaa

SEQ ID NO: 5776480 - DNA, 13 bp, Homo sapiens
ggttttcccctcc

SEQ ID NO: 5776481 - DNA, 12 bp, Homo sapiens
ggttttccctgt

SEQ ID NO: 5776482 - DNA, 13 bp, Homo sapiens
ggttttcctgaaa

SEQ ID NO: 5776483 - DNA, 20 bp, Homo sapiens
ggttttctaactgtaaatca

SEQ ID NO: 5776484 - DNA, 22 bp, Homo sapiens
ggttttctaactgtaaatcact

SEQ ID NO: 5776485 - DNA, 23 bp, Homo sapiens
ggttttctaactgtaaatcactt

SEQ ID NO: 5776486 - DNA, 19 bp, Homo sapiens
ggttttctactgttatgtg

SEQ ID NO: 5776487 - DNA, 17 bp, Homo sapiens
ggttttctccttcccaa

SEQ ID NO: 5776488 - DNA, 15 bp, Homo sapiens
ggttttctctctgga

SEQ ID NO: 5776489 - DNA, 12 bp, Homo sapiens
ggttttctgttc

SEQ ID NO: 5776490 - DNA, 12 bp, Homo sapiens
ggttttctgttt

SEQ ID NO: 5776491 - DNA, 12 bp, Homo sapiens
ggttttctttgg

SEQ ID NO: 5776492 - DNA, 20 bp, Homo sapiens
ggttttcttttttccccttt

SEQ ID NO: 5776493 - DNA, 17 bp, Homo sapiens
ggttttgaataaaaagt

SEQ ID NO: 5776494 - DNA, 20 bp, Homo sapiens
ggttttgacttgccactgcc

SEQ ID NO: 5776495 - DNA, 17 bp, Homo sapiens
ggttttgcaataacttc

SEQ ID NO: 5776496 - DNA, 18 bp, Homo sapiens
ggttttgccctccctctc

SEQ ID NO: 5776497 - DNA, 17 bp, Homo sapiens
ggttttggagtcagtag

SEQ ID NO: 5776498 - DNA, 18 bp, Homo sapiens
ggttttggggaaatgtgg

SEQ ID NO: 5776499 - DNA, 20 bp, Homo sapiens
ggttttggggtcctgggctg

SEQ ID NO: 5776500 - DNA, 18 bp, Homo sapiens
ggttttgtacactgctgt

SEQ ID NO: 5776501 - DNA, 19 bp, Homo sapiens
ggttttgtacactgctgta

SEQ ID NO: 5776502 - DNA, 11 bp, Homo sapiens
ggttttgtagc

SEQ ID NO: 5776503 - DNA, 15 bp, Homo sapiens
ggttttgtattcttt

SEQ ID NO: 5776504 - DNA, 17 bp, Homo sapiens
ggttttgtgccatctgt

SEQ ID NO: 5776505 - DNA, 14 bp, Homo sapiens
ggttttgtgcttta

SEQ ID NO: 5776506 - DNA, 14 bp, Homo sapiens
ggttttgttcccct

SEQ ID NO: 5776507 - DNA, 22 bp, Homo sapiens
ggttttgttcccctcctccact

SEQ ID NO: 5776508 - DNA, 22 bp, Homo sapiens
ggttttgttgtgttctgttgaa

SEQ ID NO: 5776509 - DNA, 18 bp, Homo sapiens
ggtttttaaattttgtaa

SEQ ID NO: 5776510 - DNA, 14 bp, Homo sapiens
ggtttttaagggcc

SEQ ID NO: 5776511 - DNA, 21 bp, Homo sapiens
ggtttttaatctttgtgacag

SEQ ID NO: 5776512 - DNA, 19 bp, Homo sapiens
ggtttttactgctctgaga

SEQ ID NO: 5776513 - DNA, 14 bp, Homo sapiens
ggtttttactgtta

SEQ ID NO: 5776514 - DNA, 22 bp, Homo sapiens
ggtttttagagaatgtgtttca

SEQ ID NO: 5776515 - DNA, 20 bp, Homo sapiens
ggtttttaggagtctgagca

SEQ ID NO: 5776516 - DNA, 14 bp, Homo sapiens
ggtttttatttcct

SEQ ID NO: 5776517 - DNA, 17 bp, Homo sapiens
ggtttttatttctcctt

SEQ ID NO: 5776518 - DNA, 19 bp, Homo sapiens
ggtttttatttctcctttt

SEQ ID NO: 5776519 - DNA, 16 bp, Homo sapiens
ggtttttatttctcgg

SEQ ID NO: 5776520 - DNA, 12 bp, Homo sapiens
ggtttttcaatt

SEQ ID NO: 5776521 - DNA, 14 bp, Homo sapiens
ggtttttcaattaa

SEQ ID NO: 5776522 - DNA, 19 bp, Homo sapiens
ggtttttcaattaaacgga

SEQ ID NO: 5776523 - DNA, 15 bp, Homo sapiens
ggtttttcatctttt

SEQ ID NO: 5776524 - DNA, 12 bp, Homo sapiens
ggtttttctcaa

SEQ ID NO: 5776525 - DNA, 15 bp, Homo sapiens
ggtttttgaaatcca

SEQ ID NO: 5776526 - DNA, 18 bp, Homo sapiens
ggtttttgctctacttta

SEQ ID NO: 5776527 - DNA, 16 bp, Homo sapiens
ggtttttggctctttc

SEQ ID NO: 5776528 - DNA, 18 bp, Homo sapiens
ggtttttgtcttgcattt

SEQ ID NO: 5776529 - DNA, 14 bp, Homo sapiens
ggttttttaatata

SEQ ID NO: 5776530 - DNA, 15 bp, Homo sapiens
ggttttttctgtttt

SEQ ID NO: 5776531 - DNA, 20 bp, Homo sapiens
ggttttttgtgtactttttg

SEQ ID NO: 5776532 - DNA, 9 bp, Homo sapiens
ggttttttt

SEQ ID NO: 5776533 - DNA, 21 bp, Homo sapiens
ggttttttttttctgaataaa

SEQ ID NO: 5776534 - DNA, 20 bp, Homo sapiens
ggttttttttttttcctttt

SEQ ID NO: 5776535 - DNA, 18 bp, Homo sapiens
gtaaaaaaaaaaaagtta

SEQ ID NO: 5776536 - DNA, 13 bp, Homo sapiens
gtaaaaaaaaatg

SEQ ID NO: 5776537 - DNA, 20 bp, Homo sapiens
gtaaaaaaaaatgcctttga

SEQ ID NO: 5776538 - DNA, 12 bp, Homo sapiens
gtaaaaaaaaga

SEQ ID NO: 5776539 - DNA, 15 bp, Homo sapiens
gtaaaaaacaaaaac

SEQ ID NO: 5776540 - DNA, 11 bp, Homo sapiens
gtaaaaaagaa

SEQ ID NO: 5776541 - DNA, 23 bp, Homo sapiens
gtaaaaaatcagattagaccagt

SEQ ID NO: 5776542 - DNA, 14 bp, Homo sapiens
gtaaaaaatggaaa

SEQ ID NO: 5776543 - DNA, 21 bp, Homo sapiens
gtaaaaaatggaaaaaaacat

SEQ ID NO: 5776544 - DNA, 16 bp, Homo sapiens
gtaaaaaatggtgttt

SEQ ID NO: 5776545 - DNA, 20 bp, Homo sapiens
gtaaaaaattcacataataa

SEQ ID NO: 5776546 - DNA, 19 bp, Homo sapiens
gtaaaaacaaaaagacagt

SEQ ID NO: 5776547 - DNA, 18 bp, Homo sapiens
gtaaaaacaaagaaatta

SEQ ID NO: 5776548 - DNA, 20 bp, Homo sapiens
gtaaaaacaaagaaattatg

SEQ ID NO: 5776549 - DNA, 22 bp, Homo sapiens
gtaaaaacactgaaaaattata

SEQ ID NO: 5776550 - DNA, 23 bp, Homo sapiens
gtaaaaacagcattgctttctga

SEQ ID NO: 5776551 - DNA, 22 bp, Homo sapiens
gtaaaaactagaaggcttctct

SEQ ID NO: 5776552 - DNA, 15 bp, Homo sapiens
gtaaaaactgaagtt

SEQ ID NO: 5776553 - DNA, 13 bp, Homo sapiens
gtaaaaacttttt

SEQ ID NO: 5776554 - DNA, 12 bp, Homo sapiens
gtaaaaagaaaa

SEQ ID NO: 5776555 - DNA, 17 bp, Homo sapiens
gtaaaaagattatatat

SEQ ID NO: 5776556 - DNA, 17 bp, Homo sapiens
gtaaaaagggaaaaaga

SEQ ID NO: 5776557 - DNA, 16 bp, Homo sapiens
gtaaaaagtggctgcg

SEQ ID NO: 5776558 - DNA, 16 bp, Homo sapiens
gtaaaaataatgaatg

SEQ ID NO: 5776559 - DNA, 14 bp, Homo sapiens
gtaaaaatactgtt

SEQ ID NO: 5776560 - DNA, 19 bp, Homo sapiens
gtaaaaatactgtttcact

SEQ ID NO: 5776561 - DNA, 16 bp, Homo sapiens
gtaaaaatattaactg

SEQ ID NO: 5776562 - DNA, 18 bp, Homo sapiens
gtaaaaatgaaggaatta

SEQ ID NO: 5776563 - DNA, 18 bp, Homo sapiens
gtaaagttacacttttat

SEQ ID NO: 5776564 - DNA, 22 bp, Homo sapiens
gtaaagttgaggggagaggaaa

SEQ ID NO: 5776565 - DNA, 17 bp, Homo sapiens
gtaaagttgtcttttaa

SEQ ID NO: 5776566 - DNA, 15 bp, Homo sapiens
gtaaagtttatttca

SEQ ID NO: 5776567 - DNA, 16 bp, Homo sapiens
gtaaataaactattta

SEQ ID NO: 5776568 - DNA, 14 bp, Homo sapiens
gtaaataaactgtt

SEQ ID NO: 5776569 - DNA, 15 bp, Homo sapiens
gtaaataaactgttt

SEQ ID NO: 5776570 - DNA, 17 bp, Homo sapiens
gtaaataaactgtttat

SEQ ID NO: 5776571 - DNA, 19 bp, Homo sapiens
gtaaataaactgtttatat

SEQ ID NO: 5776572 - DNA, 13 bp, Homo sapiens
gtaaataaagccc

SEQ ID NO: 5776573 - DNA, 12 bp, Homo sapiens
gtaaataaagct

SEQ ID NO: 5776574 - DNA, 13 bp, Homo sapiens
gtaaataaagctc

SEQ ID NO: 5776575 - DNA, 12 bp, Homo sapiens
gtaaataaagtc

SEQ ID NO: 5776576 - DNA, 13 bp, Homo sapiens
gtaaataaataga

SEQ ID NO: 5776577 - DNA, 13 bp, Homo sapiens
gtaaataaatgct

SEQ ID NO: 5776578 - DNA, 20 bp, Homo sapiens
gtaaataactggaaaacaga

SEQ ID NO: 5776579 - DNA, 13 bp, Homo sapiens
gtaaataagagat

SEQ ID NO: 5776580 - DNA, 16 bp, Homo sapiens
gtaaataatacattat

SEQ ID NO: 5776581 - DNA, 12 bp, Homo sapiens
gtaaataatgct

SEQ ID NO: 5776582 - DNA, 13 bp, Homo sapiens
gtaaataattctt

SEQ ID NO: 5776583 - DNA, 15 bp, Homo sapiens
gtaaataattttcta

SEQ ID NO: 5776584 - DNA, 14 bp, Homo sapiens
gtaaatacaaaata

SEQ ID NO: 5776585 - DNA, 20 bp, Homo sapiens
gtaaatacaaaataaaatta

SEQ ID NO: 5776586 - DNA, 22 bp, Homo sapiens
gtaaatacaaaataaaattatg

SEQ ID NO: 5776587 - DNA, 22 bp, Homo sapiens
gtaaatacaacacatctaatta

SEQ ID NO: 5776588 - DNA, 20 bp, Homo sapiens
gtaaatacaagttctattta

SEQ ID NO: 5776589 - DNA, 13 bp, Homo sapiens
gtaaatacaattt

SEQ ID NO: 5776590 - DNA, 18 bp, Homo sapiens
gtaaatacaatttgtact

SEQ ID NO: 5776591 - DNA, 14 bp, Homo sapiens
gtaaatacagcaat

SEQ ID NO: 5776592 - DNA, 17 bp, Homo sapiens
gtaaatacatcactgta

SEQ ID NO: 5776593 - DNA, 20 bp, Homo sapiens
gtaaatacatcactgtatac

SEQ ID NO: 5776594 - DNA, 13 bp, Homo sapiens
gtaaatacattat

SEQ ID NO: 5776595 - DNA, 13 bp, Homo sapiens
gtaaataccagga

SEQ ID NO: 5776596 - DNA, 16 bp, Homo sapiens
gtaaataccattgaca

SEQ ID NO: 5776597 - DNA, 17 bp, Homo sapiens
gtaaatactcatgaatg

SEQ ID NO: 5776598 - DNA, 22 bp, Homo sapiens
gtaaatactccattattttatt

SEQ ID NO: 5776599 - DNA, 23 bp, Homo sapiens
gtaaatactggactcaggaactt

SEQ ID NO: 5776600 - DNA, 16 bp, Homo sapiens
gtaaatacttgcagtt

SEQ ID NO: 5776601 - DNA, 19 bp, Homo sapiens
gtaaatactttccatgttt

SEQ ID NO: 5776602 - DNA, 20 bp, Homo sapiens
gtaaatactttccatgtttt

SEQ ID NO: 5776603 - DNA, 14 bp, Homo sapiens
gtaaatagatttta

SEQ ID NO: 5776604 - DNA, 21 bp, Homo sapiens
gtaaataggaatcattcagaa

SEQ ID NO: 5776605 - DNA, 14 bp, Homo sapiens
gtaaataggaattg

SEQ ID NO: 5776606 - DNA, 21 bp, Homo sapiens
gtaaataggtttctaaaaagt

SEQ ID NO: 5776607 - DNA, 23 bp, Homo sapiens
gtaaataggtttctaaaaagtca

SEQ ID NO: 5776608 - DNA, 20 bp, Homo sapiens
gtaaatagttactccagtgc

SEQ ID NO: 5776609 - DNA, 14 bp, Homo sapiens
gtaaatagttttaa

SEQ ID NO: 5776610 - DNA, 19 bp, Homo sapiens
gtaaatataaagacgtttt

SEQ ID NO: 5776611 - DNA, 16 bp, Homo sapiens
gtaaatataatcagac

SEQ ID NO: 5776612 - DNA, 11 bp, Homo sapiens
gtaaatatata

SEQ ID NO: 5776613 - DNA, 20 bp, Homo sapiens
gtaaatatataaatatatat

SEQ ID NO: 5776614 - DNA, 17 bp, Homo sapiens
gtaaatatatatgtcaa

SEQ ID NO: 5776615 - DNA, 11 bp, Homo sapiens
gtaaatatatc

SEQ ID NO: 5776616 - DNA, 16 bp, Homo sapiens
gtaaatatatgaacat

SEQ ID NO: 5776617 - DNA, 15 bp, Homo sapiens
gtaaatatatgtttt

SEQ ID NO: 5776618 - DNA, 23 bp, Homo sapiens
gtaaatatatgttttgagaaaaa

SEQ ID NO: 5776619 - DNA, 19 bp, Homo sapiens
gtaaatatattatatatgg

SEQ ID NO: 5776620 - DNA, 21 bp, Homo sapiens
gtaaatatcccaaactgtgat

SEQ ID NO: 5776621 - DNA, 15 bp, Homo sapiens
gtaaatatcccagag

SEQ ID NO: 5776622 - DNA, 22 bp, Homo sapiens
gtaaatatgacagaatttgtga

SEQ ID NO: 5776623 - DNA, 17 bp, Homo sapiens
gtaaatatgagactatt

SEQ ID NO: 5776624 - DNA, 21 bp, Homo sapiens
gtaaatatggggatagtctgg

SEQ ID NO: 5776625 - DNA, 18 bp, Homo sapiens
gtaaatatgtacatttgt

SEQ ID NO: 5776626 - DNA, 16 bp, Homo sapiens
gtaaatatgtgaagaa

SEQ ID NO: 5776627 - DNA, 12 bp, Homo sapiens
gtaaatattatg

SEQ ID NO: 5776628 - DNA, 12 bp, Homo sapiens
gtaaatattcat

SEQ ID NO: 5776629 - DNA, 14 bp, Homo sapiens
gtaaatattctaca

SEQ ID NO: 5776630 - DNA, 14 bp, Homo sapiens
gtaaatattcttgt

SEQ ID NO: 5776631 - DNA, 17 bp, Homo sapiens
gtaaatattcttgtcca

SEQ ID NO: 5776632 - DNA, 19 bp, Homo sapiens
gtaaatattgaggctttgt

SEQ ID NO: 5776633 - DNA, 22 bp, Homo sapiens
gtaaatattgaggctttgtgtt

SEQ ID NO: 5776634 - DNA, 15 bp, Homo sapiens
gtaaatattgtcaca

SEQ ID NO: 5776635 - DNA, 14 bp, Homo sapiens
gtaaatatttactc

SEQ ID NO: 5776636 - DNA, 13 bp, Homo sapiens
gtaaatatttcat

SEQ ID NO: 5776637 - DNA, 23 bp, Homo sapiens
gtaaatattttaaagaattgtgt

SEQ ID NO: 5776638 - DNA, 13 bp, Homo sapiens
gtaaatattttga

SEQ ID NO: 5776639 - DNA, 22 bp, Homo sapiens
gtaaatattttgatacaaatgt

SEQ ID NO: 5776640 - DNA, 19 bp, Homo sapiens
gtaaatcaagaccaaagag

SEQ ID NO: 5776641 - DNA, 19 bp, Homo sapiens
gtaaatcacactcaaactt

SEQ ID NO: 5776642 - DNA, 21 bp, Homo sapiens
gtaaatcacgctttttgaaaa

SEQ ID NO: 5776643 - DNA, 14 bp, Homo sapiens
gtaaatcacttgta

SEQ ID NO: 5776644 - DNA, 17 bp, Homo sapiens
gtaaatcacttgtaaat

SEQ ID NO: 5776645 - DNA, 18 bp, Homo sapiens
gtaaatcacttgtaaata

SEQ ID NO: 5776646 - DNA, 19 bp, Homo sapiens
gtaaatcacttgtaaataa

SEQ ID NO: 5776647 - DNA, 15 bp, Homo sapiens
gtaaatcagaaagta

SEQ ID NO: 5776648 - DNA, 22 bp, Homo sapiens
gtaaatcccacgacataagctg

SEQ ID NO: 5776649 - DNA, 20 bp, Homo sapiens
gtaaatcccagactgacaga

SEQ ID NO: 5776650 - DNA, 15 bp, Homo sapiens
gtaaatcccattatt

SEQ ID NO: 5776651 - DNA, 19 bp, Homo sapiens
gtaaatcctagacttgaaa

SEQ ID NO: 5776652 - DNA, 20 bp, Homo sapiens
gtaaatcctagacttgaaag

SEQ ID NO: 5776653 - DNA, 21 bp, Homo sapiens
gtaaatcctagacttgaaagt

SEQ ID NO: 5776654 - DNA, 22 bp, Homo sapiens
gtaaatcctagacttgaaagtt

SEQ ID NO: 5776655 - DNA, 20 bp, Homo sapiens
gtaaatcctgccatttaaaa

SEQ ID NO: 5776656 - DNA, 15 bp, Homo sapiens
gtaaatcctgtgttt

SEQ ID NO: 5776657 - DNA, 22 bp, Homo sapiens
gtaaatcgggaaggatgggaaa

SEQ ID NO: 5776658 - DNA, 20 bp, Homo sapiens
gtaaatctaacattattact

SEQ ID NO: 5776659 - DNA, 21 bp, Homo sapiens
gtaaatctaacattattactt

SEQ ID NO: 5776660 - DNA, 16 bp, Homo sapiens
gtaaatctatctctat

SEQ ID NO: 5776661 - DNA, 20 bp, Homo sapiens
gtaaatctatctctatataa

SEQ ID NO: 5776662 - DNA, 18 bp, Homo sapiens
gtaaatctcttctgtgtt

SEQ ID NO: 5776663 - DNA, 19 bp, Homo sapiens
gtaaatctcttctgtgttt

SEQ ID NO: 5776664 - DNA, 13 bp, Homo sapiens
gtaaatctgccac

SEQ ID NO: 5776665 - DNA, 23 bp, Homo sapiens
gtaaatctgtacttttttcaaat

SEQ ID NO: 5776666 - DNA, 17 bp, Homo sapiens
gtaaatctttttgcttc

SEQ ID NO: 5776667 - DNA, 16 bp, Homo sapiens
gtaaatgaactgattt

SEQ ID NO: 5776668 - DNA, 23 bp, Homo sapiens
gtaaatgaagtaacttgtcttaa

SEQ ID NO: 5776669 - DNA, 20 bp, Homo sapiens
gtaaatgacaaacgggacca

SEQ ID NO: 5776670 - DNA, 22 bp, Homo sapiens
gtaaatgaccaagaaaaagaaa

SEQ ID NO: 5776671 - DNA, 14 bp, Homo sapiens
gtaaatgagaagac

SEQ ID NO: 5776672 - DNA, 15 bp, Homo sapiens
gtaaatgattttaat

SEQ ID NO: 5776673 - DNA, 15 bp, Homo sapiens
gtaaatgcatattaa

SEQ ID NO: 5776674 - DNA, 19 bp, Homo sapiens
gtaaatgcatattaaataa

SEQ ID NO: 5776675 - DNA, 19 bp, Homo sapiens
gtaaatgctcgtgtgattt

SEQ ID NO: 5776676 - DNA, 18 bp, Homo sapiens
gtaaatgctctaactgga

SEQ ID NO: 5776677 - DNA, 14 bp, Homo sapiens
gtaaatgctgtaaa

SEQ ID NO: 5776678 - DNA, 21 bp, Homo sapiens
gtaaatgctgtaaatatttca

SEQ ID NO: 5776679 - DNA, 18 bp, Homo sapiens
gtaaatgcttaaatttca

SEQ ID NO: 5776680 - DNA, 22 bp, Homo sapiens
gtaaatggagcttgtacatatt

SEQ ID NO: 5776681 - DNA, 18 bp, Homo sapiens
gtaaatgggggtgcattt

SEQ ID NO: 5776682 - DNA, 19 bp, Homo sapiens
gtaaatgggggtgcatttg

SEQ ID NO: 5776683 - DNA, 19 bp, Homo sapiens
gtaaatggtatcatttgga

SEQ ID NO: 5776684 - DNA, 16 bp, Homo sapiens
gtaaatggttttcaac

SEQ ID NO: 5776685 - DNA, 12 bp, Homo sapiens
gtaaatgtaaac

SEQ ID NO: 5776686 - DNA, 18 bp, Homo sapiens
gtaaatgtattcattctt

SEQ ID NO: 5776687 - DNA, 22 bp, Homo sapiens
gtaaatgtccacttaaaataca

SEQ ID NO: 5776688 - DNA, 17 bp, Homo sapiens
gtaaatgtctgcactga

SEQ ID NO: 5776689 - DNA, 21 bp, Homo sapiens
gtaaatgtctgtggccttgtt

SEQ ID NO: 5776690 - DNA, 14 bp, Homo sapiens
gtaaatgtctttgt

SEQ ID NO: 5776691 - DNA, 17 bp, Homo sapiens
gtaaatgtgacaaaatt

SEQ ID NO: 5776692 - DNA, 16 bp, Homo sapiens
gtaaatgtggattttg

SEQ ID NO: 5776693 - DNA, 18 bp, Homo sapiens
gtaaatgtggattttgta

SEQ ID NO: 5776694 - DNA, 12 bp, Homo sapiens
gtaaatgtgtac

SEQ ID NO: 5776695 - DNA, 20 bp, Homo sapiens
gtaaatgtgttggacaaatg

SEQ ID NO: 5776696 - DNA, 24 bp, Homo sapiens
gtaaatgtgtttcttgctgccatg

SEQ ID NO: 5776697 - DNA, 13 bp, Homo sapiens
gtaaatgttatga

SEQ ID NO: 5776698 - DNA, 15 bp, Homo sapiens
gtaaatgttatttct

SEQ ID NO: 5776699 - DNA, 20 bp, Homo sapiens
gtaaatgttatttctgcaaa

SEQ ID NO: 5776700 - DNA, 14 bp, Homo sapiens
gtaaatgttcaagt

SEQ ID NO: 5776701 - DNA, 17 bp, Homo sapiens
gtaaatgtttaggtttt

SEQ ID NO: 5776702 - DNA, 13 bp, Homo sapiens
gtaaatgtttctt

SEQ ID NO: 5776703 - DNA, 22 bp, Homo sapiens
gtaaatgtttcttttcccttaa

SEQ ID NO: 5776704 - DNA, 19 bp, Homo sapiens
gtaaattaaacataaaaca

SEQ ID NO: 5776705 - DNA, 17 bp, Homo sapiens
gtaaattaaacattttt

SEQ ID NO: 5776706 - DNA, 15 bp, Homo sapiens
gtaaattaactttta

SEQ ID NO: 5776707 - DNA, 17 bp, Homo sapiens
gtaaattaacttttata

SEQ ID NO: 5776708 - DNA, 21 bp, Homo sapiens
gtaaattaacttttataaact

SEQ ID NO: 5776709 - DNA, 22 bp, Homo sapiens
gtaaattaacttttataaactt

SEQ ID NO: 5776710 - DNA, 14 bp, Homo sapiens
gtaaattaagagca

SEQ ID NO: 5776711 - DNA, 20 bp, Homo sapiens
gtaaattagtttgacactgc

SEQ ID NO: 5776712 - DNA, 23 bp, Homo sapiens
gtaaattatatttgtgctatagt

SEQ ID NO: 5776713 - DNA, 14 bp, Homo sapiens
gtaaattatttgct

SEQ ID NO: 5776714 - DNA, 15 bp, Homo sapiens
gtaaattatttgcta

SEQ ID NO: 5776715 - DNA, 17 bp, Homo sapiens
gtaaattatttgctaag

SEQ ID NO: 5776716 - DNA, 18 bp, Homo sapiens
gtaaattattttaaatta

SEQ ID NO: 5776717 - DNA, 15 bp, Homo sapiens
gtaaattcagacaac

SEQ ID NO: 5776718 - DNA, 17 bp, Homo sapiens
gtaaattcagacaacat

SEQ ID NO: 5776719 - DNA, 15 bp, Homo sapiens
gtaaattccaaagat

SEQ ID NO: 5776720 - DNA, 17 bp, Homo sapiens
gtaaattccaaagatct

SEQ ID NO: 5776721 - DNA, 18 bp, Homo sapiens
gtaaattccaaagatctg

SEQ ID NO: 5776722 - DNA, 20 bp, Homo sapiens
gtaaattcctaattctatga

SEQ ID NO: 5776723 - DNA, 21 bp, Homo sapiens
gtaaattcctaattctatgat

SEQ ID NO: 5776724 - DNA, 14 bp, Homo sapiens
gtaaattctgattt

SEQ ID NO: 5776725 - DNA, 15 bp, Homo sapiens
gtaaattctggtata

SEQ ID NO: 5776726 - DNA, 12 bp, Homo sapiens
gtaaattctgtt

SEQ ID NO: 5776727 - DNA, 16 bp, Homo sapiens
gtaaattggaaacatt

SEQ ID NO: 5776728 - DNA, 19 bp, Homo sapiens
gtaaattggcatggaaatt

SEQ ID NO: 5776729 - DNA, 16 bp, Homo sapiens
gtaaattgtattctca

SEQ ID NO: 5776730 - DNA, 21 bp, Homo sapiens
gtaaatttaatagataaagtg

SEQ ID NO: 5776731 - DNA, 16 bp, Homo sapiens
gtaaatttatgtgatg

SEQ ID NO: 5776732 - DNA, 19 bp, Homo sapiens
gtaaatttccccaacagtg

SEQ ID NO: 5776733 - DNA, 23 bp, Homo sapiens
gtaaatttccccaacagtgtgaa

SEQ ID NO: 5776734 - DNA, 13 bp, Homo sapiens
gtaaatttggctt

SEQ ID NO: 5776735 - DNA, 15 bp, Homo sapiens
gtaaatttggcttct

SEQ ID NO: 5776736 - DNA, 13 bp, Homo sapiens
gtaaatttgtact

SEQ ID NO: 5776737 - DNA, 15 bp, Homo sapiens
gtaaatttgtactat

SEQ ID NO: 5776738 - DNA, 22 bp, Homo sapiens
gtaaatttgtactatttaactg

SEQ ID NO: 5776739 - DNA, 22 bp, Homo sapiens
gtaaatttgtccaatggctgta

SEQ ID NO: 5776740 - DNA, 19 bp, Homo sapiens
gtaaattttataatgtcat

SEQ ID NO: 5776741 - DNA, 18 bp, Homo sapiens
gtaagaacaatgccaggg

SEQ ID NO: 5776742 - DNA, 14 bp, Homo sapiens
gtaagaacacctga

SEQ ID NO: 5776743 - DNA, 17 bp, Homo sapiens
gtaagaacagctcatct

SEQ ID NO: 5776744 - DNA, 16 bp, Homo sapiens
gtaagaaccttgcctg

SEQ ID NO: 5776745 - DNA, 16 bp, Homo sapiens
gtaagaactaaagaag

SEQ ID NO: 5776746 - DNA, 15 bp, Homo sapiens
gtaagaagacatgaa

SEQ ID NO: 5776747 - DNA, 16 bp, Homo sapiens
gtaagaagaggagcct

SEQ ID NO: 5776748 - DNA, 11 bp, Homo sapiens
gtaagaagccg

SEQ ID NO: 5776749 - DNA, 11 bp, Homo sapiens
gtaagaaggca

SEQ ID NO: 5776750 - DNA, 13 bp, Homo sapiens
gtaagaaggcaat

SEQ ID NO: 5776751 - DNA, 14 bp, Homo sapiens
gtaagaagggtggg

SEQ ID NO: 5776752 - DNA, 23 bp, Homo sapiens
gtaagaagtagagaacccagatg

SEQ ID NO: 5776753 - DNA, 19 bp, Homo sapiens
gtaagaatcactgcactta

SEQ ID NO: 5776754 - DNA, 17 bp, Homo sapiens
gtaagaattcagaagac

SEQ ID NO: 5776755 - DNA, 14 bp, Homo sapiens
gtaagacaagtggg

SEQ ID NO: 5776756 - DNA, 16 bp, Homo sapiens
gtaagacacacagcct

SEQ ID NO: 5776757 - DNA, 13 bp, Homo sapiens
gtaagacatctca

SEQ ID NO: 5776758 - DNA, 20 bp, Homo sapiens
gtaagacatttgtatattgt

SEQ ID NO: 5776759 - DNA, 18 bp, Homo sapiens
gtaagaccaaatgtagtt

SEQ ID NO: 5776760 - DNA, 15 bp, Homo sapiens
gtaagaccaccttcc

SEQ ID NO: 5776761 - DNA, 16 bp, Homo sapiens
gtaagaccaccttccc

SEQ ID NO: 5776762 - DNA, 15 bp, Homo sapiens
gtaagacggccttgg

SEQ ID NO: 5776763 - DNA, 20 bp, Homo sapiens
gtaagacttcagatttcaaa

SEQ ID NO: 5776764 - DNA, 15 bp, Homo sapiens
gtaagagaaaatatt

SEQ ID NO: 5776765 - DNA, 15 bp, Homo sapiens
gtaagagaatgttat

SEQ ID NO: 5776766 - DNA, 15 bp, Homo sapiens
gtaagagcaaaagaa

SEQ ID NO: 5776767 - DNA, 17 bp, Homo sapiens
gtaagagcaccttcctc

SEQ ID NO: 5776768 - DNA, 21 bp, Homo sapiens
gtaagagcaccttcctcactt

SEQ ID NO: 5776769 - DNA, 23 bp, Homo sapiens
gtaagagctgatgtgagtgtgtg

SEQ ID NO: 5776770 - DNA, 14 bp, Homo sapiens
gtaagagctggtgt

SEQ ID NO: 5776771 - DNA, 14 bp, Homo sapiens
gtaagaggagcaga

SEQ ID NO: 5776772 - DNA, 16 bp, Homo sapiens
gtaagaggagcagagg

SEQ ID NO: 5776773 - DNA, 19 bp, Homo sapiens
gtaagaggagcagagggca

SEQ ID NO: 5776774 - DNA, 21 bp, Homo sapiens
gtaagaggagcagagggcagg

SEQ ID NO: 5776775 - DNA, 21 bp, Homo sapiens
gtaagagtgagctctggtgga

SEQ ID NO: 5776776 - DNA, 22 bp, Homo sapiens
gtaagagtgtagaagcattcct

SEQ ID NO: 5776777 - DNA, 14 bp, Homo sapiens
gtaagagtttacaa

SEQ ID NO: 5776778 - DNA, 13 bp, Homo sapiens
gtaagatcactgt

SEQ ID NO: 5776779 - DNA, 20 bp, Homo sapiens
gtaagatcactgtttagatt

SEQ ID NO: 5776780 - DNA, 16 bp, Homo sapiens
gtaagatcataacaat

SEQ ID NO: 5776781 - DNA, 17 bp, Homo sapiens
gtaagatctctttctaa

SEQ ID NO: 5776782 - DNA, 14 bp, Homo sapiens
gtaagatgactctg

SEQ ID NO: 5776783 - DNA, 16 bp, Homo sapiens
gtaagatgactctgag

SEQ ID NO: 5776784 - DNA, 17 bp, Homo sapiens
gtaagatgactctgaga

SEQ ID NO: 5776785 - DNA, 20 bp, Homo sapiens
gtaagattatagattctaaa

SEQ ID NO: 5776786 - DNA, 21 bp, Homo sapiens
gtaagattatagattctaaag

SEQ ID NO: 5776787 - DNA, 22 bp, Homo sapiens
gtaagattatagattctaaaga

SEQ ID NO: 5776788 - DNA, 23 bp, Homo sapiens
gtaagattatagattctaaagat

SEQ ID NO: 5776789 - DNA, 18 bp, Homo sapiens
gtaagatttccttctttt

SEQ ID NO: 5776790 - DNA, 16 bp, Homo sapiens
gtaagatttgttttta

SEQ ID NO: 5776791 - DNA, 21 bp, Homo sapiens
gtaagatttgtttttaaactg

SEQ ID NO: 5776792 - DNA, 17 bp, Homo sapiens
gtaagattttattttca

SEQ ID NO: 5776793 - DNA, 19 bp, Homo sapiens
gtaagcacctgggctgagg

SEQ ID NO: 5776794 - DNA, 16 bp, Homo sapiens
gtaagcactgactggg

SEQ ID NO: 5776795 - DNA, 20 bp, Homo sapiens
gtaagcactgactgggacca

SEQ ID NO: 5776796 - DNA, 17 bp, Homo sapiens
gtaagcactgtttttcc

SEQ ID NO: 5776797 - DNA, 19 bp, Homo sapiens
gtaagcactgtttttccat

SEQ ID NO: 5776798 - DNA, 18 bp, Homo sapiens
gtaagcagagttctttgc

SEQ ID NO: 5776799 - DNA, 20 bp, Homo sapiens
gtaagcaggagagaaatttc

SEQ ID NO: 5776800 - DNA, 23 bp, Homo sapiens
gtaagcataagcttatgcttaaa

SEQ ID NO: 5776801 - DNA, 18 bp, Homo sapiens
gtaagcatctacttcagg

SEQ ID NO: 5776802 - DNA, 15 bp, Homo sapiens
gtaagcattctgagc

SEQ ID NO: 5776803 - DNA, 13 bp, Homo sapiens
gtaagccaaagaa

SEQ ID NO: 5776804 - DNA, 15 bp, Homo sapiens
gtaagccagagtcaa

SEQ ID NO: 5776805 - DNA, 21 bp, Homo sapiens
gtaagcccaagctaagctgca

SEQ ID NO: 5776806 - DNA, 18 bp, Homo sapiens
gtaagcgatttgaaacac

SEQ ID NO: 5776807 - DNA, 14 bp, Homo sapiens
gtaagcgtatggct

SEQ ID NO: 5776808 - DNA, 20 bp, Homo sapiens
gtaagcgtatggctttattt

SEQ ID NO: 5776809 - DNA, 17 bp, Homo sapiens
gtaagctataacatatt

SEQ ID NO: 5776810 - DNA, 20 bp, Homo sapiens
gtaagctggtgttataatac

SEQ ID NO: 5776811 - DNA, 18 bp, Homo sapiens
gtaagctgtttggtttta

SEQ ID NO: 5776812 - DNA, 22 bp, Homo sapiens
gtaagctgtttggttttaaaat

SEQ ID NO: 5776813 - DNA, 20 bp, Homo sapiens
gtaagcttattgcttcatct

SEQ ID NO: 5776814 - DNA, 17 bp, Homo sapiens
gtaagcttccaggaaaa

SEQ ID NO: 5776815 - DNA, 14 bp, Homo sapiens
gtaaggactgtaaa

SEQ ID NO: 5776816 - DNA, 16 bp, Homo sapiens
gtaaggacttgtgcct

SEQ ID NO: 5776817 - DNA, 14 bp, Homo sapiens
gtaaggaggagaaa

SEQ ID NO: 5776818 - DNA, 15 bp, Homo sapiens
gtaaggaggagaaaa

SEQ ID NO: 5776819 - DNA, 22 bp, Homo sapiens
gtaaggccattctttagtcatt

SEQ ID NO: 5776820 - DNA, 10 bp, Homo sapiens
gtaaggctgt

SEQ ID NO: 5776821 - DNA, 12 bp, Homo sapiens
gtaaggctgtac

SEQ ID NO: 5776822 - DNA, 22 bp, Homo sapiens
gtaagggaatttaatacttttc

SEQ ID NO: 5776823 - DNA, 16 bp, Homo sapiens
gtaagggaccttcagg

SEQ ID NO: 5776824 - DNA, 21 bp, Homo sapiens
gtaagggactccagaagcagc

SEQ ID NO: 5776825 - DNA, 16 bp, Homo sapiens
gtaagggatttcttag

SEQ ID NO: 5776826 - DNA, 11 bp, Homo sapiens
gtaagggcagt

SEQ ID NO: 5776827 - DNA, 12 bp, Homo sapiens
gtaagggtaaaa

SEQ ID NO: 5776828 - DNA, 21 bp, Homo sapiens
gtaagggtctgttgtaaatga

SEQ ID NO: 5776829 - DNA, 24 bp, Homo sapiens
gtaagggtctgttgtaaatgacca

SEQ ID NO: 5776830 - DNA, 17 bp, Homo sapiens
gtaagggtgacaaatgg

SEQ ID NO: 5776831 - DNA, 20 bp, Homo sapiens
gtaaggtaatttctgtgtat

SEQ ID NO: 5776832 - DNA, 19 bp, Homo sapiens
gtaaggtatatcattctaa

SEQ ID NO: 5776833 - DNA, 18 bp, Homo sapiens
gtaaggtctttgtaaaat

SEQ ID NO: 5776834 - DNA, 13 bp, Homo sapiens
gtaaggtgcagtt

SEQ ID NO: 5776835 - DNA, 23 bp, Homo sapiens
gtaaggtgtcttaatactgtcct

SEQ ID NO: 5776836 - DNA, 20 bp, Homo sapiens
gtaaggtgtgtactcagggc

SEQ ID NO: 5776837 - DNA, 15 bp, Homo sapiens
gtaaggttgtgcagg

SEQ ID NO: 5776838 - DNA, 19 bp, Homo sapiens
gtaaggttgtgcagggtgt

SEQ ID NO: 5776839 - DNA, 23 bp, Homo sapiens
gtaagtaacaatatgtaatcaaa

SEQ ID NO: 5776840 - DNA, 14 bp, Homo sapiens
gtaagtaagaaaga

SEQ ID NO: 5776841 - DNA, 15 bp, Homo sapiens
gtaagtaagaaagaa

SEQ ID NO: 5776842 - DNA, 14 bp, Homo sapiens
gtaagtaagtgaca

SEQ ID NO: 5776843 - DNA, 23 bp, Homo sapiens
gtaagtaattatcgggaacagtg

SEQ ID NO: 5776844 - DNA, 15 bp, Homo sapiens
gtaagtaattatgca

SEQ ID NO: 5776845 - DNA, 18 bp, Homo sapiens
gtaagtaccactcaggcc

SEQ ID NO: 5776846 - DNA, 20 bp, Homo sapiens
gtaagtagcaaccctgtgat

SEQ ID NO: 5776847 - DNA, 16 bp, Homo sapiens
gtaagtatgtttttta

SEQ ID NO: 5776848 - DNA, 20 bp, Homo sapiens
gtaagtcagccactgggacc

SEQ ID NO: 5776849 - DNA, 19 bp, Homo sapiens
gtaagtcagtgttgagatg

SEQ ID NO: 5776850 - DNA, 14 bp, Homo sapiens
gtaagtgccttcca

SEQ ID NO: 5776851 - DNA, 16 bp, Homo sapiens
gtaagtgctacataaa

SEQ ID NO: 5776852 - DNA, 17 bp, Homo sapiens
gtaagtggagtcctgga

SEQ ID NO: 5776853 - DNA, 13 bp, Homo sapiens
gtaagtggcagga

SEQ ID NO: 5776854 - DNA, 22 bp, Homo sapiens
gtaagtggcaggaccctgtcag

SEQ ID NO: 5776855 - DNA, 16 bp, Homo sapiens
gtaagtgggcccaccc

SEQ ID NO: 5776856 - DNA, 17 bp, Homo sapiens
gtaagtgggcccacccg

SEQ ID NO: 5776857 - DNA, 14 bp, Homo sapiens
gtaagtgtaaaaaa

SEQ ID NO: 5776858 - DNA, 15 bp, Homo sapiens
gtaagtgtacaattg

SEQ ID NO: 5776859 - DNA, 22 bp, Homo sapiens
gtaagtgtgtcttcctagaatt

SEQ ID NO: 5776860 - DNA, 22 bp, Homo sapiens
gtaagtgttctcatgaagcagg

SEQ ID NO: 5776861 - DNA, 16 bp, Homo sapiens
gtaagttatctttgaa

SEQ ID NO: 5776862 - DNA, 21 bp, Homo sapiens
gtaagttcctactaggcaaaa

SEQ ID NO: 5776863 - DNA, 14 bp, Homo sapiens
gtaagttctgtgca

SEQ ID NO: 5776864 - DNA, 18 bp, Homo sapiens
gtaagttgaagggaaatc

SEQ ID NO: 5776865 - DNA, 20 bp, Homo sapiens
gtaagttgaagggaaatcaa

SEQ ID NO: 5776866 - DNA, 19 bp, Homo sapiens
gtaagttgggcttgctatt

SEQ ID NO: 5776867 - DNA, 13 bp, Homo sapiens
gtaagttgtacaa

SEQ ID NO: 5776868 - DNA, 14 bp, Homo sapiens
gtaagttgtacaaa

SEQ ID NO: 5776869 - DNA, 14 bp, Homo sapiens
gtaagttgtgtgca

SEQ ID NO: 5776870 - DNA, 23 bp, Homo sapiens
gtaagttgttggtttatactgta

SEQ ID NO: 5776871 - DNA, 21 bp, Homo sapiens
gtaagtttaaaggatgttggt

SEQ ID NO: 5776872 - DNA, 23 bp, Homo sapiens
gtaagtttaattatctgcattta

SEQ ID NO: 5776873 - DNA, 15 bp, Homo sapiens
gtaagtttatccaaa

SEQ ID NO: 5776874 - DNA, 16 bp, Homo sapiens
gtaagtttatccaaat

SEQ ID NO: 5776875 - DNA, 23 bp, Homo sapiens
gtaagtttatggccttgaagtgt

SEQ ID NO: 5776876 - DNA, 12 bp, Homo sapiens
gtaagtttattt

SEQ ID NO: 5776877 - DNA, 16 bp, Homo sapiens
gtaagtttcaggtgac

SEQ ID NO: 5776878 - DNA, 21 bp, Homo sapiens
gtaagtttcccctctggcttg

SEQ ID NO: 5776879 - DNA, 12 bp, Homo sapiens
gtaagtttctaa

SEQ ID NO: 5776880 - DNA, 15 bp, Homo sapiens
gtaagtttctaagaa

SEQ ID NO: 5776881 - DNA, 13 bp, Homo sapiens
gtaagtttgcata

SEQ ID NO: 5776882 - DNA, 21 bp, Homo sapiens
gtaagtttgcatatcagtcat

SEQ ID NO: 5776883 - DNA, 13 bp, Homo sapiens
gtaagttttttga

SEQ ID NO: 5776884 - DNA, 14 bp, Homo sapiens
gtaataaaaagcca

SEQ ID NO: 5776885 - DNA, 15 bp, Homo sapiens
gtaataaaaagccac

SEQ ID NO: 5776886 - DNA, 12 bp, Homo sapiens
gtaataaaacaa

SEQ ID NO: 5776887 - DNA, 19 bp, Homo sapiens
gtaataaaactatttgtat

SEQ ID NO: 5776888 - DNA, 16 bp, Homo sapiens
gtaataaactgtgttt

SEQ ID NO: 5776889 - DNA, 16 bp, Homo sapiens
gtaataaagagaaata

SEQ ID NO: 5776890 - DNA, 12 bp, Homo sapiens
gtaataaagtat

SEQ ID NO: 5776891 - DNA, 17 bp, Homo sapiens
gtaataaagtatataat

SEQ ID NO: 5776892 - DNA, 11 bp, Homo sapiens
gtaataaagtg

SEQ ID NO: 5776893 - DNA, 12 bp, Homo sapiens
gtaataaagtgt

SEQ ID NO: 5776894 - DNA, 17 bp, Homo sapiens
gtaataaagtgttttca

SEQ ID NO: 5776895 - DNA, 18 bp, Homo sapiens
gtaataaagtgttttcag

SEQ ID NO: 5776896 - DNA, 19 bp, Homo sapiens
gtaataaagtgttttcaga

SEQ ID NO: 5776897 - DNA, 13 bp, Homo sapiens
gtaataaatactg

SEQ ID NO: 5776898 - DNA, 11 bp, Homo sapiens
gtaataaatat

SEQ ID NO: 5776899 - DNA, 16 bp, Homo sapiens
gtaataaatatgagtg

SEQ ID NO: 5776900 - DNA, 21 bp, Homo sapiens
gtaataaatctaggatgtgat

SEQ ID NO: 5776901 - DNA, 15 bp, Homo sapiens
gtaataaatgtatta

SEQ ID NO: 5776902 - DNA, 18 bp, Homo sapiens
gtaataacattttataca

SEQ ID NO: 5776903 - DNA, 16 bp, Homo sapiens
gtaataactgtgaagt

SEQ ID NO: 5776904 - DNA, 12 bp, Homo sapiens
gtaataagaaag

SEQ ID NO: 5776905 - DNA, 13 bp, Homo sapiens
gtaataagaaagt

SEQ ID NO: 5776906 - DNA, 22 bp, Homo sapiens
gtaataagaaagtataaagtca

SEQ ID NO: 5776907 - DNA, 20 bp, Homo sapiens
gtaataagaatggaaaagag

SEQ ID NO: 5776908 - DNA, 23 bp, Homo sapiens
gtaataagacataacgtttttcc

SEQ ID NO: 5776909 - DNA, 19 bp, Homo sapiens
gtaataagggaaaaatcaa

SEQ ID NO: 5776910 - DNA, 21 bp, Homo sapiens
gtaataaggttttaatttagt

SEQ ID NO: 5776911 - DNA, 16 bp, Homo sapiens
gtaataataaagaata

SEQ ID NO: 5776912 - DNA, 13 bp, Homo sapiens
gtaataatacctc

SEQ ID NO: 5776913 - DNA, 15 bp, Homo sapiens
gtaataatacctcaa

SEQ ID NO: 5776914 - DNA, 17 bp, Homo sapiens
gtaataatattttagaa

SEQ ID NO: 5776915 - DNA, 19 bp, Homo sapiens
gtaataatgctaaagaaaa

SEQ ID NO: 5776916 - DNA, 13 bp, Homo sapiens
gtaataatgtaca

SEQ ID NO: 5776917 - DNA, 16 bp, Homo sapiens
gtaataatgtgaatca

SEQ ID NO: 5776918 - DNA, 14 bp, Homo sapiens
gtaataatgtgcaa

SEQ ID NO: 5776919 - DNA, 17 bp, Homo sapiens
gtaatacagcttgtgag

SEQ ID NO: 5776920 - DNA, 23 bp, Homo sapiens
gtaattattttttagataataac

SEQ ID NO: 5776921 - DNA, 22 bp, Homo sapiens
gtaattcaagcctctaaacaga

SEQ ID NO: 5776922 - DNA, 20 bp, Homo sapiens
gtaattcaccaatttccttt

SEQ ID NO: 5776923 - DNA, 18 bp, Homo sapiens
gtaattcagaaaacataa

SEQ ID NO: 5776924 - DNA, 16 bp, Homo sapiens
gtaattccaaaatcca

SEQ ID NO: 5776925 - DNA, 20 bp, Homo sapiens
gtaattcccatctgctttat

SEQ ID NO: 5776926 - DNA, 21 bp, Homo sapiens
gtaattcctctcactaaactt

SEQ ID NO: 5776927 - DNA, 12 bp, Homo sapiens
gtaattctaaat

SEQ ID NO: 5776928 - DNA, 23 bp, Homo sapiens
gtaattctccctaaggaatctga

SEQ ID NO: 5776929 - DNA, 14 bp, Homo sapiens
gtaattctgcttct

SEQ ID NO: 5776930 - DNA, 22 bp, Homo sapiens
gtaattcttattccatattaga

SEQ ID NO: 5776931 - DNA, 15 bp, Homo sapiens
gtaattcttattctt

SEQ ID NO: 5776932 - DNA, 14 bp, Homo sapiens
gtaattcttctcct

SEQ ID NO: 5776933 - DNA, 21 bp, Homo sapiens
gtaattcttctcctttgtcaa

SEQ ID NO: 5776934 - DNA, 23 bp, Homo sapiens
gtaattgcacatttttttctatg

SEQ ID NO: 5776935 - DNA, 23 bp, Homo sapiens
gtaattgcttacatttttacaat

SEQ ID NO: 5776936 - DNA, 21 bp, Homo sapiens
gtaattggaatcttcacctca

SEQ ID NO: 5776937 - DNA, 23 bp, Homo sapiens
gtaattggcccaagtcattgttt

SEQ ID NO: 5776938 - DNA, 12 bp, Homo sapiens
gtaattggtaat

SEQ ID NO: 5776939 - DNA, 16 bp, Homo sapiens
gtaattgtaattccaa

SEQ ID NO: 5776940 - DNA, 19 bp, Homo sapiens
gtaattgtacaataaattt

SEQ ID NO: 5776941 - DNA, 16 bp, Homo sapiens
gtaattgtacaatact

SEQ ID NO: 5776942 - DNA, 23 bp, Homo sapiens
gtaattgtactaaagccaaacat

SEQ ID NO: 5776943 - DNA, 9 bp, Homo sapiens
gtaattgtg

SEQ ID NO: 5776944 - DNA, 15 bp, Homo sapiens
gtaattgtgtggatt

SEQ ID NO: 5776945 - DNA, 12 bp, Homo sapiens
gtaattgttcca

SEQ ID NO: 5776946 - DNA, 23 bp, Homo sapiens
gtaattgttgtttgtatgtataa

SEQ ID NO: 5776947 - DNA, 14 bp, Homo sapiens
gtaattgtttttta

SEQ ID NO: 5776948 - DNA, 19 bp, Homo sapiens
gtaattgttttttaaagca

SEQ ID NO: 5776949 - DNA, 20 bp, Homo sapiens
gtaattgttttttaaagcaa

SEQ ID NO: 5776950 - DNA, 10 bp, Homo sapiens
gtaatttaaa

SEQ ID NO: 5776951 - DNA, 21 bp, Homo sapiens
gtaatttaaaataattatata

SEQ ID NO: 5776952 - DNA, 21 bp, Homo sapiens
gtaatttaaacaggcccagca

SEQ ID NO: 5776953 - DNA, 23 bp, Homo sapiens
gtaatttaaacatttgttcctgg

SEQ ID NO: 5776954 - DNA, 18 bp, Homo sapiens
gtaatttaagtgacacag

SEQ ID NO: 5776955 - DNA, 19 bp, Homo sapiens
gtaatttaagtgacacaga

SEQ ID NO: 5776956 - DNA, 23 bp, Homo sapiens
gtaatttaatttgtaaaacttct

SEQ ID NO: 5776957 - DNA, 14 bp, Homo sapiens
gtaatttataaaat

SEQ ID NO: 5776958 - DNA, 22 bp, Homo sapiens
gtaatttatattccatttacat

SEQ ID NO: 5776959 - DNA, 22 bp, Homo sapiens
gtaatttcaagaatgtttcagt

SEQ ID NO: 5776960 - DNA, 11 bp, Homo sapiens
gtaatttcact

SEQ ID NO: 5776961 - DNA, 19 bp, Homo sapiens
gtaatttccccactctgag

SEQ ID NO: 5776962 - DNA, 18 bp, Homo sapiens
gtaatttcctgctcctcc

SEQ ID NO: 5776963 - DNA, 18 bp, Homo sapiens
gtaatttcgccttaaact

SEQ ID NO: 5776964 - DNA, 12 bp, Homo sapiens
gtaatttctgag

SEQ ID NO: 5776965 - DNA, 23 bp, Homo sapiens
gtaatttctgcacaggtctctgt

SEQ ID NO: 5776966 - DNA, 13 bp, Homo sapiens
gtaatttctttgc

SEQ ID NO: 5776967 - DNA, 14 bp, Homo sapiens
gtaatttctttgcc

SEQ ID NO: 5776968 - DNA, 12 bp, Homo sapiens
gtaatttgaaga

SEQ ID NO: 5776969 - DNA, 15 bp, Homo sapiens
gtaatttgcattact

SEQ ID NO: 5776970 - DNA, 19 bp, Homo sapiens
gtaatttgggaacataaaa

SEQ ID NO: 5776971 - DNA, 15 bp, Homo sapiens
gtaatttgtaaaatg

SEQ ID NO: 5776972 - DNA, 21 bp, Homo sapiens
gtaatttgtacaggggccatg

SEQ ID NO: 5776973 - DNA, 13 bp, Homo sapiens
gtaatttgtatct

SEQ ID NO: 5776974 - DNA, 21 bp, Homo sapiens
gtaatttgtatctgaaggaga

SEQ ID NO: 5776975 - DNA, 22 bp, Homo sapiens
gtaatttgtgatacaatgctgt

SEQ ID NO: 5776976 - DNA, 15 bp, Homo sapiens
gtaatttgtgtaata

SEQ ID NO: 5776977 - DNA, 22 bp, Homo sapiens
gtaatttgtgtaataaagtgtt

SEQ ID NO: 5776978 - DNA, 22 bp, Homo sapiens
gtaatttgtttcccctagctta

SEQ ID NO: 5776979 - DNA, 20 bp, Homo sapiens
gtaattttacacgcttttgt

SEQ ID NO: 5776980 - DNA, 22 bp, Homo sapiens
gtaattttacacgcttttgtga

SEQ ID NO: 5776981 - DNA, 23 bp, Homo sapiens
gtaattttatttgttctttttct

SEQ ID NO: 5776982 - DNA, 20 bp, Homo sapiens
gtaattttattttaaaattt

SEQ ID NO: 5776983 - DNA, 13 bp, Homo sapiens
gtaattttcttga

SEQ ID NO: 5776984 - DNA, 17 bp, Homo sapiens
gtaattttggattttgc

SEQ ID NO: 5776985 - DNA, 23 bp, Homo sapiens
gtaattttgggtggggagaagag

SEQ ID NO: 5776986 - DNA, 21 bp, Homo sapiens
gtaattttgtagtagttgatg

SEQ ID NO: 5776987 - DNA, 15 bp, Homo sapiens
gtaattttgtcacat

SEQ ID NO: 5776988 - DNA, 17 bp, Homo sapiens
gtaatttttaaagcaaa

SEQ ID NO: 5776989 - DNA, 14 bp, Homo sapiens
gtaatttttgtaca

SEQ ID NO: 5776990 - DNA, 15 bp, Homo sapiens
gtaatttttgtacat

SEQ ID NO: 5776991 - DNA, 17 bp, Homo sapiens
gtaatttttttttgtaa

SEQ ID NO: 5776992 - DNA, 20 bp, Homo sapiens
gtaatttttttttgtaaagt

SEQ ID NO: 5776993 - DNA, 20 bp, Homo sapiens
gtacaaaaaaaaagttttat

SEQ ID NO: 5776994 - DNA, 22 bp, Homo sapiens
gtacaaaaaattcagtgatgtg

SEQ ID NO: 5776995 - DNA, 14 bp, Homo sapiens
gtacaaaaacacaa

SEQ ID NO: 5776996 - DNA, 15 bp, Homo sapiens
gtacaaaaacacaaa

SEQ ID NO: 5776997 - DNA, 12 bp, Homo sapiens
gtacaaaaataa

SEQ ID NO: 5776998 - DNA, 18 bp, Homo sapiens
gtacaaaactctgtataa

SEQ ID NO: 5776999 - DNA, 22 bp, Homo sapiens
gtacaaaactgtaaataaaatg

SEQ ID NO: 5777000 - DNA, 15 bp, Homo sapiens
gtacaaaagagaagc

SEQ ID NO: 5777001 - DNA, 21 bp, Homo sapiens
gtacaaaagttactattgctc

SEQ ID NO: 5777002 - DNA, 16 bp, Homo sapiens
gtacaaaataaacaaa

SEQ ID NO: 5777003 - DNA, 14 bp, Homo sapiens
gtacaaaataaagt

SEQ ID NO: 5777004 - DNA, 19 bp, Homo sapiens
gtacaaaatgaattgcctt

SEQ ID NO: 5777005 - DNA, 23 bp, Homo sapiens
gtacaaaattgcctataatactt

SEQ ID NO: 5777006 - DNA, 13 bp, Homo sapiens
gtacaaacatgaa

SEQ ID NO: 5777007 - DNA, 20 bp, Homo sapiens
gtacaaacatgaaaaacaaa

SEQ ID NO: 5777008 - DNA, 17 bp, Homo sapiens
gtacaaacccaaaaaag

SEQ ID NO: 5777009 - DNA, 20 bp, Homo sapiens
gtacaaacctgcatggtgtt

SEQ ID NO: 5777010 - DNA, 16 bp, Homo sapiens
gtacaaactatttcag

SEQ ID NO: 5777011 - DNA, 14 bp, Homo sapiens
gtacaaactcagat

SEQ ID NO: 5777012 - DNA, 18 bp, Homo sapiens
gtacaaactcagatcctt

SEQ ID NO: 5777013 - DNA, 23 bp, Homo sapiens
gtacaaagggaagcagagcctgg

SEQ ID NO: 5777014 - DNA, 17 bp, Homo sapiens
gtacaaagtaaaaataa

SEQ ID NO: 5777015 - DNA, 17 bp, Homo sapiens
gtacaaagtagagaagt

SEQ ID NO: 5777016 - DNA, 21 bp, Homo sapiens
gtacaaagtattaagcatata

SEQ ID NO: 5777017 - DNA, 16 bp, Homo sapiens
gtacaaagttttcctt

SEQ ID NO: 5777018 - DNA, 20 bp, Homo sapiens
gtacaaataaagtcccaggt

SEQ ID NO: 5777019 - DNA, 18 bp, Homo sapiens
gtacaaataatattgcct

SEQ ID NO: 5777020 - DNA, 20 bp, Homo sapiens
gtacaaataatttagaaata

SEQ ID NO: 5777021 - DNA, 23 bp, Homo sapiens
gtacaaatataagaataaaatgt

SEQ ID NO: 5777022 - DNA, 17 bp, Homo sapiens
gtacaaatgtttttcat

SEQ ID NO: 5777023 - DNA, 19 bp, Homo sapiens
gtacaacagaataatgcat

SEQ ID NO: 5777024 - DNA, 17 bp, Homo sapiens
gtacaaccccctccacc

SEQ ID NO: 5777025 - DNA, 14 bp, Homo sapiens
gtacaacggaggcc

SEQ ID NO: 5777026 - DNA, 23 bp, Homo sapiens
gtacaacggaggcctgcgaccct

SEQ ID NO: 5777027 - DNA, 18 bp, Homo sapiens
gtacaactgtatttatta

SEQ ID NO: 5777028 - DNA, 18 bp, Homo sapiens
gtacaacttctgggcctc

SEQ ID NO: 5777029 - DNA, 15 bp, Homo sapiens
gtacaagaagcattt

SEQ ID NO: 5777030 - DNA, 21 bp, Homo sapiens
gtacaagaagcattttgtaag

SEQ ID NO: 5777031 - DNA, 15 bp, Homo sapiens
gtacaagctcaggag

SEQ ID NO: 5777032 - DNA, 22 bp, Homo sapiens
gtacaagctcttgtttctgttt

SEQ ID NO: 5777033 - DNA, 16 bp, Homo sapiens
gtacaaggggcccagt

SEQ ID NO: 5777034 - DNA, 18 bp, Homo sapiens
gtacaaggtaattgtttt

SEQ ID NO: 5777035 - DNA, 20 bp, Homo sapiens
gtacaaggtatttacacata

SEQ ID NO: 5777036 - DNA, 22 bp, Homo sapiens
gtacaagtagttctgtatttga

SEQ ID NO: 5777037 - DNA, 20 bp, Homo sapiens
gtacaagtgctcagttccaa

SEQ ID NO: 5777038 - DNA, 21 bp, Homo sapiens
gtacaagtgctcagttccaat

SEQ ID NO: 5777039 - DNA, 23 bp, Homo sapiens
gtacaagtgctcagttccaatgt

SEQ ID NO: 5777040 - DNA, 22 bp, Homo sapiens
gtacaagttgctttgttacaat

SEQ ID NO: 5777041 - DNA, 17 bp, Homo sapiens
gtacaataaataaaaga

SEQ ID NO: 5777042 - DNA, 13 bp, Homo sapiens
gtacaataaattt

SEQ ID NO: 5777043 - DNA, 23 bp, Homo sapiens
gtacaataagcgttaagggcaga

SEQ ID NO: 5777044 - DNA, 23 bp, Homo sapiens
gtacaataagttacttgaaataa

SEQ ID NO: 5777045 - DNA, 16 bp, Homo sapiens
gtacaataatgtactc

SEQ ID NO: 5777046 - DNA, 17 bp, Homo sapiens
gtacaataatgtactca

SEQ ID NO: 5777047 - DNA, 19 bp, Homo sapiens
gtacaataatgtactcaca

SEQ ID NO: 5777048 - DNA, 20 bp, Homo sapiens
gtacaataatgtactcacat

SEQ ID NO: 5777049 - DNA, 16 bp, Homo sapiens
gtacaataattcatat

SEQ ID NO: 5777050 - DNA, 19 bp, Homo sapiens
gtacaatacataactagtt

SEQ ID NO: 5777051 - DNA, 17 bp, Homo sapiens
gtacaatatgaaaagga

SEQ ID NO: 5777052 - DNA, 15 bp, Homo sapiens
gtacaatattttaag

SEQ ID NO: 5777053 - DNA, 16 bp, Homo sapiens
gtacaatattttaagc

SEQ ID NO: 5777054 - DNA, 17 bp, Homo sapiens
gtacaatattttaagca

SEQ ID NO: 5777055 - DNA, 22 bp, Homo sapiens
gtacaatattttaagcattact

SEQ ID NO: 5777056 - DNA, 17 bp, Homo sapiens
gtacaatcaagtgatat

SEQ ID NO: 5777057 - DNA, 14 bp, Homo sapiens
gtacaatctcaaat

SEQ ID NO: 5777058 - DNA, 12 bp, Homo sapiens
gtacaatcttgg

SEQ ID NO: 5777059 - DNA, 14 bp, Homo sapiens
gtacaatctttcac

SEQ ID NO: 5777060 - DNA, 18 bp, Homo sapiens
gtacaatgaagaagtttc

SEQ ID NO: 5777061 - DNA, 22 bp, Homo sapiens
gtacaatggcccgacatttctt

SEQ ID NO: 5777062 - DNA, 21 bp, Homo sapiens
gtacaatggtttattcccaag

SEQ ID NO: 5777063 - DNA, 23 bp, Homo sapiens
gtacaatggtttattcccaagta

SEQ ID NO: 5777064 - DNA, 15 bp, Homo sapiens
gtacaatgtttcaga

SEQ ID NO: 5777065 - DNA, 15 bp, Homo sapiens
gtacaattactaaat

SEQ ID NO: 5777066 - DNA, 21 bp, Homo sapiens
gtacaattactaaattgtata

SEQ ID NO: 5777067 - DNA, 13 bp, Homo sapiens
gtacaattctttg

SEQ ID NO: 5777068 - DNA, 14 bp, Homo sapiens
gtacaattctttgt

SEQ ID NO: 5777069 - DNA, 21 bp, Homo sapiens
gtacaattctttgttgcttaa

SEQ ID NO: 5777070 - DNA, 15 bp, Homo sapiens
gtacaattgatcttt

SEQ ID NO: 5777071 - DNA, 16 bp, Homo sapiens
gtacaattttatataa

SEQ ID NO: 5777072 - DNA, 20 bp, Homo sapiens
gtacacaataagcaaaaaca

SEQ ID NO: 5777073 - DNA, 19 bp, Homo sapiens
gtacacacaaaaaccttgg

SEQ ID NO: 5777074 - DNA, 23 bp, Homo sapiens
gtacacacaaaaaccttggcata

SEQ ID NO: 5777075 - DNA, 14 bp, Homo sapiens
gtacacacacagac

SEQ ID NO: 5777076 - DNA, 16 bp, Homo sapiens
gtacacacacatacac

SEQ ID NO: 5777077 - DNA, 24 bp, Homo sapiens
gtacacacccgcctgacaccgtgg

SEQ ID NO: 5777078 - DNA, 17 bp, Homo sapiens
gtacacaccctccagca

SEQ ID NO: 5777079 - DNA, 19 bp, Homo sapiens
gtacacacggaccatgtgg

SEQ ID NO: 5777080 - DNA, 20 bp, Homo sapiens
gtacacacttgaccttctgt

SEQ ID NO: 5777081 - DNA, 15 bp, Homo sapiens
gtacacagagaaggc

SEQ ID NO: 5777082 - DNA, 21 bp, Homo sapiens
gtacacagagaaggctatgta

SEQ ID NO: 5777083 - DNA, 12 bp, Homo sapiens
gtacacatgtgt

SEQ ID NO: 5777084 - DNA, 14 bp, Homo sapiens
gtacacatgtgtta

SEQ ID NO: 5777085 - DNA, 16 bp, Homo sapiens
gtacacatgtgttatc

SEQ ID NO: 5777086 - DNA, 11 bp, Homo sapiens
gtacacatttc

SEQ ID NO: 5777087 - DNA, 19 bp, Homo sapiens
gtacaccactttcccacac

SEQ ID NO: 5777088 - DNA, 20 bp, Homo sapiens
gtacacccaattttaaaaaa

SEQ ID NO: 5777089 - DNA, 16 bp, Homo sapiens
gtacacccatgaaaga

SEQ ID NO: 5777090 - DNA, 15 bp, Homo sapiens
gtacaccccacctct

SEQ ID NO: 5777091 - DNA, 17 bp, Homo sapiens
gtacaccccacctcttc

SEQ ID NO: 5777092 - DNA, 17 bp, Homo sapiens
gtacacctccccctgcg

SEQ ID NO: 5777093 - DNA, 18 bp, Homo sapiens
gtacacctccccctgcgc

SEQ ID NO: 5777094 - DNA, 19 bp, Homo sapiens
gtacacgtaaatctgttca

SEQ ID NO: 5777095 - DNA, 15 bp, Homo sapiens
gtacattttgcttgc

SEQ ID NO: 5777096 - DNA, 19 bp, Homo sapiens
gtacattttgtaaaatatt

SEQ ID NO: 5777097 - DNA, 16 bp, Homo sapiens
gtacattttgttgtaa

SEQ ID NO: 5777098 - DNA, 21 bp, Homo sapiens
gtacattttgttgtaaaaaga

SEQ ID NO: 5777099 - DNA, 23 bp, Homo sapiens
gtacattttgttgtaaaaagaaa

SEQ ID NO: 5777100 - DNA, 18 bp, Homo sapiens
gtacatttttaaattctt

SEQ ID NO: 5777101 - DNA, 23 bp, Homo sapiens
gtacatttttgatcaaatgtaca

SEQ ID NO: 5777102 - DNA, 24 bp, Homo sapiens
gtacatttttgatcaaatgtacat

SEQ ID NO: 5777103 - DNA, 17 bp, Homo sapiens
gtacatttttgggggga

SEQ ID NO: 5777104 - DNA, 19 bp, Homo sapiens
gtacattttttgaaatgct

SEQ ID NO: 5777105 - DNA, 20 bp, Homo sapiens
gtacattttttgaaatgctg

SEQ ID NO: 5777106 - DNA, 19 bp, Homo sapiens
gtaccaaaattttaaaaaa

SEQ ID NO: 5777107 - DNA, 20 bp, Homo sapiens
gtaccaaaattttaaaaaag

SEQ ID NO: 5777108 - DNA, 14 bp, Homo sapiens
gtaccaaagctgtt

SEQ ID NO: 5777109 - DNA, 19 bp, Homo sapiens
gtaccaaagctgtttttat

SEQ ID NO: 5777110 - DNA, 15 bp, Homo sapiens
gtaccaaatctgaca

SEQ ID NO: 5777111 - DNA, 18 bp, Homo sapiens
gtaccaaatctgacatat

SEQ ID NO: 5777112 - DNA, 13 bp, Homo sapiens
gtaccaactgagc

SEQ ID NO: 5777113 - DNA, 23 bp, Homo sapiens
gtaccaagactactagggaaatg

SEQ ID NO: 5777114 - DNA, 16 bp, Homo sapiens
gtaccaagatcacaaa

SEQ ID NO: 5777115 - DNA, 18 bp, Homo sapiens
gtaccaagatcacaaata

SEQ ID NO: 5777116 - DNA, 16 bp, Homo sapiens
gtaccaagccaccgca

SEQ ID NO: 5777117 - DNA, 22 bp, Homo sapiens
gtaccaagccaccgcagctgct

SEQ ID NO: 5777118 - DNA, 22 bp, Homo sapiens
gtaccaagccccttggccctct

SEQ ID NO: 5777119 - DNA, 14 bp, Homo sapiens
gtaccaatcatttt

SEQ ID NO: 5777120 - DNA, 21 bp, Homo sapiens
gtaccaatgctgttgtaaaca

SEQ ID NO: 5777121 - DNA, 18 bp, Homo sapiens
gtaccacaccctgcctgc

SEQ ID NO: 5777122 - DNA, 18 bp, Homo sapiens
gtaccacattccatgacg

SEQ ID NO: 5777123 - DNA, 15 bp, Homo sapiens
gtaccaccaaaaaag

SEQ ID NO: 5777124 - DNA, 16 bp, Homo sapiens
gtaccactacttagag

SEQ ID NO: 5777125 - DNA, 18 bp, Homo sapiens
gtaccactgaatctgtac

SEQ ID NO: 5777126 - DNA, 12 bp, Homo sapiens
gtaccactgcta

SEQ ID NO: 5777127 - DNA, 13 bp, Homo sapiens
gtaccactgctaa

SEQ ID NO: 5777128 - DNA, 21 bp, Homo sapiens
gtaccactgctaataaatgac

SEQ ID NO: 5777129 - DNA, 18 bp, Homo sapiens
gtaccacttctgtgggca

SEQ ID NO: 5777130 - DNA, 17 bp, Homo sapiens
gtaccagatgcagctca

SEQ ID NO: 5777131 - DNA, 13 bp, Homo sapiens
gtaccagccagga

SEQ ID NO: 5777132 - DNA, 24 bp, Homo sapiens
gtaccagccaggatcccaagcgtc

SEQ ID NO: 5777133 - DNA, 16 bp, Homo sapiens
gtaccagccccaccct

SEQ ID NO: 5777134 - DNA, 13 bp, Homo sapiens
gtaccagctgctg

SEQ ID NO: 5777135 - DNA, 23 bp, Homo sapiens
gtaccagctgctgtgctgggtgc

SEQ ID NO: 5777136 - DNA, 23 bp, Homo sapiens
gtaccaggaaaggattttataat

SEQ ID NO: 5777137 - DNA, 21 bp, Homo sapiens
gtaccaggcacatggctgggg

SEQ ID NO: 5777138 - DNA, 23 bp, Homo sapiens
gtaccaggcacatggctggggga

SEQ ID NO: 5777139 - DNA, 13 bp, Homo sapiens
gtaccaggccacc

SEQ ID NO: 5777140 - DNA, 14 bp, Homo sapiens
gtaccaggccaccc

SEQ ID NO: 5777141 - DNA, 17 bp, Homo sapiens
gtaccaggccacccact

SEQ ID NO: 5777142 - DNA, 18 bp, Homo sapiens
gtaccaggggctgggctc

SEQ ID NO: 5777143 - DNA, 21 bp, Homo sapiens
gtaccaggggctgggctccct

SEQ ID NO: 5777144 - DNA, 18 bp, Homo sapiens
gtaccaggtctcctccac

SEQ ID NO: 5777145 - DNA, 19 bp, Homo sapiens
gtaccaggtctcctccacc

SEQ ID NO: 5777146 - DNA, 19 bp, Homo sapiens
gtaccagtgtactgctttc

SEQ ID NO: 5777147 - DNA, 16 bp, Homo sapiens
gtaccagttaattttt

SEQ ID NO: 5777148 - DNA, 20 bp, Homo sapiens
gtaccagttaatttttccaa

SEQ ID NO: 5777149 - DNA, 17 bp, Homo sapiens
gtaccatacacattgga

SEQ ID NO: 5777150 - DNA, 14 bp, Homo sapiens
gtaccatagaaaaa

SEQ ID NO: 5777151 - DNA, 17 bp, Homo sapiens
gtaccatagaaaaatgt

SEQ ID NO: 5777152 - DNA, 20 bp, Homo sapiens
gtaccatagcgctgctctta

SEQ ID NO: 5777153 - DNA, 14 bp, Homo sapiens
gtaccatatgtagc

SEQ ID NO: 5777154 - DNA, 13 bp, Homo sapiens
gtaccatattgct

SEQ ID NO: 5777155 - DNA, 18 bp, Homo sapiens
gtaccatattgctcttaa

SEQ ID NO: 5777156 - DNA, 17 bp, Homo sapiens
gtaccatcaataaagta

SEQ ID NO: 5777157 - DNA, 19 bp, Homo sapiens
gtaccatcccactgatatc

SEQ ID NO: 5777158 - DNA, 21 bp, Homo sapiens
gtaccatgctggcggcgcaga

SEQ ID NO: 5777159 - DNA, 14 bp, Homo sapiens
gtaccatgggctac

SEQ ID NO: 5777160 - DNA, 16 bp, Homo sapiens
gtaccatgttaaagag

SEQ ID NO: 5777161 - DNA, 17 bp, Homo sapiens
gtaccatgttaaagagg

SEQ ID NO: 5777162 - DNA, 14 bp, Homo sapiens
gtaccattaaaata

SEQ ID NO: 5777163 - DNA, 17 bp, Homo sapiens
gtaccattaaaatatgc

SEQ ID NO: 5777164 - DNA, 18 bp, Homo sapiens
gtaccattaaaatatgca

SEQ ID NO: 5777165 - DNA, 13 bp, Homo sapiens
gtacccaaaacac

SEQ ID NO: 5777166 - DNA, 16 bp, Homo sapiens
gtacccaaaacacatt

SEQ ID NO: 5777167 - DNA, 16 bp, Homo sapiens
gtacccaccccagcac

SEQ ID NO: 5777168 - DNA, 15 bp, Homo sapiens
gtacccacctgagct

SEQ ID NO: 5777169 - DNA, 17 bp, Homo sapiens
gtacccacctgagcttt

SEQ ID NO: 5777170 - DNA, 15 bp, Homo sapiens
gtacccactcctcac

SEQ ID NO: 5777171 - DNA, 21 bp, Homo sapiens
gtacccactcctcactgcccc

SEQ ID NO: 5777172 - DNA, 12 bp, Homo sapiens
gtacccactgct

SEQ ID NO: 5777173 - DNA, 16 bp, Homo sapiens
gtacccactgctctgg

SEQ ID NO: 5777174 - DNA, 15 bp, Homo sapiens
gtacccagatgccta

SEQ ID NO: 5777175 - DNA, 12 bp, Homo sapiens
gtacccagccat

SEQ ID NO: 5777176 - DNA, 12 bp, Homo sapiens
gtacccagccta

SEQ ID NO: 5777177 - DNA, 13 bp, Homo sapiens
gtacccagctcct

SEQ ID NO: 5777178 - DNA, 22 bp, Homo sapiens
gtacccaggctttagcattatt

SEQ ID NO: 5777179 - DNA, 22 bp, Homo sapiens
gtacccattctgttttccccca

SEQ ID NO: 5777180 - DNA, 14 bp, Homo sapiens
gtaccccaccctca

SEQ ID NO: 5777181 - DNA, 19 bp, Homo sapiens
gtaccccagctctgcttgc

SEQ ID NO: 5777182 - DNA, 12 bp, Homo sapiens
gtaccccatccc

SEQ ID NO: 5777183 - DNA, 13 bp, Homo sapiens
gtacccccaggac

SEQ ID NO: 5777184 - DNA, 16 bp, Homo sapiens
gtacccccaggaccag

SEQ ID NO: 5777185 - DNA, 14 bp, Homo sapiens
gtaccccccaaccc

SEQ ID NO: 5777186 - DNA, 18 bp, Homo sapiens
gtacccccgcccaggctg

SEQ ID NO: 5777187 - DNA, 16 bp, Homo sapiens
gtacccccgtggtctt

SEQ ID NO: 5777188 - DNA, 19 bp, Homo sapiens
gtacccccgtggtctttga

SEQ ID NO: 5777189 - DNA, 22 bp, Homo sapiens
gtacccccgtggtctttgaata

SEQ ID NO: 5777190 - DNA, 17 bp, Homo sapiens
gtacccctaaaatccca

SEQ ID NO: 5777191 - DNA, 22 bp, Homo sapiens
gtacccctaaaatcccaccaga

SEQ ID NO: 5777192 - DNA, 17 bp, Homo sapiens
gtacccctggtaaacca

SEQ ID NO: 5777193 - DNA, 14 bp, Homo sapiens
gtacccgaggcctc

SEQ ID NO: 5777194 - DNA, 12 bp, Homo sapiens
gtaccctaccct

SEQ ID NO: 5777195 - DNA, 15 bp, Homo sapiens
gtaccctgcaggcca

SEQ ID NO: 5777196 - DNA, 17 bp, Homo sapiens
gtaccctgcaggccagg

SEQ ID NO: 5777197 - DNA, 18 bp, Homo sapiens
gtaccctgcaggccaggc

SEQ ID NO: 5777198 - DNA, 11 bp, Homo sapiens
gtaccctgctt

SEQ ID NO: 5777199 - DNA, 13 bp, Homo sapiens
gtaccctggcaga

SEQ ID NO: 5777200 - DNA, 22 bp, Homo sapiens
gtaccctggcagagaagagacc

SEQ ID NO: 5777201 - DNA, 18 bp, Homo sapiens
gtaccgccagcagctgtc

SEQ ID NO: 5777202 - DNA, 19 bp, Homo sapiens
gtaccgcccggcagcccct

SEQ ID NO: 5777203 - DNA, 12 bp, Homo sapiens
gtaccggatgca

SEQ ID NO: 5777204 - DNA, 16 bp, Homo sapiens
gtacctagctgtaatg

SEQ ID NO: 5777205 - DNA, 19 bp, Homo sapiens
gtacctataaagtaaagct

SEQ ID NO: 5777206 - DNA, 18 bp, Homo sapiens
gtacctatagaaatagaa

SEQ ID NO: 5777207 - DNA, 17 bp, Homo sapiens
gtacctatggctgcctg

SEQ ID NO: 5777208 - DNA, 16 bp, Homo sapiens
gtacctatgtgacaga

SEQ ID NO: 5777209 - DNA, 21 bp, Homo sapiens
gtacctatgtgagtttcagaa

SEQ ID NO: 5777210 - DNA, 14 bp, Homo sapiens
gtacctatttctga

SEQ ID NO: 5777211 - DNA, 15 bp, Homo sapiens
gtacctcaaatgaat

SEQ ID NO: 5777212 - DNA, 13 bp, Homo sapiens
gtacctcagtatt

SEQ ID NO: 5777213 - DNA, 20 bp, Homo sapiens
gtacctcagtggatcttcag

SEQ ID NO: 5777214 - DNA, 12 bp, Homo sapiens
gtacctcagttt

SEQ ID NO: 5777215 - DNA, 16 bp, Homo sapiens
gtacctcatcccatga

SEQ ID NO: 5777216 - DNA, 22 bp, Homo sapiens
gtacctcatgggaagcatgtgg

SEQ ID NO: 5777217 - DNA, 17 bp, Homo sapiens
gtacctcccctgccttg

SEQ ID NO: 5777218 - DNA, 22 bp, Homo sapiens
gtacctctattagtttcaattg

SEQ ID NO: 5777219 - DNA, 12 bp, Homo sapiens
gtacctctcaag

SEQ ID NO: 5777220 - DNA, 23 bp, Homo sapiens
gtacctctctctgctcctcaccc

SEQ ID NO: 5777221 - DNA, 22 bp, Homo sapiens
gtacctcttgagccttgaactt

SEQ ID NO: 5777222 - DNA, 14 bp, Homo sapiens
gtacctgaaaagta

SEQ ID NO: 5777223 - DNA, 14 bp, Homo sapiens
gtacctgagggtct

SEQ ID NO: 5777224 - DNA, 15 bp, Homo sapiens
gtacctgatgtacct

SEQ ID NO: 5777225 - DNA, 15 bp, Homo sapiens
gtacctgcaagcaga

SEQ ID NO: 5777226 - DNA, 17 bp, Homo sapiens
gtacctgcaagcagaac

SEQ ID NO: 5777227 - DNA, 18 bp, Homo sapiens
gtacctgcaagcagaact

SEQ ID NO: 5777228 - DNA, 17 bp, Homo sapiens
gtacctggtgacccctt

SEQ ID NO: 5777229 - DNA, 18 bp, Homo sapiens
gtacctgtccctccaggc

SEQ ID NO: 5777230 - DNA, 22 bp, Homo sapiens
gtacctgtggctgtgtgtctgc

SEQ ID NO: 5777231 - DNA, 17 bp, Homo sapiens
gtacctgttcctccccc

SEQ ID NO: 5777232 - DNA, 15 bp, Homo sapiens
gtaccttaagatatt

SEQ ID NO: 5777233 - DNA, 15 bp, Homo sapiens
gtaccttatttaaaa

SEQ ID NO: 5777234 - DNA, 19 bp, Homo sapiens
gtaccttcagatcctaccc

SEQ ID NO: 5777235 - DNA, 14 bp, Homo sapiens
gtaccttcagccct

SEQ ID NO: 5777236 - DNA, 16 bp, Homo sapiens
gtaccttcagccctgg

SEQ ID NO: 5777237 - DNA, 17 bp, Homo sapiens
gtaccttcagccctggc

SEQ ID NO: 5777238 - DNA, 15 bp, Homo sapiens
gtaccttctgccaga

SEQ ID NO: 5777239 - DNA, 17 bp, Homo sapiens
gtaccttgctgtggggc

SEQ ID NO: 5777240 - DNA, 21 bp, Homo sapiens
gtaccttgctttagagtagat

SEQ ID NO: 5777241 - DNA, 16 bp, Homo sapiens
gtacctttctagcctt

SEQ ID NO: 5777242 - DNA, 19 bp, Homo sapiens
gtaccttttaacacctgat

SEQ ID NO: 5777243 - DNA, 21 bp, Homo sapiens
gtaccttttgaggagccccag

SEQ ID NO: 5777244 - DNA, 23 bp, Homo sapiens
gtaccttttttgttttttcaaaa

SEQ ID NO: 5777245 - DNA, 23 bp, Homo sapiens
gtacgaacccctcccctcccccc

SEQ ID NO: 5777246 - DNA, 18 bp, Homo sapiens
gtacgaatctcatccctc

SEQ ID NO: 5777247 - DNA, 20 bp, Homo sapiens
gtacgaatctcatccctcaa

SEQ ID NO: 5777248 - DNA, 21 bp, Homo sapiens
gtacgactcttttccaaacac

SEQ ID NO: 5777249 - DNA, 24 bp, Homo sapiens
gtacgatcaagttgttgactgtga

SEQ ID NO: 5777250 - DNA, 15 bp, Homo sapiens
gtacgcacagacagg

SEQ ID NO: 5777251 - DNA, 13 bp, Homo sapiens
gtacgcccaggac

SEQ ID NO: 5777252 - DNA, 15 bp, Homo sapiens
gtacgcccaggacag

SEQ ID NO: 5777253 - DNA, 15 bp, Homo sapiens
gtacggcaaccacat

SEQ ID NO: 5777254 - DNA, 12 bp, Homo sapiens
gtacggctgctg

SEQ ID NO: 5777255 - DNA, 13 bp, Homo sapiens
gtacggctgctgc

SEQ ID NO: 5777256 - DNA, 14 bp, Homo sapiens
gtacggctgctgca

SEQ ID NO: 5777257 - DNA, 12 bp, Homo sapiens
gtacgtaatgta

SEQ ID NO: 5777258 - DNA, 15 bp, Homo sapiens
gtacgtagccacagg

SEQ ID NO: 5777259 - DNA, 15 bp, Homo sapiens
gtacgtatcatttct

SEQ ID NO: 5777260 - DNA, 13 bp, Homo sapiens
gtacgtcccagcg

SEQ ID NO: 5777261 - DNA, 14 bp, Homo sapiens
gtacgtctgacagg

SEQ ID NO: 5777262 - DNA, 17 bp, Homo sapiens
gtacgtctgacaggcaa

SEQ ID NO: 5777263 - DNA, 13 bp, Homo sapiens
gtacgtgggagag

SEQ ID NO: 5777264 - DNA, 19 bp, Homo sapiens
gtacgtgggagaggcagaa

SEQ ID NO: 5777265 - DNA, 21 bp, Homo sapiens
gtacgtgggtacccaggctgg

SEQ ID NO: 5777266 - DNA, 16 bp, Homo sapiens
gtacgttatatattgt

SEQ ID NO: 5777267 - DNA, 18 bp, Homo sapiens
gtacgttatatattgtat

SEQ ID NO: 5777268 - DNA, 17 bp, Homo sapiens
gtacgtttttgcattat

SEQ ID NO: 5777269 - DNA, 18 bp, Homo sapiens
gtactaaaactagataac

SEQ ID NO: 5777270 - DNA, 13 bp, Homo sapiens
gtactaaacattt

SEQ ID NO: 5777271 - DNA, 13 bp, Homo sapiens
gtactaaagccaa

SEQ ID NO: 5777272 - DNA, 17 bp, Homo sapiens
gtactaaggagaaatga

SEQ ID NO: 5777273 - DNA, 20 bp, Homo sapiens
gtactaagggaacaatccat

SEQ ID NO: 5777274 - DNA, 19 bp, Homo sapiens
gtactaaggtgactttctg

SEQ ID NO: 5777275 - DNA, 12 bp, Homo sapiens
gtactaatctga

SEQ ID NO: 5777276 - DNA, 16 bp, Homo sapiens
gtactaatctgagatt

SEQ ID NO: 5777277 - DNA, 20 bp, Homo sapiens
gtactaatgaaatttacagt

SEQ ID NO: 5777278 - DNA, 18 bp, Homo sapiens
gtactacagctatatttg

SEQ ID NO: 5777279 - DNA, 17 bp, Homo sapiens
gtactacagtcctccca

SEQ ID NO: 5777280 - DNA, 18 bp, Homo sapiens
gtactacagtcctcccat

SEQ ID NO: 5777281 - DNA, 21 bp, Homo sapiens
gtactacatttgcatgccttt

SEQ ID NO: 5777282 - DNA, 12 bp, Homo sapiens
gtactaccccag

SEQ ID NO: 5777283 - DNA, 16 bp, Homo sapiens
gtactacggagaaact

SEQ ID NO: 5777284 - DNA, 20 bp, Homo sapiens
gtactactagatgtctttag

SEQ ID NO: 5777285 - DNA, 17 bp, Homo sapiens
gtactactctccagctt

SEQ ID NO: 5777286 - DNA, 21 bp, Homo sapiens
gtactagagatattttgtaaa

SEQ ID NO: 5777287 - DNA, 20 bp, Homo sapiens
gtactagccagcacaaaagg

SEQ ID NO: 5777288 - DNA, 18 bp, Homo sapiens
gtactaggatactgctgc

SEQ ID NO: 5777289 - DNA, 19 bp, Homo sapiens
gtactaggattagaaaatt

SEQ ID NO: 5777290 - DNA, 16 bp, Homo sapiens
gtactagtactgtgta

SEQ ID NO: 5777291 - DNA, 22 bp, Homo sapiens
gtactagtgtccgcataagaaa

SEQ ID NO: 5777292 - DNA, 17 bp, Homo sapiens
gtactagtgttctgttt

SEQ ID NO: 5777293 - DNA, 13 bp, Homo sapiens
gtactatatctgt

SEQ ID NO: 5777294 - DNA, 17 bp, Homo sapiens
gtactatatctgtttta

SEQ ID NO: 5777295 - DNA, 21 bp, Homo sapiens
gtactatatctgttttactgc

SEQ ID NO: 5777296 - DNA, 16 bp, Homo sapiens
gtactatctagtgtct

SEQ ID NO: 5777297 - DNA, 19 bp, Homo sapiens
gtactatcttatctcagat

SEQ ID NO: 5777298 - DNA, 18 bp, Homo sapiens
gtactatgatgggcttct

SEQ ID NO: 5777299 - DNA, 18 bp, Homo sapiens
gtactatggaagccacat

SEQ ID NO: 5777300 - DNA, 20 bp, Homo sapiens
gtactatggaagccacatca

SEQ ID NO: 5777301 - DNA, 18 bp, Homo sapiens
gtactatttaactgacta

SEQ ID NO: 5777302 - DNA, 21 bp, Homo sapiens
gtactatttagatataacact

SEQ ID NO: 5777303 - DNA, 14 bp, Homo sapiens
gtactatttcttaa

SEQ ID NO: 5777304 - DNA, 14 bp, Homo sapiens
gtactcacatataa

SEQ ID NO: 5777305 - DNA, 20 bp, Homo sapiens
gtactcacatataacatgca

SEQ ID NO: 5777306 - DNA, 15 bp, Homo sapiens
gtactcactgaagcc

SEQ ID NO: 5777307 - DNA, 16 bp, Homo sapiens
gtactcacttttcact

SEQ ID NO: 5777308 - DNA, 17 bp, Homo sapiens
gtactcagagcagagca

SEQ ID NO: 5777309 - DNA, 18 bp, Homo sapiens
gtactccacactgcacaa

SEQ ID NO: 5777310 - DNA, 22 bp, Homo sapiens
gtactccagcaggtaggggcac

SEQ ID NO: 5777311 - DNA, 11 bp, Homo sapiens
gtactccagcc

SEQ ID NO: 5777312 - DNA, 14 bp, Homo sapiens
gtactccagcctgg

SEQ ID NO: 5777313 - DNA, 15 bp, Homo sapiens
gtactccagcctggg

SEQ ID NO: 5777314 - DNA, 16 bp, Homo sapiens
gtactccagcctgggt

SEQ ID NO: 5777315 - DNA, 18 bp, Homo sapiens
gtactcccaaactgacaa

SEQ ID NO: 5777316 - DNA, 22 bp, Homo sapiens
gtactcccaaactgacaatttt

SEQ ID NO: 5777317 - DNA, 20 bp, Homo sapiens
gtactccctctcaggatcca

SEQ ID NO: 5777318 - DNA, 14 bp, Homo sapiens
gtactcctcagacg

SEQ ID NO: 5777319 - DNA, 14 bp, Homo sapiens
gtactcctcccagg

SEQ ID NO: 5777320 - DNA, 15 bp, Homo sapiens
gtactcctccctggg

SEQ ID NO: 5777321 - DNA, 13 bp, Homo sapiens
gtactcctgccag

SEQ ID NO: 5777322 - DNA, 19 bp, Homo sapiens
gtactccttggatttgcat

SEQ ID NO: 5777323 - DNA, 22 bp, Homo sapiens
gtactcgcacctcttggctttg

SEQ ID NO: 5777324 - DNA, 21 bp, Homo sapiens
gtactcgttggatgtctgtga

SEQ ID NO: 5777325 - DNA, 14 bp, Homo sapiens
gtactctaatatac

SEQ ID NO: 5777326 - DNA, 18 bp, Homo sapiens
gtactctaggacttcaaa

SEQ ID NO: 5777327 - DNA, 18 bp, Homo sapiens
gtactctataagaggtgt

SEQ ID NO: 5777328 - DNA, 23 bp, Homo sapiens
gtactctcctagagacagaagca

SEQ ID NO: 5777329 - DNA, 15 bp, Homo sapiens
gtactctccttttat

SEQ ID NO: 5777330 - DNA, 14 bp, Homo sapiens
gtactctgaaacac

SEQ ID NO: 5777331 - DNA, 21 bp, Homo sapiens
gtactctgaaacacactgaaa

SEQ ID NO: 5777332 - DNA, 18 bp, Homo sapiens
gtactctgagtcctcatt

SEQ ID NO: 5777333 - DNA, 12 bp, Homo sapiens
gtactctggcct

SEQ ID NO: 5777334 - DNA, 14 bp, Homo sapiens
gtactctggcctct

SEQ ID NO: 5777335 - DNA, 13 bp, Homo sapiens
gtactctgtgaaa

SEQ ID NO: 5777336 - DNA, 14 bp, Homo sapiens
gtactctgtgaaag

SEQ ID NO: 5777337 - DNA, 11 bp, Homo sapiens
gtactctgtgt

SEQ ID NO: 5777338 - DNA, 13 bp, Homo sapiens
gtactctgtgtgt

SEQ ID NO: 5777339 - DNA, 21 bp, Homo sapiens
gtactctgttgagtaaaacac

SEQ ID NO: 5777340 - DNA, 13 bp, Homo sapiens
gtactcttccgaa

SEQ ID NO: 5777341 - DNA, 14 bp, Homo sapiens
gtactcttccgaaa

SEQ ID NO: 5777342 - DNA, 22 bp, Homo sapiens
gtactcttccgaaaaatcctct

SEQ ID NO: 5777343 - DNA, 23 bp, Homo sapiens
gtactcttccgatgtttgtgtca

SEQ ID NO: 5777344 - DNA, 18 bp, Homo sapiens
gtactcttgctttttcaa

SEQ ID NO: 5777345 - DNA, 11 bp, Homo sapiens
gtactctttaa

SEQ ID NO: 5777346 - DNA, 23 bp, Homo sapiens
gtactgaaagccttagggaagct

SEQ ID NO: 5777347 - DNA, 18 bp, Homo sapiens
gtactgaaataatgatct

SEQ ID NO: 5777348 - DNA, 21 bp, Homo sapiens
gtactgaagccaaatgaaact

SEQ ID NO: 5777349 - DNA, 21 bp, Homo sapiens
gtactgaaggcttctgcagct

SEQ ID NO: 5777350 - DNA, 15 bp, Homo sapiens
gtactgaattcttta

SEQ ID NO: 5777351 - DNA, 18 bp, Homo sapiens
gtactgaatttttttgta

SEQ ID NO: 5777352 - DNA, 23 bp, Homo sapiens
gtactgacccaggaccatcctgg

SEQ ID NO: 5777353 - DNA, 19 bp, Homo sapiens
gtactgaccccatcaccta

SEQ ID NO: 5777354 - DNA, 18 bp, Homo sapiens
gtactgactttgcttgct

SEQ ID NO: 5777355 - DNA, 15 bp, Homo sapiens
gtactgagacagggt

SEQ ID NO: 5777356 - DNA, 14 bp, Homo sapiens
gtactgagaggagg

SEQ ID NO: 5777357 - DNA, 15 bp, Homo sapiens
gtactgagaggaggg

SEQ ID NO: 5777358 - DNA, 22 bp, Homo sapiens
gtactgagaggaggggtaaata

SEQ ID NO: 5777359 - DNA, 17 bp, Homo sapiens
gtactgattcaagaaca

SEQ ID NO: 5777360 - DNA, 18 bp, Homo sapiens
gtactgattcaagaacaa

SEQ ID NO: 5777361 - DNA, 22 bp, Homo sapiens
gtactgattcaagaacaagcaa

SEQ ID NO: 5777362 - DNA, 17 bp, Homo sapiens
gtactgattgagaagtt

SEQ ID NO: 5777363 - DNA, 15 bp, Homo sapiens
gtactgatttcagta

SEQ ID NO: 5777364 - DNA, 14 bp, Homo sapiens
gtactgcaaagtgt

SEQ ID NO: 5777365 - DNA, 13 bp, Homo sapiens
gtactgcagcctc

SEQ ID NO: 5777366 - DNA, 19 bp, Homo sapiens
gtactgcatcttagtttac

SEQ ID NO: 5777367 - DNA, 12 bp, Homo sapiens
gtactgcatgtg

SEQ ID NO: 5777368 - DNA, 15 bp, Homo sapiens
gtactgcatgtgact

SEQ ID NO: 5777369 - DNA, 20 bp, Homo sapiens
gtactgcattctctcccatc

SEQ ID NO: 5777370 - DNA, 14 bp, Homo sapiens
gtactgccaaggta

SEQ ID NO: 5777371 - DNA, 22 bp, Homo sapiens
gtactgccccccatgaggaagg

SEQ ID NO: 5777372 - DNA, 23 bp, Homo sapiens
gtactgccccccatgaggaagga

SEQ ID NO: 5777373 - DNA, 16 bp, Homo sapiens
gtactgcctgcttggg

SEQ ID NO: 5777374 - DNA, 16 bp, Homo sapiens
gtactggaaaagccct

SEQ ID NO: 5777375 - DNA, 12 bp, Homo sapiens
gtactggccagt

SEQ ID NO: 5777376 - DNA, 20 bp, Homo sapiens
gtactgggattacaggcgtg

SEQ ID NO: 5777377 - DNA, 12 bp, Homo sapiens
gtactgggggtt

SEQ ID NO: 5777378 - DNA, 23 bp, Homo sapiens
gtactgggttatttttgtccctg

SEQ ID NO: 5777379 - DNA, 16 bp, Homo sapiens
gtactggttactttca

SEQ ID NO: 5777380 - DNA, 11 bp, Homo sapiens
gtactgtaaac

SEQ ID NO: 5777381 - DNA, 15 bp, Homo sapiens
gtactgtaactgctc

SEQ ID NO: 5777382 - DNA, 19 bp, Homo sapiens
gtactgtaataatacctca

SEQ ID NO: 5777383 - DNA, 15 bp, Homo sapiens
gtactgtacagctgg

SEQ ID NO: 5777384 - DNA, 19 bp, Homo sapiens
gtactgtacagctggctct

SEQ ID NO: 5777385 - DNA, 14 bp, Homo sapiens
gtactgtacagggt

SEQ ID NO: 5777386 - DNA, 14 bp, Homo sapiens
gtactgtactaatt

SEQ ID NO: 5777387 - DNA, 17 bp, Homo sapiens
gtactgtactgaagaac

SEQ ID NO: 5777388 - DNA, 17 bp, Homo sapiens
gtactgtactttcccag

SEQ ID NO: 5777389 - DNA, 23 bp, Homo sapiens
gtactgtactttcccaggttgac

SEQ ID NO: 5777390 - DNA, 14 bp, Homo sapiens
gtactgtagttttt

SEQ ID NO: 5777391 - DNA, 17 bp, Homo sapiens
gtactgtatagacagtt

SEQ ID NO: 5777392 - DNA, 20 bp, Homo sapiens
gtactgtatagacagtttgt

SEQ ID NO: 5777393 - DNA, 22 bp, Homo sapiens
gtactgtatgatcaaatgttta

SEQ ID NO: 5777394 - DNA, 21 bp, Homo sapiens
gtactgtatggaaacactgat

SEQ ID NO: 5777395 - DNA, 16 bp, Homo sapiens
gtactgtctcggcaga

SEQ ID NO: 5777396 - DNA, 19 bp, Homo sapiens
gtactgtctcggcagaggt

SEQ ID NO: 5777397 - DNA, 20 bp, Homo sapiens
gtactgtctcggcagaggtg

SEQ ID NO: 5777398 - DNA, 15 bp, Homo sapiens
gtactgtctgttatg

SEQ ID NO: 5777399 - DNA, 19 bp, Homo sapiens
gtactgtctgttatgattt

SEQ ID NO: 5777400 - DNA, 13 bp, Homo sapiens
gtactgtgcctgg

SEQ ID NO: 5777401 - DNA, 14 bp, Homo sapiens
gtactgtgtactgt

SEQ ID NO: 5777402 - DNA, 14 bp, Homo sapiens
gtactgtgttttta

SEQ ID NO: 5777403 - DNA, 20 bp, Homo sapiens
gtactgttaagaataataaa

SEQ ID NO: 5777404 - DNA, 14 bp, Homo sapiens
gtactgttcataca

SEQ ID NO: 5777405 - DNA, 15 bp, Homo sapiens
gtactgttcatacag

SEQ ID NO: 5777406 - DNA, 18 bp, Homo sapiens
gtactgttcatacagttt

SEQ ID NO: 5777407 - DNA, 14 bp, Homo sapiens
gtactgttgaaaaa

SEQ ID NO: 5777408 - DNA, 19 bp, Homo sapiens
gtactgttgaatttggctt

SEQ ID NO: 5777409 - DNA, 16 bp, Homo sapiens
gtactgttgctttaat

SEQ ID NO: 5777410 - DNA, 20 bp, Homo sapiens
gtactgttgctttaatatga

SEQ ID NO: 5777411 - DNA, 15 bp, Homo sapiens
gtactgtttaatgtt

SEQ ID NO: 5777412 - DNA, 13 bp, Homo sapiens
gtactgtttacca

SEQ ID NO: 5777413 - DNA, 17 bp, Homo sapiens
gtacttaaatgaaagca

SEQ ID NO: 5777414 - DNA, 19 bp, Homo sapiens
gtacttaaatgaaagcatg

SEQ ID NO: 5777415 - DNA, 14 bp, Homo sapiens
gtacttaaatgagt

SEQ ID NO: 5777416 - DNA, 16 bp, Homo sapiens
gtacttaactatctgt

SEQ ID NO: 5777417 - DNA, 14 bp, Homo sapiens
gtacttaatatact

SEQ ID NO: 5777418 - DNA, 15 bp, Homo sapiens
gtacttaatttactt

SEQ ID NO: 5777419 - DNA, 23 bp, Homo sapiens
gtacttaatttacttaagtgttc

SEQ ID NO: 5777420 - DNA, 16 bp, Homo sapiens
gtacttacactgaaat

SEQ ID NO: 5777421 - DNA, 19 bp, Homo sapiens
gtacttacactgaaatcca

SEQ ID NO: 5777422 - DNA, 20 bp, Homo sapiens
gtacttacactgaaatccaa

SEQ ID NO: 5777423 - DNA, 22 bp, Homo sapiens
gtacttacatctttgtttacca

SEQ ID NO: 5777424 - DNA, 16 bp, Homo sapiens
gtacttagcagctatc

SEQ ID NO: 5777425 - DNA, 19 bp, Homo sapiens
gtacttagcagctatctct

SEQ ID NO: 5777426 - DNA, 22 bp, Homo sapiens
gtacttagccagttcaaagtgt

SEQ ID NO: 5777427 - DNA, 23 bp, Homo sapiens
gtacttagccagttcaaagtgta

SEQ ID NO: 5777428 - DNA, 19 bp, Homo sapiens
gtacttcagcaagagagaa

SEQ ID NO: 5777429 - DNA, 20 bp, Homo sapiens
gtacttccaatttataatga

SEQ ID NO: 5777430 - DNA, 21 bp, Homo sapiens
gtacttcccgggccagggctg

SEQ ID NO: 5777431 - DNA, 11 bp, Homo sapiens
gtacttcctct

SEQ ID NO: 5777432 - DNA, 22 bp, Homo sapiens
gtacttcctctaggaaatgtac

SEQ ID NO: 5777433 - DNA, 13 bp, Homo sapiens
gtacttcctctgt

SEQ ID NO: 5777434 - DNA, 18 bp, Homo sapiens
gtacttcctctgtgaact

SEQ ID NO: 5777435 - DNA, 21 bp, Homo sapiens
gtacttcctgagtggccaggg

SEQ ID NO: 5777436 - DNA, 15 bp, Homo sapiens
gtacttcctttctcc

SEQ ID NO: 5777437 - DNA, 13 bp, Homo sapiens
gtacttctaagag

SEQ ID NO: 5777438 - DNA, 18 bp, Homo sapiens
gtacttctccaccctgct

SEQ ID NO: 5777439 - DNA, 19 bp, Homo sapiens
gtacttctgtgttcatttt

SEQ ID NO: 5777440 - DNA, 23 bp, Homo sapiens
gtacttgaagtctaaaagcagaa

SEQ ID NO: 5777441 - DNA, 20 bp, Homo sapiens
gtacttgagaataaatgagc

SEQ ID NO: 5777442 - DNA, 18 bp, Homo sapiens
gtacttgagtgtaatgtt

SEQ ID NO: 5777443 - DNA, 20 bp, Homo sapiens
gtacttgatactgaatgcat

SEQ ID NO: 5777444 - DNA, 23 bp, Homo sapiens
gtacttgatttgatgtgactttt

SEQ ID NO: 5777445 - DNA, 20 bp, Homo sapiens
gtacttgatttttcaaagac

SEQ ID NO: 5777446 - DNA, 23 bp, Homo sapiens
gtacttgccagaagttgtggatt

SEQ ID NO: 5777447 - DNA, 15 bp, Homo sapiens
gtacttgctctctga

SEQ ID NO: 5777448 - DNA, 21 bp, Homo sapiens
gtacttggagtattggggtct

SEQ ID NO: 5777449 - DNA, 21 bp, Homo sapiens
gtacttggcaccaataaagga

SEQ ID NO: 5777450 - DNA, 20 bp, Homo sapiens
gtacttgggtcacatgactc

SEQ ID NO: 5777451 - DNA, 19 bp, Homo sapiens
gtacttggtccaactgcaa

SEQ ID NO: 5777452 - DNA, 15 bp, Homo sapiens
gtagaggtttaaaga

SEQ ID NO: 5777453 - DNA, 14 bp, Homo sapiens
gtagaggttttgtt

SEQ ID NO: 5777454 - DNA, 17 bp, Homo sapiens
gtagagtatattgaaaa

SEQ ID NO: 5777455 - DNA, 14 bp, Homo sapiens
gtagagtcactgac

SEQ ID NO: 5777456 - DNA, 17 bp, Homo sapiens
gtagagtcctaggacat

SEQ ID NO: 5777457 - DNA, 22 bp, Homo sapiens
gtagagtcttacaatcaaatct

SEQ ID NO: 5777458 - DNA, 18 bp, Homo sapiens
gtagagtgacctcggaca

SEQ ID NO: 5777459 - DNA, 15 bp, Homo sapiens
gtagagtgggagctg

SEQ ID NO: 5777460 - DNA, 19 bp, Homo sapiens
gtagagttcctttctggga

SEQ ID NO: 5777461 - DNA, 23 bp, Homo sapiens
gtagagtttttatgcctttctct

SEQ ID NO: 5777462 - DNA, 15 bp, Homo sapiens
gtagataaagcactg

SEQ ID NO: 5777463 - DNA, 15 bp, Homo sapiens
gtagatacaatcagc

SEQ ID NO: 5777464 - DNA, 17 bp, Homo sapiens
gtagatacaatcagctg

SEQ ID NO: 5777465 - DNA, 22 bp, Homo sapiens
gtagatacagatccgcatgtgt

SEQ ID NO: 5777466 - DNA, 20 bp, Homo sapiens
gtagataccgagaatgatcc

SEQ ID NO: 5777467 - DNA, 16 bp, Homo sapiens
gtagatactaaagcaa

SEQ ID NO: 5777468 - DNA, 16 bp, Homo sapiens
gtagatacttcctgcc

SEQ ID NO: 5777469 - DNA, 16 bp, Homo sapiens
gtagatagtatgcact

SEQ ID NO: 5777470 - DNA, 18 bp, Homo sapiens
gtagatatgtattctttt

SEQ ID NO: 5777471 - DNA, 16 bp, Homo sapiens
gtagatattgttttct

SEQ ID NO: 5777472 - DNA, 14 bp, Homo sapiens
gtagatatttgaaa

SEQ ID NO: 5777473 - DNA, 21 bp, Homo sapiens
gtagatatttggcttaaatat

SEQ ID NO: 5777474 - DNA, 19 bp, Homo sapiens
gtagatcaccagaataaac

SEQ ID NO: 5777475 - DNA, 17 bp, Homo sapiens
gtagatcagagcagcag

SEQ ID NO: 5777476 - DNA, 13 bp, Homo sapiens
gtagatcaggttt

SEQ ID NO: 5777477 - DNA, 22 bp, Homo sapiens
gtagatccatttccattgctta

SEQ ID NO: 5777478 - DNA, 17 bp, Homo sapiens
gtagatcctgagaagta

SEQ ID NO: 5777479 - DNA, 17 bp, Homo sapiens
gtagatcgcttgagccc

SEQ ID NO: 5777480 - DNA, 19 bp, Homo sapiens
gtagatctgctttctgttc

SEQ ID NO: 5777481 - DNA, 21 bp, Homo sapiens
gtagatctgctttctgttcat

SEQ ID NO: 5777482 - DNA, 21 bp, Homo sapiens
gtagatgaaaaagcatgtaca

SEQ ID NO: 5777483 - DNA, 14 bp, Homo sapiens
gtagatgagaaaac

SEQ ID NO: 5777484 - DNA, 17 bp, Homo sapiens
gtagatgagccgggtcc

SEQ ID NO: 5777485 - DNA, 14 bp, Homo sapiens
gtagatgcagaaaa

SEQ ID NO: 5777486 - DNA, 14 bp, Homo sapiens
gtagatgctgaggc

SEQ ID NO: 5777487 - DNA, 17 bp, Homo sapiens
gtagatgggagggaggc

SEQ ID NO: 5777488 - DNA, 19 bp, Homo sapiens
gtagatgggggaactgtga

SEQ ID NO: 5777489 - DNA, 12 bp, Homo sapiens
gtagatgggtgg

SEQ ID NO: 5777490 - DNA, 14 bp, Homo sapiens
gtagatgggtgggg

SEQ ID NO: 5777491 - DNA, 17 bp, Homo sapiens
gtagatgggtgggggct

SEQ ID NO: 5777492 - DNA, 23 bp, Homo sapiens
gtagatgggtgggggctcctggt

SEQ ID NO: 5777493 - DNA, 17 bp, Homo sapiens
gtagatggtacgatgca

SEQ ID NO: 5777494 - DNA, 20 bp, Homo sapiens
gtagatgtagcattgttcca

SEQ ID NO: 5777495 - DNA, 17 bp, Homo sapiens
gtagatgtatgcacaca

SEQ ID NO: 5777496 - DNA, 20 bp, Homo sapiens
gtagatgtatgcacacacat

SEQ ID NO: 5777497 - DNA, 13 bp, Homo sapiens
gtagatgttctag

SEQ ID NO: 5777498 - DNA, 22 bp, Homo sapiens
gtagatgttcttttctatttat

SEQ ID NO: 5777499 - DNA, 16 bp, Homo sapiens
gtagattacctgccac

SEQ ID NO: 5777500 - DNA, 20 bp, Homo sapiens
gtagattaggtcttgctgga

SEQ ID NO: 5777501 - DNA, 18 bp, Homo sapiens
gtagattcaggtaataca

SEQ ID NO: 5777502 - DNA, 19 bp, Homo sapiens
gtagattctgtggaacaag

SEQ ID NO: 5777503 - DNA, 13 bp, Homo sapiens
gtagattgatcta

SEQ ID NO: 5777504 - DNA, 16 bp, Homo sapiens
gtagattgcttctgta

SEQ ID NO: 5777505 - DNA, 15 bp, Homo sapiens
gtagatttgaaaatt

SEQ ID NO: 5777506 - DNA, 18 bp, Homo sapiens
gtagatttgaaaattgta

SEQ ID NO: 5777507 - DNA, 15 bp, Homo sapiens
gtagatttgttttgt

SEQ ID NO: 5777508 - DNA, 18 bp, Homo sapiens
gtagattttaaagacaaa

SEQ ID NO: 5777509 - DNA, 14 bp, Homo sapiens
gtagattttaagaa

SEQ ID NO: 5777510 - DNA, 13 bp, Homo sapiens
gtagcaaaacaaa

SEQ ID NO: 5777511 - DNA, 21 bp, Homo sapiens
gtagcaaaccctgtcaaacat

SEQ ID NO: 5777512 - DNA, 20 bp, Homo sapiens
gtagcaaattccaatacatt

SEQ ID NO: 5777513 - DNA, 13 bp, Homo sapiens
gtagcaacaacag

SEQ ID NO: 5777514 - DNA, 17 bp, Homo sapiens
gtagcaaccctgtgata

SEQ ID NO: 5777515 - DNA, 15 bp, Homo sapiens
gtagcaaccttcatt

SEQ ID NO: 5777516 - DNA, 17 bp, Homo sapiens
gtagcaaggaaggacac

SEQ ID NO: 5777517 - DNA, 23 bp, Homo sapiens
gtagcaatatatttgtaggtata

SEQ ID NO: 5777518 - DNA, 16 bp, Homo sapiens
gtagcaatgtgccttg

SEQ ID NO: 5777519 - DNA, 17 bp, Homo sapiens
gtagcaattctacccag

SEQ ID NO: 5777520 - DNA, 16 bp, Homo sapiens
gtagcacaaagaggga

SEQ ID NO: 5777521 - DNA, 19 bp, Homo sapiens
gtagcacagattttgaatc

SEQ ID NO: 5777522 - DNA, 20 bp, Homo sapiens
gtagcacatgtctgtcctca

SEQ ID NO: 5777523 - DNA, 12 bp, Homo sapiens
gtagcacgctgc

SEQ ID NO: 5777524 - DNA, 16 bp, Homo sapiens
gtagcacgctgcctgc

SEQ ID NO: 5777525 - DNA, 20 bp, Homo sapiens
gtagcacggagtgttggggc

SEQ ID NO: 5777526 - DNA, 20 bp, Homo sapiens
gtagcactactaaaagttta

SEQ ID NO: 5777527 - DNA, 21 bp, Homo sapiens
gtagcactactaaaagtttag

SEQ ID NO: 5777528 - DNA, 13 bp, Homo sapiens
gtagcacttactg

SEQ ID NO: 5777529 - DNA, 22 bp, Homo sapiens
gtagcagaaatatattatgaaa

SEQ ID NO: 5777530 - DNA, 18 bp, Homo sapiens
gtagcagacaacacacaa

SEQ ID NO: 5777531 - DNA, 18 bp, Homo sapiens
gtagcagataaagacagc

SEQ ID NO: 5777532 - DNA, 15 bp, Homo sapiens
gtagcagcagaggca

SEQ ID NO: 5777533 - DNA, 18 bp, Homo sapiens
gtagcagctatatatttc

SEQ ID NO: 5777534 - DNA, 20 bp, Homo sapiens
gtagcaggacctgccaagaa

SEQ ID NO: 5777535 - DNA, 13 bp, Homo sapiens
gtagcaggccatg

SEQ ID NO: 5777536 - DNA, 21 bp, Homo sapiens
gtagcagggtctttgtgtgct

SEQ ID NO: 5777537 - DNA, 21 bp, Homo sapiens
gtagcagttacagctctgtag

SEQ ID NO: 5777538 - DNA, 21 bp, Homo sapiens
gtagcataaataaaactgaat

SEQ ID NO: 5777539 - DNA, 13 bp, Homo sapiens
gtagcatacattt

SEQ ID NO: 5777540 - DNA, 16 bp, Homo sapiens
gtagcatataaatgtt

SEQ ID NO: 5777541 - DNA, 16 bp, Homo sapiens
gtagcatcctggaata

SEQ ID NO: 5777542 - DNA, 18 bp, Homo sapiens
gtagcatcttcctctgca

SEQ ID NO: 5777543 - DNA, 20 bp, Homo sapiens
gtagcatgaccttttggcct

SEQ ID NO: 5777544 - DNA, 17 bp, Homo sapiens
gtagcatgcttgttgca

SEQ ID NO: 5777545 - DNA, 16 bp, Homo sapiens
gtagcatggactctgg

SEQ ID NO: 5777546 - DNA, 18 bp, Homo sapiens
gtagcatggactctgggt

SEQ ID NO: 5777547 - DNA, 21 bp, Homo sapiens
gtagcatgttgagccaggcct

SEQ ID NO: 5777548 - DNA, 16 bp, Homo sapiens
gtagcattaaatataa

SEQ ID NO: 5777549 - DNA, 20 bp, Homo sapiens
gtagcattgttccacacatt

SEQ ID NO: 5777550 - DNA, 20 bp, Homo sapiens
gtagcatttaaaatggaaaa

SEQ ID NO: 5777551 - DNA, 13 bp, Homo sapiens
gtagcatttcatt

SEQ ID NO: 5777552 - DNA, 19 bp, Homo sapiens
gtagcatttcattcttctc

SEQ ID NO: 5777553 - DNA, 15 bp, Homo sapiens
gtagcattttcctgt

SEQ ID NO: 5777554 - DNA, 21 bp, Homo sapiens
gtagcattttcctgtttactg

SEQ ID NO: 5777555 - DNA, 18 bp, Homo sapiens
gtagccaaggtgggctga

SEQ ID NO: 5777556 - DNA, 19 bp, Homo sapiens
gtagccaaggtgggctgag

SEQ ID NO: 5777557 - DNA, 18 bp, Homo sapiens
gtagccacaggagccctg

SEQ ID NO: 5777558 - DNA, 20 bp, Homo sapiens
gtagccacaggagccctgct

SEQ ID NO: 5777559 - DNA, 12 bp, Homo sapiens
gtagccactctc

SEQ ID NO: 5777560 - DNA, 22 bp, Homo sapiens
gtagccactggcatagccctcc

SEQ ID NO: 5777561 - DNA, 15 bp, Homo sapiens
gtagccagcacacag

SEQ ID NO: 5777562 - DNA, 19 bp, Homo sapiens
gtagccagcacacagggca

SEQ ID NO: 5777563 - DNA, 21 bp, Homo sapiens
gtagccagcacacagggcagt

SEQ ID NO: 5777564 - DNA, 14 bp, Homo sapiens
gtagccagctgtgc

SEQ ID NO: 5777565 - DNA, 14 bp, Homo sapiens
gtagccaggaagcc

SEQ ID NO: 5777566 - DNA, 22 bp, Homo sapiens
gtagccaggaagccccgctcag

SEQ ID NO: 5777567 - DNA, 19 bp, Homo sapiens
gtagccagggggactagcc

SEQ ID NO: 5777568 - DNA, 23 bp, Homo sapiens
gtagccagggtgtggccctgcca

SEQ ID NO: 5777569 - DNA, 20 bp, Homo sapiens
gtagccaggtccccctgcag

SEQ ID NO: 5777570 - DNA, 22 bp, Homo sapiens
gtagccaggtccccctgcagct

SEQ ID NO: 5777571 - DNA, 18 bp, Homo sapiens
gtagccagttaaggaaag

SEQ ID NO: 5777572 - DNA, 12 bp, Homo sapiens
gtagccatctcc

SEQ ID NO: 5777573 - DNA, 15 bp, Homo sapiens
gtagccatctgcaca

SEQ ID NO: 5777574 - DNA, 23 bp, Homo sapiens
gtagccatgaggaggcagagagg

SEQ ID NO: 5777575 - DNA, 23 bp, Homo sapiens
gtagccatgatttgtcccagcct

SEQ ID NO: 5777576 - DNA, 15 bp, Homo sapiens
gtagccatggctcag

SEQ ID NO: 5777577 - DNA, 18 bp, Homo sapiens
gtagccatggctcaggca

SEQ ID NO: 5777578 - DNA, 20 bp, Homo sapiens
gtagccatggctcaggcaag

SEQ ID NO: 5777579 - DNA, 20 bp, Homo sapiens
gtagccatgttaacatgaca

SEQ ID NO: 5777580 - DNA, 16 bp, Homo sapiens
gtagcccactctgctc

SEQ ID NO: 5777581 - DNA, 14 bp, Homo sapiens
gtagcccagcactg

SEQ ID NO: 5777582 - DNA, 15 bp, Homo sapiens
gtagcccagcactgt

SEQ ID NO: 5777583 - DNA, 17 bp, Homo sapiens
gtagcccagcactgtga

SEQ ID NO: 5777584 - DNA, 15 bp, Homo sapiens
gtagcccaggctgga

SEQ ID NO: 5777585 - DNA, 21 bp, Homo sapiens
gtagccccaagaaggctgggg

SEQ ID NO: 5777586 - DNA, 16 bp, Homo sapiens
gtagccccctcatctg

SEQ ID NO: 5777587 - DNA, 17 bp, Homo sapiens
gtagccccgccccagcc

SEQ ID NO: 5777588 - DNA, 19 bp, Homo sapiens
gtagccccgccccagccct

SEQ ID NO: 5777589 - DNA, 16 bp, Homo sapiens
gtagcccgcctgccag

SEQ ID NO: 5777590 - DNA, 17 bp, Homo sapiens
gtagcccgcctgccagt

SEQ ID NO: 5777591 - DNA, 20 bp, Homo sapiens
gtagcccgcctgccagtcct

SEQ ID NO: 5777592 - DNA, 17 bp, Homo sapiens
gtagccctcccactttg

SEQ ID NO: 5777593 - DNA, 20 bp, Homo sapiens
gtagccctggatggcctctg

SEQ ID NO: 5777594 - DNA, 21 bp, Homo sapiens
gtagccctggatggcctctgg

SEQ ID NO: 5777595 - DNA, 11 bp, Homo sapiens
gtagccctggc

SEQ ID NO: 5777596 - DNA, 12 bp, Homo sapiens
gtagccctggcc

SEQ ID NO: 5777597 - DNA, 14 bp, Homo sapiens
gtagccctggcccg

SEQ ID NO: 5777598 - DNA, 14 bp, Homo sapiens
gtagccctgggttt

SEQ ID NO: 5777599 - DNA, 19 bp, Homo sapiens
gtagccgagagcctgctcc

SEQ ID NO: 5777600 - DNA, 23 bp, Homo sapiens
gtagcctaaaacgaatggtcttt

SEQ ID NO: 5777601 - DNA, 14 bp, Homo sapiens
gtagcctaaagggc

SEQ ID NO: 5777602 - DNA, 18 bp, Homo sapiens
gtagcctaaatctccagt

SEQ ID NO: 5777603 - DNA, 20 bp, Homo sapiens
gtagcctaatattcatgctg

SEQ ID NO: 5777604 - DNA, 19 bp, Homo sapiens
gtagcctccgtttatgggc

SEQ ID NO: 5777605 - DNA, 20 bp, Homo sapiens
gtagcctccgtttatgggcc

SEQ ID NO: 5777606 - DNA, 15 bp, Homo sapiens
gtagcctctctttgt

SEQ ID NO: 5777607 - DNA, 20 bp, Homo sapiens
gtagcctgcgtcatggctca

SEQ ID NO: 5777608 - DNA, 22 bp, Homo sapiens
gtagcctggcttttctggctgg

SEQ ID NO: 5777609 - DNA, 12 bp, Homo sapiens
gtagcctggtct

SEQ ID NO: 5777610 - DNA, 16 bp, Homo sapiens
gtagcctggtctgtgc

SEQ ID NO: 5777611 - DNA, 12 bp, Homo sapiens
gtagcctgtgca

SEQ ID NO: 5777612 - DNA, 15 bp, Homo sapiens
gtagccttattcacc

SEQ ID NO: 5777613 - DNA, 23 bp, Homo sapiens
gtagccttgcccggattctggga

SEQ ID NO: 5777614 - DNA, 22 bp, Homo sapiens
gtagccttgccttttaaaagaa

SEQ ID NO: 5777615 - DNA, 23 bp, Homo sapiens
gtagccttgccttttaaaagaaa

SEQ ID NO: 5777616 - DNA, 16 bp, Homo sapiens
gtagccttttgacttt

SEQ ID NO: 5777617 - DNA, 18 bp, Homo sapiens
gtagcctttttgtataaa

SEQ ID NO: 5777618 - DNA, 15 bp, Homo sapiens
gtagcgaccccagac

SEQ ID NO: 5777619 - DNA, 15 bp, Homo sapiens
gtagcgagctgctct

SEQ ID NO: 5777620 - DNA, 18 bp, Homo sapiens
gtagcggatgattcttca

SEQ ID NO: 5777621 - DNA, 13 bp, Homo sapiens
gtagctacagaga

SEQ ID NO: 5777622 - DNA, 14 bp, Homo sapiens
gtagctacagagaa

SEQ ID NO: 5777623 - DNA, 22 bp, Homo sapiens
gtagctacctacatgctgaaaa

SEQ ID NO: 5777624 - DNA, 21 bp, Homo sapiens
gtagctagaatatcctatact

SEQ ID NO: 5777625 - DNA, 14 bp, Homo sapiens
gtagctagaggaac

SEQ ID NO: 5777626 - DNA, 21 bp, Homo sapiens
gtagctagtagcaatgtgcct

SEQ ID NO: 5777627 - DNA, 20 bp, Homo sapiens
gtagctagtttaaaattatt

SEQ ID NO: 5777628 - DNA, 21 bp, Homo sapiens
gtagctatagttgcagcccaa

SEQ ID NO: 5777629 - DNA, 21 bp, Homo sapiens
gtagggtttagccgggcccca

SEQ ID NO: 5777630 - DNA, 22 bp, Homo sapiens
gtaggtaaaatgtatttttcta

SEQ ID NO: 5777631 - DNA, 13 bp, Homo sapiens
gtaggtaagactg

SEQ ID NO: 5777632 - DNA, 15 bp, Homo sapiens
gtaggtaattccccc

SEQ ID NO: 5777633 - DNA, 18 bp, Homo sapiens
gtaggtatacaaaagact

SEQ ID NO: 5777634 - DNA, 18 bp, Homo sapiens
gtaggtatactatgtaag

SEQ ID NO: 5777635 - DNA, 23 bp, Homo sapiens
gtaggtatcattttctgcattta

SEQ ID NO: 5777636 - DNA, 19 bp, Homo sapiens
gtaggtatgtctgtgccat

SEQ ID NO: 5777637 - DNA, 15 bp, Homo sapiens
gtaggtattaaagat

SEQ ID NO: 5777638 - DNA, 15 bp, Homo sapiens
gtaggtccaagggcc

SEQ ID NO: 5777639 - DNA, 16 bp, Homo sapiens
gtaggtccaagggcca

SEQ ID NO: 5777640 - DNA, 19 bp, Homo sapiens
gtaggtcccggccagctct

SEQ ID NO: 5777641 - DNA, 20 bp, Homo sapiens
gtaggtcccggccagctctg

SEQ ID NO: 5777642 - DNA, 22 bp, Homo sapiens
gtaggtcccggccagctctgga

SEQ ID NO: 5777643 - DNA, 15 bp, Homo sapiens
gtaggtctgcacaca

SEQ ID NO: 5777644 - DNA, 16 bp, Homo sapiens
gtaggtctgggatgga

SEQ ID NO: 5777645 - DNA, 13 bp, Homo sapiens
gtaggtgaacagt

SEQ ID NO: 5777646 - DNA, 18 bp, Homo sapiens
gtaggtgagcctgggcag

SEQ ID NO: 5777647 - DNA, 18 bp, Homo sapiens
gtaggtgatgggggacga

SEQ ID NO: 5777648 - DNA, 15 bp, Homo sapiens
gtaggtgatttgaag

SEQ ID NO: 5777649 - DNA, 23 bp, Homo sapiens
gtaggtggaagctagacacatga

SEQ ID NO: 5777650 - DNA, 18 bp, Homo sapiens
gtaggtggcttgagctag

SEQ ID NO: 5777651 - DNA, 22 bp, Homo sapiens
gtaggtgtctctgggcctgtgt

SEQ ID NO: 5777652 - DNA, 16 bp, Homo sapiens
gtaggtgttgaaaatg

SEQ ID NO: 5777653 - DNA, 21 bp, Homo sapiens
gtaggttattatgattagctt

SEQ ID NO: 5777654 - DNA, 21 bp, Homo sapiens
gtaggttccgtatctccctgg

SEQ ID NO: 5777655 - DNA, 15 bp, Homo sapiens
gtaggttgaggacag

SEQ ID NO: 5777656 - DNA, 13 bp, Homo sapiens
gtaggttgcacac

SEQ ID NO: 5777657 - DNA, 15 bp, Homo sapiens
gtaggttgtctaaaa

SEQ ID NO: 5777658 - DNA, 23 bp, Homo sapiens
gtagtaaaagtggtctctgctgg

SEQ ID NO: 5777659 - DNA, 23 bp, Homo sapiens
gtagtaaaattagaaaaaaacaa

SEQ ID NO: 5777660 - DNA, 15 bp, Homo sapiens
gtagtaaataatgct

SEQ ID NO: 5777661 - DNA, 17 bp, Homo sapiens
gtagtaacacataaagt

SEQ ID NO: 5777662 - DNA, 20 bp, Homo sapiens
gtagtaacacataaagtaaa

SEQ ID NO: 5777663 - DNA, 13 bp, Homo sapiens
gtagtaacactaa

SEQ ID NO: 5777664 - DNA, 21 bp, Homo sapiens
gtagtaataaaaagtaacaca

SEQ ID NO: 5777665 - DNA, 14 bp, Homo sapiens
gtagtaattgttac

SEQ ID NO: 5777666 - DNA, 14 bp, Homo sapiens
gtagtaatttattg

SEQ ID NO: 5777667 - DNA, 19 bp, Homo sapiens
gtagtaatttattgtctgt

SEQ ID NO: 5777668 - DNA, 16 bp, Homo sapiens
gtagtaccaaaataaa

SEQ ID NO: 5777669 - DNA, 17 bp, Homo sapiens
gtagtagttctgtgttg

SEQ ID NO: 5777670 - DNA, 23 bp, Homo sapiens
gtagtagttgatgaccaatctct

SEQ ID NO: 5777671 - DNA, 21 bp, Homo sapiens
gtagtataatgtatgaatttt

SEQ ID NO: 5777672 - DNA, 21 bp, Homo sapiens
gtagtatggcctgacagctct

SEQ ID NO: 5777673 - DNA, 12 bp, Homo sapiens
gtagtatgttat

SEQ ID NO: 5777674 - DNA, 15 bp, Homo sapiens
gtagtattttttgta

SEQ ID NO: 5777675 - DNA, 16 bp, Homo sapiens
gtagtcacctctgggc

SEQ ID NO: 5777676 - DNA, 22 bp, Homo sapiens
gtagtcagaactataacattca

SEQ ID NO: 5777677 - DNA, 18 bp, Homo sapiens
gtagtcagactgacacta

SEQ ID NO: 5777678 - DNA, 16 bp, Homo sapiens
gtagtcatgctgtgca

SEQ ID NO: 5777679 - DNA, 12 bp, Homo sapiens
gtagtccccaac

SEQ ID NO: 5777680 - DNA, 21 bp, Homo sapiens
gtagtcccggaggccttccct

SEQ ID NO: 5777681 - DNA, 16 bp, Homo sapiens
gtagtccgtgctgaca

SEQ ID NO: 5777682 - DNA, 23 bp, Homo sapiens
gtagtccgtgctgacagctgctc

SEQ ID NO: 5777683 - DNA, 16 bp, Homo sapiens
gtagtcctcccaagct

SEQ ID NO: 5777684 - DNA, 19 bp, Homo sapiens
gtagtcctcccaagctgtg

SEQ ID NO: 5777685 - DNA, 20 bp, Homo sapiens
gtagtcctcccaagctgtgc

SEQ ID NO: 5777686 - DNA, 22 bp, Homo sapiens
gtagtcctttctgccttggcct

SEQ ID NO: 5777687 - DNA, 15 bp, Homo sapiens
gtagtcggagccccc

SEQ ID NO: 5777688 - DNA, 14 bp, Homo sapiens
gtagtcggcacagc

SEQ ID NO: 5777689 - DNA, 14 bp, Homo sapiens
gtagtctaaccaaa

SEQ ID NO: 5777690 - DNA, 15 bp, Homo sapiens
gtagtctaaccaaat

SEQ ID NO: 5777691 - DNA, 18 bp, Homo sapiens
gtagtctaaccaaatgca

SEQ ID NO: 5777692 - DNA, 20 bp, Homo sapiens
gtagtctcactgcttgaact

SEQ ID NO: 5777693 - DNA, 12 bp, Homo sapiens
gtagtctcagtt

SEQ ID NO: 5777694 - DNA, 12 bp, Homo sapiens
gtagtctcctgg

SEQ ID NO: 5777695 - DNA, 13 bp, Homo sapiens
gtagtctgctcac

SEQ ID NO: 5777696 - DNA, 16 bp, Homo sapiens
gtagtcttgatgacca

SEQ ID NO: 5777697 - DNA, 19 bp, Homo sapiens
gtagtctttttataggttt

SEQ ID NO: 5777698 - DNA, 21 bp, Homo sapiens
gtagtctttttataggtttta

SEQ ID NO: 5777699 - DNA, 19 bp, Homo sapiens
gtagtgaagactccagaaa

SEQ ID NO: 5777700 - DNA, 14 bp, Homo sapiens
gtagtgagaagaat

SEQ ID NO: 5777701 - DNA, 15 bp, Homo sapiens
gtagtgagaagaata

SEQ ID NO: 5777702 - DNA, 13 bp, Homo sapiens
gtagtgagccttg

SEQ ID NO: 5777703 - DNA, 12 bp, Homo sapiens
gtagtgagcgag

SEQ ID NO: 5777704 - DNA, 13 bp, Homo sapiens
gtagtgatgaaat

SEQ ID NO: 5777705 - DNA, 14 bp, Homo sapiens
gtagtgcaaaatgg

SEQ ID NO: 5777706 - DNA, 18 bp, Homo sapiens
gtagtgcatttttaaact

SEQ ID NO: 5777707 - DNA, 19 bp, Homo sapiens
gtagtgcatttttaaactt

SEQ ID NO: 5777708 - DNA, 19 bp, Homo sapiens
gtagtgccatggccaggag

SEQ ID NO: 5777709 - DNA, 14 bp, Homo sapiens
gtagtgccccacct

SEQ ID NO: 5777710 - DNA, 21 bp, Homo sapiens
gtagtgcccctcccatggccc

SEQ ID NO: 5777711 - DNA, 13 bp, Homo sapiens
gtagtgctttgag

SEQ ID NO: 5777712 - DNA, 14 bp, Homo sapiens
gtagtgcttttaaa

SEQ ID NO: 5777713 - DNA, 13 bp, Homo sapiens
gtagtggaagagc

SEQ ID NO: 5777714 - DNA, 14 bp, Homo sapiens
gtagtggaagagca

SEQ ID NO: 5777715 - DNA, 19 bp, Homo sapiens
gtagtggaagagcagcctg

SEQ ID NO: 5777716 - DNA, 13 bp, Homo sapiens
gtagtggccactg

SEQ ID NO: 5777717 - DNA, 15 bp, Homo sapiens
gtagtggccactggg

SEQ ID NO: 5777718 - DNA, 18 bp, Homo sapiens
gtagtggccccctcctcc

SEQ ID NO: 5777719 - DNA, 18 bp, Homo sapiens
gtagtggggaagagggtt

SEQ ID NO: 5777720 - DNA, 19 bp, Homo sapiens
gtagtgtaagctagaagaa

SEQ ID NO: 5777721 - DNA, 15 bp, Homo sapiens
gtagtgtcagtacta

SEQ ID NO: 5777722 - DNA, 14 bp, Homo sapiens
gtagtgttggagaa

SEQ ID NO: 5777723 - DNA, 13 bp, Homo sapiens
gtagtgttgggtg

SEQ ID NO: 5777724 - DNA, 18 bp, Homo sapiens
gtagtgttgggtggagga

SEQ ID NO: 5777725 - DNA, 19 bp, Homo sapiens
gtagtgttgggtggaggat

SEQ ID NO: 5777726 - DNA, 19 bp, Homo sapiens
gtagtgttgtccaggaagt

SEQ ID NO: 5777727 - DNA, 17 bp, Homo sapiens
gtagttaaatagctata

SEQ ID NO: 5777728 - DNA, 11 bp, Homo sapiens
gtagttaggaa

SEQ ID NO: 5777729 - DNA, 13 bp, Homo sapiens
gtagttaggaaat

SEQ ID NO: 5777730 - DNA, 14 bp, Homo sapiens
gtagttaggaaata

SEQ ID NO: 5777731 - DNA, 13 bp, Homo sapiens
gtagttagtagca

SEQ ID NO: 5777732 - DNA, 21 bp, Homo sapiens
gtagttataaaccaatgaaat

SEQ ID NO: 5777733 - DNA, 13 bp, Homo sapiens
gtagttatcatgt

SEQ ID NO: 5777734 - DNA, 15 bp, Homo sapiens
gtagttcatgtaaat

SEQ ID NO: 5777735 - DNA, 15 bp, Homo sapiens
gtagttccctctgcc

SEQ ID NO: 5777736 - DNA, 16 bp, Homo sapiens
gtagttccctctgcct

SEQ ID NO: 5777737 - DNA, 19 bp, Homo sapiens
gtagttccctctgcctggg

SEQ ID NO: 5777738 - DNA, 23 bp, Homo sapiens
gtagttccctgaaaacccagaga

SEQ ID NO: 5777739 - DNA, 13 bp, Homo sapiens
gtagttctaagac

SEQ ID NO: 5777740 - DNA, 15 bp, Homo sapiens
gtagttctctcattt

SEQ ID NO: 5777741 - DNA, 20 bp, Homo sapiens
gtagttctgctccagacagg

SEQ ID NO: 5777742 - DNA, 16 bp, Homo sapiens
gtagttctgtgcctcc

SEQ ID NO: 5777743 - DNA, 19 bp, Homo sapiens
gtagttctttgttcctgct

SEQ ID NO: 5777744 - DNA, 20 bp, Homo sapiens
gtagttgagacgctgttgca

SEQ ID NO: 5777745 - DNA, 22 bp, Homo sapiens
gtagttgagacgctgttgcaaa

SEQ ID NO: 5777746 - DNA, 20 bp, Homo sapiens
gtagttgaggaaagcacaga

SEQ ID NO: 5777747 - DNA, 21 bp, Homo sapiens
gtagttgagttggaacaacat

SEQ ID NO: 5777748 - DNA, 23 bp, Homo sapiens
gtagttgcataagcattgctcaa

SEQ ID NO: 5777749 - DNA, 20 bp, Homo sapiens
gtagttgctttgcggcatct

SEQ ID NO: 5777750 - DNA, 21 bp, Homo sapiens
gtagttggcaggagctcctgg

SEQ ID NO: 5777751 - DNA, 18 bp, Homo sapiens
gtagttgggattacaggt

SEQ ID NO: 5777752 - DNA, 20 bp, Homo sapiens
gtagttgtattcttctgtat

SEQ ID NO: 5777753 - DNA, 20 bp, Homo sapiens
gtagttgttggtctgtagca

SEQ ID NO: 5777754 - DNA, 22 bp, Homo sapiens
gtagtttgaaagttgtacatga

SEQ ID NO: 5777755 - DNA, 15 bp, Homo sapiens
gtagtttgcccagag

SEQ ID NO: 5777756 - DNA, 19 bp, Homo sapiens
gtagtttgcccagagttgg

SEQ ID NO: 5777757 - DNA, 18 bp, Homo sapiens
gtagtttggatatttttg

SEQ ID NO: 5777758 - DNA, 19 bp, Homo sapiens
gtagtttggatatttttgt

SEQ ID NO: 5777759 - DNA, 23 bp, Homo sapiens
gtagttttaattcaacatcaaaa

SEQ ID NO: 5777760 - DNA, 21 bp, Homo sapiens
gtagttttatcacatgtatgt

SEQ ID NO: 5777761 - DNA, 20 bp, Homo sapiens
gtagttttattttatgttta

SEQ ID NO: 5777762 - DNA, 20 bp, Homo sapiens
gtagttttccctgcactgtg

SEQ ID NO: 5777763 - DNA, 13 bp, Homo sapiens
gtagttttccttt

SEQ ID NO: 5777764 - DNA, 20 bp, Homo sapiens
gtagttttgtgatgcatttt

SEQ ID NO: 5777765 - DNA, 22 bp, Homo sapiens
gtagtttttacagctgtgttat

SEQ ID NO: 5777766 - DNA, 19 bp, Homo sapiens
gtagtttttcagctagttt

SEQ ID NO: 5777767 - DNA, 21 bp, Homo sapiens
gtagtttttctgtaacacaga

SEQ ID NO: 5777768 - DNA, 21 bp, Homo sapiens
gtagtttttgttcaccttctg

SEQ ID NO: 5777769 - DNA, 13 bp, Homo sapiens
gtagttttttcat

SEQ ID NO: 5777770 - DNA, 14 bp, Homo sapiens
gtagttttttcatc

SEQ ID NO: 5777771 - DNA, 15 bp, Homo sapiens
gtagttttttcatct

SEQ ID NO: 5777772 - DNA, 23 bp, Homo sapiens
gtagttttttttttttttatgtg

SEQ ID NO: 5777773 - DNA, 17 bp, Homo sapiens
gtataaaaaagaaaact

SEQ ID NO: 5777774 - DNA, 17 bp, Homo sapiens
gtataaaaaattctcat

SEQ ID NO: 5777775 - DNA, 12 bp, Homo sapiens
gtataaaaagga

SEQ ID NO: 5777776 - DNA, 21 bp, Homo sapiens
gtataaaaaggaaattagtct

SEQ ID NO: 5777777 - DNA, 23 bp, Homo sapiens
gtataaaaataaaaaagatccca

SEQ ID NO: 5777778 - DNA, 14 bp, Homo sapiens
gtataaaaatgtaa

SEQ ID NO: 5777779 - DNA, 13 bp, Homo sapiens
gtataaaacagtg

SEQ ID NO: 5777780 - DNA, 19 bp, Homo sapiens
gtataaaacagtgtttcca

SEQ ID NO: 5777781 - DNA, 21 bp, Homo sapiens
gtataaaacagtgtttccagt

SEQ ID NO: 5777782 - DNA, 20 bp, Homo sapiens
gtataaaacttgataaatgg

SEQ ID NO: 5777783 - DNA, 19 bp, Homo sapiens
gtataaaactttcctcgcc

SEQ ID NO: 5777784 - DNA, 12 bp, Homo sapiens
gtataaaagatg

SEQ ID NO: 5777785 - DNA, 18 bp, Homo sapiens
gtataaaagggactgaga

SEQ ID NO: 5777786 - DNA, 19 bp, Homo sapiens
gtataaaagggactgagaa

SEQ ID NO: 5777787 - DNA, 12 bp, Homo sapiens
gtataaaataca

SEQ ID NO: 5777788 - DNA, 22 bp, Homo sapiens
gtataaaatacatagtgaaaat

SEQ ID NO: 5777789 - DNA, 15 bp, Homo sapiens
gtataaaatcagcca

SEQ ID NO: 5777790 - DNA, 17 bp, Homo sapiens
gtataaaatcagccaat

SEQ ID NO: 5777791 - DNA, 13 bp, Homo sapiens
gtataaaatgtaa

SEQ ID NO: 5777792 - DNA, 19 bp, Homo sapiens
gtataaaatgtaacactga

SEQ ID NO: 5777793 - DNA, 18 bp, Homo sapiens
gtataaacaaattagcaa

SEQ ID NO: 5777794 - DNA, 16 bp, Homo sapiens
gtataaacaagaaaaa

SEQ ID NO: 5777795 - DNA, 17 bp, Homo sapiens
gtataaacaagaaaaat

SEQ ID NO: 5777796 - DNA, 15 bp, Homo sapiens
gtataaacaagccta

SEQ ID NO: 5777797 - DNA, 14 bp, Homo sapiens
gtataaacattaaa

SEQ ID NO: 5777798 - DNA, 19 bp, Homo sapiens
gtataaacattaaatgtct

SEQ ID NO: 5777799 - DNA, 13 bp, Homo sapiens
gtataaactatca

SEQ ID NO: 5777800 - DNA, 22 bp, Homo sapiens
gtataaagaataggacttgttt

SEQ ID NO: 5777801 - DNA, 13 bp, Homo sapiens
gtataaagacaag

SEQ ID NO: 5777802 - DNA, 18 bp, Homo sapiens
gtataaagattgtactta

SEQ ID NO: 5777803 - DNA, 18 bp, Homo sapiens
gtataaagcaactgttat

SEQ ID NO: 5777804 - DNA, 16 bp, Homo sapiens
gtataaagctcagaag

SEQ ID NO: 5777805 - DNA, 12 bp, Homo sapiens
gtataaataaga

SEQ ID NO: 5777806 - DNA, 13 bp, Homo sapiens
gtataaataagag

SEQ ID NO: 5777807 - DNA, 14 bp, Homo sapiens
gtatatatatgtga

SEQ ID NO: 5777808 - DNA, 22 bp, Homo sapiens
gtatatatctgcttcagtggag

SEQ ID NO: 5777809 - DNA, 21 bp, Homo sapiens
gtatatatcttataactgttt

SEQ ID NO: 5777810 - DNA, 20 bp, Homo sapiens
gtatatatggatcagaggag

SEQ ID NO: 5777811 - DNA, 12 bp, Homo sapiens
gtatatatgtac

SEQ ID NO: 5777812 - DNA, 13 bp, Homo sapiens
gtatatatgtgta

SEQ ID NO: 5777813 - DNA, 20 bp, Homo sapiens
gtatatatgtgtatatatac

SEQ ID NO: 5777814 - DNA, 19 bp, Homo sapiens
gtatatatgtgtgtttaaa

SEQ ID NO: 5777815 - DNA, 21 bp, Homo sapiens
gtatatattatatatacatta

SEQ ID NO: 5777816 - DNA, 14 bp, Homo sapiens
gtatatattcccaa

SEQ ID NO: 5777817 - DNA, 20 bp, Homo sapiens
gtatatattcccctaagatt

SEQ ID NO: 5777818 - DNA, 14 bp, Homo sapiens
gtatatattctaca

SEQ ID NO: 5777819 - DNA, 16 bp, Homo sapiens
gtatatatttaggatt

SEQ ID NO: 5777820 - DNA, 22 bp, Homo sapiens
gtatatattttatatgttcata

SEQ ID NO: 5777821 - DNA, 18 bp, Homo sapiens
gtatatattttgaaagga

SEQ ID NO: 5777822 - DNA, 21 bp, Homo sapiens
gtatatattttttaaaaatct

SEQ ID NO: 5777823 - DNA, 17 bp, Homo sapiens
gtatatattttttttta

SEQ ID NO: 5777824 - DNA, 16 bp, Homo sapiens
gtatatcagtatctga

SEQ ID NO: 5777825 - DNA, 12 bp, Homo sapiens
gtatatcatgta

SEQ ID NO: 5777826 - DNA, 24 bp, Homo sapiens
gtatatcatgtaaagaaatgtctt

SEQ ID NO: 5777827 - DNA, 17 bp, Homo sapiens
gtatatcattctaaaga

SEQ ID NO: 5777828 - DNA, 19 bp, Homo sapiens
gtatatcattctaaagata

SEQ ID NO: 5777829 - DNA, 16 bp, Homo sapiens
gtatatcattctacag

SEQ ID NO: 5777830 - DNA, 20 bp, Homo sapiens
gtatatcattctacagaata

SEQ ID NO: 5777831 - DNA, 12 bp, Homo sapiens
gtatatcgttat

SEQ ID NO: 5777832 - DNA, 18 bp, Homo sapiens
gtatatcgttatcactgt

SEQ ID NO: 5777833 - DNA, 19 bp, Homo sapiens
gtatatctaggtttatgac

SEQ ID NO: 5777834 - DNA, 20 bp, Homo sapiens
gtatatctaggtttatgaca

SEQ ID NO: 5777835 - DNA, 23 bp, Homo sapiens
gtatatctaggtttatgacagta

SEQ ID NO: 5777836 - DNA, 18 bp, Homo sapiens
gtatatctatatctctaa

SEQ ID NO: 5777837 - DNA, 19 bp, Homo sapiens
gtatatctggccacactgg

SEQ ID NO: 5777838 - DNA, 21 bp, Homo sapiens
gtatatctgggctggccagtt

SEQ ID NO: 5777839 - DNA, 13 bp, Homo sapiens
gtatatctgtgta

SEQ ID NO: 5777840 - DNA, 16 bp, Homo sapiens
gtatatctgtgtaaga

SEQ ID NO: 5777841 - DNA, 14 bp, Homo sapiens
gtatatcttaagaa

SEQ ID NO: 5777842 - DNA, 15 bp, Homo sapiens
gtatatctttgcact

SEQ ID NO: 5777843 - DNA, 19 bp, Homo sapiens
gtatatctttgcactgaag

SEQ ID NO: 5777844 - DNA, 18 bp, Homo sapiens
gtatatgaaatattttga

SEQ ID NO: 5777845 - DNA, 15 bp, Homo sapiens
gtatatgacatttaa

SEQ ID NO: 5777846 - DNA, 20 bp, Homo sapiens
gtatatgaggatgtatgtgt

SEQ ID NO: 5777847 - DNA, 23 bp, Homo sapiens
gtatatgggcttttacctgtgca

SEQ ID NO: 5777848 - DNA, 16 bp, Homo sapiens
gtatatggtatttatt

SEQ ID NO: 5777849 - DNA, 18 bp, Homo sapiens
gtatatggtggtaataag

SEQ ID NO: 5777850 - DNA, 15 bp, Homo sapiens
gtatatgtatatcta

SEQ ID NO: 5777851 - DNA, 20 bp, Homo sapiens
gtatatgtattcccttgtat

SEQ ID NO: 5777852 - DNA, 22 bp, Homo sapiens
gtatatgtattcccttgtattt

SEQ ID NO: 5777853 - DNA, 12 bp, Homo sapiens
gtatatgtcatt

SEQ ID NO: 5777854 - DNA, 16 bp, Homo sapiens
gtatatgtcatttact

SEQ ID NO: 5777855 - DNA, 16 bp, Homo sapiens
gtatatgtcatttatt

SEQ ID NO: 5777856 - DNA, 15 bp, Homo sapiens
gtatatgtctcaggt

SEQ ID NO: 5777857 - DNA, 21 bp, Homo sapiens
gtatatgtctcaggtccctgc

SEQ ID NO: 5777858 - DNA, 18 bp, Homo sapiens
gtatatgtgattttcaaa

SEQ ID NO: 5777859 - DNA, 22 bp, Homo sapiens
gtatatgtgattttcaaatatg

SEQ ID NO: 5777860 - DNA, 18 bp, Homo sapiens
gtatatgtttatacacac

SEQ ID NO: 5777861 - DNA, 19 bp, Homo sapiens
gtatatgtttatacacaca

SEQ ID NO: 5777862 - DNA, 22 bp, Homo sapiens
gtatatgtttatacacacagga

SEQ ID NO: 5777863 - DNA, 12 bp, Homo sapiens
gtatatgtttta

SEQ ID NO: 5777864 - DNA, 14 bp, Homo sapiens
gtatattaaaaatg

SEQ ID NO: 5777865 - DNA, 18 bp, Homo sapiens
gtatattaaaaatggtaa

SEQ ID NO: 5777866 - DNA, 14 bp, Homo sapiens
gtatattaaaatag

SEQ ID NO: 5777867 - DNA, 14 bp, Homo sapiens
gtatattacaatga

SEQ ID NO: 5777868 - DNA, 14 bp, Homo sapiens
gtatattacaccaa

SEQ ID NO: 5777869 - DNA, 13 bp, Homo sapiens
gtatattactgat

SEQ ID NO: 5777870 - DNA, 22 bp, Homo sapiens
gtatattactgatttacaagac

SEQ ID NO: 5777871 - DNA, 19 bp, Homo sapiens
gtatattatataactcttt

SEQ ID NO: 5777872 - DNA, 15 bp, Homo sapiens
gtatattatcctaag

SEQ ID NO: 5777873 - DNA, 19 bp, Homo sapiens
gtatattatggtgtaatgc

SEQ ID NO: 5777874 - DNA, 11 bp, Homo sapiens
gtatattattt

SEQ ID NO: 5777875 - DNA, 15 bp, Homo sapiens
gtatattatttctag

SEQ ID NO: 5777876 - DNA, 15 bp, Homo sapiens
gtatattatttggca

SEQ ID NO: 5777877 - DNA, 15 bp, Homo sapiens
gtatattcatatatt

SEQ ID NO: 5777878 - DNA, 14 bp, Homo sapiens
gtatattcatttca

SEQ ID NO: 5777879 - DNA, 15 bp, Homo sapiens
gtatattccaccatt

SEQ ID NO: 5777880 - DNA, 18 bp, Homo sapiens
gtatattctattttacaa

SEQ ID NO: 5777881 - DNA, 14 bp, Homo sapiens
gtatattctggaaa

SEQ ID NO: 5777882 - DNA, 23 bp, Homo sapiens
gtatattcttattggaaatgtac

SEQ ID NO: 5777883 - DNA, 14 bp, Homo sapiens
gtatattcttgtaa

SEQ ID NO: 5777884 - DNA, 15 bp, Homo sapiens
gtatattcttgtaaa

SEQ ID NO: 5777885 - DNA, 17 bp, Homo sapiens
gtatattgaaaagaaaa

SEQ ID NO: 5777886 - DNA, 22 bp, Homo sapiens
gtatattgatccagaaagaaaa

SEQ ID NO: 5777887 - DNA, 21 bp, Homo sapiens
gtatattgatgtaactgtgtc

SEQ ID NO: 5777888 - DNA, 13 bp, Homo sapiens
gtatattgctaag

SEQ ID NO: 5777889 - DNA, 21 bp, Homo sapiens
gtatattgggtgtagatttct

SEQ ID NO: 5777890 - DNA, 17 bp, Homo sapiens
gtatatttaaaagaaag

SEQ ID NO: 5777891 - DNA, 22 bp, Homo sapiens
gtatatttaaactcaagacaat

SEQ ID NO: 5777892 - DNA, 18 bp, Homo sapiens
gtatatttagttacgtat

SEQ ID NO: 5777893 - DNA, 18 bp, Homo sapiens
gtatatttattcataatg

SEQ ID NO: 5777894 - DNA, 15 bp, Homo sapiens
gtatatttgaaataa

SEQ ID NO: 5777895 - DNA, 20 bp, Homo sapiens
gtatatttgatttattaact

SEQ ID NO: 5777896 - DNA, 23 bp, Homo sapiens
gtatatttgatttattaacttaa

SEQ ID NO: 5777897 - DNA, 12 bp, Homo sapiens
gtatatttgcaa

SEQ ID NO: 5777898 - DNA, 18 bp, Homo sapiens
gtatatttgtaaaagcta

SEQ ID NO: 5777899 - DNA, 15 bp, Homo sapiens
gtatatttgtacaaa

SEQ ID NO: 5777900 - DNA, 15 bp, Homo sapiens
gtatatttgtatgat

SEQ ID NO: 5777901 - DNA, 15 bp, Homo sapiens
gtatatttgtcatga

SEQ ID NO: 5777902 - DNA, 22 bp, Homo sapiens
gtatatttgtcatgacagtgct

SEQ ID NO: 5777903 - DNA, 23 bp, Homo sapiens
gtatatttgtgatagcactttct

SEQ ID NO: 5777904 - DNA, 16 bp, Homo sapiens
gtatatttgtgtatgt

SEQ ID NO: 5777905 - DNA, 17 bp, Homo sapiens
gtatatttgtgtatgtg

SEQ ID NO: 5777906 - DNA, 19 bp, Homo sapiens
gtatatttgtgtatgtgta

SEQ ID NO: 5777907 - DNA, 21 bp, Homo sapiens
gtatatttgttttatgctact

SEQ ID NO: 5777908 - DNA, 16 bp, Homo sapiens
gtatattttatatcaa

SEQ ID NO: 5777909 - DNA, 15 bp, Homo sapiens
gtatattttatttca

SEQ ID NO: 5777910 - DNA, 20 bp, Homo sapiens
gtatattttatttcaatgta

SEQ ID NO: 5777911 - DNA, 14 bp, Homo sapiens
gtatattttctgta

SEQ ID NO: 5777912 - DNA, 17 bp, Homo sapiens
gtatattttctgtattt

SEQ ID NO: 5777913 - DNA, 18 bp, Homo sapiens
gtatattttctgtattta

SEQ ID NO: 5777914 - DNA, 21 bp, Homo sapiens
gtatattttgggaatcttttc

SEQ ID NO: 5777915 - DNA, 15 bp, Homo sapiens
gtatatttttaactg

SEQ ID NO: 5777916 - DNA, 15 bp, Homo sapiens
gtatcaaaggcagaa

SEQ ID NO: 5777917 - DNA, 16 bp, Homo sapiens
gtatcaaaggcagaaa

SEQ ID NO: 5777918 - DNA, 21 bp, Homo sapiens
gtatcaaaggcagaaaggaga

SEQ ID NO: 5777919 - DNA, 15 bp, Homo sapiens
gtatcaaataaaatt

SEQ ID NO: 5777920 - DNA, 20 bp, Homo sapiens
gtatcaaatattagatgtga

SEQ ID NO: 5777921 - DNA, 13 bp, Homo sapiens
gtatcaaatgtaa

SEQ ID NO: 5777922 - DNA, 18 bp, Homo sapiens
gtatcaaattatttttaa

SEQ ID NO: 5777923 - DNA, 19 bp, Homo sapiens
gtatcaacacacattttaa

SEQ ID NO: 5777924 - DNA, 16 bp, Homo sapiens
gtatcaagacgtttaa

SEQ ID NO: 5777925 - DNA, 22 bp, Homo sapiens
gtatcaagacgtttaactgcag

SEQ ID NO: 5777926 - DNA, 18 bp, Homo sapiens
gtatcaagtatagaaaat

SEQ ID NO: 5777927 - DNA, 14 bp, Homo sapiens
gtatcaataaaatt

SEQ ID NO: 5777928 - DNA, 18 bp, Homo sapiens
gtatcaataaaattctgt

SEQ ID NO: 5777929 - DNA, 21 bp, Homo sapiens
gtatcaataaaattctgtaat

SEQ ID NO: 5777930 - DNA, 23 bp, Homo sapiens
gtatcaatacagtttataaagcc

SEQ ID NO: 5777931 - DNA, 23 bp, Homo sapiens
gtatcaatttctaatgtttacta

SEQ ID NO: 5777932 - DNA, 19 bp, Homo sapiens
gtatcacacactttctgac

SEQ ID NO: 5777933 - DNA, 14 bp, Homo sapiens
gtatcacagatgta

SEQ ID NO: 5777934 - DNA, 12 bp, Homo sapiens
gtatcacagtgt

SEQ ID NO: 5777935 - DNA, 22 bp, Homo sapiens
gtatcacattttagtccagaga

SEQ ID NO: 5777936 - DNA, 17 bp, Homo sapiens
gtatcaccctcagctgg

SEQ ID NO: 5777937 - DNA, 16 bp, Homo sapiens
gtatcacctttcccag

SEQ ID NO: 5777938 - DNA, 15 bp, Homo sapiens
gtatcacgatttgca

SEQ ID NO: 5777939 - DNA, 16 bp, Homo sapiens
gtatcacgatttgcag

SEQ ID NO: 5777940 - DNA, 18 bp, Homo sapiens
gtatcactctaaaaaaca

SEQ ID NO: 5777941 - DNA, 17 bp, Homo sapiens
gtatcactgtctttcct

SEQ ID NO: 5777942 - DNA, 20 bp, Homo sapiens
gtatcactttaactcaggag

SEQ ID NO: 5777943 - DNA, 20 bp, Homo sapiens
gtatcagaattgaaacactt

SEQ ID NO: 5777944 - DNA, 21 bp, Homo sapiens
gtatcagagttgcttttctaa

SEQ ID NO: 5777945 - DNA, 14 bp, Homo sapiens
gtatcagatgtgaa

SEQ ID NO: 5777946 - DNA, 12 bp, Homo sapiens
gtatcagcacta

SEQ ID NO: 5777947 - DNA, 16 bp, Homo sapiens
gtatcagccagccttc

SEQ ID NO: 5777948 - DNA, 17 bp, Homo sapiens
gtatcagccagccttcc

SEQ ID NO: 5777949 - DNA, 21 bp, Homo sapiens
gtatcaggaaatatatatgtg

SEQ ID NO: 5777950 - DNA, 17 bp, Homo sapiens
gtatcaggacgagaatg

SEQ ID NO: 5777951 - DNA, 16 bp, Homo sapiens
gtatcaggactgtgac

SEQ ID NO: 5777952 - DNA, 13 bp, Homo sapiens
gtatcaggcacag

SEQ ID NO: 5777953 - DNA, 17 bp, Homo sapiens
gtatcaggcacaggcag

SEQ ID NO: 5777954 - DNA, 22 bp, Homo sapiens
gtatcaggcacaggcaggaaga

SEQ ID NO: 5777955 - DNA, 17 bp, Homo sapiens
gtatcaggtcagggact

SEQ ID NO: 5777956 - DNA, 18 bp, Homo sapiens
gtatcaggtcagggactt

SEQ ID NO: 5777957 - DNA, 15 bp, Homo sapiens
gtatcaggtctccca

SEQ ID NO: 5777958 - DNA, 18 bp, Homo sapiens
gtatcaggtgctgccatc

SEQ ID NO: 5777959 - DNA, 15 bp, Homo sapiens
gtatcagtgttttaa

SEQ ID NO: 5777960 - DNA, 17 bp, Homo sapiens
gtatcagtgttttaaat

SEQ ID NO: 5777961 - DNA, 19 bp, Homo sapiens
gtatcagtgttttaaattc

SEQ ID NO: 5777962 - DNA, 17 bp, Homo sapiens
gtatcagttgcaataat

SEQ ID NO: 5777963 - DNA, 19 bp, Homo sapiens
gtatcataaaaataaaatc

SEQ ID NO: 5777964 - DNA, 21 bp, Homo sapiens
gtatcatacgttgatagttta

SEQ ID NO: 5777965 - DNA, 12 bp, Homo sapiens
gtatcatagaaa

SEQ ID NO: 5777966 - DNA, 19 bp, Homo sapiens
gtatcatatattaaaacaa

SEQ ID NO: 5777967 - DNA, 24 bp, Homo sapiens
gtatcatctggataggagcctgct

SEQ ID NO: 5777968 - DNA, 11 bp, Homo sapiens
gtatcatgcat

SEQ ID NO: 5777969 - DNA, 15 bp, Homo sapiens
gtatcatgtatctct

SEQ ID NO: 5777970 - DNA, 15 bp, Homo sapiens
gtatcattaaaatat

SEQ ID NO: 5777971 - DNA, 14 bp, Homo sapiens
gtatcattaatgta

SEQ ID NO: 5777972 - DNA, 20 bp, Homo sapiens
gtatcattacaattttctgt

SEQ ID NO: 5777973 - DNA, 21 bp, Homo sapiens
gtatcattacaattttctgta

SEQ ID NO: 5777974 - DNA, 19 bp, Homo sapiens
gtatcatttctaattttaa

SEQ ID NO: 5777975 - DNA, 15 bp, Homo sapiens
gtatccaatgaaata

SEQ ID NO: 5777976 - DNA, 14 bp, Homo sapiens
gtatccaatgtctt

SEQ ID NO: 5777977 - DNA, 18 bp, Homo sapiens
gtatccaatgtcttttga

SEQ ID NO: 5777978 - DNA, 12 bp, Homo sapiens
gtatccagagct

SEQ ID NO: 5777979 - DNA, 13 bp, Homo sapiens
gtatccagaggaa

SEQ ID NO: 5777980 - DNA, 23 bp, Homo sapiens
gtatccagaggaattgattgtca

SEQ ID NO: 5777981 - DNA, 17 bp, Homo sapiens
gtatccagtacatttaa

SEQ ID NO: 5777982 - DNA, 16 bp, Homo sapiens
gtatccatgggggcag

SEQ ID NO: 5777983 - DNA, 19 bp, Homo sapiens
gtatccattatcatgtgta

SEQ ID NO: 5777984 - DNA, 20 bp, Homo sapiens
gtatcccaaatctgtcagca

SEQ ID NO: 5777985 - DNA, 16 bp, Homo sapiens
gtatggaagttttcct

SEQ ID NO: 5777986 - DNA, 21 bp, Homo sapiens
gtatggagcagcctggagacc

SEQ ID NO: 5777987 - DNA, 15 bp, Homo sapiens
gtatggagctcagag

SEQ ID NO: 5777988 - DNA, 11 bp, Homo sapiens
gtatggagtta

SEQ ID NO: 5777989 - DNA, 20 bp, Homo sapiens
gtatggattgggggggccaa

SEQ ID NO: 5777990 - DNA, 17 bp, Homo sapiens
gtatggccatgccctag

SEQ ID NO: 5777991 - DNA, 19 bp, Homo sapiens
gtatggcccaggcagcctc

SEQ ID NO: 5777992 - DNA, 18 bp, Homo sapiens
gtatggcgtaagtacaga

SEQ ID NO: 5777993 - DNA, 19 bp, Homo sapiens
gtatggcgtaagtacagag

SEQ ID NO: 5777994 - DNA, 22 bp, Homo sapiens
gtatggcgtaagtacagagaag

SEQ ID NO: 5777995 - DNA, 24 bp, Homo sapiens
gtatggcgtaagtacagagaagcc

SEQ ID NO: 5777996 - DNA, 14 bp, Homo sapiens
gtatggctctgcac

SEQ ID NO: 5777997 - DNA, 14 bp, Homo sapiens
gtatgggaagccat

SEQ ID NO: 5777998 - DNA, 15 bp, Homo sapiens
gtatgggagagaaga

SEQ ID NO: 5777999 - DNA, 15 bp, Homo sapiens
gtatgggctgggggc

SEQ ID NO: 5778000 - DNA, 15 bp, Homo sapiens
gtatgggtgtgtgtt

SEQ ID NO: 5778001 - DNA, 14 bp, Homo sapiens
gtatggtaatcttt

SEQ ID NO: 5778002 - DNA, 14 bp, Homo sapiens
gtatggtcaggatg

SEQ ID NO: 5778003 - DNA, 12 bp, Homo sapiens
gtatggtgacct

SEQ ID NO: 5778004 - DNA, 21 bp, Homo sapiens
gtatggtgctaatattttatt

SEQ ID NO: 5778005 - DNA, 14 bp, Homo sapiens
gtatggtggctggg

SEQ ID NO: 5778006 - DNA, 14 bp, Homo sapiens
gtatgtaaatgtgc

SEQ ID NO: 5778007 - DNA, 15 bp, Homo sapiens
gtatgtaaatgtgca

SEQ ID NO: 5778008 - DNA, 16 bp, Homo sapiens
gtatgtaatatttaca

SEQ ID NO: 5778009 - DNA, 16 bp, Homo sapiens
gtatgtaatggaactt

SEQ ID NO: 5778010 - DNA, 15 bp, Homo sapiens
gtatgtaatttatgc

SEQ ID NO: 5778011 - DNA, 16 bp, Homo sapiens
gtatgtaatttatgca

SEQ ID NO: 5778012 - DNA, 14 bp, Homo sapiens
gtatgtaatttctg

SEQ ID NO: 5778013 - DNA, 16 bp, Homo sapiens
gtatgtaatttctgca

SEQ ID NO: 5778014 - DNA, 23 bp, Homo sapiens
gtatgtacaggctgagacacagc

SEQ ID NO: 5778015 - DNA, 22 bp, Homo sapiens
gtatgtacagttcataaatttg

SEQ ID NO: 5778016 - DNA, 16 bp, Homo sapiens
gtatgtacttccagta

SEQ ID NO: 5778017 - DNA, 14 bp, Homo sapiens
gtatgtatacacac

SEQ ID NO: 5778018 - DNA, 15 bp, Homo sapiens
gtatgtatacacaca

SEQ ID NO: 5778019 - DNA, 17 bp, Homo sapiens
gtatgtatacacacaca

SEQ ID NO: 5778020 - DNA, 17 bp, Homo sapiens
gtatgtatacacacata

SEQ ID NO: 5778021 - DNA, 15 bp, Homo sapiens
gtatgtatataatca

SEQ ID NO: 5778022 - DNA, 18 bp, Homo sapiens
gtatgtatatacacacat

SEQ ID NO: 5778023 - DNA, 17 bp, Homo sapiens
gtatgtatgaaggccac

SEQ ID NO: 5778024 - DNA, 22 bp, Homo sapiens
gtatgtatgccttcgggaaaat

SEQ ID NO: 5778025 - DNA, 15 bp, Homo sapiens
gtatgtattaaactt

SEQ ID NO: 5778026 - DNA, 13 bp, Homo sapiens
gtatgtattagtg

SEQ ID NO: 5778027 - DNA, 11 bp, Homo sapiens
gtatgtatttc

SEQ ID NO: 5778028 - DNA, 22 bp, Homo sapiens
gtatgtcaataaacaacagctg

SEQ ID NO: 5778029 - DNA, 14 bp, Homo sapiens
gtatgtcactattt

SEQ ID NO: 5778030 - DNA, 11 bp, Homo sapiens
gtatgtcactc

SEQ ID NO: 5778031 - DNA, 17 bp, Homo sapiens
gtatgtcagtgctataa

SEQ ID NO: 5778032 - DNA, 20 bp, Homo sapiens
gtatgtcagtggtttctact

SEQ ID NO: 5778033 - DNA, 13 bp, Homo sapiens
gtatgtcagttat

SEQ ID NO: 5778034 - DNA, 14 bp, Homo sapiens
gtatgtcatttcct

SEQ ID NO: 5778035 - DNA, 16 bp, Homo sapiens
gtatgtctatgtgtat

SEQ ID NO: 5778036 - DNA, 23 bp, Homo sapiens
gtatgtctatgtgtatatattat

SEQ ID NO: 5778037 - DNA, 23 bp, Homo sapiens
gtatgtctgtttttgtatcttta

SEQ ID NO: 5778038 - DNA, 18 bp, Homo sapiens
gtatgtgaaagtgtaaaa

SEQ ID NO: 5778039 - DNA, 23 bp, Homo sapiens
gtatgtgaaagtgtaaaatagaa

SEQ ID NO: 5778040 - DNA, 23 bp, Homo sapiens
gtatgtgaacaaatcaaattgct

SEQ ID NO: 5778041 - DNA, 21 bp, Homo sapiens
gtatgtgacaccaaagccacc

SEQ ID NO: 5778042 - DNA, 23 bp, Homo sapiens
gtatgtgacaccaaagccacctc

SEQ ID NO: 5778043 - DNA, 20 bp, Homo sapiens
gtatgtgatatctgaacaca

SEQ ID NO: 5778044 - DNA, 16 bp, Homo sapiens
gtatgtgcacatgtgt

SEQ ID NO: 5778045 - DNA, 16 bp, Homo sapiens
gtatgtgcactgtcac

SEQ ID NO: 5778046 - DNA, 16 bp, Homo sapiens
gtatgtgcatttaatt

SEQ ID NO: 5778047 - DNA, 15 bp, Homo sapiens
gtatgtgccaatttt

SEQ ID NO: 5778048 - DNA, 13 bp, Homo sapiens
gtatgtgccaggc

SEQ ID NO: 5778049 - DNA, 14 bp, Homo sapiens
gtatgtgccaggct

SEQ ID NO: 5778050 - DNA, 11 bp, Homo sapiens
gtatgtgccat

SEQ ID NO: 5778051 - DNA, 17 bp, Homo sapiens
gtatgtgcccctcctgg

SEQ ID NO: 5778052 - DNA, 18 bp, Homo sapiens
gtatgtgcccctcctggg

SEQ ID NO: 5778053 - DNA, 20 bp, Homo sapiens
gtatgtgcgtgtgcgtgttc

SEQ ID NO: 5778054 - DNA, 14 bp, Homo sapiens
gtatgtggaagcag

SEQ ID NO: 5778055 - DNA, 15 bp, Homo sapiens
gtatgtggatacagt

SEQ ID NO: 5778056 - DNA, 16 bp, Homo sapiens
gtatgtgggggcttca

SEQ ID NO: 5778057 - DNA, 16 bp, Homo sapiens
gtatgtggtatgtata

SEQ ID NO: 5778058 - DNA, 15 bp, Homo sapiens
gtatgtgtaataaat

SEQ ID NO: 5778059 - DNA, 23 bp, Homo sapiens
gtatgtgtatatgtttatacaca

SEQ ID NO: 5778060 - DNA, 19 bp, Homo sapiens
gtatgtgtatctcacactc

SEQ ID NO: 5778061 - DNA, 14 bp, Homo sapiens
gtatgtgtatgtac

SEQ ID NO: 5778062 - DNA, 20 bp, Homo sapiens
gtatgtgtatgtacttacat

SEQ ID NO: 5778063 - DNA, 17 bp, Homo sapiens
gtatgtgtatgtgtgtg

SEQ ID NO: 5778064 - DNA, 18 bp, Homo sapiens
gtatgtgtctagcaaagc

SEQ ID NO: 5778065 - DNA, 20 bp, Homo sapiens
gtatgtgtctagcaaagcca

SEQ ID NO: 5778066 - DNA, 13 bp, Homo sapiens
gtatgtgtgaagt

SEQ ID NO: 5778067 - DNA, 21 bp, Homo sapiens
gtatgtgtgaagtgagtgagt

SEQ ID NO: 5778068 - DNA, 11 bp, Homo sapiens
gtatgtgtgac

SEQ ID NO: 5778069 - DNA, 18 bp, Homo sapiens
gtatgtgtgagtgtatgt

SEQ ID NO: 5778070 - DNA, 15 bp, Homo sapiens
gtatgtgtgcttgag

SEQ ID NO: 5778071 - DNA, 13 bp, Homo sapiens
gtatgtgtgggta

SEQ ID NO: 5778072 - DNA, 21 bp, Homo sapiens
gtatgtgtggtttcagttctg

SEQ ID NO: 5778073 - DNA, 13 bp, Homo sapiens
gtatgtgtgtaga

SEQ ID NO: 5778074 - DNA, 15 bp, Homo sapiens
gtatgtgtgtctatt

SEQ ID NO: 5778075 - DNA, 17 bp, Homo sapiens
gtatgtgtgtctatttt

SEQ ID NO: 5778076 - DNA, 13 bp, Homo sapiens
gtatgtgtgtggt

SEQ ID NO: 5778077 - DNA, 12 bp, Homo sapiens
gtatgtgtgtgt

SEQ ID NO: 5778078 - DNA, 19 bp, Homo sapiens
gtatgtgtgtgtgggtgtg

SEQ ID NO: 5778079 - DNA, 18 bp, Homo sapiens
gtatgtgtttagaattga

SEQ ID NO: 5778080 - DNA, 22 bp, Homo sapiens
gtatgtgtttagaattgaaggt

SEQ ID NO: 5778081 - DNA, 17 bp, Homo sapiens
gtatgtgtttgtgtgtg

SEQ ID NO: 5778082 - DNA, 18 bp, Homo sapiens
gtatgttaaagagaatga

SEQ ID NO: 5778083 - DNA, 22 bp, Homo sapiens
gtatgttaaagcatcagagatg

SEQ ID NO: 5778084 - DNA, 18 bp, Homo sapiens
gtatgttaacctaggcag

SEQ ID NO: 5778085 - DNA, 22 bp, Homo sapiens
gtatgttatgatattgtttaaa

SEQ ID NO: 5778086 - DNA, 13 bp, Homo sapiens
gtatgttcctaag

SEQ ID NO: 5778087 - DNA, 22 bp, Homo sapiens
gtatgttcctaaggtcatttct

SEQ ID NO: 5778088 - DNA, 19 bp, Homo sapiens
gtatgttctaacctttaca

SEQ ID NO: 5778089 - DNA, 21 bp, Homo sapiens
gtatgttgactttttaaaatt

SEQ ID NO: 5778090 - DNA, 17 bp, Homo sapiens
gtatgttgaggatctat

SEQ ID NO: 5778091 - DNA, 13 bp, Homo sapiens
gtatgttgtacat

SEQ ID NO: 5778092 - DNA, 16 bp, Homo sapiens
gtatgttgtcaaagag

SEQ ID NO: 5778093 - DNA, 20 bp, Homo sapiens
gtatgtttctctttgattat

SEQ ID NO: 5778094 - DNA, 14 bp, Homo sapiens
gtatgtttgcacac

SEQ ID NO: 5778095 - DNA, 21 bp, Homo sapiens
gtatgtttgcacacttgtgtg

SEQ ID NO: 5778096 - DNA, 14 bp, Homo sapiens
gtatgtttgtaact

SEQ ID NO: 5778097 - DNA, 15 bp, Homo sapiens
gtatgtttgtacttg

SEQ ID NO: 5778098 - DNA, 22 bp, Homo sapiens
gtatgttttaattgcatttaaa

SEQ ID NO: 5778099 - DNA, 20 bp, Homo sapiens
gtatgttttattgtaatcat

SEQ ID NO: 5778100 - DNA, 22 bp, Homo sapiens
gtatgtttttacattatgcaaa

SEQ ID NO: 5778101 - DNA, 23 bp, Homo sapiens
gtatgtttttactgaatgatcta

SEQ ID NO: 5778102 - DNA, 18 bp, Homo sapiens
gtatgtttttcagttcaa

SEQ ID NO: 5778103 - DNA, 16 bp, Homo sapiens
gtatgtttttctgtat

SEQ ID NO: 5778104 - DNA, 22 bp, Homo sapiens
gtatgttttttattatgctgta

SEQ ID NO: 5778105 - DNA, 16 bp, Homo sapiens
gtatgtttttttccaa

SEQ ID NO: 5778106 - DNA, 21 bp, Homo sapiens
gtattaaaaaacaattaactg

SEQ ID NO: 5778107 - DNA, 23 bp, Homo sapiens
gtattaaaaaacaattaactgcc

SEQ ID NO: 5778108 - DNA, 12 bp, Homo sapiens
gtattaaaacat

SEQ ID NO: 5778109 - DNA, 17 bp, Homo sapiens
gtattaaaacattggat

SEQ ID NO: 5778110 - DNA, 20 bp, Homo sapiens
gtattaaaacattggattat

SEQ ID NO: 5778111 - DNA, 11 bp, Homo sapiens
gtattaaaatc

SEQ ID NO: 5778112 - DNA, 22 bp, Homo sapiens
gtattaaaatgcatatttctat

SEQ ID NO: 5778113 - DNA, 14 bp, Homo sapiens
gtattaaaatgtat

SEQ ID NO: 5778114 - DNA, 14 bp, Homo sapiens
gtattaaactgtaa

SEQ ID NO: 5778115 - DNA, 14 bp, Homo sapiens
gtattaaacttgaa

SEQ ID NO: 5778116 - DNA, 17 bp, Homo sapiens
gtattaaacttgtcaga

SEQ ID NO: 5778117 - DNA, 12 bp, Homo sapiens
gtattaaagaaa

SEQ ID NO: 5778118 - DNA, 15 bp, Homo sapiens
gtattaaagaatgct

SEQ ID NO: 5778119 - DNA, 14 bp, Homo sapiens
gtattaaatattta

SEQ ID NO: 5778120 - DNA, 23 bp, Homo sapiens
gtattaaatcttaaacaatgtat

SEQ ID NO: 5778121 - DNA, 14 bp, Homo sapiens
gtattaaatggttt

SEQ ID NO: 5778122 - DNA, 15 bp, Homo sapiens
gtattaaattacatt

SEQ ID NO: 5778123 - DNA, 18 bp, Homo sapiens
gtattaaattacatttgt

SEQ ID NO: 5778124 - DNA, 14 bp, Homo sapiens
gtattaacactaaa

SEQ ID NO: 5778125 - DNA, 14 bp, Homo sapiens
gtattaacatgcaa

SEQ ID NO: 5778126 - DNA, 17 bp, Homo sapiens
gtattaacatgcaataa

SEQ ID NO: 5778127 - DNA, 19 bp, Homo sapiens
gtattaacatgcaataaca

SEQ ID NO: 5778128 - DNA, 21 bp, Homo sapiens
gtattaactctgtaaaagtgt

SEQ ID NO: 5778129 - DNA, 14 bp, Homo sapiens
gtattaagaaagga

SEQ ID NO: 5778130 - DNA, 15 bp, Homo sapiens
gtattaagaaaggaa

SEQ ID NO: 5778131 - DNA, 16 bp, Homo sapiens
gtattaagattataat

SEQ ID NO: 5778132 - DNA, 15 bp, Homo sapiens
gtattaagcatatat

SEQ ID NO: 5778133 - DNA, 18 bp, Homo sapiens
gtattaagccaaacatga

SEQ ID NO: 5778134 - DNA, 19 bp, Homo sapiens
gtattaagcccacagtata

SEQ ID NO: 5778135 - DNA, 23 bp, Homo sapiens
gtattaagctaatggtcctgtta

SEQ ID NO: 5778136 - DNA, 15 bp, Homo sapiens
gtattaagggattta

SEQ ID NO: 5778137 - DNA, 18 bp, Homo sapiens
gtattaagtgcagcttga

SEQ ID NO: 5778138 - DNA, 22 bp, Homo sapiens
gtattaagttgttaataaaagt

SEQ ID NO: 5778139 - DNA, 11 bp, Homo sapiens
gtattaataaa

SEQ ID NO: 5778140 - DNA, 19 bp, Homo sapiens
gtattaataaagcattctt

SEQ ID NO: 5778141 - DNA, 15 bp, Homo sapiens
gtattaataaataga

SEQ ID NO: 5778142 - DNA, 21 bp, Homo sapiens
gtattaataaatagagcaatt

SEQ ID NO: 5778143 - DNA, 16 bp, Homo sapiens
gtattaatactaaaat

SEQ ID NO: 5778144 - DNA, 22 bp, Homo sapiens
gtattaatactaaaatatgtct

SEQ ID NO: 5778145 - DNA, 13 bp, Homo sapiens
gtattaatctgtt

SEQ ID NO: 5778146 - DNA, 22 bp, Homo sapiens
gtattaatggacaaataagttt

SEQ ID NO: 5778147 - DNA, 17 bp, Homo sapiens
gtattaattatttaaag

SEQ ID NO: 5778148 - DNA, 22 bp, Homo sapiens
gtattaatttctgataaagttc

SEQ ID NO: 5778149 - DNA, 18 bp, Homo sapiens
gtattaattttgatataa

SEQ ID NO: 5778150 - DNA, 19 bp, Homo sapiens
gtattacagctttcacagt

SEQ ID NO: 5778151 - DNA, 16 bp, Homo sapiens
gtattacataaaacac

SEQ ID NO: 5778152 - DNA, 12 bp, Homo sapiens
gtattacatttt

SEQ ID NO: 5778153 - DNA, 14 bp, Homo sapiens
gtattaccagcccc

SEQ ID NO: 5778154 - DNA, 23 bp, Homo sapiens
gtattaccatgtaaataatctgt

SEQ ID NO: 5778155 - DNA, 23 bp, Homo sapiens
gtattacccaagaagtaaagatg

SEQ ID NO: 5778156 - DNA, 18 bp, Homo sapiens
gtattactagtggacgta

SEQ ID NO: 5778157 - DNA, 22 bp, Homo sapiens
gtattactgaataatatcaaat

SEQ ID NO: 5778158 - DNA, 13 bp, Homo sapiens
gtattactttaat

SEQ ID NO: 5778159 - DNA, 18 bp, Homo sapiens
gtattactttctgccgct

SEQ ID NO: 5778160 - DNA, 19 bp, Homo sapiens
gtattagagcgccagctcc

SEQ ID NO: 5778161 - DNA, 14 bp, Homo sapiens
gtattagatgttct

SEQ ID NO: 5778162 - DNA, 21 bp, Homo sapiens
gtattagatgttctctatcat

SEQ ID NO: 5778163 - DNA, 22 bp, Homo sapiens
gtattagatgttctctatcatt

SEQ ID NO: 5778164 - DNA, 21 bp, Homo sapiens
gtatttatgtaatttgtacag

SEQ ID NO: 5778165 - DNA, 18 bp, Homo sapiens
gtatttattaatttgaaa

SEQ ID NO: 5778166 - DNA, 14 bp, Homo sapiens
gtatttattcaata

SEQ ID NO: 5778167 - DNA, 21 bp, Homo sapiens
gtatttattccatattcatgt

SEQ ID NO: 5778168 - DNA, 23 bp, Homo sapiens
gtatttattccatattcatgtaa

SEQ ID NO: 5778169 - DNA, 13 bp, Homo sapiens
gtatttattccca

SEQ ID NO: 5778170 - DNA, 20 bp, Homo sapiens
gtatttattctctatttatt

SEQ ID NO: 5778171 - DNA, 19 bp, Homo sapiens
gtatttattgttcccacaa

SEQ ID NO: 5778172 - DNA, 19 bp, Homo sapiens
gtatttatttaaaactctg

SEQ ID NO: 5778173 - DNA, 19 bp, Homo sapiens
gtatttattttcctcccca

SEQ ID NO: 5778174 - DNA, 20 bp, Homo sapiens
gtatttattttcctccccag

SEQ ID NO: 5778175 - DNA, 22 bp, Homo sapiens
gtatttattttcctccccagca

SEQ ID NO: 5778176 - DNA, 23 bp, Homo sapiens
gtatttattttcctccccagcag

SEQ ID NO: 5778177 - DNA, 12 bp, Homo sapiens
gtatttattttg

SEQ ID NO: 5778178 - DNA, 16 bp, Homo sapiens
gtatttattttgtaat

SEQ ID NO: 5778179 - DNA, 17 bp, Homo sapiens
gtatttattttttcaaa

SEQ ID NO: 5778180 - DNA, 17 bp, Homo sapiens
gtatttcaactgctgta

SEQ ID NO: 5778181 - DNA, 16 bp, Homo sapiens
gtatttcagatgcttt

SEQ ID NO: 5778182 - DNA, 14 bp, Homo sapiens
gtatttcagggacc

SEQ ID NO: 5778183 - DNA, 13 bp, Homo sapiens
gtatttcagtgta

SEQ ID NO: 5778184 - DNA, 14 bp, Homo sapiens
gtatttcagtgttt

SEQ ID NO: 5778185 - DNA, 12 bp, Homo sapiens
gtatttcattgc

SEQ ID NO: 5778186 - DNA, 16 bp, Homo sapiens
gtatttccagtgcaat

SEQ ID NO: 5778187 - DNA, 12 bp, Homo sapiens
gtatttcccctg

SEQ ID NO: 5778188 - DNA, 17 bp, Homo sapiens
gtatttcccttccaaag

SEQ ID NO: 5778189 - DNA, 12 bp, Homo sapiens
gtatttcctgct

SEQ ID NO: 5778190 - DNA, 15 bp, Homo sapiens
gtatttccttccact

SEQ ID NO: 5778191 - DNA, 20 bp, Homo sapiens
gtatttccttccactgtagc

SEQ ID NO: 5778192 - DNA, 21 bp, Homo sapiens
gtatttccttccactgtagct

SEQ ID NO: 5778193 - DNA, 17 bp, Homo sapiens
gtatttcgaaactgcca

SEQ ID NO: 5778194 - DNA, 16 bp, Homo sapiens
gtatttcggctatgtc

SEQ ID NO: 5778195 - DNA, 11 bp, Homo sapiens
gtatttctcag

SEQ ID NO: 5778196 - DNA, 14 bp, Homo sapiens
gtatttctcaggaa

SEQ ID NO: 5778197 - DNA, 12 bp, Homo sapiens
gtatttctcata

SEQ ID NO: 5778198 - DNA, 17 bp, Homo sapiens
gtatttctcctttgcaa

SEQ ID NO: 5778199 - DNA, 22 bp, Homo sapiens
gtatttctctattttcataatc

SEQ ID NO: 5778200 - DNA, 17 bp, Homo sapiens
gtatttctctgtgaatc

SEQ ID NO: 5778201 - DNA, 12 bp, Homo sapiens
gtatttctgccc

SEQ ID NO: 5778202 - DNA, 18 bp, Homo sapiens
gtatttctgttccttttt

SEQ ID NO: 5778203 - DNA, 16 bp, Homo sapiens
gtatttcttaagaatt

SEQ ID NO: 5778204 - DNA, 22 bp, Homo sapiens
gtatttcttccagtgatgttga

SEQ ID NO: 5778205 - DNA, 14 bp, Homo sapiens
gtatttctttctcg

SEQ ID NO: 5778206 - DNA, 17 bp, Homo sapiens
gtatttcttttatatat

SEQ ID NO: 5778207 - DNA, 23 bp, Homo sapiens
gtatttcttttatatataaaata

SEQ ID NO: 5778208 - DNA, 16 bp, Homo sapiens
gtatttgaaaacagaa

SEQ ID NO: 5778209 - DNA, 17 bp, Homo sapiens
gtatttgaaagtgcctt

SEQ ID NO: 5778210 - DNA, 15 bp, Homo sapiens
gtatttgaatcagcc

SEQ ID NO: 5778211 - DNA, 14 bp, Homo sapiens
gtatttgaattaaa

SEQ ID NO: 5778212 - DNA, 15 bp, Homo sapiens
gtatttgagacattc

SEQ ID NO: 5778213 - DNA, 14 bp, Homo sapiens
gtatttgagagact

SEQ ID NO: 5778214 - DNA, 19 bp, Homo sapiens
gtatttgagagttctaaat

SEQ ID NO: 5778215 - DNA, 19 bp, Homo sapiens
gtatttgattcaaaatatt

SEQ ID NO: 5778216 - DNA, 22 bp, Homo sapiens
gtatttgcttttttgttttggc

SEQ ID NO: 5778217 - DNA, 15 bp, Homo sapiens
gtatttggaaaaaga

SEQ ID NO: 5778218 - DNA, 21 bp, Homo sapiens
gtatttggaaaatgttatgtg

SEQ ID NO: 5778219 - DNA, 16 bp, Homo sapiens
gtatttggatatctgt

SEQ ID NO: 5778220 - DNA, 20 bp, Homo sapiens
gtatttggtaacttgctgtg

SEQ ID NO: 5778221 - DNA, 22 bp, Homo sapiens
gtatttggtatatactttgcca

SEQ ID NO: 5778222 - DNA, 12 bp, Homo sapiens
gtatttgtatta

SEQ ID NO: 5778223 - DNA, 13 bp, Homo sapiens
gtatttgtattaa

SEQ ID NO: 5778224 - DNA, 21 bp, Homo sapiens
gtatttgtattaataaagcat

SEQ ID NO: 5778225 - DNA, 21 bp, Homo sapiens
gtatttgtgactaattgtata

SEQ ID NO: 5778226 - DNA, 17 bp, Homo sapiens
gtatttgtgcacatgta

SEQ ID NO: 5778227 - DNA, 11 bp, Homo sapiens
gtatttgtgta

SEQ ID NO: 5778228 - DNA, 13 bp, Homo sapiens
gtatttgttaatt

SEQ ID NO: 5778229 - DNA, 22 bp, Homo sapiens
gtatttgttaatttagaaaact

SEQ ID NO: 5778230 - DNA, 14 bp, Homo sapiens
gtatttgttcatgt

SEQ ID NO: 5778231 - DNA, 16 bp, Homo sapiens
gtatttgttcccaaga

SEQ ID NO: 5778232 - DNA, 13 bp, Homo sapiens
gtatttgtttaat

SEQ ID NO: 5778233 - DNA, 23 bp, Homo sapiens
gtatttgtttgcataggtgatct

SEQ ID NO: 5778234 - DNA, 23 bp, Homo sapiens
gtatttgtttgtagctttcctgg

SEQ ID NO: 5778235 - DNA, 16 bp, Homo sapiens
gtattttaaaagaatg

SEQ ID NO: 5778236 - DNA, 18 bp, Homo sapiens
gtattttaaaagaatgat

SEQ ID NO: 5778237 - DNA, 23 bp, Homo sapiens
gtattttaaaatagcgttcttgt

SEQ ID NO: 5778238 - DNA, 20 bp, Homo sapiens
gtattttaacatagcagctg

SEQ ID NO: 5778239 - DNA, 17 bp, Homo sapiens
gtattttaagaagacat

SEQ ID NO: 5778240 - DNA, 21 bp, Homo sapiens
gtattttaagagaaaactgca

SEQ ID NO: 5778241 - DNA, 17 bp, Homo sapiens
gtattttaagtctacaa

SEQ ID NO: 5778242 - DNA, 15 bp, Homo sapiens
gtattttaatcctgt

SEQ ID NO: 5778243 - DNA, 16 bp, Homo sapiens
gtattttaatcctgta

SEQ ID NO: 5778244 - DNA, 17 bp, Homo sapiens
gtattttactttgtgca

SEQ ID NO: 5778245 - DNA, 15 bp, Homo sapiens
gtattttagatatat

SEQ ID NO: 5778246 - DNA, 19 bp, Homo sapiens
gtattttagtgaacttgaa

SEQ ID NO: 5778247 - DNA, 20 bp, Homo sapiens
gtattttagtgaacttgaaa

SEQ ID NO: 5778248 - DNA, 20 bp, Homo sapiens
gtattttataagcacagaca

SEQ ID NO: 5778249 - DNA, 19 bp, Homo sapiens
gtattttataattctggga

SEQ ID NO: 5778250 - DNA, 13 bp, Homo sapiens
gtattttatgtat

SEQ ID NO: 5778251 - DNA, 10 bp, Homo sapiens
gtattttatt

SEQ ID NO: 5778252 - DNA, 20 bp, Homo sapiens
gtattttattcagtagtttg

SEQ ID NO: 5778253 - DNA, 23 bp, Homo sapiens
gtattttcacaggtttgtttctt

SEQ ID NO: 5778254 - DNA, 13 bp, Homo sapiens
gtattttcatagt

SEQ ID NO: 5778255 - DNA, 12 bp, Homo sapiens
gtattttccacc

SEQ ID NO: 5778256 - DNA, 12 bp, Homo sapiens
gtattttccagc

SEQ ID NO: 5778257 - DNA, 23 bp, Homo sapiens
gtattttccagccttatgtgtta

SEQ ID NO: 5778258 - DNA, 22 bp, Homo sapiens
gtattttcccccttttctgcat

SEQ ID NO: 5778259 - DNA, 16 bp, Homo sapiens
gtattttcctccaaag

SEQ ID NO: 5778260 - DNA, 12 bp, Homo sapiens
gtattttcctgg

SEQ ID NO: 5778261 - DNA, 18 bp, Homo sapiens
gtattttcgtgcatttgt

SEQ ID NO: 5778262 - DNA, 12 bp, Homo sapiens
gtattttctaat

SEQ ID NO: 5778263 - DNA, 15 bp, Homo sapiens
gtattttctgtcact

SEQ ID NO: 5778264 - DNA, 14 bp, Homo sapiens
gtattttcttcaaa

SEQ ID NO: 5778265 - DNA, 13 bp, Homo sapiens
gtattttcttccc

SEQ ID NO: 5778266 - DNA, 16 bp, Homo sapiens
gtattttcttctctgt

SEQ ID NO: 5778267 - DNA, 15 bp, Homo sapiens
gtattttctttctct

SEQ ID NO: 5778268 - DNA, 19 bp, Homo sapiens
gtattttcttttgtgcccc

SEQ ID NO: 5778269 - DNA, 15 bp, Homo sapiens
gtattttgaaaacac

SEQ ID NO: 5778270 - DNA, 13 bp, Homo sapiens
gtattttgaagaa

SEQ ID NO: 5778271 - DNA, 12 bp, Homo sapiens
gtattttgaagt

SEQ ID NO: 5778272 - DNA, 19 bp, Homo sapiens
gtattttgaagtttacatt

SEQ ID NO: 5778273 - DNA, 20 bp, Homo sapiens
gtattttgaagtttacattt

SEQ ID NO: 5778274 - DNA, 11 bp, Homo sapiens
gtattttgaat

SEQ ID NO: 5778275 - DNA, 14 bp, Homo sapiens
gtattttgagataa

SEQ ID NO: 5778276 - DNA, 17 bp, Homo sapiens
gtattttgatcagtgtt

SEQ ID NO: 5778277 - DNA, 17 bp, Homo sapiens
gtattttgcctctgggt

SEQ ID NO: 5778278 - DNA, 20 bp, Homo sapiens
gtattttggaggtgcttgat

SEQ ID NO: 5778279 - DNA, 15 bp, Homo sapiens
gtattttgtaatatt

SEQ ID NO: 5778280 - DNA, 18 bp, Homo sapiens
gtattttgtagatgtgat

SEQ ID NO: 5778281 - DNA, 18 bp, Homo sapiens
gtattttgtcagttttaa

SEQ ID NO: 5778282 - DNA, 16 bp, Homo sapiens
gtattttgtcccattt

SEQ ID NO: 5778283 - DNA, 21 bp, Homo sapiens
gtattttgtgagtttgtttct

SEQ ID NO: 5778284 - DNA, 21 bp, Homo sapiens
gtattttgtgttcctctttgc

SEQ ID NO: 5778285 - DNA, 16 bp, Homo sapiens
gtattttgttaaagct

SEQ ID NO: 5778286 - DNA, 18 bp, Homo sapiens
gtattttgttaaagctgg

SEQ ID NO: 5778287 - DNA, 22 bp, Homo sapiens
gtattttgtttttgtcttaaaa

SEQ ID NO: 5778288 - DNA, 10 bp, Homo sapiens
gtatttttaa

SEQ ID NO: 5778289 - DNA, 14 bp, Homo sapiens
gtatttttaatggg

SEQ ID NO: 5778290 - DNA, 21 bp, Homo sapiens
gtatttttagaataagaattt

SEQ ID NO: 5778291 - DNA, 14 bp, Homo sapiens
gtatttttagagat

SEQ ID NO: 5778292 - DNA, 18 bp, Homo sapiens
gtatttttagagattaat

SEQ ID NO: 5778293 - DNA, 15 bp, Homo sapiens
gtatttttagtagag

SEQ ID NO: 5778294 - DNA, 10 bp, Homo sapiens
gtatttttat

SEQ ID NO: 5778295 - DNA, 14 bp, Homo sapiens
gtatttttataaat

SEQ ID NO: 5778296 - DNA, 18 bp, Homo sapiens
gtatttttataattttat

SEQ ID NO: 5778297 - DNA, 13 bp, Homo sapiens
gtatttttatcca

SEQ ID NO: 5778298 - DNA, 19 bp, Homo sapiens
gtatttttcaataataaaa

SEQ ID NO: 5778299 - DNA, 17 bp, Homo sapiens
gtatttttcagagattt

SEQ ID NO: 5778300 - DNA, 18 bp, Homo sapiens
gtatttttcagatataaa

SEQ ID NO: 5778301 - DNA, 20 bp, Homo sapiens
gtatttttcaggtaggccct

SEQ ID NO: 5778302 - DNA, 17 bp, Homo sapiens
gtatttttctgttagct

SEQ ID NO: 5778303 - DNA, 17 bp, Homo sapiens
gtatttttctttaacca

SEQ ID NO: 5778304 - DNA, 13 bp, Homo sapiens
gtatttttgaaag

SEQ ID NO: 5778305 - DNA, 14 bp, Homo sapiens
gtatttttgaataa

SEQ ID NO: 5778306 - DNA, 12 bp, Homo sapiens
gtatttttgaca

SEQ ID NO: 5778307 - DNA, 19 bp, Homo sapiens
gtatttttgattaacaatg

SEQ ID NO: 5778308 - DNA, 20 bp, Homo sapiens
gtatttttgattaacaatgt

SEQ ID NO: 5778309 - DNA, 18 bp, Homo sapiens
gtatttttggtttatatg

SEQ ID NO: 5778310 - DNA, 14 bp, Homo sapiens
gtatttttgtaaat

SEQ ID NO: 5778311 - DNA, 17 bp, Homo sapiens
gtatttttgtattcaat

SEQ ID NO: 5778312 - DNA, 20 bp, Homo sapiens
gtatttttgtgaagtattca

SEQ ID NO: 5778313 - DNA, 23 bp, Homo sapiens
gtatttttgtgaagtattcacaa

SEQ ID NO: 5778314 - DNA, 18 bp, Homo sapiens
gtattttttaaaacacta

SEQ ID NO: 5778315 - DNA, 20 bp, Homo sapiens
gtattttttaaaacactaaa

SEQ ID NO: 5778316 - DNA, 18 bp, Homo sapiens
gtattttttaaaacatca

SEQ ID NO: 5778317 - DNA, 21 bp, Homo sapiens
gtattttttacttttcacact

SEQ ID NO: 5778318 - DNA, 16 bp, Homo sapiens
gtattttttatttaat

SEQ ID NO: 5778319 - DNA, 16 bp, Homo sapiens
gtattttttgtgaatg

SEQ ID NO: 5778320 - DNA, 15 bp, Homo sapiens
gtattttttgtttgt

SEQ ID NO: 5778321 - DNA, 20 bp, Homo sapiens
gtattttttgtttgtattgt

SEQ ID NO: 5778322 - DNA, 22 bp, Homo sapiens
gtattttttgtttgtattgtaa

SEQ ID NO: 5778323 - DNA, 23 bp, Homo sapiens
gtatttttttatcttgggactgg

SEQ ID NO: 5778324 - DNA, 14 bp, Homo sapiens
gtatttttttccaa

SEQ ID NO: 5778325 - DNA, 17 bp, Homo sapiens
gtattttttttgctttt

SEQ ID NO: 5778326 - DNA, 22 bp, Homo sapiens
gtattttttttttaaataaaag

SEQ ID NO: 5778327 - DNA, 23 bp, Homo sapiens
gtattttttttttaaataaaagc

SEQ ID NO: 5778328 - DNA, 13 bp, Homo sapiens
gtcaaaaaaggaa

SEQ ID NO: 5778329 - DNA, 19 bp, Homo sapiens
gtcaaaaaattatttgcta

SEQ ID NO: 5778330 - DNA, 19 bp, Homo sapiens
gtcaaaaagaaccacttgt

SEQ ID NO: 5778331 - DNA, 15 bp, Homo sapiens
gtcaaaaagtaatga

SEQ ID NO: 5778332 - DNA, 16 bp, Homo sapiens
gtcaaaaagtaatgat

SEQ ID NO: 5778333 - DNA, 15 bp, Homo sapiens
gtcaaaaatattttt

SEQ ID NO: 5778334 - DNA, 16 bp, Homo sapiens
gtcaaaaatattttta

SEQ ID NO: 5778335 - DNA, 13 bp, Homo sapiens
gtcaaaaattaaa

SEQ ID NO: 5778336 - DNA, 14 bp, Homo sapiens
gtcaaaaattaaac

SEQ ID NO: 5778337 - DNA, 21 bp, Homo sapiens
gtcaaaacactgtggaactaa

SEQ ID NO: 5778338 - DNA, 15 bp, Homo sapiens
gtcaaaacagattgt

SEQ ID NO: 5778339 - DNA, 19 bp, Homo sapiens
gtcaaaactccactcagca

SEQ ID NO: 5778340 - DNA, 13 bp, Homo sapiens
gtcaaaactgaag

SEQ ID NO: 5778341 - DNA, 15 bp, Homo sapiens
gtcaaaactggttta

SEQ ID NO: 5778342 - DNA, 21 bp, Homo sapiens
gtcaaaagagccctggctctg

SEQ ID NO: 5778343 - DNA, 12 bp, Homo sapiens
gtcaaaaggaac

SEQ ID NO: 5778344 - DNA, 16 bp, Homo sapiens
gtcaaaagtagaactt

SEQ ID NO: 5778345 - DNA, 16 bp, Homo sapiens
gtcaaaagttggacta

SEQ ID NO: 5778346 - DNA, 19 bp, Homo sapiens
gtcaaaagttggactaaat

SEQ ID NO: 5778347 - DNA, 21 bp, Homo sapiens
gtcaaaagttggactaaatgc

SEQ ID NO: 5778348 - DNA, 21 bp, Homo sapiens
gtcaaaataaaggataactct

SEQ ID NO: 5778349 - DNA, 23 bp, Homo sapiens
gtcaaaataaaggataactctgt

SEQ ID NO: 5778350 - DNA, 14 bp, Homo sapiens
gtcaaaatatgtaa

SEQ ID NO: 5778351 - DNA, 18 bp, Homo sapiens
gtcaaaatatttttaaaa

SEQ ID NO: 5778352 - DNA, 17 bp, Homo sapiens
gtcaaaattgtttaaaa

SEQ ID NO: 5778353 - DNA, 11 bp, Homo sapiens
gtcaaacaaaa

SEQ ID NO: 5778354 - DNA, 16 bp, Homo sapiens
gtcaaacaaagccaga

SEQ ID NO: 5778355 - DNA, 16 bp, Homo sapiens
gtcaaacagtgccaaa

SEQ ID NO: 5778356 - DNA, 14 bp, Homo sapiens
gtcaaacagtgtgg

SEQ ID NO: 5778357 - DNA, 16 bp, Homo sapiens
gtcaaacatgaagtgt

SEQ ID NO: 5778358 - DNA, 19 bp, Homo sapiens
gtcaaacattagtacttta

SEQ ID NO: 5778359 - DNA, 23 bp, Homo sapiens
gtcaaacattcgtgagctgggga

SEQ ID NO: 5778360 - DNA, 16 bp, Homo sapiens
gtcaaaccataaactt

SEQ ID NO: 5778361 - DNA, 22 bp, Homo sapiens
gtcaaaccgcactcacccatgt

SEQ ID NO: 5778362 - DNA, 14 bp, Homo sapiens
gtcaaacgtgaaaa

SEQ ID NO: 5778363 - DNA, 21 bp, Homo sapiens
gtcaaacgtgccccccagttc

SEQ ID NO: 5778364 - DNA, 17 bp, Homo sapiens
gtcaaacttggatactt

SEQ ID NO: 5778365 - DNA, 21 bp, Homo sapiens
gtcaaacttggatacttggat

SEQ ID NO: 5778366 - DNA, 15 bp, Homo sapiens
gtcaaactttttcca

SEQ ID NO: 5778367 - DNA, 24 bp, Homo sapiens
gtcaaactttttccagcaaaatgg

SEQ ID NO: 5778368 - DNA, 16 bp, Homo sapiens
gtcaaagacagaatgg

SEQ ID NO: 5778369 - DNA, 20 bp, Homo sapiens
gtcaaagatgccccattcct

SEQ ID NO: 5778370 - DNA, 10 bp, Homo sapiens
gtcaaaggct

SEQ ID NO: 5778371 - DNA, 21 bp, Homo sapiens
gtcaaaggtcgggacagctgt

SEQ ID NO: 5778372 - DNA, 14 bp, Homo sapiens
gtcaaagtacagaa

SEQ ID NO: 5778373 - DNA, 22 bp, Homo sapiens
gtcaaagtgttgctgtggctcc

SEQ ID NO: 5778374 - DNA, 17 bp, Homo sapiens
gtcaaataaacactgtg

SEQ ID NO: 5778375 - DNA, 19 bp, Homo sapiens
gtcaaataaatgtttcccc

SEQ ID NO: 5778376 - DNA, 19 bp, Homo sapiens
gtcaaatatatttaactat

SEQ ID NO: 5778377 - DNA, 14 bp, Homo sapiens
gtcaaatatttatt

SEQ ID NO: 5778378 - DNA, 14 bp, Homo sapiens
gtcaaatccagtgg

SEQ ID NO: 5778379 - DNA, 17 bp, Homo sapiens
gtcaaatccagtggtgg

SEQ ID NO: 5778380 - DNA, 19 bp, Homo sapiens
gtcaaatccatgtgtcccc

SEQ ID NO: 5778381 - DNA, 15 bp, Homo sapiens
gtcaaatgaactttt

SEQ ID NO: 5778382 - DNA, 23 bp, Homo sapiens
gtcaaatggtattttttgtgaat

SEQ ID NO: 5778383 - DNA, 23 bp, Homo sapiens
gtcaaatgtttccttaaacatga

SEQ ID NO: 5778384 - DNA, 17 bp, Homo sapiens
gtcaaatttacatttat

SEQ ID NO: 5778385 - DNA, 14 bp, Homo sapiens
gtcaacaaagtgct

SEQ ID NO: 5778386 - DNA, 14 bp, Homo sapiens
gtcaacaaattaaa

SEQ ID NO: 5778387 - DNA, 21 bp, Homo sapiens
gtcaacaagtatgaataaaga

SEQ ID NO: 5778388 - DNA, 14 bp, Homo sapiens
gtcaacacaaagac

SEQ ID NO: 5778389 - DNA, 15 bp, Homo sapiens
gtcaacacaaagaca

SEQ ID NO: 5778390 - DNA, 17 bp, Homo sapiens
gtcaacacaaagacatg

SEQ ID NO: 5778391 - DNA, 18 bp, Homo sapiens
gtcaacacaaagacatgg

SEQ ID NO: 5778392 - DNA, 19 bp, Homo sapiens
gtcaacacaaagacatgga

SEQ ID NO: 5778393 - DNA, 16 bp, Homo sapiens
gtcaacaccagaaagc

SEQ ID NO: 5778394 - DNA, 17 bp, Homo sapiens
gtcaacactaacatgat

SEQ ID NO: 5778395 - DNA, 17 bp, Homo sapiens
gtcaacactcttcttga

SEQ ID NO: 5778396 - DNA, 19 bp, Homo sapiens
gtcaacactcttcttgagc

SEQ ID NO: 5778397 - DNA, 22 bp, Homo sapiens
gtcaacacttaagggttttaga

SEQ ID NO: 5778398 - DNA, 13 bp, Homo sapiens
gtcaacagaatga

SEQ ID NO: 5778399 - DNA, 14 bp, Homo sapiens
gtcaacagaatgaa

SEQ ID NO: 5778400 - DNA, 20 bp, Homo sapiens
gtcaacagaatgaaaaatga

SEQ ID NO: 5778401 - DNA, 19 bp, Homo sapiens
gtcaacagagaaggcagga

SEQ ID NO: 5778402 - DNA, 22 bp, Homo sapiens
gtcaacagagaaggcaggaatg

SEQ ID NO: 5778403 - DNA, 23 bp, Homo sapiens
gtcaacagagaaggcaggaatgt

SEQ ID NO: 5778404 - DNA, 18 bp, Homo sapiens
gtcaacagattcagaatg

SEQ ID NO: 5778405 - DNA, 14 bp, Homo sapiens
gtcaacagtaaacc

SEQ ID NO: 5778406 - DNA, 12 bp, Homo sapiens
gtcaacagtgaa

SEQ ID NO: 5778407 - DNA, 22 bp, Homo sapiens
gtcaacatagtgagacactgtc

SEQ ID NO: 5778408 - DNA, 11 bp, Homo sapiens
gtcaacatctt

SEQ ID NO: 5778409 - DNA, 15 bp, Homo sapiens
gtcaacatcttctct

SEQ ID NO: 5778410 - DNA, 19 bp, Homo sapiens
gtcaacatttctcatgttg

SEQ ID NO: 5778411 - DNA, 21 bp, Homo sapiens
gtcaaccactaaagtatagag

SEQ ID NO: 5778412 - DNA, 16 bp, Homo sapiens
gtcaaccagacagagg

SEQ ID NO: 5778413 - DNA, 15 bp, Homo sapiens
gtcaacccaagctct

SEQ ID NO: 5778414 - DNA, 20 bp, Homo sapiens
gtcaacccaagctctgggga

SEQ ID NO: 5778415 - DNA, 20 bp, Homo sapiens
gtcaacccgctgcttccagg

SEQ ID NO: 5778416 - DNA, 21 bp, Homo sapiens
gtcaacccgctgcttccaggt

SEQ ID NO: 5778417 - DNA, 15 bp, Homo sapiens
gtcaacccttctgga

SEQ ID NO: 5778418 - DNA, 19 bp, Homo sapiens
gtcaacccttctggaaact

SEQ ID NO: 5778419 - DNA, 14 bp, Homo sapiens
gtcaacctcctgga

SEQ ID NO: 5778420 - DNA, 21 bp, Homo sapiens
gtcaacctcgcgcttgctggc

SEQ ID NO: 5778421 - DNA, 19 bp, Homo sapiens
gtcaacctgggcaaagcct

SEQ ID NO: 5778422 - DNA, 16 bp, Homo sapiens
gtcaacctttgtgtgg

SEQ ID NO: 5778423 - DNA, 20 bp, Homo sapiens
gtcaacctttgtgtggctcc

SEQ ID NO: 5778424 - DNA, 18 bp, Homo sapiens
gtcaacggccctgtttat

SEQ ID NO: 5778425 - DNA, 20 bp, Homo sapiens
gtcaacggggggctcctgcc

SEQ ID NO: 5778426 - DNA, 21 bp, Homo sapiens
gtcaacggggggctcctgccc

SEQ ID NO: 5778427 - DNA, 22 bp, Homo sapiens
gtcaacggggggctcctgccca

SEQ ID NO: 5778428 - DNA, 19 bp, Homo sapiens
gtcaactcatattttcatg

SEQ ID NO: 5778429 - DNA, 13 bp, Homo sapiens
gtcaactccaagg

SEQ ID NO: 5778430 - DNA, 23 bp, Homo sapiens
gtcaactccaaggcaaatgtcca

SEQ ID NO: 5778431 - DNA, 15 bp, Homo sapiens
gtcaactccaggact

SEQ ID NO: 5778432 - DNA, 14 bp, Homo sapiens
gtcaactggctggc

SEQ ID NO: 5778433 - DNA, 18 bp, Homo sapiens
gtcaactggctggccagt

SEQ ID NO: 5778434 - DNA, 21 bp, Homo sapiens
gtcaacttgacaccactaaga

SEQ ID NO: 5778435 - DNA, 20 bp, Homo sapiens
gtcaacttgagcatgttact

SEQ ID NO: 5778436 - DNA, 21 bp, Homo sapiens
gtcaactttcctcaaatcaaa

SEQ ID NO: 5778437 - DNA, 14 bp, Homo sapiens
gtcaagaaaaatat

SEQ ID NO: 5778438 - DNA, 22 bp, Homo sapiens
gtcaagaaaaatataaaaacaa

SEQ ID NO: 5778439 - DNA, 12 bp, Homo sapiens
gtcaagaaaagc

SEQ ID NO: 5778440 - DNA, 18 bp, Homo sapiens
gtcaagaaacagccagca

SEQ ID NO: 5778441 - DNA, 12 bp, Homo sapiens
gtcaagaaagga

SEQ ID NO: 5778442 - DNA, 16 bp, Homo sapiens
gtcaagaaattctgct

SEQ ID NO: 5778443 - DNA, 20 bp, Homo sapiens
gtcaagaaattctgctgtta

SEQ ID NO: 5778444 - DNA, 14 bp, Homo sapiens
gtcaagacatttct

SEQ ID NO: 5778445 - DNA, 13 bp, Homo sapiens
gtcaagacatttg

SEQ ID NO: 5778446 - DNA, 14 bp, Homo sapiens
gtcaagacatttgc

SEQ ID NO: 5778447 - DNA, 15 bp, Homo sapiens
gtcaagaccagcctg

SEQ ID NO: 5778448 - DNA, 19 bp, Homo sapiens
gtcaagagatcgagaccat

SEQ ID NO: 5778449 - DNA, 16 bp, Homo sapiens
gtcaagagcatgcaca

SEQ ID NO: 5778450 - DNA, 16 bp, Homo sapiens
gtcaagagccaagaca

SEQ ID NO: 5778451 - DNA, 17 bp, Homo sapiens
gtcaagagggaggaagg

SEQ ID NO: 5778452 - DNA, 18 bp, Homo sapiens
gtcaagagggtctgagga

SEQ ID NO: 5778453 - DNA, 19 bp, Homo sapiens
gtcaagagggtctgaggaa

SEQ ID NO: 5778454 - DNA, 17 bp, Homo sapiens
gtcaagagtagttatat

SEQ ID NO: 5778455 - DNA, 19 bp, Homo sapiens
gtcaagagtgaattccctc

SEQ ID NO: 5778456 - DNA, 20 bp, Homo sapiens
gtcaagagtgaattccctca

SEQ ID NO: 5778457 - DNA, 17 bp, Homo sapiens
gtcaagatcaacattcc

SEQ ID NO: 5778458 - DNA, 21 bp, Homo sapiens
gtcaagatcaacattccaggg

SEQ ID NO: 5778459 - DNA, 22 bp, Homo sapiens
gtcaagattttttttgtaactt

SEQ ID NO: 5778460 - DNA, 14 bp, Homo sapiens
gtcaagcatgtatt

SEQ ID NO: 5778461 - DNA, 13 bp, Homo sapiens
gtcaagcccagaa

SEQ ID NO: 5778462 - DNA, 23 bp, Homo sapiens
gtcaagcctcttattccaggaga

SEQ ID NO: 5778463 - DNA, 19 bp, Homo sapiens
gtcaagctcctcctccctg

SEQ ID NO: 5778464 - DNA, 14 bp, Homo sapiens
gtcaagctgcttgg

SEQ ID NO: 5778465 - DNA, 12 bp, Homo sapiens
gtcaagcttact

SEQ ID NO: 5778466 - DNA, 12 bp, Homo sapiens
gtcaaggaacct

SEQ ID NO: 5778467 - DNA, 13 bp, Homo sapiens
gtcaaggccagca

SEQ ID NO: 5778468 - DNA, 15 bp, Homo sapiens
gtcaaggccgagggc

SEQ ID NO: 5778469 - DNA, 21 bp, Homo sapiens
gtcaaggcgcgctcagatgcc

SEQ ID NO: 5778470 - DNA, 20 bp, Homo sapiens
gtcaaggcttagaccctcat

SEQ ID NO: 5778471 - DNA, 21 bp, Homo sapiens
gtcaagggcagctttgctcat

SEQ ID NO: 5778472 - DNA, 17 bp, Homo sapiens
gtcaaggggccctagga

SEQ ID NO: 5778473 - DNA, 15 bp, Homo sapiens
gtcaagtaagaagac

SEQ ID NO: 5778474 - DNA, 14 bp, Homo sapiens
gtcaagtataaagt

SEQ ID NO: 5778475 - DNA, 13 bp, Homo sapiens
gtcaagtcaacca

SEQ ID NO: 5778476 - DNA, 19 bp, Homo sapiens
gtcaagtcccccagcagaa

SEQ ID NO: 5778477 - DNA, 20 bp, Homo sapiens
gtcaagtcccccagcagaac

SEQ ID NO: 5778478 - DNA, 23 bp, Homo sapiens
gtcaagtcccccagcagaaccag

SEQ ID NO: 5778479 - DNA, 17 bp, Homo sapiens
gtcaagtctacctgcct

SEQ ID NO: 5778480 - DNA, 15 bp, Homo sapiens
gtcaagtgaaaaagg

SEQ ID NO: 5778481 - DNA, 14 bp, Homo sapiens
gtcaagtgggatct

SEQ ID NO: 5778482 - DNA, 14 bp, Homo sapiens
gtcaagttcccaac

SEQ ID NO: 5778483 - DNA, 16 bp, Homo sapiens
gtcaagttcccaactg

SEQ ID NO: 5778484 - DNA, 14 bp, Homo sapiens
gtcaagttgagatt

SEQ ID NO: 5778485 - DNA, 15 bp, Homo sapiens
gtcaagttgagattt

SEQ ID NO: 5778486 - DNA, 22 bp, Homo sapiens
gtcaagttggacttgttttaac

SEQ ID NO: 5778487 - DNA, 22 bp, Homo sapiens
gtcaagttgggttcacttgcca

SEQ ID NO: 5778488 - DNA, 17 bp, Homo sapiens
gtcaagtttttctctca

SEQ ID NO: 5778489 - DNA, 19 bp, Homo sapiens
gtcaataaaagagctgtct

SEQ ID NO: 5778490 - DNA, 13 bp, Homo sapiens
gtcaataaaatga

SEQ ID NO: 5778491 - DNA, 18 bp, Homo sapiens
gtcaataaacaacagctg

SEQ ID NO: 5778492 - DNA, 22 bp, Homo sapiens
gtcaataaacaacagctgaagc

SEQ ID NO: 5778493 - DNA, 18 bp, Homo sapiens
gtcaataaacttagagga

SEQ ID NO: 5778494 - DNA, 23 bp, Homo sapiens
gtcaataaacttagaggaaaatg

SEQ ID NO: 5778495 - DNA, 18 bp, Homo sapiens
gtcaataaagcagagcca

SEQ ID NO: 5778496 - DNA, 21 bp, Homo sapiens
gtcaataaagcagagccaagg

SEQ ID NO: 5778497 - DNA, 14 bp, Homo sapiens
gtcaataaatgaca

SEQ ID NO: 5778498 - DNA, 19 bp, Homo sapiens
gtcaataacactgtatttt

SEQ ID NO: 5778499 - DNA, 14 bp, Homo sapiens
gtcaataactctga

SEQ ID NO: 5778500 - DNA, 16 bp, Homo sapiens
gtcaatacaaatgtta

SEQ ID NO: 5778501 - DNA, 18 bp, Homo sapiens
gtcaatataccatgacat

SEQ ID NO: 5778502 - DNA, 11 bp, Homo sapiens
gtcaatatata

SEQ ID NO: 5778503 - DNA, 16 bp, Homo sapiens
gtcaatattaaataca

SEQ ID NO: 5778504 - DNA, 20 bp, Homo sapiens
gtcaatattaaatacagaca

SEQ ID NO: 5778505 - DNA, 23 bp, Homo sapiens
gtcaatattaaatacagacacta

SEQ ID NO: 5778506 - DNA, 16 bp, Homo sapiens
gtcaatatttgatcta

SEQ ID NO: 5778507 - DNA, 13 bp, Homo sapiens
gtcaatcaaacag

SEQ ID NO: 5778508 - DNA, 18 bp, Homo sapiens
gtcaatcacagtctcagt

SEQ ID NO: 5778509 - DNA, 13 bp, Homo sapiens
gtcaatcagcctt

SEQ ID NO: 5778510 - DNA, 22 bp, Homo sapiens
gtcaatcatatttaaagggaat

SEQ ID NO: 5778511 - DNA, 24 bp, Homo sapiens
gtcaatccaatctgtaatttcact

SEQ ID NO: 5778512 - DNA, 16 bp, Homo sapiens
gtcaatccatcagcaa

SEQ ID NO: 5778513 - DNA, 17 bp, Homo sapiens
gtcaatcccaaaagtca

SEQ ID NO: 5778514 - DNA, 20 bp, Homo sapiens
gtcaatcccaaaagtcacca

SEQ ID NO: 5778515 - DNA, 16 bp, Homo sapiens
gtcaatcccctcattc

SEQ ID NO: 5778516 - DNA, 17 bp, Homo sapiens
gtcaatcccctcattca

SEQ ID NO: 5778517 - DNA, 21 bp, Homo sapiens
gtcaatgaaatatttgcttat

SEQ ID NO: 5778518 - DNA, 22 bp, Homo sapiens
gtcaatgaaatatttgcttatt

SEQ ID NO: 5778519 - DNA, 23 bp, Homo sapiens
gtcaatgacatgaattttagctt

SEQ ID NO: 5778520 - DNA, 16 bp, Homo sapiens
gtcaatgcagttgtct

SEQ ID NO: 5778521 - DNA, 17 bp, Homo sapiens
gtcaccgagactcagcc

SEQ ID NO: 5778522 - DNA, 18 bp, Homo sapiens
gtcaccgagactcagcct

SEQ ID NO: 5778523 - DNA, 17 bp, Homo sapiens
gtcaccgagcgggtgca

SEQ ID NO: 5778524 - DNA, 20 bp, Homo sapiens
gtcaccgcggacgtgctggc

SEQ ID NO: 5778525 - DNA, 18 bp, Homo sapiens
gtcaccggtcagtgcctt

SEQ ID NO: 5778526 - DNA, 18 bp, Homo sapiens
gtcaccgtggaccttcct

SEQ ID NO: 5778527 - DNA, 19 bp, Homo sapiens
gtcaccgtggaccttcctg

SEQ ID NO: 5778528 - DNA, 20 bp, Homo sapiens
gtcaccgtggaccttcctgc

SEQ ID NO: 5778529 - DNA, 16 bp, Homo sapiens
gtcacctagcaagctg

SEQ ID NO: 5778530 - DNA, 19 bp, Homo sapiens
gtcacctaggaagcctcag

SEQ ID NO: 5778531 - DNA, 20 bp, Homo sapiens
gtcacctaggaagcctcaga

SEQ ID NO: 5778532 - DNA, 21 bp, Homo sapiens
gtcacctaggaagcctcagat

SEQ ID NO: 5778533 - DNA, 23 bp, Homo sapiens
gtcacctcactcagcaccactca

SEQ ID NO: 5778534 - DNA, 15 bp, Homo sapiens
gtcacctcccatccc

SEQ ID NO: 5778535 - DNA, 16 bp, Homo sapiens
gtcacctccccacatc

SEQ ID NO: 5778536 - DNA, 16 bp, Homo sapiens
gtcacctcctccactc

SEQ ID NO: 5778537 - DNA, 16 bp, Homo sapiens
gtcacctccttcccca

SEQ ID NO: 5778538 - DNA, 16 bp, Homo sapiens
gtcacctcgctgggct

SEQ ID NO: 5778539 - DNA, 19 bp, Homo sapiens
gtcacctctcagctgctgg

SEQ ID NO: 5778540 - DNA, 15 bp, Homo sapiens
gtcacctctctcaga

SEQ ID NO: 5778541 - DNA, 21 bp, Homo sapiens
gtcacctctctcagagcatct

SEQ ID NO: 5778542 - DNA, 20 bp, Homo sapiens
gtcacctctctctgaggaca

SEQ ID NO: 5778543 - DNA, 20 bp, Homo sapiens
gtcacctgaagactcattct

SEQ ID NO: 5778544 - DNA, 12 bp, Homo sapiens
gtcacctgcaag

SEQ ID NO: 5778545 - DNA, 13 bp, Homo sapiens
gtcacctgcaagc

SEQ ID NO: 5778546 - DNA, 24 bp, Homo sapiens
gtcacctgcaagccccagggcctg

SEQ ID NO: 5778547 - DNA, 22 bp, Homo sapiens
gtcacctgcacagggccctctg

SEQ ID NO: 5778548 - DNA, 23 bp, Homo sapiens
gtcacctgcccagatcccagaag

SEQ ID NO: 5778549 - DNA, 21 bp, Homo sapiens
gtcacctgccccgtagagaat

SEQ ID NO: 5778550 - DNA, 19 bp, Homo sapiens
gtcacctgccgccctgtgg

SEQ ID NO: 5778551 - DNA, 19 bp, Homo sapiens
gtcacctgctcacagggat

SEQ ID NO: 5778552 - DNA, 22 bp, Homo sapiens
gtcacctgctggttgttgccag

SEQ ID NO: 5778553 - DNA, 17 bp, Homo sapiens
gtcacctgcttctctgc

SEQ ID NO: 5778554 - DNA, 18 bp, Homo sapiens
gtcacctggcacattcat

SEQ ID NO: 5778555 - DNA, 13 bp, Homo sapiens
gtcacctggctgc

SEQ ID NO: 5778556 - DNA, 22 bp, Homo sapiens
gtcacctgggcgtcatctggtc

SEQ ID NO: 5778557 - DNA, 22 bp, Homo sapiens
gtcacctgggggggttgggcgg

SEQ ID NO: 5778558 - DNA, 22 bp, Homo sapiens
gtcaccttcctgggcagcccag

SEQ ID NO: 5778559 - DNA, 23 bp, Homo sapiens
gtcaccttcctgggcagcccaga

SEQ ID NO: 5778560 - DNA, 14 bp, Homo sapiens
gtcaccttgcactc

SEQ ID NO: 5778561 - DNA, 15 bp, Homo sapiens
gtcaccttgcactcc

SEQ ID NO: 5778562 - DNA, 18 bp, Homo sapiens
gtcaccttgcactcctca

SEQ ID NO: 5778563 - DNA, 13 bp, Homo sapiens
gtcacctttctgg

SEQ ID NO: 5778564 - DNA, 20 bp, Homo sapiens
gtcacctttctgggctttct

SEQ ID NO: 5778565 - DNA, 21 bp, Homo sapiens
gtcaccttttaaatcctgttg

SEQ ID NO: 5778566 - DNA, 20 bp, Homo sapiens
gtcacgagggtaggaccctc

SEQ ID NO: 5778567 - DNA, 14 bp, Homo sapiens
gtcacgccagactt

SEQ ID NO: 5778568 - DNA, 17 bp, Homo sapiens
gtcacgctcatgtcctg

SEQ ID NO: 5778569 - DNA, 16 bp, Homo sapiens
gtcacgctctggtgca

SEQ ID NO: 5778570 - DNA, 18 bp, Homo sapiens
gtcacggatttgtgtctg

SEQ ID NO: 5778571 - DNA, 16 bp, Homo sapiens
gtcacggctactctat

SEQ ID NO: 5778572 - DNA, 16 bp, Homo sapiens
gtcacgtgaaatattt

SEQ ID NO: 5778573 - DNA, 14 bp, Homo sapiens
gtcacgtgaccctg

SEQ ID NO: 5778574 - DNA, 18 bp, Homo sapiens
gtcacgtgaccctgtgcc

SEQ ID NO: 5778575 - DNA, 17 bp, Homo sapiens
gtcacgtgtaggagtga

SEQ ID NO: 5778576 - DNA, 23 bp, Homo sapiens
gtcacgttcttggatcctcagaa

SEQ ID NO: 5778577 - DNA, 21 bp, Homo sapiens
gtcacgttttgcctcatgaac

SEQ ID NO: 5778578 - DNA, 22 bp, Homo sapiens
gtcactactcacagtctcttta

SEQ ID NO: 5778579 - DNA, 12 bp, Homo sapiens
gtcactactgca

SEQ ID NO: 5778580 - DNA, 12 bp, Homo sapiens
gtcactagaatg

SEQ ID NO: 5778581 - DNA, 16 bp, Homo sapiens
gtcactagcagctgca

SEQ ID NO: 5778582 - DNA, 21 bp, Homo sapiens
gtcactaggaatttttttcag

SEQ ID NO: 5778583 - DNA, 23 bp, Homo sapiens
gtcactaggaatttttttcagta

SEQ ID NO: 5778584 - DNA, 19 bp, Homo sapiens
gtcactagtgaacaattcg

SEQ ID NO: 5778585 - DNA, 22 bp, Homo sapiens
gtcactattttcactagggctg

SEQ ID NO: 5778586 - DNA, 23 bp, Homo sapiens
gtcactcaacaaaagtgctttgg

SEQ ID NO: 5778587 - DNA, 23 bp, Homo sapiens
gtcactcacaaaaggctggatgt

SEQ ID NO: 5778588 - DNA, 16 bp, Homo sapiens
gtcactcacactggcc

SEQ ID NO: 5778589 - DNA, 17 bp, Homo sapiens
gtcactcacactggcca

SEQ ID NO: 5778590 - DNA, 20 bp, Homo sapiens
gtcactcacattgagagtaa

SEQ ID NO: 5778591 - DNA, 11 bp, Homo sapiens
gtcactcagcc

SEQ ID NO: 5778592 - DNA, 19 bp, Homo sapiens
gtcactcagccccttcccg

SEQ ID NO: 5778593 - DNA, 14 bp, Homo sapiens
gtcactcagctgag

SEQ ID NO: 5778594 - DNA, 16 bp, Homo sapiens
gtcactcaggcctctg

SEQ ID NO: 5778595 - DNA, 14 bp, Homo sapiens
gtcactcaggctgg

SEQ ID NO: 5778596 - DNA, 15 bp, Homo sapiens
gtcactcaggctgga

SEQ ID NO: 5778597 - DNA, 18 bp, Homo sapiens
gtcactcattgctgagcc

SEQ ID NO: 5778598 - DNA, 20 bp, Homo sapiens
gtcactcattgctgagcctc

SEQ ID NO: 5778599 - DNA, 22 bp, Homo sapiens
gtcactcattgctgagcctctg

SEQ ID NO: 5778600 - DNA, 23 bp, Homo sapiens
gtcactcattgctgagcctctgc

SEQ ID NO: 5778601 - DNA, 21 bp, Homo sapiens
gtcactccaccatccccaccc

SEQ ID NO: 5778602 - DNA, 11 bp, Homo sapiens
gtcactccagt

SEQ ID NO: 5778603 - DNA, 13 bp, Homo sapiens
gtcactccagtgc

SEQ ID NO: 5778604 - DNA, 23 bp, Homo sapiens
gtcactccagtgctcagctgtgg

SEQ ID NO: 5778605 - DNA, 19 bp, Homo sapiens
gtcactccataaaaagaaa

SEQ ID NO: 5778606 - DNA, 12 bp, Homo sapiens
gtcactcccaga

SEQ ID NO: 5778607 - DNA, 19 bp, Homo sapiens
gtcactccctctgccttca

SEQ ID NO: 5778608 - DNA, 22 bp, Homo sapiens
gtcactctaggactctgcactg

SEQ ID NO: 5778609 - DNA, 18 bp, Homo sapiens
gtcactctgccctctgct

SEQ ID NO: 5778610 - DNA, 13 bp, Homo sapiens
gtcactctgcctc

SEQ ID NO: 5778611 - DNA, 16 bp, Homo sapiens
gtcactctgcctctaa

SEQ ID NO: 5778612 - DNA, 15 bp, Homo sapiens
gtcactgaaccactg

SEQ ID NO: 5778613 - DNA, 16 bp, Homo sapiens
gtcactgaaccactgc

SEQ ID NO: 5778614 - DNA, 17 bp, Homo sapiens
gtcactgaaccactgct

SEQ ID NO: 5778615 - DNA, 21 bp, Homo sapiens
gtcactgaaccactgcttctc

SEQ ID NO: 5778616 - DNA, 21 bp, Homo sapiens
gtcactgaaggcctggcccac

SEQ ID NO: 5778617 - DNA, 19 bp, Homo sapiens
gtcactgaccctggagcgg

SEQ ID NO: 5778618 - DNA, 17 bp, Homo sapiens
gtcactgagacagcccg

SEQ ID NO: 5778619 - DNA, 21 bp, Homo sapiens
gtcactgagacagcccgggct

SEQ ID NO: 5778620 - DNA, 14 bp, Homo sapiens
gtcactgagctgtg

SEQ ID NO: 5778621 - DNA, 15 bp, Homo sapiens
gtcactgagctgtgt

SEQ ID NO: 5778622 - DNA, 9 bp, Homo sapiens
gtcactgcc

SEQ ID NO: 5778623 - DNA, 16 bp, Homo sapiens
gtcactgccactttgc

SEQ ID NO: 5778624 - DNA, 15 bp, Homo sapiens
gtcactgcccaccaa

SEQ ID NO: 5778625 - DNA, 20 bp, Homo sapiens
gtcactgcccacctgccagg

SEQ ID NO: 5778626 - DNA, 22 bp, Homo sapiens
gtcactgccgacatccctcccc

SEQ ID NO: 5778627 - DNA, 23 bp, Homo sapiens
gtcactgctacaccttagcagct

SEQ ID NO: 5778628 - DNA, 15 bp, Homo sapiens
gtcactgctctggac

SEQ ID NO: 5778629 - DNA, 22 bp, Homo sapiens
gtcactgctgcttcatgtttgc

SEQ ID NO: 5778630 - DNA, 12 bp, Homo sapiens
gtcactgctgta

SEQ ID NO: 5778631 - DNA, 10 bp, Homo sapiens
gtcactgctt

SEQ ID NO: 5778632 - DNA, 18 bp, Homo sapiens
gtcactggaaaggggaga

SEQ ID NO: 5778633 - DNA, 19 bp, Homo sapiens
gtcactggaccactgggca

SEQ ID NO: 5778634 - DNA, 12 bp, Homo sapiens
gtcactggcaga

SEQ ID NO: 5778635 - DNA, 16 bp, Homo sapiens
gtcactggcagagcac

SEQ ID NO: 5778636 - DNA, 19 bp, Homo sapiens
gtcactggcagagcacagc

SEQ ID NO: 5778637 - DNA, 21 bp, Homo sapiens
gtcactggcagagcacagccc

SEQ ID NO: 5778638 - DNA, 20 bp, Homo sapiens
gtcactggcccaaccagaac

SEQ ID NO: 5778639 - DNA, 22 bp, Homo sapiens
gtcactggcctctccccaggaa

SEQ ID NO: 5778640 - DNA, 12 bp, Homo sapiens
gtcactggctct

SEQ ID NO: 5778641 - DNA, 14 bp, Homo sapiens
gtcactggctctcc

SEQ ID NO: 5778642 - DNA, 17 bp, Homo sapiens
gtcactggctctccaag

SEQ ID NO: 5778643 - DNA, 16 bp, Homo sapiens
gtcactggctgcctcc

SEQ ID NO: 5778644 - DNA, 19 bp, Homo sapiens
gtcactggctgcctccact

SEQ ID NO: 5778645 - DNA, 14 bp, Homo sapiens
gtcactggctggct

SEQ ID NO: 5778646 - DNA, 21 bp, Homo sapiens
gtcactggctggctcctaggg

SEQ ID NO: 5778647 - DNA, 22 bp, Homo sapiens
gtcactggggcccaagagtctg

SEQ ID NO: 5778648 - DNA, 23 bp, Homo sapiens
gtcactggtaccggatgcagacc

SEQ ID NO: 5778649 - DNA, 21 bp, Homo sapiens
gtcactggtagaccaaaataa

SEQ ID NO: 5778650 - DNA, 16 bp, Homo sapiens
gtcactggtcagggca

SEQ ID NO: 5778651 - DNA, 23 bp, Homo sapiens
gtcactggtcagggcagtggcca

SEQ ID NO: 5778652 - DNA, 17 bp, Homo sapiens
gtcactgtacagttttg

SEQ ID NO: 5778653 - DNA, 12 bp, Homo sapiens
gtcactgtagtt

SEQ ID NO: 5778654 - DNA, 12 bp, Homo sapiens
gtcactgtcact

SEQ ID NO: 5778655 - DNA, 24 bp, Homo sapiens
gtcactgtccaggtaggaaacaat

SEQ ID NO: 5778656 - DNA, 17 bp, Homo sapiens
gtcactgtccctcctgg

SEQ ID NO: 5778657 - DNA, 17 bp, Homo sapiens
gtcactgttccttgtca

SEQ ID NO: 5778658 - DNA, 14 bp, Homo sapiens
gtcactgtttcctg

SEQ ID NO: 5778659 - DNA, 13 bp, Homo sapiens
gtcactgtttctc

SEQ ID NO: 5778660 - DNA, 14 bp, Homo sapiens
gtcactgtttttat

SEQ ID NO: 5778661 - DNA, 20 bp, Homo sapiens
gtcactgtttttattccttc

SEQ ID NO: 5778662 - DNA, 21 bp, Homo sapiens
gtcactgtttttattccttcc

SEQ ID NO: 5778663 - DNA, 23 bp, Homo sapiens
gtcactgtttttattccttccat

SEQ ID NO: 5778664 - DNA, 14 bp, Homo sapiens
gtcacttaaaatgt

SEQ ID NO: 5778665 - DNA, 18 bp, Homo sapiens
gtcacttaaaatgtgcag

SEQ ID NO: 5778666 - DNA, 16 bp, Homo sapiens
gtcacttactgtttct

SEQ ID NO: 5778667 - DNA, 18 bp, Homo sapiens
gtcacttactgtttctgt

SEQ ID NO: 5778668 - DNA, 15 bp, Homo sapiens
gtcacttatcctgac

SEQ ID NO: 5778669 - DNA, 15 bp, Homo sapiens
gtcacttatttcata

SEQ ID NO: 5778670 - DNA, 13 bp, Homo sapiens
gtcacttcaccat

SEQ ID NO: 5778671 - DNA, 17 bp, Homo sapiens
gtcacttcatattttat

SEQ ID NO: 5778672 - DNA, 16 bp, Homo sapiens
gtcacttccagtgttg

SEQ ID NO: 5778673 - DNA, 22 bp, Homo sapiens
gtcacttccccaagatctgcca

SEQ ID NO: 5778674 - DNA, 23 bp, Homo sapiens
gtcacttccccaagatctgccag

SEQ ID NO: 5778675 - DNA, 21 bp, Homo sapiens
gtcacttcttcacctcttcca

SEQ ID NO: 5778676 - DNA, 13 bp, Homo sapiens
gtcacttcttctg

SEQ ID NO: 5778677 - DNA, 14 bp, Homo sapiens
gtcacttcttctgt

SEQ ID NO: 5778678 - DNA, 21 bp, Homo sapiens
gtcacttgatcatgctgcagt

SEQ ID NO: 5778679 - DNA, 15 bp, Homo sapiens
gtcacttgccacatg

SEQ ID NO: 5778680 - DNA, 15 bp, Homo sapiens
gtcacttgctgcttt

SEQ ID NO: 5778681 - DNA, 22 bp, Homo sapiens
gtcacttgggagctgctgggct

SEQ ID NO: 5778682 - DNA, 17 bp, Homo sapiens
gtcactttgttttactg

SEQ ID NO: 5778683 - DNA, 16 bp, Homo sapiens
gtcactttttcccctg

SEQ ID NO: 5778684 - DNA, 19 bp, Homo sapiens
gtcactttttcccctgcaa

SEQ ID NO: 5778685 - DNA, 20 bp, Homo sapiens
gtcagaaaagagccactttc

SEQ ID NO: 5778686 - DNA, 23 bp, Homo sapiens
gtcagaaaattggcagtggcaga

SEQ ID NO: 5778687 - DNA, 15 bp, Homo sapiens
gtcagaaactaaaac

SEQ ID NO: 5778688 - DNA, 13 bp, Homo sapiens
gtcagaaactgtt

SEQ ID NO: 5778689 - DNA, 16 bp, Homo sapiens
gtcagaacagcagact

SEQ ID NO: 5778690 - DNA, 19 bp, Homo sapiens
gtcagaacagcagactcag

SEQ ID NO: 5778691 - DNA, 16 bp, Homo sapiens
gtcagaagaagtggga

SEQ ID NO: 5778692 - DNA, 16 bp, Homo sapiens
gtcagaaggagacaga

SEQ ID NO: 5778693 - DNA, 19 bp, Homo sapiens
gtcagaaggagacagaatg

SEQ ID NO: 5778694 - DNA, 15 bp, Homo sapiens
gtcagaagtctagtt

SEQ ID NO: 5778695 - DNA, 14 bp, Homo sapiens
gtcagaagttctgg

SEQ ID NO: 5778696 - DNA, 21 bp, Homo sapiens
gtcagaagtttctgccgcagc

SEQ ID NO: 5778697 - DNA, 19 bp, Homo sapiens
gtcagctgggatgtgaagt

SEQ ID NO: 5778698 - DNA, 22 bp, Homo sapiens
gtcagctgtggggaacacagct

SEQ ID NO: 5778699 - DNA, 11 bp, Homo sapiens
gtcagctgtta

SEQ ID NO: 5778700 - DNA, 13 bp, Homo sapiens
gtcagcttcccaa

SEQ ID NO: 5778701 - DNA, 13 bp, Homo sapiens
gtcagcttctccc

SEQ ID NO: 5778702 - DNA, 21 bp, Homo sapiens
gtcagcttctcccaagcccac

SEQ ID NO: 5778703 - DNA, 20 bp, Homo sapiens
gtcagcttgctgccctaggc

SEQ ID NO: 5778704 - DNA, 13 bp, Homo sapiens
gtcagctttcaga

SEQ ID NO: 5778705 - DNA, 14 bp, Homo sapiens
gtcagctttcagag

SEQ ID NO: 5778706 - DNA, 21 bp, Homo sapiens
gtcagctttcagagccagtga

SEQ ID NO: 5778707 - DNA, 17 bp, Homo sapiens
gtcagctttgccttcca

SEQ ID NO: 5778708 - DNA, 23 bp, Homo sapiens
gtcagctttgccttccacgctgt

SEQ ID NO: 5778709 - DNA, 19 bp, Homo sapiens
gtcagcttttgttgtttat

SEQ ID NO: 5778710 - DNA, 17 bp, Homo sapiens
gtcaggaacagaaggat

SEQ ID NO: 5778711 - DNA, 20 bp, Homo sapiens
gtcaggaacagtggctgggt

SEQ ID NO: 5778712 - DNA, 22 bp, Homo sapiens
gtcaggaacagtggctgggtgg

SEQ ID NO: 5778713 - DNA, 15 bp, Homo sapiens
gtcaggaagaaatca

SEQ ID NO: 5778714 - DNA, 17 bp, Homo sapiens
gtcaggaaggatgagca

SEQ ID NO: 5778715 - DNA, 18 bp, Homo sapiens
gtcaggaaggatgagcat

SEQ ID NO: 5778716 - DNA, 14 bp, Homo sapiens
gtcaggacacatcg

SEQ ID NO: 5778717 - DNA, 14 bp, Homo sapiens
gtcaggaccaggac

SEQ ID NO: 5778718 - DNA, 21 bp, Homo sapiens
gtcaggaccaggacccaggga

SEQ ID NO: 5778719 - DNA, 15 bp, Homo sapiens
gtcaggacctggctt

SEQ ID NO: 5778720 - DNA, 21 bp, Homo sapiens
gtcaggacggctcctcagagc

SEQ ID NO: 5778721 - DNA, 15 bp, Homo sapiens
gtcaggagagcagcg

SEQ ID NO: 5778722 - DNA, 20 bp, Homo sapiens
gtcaggaggtgcctgagagc

SEQ ID NO: 5778723 - DNA, 18 bp, Homo sapiens
gtcaggagtccaagacca

SEQ ID NO: 5778724 - DNA, 19 bp, Homo sapiens
gtcaggagtccaagaccag

SEQ ID NO: 5778725 - DNA, 19 bp, Homo sapiens
gtcaggagttagaggccag

SEQ ID NO: 5778726 - DNA, 23 bp, Homo sapiens
gtcaggagttagaggccagcctg

SEQ ID NO: 5778727 - DNA, 22 bp, Homo sapiens
gtcaggagttcaagaccagcct

SEQ ID NO: 5778728 - DNA, 22 bp, Homo sapiens
gtcaggagttcgagaccagcct

SEQ ID NO: 5778729 - DNA, 22 bp, Homo sapiens
gtcaggagttcgagagcagcct

SEQ ID NO: 5778730 - DNA, 21 bp, Homo sapiens
gtcaggagttttactgcctgt

SEQ ID NO: 5778731 - DNA, 21 bp, Homo sapiens
gtcaggatgcacatttctgga

SEQ ID NO: 5778732 - DNA, 23 bp, Homo sapiens
gtcaggattgcaggtgcctggct

SEQ ID NO: 5778733 - DNA, 18 bp, Homo sapiens
gtcaggattgcgagagat

SEQ ID NO: 5778734 - DNA, 21 bp, Homo sapiens
gtcaggattgcgagagatgtg

SEQ ID NO: 5778735 - DNA, 16 bp, Homo sapiens
gtcaggcaatgccctg

SEQ ID NO: 5778736 - DNA, 14 bp, Homo sapiens
gtcaggcaattgat

SEQ ID NO: 5778737 - DNA, 15 bp, Homo sapiens
gtcaggcaattgatt

SEQ ID NO: 5778738 - DNA, 17 bp, Homo sapiens
gtcaggcacgtctcctg

SEQ ID NO: 5778739 - DNA, 19 bp, Homo sapiens
gtcaggcacgtctcctgct

SEQ ID NO: 5778740 - DNA, 21 bp, Homo sapiens
gtcaggcacgtctcctgctgc

SEQ ID NO: 5778741 - DNA, 18 bp, Homo sapiens
gtcaggcactgggcatga

SEQ ID NO: 5778742 - DNA, 21 bp, Homo sapiens
gtcaggccacagcccctggca

SEQ ID NO: 5778743 - DNA, 22 bp, Homo sapiens
gtcaggccacagcccctggcac

SEQ ID NO: 5778744 - DNA, 15 bp, Homo sapiens
gtcaggccacggcag

SEQ ID NO: 5778745 - DNA, 18 bp, Homo sapiens
gtcaggccacggcagcct

SEQ ID NO: 5778746 - DNA, 12 bp, Homo sapiens
gtcaggccaggt

SEQ ID NO: 5778747 - DNA, 13 bp, Homo sapiens
gtcaggcccagcc

SEQ ID NO: 5778748 - DNA, 16 bp, Homo sapiens
gtcaggcccagcctct

SEQ ID NO: 5778749 - DNA, 19 bp, Homo sapiens
gtcaggcccagcctctctg

SEQ ID NO: 5778750 - DNA, 17 bp, Homo sapiens
gtcaggcccccagtggg

SEQ ID NO: 5778751 - DNA, 18 bp, Homo sapiens
gtcaggcccccagtggga

SEQ ID NO: 5778752 - DNA, 17 bp, Homo sapiens
gtcaggcccgtcagcat

SEQ ID NO: 5778753 - DNA, 23 bp, Homo sapiens
gtcaggcccgtcggagctgcctg

SEQ ID NO: 5778754 - DNA, 14 bp, Homo sapiens
gtcaggccctctgc

SEQ ID NO: 5778755 - DNA, 16 bp, Homo sapiens
gtcaggccctctgcct

SEQ ID NO: 5778756 - DNA, 21 bp, Homo sapiens
gtcaggccctgactcctctgg

SEQ ID NO: 5778757 - DNA, 21 bp, Homo sapiens
gtcaggcccttattttcaaga

SEQ ID NO: 5778758 - DNA, 22 bp, Homo sapiens
gtcaggcccttattttcaagaa

SEQ ID NO: 5778759 - DNA, 15 bp, Homo sapiens
gtcaggccgggcaga

SEQ ID NO: 5778760 - DNA, 19 bp, Homo sapiens
gtcaggccgggcagagcac

SEQ ID NO: 5778761 - DNA, 16 bp, Homo sapiens
gtcaggcctggcctca

SEQ ID NO: 5778762 - DNA, 20 bp, Homo sapiens
gtcaggcctgggcaggaccc

SEQ ID NO: 5778763 - DNA, 16 bp, Homo sapiens
gtcaggcggagctgct

SEQ ID NO: 5778764 - DNA, 19 bp, Homo sapiens
gtcaggcggggtgctgtgg

SEQ ID NO: 5778765 - DNA, 22 bp, Homo sapiens
gtcaggctacaggtgccccacc

SEQ ID NO: 5778766 - DNA, 16 bp, Homo sapiens
gtcaggctagctgtgc

SEQ ID NO: 5778767 - DNA, 14 bp, Homo sapiens
gtcaggctctctgg

SEQ ID NO: 5778768 - DNA, 21 bp, Homo sapiens
gtcaggctctgaatctctcaa

SEQ ID NO: 5778769 - DNA, 12 bp, Homo sapiens
gtcaggctctgg

SEQ ID NO: 5778770 - DNA, 15 bp, Homo sapiens
gtcaggctctggccc

SEQ ID NO: 5778771 - DNA, 16 bp, Homo sapiens
gtcaggctctggccct

SEQ ID NO: 5778772 - DNA, 13 bp, Homo sapiens
gtcaggctgccag

SEQ ID NO: 5778773 - DNA, 14 bp, Homo sapiens
gtcaggctgctggc

SEQ ID NO: 5778774 - DNA, 17 bp, Homo sapiens
gtcaggctgctggcgcc

SEQ ID NO: 5778775 - DNA, 20 bp, Homo sapiens
gtcaggctgctggcgcctct

SEQ ID NO: 5778776 - DNA, 22 bp, Homo sapiens
gtcaggctgctggcgcctctgc

SEQ ID NO: 5778777 - DNA, 12 bp, Homo sapiens
gtcaggctggga

SEQ ID NO: 5778778 - DNA, 17 bp, Homo sapiens
gtcaggctgggcagccc

SEQ ID NO: 5778779 - DNA, 13 bp, Homo sapiens
gtcaggctggtct

SEQ ID NO: 5778780 - DNA, 17 bp, Homo sapiens
gtcagggacagcagcct

SEQ ID NO: 5778781 - DNA, 16 bp, Homo sapiens
gtcagggaccaaggac

SEQ ID NO: 5778782 - DNA, 20 bp, Homo sapiens
gtcagggagaggtcaccagc

SEQ ID NO: 5778783 - DNA, 21 bp, Homo sapiens
gtcagggagaggtcaccagct

SEQ ID NO: 5778784 - DNA, 12 bp, Homo sapiens
gtcagggagggc

SEQ ID NO: 5778785 - DNA, 18 bp, Homo sapiens
gtcagggaggggcaacca

SEQ ID NO: 5778786 - DNA, 19 bp, Homo sapiens
gtcagggagtgctggctca

SEQ ID NO: 5778787 - DNA, 17 bp, Homo sapiens
gtcagggagtgttccct

SEQ ID NO: 5778788 - DNA, 18 bp, Homo sapiens
gtcagggcacagctgccc

SEQ ID NO: 5778789 - DNA, 21 bp, Homo sapiens
gtcagggcacagctgccctgc

SEQ ID NO: 5778790 - DNA, 23 bp, Homo sapiens
gtcagggcagtggccaagcctgc

SEQ ID NO: 5778791 - DNA, 16 bp, Homo sapiens
gtcagggccagactgg

SEQ ID NO: 5778792 - DNA, 19 bp, Homo sapiens
gtcagggcccaagtccctg

SEQ ID NO: 5778793 - DNA, 14 bp, Homo sapiens
gtcagggcccagag

SEQ ID NO: 5778794 - DNA, 20 bp, Homo sapiens
gtcagggcccagaggctgag

SEQ ID NO: 5778795 - DNA, 23 bp, Homo sapiens
gtcagggcggggctggccagctg

SEQ ID NO: 5778796 - DNA, 13 bp, Homo sapiens
gtcagggctcaga

SEQ ID NO: 5778797 - DNA, 17 bp, Homo sapiens
gtcaggggcagctgacc

SEQ ID NO: 5778798 - DNA, 16 bp, Homo sapiens
gtcaggggctctgtgt

SEQ ID NO: 5778799 - DNA, 17 bp, Homo sapiens
gtcaggggtgacacaga

SEQ ID NO: 5778800 - DNA, 18 bp, Homo sapiens
gtcaggggtgacacagac

SEQ ID NO: 5778801 - DNA, 20 bp, Homo sapiens
gtcaggggtgacacagactc

SEQ ID NO: 5778802 - DNA, 21 bp, Homo sapiens
gtcaggggtgacacagactca

SEQ ID NO: 5778803 - DNA, 20 bp, Homo sapiens
gtcaggggtttgcttacagt

SEQ ID NO: 5778804 - DNA, 14 bp, Homo sapiens
gtcagggtggctgg

SEQ ID NO: 5778805 - DNA, 18 bp, Homo sapiens
gtcagggtgtgaggccac

SEQ ID NO: 5778806 - DNA, 15 bp, Homo sapiens
gtcagggttggaaag

SEQ ID NO: 5778807 - DNA, 17 bp, Homo sapiens
gtcaggtaatatacctg

SEQ ID NO: 5778808 - DNA, 13 bp, Homo sapiens
gtcaggtcccagc

SEQ ID NO: 5778809 - DNA, 14 bp, Homo sapiens
gtcaggtcccagcg

SEQ ID NO: 5778810 - DNA, 15 bp, Homo sapiens
gtcaggtcccagcga

SEQ ID NO: 5778811 - DNA, 17 bp, Homo sapiens
gtcaggtcccagcgagc

SEQ ID NO: 5778812 - DNA, 22 bp, Homo sapiens
gtcaggtcccagcgagccacag

SEQ ID NO: 5778813 - DNA, 20 bp, Homo sapiens
gtcaggtggactctgggatg

SEQ ID NO: 5778814 - DNA, 15 bp, Homo sapiens
gtcaggtggctgtgg

SEQ ID NO: 5778815 - DNA, 16 bp, Homo sapiens
gtcaggtggggcagct

SEQ ID NO: 5778816 - DNA, 17 bp, Homo sapiens
gtcaggtggttaccagg

SEQ ID NO: 5778817 - DNA, 18 bp, Homo sapiens
gtcaggtggttaccaggc

SEQ ID NO: 5778818 - DNA, 21 bp, Homo sapiens
gtcaggtggttaccaggcact

SEQ ID NO: 5778819 - DNA, 17 bp, Homo sapiens
gtcaggtgtcaggcccg

SEQ ID NO: 5778820 - DNA, 15 bp, Homo sapiens
gtcaggtgtcgaggc

SEQ ID NO: 5778821 - DNA, 17 bp, Homo sapiens
gtcaggtgtcgaggcca

SEQ ID NO: 5778822 - DNA, 19 bp, Homo sapiens
gtcaggttatactcctcct

SEQ ID NO: 5778823 - DNA, 13 bp, Homo sapiens
gtcaggtttgagt

SEQ ID NO: 5778824 - DNA, 16 bp, Homo sapiens
gtcagtaccttcaaac

SEQ ID NO: 5778825 - DNA, 22 bp, Homo sapiens
gtcagtactaaggtgactttct

SEQ ID NO: 5778826 - DNA, 15 bp, Homo sapiens
gtcagtagtgctaat

SEQ ID NO: 5778827 - DNA, 20 bp, Homo sapiens
gtcagtagtgctaatgcatt

SEQ ID NO: 5778828 - DNA, 23 bp, Homo sapiens
gtcagtatcaggcctgccagacg

SEQ ID NO: 5778829 - DNA, 14 bp, Homo sapiens
gtcagtatccaggc

SEQ ID NO: 5778830 - DNA, 17 bp, Homo sapiens
gtcagtatctgtagcta

SEQ ID NO: 5778831 - DNA, 17 bp, Homo sapiens
gtcagtatgtggaagtg

SEQ ID NO: 5778832 - DNA, 14 bp, Homo sapiens
gtcagtattgtttt

SEQ ID NO: 5778833 - DNA, 16 bp, Homo sapiens
gtcagtattgttttgg

SEQ ID NO: 5778834 - DNA, 20 bp, Homo sapiens
gtcagtcacaaaccagcctg

SEQ ID NO: 5778835 - DNA, 16 bp, Homo sapiens
gtcagtcacagccacc

SEQ ID NO: 5778836 - DNA, 15 bp, Homo sapiens
gtcagtcccactgca

SEQ ID NO: 5778837 - DNA, 17 bp, Homo sapiens
gtcagtcccactgcacc

SEQ ID NO: 5778838 - DNA, 14 bp, Homo sapiens
gtcagtcgcctttc

SEQ ID NO: 5778839 - DNA, 15 bp, Homo sapiens
gtcagtctttgctca

SEQ ID NO: 5778840 - DNA, 18 bp, Homo sapiens
gtcagtctttgctcagtg

SEQ ID NO: 5778841 - DNA, 16 bp, Homo sapiens
gtcagtctttttctgt

SEQ ID NO: 5778842 - DNA, 23 bp, Homo sapiens
gtcagtgaggcccagggagaggc

SEQ ID NO: 5778843 - DNA, 22 bp, Homo sapiens
gtcagtgccgccgcctcgccca

SEQ ID NO: 5778844 - DNA, 23 bp, Homo sapiens
gtcagtgctataaatgccagagc

SEQ ID NO: 5778845 - DNA, 13 bp, Homo sapiens
gtcagtggccagg

SEQ ID NO: 5778846 - DNA, 15 bp, Homo sapiens
gtcagtggccaggtg

SEQ ID NO: 5778847 - DNA, 15 bp, Homo sapiens
gtcagtggctctttt

SEQ ID NO: 5778848 - DNA, 22 bp, Homo sapiens
gtcagtggtccacatcccggga

SEQ ID NO: 5778849 - DNA, 20 bp, Homo sapiens
gtcagtggtttctacttccc

SEQ ID NO: 5778850 - DNA, 16 bp, Homo sapiens
gtcagtgtactctgag

SEQ ID NO: 5778851 - DNA, 17 bp, Homo sapiens
gtcagtgtagacacagg

SEQ ID NO: 5778852 - DNA, 20 bp, Homo sapiens
gtcagtgtagacctgagctg

SEQ ID NO: 5778853 - DNA, 16 bp, Homo sapiens
gtcagtgtagatcaac

SEQ ID NO: 5778854 - DNA, 24 bp, Homo sapiens
gtcagtgtccaaagcagggtctgg

SEQ ID NO: 5778855 - DNA, 22 bp, Homo sapiens
gtcagtgtcgtttatattgtag

SEQ ID NO: 5778856 - DNA, 16 bp, Homo sapiens
gtcagtgtgccaccct

SEQ ID NO: 5778857 - DNA, 19 bp, Homo sapiens
gtcagtgtgccaccctctg

SEQ ID NO: 5778858 - DNA, 23 bp, Homo sapiens
gtcagtgtgccaccctctgcagg

SEQ ID NO: 5778859 - DNA, 21 bp, Homo sapiens
gtcagtgttgaattttattga

SEQ ID NO: 5778860 - DNA, 22 bp, Homo sapiens
gtcagttcttggtgctctgtgt

SEQ ID NO: 5778861 - DNA, 15 bp, Homo sapiens
gtcagttgataaaag

SEQ ID NO: 5778862 - DNA, 13 bp, Homo sapiens
gtcagttgtaata

SEQ ID NO: 5778863 - DNA, 23 bp, Homo sapiens
gtcagttgtacgtaatgtattta

SEQ ID NO: 5778864 - DNA, 13 bp, Homo sapiens
gtcagttgtatca

SEQ ID NO: 5778865 - DNA, 21 bp, Homo sapiens
gtcagttgttatttattgaaa

SEQ ID NO: 5778866 - DNA, 16 bp, Homo sapiens
gtcagtttcctctcct

SEQ ID NO: 5778867 - DNA, 13 bp, Homo sapiens
gtcagtttgtgaa

SEQ ID NO: 5778868 - DNA, 15 bp, Homo sapiens
gtcagttttcacaga

SEQ ID NO: 5778869 - DNA, 19 bp, Homo sapiens
gtcagttttcacagaggcg

SEQ ID NO: 5778870 - DNA, 16 bp, Homo sapiens
gtcagtttttcctccc

SEQ ID NO: 5778871 - DNA, 22 bp, Homo sapiens
gtcataaaatgctattttaaaa

SEQ ID NO: 5778872 - DNA, 21 bp, Homo sapiens
gtcataaagattataatatgt

SEQ ID NO: 5778873 - DNA, 15 bp, Homo sapiens
gtcatgtgcctctgt

SEQ ID NO: 5778874 - DNA, 18 bp, Homo sapiens
gtcatgtgcgaacacagt

SEQ ID NO: 5778875 - DNA, 12 bp, Homo sapiens
gtcatgtgtata

SEQ ID NO: 5778876 - DNA, 17 bp, Homo sapiens
gtcatgtgtatgagaag

SEQ ID NO: 5778877 - DNA, 16 bp, Homo sapiens
gtcatgtgtgcatgtg

SEQ ID NO: 5778878 - DNA, 20 bp, Homo sapiens
gtcatgtgtgcatgtgagca

SEQ ID NO: 5778879 - DNA, 15 bp, Homo sapiens
gtcatgttatgcagt

SEQ ID NO: 5778880 - DNA, 20 bp, Homo sapiens
gtcatgttatgcagtgaact

SEQ ID NO: 5778881 - DNA, 15 bp, Homo sapiens
gtcatgttggccagg

SEQ ID NO: 5778882 - DNA, 18 bp, Homo sapiens
gtcatgttggccaggctg

SEQ ID NO: 5778883 - DNA, 13 bp, Homo sapiens
gtcatgtttatct

SEQ ID NO: 5778884 - DNA, 20 bp, Homo sapiens
gtcatgttttaaatgtacag

SEQ ID NO: 5778885 - DNA, 21 bp, Homo sapiens
gtcattaaaacagaagcaaat

SEQ ID NO: 5778886 - DNA, 13 bp, Homo sapiens
gtcattaaactgg

SEQ ID NO: 5778887 - DNA, 12 bp, Homo sapiens
gtcattaaaggt

SEQ ID NO: 5778888 - DNA, 16 bp, Homo sapiens
gtcattaaagtgcact

SEQ ID NO: 5778889 - DNA, 11 bp, Homo sapiens
gtcattaaatg

SEQ ID NO: 5778890 - DNA, 13 bp, Homo sapiens
gtcattaacccat

SEQ ID NO: 5778891 - DNA, 22 bp, Homo sapiens
gtcattacaaaaaaacacgtgg

SEQ ID NO: 5778892 - DNA, 14 bp, Homo sapiens
gtcattactgcctt

SEQ ID NO: 5778893 - DNA, 17 bp, Homo sapiens
gtcattacttctgagcc

SEQ ID NO: 5778894 - DNA, 13 bp, Homo sapiens
gtcattatattct

SEQ ID NO: 5778895 - DNA, 18 bp, Homo sapiens
gtcattatattctaatta

SEQ ID NO: 5778896 - DNA, 21 bp, Homo sapiens
gtcattatgagaggcaatgat

SEQ ID NO: 5778897 - DNA, 21 bp, Homo sapiens
gtcattatgggttaggcatta

SEQ ID NO: 5778898 - DNA, 15 bp, Homo sapiens
gtcattatgtagaaa

SEQ ID NO: 5778899 - DNA, 17 bp, Homo sapiens
gtcattatgttaatatt

SEQ ID NO: 5778900 - DNA, 17 bp, Homo sapiens
gtcattatttcagtgtg

SEQ ID NO: 5778901 - DNA, 21 bp, Homo sapiens
gtcattcagatatgattcaaa

SEQ ID NO: 5778902 - DNA, 22 bp, Homo sapiens
gtcattcaggtgacctcctgca

SEQ ID NO: 5778903 - DNA, 14 bp, Homo sapiens
gtcattcagttcta

SEQ ID NO: 5778904 - DNA, 18 bp, Homo sapiens
gtcattcagttctaggcc

SEQ ID NO: 5778905 - DNA, 16 bp, Homo sapiens
gtcattcatatttgtc

SEQ ID NO: 5778906 - DNA, 12 bp, Homo sapiens
gtcattccagag

SEQ ID NO: 5778907 - DNA, 21 bp, Homo sapiens
gtcattcccattccttttcgt

SEQ ID NO: 5778908 - DNA, 17 bp, Homo sapiens
gtcattcctgtcaacaa

SEQ ID NO: 5778909 - DNA, 16 bp, Homo sapiens
gtcattcgttctgtgg

SEQ ID NO: 5778910 - DNA, 11 bp, Homo sapiens
gtcattctcat

SEQ ID NO: 5778911 - DNA, 16 bp, Homo sapiens
gtcattctcatccaaa

SEQ ID NO: 5778912 - DNA, 16 bp, Homo sapiens
gtcattctgcctgccc

SEQ ID NO: 5778913 - DNA, 22 bp, Homo sapiens
gtcattcttacaattgcactgc

SEQ ID NO: 5778914 - DNA, 13 bp, Homo sapiens
gtcattctttatt

SEQ ID NO: 5778915 - DNA, 17 bp, Homo sapiens
gtcattgacctctcagg

SEQ ID NO: 5778916 - DNA, 18 bp, Homo sapiens
gtcattgacctctcaggg

SEQ ID NO: 5778917 - DNA, 15 bp, Homo sapiens
gtcattgagggacca

SEQ ID NO: 5778918 - DNA, 19 bp, Homo sapiens
gtcattgcacataagcttc

SEQ ID NO: 5778919 - DNA, 12 bp, Homo sapiens
gtcattgccatg

SEQ ID NO: 5778920 - DNA, 21 bp, Homo sapiens
gtcattgcccacttctgtgta

SEQ ID NO: 5778921 - DNA, 11 bp, Homo sapiens
gtcattgcctt

SEQ ID NO: 5778922 - DNA, 20 bp, Homo sapiens
gtcattgccttgggcctggg

SEQ ID NO: 5778923 - DNA, 13 bp, Homo sapiens
gtcattgctaaaa

SEQ ID NO: 5778924 - DNA, 14 bp, Homo sapiens
gtcattgctgctgc

SEQ ID NO: 5778925 - DNA, 15 bp, Homo sapiens
gtcattgctgctgct

SEQ ID NO: 5778926 - DNA, 14 bp, Homo sapiens
gtcattgcttcttc

SEQ ID NO: 5778927 - DNA, 14 bp, Homo sapiens
gtcattggcaaagt

SEQ ID NO: 5778928 - DNA, 12 bp, Homo sapiens
gtcattgtcata

SEQ ID NO: 5778929 - DNA, 15 bp, Homo sapiens
gtcattgtccagctg

SEQ ID NO: 5778930 - DNA, 16 bp, Homo sapiens
gtcattgtccagctgg

SEQ ID NO: 5778931 - DNA, 14 bp, Homo sapiens
gtcattgtgtaagg

SEQ ID NO: 5778932 - DNA, 13 bp, Homo sapiens
gtcattgttctcc

SEQ ID NO: 5778933 - DNA, 14 bp, Homo sapiens
gtcatttaaatgtg

SEQ ID NO: 5778934 - DNA, 20 bp, Homo sapiens
gtcatttaccctggtggagg

SEQ ID NO: 5778935 - DNA, 18 bp, Homo sapiens
gtcatttaggatccatgc

SEQ ID NO: 5778936 - DNA, 14 bp, Homo sapiens
gtcatttataaaac

SEQ ID NO: 5778937 - DNA, 21 bp, Homo sapiens
gtcatttatgtgtcagttcat

SEQ ID NO: 5778938 - DNA, 21 bp, Homo sapiens
gtcatttcattccattgccta

SEQ ID NO: 5778939 - DNA, 14 bp, Homo sapiens
gtcatttcccccaa

SEQ ID NO: 5778940 - DNA, 17 bp, Homo sapiens
gtcatttcccccaaagg

SEQ ID NO: 5778941 - DNA, 17 bp, Homo sapiens
gtcatttcgttccctga

SEQ ID NO: 5778942 - DNA, 15 bp, Homo sapiens
gtcatttctcttttt

SEQ ID NO: 5778943 - DNA, 13 bp, Homo sapiens
gtcatttctttta

SEQ ID NO: 5778944 - DNA, 15 bp, Homo sapiens
gtcatttgcaagctg

SEQ ID NO: 5778945 - DNA, 13 bp, Homo sapiens
gtcatttgctaat

SEQ ID NO: 5778946 - DNA, 16 bp, Homo sapiens
gtcatttgctctgcct

SEQ ID NO: 5778947 - DNA, 21 bp, Homo sapiens
gtcatttgctgagcatgtact

SEQ ID NO: 5778948 - DNA, 22 bp, Homo sapiens
gtcatttgctgtgaactgaaat

SEQ ID NO: 5778949 - DNA, 17 bp, Homo sapiens
gtcatttggtggctcta

SEQ ID NO: 5778950 - DNA, 16 bp, Homo sapiens
gtcatttgttaaaata

SEQ ID NO: 5778951 - DNA, 17 bp, Homo sapiens
gtcatttgttgtgatgt

SEQ ID NO: 5778952 - DNA, 21 bp, Homo sapiens
gtcatttgttgtgatgtcttt

SEQ ID NO: 5778953 - DNA, 15 bp, Homo sapiens
gtcattttaaaatct

SEQ ID NO: 5778954 - DNA, 16 bp, Homo sapiens
gtcattttaaaatctg

SEQ ID NO: 5778955 - DNA, 17 bp, Homo sapiens
gtcattttaaaatctga

SEQ ID NO: 5778956 - DNA, 21 bp, Homo sapiens
gtcattttaaaatctgattta

SEQ ID NO: 5778957 - DNA, 20 bp, Homo sapiens
gtcattttcagatccttcca

SEQ ID NO: 5778958 - DNA, 11 bp, Homo sapiens
gtcattttcat

SEQ ID NO: 5778959 - DNA, 20 bp, Homo sapiens
gtcattttcctttctgtatt

SEQ ID NO: 5778960 - DNA, 13 bp, Homo sapiens
gtcattttctctt

SEQ ID NO: 5778961 - DNA, 14 bp, Homo sapiens
gtcattttgaagct

SEQ ID NO: 5778962 - DNA, 16 bp, Homo sapiens
gtcattttgactggct

SEQ ID NO: 5778963 - DNA, 19 bp, Homo sapiens
gtcattttgcactgtaaat

SEQ ID NO: 5778964 - DNA, 19 bp, Homo sapiens
gtcattttggcatctgcaa

SEQ ID NO: 5778965 - DNA, 17 bp, Homo sapiens
gtcattttggtctaagg

SEQ ID NO: 5778966 - DNA, 13 bp, Homo sapiens
gtcattttgtaat

SEQ ID NO: 5778967 - DNA, 20 bp, Homo sapiens
gtcattttgtgttgaagagc

SEQ ID NO: 5778968 - DNA, 21 bp, Homo sapiens
gtcatttttaacagcatgctg

SEQ ID NO: 5778969 - DNA, 19 bp, Homo sapiens
gtcatttttaactactgta

SEQ ID NO: 5778970 - DNA, 17 bp, Homo sapiens
gtcatttttaatgtatc

SEQ ID NO: 5778971 - DNA, 18 bp, Homo sapiens
gtcatttttaatgtatct

SEQ ID NO: 5778972 - DNA, 24 bp, Homo sapiens
gtcatttttaatgtatctatttgt

SEQ ID NO: 5778973 - DNA, 20 bp, Homo sapiens
gtcatttttcagacctttta

SEQ ID NO: 5778974 - DNA, 12 bp, Homo sapiens
gtcatttttgta

SEQ ID NO: 5778975 - DNA, 17 bp, Homo sapiens
gtcattttttacttgaa

SEQ ID NO: 5778976 - DNA, 19 bp, Homo sapiens
gtcattttttttatattgc

SEQ ID NO: 5778977 - DNA, 23 bp, Homo sapiens
gtcattttttttctttgaataaa

SEQ ID NO: 5778978 - DNA, 18 bp, Homo sapiens
gtccaaaaaaaggaaaaa

SEQ ID NO: 5778979 - DNA, 17 bp, Homo sapiens
gtccaaaaccgccagct

SEQ ID NO: 5778980 - DNA, 21 bp, Homo sapiens
gtccaaaaccgccagctctgt

SEQ ID NO: 5778981 - DNA, 21 bp, Homo sapiens
gtccaaaataaaacctcagct

SEQ ID NO: 5778982 - DNA, 14 bp, Homo sapiens
gtccaaacccttca

SEQ ID NO: 5778983 - DNA, 21 bp, Homo sapiens
gtccaaactgcctaagccctc

SEQ ID NO: 5778984 - DNA, 16 bp, Homo sapiens
gtccaaagaggctgcc

SEQ ID NO: 5778985 - DNA, 19 bp, Homo sapiens
gtccaaagaggctgcccct

SEQ ID NO: 5778986 - DNA, 20 bp, Homo sapiens
gtccaaaggagtgcatggcc

SEQ ID NO: 5778987 - DNA, 15 bp, Homo sapiens
gtccaaataaaaact

SEQ ID NO: 5778988 - DNA, 18 bp, Homo sapiens
gtccaaataaaaactaaa

SEQ ID NO: 5778989 - DNA, 22 bp, Homo sapiens
gtccaaatgtcctccagaagcc

SEQ ID NO: 5778990 - DNA, 18 bp, Homo sapiens
gtccaaatgtttacaggg

SEQ ID NO: 5778991 - DNA, 16 bp, Homo sapiens
gtccaaattctttatt

SEQ ID NO: 5778992 - DNA, 14 bp, Homo sapiens
gtccaacaagaatg

SEQ ID NO: 5778993 - DNA, 16 bp, Homo sapiens
gtccaaccagactttg

SEQ ID NO: 5778994 - DNA, 14 bp, Homo sapiens
gtccaacccagcct

SEQ ID NO: 5778995 - DNA, 17 bp, Homo sapiens
gtccaacctaacccctt

SEQ ID NO: 5778996 - DNA, 20 bp, Homo sapiens
gtccaacctaacccctttcc

SEQ ID NO: 5778997 - DNA, 16 bp, Homo sapiens
gtccaacctgcctgtg

SEQ ID NO: 5778998 - DNA, 18 bp, Homo sapiens
gtccaacgtggggcagca

SEQ ID NO: 5778999 - DNA, 17 bp, Homo sapiens
gtccaactcacttccag

SEQ ID NO: 5779000 - DNA, 12 bp, Homo sapiens
gtccaactccag

SEQ ID NO: 5779001 - DNA, 14 bp, Homo sapiens
gtccaactccagta

SEQ ID NO: 5779002 - DNA, 20 bp, Homo sapiens
gtccaagaactctaaccagt

SEQ ID NO: 5779003 - DNA, 15 bp, Homo sapiens
gtccaagaagcccag

SEQ ID NO: 5779004 - DNA, 18 bp, Homo sapiens
gtccaagaagcccaggaa

SEQ ID NO: 5779005 - DNA, 22 bp, Homo sapiens
gtccaagaatccacatttctaa

SEQ ID NO: 5779006 - DNA, 23 bp, Homo sapiens
gtccaagaatccacatttctaaa

SEQ ID NO: 5779007 - DNA, 21 bp, Homo sapiens
gtccaagacagggctcatttt

SEQ ID NO: 5779008 - DNA, 13 bp, Homo sapiens
gtccaagagacat

SEQ ID NO: 5779009 - DNA, 14 bp, Homo sapiens
gtccaagagacatg

SEQ ID NO: 5779010 - DNA, 21 bp, Homo sapiens
gtccaagcaacagcctttgaa

SEQ ID NO: 5779011 - DNA, 12 bp, Homo sapiens
gtccaagcagag

SEQ ID NO: 5779012 - DNA, 13 bp, Homo sapiens
gtccaaggccagt

SEQ ID NO: 5779013 - DNA, 16 bp, Homo sapiens
gtccaagggacagccc

SEQ ID NO: 5779014 - DNA, 17 bp, Homo sapiens
gtccaagggacagccca

SEQ ID NO: 5779015 - DNA, 16 bp, Homo sapiens
gtccaagtgtgtgtgc

SEQ ID NO: 5779016 - DNA, 17 bp, Homo sapiens
gtccaagtgtgtgtgcg

SEQ ID NO: 5779017 - DNA, 20 bp, Homo sapiens
gtccaagttcttcacctcta

SEQ ID NO: 5779018 - DNA, 15 bp, Homo sapiens
gtccaatacacgcgt

SEQ ID NO: 5779019 - DNA, 12 bp, Homo sapiens
gtccaatatttg

SEQ ID NO: 5779020 - DNA, 20 bp, Homo sapiens
gtccaatcacccccaggacc

SEQ ID NO: 5779021 - DNA, 14 bp, Homo sapiens
gtccaatccagcct

SEQ ID NO: 5779022 - DNA, 21 bp, Homo sapiens
gtccaatctgcaagtcccagg

SEQ ID NO: 5779023 - DNA, 21 bp, Homo sapiens
gtccaatgaagataaatgctt

SEQ ID NO: 5779024 - DNA, 16 bp, Homo sapiens
gtccaatgagctttct

SEQ ID NO: 5779025 - DNA, 18 bp, Homo sapiens
gtccaatggctgtaaact

SEQ ID NO: 5779026 - DNA, 19 bp, Homo sapiens
gtccaatggctgtaaacta

SEQ ID NO: 5779027 - DNA, 21 bp, Homo sapiens
gtccaattaatgaagttgatt

SEQ ID NO: 5779028 - DNA, 22 bp, Homo sapiens
gtccaatttctattaaaggttc

SEQ ID NO: 5779029 - DNA, 14 bp, Homo sapiens
gtccaatttctgct

SEQ ID NO: 5779030 - DNA, 16 bp, Homo sapiens
gtccaatttctgctgt

SEQ ID NO: 5779031 - DNA, 18 bp, Homo sapiens
gtccaattttaatttagt

SEQ ID NO: 5779032 - DNA, 15 bp, Homo sapiens
gtccacaaatgtcct

SEQ ID NO: 5779033 - DNA, 18 bp, Homo sapiens
gtccacaaatgtcctcag

SEQ ID NO: 5779034 - DNA, 13 bp, Homo sapiens
gtccacagagagg

SEQ ID NO: 5779035 - DNA, 17 bp, Homo sapiens
gtccacagatgcctcca

SEQ ID NO: 5779036 - DNA, 18 bp, Homo sapiens
gtccacagccatgccctt

SEQ ID NO: 5779037 - DNA, 13 bp, Homo sapiens
gtccacaggggca

SEQ ID NO: 5779038 - DNA, 15 bp, Homo sapiens
gtccacaggggcagg

SEQ ID NO: 5779039 - DNA, 17 bp, Homo sapiens
gtccacaggggcaggcc

SEQ ID NO: 5779040 - DNA, 16 bp, Homo sapiens
gtccacaggtccaagg

SEQ ID NO: 5779041 - DNA, 17 bp, Homo sapiens
gtccacaggtccaagga

SEQ ID NO: 5779042 - DNA, 16 bp, Homo sapiens
gtccacagtctcccat

SEQ ID NO: 5779043 - DNA, 19 bp, Homo sapiens
gtccacagtctcccattct

SEQ ID NO: 5779044 - DNA, 22 bp, Homo sapiens
gtccacagtctcccattctcat

SEQ ID NO: 5779045 - DNA, 23 bp, Homo sapiens
gtccacagtgattagcctcgtct

SEQ ID NO: 5779046 - DNA, 19 bp, Homo sapiens
gtccacagtggaaccagcc

SEQ ID NO: 5779047 - DNA, 15 bp, Homo sapiens
gtccacatccccaga

SEQ ID NO: 5779048 - DNA, 16 bp, Homo sapiens
gtccacatccccagag

SEQ ID NO: 5779049 - DNA, 20 bp, Homo sapiens
gtccacatccccagagccca

SEQ ID NO: 5779050 - DNA, 21 bp, Homo sapiens
gtccacatccccagagcccag

SEQ ID NO: 5779051 - DNA, 17 bp, Homo sapiens
gtccacatctgcctcct

SEQ ID NO: 5779052 - DNA, 18 bp, Homo sapiens
gtccacatctgcctcctc

SEQ ID NO: 5779053 - DNA, 13 bp, Homo sapiens
gtccagggaagag

SEQ ID NO: 5779054 - DNA, 23 bp, Homo sapiens
gtccagggaagagaaagtgattt

SEQ ID NO: 5779055 - DNA, 21 bp, Homo sapiens
gtccagggcccatgtagctgg

SEQ ID NO: 5779056 - DNA, 14 bp, Homo sapiens
gtccagggcctgac

SEQ ID NO: 5779057 - DNA, 16 bp, Homo sapiens
gtccagggcctgacac

SEQ ID NO: 5779058 - DNA, 17 bp, Homo sapiens
gtccagggcgggagtgg

SEQ ID NO: 5779059 - DNA, 11 bp, Homo sapiens
gtccagggctt

SEQ ID NO: 5779060 - DNA, 11 bp, Homo sapiens
gtccaggggat

SEQ ID NO: 5779061 - DNA, 18 bp, Homo sapiens
gtccaggggcccctccag

SEQ ID NO: 5779062 - DNA, 18 bp, Homo sapiens
gtccaggggtctgtctgc

SEQ ID NO: 5779063 - DNA, 17 bp, Homo sapiens
gtccagggtaagctggt

SEQ ID NO: 5779064 - DNA, 16 bp, Homo sapiens
gtccagggtccagccc

SEQ ID NO: 5779065 - DNA, 19 bp, Homo sapiens
gtccagggtccagccctcc

SEQ ID NO: 5779066 - DNA, 16 bp, Homo sapiens
gtccagggtttctctg

SEQ ID NO: 5779067 - DNA, 15 bp, Homo sapiens
gtccaggtcacaggc

SEQ ID NO: 5779068 - DNA, 23 bp, Homo sapiens
gtccaggtcaccagcctgactgc

SEQ ID NO: 5779069 - DNA, 21 bp, Homo sapiens
gtccaggtcctggtggggcag

SEQ ID NO: 5779070 - DNA, 19 bp, Homo sapiens
gtccaggtcgggctcagct

SEQ ID NO: 5779071 - DNA, 22 bp, Homo sapiens
gtccaggtcgggctcagctctg

SEQ ID NO: 5779072 - DNA, 17 bp, Homo sapiens
gtccaggtctagaaggc

SEQ ID NO: 5779073 - DNA, 20 bp, Homo sapiens
gtccaggtctagaaggccag

SEQ ID NO: 5779074 - DNA, 19 bp, Homo sapiens
gtccaggtgagaacatcca

SEQ ID NO: 5779075 - DNA, 12 bp, Homo sapiens
gtccaggtgagg

SEQ ID NO: 5779076 - DNA, 18 bp, Homo sapiens
gtccaggtgaggcccaag

SEQ ID NO: 5779077 - DNA, 11 bp, Homo sapiens
gtccaggtgat

SEQ ID NO: 5779078 - DNA, 12 bp, Homo sapiens
gtccaggtgatc

SEQ ID NO: 5779079 - DNA, 17 bp, Homo sapiens
gtccaggttgatcttga

SEQ ID NO: 5779080 - DNA, 18 bp, Homo sapiens
gtccagtaagatcactgt

SEQ ID NO: 5779081 - DNA, 19 bp, Homo sapiens
gtccagtcatcctgccctg

SEQ ID NO: 5779082 - DNA, 23 bp, Homo sapiens
gtccagtcatcctgccctgcagc

SEQ ID NO: 5779083 - DNA, 15 bp, Homo sapiens
gtccagtccagtcct

SEQ ID NO: 5779084 - DNA, 17 bp, Homo sapiens
gtccagtccagtcctat

SEQ ID NO: 5779085 - DNA, 18 bp, Homo sapiens
gtccagtcctttgttgct

SEQ ID NO: 5779086 - DNA, 18 bp, Homo sapiens
gtccagtcgggaggagca

SEQ ID NO: 5779087 - DNA, 13 bp, Homo sapiens
gtccagtctgtga

SEQ ID NO: 5779088 - DNA, 16 bp, Homo sapiens
gtccagtctttttaaa

SEQ ID NO: 5779089 - DNA, 20 bp, Homo sapiens
gtccagtgaccctggagcta

SEQ ID NO: 5779090 - DNA, 17 bp, Homo sapiens
gtccagtgacctgctgg

SEQ ID NO: 5779091 - DNA, 14 bp, Homo sapiens
gtccagtgcccatt

SEQ ID NO: 5779092 - DNA, 14 bp, Homo sapiens
gtccagtgcctaca

SEQ ID NO: 5779093 - DNA, 24 bp, Homo sapiens
gtccagtgggaggtgagaccacct

SEQ ID NO: 5779094 - DNA, 16 bp, Homo sapiens
gtccagtgtcacctct

SEQ ID NO: 5779095 - DNA, 20 bp, Homo sapiens
gtccagttataagcgtattt

SEQ ID NO: 5779096 - DNA, 17 bp, Homo sapiens
gtccataacttacctct

SEQ ID NO: 5779097 - DNA, 17 bp, Homo sapiens
gtccataatgttctgct

SEQ ID NO: 5779098 - DNA, 13 bp, Homo sapiens
gtccatagagagc

SEQ ID NO: 5779099 - DNA, 15 bp, Homo sapiens
gtccatagagatgag

SEQ ID NO: 5779100 - DNA, 16 bp, Homo sapiens
gtccatagagatgagc

SEQ ID NO: 5779101 - DNA, 18 bp, Homo sapiens
gtccatatcacacacatt

SEQ ID NO: 5779102 - DNA, 16 bp, Homo sapiens
gtccatatcagacctc

SEQ ID NO: 5779103 - DNA, 17 bp, Homo sapiens
gtccatcagccaggaca

SEQ ID NO: 5779104 - DNA, 16 bp, Homo sapiens
gtccatcagtgcatga

SEQ ID NO: 5779105 - DNA, 12 bp, Homo sapiens
gtccatcccagc

SEQ ID NO: 5779106 - DNA, 13 bp, Homo sapiens
gtccatccccagt

SEQ ID NO: 5779107 - DNA, 21 bp, Homo sapiens
gtccatcccccttcttcctcc

SEQ ID NO: 5779108 - DNA, 17 bp, Homo sapiens
gtccatccccttccccc

SEQ ID NO: 5779109 - DNA, 15 bp, Homo sapiens
gtccatccgactgcc

SEQ ID NO: 5779110 - DNA, 15 bp, Homo sapiens
gtccatccgtctctg

SEQ ID NO: 5779111 - DNA, 16 bp, Homo sapiens
gtccatccgtctctgt

SEQ ID NO: 5779112 - DNA, 19 bp, Homo sapiens
gtccatccgtctctgtccg

SEQ ID NO: 5779113 - DNA, 22 bp, Homo sapiens
gtccatcctcctctccatgcaa

SEQ ID NO: 5779114 - DNA, 22 bp, Homo sapiens
gtccatctagggaatgggactg

SEQ ID NO: 5779115 - DNA, 23 bp, Homo sapiens
gtccatctcattgcggcctgttg

SEQ ID NO: 5779116 - DNA, 15 bp, Homo sapiens
gtccatctctgaaaa

SEQ ID NO: 5779117 - DNA, 16 bp, Homo sapiens
gtccatctctgaaaac

SEQ ID NO: 5779118 - DNA, 15 bp, Homo sapiens
gtccatctgacaaaa

SEQ ID NO: 5779119 - DNA, 14 bp, Homo sapiens
gtccatctgcccgc

SEQ ID NO: 5779120 - DNA, 13 bp, Homo sapiens
gtccatctgtctg

SEQ ID NO: 5779121 - DNA, 17 bp, Homo sapiens
gtccatctgtctgtcct

SEQ ID NO: 5779122 - DNA, 9 bp, Homo sapiens
gtccatctt

SEQ ID NO: 5779123 - DNA, 13 bp, Homo sapiens
gtccatcttgttt

SEQ ID NO: 5779124 - DNA, 19 bp, Homo sapiens
gtccatgaaaaacagcaga

SEQ ID NO: 5779125 - DNA, 14 bp, Homo sapiens
gtccatgcccactg

SEQ ID NO: 5779126 - DNA, 18 bp, Homo sapiens
gtccatgctaacaaagac

SEQ ID NO: 5779127 - DNA, 19 bp, Homo sapiens
gtccatgctaacaaagaca

SEQ ID NO: 5779128 - DNA, 18 bp, Homo sapiens
gtccatggaatgcttgaa

SEQ ID NO: 5779129 - DNA, 20 bp, Homo sapiens
gtccatggcaccagccccct

SEQ ID NO: 5779130 - DNA, 22 bp, Homo sapiens
gtccatggcaccagccccctgg

SEQ ID NO: 5779131 - DNA, 23 bp, Homo sapiens
gtccatgggcagagcccaaggga

SEQ ID NO: 5779132 - DNA, 18 bp, Homo sapiens
gtccatgggtctggcctg

SEQ ID NO: 5779133 - DNA, 14 bp, Homo sapiens
gtccatgtaaatac

SEQ ID NO: 5779134 - DNA, 15 bp, Homo sapiens
gtccatgtaaatact

SEQ ID NO: 5779135 - DNA, 14 bp, Homo sapiens
gtccatgtcctatg

SEQ ID NO: 5779136 - DNA, 20 bp, Homo sapiens
gtccatgtgataattgtaaa

SEQ ID NO: 5779137 - DNA, 16 bp, Homo sapiens
gtccatgtgcacccgg

SEQ ID NO: 5779138 - DNA, 15 bp, Homo sapiens
gtccatgtttctcac

SEQ ID NO: 5779139 - DNA, 14 bp, Homo sapiens
gtccattatctgct

SEQ ID NO: 5779140 - DNA, 13 bp, Homo sapiens
gtccattattcat

SEQ ID NO: 5779141 - DNA, 17 bp, Homo sapiens
gtccattatttgagttt

SEQ ID NO: 5779142 - DNA, 18 bp, Homo sapiens
gtccattcagaaagcttc

SEQ ID NO: 5779143 - DNA, 23 bp, Homo sapiens
gtccattcattaattagttccag

SEQ ID NO: 5779144 - DNA, 21 bp, Homo sapiens
gtccattcttcagtgtctctg

SEQ ID NO: 5779145 - DNA, 22 bp, Homo sapiens
gtccattcttcagtgtctctgt

SEQ ID NO: 5779146 - DNA, 14 bp, Homo sapiens
gtccattgacatgt

SEQ ID NO: 5779147 - DNA, 19 bp, Homo sapiens
gtccattgacatgtacaga

SEQ ID NO: 5779148 - DNA, 22 bp, Homo sapiens
gtccattgacatgtacagagaa

SEQ ID NO: 5779149 - DNA, 23 bp, Homo sapiens
gtccatttaaacccggctgactc

SEQ ID NO: 5779150 - DNA, 16 bp, Homo sapiens
gtccatttacacgtat

SEQ ID NO: 5779151 - DNA, 16 bp, Homo sapiens
gtccatttcatgtgat

SEQ ID NO: 5779152 - DNA, 18 bp, Homo sapiens
gtccatttcatgtgatct

SEQ ID NO: 5779153 - DNA, 19 bp, Homo sapiens
gtccatttcatgtgatcta

SEQ ID NO: 5779154 - DNA, 13 bp, Homo sapiens
gtccatttctacc

SEQ ID NO: 5779155 - DNA, 14 bp, Homo sapiens
gtccatttgtaaaa

SEQ ID NO: 5779156 - DNA, 16 bp, Homo sapiens
gtccatttgttcctgc

SEQ ID NO: 5779157 - DNA, 19 bp, Homo sapiens
gtccattttgcaaacccaa

SEQ ID NO: 5779158 - DNA, 20 bp, Homo sapiens
gtccattttgcaaacccaac

SEQ ID NO: 5779159 - DNA, 17 bp, Homo sapiens
gtccattttgtgaagcc

SEQ ID NO: 5779160 - DNA, 21 bp, Homo sapiens
gtccattttgtgaagccctgt

SEQ ID NO: 5779161 - DNA, 16 bp, Homo sapiens
gtccatttttacaagt

SEQ ID NO: 5779162 - DNA, 21 bp, Homo sapiens
gtcccaaatatgtattttcct

SEQ ID NO: 5779163 - DNA, 20 bp, Homo sapiens
gtcccaacaggaggacaatt

SEQ ID NO: 5779164 - DNA, 23 bp, Homo sapiens
gtcccaacaggaggacaattcat

SEQ ID NO: 5779165 - DNA, 20 bp, Homo sapiens
gtcccaaccctgcccagcct

SEQ ID NO: 5779166 - DNA, 18 bp, Homo sapiens
gtcccaagagccataagg

SEQ ID NO: 5779167 - DNA, 17 bp, Homo sapiens
gtcccaagctcccaaga

SEQ ID NO: 5779168 - DNA, 23 bp, Homo sapiens
gtcccaaggaaagccccagcact

SEQ ID NO: 5779169 - DNA, 21 bp, Homo sapiens
gtcccaaggtgaaatgaagca

SEQ ID NO: 5779170 - DNA, 23 bp, Homo sapiens
gtcccaagtcctgctcctttctg

SEQ ID NO: 5779171 - DNA, 16 bp, Homo sapiens
gtcccaagtctgacag

SEQ ID NO: 5779172 - DNA, 15 bp, Homo sapiens
gtcccaatagctcta

SEQ ID NO: 5779173 - DNA, 23 bp, Homo sapiens
gtcccaatagctctactgccctc

SEQ ID NO: 5779174 - DNA, 23 bp, Homo sapiens
gtcccaatgcacatccattccca

SEQ ID NO: 5779175 - DNA, 16 bp, Homo sapiens
gtcccaattaaaatac

SEQ ID NO: 5779176 - DNA, 15 bp, Homo sapiens
gtcccaattctgccc

SEQ ID NO: 5779177 - DNA, 22 bp, Homo sapiens
gtcccacaaaatatttctaagc

SEQ ID NO: 5779178 - DNA, 13 bp, Homo sapiens
gtcccacaccgct

SEQ ID NO: 5779179 - DNA, 13 bp, Homo sapiens
gtcccacactgtg

SEQ ID NO: 5779180 - DNA, 20 bp, Homo sapiens
gtcccacactgtggccaggc

SEQ ID NO: 5779181 - DNA, 22 bp, Homo sapiens
gtcccacactgtggccaggcct

SEQ ID NO: 5779182 - DNA, 19 bp, Homo sapiens
gtcccacacttatcagcag

SEQ ID NO: 5779183 - DNA, 16 bp, Homo sapiens
gtcccacactttgaag

SEQ ID NO: 5779184 - DNA, 18 bp, Homo sapiens
gtcccacactttgaagca

SEQ ID NO: 5779185 - DNA, 15 bp, Homo sapiens
gtcccacagccacgt

SEQ ID NO: 5779186 - DNA, 12 bp, Homo sapiens
gtcccacagctt

SEQ ID NO: 5779187 - DNA, 22 bp, Homo sapiens
gtcccacagggaaatgtgtatc

SEQ ID NO: 5779188 - DNA, 23 bp, Homo sapiens
gtcccacagggaccacatccacc

SEQ ID NO: 5779189 - DNA, 16 bp, Homo sapiens
gtcccacatcagggcg

SEQ ID NO: 5779190 - DNA, 21 bp, Homo sapiens
gtcccacatcagggcggcctc

SEQ ID NO: 5779191 - DNA, 17 bp, Homo sapiens
gtcccaccaactctgca

SEQ ID NO: 5779192 - DNA, 23 bp, Homo sapiens
gtcccaccaactctgcactccat

SEQ ID NO: 5779193 - DNA, 22 bp, Homo sapiens
gtcccaccagggaccagcccag

SEQ ID NO: 5779194 - DNA, 21 bp, Homo sapiens
gtcccacccacacagctgccc

SEQ ID NO: 5779195 - DNA, 13 bp, Homo sapiens
gtcccacccaccc

SEQ ID NO: 5779196 - DNA, 20 bp, Homo sapiens
gtcccaccccacacacgcca

SEQ ID NO: 5779197 - DNA, 21 bp, Homo sapiens
gtcccaccccacacacgccag

SEQ ID NO: 5779198 - DNA, 16 bp, Homo sapiens
gtcccaccccacctct

SEQ ID NO: 5779199 - DNA, 21 bp, Homo sapiens
gtcccacccccaacccccaga

SEQ ID NO: 5779200 - DNA, 14 bp, Homo sapiens
gtcccacccccacc

SEQ ID NO: 5779201 - DNA, 21 bp, Homo sapiens
gtcccacccccacccccagct

SEQ ID NO: 5779202 - DNA, 16 bp, Homo sapiens
gtcccacccctccctc

SEQ ID NO: 5779203 - DNA, 13 bp, Homo sapiens
gtcccaccctccc

SEQ ID NO: 5779204 - DNA, 16 bp, Homo sapiens
gtcccaccctccctag

SEQ ID NO: 5779205 - DNA, 18 bp, Homo sapiens
gtcccaccctgctgctgc

SEQ ID NO: 5779206 - DNA, 19 bp, Homo sapiens
gtcccaccgggagcctccc

SEQ ID NO: 5779207 - DNA, 23 bp, Homo sapiens
gtcccacctcaaatgggtctggg

SEQ ID NO: 5779208 - DNA, 15 bp, Homo sapiens
gtcccacctccagcc

SEQ ID NO: 5779209 - DNA, 12 bp, Homo sapiens
gtcccacctctt

SEQ ID NO: 5779210 - DNA, 13 bp, Homo sapiens
gtcccacctcttc

SEQ ID NO: 5779211 - DNA, 14 bp, Homo sapiens
gtcccacctcttct

SEQ ID NO: 5779212 - DNA, 19 bp, Homo sapiens
gtcccacctcttctcttcc

SEQ ID NO: 5779213 - DNA, 23 bp, Homo sapiens
gtcccacctcttctcttcctgta

SEQ ID NO: 5779214 - DNA, 17 bp, Homo sapiens
gtcccaccttggctgca

SEQ ID NO: 5779215 - DNA, 18 bp, Homo sapiens
gtcccaccttggctgcag

SEQ ID NO: 5779216 - DNA, 17 bp, Homo sapiens
gtcccacgccaggccag

SEQ ID NO: 5779217 - DNA, 20 bp, Homo sapiens
gtcccacgtctggccaggca

SEQ ID NO: 5779218 - DNA, 16 bp, Homo sapiens
gtcccacgtgtcttcc

SEQ ID NO: 5779219 - DNA, 21 bp, Homo sapiens
gtcccacgtgtcttccacttt

SEQ ID NO: 5779220 - DNA, 23 bp, Homo sapiens
gtcccactaaggtgaccagagtg

SEQ ID NO: 5779221 - DNA, 12 bp, Homo sapiens
gtcccactcaag

SEQ ID NO: 5779222 - DNA, 22 bp, Homo sapiens
gtcccactcaagccaagcagcc

SEQ ID NO: 5779223 - DNA, 15 bp, Homo sapiens
gtcccactcagtcca

SEQ ID NO: 5779224 - DNA, 13 bp, Homo sapiens
gtcccactccaag

SEQ ID NO: 5779225 - DNA, 22 bp, Homo sapiens
gtcccactggctcctcccagca

SEQ ID NO: 5779226 - DNA, 23 bp, Homo sapiens
gtcccactggctcctcccagcac

SEQ ID NO: 5779227 - DNA, 14 bp, Homo sapiens
gtcccactgtgcag

SEQ ID NO: 5779228 - DNA, 18 bp, Homo sapiens
gtcccacttcacagctgg

SEQ ID NO: 5779229 - DNA, 14 bp, Homo sapiens
gtcccacttctcat

SEQ ID NO: 5779230 - DNA, 22 bp, Homo sapiens
gtcccccagccctcaggccagt

SEQ ID NO: 5779231 - DNA, 16 bp, Homo sapiens
gtcccccagctctggt

SEQ ID NO: 5779232 - DNA, 14 bp, Homo sapiens
gtcccccaggaggc

SEQ ID NO: 5779233 - DNA, 17 bp, Homo sapiens
gtcccccaggaggcagc

SEQ ID NO: 5779234 - DNA, 15 bp, Homo sapiens
gtcccccaggctgga

SEQ ID NO: 5779235 - DNA, 20 bp, Homo sapiens
gtcccccatcatgtggccca

SEQ ID NO: 5779236 - DNA, 17 bp, Homo sapiens
gtcccccatgccaccac

SEQ ID NO: 5779237 - DNA, 22 bp, Homo sapiens
gtccccccaccctcattctact

SEQ ID NO: 5779238 - DNA, 20 bp, Homo sapiens
gtccccccaccgctcagtgt

SEQ ID NO: 5779239 - DNA, 12 bp, Homo sapiens
gtccccccactc

SEQ ID NO: 5779240 - DNA, 17 bp, Homo sapiens
gtccccccactcccagc

SEQ ID NO: 5779241 - DNA, 13 bp, Homo sapiens
gtccccccatccc

SEQ ID NO: 5779242 - DNA, 21 bp, Homo sapiens
gtcccccccaggccttgtcct

SEQ ID NO: 5779243 - DNA, 15 bp, Homo sapiens
gtcccccccagtgca

SEQ ID NO: 5779244 - DNA, 16 bp, Homo sapiens
gtccccccccaggccc

SEQ ID NO: 5779245 - DNA, 18 bp, Homo sapiens
gtccccccccaggccctc

SEQ ID NO: 5779246 - DNA, 19 bp, Homo sapiens
gtccccccccaggccctcc

SEQ ID NO: 5779247 - DNA, 21 bp, Homo sapiens
gtccccccccaggccctccca

SEQ ID NO: 5779248 - DNA, 12 bp, Homo sapiens
gtcccccctgag

SEQ ID NO: 5779249 - DNA, 20 bp, Homo sapiens
gtcccccctgtggtctgtgt

SEQ ID NO: 5779250 - DNA, 20 bp, Homo sapiens
gtccccccttgaagcaataa

SEQ ID NO: 5779251 - DNA, 18 bp, Homo sapiens
gtcccccgaccaatcccc

SEQ ID NO: 5779252 - DNA, 16 bp, Homo sapiens
gtcccccgactgcctg

SEQ ID NO: 5779253 - DNA, 13 bp, Homo sapiens
gtcccccgccgcg

SEQ ID NO: 5779254 - DNA, 16 bp, Homo sapiens
gtcccccgccgcgcca

SEQ ID NO: 5779255 - DNA, 18 bp, Homo sapiens
gtcccccgttgtgcctgg

SEQ ID NO: 5779256 - DNA, 22 bp, Homo sapiens
gtccccctacccaccgatggag

SEQ ID NO: 5779257 - DNA, 16 bp, Homo sapiens
gtccccctagagactc

SEQ ID NO: 5779258 - DNA, 13 bp, Homo sapiens
gtccccctcaccc

SEQ ID NO: 5779259 - DNA, 15 bp, Homo sapiens
gtccccctcaccccc

SEQ ID NO: 5779260 - DNA, 20 bp, Homo sapiens
gtccccctcccctcccagtc

SEQ ID NO: 5779261 - DNA, 17 bp, Homo sapiens
gtccccctccctgccca

SEQ ID NO: 5779262 - DNA, 13 bp, Homo sapiens
gtccccctgacaa

SEQ ID NO: 5779263 - DNA, 13 bp, Homo sapiens
gtccccctgcagc

SEQ ID NO: 5779264 - DNA, 22 bp, Homo sapiens
gtcccccttcgtggagctctaa

SEQ ID NO: 5779265 - DNA, 21 bp, Homo sapiens
gtcccccttggaggagggctg

SEQ ID NO: 5779266 - DNA, 16 bp, Homo sapiens
gtccccgaggagctgg

SEQ ID NO: 5779267 - DNA, 20 bp, Homo sapiens
gtccccgaggagctgggccc

SEQ ID NO: 5779268 - DNA, 15 bp, Homo sapiens
gtccccgcactgggc

SEQ ID NO: 5779269 - DNA, 16 bp, Homo sapiens
gtccccgccctctctc

SEQ ID NO: 5779270 - DNA, 10 bp, Homo sapiens
gtccccggac

SEQ ID NO: 5779271 - DNA, 22 bp, Homo sapiens
gtccccggccacgtctgtgctc

SEQ ID NO: 5779272 - DNA, 16 bp, Homo sapiens
gtccccggcccctgcc

SEQ ID NO: 5779273 - DNA, 21 bp, Homo sapiens
gtccccggcggggtgcctgct

SEQ ID NO: 5779274 - DNA, 16 bp, Homo sapiens
gtccccggggcccagg

SEQ ID NO: 5779275 - DNA, 21 bp, Homo sapiens
gtccccgtcccccagaacctc

SEQ ID NO: 5779276 - DNA, 18 bp, Homo sapiens
gtcccctaacccccagtc

SEQ ID NO: 5779277 - DNA, 14 bp, Homo sapiens
gtcccctatcctcc

SEQ ID NO: 5779278 - DNA, 17 bp, Homo sapiens
gtcccctcaaactcatt

SEQ ID NO: 5779279 - DNA, 20 bp, Homo sapiens
gtcccctcaaactcattgca

SEQ ID NO: 5779280 - DNA, 16 bp, Homo sapiens
gtcccctcaagcccct

SEQ ID NO: 5779281 - DNA, 15 bp, Homo sapiens
gtcccctcacagact

SEQ ID NO: 5779282 - DNA, 16 bp, Homo sapiens
gtcccctcacagactc

SEQ ID NO: 5779283 - DNA, 20 bp, Homo sapiens
gtcccctcacgcaagtgcca

SEQ ID NO: 5779284 - DNA, 16 bp, Homo sapiens
gtcccctcactctgtc

SEQ ID NO: 5779285 - DNA, 20 bp, Homo sapiens
gtcccctcactctgtcagcc

SEQ ID NO: 5779286 - DNA, 19 bp, Homo sapiens
gtcccctccacatcccagc

SEQ ID NO: 5779287 - DNA, 13 bp, Homo sapiens
gtcccctccatct

SEQ ID NO: 5779288 - DNA, 17 bp, Homo sapiens
gtcccctccatctgggg

SEQ ID NO: 5779289 - DNA, 22 bp, Homo sapiens
gtcccctcccagagctggtgga

SEQ ID NO: 5779290 - DNA, 14 bp, Homo sapiens
gtcccctcccatct

SEQ ID NO: 5779291 - DNA, 13 bp, Homo sapiens
gtcccctccctcg

SEQ ID NO: 5779292 - DNA, 17 bp, Homo sapiens
gtcccctccgccgtgcc

SEQ ID NO: 5779293 - DNA, 19 bp, Homo sapiens
gtcccctccgccgtgccgg

SEQ ID NO: 5779294 - DNA, 15 bp, Homo sapiens
gtcccctccttccca

SEQ ID NO: 5779295 - DNA, 21 bp, Homo sapiens
gtcccctccttccctcacccc

SEQ ID NO: 5779296 - DNA, 20 bp, Homo sapiens
gtcccctctgccccaccctc

SEQ ID NO: 5779297 - DNA, 22 bp, Homo sapiens
gtcccctctgtcatcactccct

SEQ ID NO: 5779298 - DNA, 14 bp, Homo sapiens
gtcccctctgtgct

SEQ ID NO: 5779299 - DNA, 16 bp, Homo sapiens
gtcccctcttgcccca

SEQ ID NO: 5779300 - DNA, 21 bp, Homo sapiens
gtcccctcttgccccaacccc

SEQ ID NO: 5779301 - DNA, 14 bp, Homo sapiens
gtcccctgacaggg

SEQ ID NO: 5779302 - DNA, 14 bp, Homo sapiens
gtcccctgacctgt

SEQ ID NO: 5779303 - DNA, 18 bp, Homo sapiens
gtcccctgacctgtccag

SEQ ID NO: 5779304 - DNA, 13 bp, Homo sapiens
gtcccctgcagcc

SEQ ID NO: 5779305 - DNA, 15 bp, Homo sapiens
gtcccctgcagcctg

SEQ ID NO: 5779306 - DNA, 19 bp, Homo sapiens
gtcccctgcagcctgggtc

SEQ ID NO: 5779307 - DNA, 17 bp, Homo sapiens
gtcccctgccccagagg

SEQ ID NO: 5779308 - DNA, 15 bp, Homo sapiens
gtcccctgccctgag

SEQ ID NO: 5779309 - DNA, 13 bp, Homo sapiens
gtcccctgctaca

SEQ ID NO: 5779310 - DNA, 20 bp, Homo sapiens
gtcccctgctactcctgtgc

SEQ ID NO: 5779311 - DNA, 23 bp, Homo sapiens
gtcccctgctactcctgtgctct

SEQ ID NO: 5779312 - DNA, 11 bp, Homo sapiens
gtcccctgctt

SEQ ID NO: 5779313 - DNA, 12 bp, Homo sapiens
gtcccctggcag

SEQ ID NO: 5779314 - DNA, 15 bp, Homo sapiens
gtcccctggggctgg

SEQ ID NO: 5779315 - DNA, 17 bp, Homo sapiens
gtcccctggggctggtg

SEQ ID NO: 5779316 - DNA, 12 bp, Homo sapiens
gtcccctgtccc

SEQ ID NO: 5779317 - DNA, 15 bp, Homo sapiens
gtcccctgtcccacc

SEQ ID NO: 5779318 - DNA, 19 bp, Homo sapiens
gtcccctgtcccaccaact

SEQ ID NO: 5779319 - DNA, 23 bp, Homo sapiens
gtcccctgtcgagttcggctctg

SEQ ID NO: 5779320 - DNA, 21 bp, Homo sapiens
gtcccctgttgattatcttca

SEQ ID NO: 5779321 - DNA, 22 bp, Homo sapiens
gtccccttactgagcgcaagcc

SEQ ID NO: 5779322 - DNA, 16 bp, Homo sapiens
gtccccttccaggggt

SEQ ID NO: 5779323 - DNA, 16 bp, Homo sapiens
gtccccttcccctgct

SEQ ID NO: 5779324 - DNA, 17 bp, Homo sapiens
gtccccttcccctgctg

SEQ ID NO: 5779325 - DNA, 12 bp, Homo sapiens
gtccccttccct

SEQ ID NO: 5779326 - DNA, 11 bp, Homo sapiens
gtccccttctc

SEQ ID NO: 5779327 - DNA, 13 bp, Homo sapiens
gtccccttctctc

SEQ ID NO: 5779328 - DNA, 14 bp, Homo sapiens
gtccccttctctca

SEQ ID NO: 5779329 - DNA, 17 bp, Homo sapiens
gtccccttctctcatct

SEQ ID NO: 5779330 - DNA, 18 bp, Homo sapiens
gtccccttctctcatctc

SEQ ID NO: 5779331 - DNA, 13 bp, Homo sapiens
gtcccctttcctc

SEQ ID NO: 5779332 - DNA, 15 bp, Homo sapiens
gtcccgagccccctg

SEQ ID NO: 5779333 - DNA, 14 bp, Homo sapiens
gtcccgcactctgc

SEQ ID NO: 5779334 - DNA, 16 bp, Homo sapiens
gtcccgcactctgccc

SEQ ID NO: 5779335 - DNA, 14 bp, Homo sapiens
gtcccgccttcctc

SEQ ID NO: 5779336 - DNA, 22 bp, Homo sapiens
gtcccgccttcctcctccacag

SEQ ID NO: 5779337 - DNA, 20 bp, Homo sapiens
gtcccgcgcttcgaactcca

SEQ ID NO: 5779338 - DNA, 22 bp, Homo sapiens
gtcccgcgcttcgaactccagg

SEQ ID NO: 5779339 - DNA, 13 bp, Homo sapiens
gtcccgcggtgct

SEQ ID NO: 5779340 - DNA, 14 bp, Homo sapiens
gtcccgctgcctcc

SEQ ID NO: 5779341 - DNA, 15 bp, Homo sapiens
gtcccgctgcctcct

SEQ ID NO: 5779342 - DNA, 16 bp, Homo sapiens
gtcccgcttagttctt

SEQ ID NO: 5779343 - DNA, 13 bp, Homo sapiens
gtcccggccagct

SEQ ID NO: 5779344 - DNA, 15 bp, Homo sapiens
gtcccggccagctct

SEQ ID NO: 5779345 - DNA, 16 bp, Homo sapiens
gtcccggccagctctg

SEQ ID NO: 5779346 - DNA, 21 bp, Homo sapiens
gtcccggccccgcgcgtgccc

SEQ ID NO: 5779347 - DNA, 14 bp, Homo sapiens
gtcccggccgcgcc

SEQ ID NO: 5779348 - DNA, 20 bp, Homo sapiens
gtcccggccgcgccgccgcc

SEQ ID NO: 5779349 - DNA, 15 bp, Homo sapiens
gtcccggctctgtgg

SEQ ID NO: 5779350 - DNA, 17 bp, Homo sapiens
gtcccggctgacacctc

SEQ ID NO: 5779351 - DNA, 19 bp, Homo sapiens
gtcccggctgacacctccc

SEQ ID NO: 5779352 - DNA, 14 bp, Homo sapiens
gtcccggcttccac

SEQ ID NO: 5779353 - DNA, 23 bp, Homo sapiens
gtcccgggaggaacgtggttcag

SEQ ID NO: 5779354 - DNA, 15 bp, Homo sapiens
gtcccggggctccac

SEQ ID NO: 5779355 - DNA, 19 bp, Homo sapiens
gtcccggggtcctgtggca

SEQ ID NO: 5779356 - DNA, 23 bp, Homo sapiens
gtcccggtgtatcctggccctgg

SEQ ID NO: 5779357 - DNA, 17 bp, Homo sapiens
gtcccggttcaccttgc

SEQ ID NO: 5779358 - DNA, 21 bp, Homo sapiens
gtcccggttcagacccctgcc

SEQ ID NO: 5779359 - DNA, 13 bp, Homo sapiens
gtcccgtccctcc

SEQ ID NO: 5779360 - DNA, 19 bp, Homo sapiens
gtcccgtcgtgcagtcagg

SEQ ID NO: 5779361 - DNA, 17 bp, Homo sapiens
gtcccgtggatgctctt

SEQ ID NO: 5779362 - DNA, 22 bp, Homo sapiens
gtcccgtggatgctctttcaat

SEQ ID NO: 5779363 - DNA, 17 bp, Homo sapiens
gtcccgttctccattct

SEQ ID NO: 5779364 - DNA, 12 bp, Homo sapiens
gtccctaataaa

SEQ ID NO: 5779365 - DNA, 17 bp, Homo sapiens
gtccctaataaagctgt

SEQ ID NO: 5779366 - DNA, 18 bp, Homo sapiens
gtccctaataaagctgtg

SEQ ID NO: 5779367 - DNA, 15 bp, Homo sapiens
gtccctaattctctt

SEQ ID NO: 5779368 - DNA, 16 bp, Homo sapiens
gtccctacacccctcc

SEQ ID NO: 5779369 - DNA, 14 bp, Homo sapiens
gtccctacaggagg

SEQ ID NO: 5779370 - DNA, 21 bp, Homo sapiens
gtccctaccccatggtgctag

SEQ ID NO: 5779371 - DNA, 18 bp, Homo sapiens
gtccctagcagcccaccc

SEQ ID NO: 5779372 - DNA, 20 bp, Homo sapiens
gtccctagcagcccaccctg

SEQ ID NO: 5779373 - DNA, 21 bp, Homo sapiens
gtccctagcagcccaccctgc

SEQ ID NO: 5779374 - DNA, 15 bp, Homo sapiens
gtccctagctcacac

SEQ ID NO: 5779375 - DNA, 20 bp, Homo sapiens
gtccctagggctctccaagc

SEQ ID NO: 5779376 - DNA, 18 bp, Homo sapiens
gtccctatagtttcacca

SEQ ID NO: 5779377 - DNA, 17 bp, Homo sapiens
gtccctatatcagggcc

SEQ ID NO: 5779378 - DNA, 22 bp, Homo sapiens
gtccctatctattaaagtgact

SEQ ID NO: 5779379 - DNA, 15 bp, Homo sapiens
gtccctatgcatatc

SEQ ID NO: 5779380 - DNA, 20 bp, Homo sapiens
gtccctattctgccatggga

SEQ ID NO: 5779381 - DNA, 16 bp, Homo sapiens
gtccctcatggagacc

SEQ ID NO: 5779382 - DNA, 19 bp, Homo sapiens
gtccctccacgttcacccc

SEQ ID NO: 5779383 - DNA, 20 bp, Homo sapiens
gtccctccaggcccatctca

SEQ ID NO: 5779384 - DNA, 12 bp, Homo sapiens
gtccctcccacc

SEQ ID NO: 5779385 - DNA, 16 bp, Homo sapiens
gtccctcccacctctg

SEQ ID NO: 5779386 - DNA, 17 bp, Homo sapiens
gtccctcccacctctgt

SEQ ID NO: 5779387 - DNA, 21 bp, Homo sapiens
gtccctcccacctctgtgacc

SEQ ID NO: 5779388 - DNA, 12 bp, Homo sapiens
gtccctcccact

SEQ ID NO: 5779389 - DNA, 18 bp, Homo sapiens
gtccctcccactccctgg

SEQ ID NO: 5779390 - DNA, 15 bp, Homo sapiens
gtccctcccaggtcg

SEQ ID NO: 5779391 - DNA, 14 bp, Homo sapiens
gtccctccctcctg

SEQ ID NO: 5779392 - DNA, 19 bp, Homo sapiens
gtccctccctcctggctca

SEQ ID NO: 5779393 - DNA, 21 bp, Homo sapiens
gtccctccctcctggctcaca

SEQ ID NO: 5779394 - DNA, 13 bp, Homo sapiens
gtccctccctgcc

SEQ ID NO: 5779395 - DNA, 16 bp, Homo sapiens
gtccctccctgcctga

SEQ ID NO: 5779396 - DNA, 17 bp, Homo sapiens
gtccctccctgcctgag

SEQ ID NO: 5779397 - DNA, 11 bp, Homo sapiens
gtccctccctt

SEQ ID NO: 5779398 - DNA, 23 bp, Homo sapiens
gtccctccgggacctggtgctgc

SEQ ID NO: 5779399 - DNA, 17 bp, Homo sapiens
gtccctcctaacaagtg

SEQ ID NO: 5779400 - DNA, 13 bp, Homo sapiens
gtccctcctgagg

SEQ ID NO: 5779401 - DNA, 19 bp, Homo sapiens
gtccctcctggtgtcaccc

SEQ ID NO: 5779402 - DNA, 21 bp, Homo sapiens
gtccctcctggtgtcacccca

SEQ ID NO: 5779403 - DNA, 19 bp, Homo sapiens
gtccctcctgttgccacac

SEQ ID NO: 5779404 - DNA, 15 bp, Homo sapiens
gtccctcgagctctg

SEQ ID NO: 5779405 - DNA, 16 bp, Homo sapiens
gtccctcgagctctgt

SEQ ID NO: 5779406 - DNA, 21 bp, Homo sapiens
gtccctcgccgtccctcccag

SEQ ID NO: 5779407 - DNA, 14 bp, Homo sapiens
gtccctcggagctg

SEQ ID NO: 5779408 - DNA, 19 bp, Homo sapiens
gtccctcggagctgccagc

SEQ ID NO: 5779409 - DNA, 18 bp, Homo sapiens
gtccgtgccccttccctg

SEQ ID NO: 5779410 - DNA, 20 bp, Homo sapiens
gtccgtgccccttccctggg

SEQ ID NO: 5779411 - DNA, 19 bp, Homo sapiens
gtccgtgcttgctggtgcc

SEQ ID NO: 5779412 - DNA, 13 bp, Homo sapiens
gtccgtggaaaat

SEQ ID NO: 5779413 - DNA, 19 bp, Homo sapiens
gtccgtgggacggtgccca

SEQ ID NO: 5779414 - DNA, 19 bp, Homo sapiens
gtccgtgggccgtatctgt

SEQ ID NO: 5779415 - DNA, 14 bp, Homo sapiens
gtccgtgggctggc

SEQ ID NO: 5779416 - DNA, 17 bp, Homo sapiens
gtccgtgggttgctaac

SEQ ID NO: 5779417 - DNA, 15 bp, Homo sapiens
gtccgtggtagaggc

SEQ ID NO: 5779418 - DNA, 17 bp, Homo sapiens
gtccgtggttgccctag

SEQ ID NO: 5779419 - DNA, 21 bp, Homo sapiens
gtccgtgtgtcccagatgctg

SEQ ID NO: 5779420 - DNA, 19 bp, Homo sapiens
gtccgttccaggagcacac

SEQ ID NO: 5779421 - DNA, 16 bp, Homo sapiens
gtccgttgctgaaaat

SEQ ID NO: 5779422 - DNA, 16 bp, Homo sapiens
gtcctaaaaatggcta

SEQ ID NO: 5779423 - DNA, 23 bp, Homo sapiens
gtcctaaaacttggatggacttg

SEQ ID NO: 5779424 - DNA, 17 bp, Homo sapiens
gtcctaaagaagacatt

SEQ ID NO: 5779425 - DNA, 14 bp, Homo sapiens
gtcctaaccactaa

SEQ ID NO: 5779426 - DNA, 18 bp, Homo sapiens
gtcctaacttcctgtgcc

SEQ ID NO: 5779427 - DNA, 15 bp, Homo sapiens
gtcctaagaagtggg

SEQ ID NO: 5779428 - DNA, 18 bp, Homo sapiens
gtcctaagagatttatct

SEQ ID NO: 5779429 - DNA, 20 bp, Homo sapiens
gtcctaagagatttatcttt

SEQ ID NO: 5779430 - DNA, 18 bp, Homo sapiens
gtcctaaggaaccttcct

SEQ ID NO: 5779431 - DNA, 18 bp, Homo sapiens
gtcctaagtccctgcccc

SEQ ID NO: 5779432 - DNA, 20 bp, Homo sapiens
gtcctaagtgtcaagtcctg

SEQ ID NO: 5779433 - DNA, 13 bp, Homo sapiens
gtcctaatggtga

SEQ ID NO: 5779434 - DNA, 21 bp, Homo sapiens
gtcctaatggtgatgcagtct

SEQ ID NO: 5779435 - DNA, 20 bp, Homo sapiens
gtcctacagtgactccctgg

SEQ ID NO: 5779436 - DNA, 17 bp, Homo sapiens
gtcctacagtggctgtc

SEQ ID NO: 5779437 - DNA, 16 bp, Homo sapiens
gtcctaccaatagatt

SEQ ID NO: 5779438 - DNA, 17 bp, Homo sapiens
gtcctaccatcagctct

SEQ ID NO: 5779439 - DNA, 22 bp, Homo sapiens
gtcctaccatcagctctgcctt

SEQ ID NO: 5779440 - DNA, 13 bp, Homo sapiens
gtcctacccaccc

SEQ ID NO: 5779441 - DNA, 16 bp, Homo sapiens
gtcctacccaccctcc

SEQ ID NO: 5779442 - DNA, 16 bp, Homo sapiens
gtcctacccatccccg

SEQ ID NO: 5779443 - DNA, 14 bp, Homo sapiens
gtcctacggaggga

SEQ ID NO: 5779444 - DNA, 16 bp, Homo sapiens
gtcctacgtccaaggt

SEQ ID NO: 5779445 - DNA, 20 bp, Homo sapiens
gtcctacgtccaaggtggca

SEQ ID NO: 5779446 - DNA, 15 bp, Homo sapiens
gtcctactggggaaa

SEQ ID NO: 5779447 - DNA, 20 bp, Homo sapiens
gtcctacttctgactttact

SEQ ID NO: 5779448 - DNA, 23 bp, Homo sapiens
gtcctagagatctatgggcattt

SEQ ID NO: 5779449 - DNA, 17 bp, Homo sapiens
gtcctagagctcctgtc

SEQ ID NO: 5779450 - DNA, 20 bp, Homo sapiens
gtcctagagctcctgtccct

SEQ ID NO: 5779451 - DNA, 20 bp, Homo sapiens
gtcctagaggccctttgctg

SEQ ID NO: 5779452 - DNA, 15 bp, Homo sapiens
gtcctagcacagatg

SEQ ID NO: 5779453 - DNA, 17 bp, Homo sapiens
gtcctagcacagatggc

SEQ ID NO: 5779454 - DNA, 22 bp, Homo sapiens
gtcctagccaggtctcctggga

SEQ ID NO: 5779455 - DNA, 23 bp, Homo sapiens
gtcctagccaggtctcctgggaa

SEQ ID NO: 5779456 - DNA, 20 bp, Homo sapiens
gtcctagcccagtgcttctc

SEQ ID NO: 5779457 - DNA, 16 bp, Homo sapiens
gtcctagcccttccct

SEQ ID NO: 5779458 - DNA, 20 bp, Homo sapiens
gtcctagcccttccctgagt

SEQ ID NO: 5779459 - DNA, 23 bp, Homo sapiens
gtcctagcttgggaggcttcccc

SEQ ID NO: 5779460 - DNA, 16 bp, Homo sapiens
gtcctaggctggaagg

SEQ ID NO: 5779461 - DNA, 22 bp, Homo sapiens
gtcctaggctggaaggaggaag

SEQ ID NO: 5779462 - DNA, 22 bp, Homo sapiens
gtcctaggggccgagggaaatg

SEQ ID NO: 5779463 - DNA, 12 bp, Homo sapiens
gtcctaggtcat

SEQ ID NO: 5779464 - DNA, 17 bp, Homo sapiens
gtcctagtaagaagaca

SEQ ID NO: 5779465 - DNA, 18 bp, Homo sapiens
gtcctagtctcctttgaa

SEQ ID NO: 5779466 - DNA, 21 bp, Homo sapiens
gtcctagtgtctattccctgg

SEQ ID NO: 5779467 - DNA, 14 bp, Homo sapiens
gtcctatagtttgt

SEQ ID NO: 5779468 - DNA, 20 bp, Homo sapiens
gtcctatccaaaggaatcag

SEQ ID NO: 5779469 - DNA, 14 bp, Homo sapiens
gtcctatccccgga

SEQ ID NO: 5779470 - DNA, 22 bp, Homo sapiens
gtcctatccctggacgcatgca

SEQ ID NO: 5779471 - DNA, 18 bp, Homo sapiens
gtcctatctatcttccaa

SEQ ID NO: 5779472 - DNA, 20 bp, Homo sapiens
gtcctatctccagcggccct

SEQ ID NO: 5779473 - DNA, 15 bp, Homo sapiens
gtcctatctccccca

SEQ ID NO: 5779474 - DNA, 19 bp, Homo sapiens
gtcctatctcccccaaccc

SEQ ID NO: 5779475 - DNA, 20 bp, Homo sapiens
gtcctatctcccccaaccca

SEQ ID NO: 5779476 - DNA, 18 bp, Homo sapiens
gtcctatctgggcttcct

SEQ ID NO: 5779477 - DNA, 21 bp, Homo sapiens
gtcctatctgggcttcctgga

SEQ ID NO: 5779478 - DNA, 22 bp, Homo sapiens
gtcctatctgggcttcctggag

SEQ ID NO: 5779479 - DNA, 15 bp, Homo sapiens
gtcctatgcaataaa

SEQ ID NO: 5779480 - DNA, 22 bp, Homo sapiens
gtcctatgcagtattgttagac

SEQ ID NO: 5779481 - DNA, 15 bp, Homo sapiens
gtcctatgcctcaca

SEQ ID NO: 5779482 - DNA, 21 bp, Homo sapiens
gtcctatggagcctctgcaga

SEQ ID NO: 5779483 - DNA, 15 bp, Homo sapiens
gtcctatggcctcat

SEQ ID NO: 5779484 - DNA, 17 bp, Homo sapiens
gtcctattagtgttata

SEQ ID NO: 5779485 - DNA, 19 bp, Homo sapiens
gtcctattatattcattct

SEQ ID NO: 5779486 - DNA, 19 bp, Homo sapiens
gtcctcaaaataaggggca

SEQ ID NO: 5779487 - DNA, 12 bp, Homo sapiens
gtcctcaataaa

SEQ ID NO: 5779488 - DNA, 23 bp, Homo sapiens
gtcctcacagcagtcacaggccc

SEQ ID NO: 5779489 - DNA, 15 bp, Homo sapiens
gtcctcacagcctct

SEQ ID NO: 5779490 - DNA, 14 bp, Homo sapiens
gtcctcacatgcag

SEQ ID NO: 5779491 - DNA, 22 bp, Homo sapiens
gtcctcacccctgtcctcactg

SEQ ID NO: 5779492 - DNA, 16 bp, Homo sapiens
gtcctcaccctgtggg

SEQ ID NO: 5779493 - DNA, 19 bp, Homo sapiens
gtcctcaccctgtgggacc

SEQ ID NO: 5779494 - DNA, 18 bp, Homo sapiens
gtcctcacggtgcctttt

SEQ ID NO: 5779495 - DNA, 14 bp, Homo sapiens
gtcctcactcccag

SEQ ID NO: 5779496 - DNA, 18 bp, Homo sapiens
gtcctcactgctccctga

SEQ ID NO: 5779497 - DNA, 22 bp, Homo sapiens
gtcctcacttctagatctcagc

SEQ ID NO: 5779498 - DNA, 16 bp, Homo sapiens
gtcctcacttctgtct

SEQ ID NO: 5779499 - DNA, 17 bp, Homo sapiens
gtcctcacttctgtctc

SEQ ID NO: 5779500 - DNA, 21 bp, Homo sapiens
gtcctcacttctgtctcctgt

SEQ ID NO: 5779501 - DNA, 12 bp, Homo sapiens
gtcctcagagca

SEQ ID NO: 5779502 - DNA, 18 bp, Homo sapiens
gtcctcagagggtcccta

SEQ ID NO: 5779503 - DNA, 15 bp, Homo sapiens
gtcctcagcacccca

SEQ ID NO: 5779504 - DNA, 22 bp, Homo sapiens
gtcctcagcaccccactcctca

SEQ ID NO: 5779505 - DNA, 20 bp, Homo sapiens
gtcctcagccttgccagaga

SEQ ID NO: 5779506 - DNA, 13 bp, Homo sapiens
gtcctcagctgct

SEQ ID NO: 5779507 - DNA, 19 bp, Homo sapiens
gtcctcaggtacagcgggc

SEQ ID NO: 5779508 - DNA, 14 bp, Homo sapiens
gtcctcaggtcagc

SEQ ID NO: 5779509 - DNA, 20 bp, Homo sapiens
gtcctcaggtcagctgggag

SEQ ID NO: 5779510 - DNA, 22 bp, Homo sapiens
gtcctcaggtcagctgggagcc

SEQ ID NO: 5779511 - DNA, 17 bp, Homo sapiens
gtcctcaggtggccatg

SEQ ID NO: 5779512 - DNA, 23 bp, Homo sapiens
gtcctcaggtggccatgcctcag

SEQ ID NO: 5779513 - DNA, 15 bp, Homo sapiens
gtcctcagtccattt

SEQ ID NO: 5779514 - DNA, 16 bp, Homo sapiens
gtcctcatctccagcc

SEQ ID NO: 5779515 - DNA, 15 bp, Homo sapiens
gtcctcatttctcca

SEQ ID NO: 5779516 - DNA, 21 bp, Homo sapiens
gtcctccaacaataaagagct

SEQ ID NO: 5779517 - DNA, 14 bp, Homo sapiens
gtcctccaagtgcc

SEQ ID NO: 5779518 - DNA, 15 bp, Homo sapiens
gtcctccaagtgccc

SEQ ID NO: 5779519 - DNA, 21 bp, Homo sapiens
gtcctccaagtgccccctcac

SEQ ID NO: 5779520 - DNA, 23 bp, Homo sapiens
gtcctccaagtgccccctcacct

SEQ ID NO: 5779521 - DNA, 15 bp, Homo sapiens
gtcctccaccacaag

SEQ ID NO: 5779522 - DNA, 20 bp, Homo sapiens
gtcctccaccacaagagctc

SEQ ID NO: 5779523 - DNA, 20 bp, Homo sapiens
gtcctccaccggtgcctcct

SEQ ID NO: 5779524 - DNA, 21 bp, Homo sapiens
gtcctccaccggtgcctcctc

SEQ ID NO: 5779525 - DNA, 19 bp, Homo sapiens
gtcctccagaagcctctgg

SEQ ID NO: 5779526 - DNA, 20 bp, Homo sapiens
gtcctccagaagcctctggc

SEQ ID NO: 5779527 - DNA, 21 bp, Homo sapiens
gtcctccagaagcctctggct

SEQ ID NO: 5779528 - DNA, 14 bp, Homo sapiens
gtcctccaggagct

SEQ ID NO: 5779529 - DNA, 14 bp, Homo sapiens
gtcctccagggcga

SEQ ID NO: 5779530 - DNA, 14 bp, Homo sapiens
gtcctccatccacg

SEQ ID NO: 5779531 - DNA, 21 bp, Homo sapiens
gtcctccatttcaactccaga

SEQ ID NO: 5779532 - DNA, 20 bp, Homo sapiens
gtcctcccacagacctgcag

SEQ ID NO: 5779533 - DNA, 12 bp, Homo sapiens
gtcctcccaccc

SEQ ID NO: 5779534 - DNA, 16 bp, Homo sapiens
gtcctcccaccttggc

SEQ ID NO: 5779535 - DNA, 19 bp, Homo sapiens
gtcctcccaccttggcctc

SEQ ID NO: 5779536 - DNA, 21 bp, Homo sapiens
gtcctcccaccttggcctccc

SEQ ID NO: 5779537 - DNA, 19 bp, Homo sapiens
gtcctcccagctgacggca

SEQ ID NO: 5779538 - DNA, 13 bp, Homo sapiens
gtcctcccaggaa

SEQ ID NO: 5779539 - DNA, 15 bp, Homo sapiens
gtcctcccaggaacc

SEQ ID NO: 5779540 - DNA, 19 bp, Homo sapiens
gtcctcccaggaaccaaaa

SEQ ID NO: 5779541 - DNA, 14 bp, Homo sapiens
gtcctcccatcccc

SEQ ID NO: 5779542 - DNA, 16 bp, Homo sapiens
gtcctcccatcccctg

SEQ ID NO: 5779543 - DNA, 21 bp, Homo sapiens
gtcctcccatcccctggactg

SEQ ID NO: 5779544 - DNA, 14 bp, Homo sapiens
gtcctcccatttct

SEQ ID NO: 5779545 - DNA, 16 bp, Homo sapiens
gtcctcccctatttta

SEQ ID NO: 5779546 - DNA, 13 bp, Homo sapiens
gtcctccccttgg

SEQ ID NO: 5779547 - DNA, 19 bp, Homo sapiens
gtcctccccttgggcggct

SEQ ID NO: 5779548 - DNA, 17 bp, Homo sapiens
gtcctcccgggccctcc

SEQ ID NO: 5779549 - DNA, 22 bp, Homo sapiens
gtcctcccgggccctcccttgg

SEQ ID NO: 5779550 - DNA, 20 bp, Homo sapiens
gtcctccctcaccccctcct

SEQ ID NO: 5779551 - DNA, 12 bp, Homo sapiens
gtcctccctcag

SEQ ID NO: 5779552 - DNA, 21 bp, Homo sapiens
gtcctccctcagcctcccctt

SEQ ID NO: 5779553 - DNA, 20 bp, Homo sapiens
gtcctccctcccaaggagcc

SEQ ID NO: 5779554 - DNA, 12 bp, Homo sapiens
gtcctccctgac

SEQ ID NO: 5779555 - DNA, 15 bp, Homo sapiens
gtcctccctgacttt

SEQ ID NO: 5779556 - DNA, 13 bp, Homo sapiens
gtcctccctgctc

SEQ ID NO: 5779557 - DNA, 16 bp, Homo sapiens
gtcctccgtagggtct

SEQ ID NO: 5779558 - DNA, 17 bp, Homo sapiens
gtcctcctagaactcca

SEQ ID NO: 5779559 - DNA, 19 bp, Homo sapiens
gtcctcctatctccctggc

SEQ ID NO: 5779560 - DNA, 20 bp, Homo sapiens
gtcctcctatctccctggct

SEQ ID NO: 5779561 - DNA, 13 bp, Homo sapiens
gtcctcctcacct

SEQ ID NO: 5779562 - DNA, 21 bp, Homo sapiens
gtcctcctcacctcatgccca

SEQ ID NO: 5779563 - DNA, 14 bp, Homo sapiens
gtcctcctccaggg

SEQ ID NO: 5779564 - DNA, 21 bp, Homo sapiens
gtcctcctcgctcctccttcc

SEQ ID NO: 5779565 - DNA, 21 bp, Homo sapiens
gtcctcctcggatcaccgaga

SEQ ID NO: 5779566 - DNA, 20 bp, Homo sapiens
gtcctcctctacctctctcc

SEQ ID NO: 5779567 - DNA, 21 bp, Homo sapiens
gtcctcctctacctctctcct

SEQ ID NO: 5779568 - DNA, 14 bp, Homo sapiens
gtcctcctctgtga

SEQ ID NO: 5779569 - DNA, 16 bp, Homo sapiens
gtcctcctctgtgaaa

SEQ ID NO: 5779570 - DNA, 12 bp, Homo sapiens
gtcctcctgctc

SEQ ID NO: 5779571 - DNA, 13 bp, Homo sapiens
gtcctcctgctct

SEQ ID NO: 5779572 - DNA, 14 bp, Homo sapiens
gtcctcctgctctg

SEQ ID NO: 5779573 - DNA, 14 bp, Homo sapiens
gtcctcctgctgcc

SEQ ID NO: 5779574 - DNA, 15 bp, Homo sapiens
gtcctcctgctgcca

SEQ ID NO: 5779575 - DNA, 13 bp, Homo sapiens
gtcctcctggcct

SEQ ID NO: 5779576 - DNA, 14 bp, Homo sapiens
gtcctcctggcctg

SEQ ID NO: 5779577 - DNA, 15 bp, Homo sapiens
gtcctcctggcctga

SEQ ID NO: 5779578 - DNA, 12 bp, Homo sapiens
gtcctcctgtgc

SEQ ID NO: 5779579 - DNA, 23 bp, Homo sapiens
gtcctcctgttccgtgtgggctt

SEQ ID NO: 5779580 - DNA, 10 bp, Homo sapiens
gtcctccttc

SEQ ID NO: 5779581 - DNA, 13 bp, Homo sapiens
gtcctccttcctg

SEQ ID NO: 5779582 - DNA, 14 bp, Homo sapiens
gtcctccttcctgg

SEQ ID NO: 5779583 - DNA, 16 bp, Homo sapiens
gtcctccttcctggga

SEQ ID NO: 5779584 - DNA, 17 bp, Homo sapiens
gtcctccttcctgggac

SEQ ID NO: 5779585 - DNA, 14 bp, Homo sapiens
gtcctcgccccccg

SEQ ID NO: 5779586 - DNA, 20 bp, Homo sapiens
gtcctggcccttcagtctgc

SEQ ID NO: 5779587 - DNA, 22 bp, Homo sapiens
gtcctggcgcctggcagtccgt

SEQ ID NO: 5779588 - DNA, 20 bp, Homo sapiens
gtcctggctcccagggtcct

SEQ ID NO: 5779589 - DNA, 14 bp, Homo sapiens
gtcctggctcctga

SEQ ID NO: 5779590 - DNA, 15 bp, Homo sapiens
gtcctggctgtgcac

SEQ ID NO: 5779591 - DNA, 12 bp, Homo sapiens
gtcctggcttct

SEQ ID NO: 5779592 - DNA, 20 bp, Homo sapiens
gtcctggcttctagatctgg

SEQ ID NO: 5779593 - DNA, 10 bp, Homo sapiens
gtcctgggag

SEQ ID NO: 5779594 - DNA, 19 bp, Homo sapiens
gtcctgggagaacctcagg

SEQ ID NO: 5779595 - DNA, 20 bp, Homo sapiens
gtcctgggagaacctcaggc

SEQ ID NO: 5779596 - DNA, 21 bp, Homo sapiens
gtcctgggagaacctcaggct

SEQ ID NO: 5779597 - DNA, 24 bp, Homo sapiens
gtcctgggagaggacagggacttc

SEQ ID NO: 5779598 - DNA, 12 bp, Homo sapiens
gtcctgggagga

SEQ ID NO: 5779599 - DNA, 17 bp, Homo sapiens
gtcctgggaggctgcag

SEQ ID NO: 5779600 - DNA, 18 bp, Homo sapiens
gtcctgggaggctgcagc

SEQ ID NO: 5779601 - DNA, 18 bp, Homo sapiens
gtcctgggagtgagctgg

SEQ ID NO: 5779602 - DNA, 14 bp, Homo sapiens
gtcctgggcaggtg

SEQ ID NO: 5779603 - DNA, 16 bp, Homo sapiens
gtcctgggcaggtggg

SEQ ID NO: 5779604 - DNA, 14 bp, Homo sapiens
gtcctgggcctgcc

SEQ ID NO: 5779605 - DNA, 15 bp, Homo sapiens
gtcctgggcctgccc

SEQ ID NO: 5779606 - DNA, 16 bp, Homo sapiens
gtcctgggcctgcccc

SEQ ID NO: 5779607 - DNA, 13 bp, Homo sapiens
gtcctgggcgtga

SEQ ID NO: 5779608 - DNA, 16 bp, Homo sapiens
gtcctgggcgtgaccc

SEQ ID NO: 5779609 - DNA, 19 bp, Homo sapiens
gtcctggggaacctgaccc

SEQ ID NO: 5779610 - DNA, 20 bp, Homo sapiens
gtcctggggaacctgacccc

SEQ ID NO: 5779611 - DNA, 22 bp, Homo sapiens
gtcctggggaggctgagactgc

SEQ ID NO: 5779612 - DNA, 15 bp, Homo sapiens
gtcctggggctctgt

SEQ ID NO: 5779613 - DNA, 14 bp, Homo sapiens
gtcctgggggcagg

SEQ ID NO: 5779614 - DNA, 14 bp, Homo sapiens
gtcctgggggcctg

SEQ ID NO: 5779615 - DNA, 14 bp, Homo sapiens
gtcctgggggctgc

SEQ ID NO: 5779616 - DNA, 12 bp, Homo sapiens
gtcctggggtgg

SEQ ID NO: 5779617 - DNA, 13 bp, Homo sapiens
gtcctggggtggt

SEQ ID NO: 5779618 - DNA, 23 bp, Homo sapiens
gtcctggggtggttggaggcctg

SEQ ID NO: 5779619 - DNA, 22 bp, Homo sapiens
gtcctggtcagttttcacagag

SEQ ID NO: 5779620 - DNA, 15 bp, Homo sapiens
gtcctggtcctgatg

SEQ ID NO: 5779621 - DNA, 11 bp, Homo sapiens
gtcctggtctt

SEQ ID NO: 5779622 - DNA, 15 bp, Homo sapiens
gtcctggtgagaaaa

SEQ ID NO: 5779623 - DNA, 22 bp, Homo sapiens
gtcctggtgagaaaatatatgc

SEQ ID NO: 5779624 - DNA, 22 bp, Homo sapiens
gtcctggtgcctatctgcctgg

SEQ ID NO: 5779625 - DNA, 23 bp, Homo sapiens
gtcctggtgcctatctgcctgga

SEQ ID NO: 5779626 - DNA, 16 bp, Homo sapiens
gtcctggtgctctctg

SEQ ID NO: 5779627 - DNA, 17 bp, Homo sapiens
gtcctggtgctgccgag

SEQ ID NO: 5779628 - DNA, 18 bp, Homo sapiens
gtcctggtgctgccgagg

SEQ ID NO: 5779629 - DNA, 16 bp, Homo sapiens
gtcctggtggctgggc

SEQ ID NO: 5779630 - DNA, 18 bp, Homo sapiens
gtcctggtggctgggccc

SEQ ID NO: 5779631 - DNA, 19 bp, Homo sapiens
gtcctggtggctgggccca

SEQ ID NO: 5779632 - DNA, 23 bp, Homo sapiens
gtcctggtggctgggcccagcag

SEQ ID NO: 5779633 - DNA, 16 bp, Homo sapiens
gtcctggtggggcagc

SEQ ID NO: 5779634 - DNA, 19 bp, Homo sapiens
gtcctggtggggctgagcc

SEQ ID NO: 5779635 - DNA, 20 bp, Homo sapiens
gtcctggtggggctgagcct

SEQ ID NO: 5779636 - DNA, 21 bp, Homo sapiens
gtcctggtgggtcagcccagc

SEQ ID NO: 5779637 - DNA, 19 bp, Homo sapiens
gtcctggttcagtgggaat

SEQ ID NO: 5779638 - DNA, 16 bp, Homo sapiens
gtcctggttgtctgaa

SEQ ID NO: 5779639 - DNA, 21 bp, Homo sapiens
gtcctgtaaacactcagctgt

SEQ ID NO: 5779640 - DNA, 17 bp, Homo sapiens
gtcctgtagcacgctgc

SEQ ID NO: 5779641 - DNA, 16 bp, Homo sapiens
gtcctgtatagcaacc

SEQ ID NO: 5779642 - DNA, 16 bp, Homo sapiens
gtcctgtcaccctggc

SEQ ID NO: 5779643 - DNA, 17 bp, Homo sapiens
gtcctgtcactgatgga

SEQ ID NO: 5779644 - DNA, 14 bp, Homo sapiens
gtcctgtcagtgcc

SEQ ID NO: 5779645 - DNA, 22 bp, Homo sapiens
gtcctgtcagtgccgccgcctc

SEQ ID NO: 5779646 - DNA, 14 bp, Homo sapiens
gtcctgtcccagag

SEQ ID NO: 5779647 - DNA, 15 bp, Homo sapiens
gtcctgtcccagagg

SEQ ID NO: 5779648 - DNA, 14 bp, Homo sapiens
gtcctgtccggagc

SEQ ID NO: 5779649 - DNA, 20 bp, Homo sapiens
gtcctgtccggagcgaccct

SEQ ID NO: 5779650 - DNA, 21 bp, Homo sapiens
gtcctgtcctggctcccaggg

SEQ ID NO: 5779651 - DNA, 15 bp, Homo sapiens
gtcctgtcctggtcc

SEQ ID NO: 5779652 - DNA, 16 bp, Homo sapiens
gtcctgtcctggtcct

SEQ ID NO: 5779653 - DNA, 18 bp, Homo sapiens
gtcctgtcctggtcctga

SEQ ID NO: 5779654 - DNA, 22 bp, Homo sapiens
gtcctgtcgaaggggaggcaca

SEQ ID NO: 5779655 - DNA, 20 bp, Homo sapiens
gtcctgtcggagccctgtct

SEQ ID NO: 5779656 - DNA, 16 bp, Homo sapiens
gtcctgtctcccctct

SEQ ID NO: 5779657 - DNA, 13 bp, Homo sapiens
gtcctgtctgctg

SEQ ID NO: 5779658 - DNA, 14 bp, Homo sapiens
gtcctgtctgctgg

SEQ ID NO: 5779659 - DNA, 15 bp, Homo sapiens
gtcctgtctgctggg

SEQ ID NO: 5779660 - DNA, 14 bp, Homo sapiens
gtcctgtctgtcct

SEQ ID NO: 5779661 - DNA, 23 bp, Homo sapiens
gtcctgtctgtccttctgaagtg

SEQ ID NO: 5779662 - DNA, 11 bp, Homo sapiens
gtcctgtgaat

SEQ ID NO: 5779663 - DNA, 15 bp, Homo sapiens
gtcctgtgaatttct

SEQ ID NO: 5779664 - DNA, 23 bp, Homo sapiens
gtcctgtgacaacactcatcaca

SEQ ID NO: 5779665 - DNA, 16 bp, Homo sapiens
gtcctgtgagatgtgt

SEQ ID NO: 5779666 - DNA, 22 bp, Homo sapiens
gtcctgtgatcttatttttcta

SEQ ID NO: 5779667 - DNA, 21 bp, Homo sapiens
gtcctgtgatgtcagcggtgc

SEQ ID NO: 5779668 - DNA, 11 bp, Homo sapiens
gtcctgtgctt

SEQ ID NO: 5779669 - DNA, 14 bp, Homo sapiens
gtcctgtgcttgct

SEQ ID NO: 5779670 - DNA, 23 bp, Homo sapiens
gtcctgtgctttctgcatgctta

SEQ ID NO: 5779671 - DNA, 18 bp, Homo sapiens
gtcctgtggatgggatcc

SEQ ID NO: 5779672 - DNA, 23 bp, Homo sapiens
gtcctgtggggagcccatcctct

SEQ ID NO: 5779673 - DNA, 19 bp, Homo sapiens
gtcctgtgtcatctgtcag

SEQ ID NO: 5779674 - DNA, 11 bp, Homo sapiens
gtcctgtgtct

SEQ ID NO: 5779675 - DNA, 21 bp, Homo sapiens
gtcctgttaacgtcatctcag

SEQ ID NO: 5779676 - DNA, 15 bp, Homo sapiens
gtcctgttctcagag

SEQ ID NO: 5779677 - DNA, 16 bp, Homo sapiens
gtcctgttctcagagc

SEQ ID NO: 5779678 - DNA, 23 bp, Homo sapiens
gtcctgttctcagagctccacag

SEQ ID NO: 5779679 - DNA, 19 bp, Homo sapiens
gtccttaaaaatcacactg

SEQ ID NO: 5779680 - DNA, 23 bp, Homo sapiens
gtccttaacacctgatctggccc

SEQ ID NO: 5779681 - DNA, 20 bp, Homo sapiens
gtccttaagacggaagtaaa

SEQ ID NO: 5779682 - DNA, 15 bp, Homo sapiens
gtccttaatgaagag

SEQ ID NO: 5779683 - DNA, 16 bp, Homo sapiens
gtccttaccagcagag

SEQ ID NO: 5779684 - DNA, 17 bp, Homo sapiens
gtccttaccagcagagc

SEQ ID NO: 5779685 - DNA, 19 bp, Homo sapiens
gtccttaccagcagagcac

SEQ ID NO: 5779686 - DNA, 21 bp, Homo sapiens
gtccttaccagcagagcacct

SEQ ID NO: 5779687 - DNA, 13 bp, Homo sapiens
gtccttacctcgg

SEQ ID NO: 5779688 - DNA, 18 bp, Homo sapiens
gtccttactcagagctgc

SEQ ID NO: 5779689 - DNA, 15 bp, Homo sapiens
gtccttactcctgtg

SEQ ID NO: 5779690 - DNA, 23 bp, Homo sapiens
gtccttactcctgtgggagcctc

SEQ ID NO: 5779691 - DNA, 15 bp, Homo sapiens
gtccttagaacattt

SEQ ID NO: 5779692 - DNA, 18 bp, Homo sapiens
gtccttagaatactgtat

SEQ ID NO: 5779693 - DNA, 17 bp, Homo sapiens
gtccttagactccttct

SEQ ID NO: 5779694 - DNA, 14 bp, Homo sapiens
gtccttagcctggg

SEQ ID NO: 5779695 - DNA, 20 bp, Homo sapiens
gtccttaggagacgctgcac

SEQ ID NO: 5779696 - DNA, 16 bp, Homo sapiens
gtccttatctagctgc

SEQ ID NO: 5779697 - DNA, 18 bp, Homo sapiens
gtccttatctagctgcat

SEQ ID NO: 5779698 - DNA, 22 bp, Homo sapiens
gtccttatgttaagccctggca

SEQ ID NO: 5779699 - DNA, 19 bp, Homo sapiens
gtccttattatcccagctt

SEQ ID NO: 5779700 - DNA, 22 bp, Homo sapiens
gtccttcaaaatccttccaaag

SEQ ID NO: 5779701 - DNA, 16 bp, Homo sapiens
gtccttcaagattcca

SEQ ID NO: 5779702 - DNA, 15 bp, Homo sapiens
gtccttcacctcact

SEQ ID NO: 5779703 - DNA, 21 bp, Homo sapiens
gtccttcacctcactgaaaac

SEQ ID NO: 5779704 - DNA, 18 bp, Homo sapiens
gtccttcactggcgcctt

SEQ ID NO: 5779705 - DNA, 20 bp, Homo sapiens
gtccttcactggcgccttct

SEQ ID NO: 5779706 - DNA, 14 bp, Homo sapiens
gtccttcagagctc

SEQ ID NO: 5779707 - DNA, 15 bp, Homo sapiens
gtccttcagatggaa

SEQ ID NO: 5779708 - DNA, 19 bp, Homo sapiens
gtccttcagtttagaacct

SEQ ID NO: 5779709 - DNA, 15 bp, Homo sapiens
gtccttccacctgcc

SEQ ID NO: 5779710 - DNA, 14 bp, Homo sapiens
gtccttccaggccc

SEQ ID NO: 5779711 - DNA, 22 bp, Homo sapiens
gtccttccaggcccccaccact

SEQ ID NO: 5779712 - DNA, 19 bp, Homo sapiens
gtccttcccacggccactg

SEQ ID NO: 5779713 - DNA, 22 bp, Homo sapiens
gtccttcccacggccactgcag

SEQ ID NO: 5779714 - DNA, 15 bp, Homo sapiens
gtccttccccttccc

SEQ ID NO: 5779715 - DNA, 16 bp, Homo sapiens
gtccttccctcaaaga

SEQ ID NO: 5779716 - DNA, 12 bp, Homo sapiens
gtccttccctct

SEQ ID NO: 5779717 - DNA, 19 bp, Homo sapiens
gtccttccctgatggcctt

SEQ ID NO: 5779718 - DNA, 20 bp, Homo sapiens
gtccttccctgttctccctt

SEQ ID NO: 5779719 - DNA, 19 bp, Homo sapiens
gtccttccttgactgtcta

SEQ ID NO: 5779720 - DNA, 23 bp, Homo sapiens
gtccttctacagaacctgagggc

SEQ ID NO: 5779721 - DNA, 21 bp, Homo sapiens
gtccttctagcttttctcttt

SEQ ID NO: 5779722 - DNA, 15 bp, Homo sapiens
gtccttctcattcat

SEQ ID NO: 5779723 - DNA, 12 bp, Homo sapiens
gtccttgaaaca

SEQ ID NO: 5779724 - DNA, 14 bp, Homo sapiens
gtccttgaactgag

SEQ ID NO: 5779725 - DNA, 18 bp, Homo sapiens
gtccttgaactgaggccc

SEQ ID NO: 5779726 - DNA, 17 bp, Homo sapiens
gtccttgaagcttgtat

SEQ ID NO: 5779727 - DNA, 22 bp, Homo sapiens
gtccttgaagcttgtatctgat

SEQ ID NO: 5779728 - DNA, 19 bp, Homo sapiens
gtccttgagtgctcttgct

SEQ ID NO: 5779729 - DNA, 16 bp, Homo sapiens
gtccttgatgccagag

SEQ ID NO: 5779730 - DNA, 18 bp, Homo sapiens
gtccttgatgccagaggg

SEQ ID NO: 5779731 - DNA, 16 bp, Homo sapiens
gtccttgatttcaaag

SEQ ID NO: 5779732 - DNA, 16 bp, Homo sapiens
gtccttgcacccctca

SEQ ID NO: 5779733 - DNA, 18 bp, Homo sapiens
gtccttgcacccctcact

SEQ ID NO: 5779734 - DNA, 14 bp, Homo sapiens
gtccttgcacctgc

SEQ ID NO: 5779735 - DNA, 17 bp, Homo sapiens
gtccttgcacctgcatc

SEQ ID NO: 5779736 - DNA, 15 bp, Homo sapiens
gtccttgcagacaga

SEQ ID NO: 5779737 - DNA, 14 bp, Homo sapiens
gtccttgccccact

SEQ ID NO: 5779738 - DNA, 15 bp, Homo sapiens
gtccttgcctcctgg

SEQ ID NO: 5779739 - DNA, 12 bp, Homo sapiens
gtccttgcctga

SEQ ID NO: 5779740 - DNA, 20 bp, Homo sapiens
gtccttgcctgaactccaga

SEQ ID NO: 5779741 - DNA, 21 bp, Homo sapiens
gtccttgcctgaactccagag

SEQ ID NO: 5779742 - DNA, 17 bp, Homo sapiens
gtccttgctcctggaac

SEQ ID NO: 5779743 - DNA, 22 bp, Homo sapiens
gtccttgctggttttctggatg

SEQ ID NO: 5779744 - DNA, 17 bp, Homo sapiens
gtccttggaagtttcat

SEQ ID NO: 5779745 - DNA, 23 bp, Homo sapiens
gtccttggactgttttgaaaagt

SEQ ID NO: 5779746 - DNA, 13 bp, Homo sapiens
gtccttggaggaa

SEQ ID NO: 5779747 - DNA, 13 bp, Homo sapiens
gtccttggagtga

SEQ ID NO: 5779748 - DNA, 15 bp, Homo sapiens
gtccttggctgccgt

SEQ ID NO: 5779749 - DNA, 17 bp, Homo sapiens
gtccttgggcctggcca

SEQ ID NO: 5779750 - DNA, 18 bp, Homo sapiens
gtccttggggacatctca

SEQ ID NO: 5779751 - DNA, 23 bp, Homo sapiens
gtccttggtggccgggggtgggg

SEQ ID NO: 5779752 - DNA, 22 bp, Homo sapiens
gtccttgtatgaataaaaggct

SEQ ID NO: 5779753 - DNA, 23 bp, Homo sapiens
gtccttgtatgaataaaaggctg

SEQ ID NO: 5779754 - DNA, 13 bp, Homo sapiens
gtccttgtccccg

SEQ ID NO: 5779755 - DNA, 21 bp, Homo sapiens
gtccttgtgatgtgcacgtaa

SEQ ID NO: 5779756 - DNA, 21 bp, Homo sapiens
gtccttgttcatggagagctg

SEQ ID NO: 5779757 - DNA, 21 bp, Homo sapiens
gtcctttacactcaggctttc

SEQ ID NO: 5779758 - DNA, 13 bp, Homo sapiens
gtcctttagaaac

SEQ ID NO: 5779759 - DNA, 14 bp, Homo sapiens
gtcctttaggcagc

SEQ ID NO: 5779760 - DNA, 17 bp, Homo sapiens
gtcctttaggtttgaaa

SEQ ID NO: 5779761 - DNA, 14 bp, Homo sapiens
gtcctttagtacct

SEQ ID NO: 5779762 - DNA, 15 bp, Homo sapiens
gtcctttatctgcac

SEQ ID NO: 5779763 - DNA, 16 bp, Homo sapiens
gtcgtctttgtgtatg

SEQ ID NO: 5779764 - DNA, 18 bp, Homo sapiens
gtcgtgaatcttgttcaa

SEQ ID NO: 5779765 - DNA, 17 bp, Homo sapiens
gtcgtgatgtggaggaa

SEQ ID NO: 5779766 - DNA, 22 bp, Homo sapiens
gtcgtggaattaaatcacggat

SEQ ID NO: 5779767 - DNA, 16 bp, Homo sapiens
gtcgtggactccagct

SEQ ID NO: 5779768 - DNA, 21 bp, Homo sapiens
gtcgtggagagctaggagcaa

SEQ ID NO: 5779769 - DNA, 24 bp, Homo sapiens
gtcgtggagagctaggagcaaagc

SEQ ID NO: 5779770 - DNA, 15 bp, Homo sapiens
gtcgtggcagataat

SEQ ID NO: 5779771 - DNA, 23 bp, Homo sapiens
gtcgtggcagataatcagcctct

SEQ ID NO: 5779772 - DNA, 14 bp, Homo sapiens
gtcgtggttcttaa

SEQ ID NO: 5779773 - DNA, 20 bp, Homo sapiens
gtcgtggttcttaaatgttt

SEQ ID NO: 5779774 - DNA, 17 bp, Homo sapiens
gtcgtgtctgctgttgt

SEQ ID NO: 5779775 - DNA, 19 bp, Homo sapiens
gtcgtgttttcaaggaaga

SEQ ID NO: 5779776 - DNA, 17 bp, Homo sapiens
gtcgttatatttgactt

SEQ ID NO: 5779777 - DNA, 14 bp, Homo sapiens
gtcgttcaattcat

SEQ ID NO: 5779778 - DNA, 19 bp, Homo sapiens
gtcgttgagggaatgacac

SEQ ID NO: 5779779 - DNA, 22 bp, Homo sapiens
gtcgtttatgtgtgcagacaat

SEQ ID NO: 5779780 - DNA, 16 bp, Homo sapiens
gtcgtttcattcattt

SEQ ID NO: 5779781 - DNA, 19 bp, Homo sapiens
gtcgtttgtgaacgctgtg

SEQ ID NO: 5779782 - DNA, 18 bp, Homo sapiens
gtcgttttagtgtctgac

SEQ ID NO: 5779783 - DNA, 17 bp, Homo sapiens
gtcgttttccaaactga

SEQ ID NO: 5779784 - DNA, 23 bp, Homo sapiens
gtcgttttttttttttcttttct

SEQ ID NO: 5779785 - DNA, 20 bp, Homo sapiens
gtctaaaaagacctggcctt

SEQ ID NO: 5779786 - DNA, 14 bp, Homo sapiens
gtctaaaaataaaa

SEQ ID NO: 5779787 - DNA, 21 bp, Homo sapiens
gtctaaaaataaaatgcattt

SEQ ID NO: 5779788 - DNA, 22 bp, Homo sapiens
gtctaaaacagctatttccctt

SEQ ID NO: 5779789 - DNA, 17 bp, Homo sapiens
gtctaaaagattcttta

SEQ ID NO: 5779790 - DNA, 21 bp, Homo sapiens
gtctaaaatacttgagaaatt

SEQ ID NO: 5779791 - DNA, 16 bp, Homo sapiens
gtctaaaatcctgctt

SEQ ID NO: 5779792 - DNA, 14 bp, Homo sapiens
gtctaaacaaaatt

SEQ ID NO: 5779793 - DNA, 21 bp, Homo sapiens
gtctaaaccaagattatgtga

SEQ ID NO: 5779794 - DNA, 13 bp, Homo sapiens
gtctaaactgagc

SEQ ID NO: 5779795 - DNA, 14 bp, Homo sapiens
gtctaaagagaaca

SEQ ID NO: 5779796 - DNA, 16 bp, Homo sapiens
gtctaaagccttaact

SEQ ID NO: 5779797 - DNA, 23 bp, Homo sapiens
gtctaaagttagggcatttttct

SEQ ID NO: 5779798 - DNA, 15 bp, Homo sapiens
gtctaaagtttacag

SEQ ID NO: 5779799 - DNA, 16 bp, Homo sapiens
gtctaaataagtttgc

SEQ ID NO: 5779800 - DNA, 22 bp, Homo sapiens
gtctaaataggatcctggaggc

SEQ ID NO: 5779801 - DNA, 13 bp, Homo sapiens
gtctaaattttct

SEQ ID NO: 5779802 - DNA, 16 bp, Homo sapiens
gtctaaattttctaaa

SEQ ID NO: 5779803 - DNA, 18 bp, Homo sapiens
gtctaaccccaggttttc

SEQ ID NO: 5779804 - DNA, 18 bp, Homo sapiens
gtctaacccccagctggg

SEQ ID NO: 5779805 - DNA, 14 bp, Homo sapiens
gtctaacttttgtg

SEQ ID NO: 5779806 - DNA, 18 bp, Homo sapiens
gtctaacttttgtgtgaa

SEQ ID NO: 5779807 - DNA, 15 bp, Homo sapiens
gtctaagaaacattg

SEQ ID NO: 5779808 - DNA, 13 bp, Homo sapiens
gtctaagattcta

SEQ ID NO: 5779809 - DNA, 14 bp, Homo sapiens
gtctaagattctag

SEQ ID NO: 5779810 - DNA, 20 bp, Homo sapiens
gtctaagcaagatgttttgt

SEQ ID NO: 5779811 - DNA, 15 bp, Homo sapiens
gtctaagcaatactt

SEQ ID NO: 5779812 - DNA, 21 bp, Homo sapiens
gtctaagcagttttgtaaatg

SEQ ID NO: 5779813 - DNA, 13 bp, Homo sapiens
gtctaaggaagaa

SEQ ID NO: 5779814 - DNA, 14 bp, Homo sapiens
gtctaaggaagaat

SEQ ID NO: 5779815 - DNA, 18 bp, Homo sapiens
gtctaagtagggccaggg

SEQ ID NO: 5779816 - DNA, 22 bp, Homo sapiens
gtctaatcagtgattatttttc

SEQ ID NO: 5779817 - DNA, 17 bp, Homo sapiens
gtctaatgaagagaaaa

SEQ ID NO: 5779818 - DNA, 22 bp, Homo sapiens
gtctaatgattcaaatgtttta

SEQ ID NO: 5779819 - DNA, 15 bp, Homo sapiens
gtctaatgtttaagc

SEQ ID NO: 5779820 - DNA, 16 bp, Homo sapiens
gtctaattcatttact

SEQ ID NO: 5779821 - DNA, 22 bp, Homo sapiens
gtctaattcatttactcaccat

SEQ ID NO: 5779822 - DNA, 22 bp, Homo sapiens
gtctaattgcatctcaaaatta

SEQ ID NO: 5779823 - DNA, 15 bp, Homo sapiens
gtctacaaaagcaaa

SEQ ID NO: 5779824 - DNA, 21 bp, Homo sapiens
gtctacaaactgaacactgca

SEQ ID NO: 5779825 - DNA, 15 bp, Homo sapiens
gtctacaaatataag

SEQ ID NO: 5779826 - DNA, 17 bp, Homo sapiens
gtctacacaccctgcat

SEQ ID NO: 5779827 - DNA, 15 bp, Homo sapiens
gtctacactgccttt

SEQ ID NO: 5779828 - DNA, 15 bp, Homo sapiens
gtctacactgtgctg

SEQ ID NO: 5779829 - DNA, 15 bp, Homo sapiens
gtctacagctccccc

SEQ ID NO: 5779830 - DNA, 16 bp, Homo sapiens
gtctacagttgtcctg

SEQ ID NO: 5779831 - DNA, 14 bp, Homo sapiens
gtctacattaaaca

SEQ ID NO: 5779832 - DNA, 15 bp, Homo sapiens
gtctacattaaacaa

SEQ ID NO: 5779833 - DNA, 18 bp, Homo sapiens
gtctaccaatacaaaatg

SEQ ID NO: 5779834 - DNA, 13 bp, Homo sapiens
gtctacccagaga

SEQ ID NO: 5779835 - DNA, 21 bp, Homo sapiens
gtctacccagagaagcccctt

SEQ ID NO: 5779836 - DNA, 14 bp, Homo sapiens
gtctaccctgggat

SEQ ID NO: 5779837 - DNA, 15 bp, Homo sapiens
gtctaccctgtcctt

SEQ ID NO: 5779838 - DNA, 17 bp, Homo sapiens
gtctacctgagcattca

SEQ ID NO: 5779839 - DNA, 18 bp, Homo sapiens
gtctacgttctccagccc

SEQ ID NO: 5779840 - DNA, 20 bp, Homo sapiens
gtctactaaataatacttta

SEQ ID NO: 5779841 - DNA, 17 bp, Homo sapiens
gtctactcttaagccat

SEQ ID NO: 5779842 - DNA, 12 bp, Homo sapiens
gtctactgcaag

SEQ ID NO: 5779843 - DNA, 18 bp, Homo sapiens
gtctactgcaagagccaa

SEQ ID NO: 5779844 - DNA, 15 bp, Homo sapiens
gtctacttgctcagg

SEQ ID NO: 5779845 - DNA, 14 bp, Homo sapiens
gtctactttctctt

SEQ ID NO: 5779846 - DNA, 15 bp, Homo sapiens
gtctactttctcttg

SEQ ID NO: 5779847 - DNA, 16 bp, Homo sapiens
gtctactttctcttgt

SEQ ID NO: 5779848 - DNA, 13 bp, Homo sapiens
gtctagaaaccag

SEQ ID NO: 5779849 - DNA, 22 bp, Homo sapiens
gtctagaaatgcggtctggtct

SEQ ID NO: 5779850 - DNA, 14 bp, Homo sapiens
gtctagaaggccag

SEQ ID NO: 5779851 - DNA, 16 bp, Homo sapiens
gtctagaaggccaggc

SEQ ID NO: 5779852 - DNA, 17 bp, Homo sapiens
gtctagaaggccaggcc

SEQ ID NO: 5779853 - DNA, 18 bp, Homo sapiens
gtctagaatcctgcttta

SEQ ID NO: 5779854 - DNA, 14 bp, Homo sapiens
gtctagaccagggc

SEQ ID NO: 5779855 - DNA, 15 bp, Homo sapiens
gtctagaccagggct

SEQ ID NO: 5779856 - DNA, 16 bp, Homo sapiens
gtctagactaaaagat

SEQ ID NO: 5779857 - DNA, 16 bp, Homo sapiens
gtctagactggcctag

SEQ ID NO: 5779858 - DNA, 21 bp, Homo sapiens
gtctagagagggaggcaagcc

SEQ ID NO: 5779859 - DNA, 20 bp, Homo sapiens
gtctagaggcaacagtgttc

SEQ ID NO: 5779860 - DNA, 18 bp, Homo sapiens
gtctagaggcagactcct

SEQ ID NO: 5779861 - DNA, 16 bp, Homo sapiens
gtctagagtcatgtga

SEQ ID NO: 5779862 - DNA, 17 bp, Homo sapiens
gtctagatggctcctct

SEQ ID NO: 5779863 - DNA, 22 bp, Homo sapiens
gtctagatgtttattcttctag

SEQ ID NO: 5779864 - DNA, 15 bp, Homo sapiens
gtctagattcaaagg

SEQ ID NO: 5779865 - DNA, 20 bp, Homo sapiens
gtctagattcaaaggttcta

SEQ ID NO: 5779866 - DNA, 14 bp, Homo sapiens
gtctagattttgaa

SEQ ID NO: 5779867 - DNA, 20 bp, Homo sapiens
gtctagattttgaaaaatta

SEQ ID NO: 5779868 - DNA, 22 bp, Homo sapiens
gtctagccgctgccctgggtcc

SEQ ID NO: 5779869 - DNA, 21 bp, Homo sapiens
gtctagcgtagtgcagcaggg

SEQ ID NO: 5779870 - DNA, 22 bp, Homo sapiens
gtctagctatgctgtatctgtg

SEQ ID NO: 5779871 - DNA, 18 bp, Homo sapiens
gtctagctttcctttcct

SEQ ID NO: 5779872 - DNA, 14 bp, Homo sapiens
gtctaggacacagt

SEQ ID NO: 5779873 - DNA, 17 bp, Homo sapiens
gtctaggagatgctttc

SEQ ID NO: 5779874 - DNA, 15 bp, Homo sapiens
gtctaggataatttt

SEQ ID NO: 5779875 - DNA, 19 bp, Homo sapiens
gtctaggtctcctcagggt

SEQ ID NO: 5779876 - DNA, 15 bp, Homo sapiens
gtctaggttaaagct

SEQ ID NO: 5779877 - DNA, 16 bp, Homo sapiens
gtctaggttaaagcta

SEQ ID NO: 5779878 - DNA, 13 bp, Homo sapiens
gtctagtcctggg

SEQ ID NO: 5779879 - DNA, 14 bp, Homo sapiens
gtctagtctctcct

SEQ ID NO: 5779880 - DNA, 14 bp, Homo sapiens
gtctagtcttctgg

SEQ ID NO: 5779881 - DNA, 18 bp, Homo sapiens
gtctagtgtattctcttc

SEQ ID NO: 5779882 - DNA, 21 bp, Homo sapiens
gtctagttgccaaatctggct

SEQ ID NO: 5779883 - DNA, 17 bp, Homo sapiens
gtctagtttcattatag

SEQ ID NO: 5779884 - DNA, 17 bp, Homo sapiens
gtctataaaagaaacac

SEQ ID NO: 5779885 - DNA, 12 bp, Homo sapiens
gtctataaaata

SEQ ID NO: 5779886 - DNA, 19 bp, Homo sapiens
gtctataaaataaacttct

SEQ ID NO: 5779887 - DNA, 20 bp, Homo sapiens
gtctataaaataaacttctt

SEQ ID NO: 5779888 - DNA, 22 bp, Homo sapiens
gtctataaaataaacttcttaa

SEQ ID NO: 5779889 - DNA, 13 bp, Homo sapiens
gtctataaagcat

SEQ ID NO: 5779890 - DNA, 15 bp, Homo sapiens
gtctataaagcattt

SEQ ID NO: 5779891 - DNA, 20 bp, Homo sapiens
gtctataaagcatttaaccc

SEQ ID NO: 5779892 - DNA, 20 bp, Homo sapiens
gtctataatcccagcacttt

SEQ ID NO: 5779893 - DNA, 20 bp, Homo sapiens
gtctataatggaaacattta

SEQ ID NO: 5779894 - DNA, 22 bp, Homo sapiens
gtctataattccttaaaatttt

SEQ ID NO: 5779895 - DNA, 13 bp, Homo sapiens
gtctataggtttg

SEQ ID NO: 5779896 - DNA, 21 bp, Homo sapiens
gtctatataaccacatttcta

SEQ ID NO: 5779897 - DNA, 22 bp, Homo sapiens
gtctatataaccacatttctaa

SEQ ID NO: 5779898 - DNA, 17 bp, Homo sapiens
gtctatatcataactat

SEQ ID NO: 5779899 - DNA, 23 bp, Homo sapiens
gtctatcaaccccagacactggt

SEQ ID NO: 5779900 - DNA, 20 bp, Homo sapiens
gtctatcctagtcttcacaa

SEQ ID NO: 5779901 - DNA, 13 bp, Homo sapiens
gtctatcttgtaa

SEQ ID NO: 5779902 - DNA, 16 bp, Homo sapiens
gtctatgaagttgctg

SEQ ID NO: 5779903 - DNA, 14 bp, Homo sapiens
gtctatgcagcctg

SEQ ID NO: 5779904 - DNA, 16 bp, Homo sapiens
gtctatggagcagccg

SEQ ID NO: 5779905 - DNA, 15 bp, Homo sapiens
gtctatgggactcaa

SEQ ID NO: 5779906 - DNA, 15 bp, Homo sapiens
gtctatgtgtatata

SEQ ID NO: 5779907 - DNA, 20 bp, Homo sapiens
gtctatgtgtatatattata

SEQ ID NO: 5779908 - DNA, 18 bp, Homo sapiens
gtctattaaaattctgat

SEQ ID NO: 5779909 - DNA, 20 bp, Homo sapiens
gtctattaaaattctgatgt

SEQ ID NO: 5779910 - DNA, 20 bp, Homo sapiens
gtctattaaagatatttctt

SEQ ID NO: 5779911 - DNA, 14 bp, Homo sapiens
gtctattagttttc

SEQ ID NO: 5779912 - DNA, 19 bp, Homo sapiens
gtctattatagtgaaacat

SEQ ID NO: 5779913 - DNA, 14 bp, Homo sapiens
gtctattattgaaa

SEQ ID NO: 5779914 - DNA, 13 bp, Homo sapiens
gtctattcagctt

SEQ ID NO: 5779915 - DNA, 21 bp, Homo sapiens
gtctattcattaagtaatctt

SEQ ID NO: 5779916 - DNA, 14 bp, Homo sapiens
gtctattccattcc

SEQ ID NO: 5779917 - DNA, 17 bp, Homo sapiens
gtctattctgagccttg

SEQ ID NO: 5779918 - DNA, 10 bp, Homo sapiens
gtctatttaa

SEQ ID NO: 5779919 - DNA, 20 bp, Homo sapiens
gtctatttacggaactcaaa

SEQ ID NO: 5779920 - DNA, 20 bp, Homo sapiens
gtctatttccactgaacaaa

SEQ ID NO: 5779921 - DNA, 14 bp, Homo sapiens
gtctatttctagtt

SEQ ID NO: 5779922 - DNA, 16 bp, Homo sapiens
gtctatttgtctctta

SEQ ID NO: 5779923 - DNA, 16 bp, Homo sapiens
gtctattttctgcaga

SEQ ID NO: 5779924 - DNA, 18 bp, Homo sapiens
gtctattttgtatatttg

SEQ ID NO: 5779925 - DNA, 19 bp, Homo sapiens
gtctattttttctgaggaa

SEQ ID NO: 5779926 - DNA, 20 bp, Homo sapiens
gtctattttttctgaggaat

SEQ ID NO: 5779927 - DNA, 13 bp, Homo sapiens
gtctattttttta

SEQ ID NO: 5779928 - DNA, 17 bp, Homo sapiens
gtctcaaaaaaagaaaa

SEQ ID NO: 5779929 - DNA, 19 bp, Homo sapiens
gtctcaaaaaaagaaaaag

SEQ ID NO: 5779930 - DNA, 17 bp, Homo sapiens
gtctcaaaataaagcaa

SEQ ID NO: 5779931 - DNA, 22 bp, Homo sapiens
gtctcaaaatatttttttaaga

SEQ ID NO: 5779932 - DNA, 22 bp, Homo sapiens
gtctcaaaatggtgtgctataa

SEQ ID NO: 5779933 - DNA, 20 bp, Homo sapiens
gtctcaaacctccaaaagcc

SEQ ID NO: 5779934 - DNA, 16 bp, Homo sapiens
gtctcaaactcctgac

SEQ ID NO: 5779935 - DNA, 20 bp, Homo sapiens
gtctcaaacttgtggcctca

SEQ ID NO: 5779936 - DNA, 21 bp, Homo sapiens
gtctcaaacttgtggcctcaa

SEQ ID NO: 5779937 - DNA, 22 bp, Homo sapiens
gtctcaaataataataataaca

SEQ ID NO: 5779938 - DNA, 21 bp, Homo sapiens
gtctcaacccttttgtctgcc

SEQ ID NO: 5779939 - DNA, 20 bp, Homo sapiens
gtctcaagagggcactggtg

SEQ ID NO: 5779940 - DNA, 22 bp, Homo sapiens
gtctcaagagggcactggtggc

SEQ ID NO: 5779941 - DNA, 20 bp, Homo sapiens
gtctcaagcactaaaaagtg

SEQ ID NO: 5779942 - DNA, 14 bp, Homo sapiens
gtctcaagggtggc

SEQ ID NO: 5779943 - DNA, 20 bp, Homo sapiens
gtctcaagggtggcaggtca

SEQ ID NO: 5779944 - DNA, 14 bp, Homo sapiens
gtctcaatgaaata

SEQ ID NO: 5779945 - DNA, 15 bp, Homo sapiens
gtctcaatgaaatag

SEQ ID NO: 5779946 - DNA, 12 bp, Homo sapiens
gtctcaatgctc

SEQ ID NO: 5779947 - DNA, 15 bp, Homo sapiens
gtctcaatggtgcta

SEQ ID NO: 5779948 - DNA, 15 bp, Homo sapiens
gtctcaatgttccat

SEQ ID NO: 5779949 - DNA, 20 bp, Homo sapiens
gtctcaattctgaaggggaa

SEQ ID NO: 5779950 - DNA, 23 bp, Homo sapiens
gtctcacaatagcgtgagctaac

SEQ ID NO: 5779951 - DNA, 14 bp, Homo sapiens
gtctcacactcctc

SEQ ID NO: 5779952 - DNA, 21 bp, Homo sapiens
gtctcacactcctcctgccag

SEQ ID NO: 5779953 - DNA, 21 bp, Homo sapiens
gtctcacagagaagctcctgc

SEQ ID NO: 5779954 - DNA, 17 bp, Homo sapiens
gtctcaccagctcagcc

SEQ ID NO: 5779955 - DNA, 23 bp, Homo sapiens
gtctcaccatttccccagggcac

SEQ ID NO: 5779956 - DNA, 23 bp, Homo sapiens
gtctcacccatgcaagcagagga

SEQ ID NO: 5779957 - DNA, 22 bp, Homo sapiens
gtctcacccattatctggaata

SEQ ID NO: 5779958 - DNA, 15 bp, Homo sapiens
gtctcaccctggagg

SEQ ID NO: 5779959 - DNA, 20 bp, Homo sapiens
gtctcaccctggaggcacct

SEQ ID NO: 5779960 - DNA, 19 bp, Homo sapiens
gtctcaccggctctcacct

SEQ ID NO: 5779961 - DNA, 20 bp, Homo sapiens
gtctcaccggctctcacctg

SEQ ID NO: 5779962 - DNA, 18 bp, Homo sapiens
gtctcaccttcgcctttg

SEQ ID NO: 5779963 - DNA, 14 bp, Homo sapiens
gtctcacgattcca

SEQ ID NO: 5779964 - DNA, 16 bp, Homo sapiens
gtctcacgattccagt

SEQ ID NO: 5779965 - DNA, 14 bp, Homo sapiens
gtctcacgcagcca

SEQ ID NO: 5779966 - DNA, 20 bp, Homo sapiens
gtctcactatgttgcccagg

SEQ ID NO: 5779967 - DNA, 13 bp, Homo sapiens
gtctcactcctga

SEQ ID NO: 5779968 - DNA, 16 bp, Homo sapiens
gtctcactcgttctgt

SEQ ID NO: 5779969 - DNA, 18 bp, Homo sapiens
gtctcactctgtcgccca

SEQ ID NO: 5779970 - DNA, 18 bp, Homo sapiens
gtctcactctgtcgctca

SEQ ID NO: 5779971 - DNA, 20 bp, Homo sapiens
gtctcactctgtcgctcagg

SEQ ID NO: 5779972 - DNA, 14 bp, Homo sapiens
gtctcactcttgtc

SEQ ID NO: 5779973 - DNA, 23 bp, Homo sapiens
gtctcactcttgtcacccaggct

SEQ ID NO: 5779974 - DNA, 20 bp, Homo sapiens
gtctcactgtgttgcccagg

SEQ ID NO: 5779975 - DNA, 15 bp, Homo sapiens
gtctcactgttctgc

SEQ ID NO: 5779976 - DNA, 16 bp, Homo sapiens
gtctcactgttgccca

SEQ ID NO: 5779977 - DNA, 16 bp, Homo sapiens
gtctcacttataccaa

SEQ ID NO: 5779978 - DNA, 20 bp, Homo sapiens
gtctcactttactttcaagt

SEQ ID NO: 5779979 - DNA, 16 bp, Homo sapiens
gtctcacttttaaaaa

SEQ ID NO: 5779980 - DNA, 17 bp, Homo sapiens
gtctcacttttaaaaag

SEQ ID NO: 5779981 - DNA, 14 bp, Homo sapiens
gtctcacttttcat

SEQ ID NO: 5779982 - DNA, 21 bp, Homo sapiens
gtctcactttttacccagaac

SEQ ID NO: 5779983 - DNA, 17 bp, Homo sapiens
gtctcagaaactcccct

SEQ ID NO: 5779984 - DNA, 21 bp, Homo sapiens
gtctcagaaactcccctgggg

SEQ ID NO: 5779985 - DNA, 23 bp, Homo sapiens
gtctcagaaactcccctgggggt

SEQ ID NO: 5779986 - DNA, 21 bp, Homo sapiens
gtctcagaaggctctatctgc

SEQ ID NO: 5779987 - DNA, 13 bp, Homo sapiens
gtctcagaatcta

SEQ ID NO: 5779988 - DNA, 22 bp, Homo sapiens
gtctcagacgactagcccagga

SEQ ID NO: 5779989 - DNA, 24 bp, Homo sapiens
gtctcagactctttttgtacctgg

SEQ ID NO: 5779990 - DNA, 17 bp, Homo sapiens
gtctcagagaccagcac

SEQ ID NO: 5779991 - DNA, 19 bp, Homo sapiens
gtctcagagcacagaggta

SEQ ID NO: 5779992 - DNA, 17 bp, Homo sapiens
gtctcagagccttccat

SEQ ID NO: 5779993 - DNA, 13 bp, Homo sapiens
gtctcagcctccc

SEQ ID NO: 5779994 - DNA, 17 bp, Homo sapiens
gtctcagcctctgccag

SEQ ID NO: 5779995 - DNA, 18 bp, Homo sapiens
gtctcagcctctgccagc

SEQ ID NO: 5779996 - DNA, 22 bp, Homo sapiens
gtctcagcctctgccagcgcca

SEQ ID NO: 5779997 - DNA, 14 bp, Homo sapiens
gtctcagcctgggc

SEQ ID NO: 5779998 - DNA, 19 bp, Homo sapiens
gtctcagcctgggcccctc

SEQ ID NO: 5779999 - DNA, 21 bp, Homo sapiens
gtctcagcctgggcccctcag

SEQ ID NO: 5780000 - DNA, 22 bp, Homo sapiens
gtctcagcctgggcccctcagc

SEQ ID NO: 5780001 - DNA, 24 bp, Homo sapiens
gtctcagcctgggcccctcagcca

SEQ ID NO: 5780002 - DNA, 14 bp, Homo sapiens
gtctcagctgctga

SEQ ID NO: 5780003 - DNA, 15 bp, Homo sapiens
gtctcagctgctgaa

SEQ ID NO: 5780004 - DNA, 10 bp, Homo sapiens
gtctcaggag

SEQ ID NO: 5780005 - DNA, 14 bp, Homo sapiens
gtctcaggaggagg

SEQ ID NO: 5780006 - DNA, 12 bp, Homo sapiens
gtctcaggcagc

SEQ ID NO: 5780007 - DNA, 16 bp, Homo sapiens
gtctcaggcagcacca

SEQ ID NO: 5780008 - DNA, 14 bp, Homo sapiens
gtctcaggcctcca

SEQ ID NO: 5780009 - DNA, 14 bp, Homo sapiens
gtctcaggctgcct

SEQ ID NO: 5780010 - DNA, 20 bp, Homo sapiens
gtctcagtacacttcctgtg

SEQ ID NO: 5780011 - DNA, 18 bp, Homo sapiens
gtctcagtacctcccctc

SEQ ID NO: 5780012 - DNA, 15 bp, Homo sapiens
gtctcagtctgtcac

SEQ ID NO: 5780013 - DNA, 22 bp, Homo sapiens
gtctcagtggcttcatctgtca

SEQ ID NO: 5780014 - DNA, 19 bp, Homo sapiens
gtctcagttctcttgcttt

SEQ ID NO: 5780015 - DNA, 18 bp, Homo sapiens
gtctcagtttgtgtgtct

SEQ ID NO: 5780016 - DNA, 19 bp, Homo sapiens
gtctcagtttgtgtgtctt

SEQ ID NO: 5780017 - DNA, 21 bp, Homo sapiens
gtctcagtttgtgtgtcttaa

SEQ ID NO: 5780018 - DNA, 22 bp, Homo sapiens
gtctcatagttggactttctag

SEQ ID NO: 5780019 - DNA, 15 bp, Homo sapiens
gtctcatattttcag

SEQ ID NO: 5780020 - DNA, 17 bp, Homo sapiens
gtctcatatttttacaa

SEQ ID NO: 5780021 - DNA, 19 bp, Homo sapiens
gtctcatccacataagcac

SEQ ID NO: 5780022 - DNA, 16 bp, Homo sapiens
gtctcatccatcatca

SEQ ID NO: 5780023 - DNA, 12 bp, Homo sapiens
gtctcatcccat

SEQ ID NO: 5780024 - DNA, 14 bp, Homo sapiens
gtctcatccccagg

SEQ ID NO: 5780025 - DNA, 15 bp, Homo sapiens
gtctcatcctccttt

SEQ ID NO: 5780026 - DNA, 18 bp, Homo sapiens
gtctcatctcctgaccct

SEQ ID NO: 5780027 - DNA, 18 bp, Homo sapiens
gtctcatctcctttgcta

SEQ ID NO: 5780028 - DNA, 15 bp, Homo sapiens
gtctcatctcttcag

SEQ ID NO: 5780029 - DNA, 13 bp, Homo sapiens
gtctcatctgggg

SEQ ID NO: 5780030 - DNA, 16 bp, Homo sapiens
gtctcatgccagcagc

SEQ ID NO: 5780031 - DNA, 15 bp, Homo sapiens
gtctcatgcctgaga

SEQ ID NO: 5780032 - DNA, 21 bp, Homo sapiens
gtctcatgcctgagaatgcct

SEQ ID NO: 5780033 - DNA, 19 bp, Homo sapiens
gtctcatgctccttaatgg

SEQ ID NO: 5780034 - DNA, 14 bp, Homo sapiens
gtctcatgggaagc

SEQ ID NO: 5780035 - DNA, 17 bp, Homo sapiens
gtctcatggtcccactt

SEQ ID NO: 5780036 - DNA, 19 bp, Homo sapiens
gtctcatgtaaaataagaa

SEQ ID NO: 5780037 - DNA, 15 bp, Homo sapiens
gtctcatgtaacaca

SEQ ID NO: 5780038 - DNA, 11 bp, Homo sapiens
gtctcatgtgt

SEQ ID NO: 5780039 - DNA, 13 bp, Homo sapiens
gtctcatgtttta

SEQ ID NO: 5780040 - DNA, 19 bp, Homo sapiens
gtctcattccgttgtctgt

SEQ ID NO: 5780041 - DNA, 17 bp, Homo sapiens
gtctcattcctctgtcc

SEQ ID NO: 5780042 - DNA, 18 bp, Homo sapiens
gtctcattcctctgtccc

SEQ ID NO: 5780043 - DNA, 17 bp, Homo sapiens
gtctcattcgcctttgt

SEQ ID NO: 5780044 - DNA, 19 bp, Homo sapiens
gtctcattcgcctttgtct

SEQ ID NO: 5780045 - DNA, 12 bp, Homo sapiens
gtctcattgcca

SEQ ID NO: 5780046 - DNA, 17 bp, Homo sapiens
gtctcattgccagtggt

SEQ ID NO: 5780047 - DNA, 15 bp, Homo sapiens
gtctcattgcttctg

SEQ ID NO: 5780048 - DNA, 19 bp, Homo sapiens
gtctcattgtcacctctgt

SEQ ID NO: 5780049 - DNA, 21 bp, Homo sapiens
gtctcatttaggactgggttc

SEQ ID NO: 5780050 - DNA, 16 bp, Homo sapiens
gtctcattttaatgta

SEQ ID NO: 5780051 - DNA, 22 bp, Homo sapiens
gtctcattttaatgtaaagatt

SEQ ID NO: 5780052 - DNA, 19 bp, Homo sapiens
gtctcattttggtctgttt

SEQ ID NO: 5780053 - DNA, 20 bp, Homo sapiens
gtctcattttgtatgtatgt

SEQ ID NO: 5780054 - DNA, 23 bp, Homo sapiens
gtctcattttgtccatgtccccc

SEQ ID NO: 5780055 - DNA, 20 bp, Homo sapiens
gtctccaaagaagatagctc

SEQ ID NO: 5780056 - DNA, 17 bp, Homo sapiens
gtctccaaccccccagc

SEQ ID NO: 5780057 - DNA, 14 bp, Homo sapiens
gtctccaagacctt

SEQ ID NO: 5780058 - DNA, 20 bp, Homo sapiens
gtctccacacacagctgggc

SEQ ID NO: 5780059 - DNA, 23 bp, Homo sapiens
gtctccacacacagctgggctgt

SEQ ID NO: 5780060 - DNA, 17 bp, Homo sapiens
gtctccacactgctgct

SEQ ID NO: 5780061 - DNA, 12 bp, Homo sapiens
gtctccaccagg

SEQ ID NO: 5780062 - DNA, 16 bp, Homo sapiens
gtctccaccaggaacc

SEQ ID NO: 5780063 - DNA, 14 bp, Homo sapiens
gtctccaccccagg

SEQ ID NO: 5780064 - DNA, 14 bp, Homo sapiens
gtctccacccctca

SEQ ID NO: 5780065 - DNA, 17 bp, Homo sapiens
gtctccacccctcaagc

SEQ ID NO: 5780066 - DNA, 20 bp, Homo sapiens
gtctccacctcaggggagac

SEQ ID NO: 5780067 - DNA, 18 bp, Homo sapiens
gtctccacctgagaccct

SEQ ID NO: 5780068 - DNA, 17 bp, Homo sapiens
gtctccacctgcacatt

SEQ ID NO: 5780069 - DNA, 12 bp, Homo sapiens
gtctccacctgt

SEQ ID NO: 5780070 - DNA, 15 bp, Homo sapiens
gtctccacctgtgct

SEQ ID NO: 5780071 - DNA, 16 bp, Homo sapiens
gtctccacctgtgctt

SEQ ID NO: 5780072 - DNA, 22 bp, Homo sapiens
gtctccactaaatgagctcctg

SEQ ID NO: 5780073 - DNA, 17 bp, Homo sapiens
gtctccactgaggatgt

SEQ ID NO: 5780074 - DNA, 19 bp, Homo sapiens
gtctccactgaggatgtga

SEQ ID NO: 5780075 - DNA, 20 bp, Homo sapiens
gtctccacttgtatatatgg

SEQ ID NO: 5780076 - DNA, 20 bp, Homo sapiens
gtctccagccccttctcaga

SEQ ID NO: 5780077 - DNA, 15 bp, Homo sapiens
gtctccagctcctct

SEQ ID NO: 5780078 - DNA, 11 bp, Homo sapiens
gtctccagctg

SEQ ID NO: 5780079 - DNA, 13 bp, Homo sapiens
gtctccagctgat

SEQ ID NO: 5780080 - DNA, 13 bp, Homo sapiens
gtctccagctgcc

SEQ ID NO: 5780081 - DNA, 15 bp, Homo sapiens
gtctccagctgcctg

SEQ ID NO: 5780082 - DNA, 16 bp, Homo sapiens
gtctccagctgcctgg

SEQ ID NO: 5780083 - DNA, 20 bp, Homo sapiens
gtctccagctgcctgggccc

SEQ ID NO: 5780084 - DNA, 23 bp, Homo sapiens
gtctccagctgcctgggcccgga

SEQ ID NO: 5780085 - DNA, 14 bp, Homo sapiens
gtctccagctgctg

SEQ ID NO: 5780086 - DNA, 23 bp, Homo sapiens
gtctccagggacccttgcctgcc

SEQ ID NO: 5780087 - DNA, 22 bp, Homo sapiens
gtctccagggccccccaactgt

SEQ ID NO: 5780088 - DNA, 14 bp, Homo sapiens
gtctccaggggcct

SEQ ID NO: 5780089 - DNA, 20 bp, Homo sapiens
gtctccaggggcctgcagaa

SEQ ID NO: 5780090 - DNA, 19 bp, Homo sapiens
gtctccaggggctgcttcc

SEQ ID NO: 5780091 - DNA, 20 bp, Homo sapiens
gtctccaggggctgcttcct

SEQ ID NO: 5780092 - DNA, 22 bp, Homo sapiens
gtctccaggggctgcttcctcc

SEQ ID NO: 5780093 - DNA, 23 bp, Homo sapiens
gtctccaggggctgcttcctcct

SEQ ID NO: 5780094 - DNA, 19 bp, Homo sapiens
gtctccaggggtgccccag

SEQ ID NO: 5780095 - DNA, 9 bp, Homo sapiens
gtctccagt

SEQ ID NO: 5780096 - DNA, 19 bp, Homo sapiens
gtctccatatcagctctct

SEQ ID NO: 5780097 - DNA, 16 bp, Homo sapiens
gtctccatcaacactg

SEQ ID NO: 5780098 - DNA, 15 bp, Homo sapiens
gtctccatctctggt

SEQ ID NO: 5780099 - DNA, 21 bp, Homo sapiens
gtctccatgaggtactggtcc

SEQ ID NO: 5780100 - DNA, 20 bp, Homo sapiens
gtctccatgcacatgcacgc

SEQ ID NO: 5780101 - DNA, 21 bp, Homo sapiens
gtctccatgtgtgtgccaagc

SEQ ID NO: 5780102 - DNA, 23 bp, Homo sapiens
gtctccattgtgtgatccagccc

SEQ ID NO: 5780103 - DNA, 20 bp, Homo sapiens
gtctccattgttaaatgttc

SEQ ID NO: 5780104 - DNA, 16 bp, Homo sapiens
gtctcccaaagtgctg

SEQ ID NO: 5780105 - DNA, 15 bp, Homo sapiens
gtctcccaacaagtg

SEQ ID NO: 5780106 - DNA, 12 bp, Homo sapiens
gtctcccaaggc

SEQ ID NO: 5780107 - DNA, 16 bp, Homo sapiens
gtctcccaccctttct

SEQ ID NO: 5780108 - DNA, 20 bp, Homo sapiens
gtctcccaccctttctgcca

SEQ ID NO: 5780109 - DNA, 17 bp, Homo sapiens
gtctcccacgtgggaga

SEQ ID NO: 5780110 - DNA, 18 bp, Homo sapiens
gtctcccactttctgttc

SEQ ID NO: 5780111 - DNA, 11 bp, Homo sapiens
gtctcccagat

SEQ ID NO: 5780112 - DNA, 14 bp, Homo sapiens
gtctcccaggctgc

SEQ ID NO: 5780113 - DNA, 23 bp, Homo sapiens
gtctcccaggctgctggagtgca

SEQ ID NO: 5780114 - DNA, 12 bp, Homo sapiens
gtctcccatcct

SEQ ID NO: 5780115 - DNA, 14 bp, Homo sapiens
gtctccccactcca

SEQ ID NO: 5780116 - DNA, 19 bp, Homo sapiens
gtctccccagttccacagc

SEQ ID NO: 5780117 - DNA, 13 bp, Homo sapiens
gtctccccatccc

SEQ ID NO: 5780118 - DNA, 15 bp, Homo sapiens
gtctccccatcccca

SEQ ID NO: 5780119 - DNA, 23 bp, Homo sapiens
gtctctccccggtaatgtcactg

SEQ ID NO: 5780120 - DNA, 13 bp, Homo sapiens
gtctctccctggg

SEQ ID NO: 5780121 - DNA, 14 bp, Homo sapiens
gtctctccctgggg

SEQ ID NO: 5780122 - DNA, 15 bp, Homo sapiens
gtctctcccttccag

SEQ ID NO: 5780123 - DNA, 17 bp, Homo sapiens
gtctctcctagcccctc

SEQ ID NO: 5780124 - DNA, 19 bp, Homo sapiens
gtctctcctggctgggcca

SEQ ID NO: 5780125 - DNA, 11 bp, Homo sapiens
gtctctccttt

SEQ ID NO: 5780126 - DNA, 19 bp, Homo sapiens
gtctctccttttcttttgt

SEQ ID NO: 5780127 - DNA, 22 bp, Homo sapiens
gtctctccttttcttttgttac

SEQ ID NO: 5780128 - DNA, 23 bp, Homo sapiens
gtctctcgttttgggtactttct

SEQ ID NO: 5780129 - DNA, 17 bp, Homo sapiens
gtctctctatgcctctc

SEQ ID NO: 5780130 - DNA, 18 bp, Homo sapiens
gtctctctatgcctctct

SEQ ID NO: 5780131 - DNA, 14 bp, Homo sapiens
gtctctctccaggt

SEQ ID NO: 5780132 - DNA, 18 bp, Homo sapiens
gtctctctccatgttggc

SEQ ID NO: 5780133 - DNA, 12 bp, Homo sapiens
gtctctctccca

SEQ ID NO: 5780134 - DNA, 13 bp, Homo sapiens
gtctctctcccta

SEQ ID NO: 5780135 - DNA, 22 bp, Homo sapiens
gtctctctccctacctccctcc

SEQ ID NO: 5780136 - DNA, 17 bp, Homo sapiens
gtctctctcggcccctg

SEQ ID NO: 5780137 - DNA, 18 bp, Homo sapiens
gtctctctcggcccctgt

SEQ ID NO: 5780138 - DNA, 14 bp, Homo sapiens
gtctctctctctct

SEQ ID NO: 5780139 - DNA, 14 bp, Homo sapiens
gtctctctctcttt

SEQ ID NO: 5780140 - DNA, 16 bp, Homo sapiens
gtctctctctcttttt

SEQ ID NO: 5780141 - DNA, 23 bp, Homo sapiens
gtctctctctctttttcttttct

SEQ ID NO: 5780142 - DNA, 11 bp, Homo sapiens
gtctctctctt

SEQ ID NO: 5780143 - DNA, 12 bp, Homo sapiens
gtctctctgcct

SEQ ID NO: 5780144 - DNA, 14 bp, Homo sapiens
gtctctctgcctgc

SEQ ID NO: 5780145 - DNA, 18 bp, Homo sapiens
gtctctctgcctgctggg

SEQ ID NO: 5780146 - DNA, 15 bp, Homo sapiens
gtctctctgggctgc

SEQ ID NO: 5780147 - DNA, 11 bp, Homo sapiens
gtctctctgtg

SEQ ID NO: 5780148 - DNA, 12 bp, Homo sapiens
gtctctctgtga

SEQ ID NO: 5780149 - DNA, 16 bp, Homo sapiens
gtctctctgtgaatac

SEQ ID NO: 5780150 - DNA, 21 bp, Homo sapiens
gtctctctgtgaatacaatta

SEQ ID NO: 5780151 - DNA, 22 bp, Homo sapiens
gtctctctgtgaatacaattaa

SEQ ID NO: 5780152 - DNA, 14 bp, Homo sapiens
gtctctcttctctc

SEQ ID NO: 5780153 - DNA, 20 bp, Homo sapiens
gtctctcttgctttgttctt

SEQ ID NO: 5780154 - DNA, 21 bp, Homo sapiens
gtctctcttggaattagatgt

SEQ ID NO: 5780155 - DNA, 20 bp, Homo sapiens
gtctctctttctccctcacc

SEQ ID NO: 5780156 - DNA, 16 bp, Homo sapiens
gtctctctttggactc

SEQ ID NO: 5780157 - DNA, 21 bp, Homo sapiens
gtctctgaaggtaagatcatt

SEQ ID NO: 5780158 - DNA, 17 bp, Homo sapiens
gtctctgaagtactaac

SEQ ID NO: 5780159 - DNA, 15 bp, Homo sapiens
gtctctgagcagtgg

SEQ ID NO: 5780160 - DNA, 15 bp, Homo sapiens
gtctctgagtccttt

SEQ ID NO: 5780161 - DNA, 23 bp, Homo sapiens
gtctctgattagttgacagtatt

SEQ ID NO: 5780162 - DNA, 17 bp, Homo sapiens
gtctctgcatcttcagt

SEQ ID NO: 5780163 - DNA, 13 bp, Homo sapiens
gtctctgccaccc

SEQ ID NO: 5780164 - DNA, 22 bp, Homo sapiens
gtctctgccagttacttgggct

SEQ ID NO: 5780165 - DNA, 12 bp, Homo sapiens
gtctctgcccca

SEQ ID NO: 5780166 - DNA, 15 bp, Homo sapiens
gtctctgccccagcc

SEQ ID NO: 5780167 - DNA, 17 bp, Homo sapiens
gtctctgccccagcctg

SEQ ID NO: 5780168 - DNA, 23 bp, Homo sapiens
gtctctgccctgcctacttttag

SEQ ID NO: 5780169 - DNA, 13 bp, Homo sapiens
gtctctgccctgg

SEQ ID NO: 5780170 - DNA, 14 bp, Homo sapiens
gtctctgccctggg

SEQ ID NO: 5780171 - DNA, 17 bp, Homo sapiens
gtctctgccctgggctc

SEQ ID NO: 5780172 - DNA, 22 bp, Homo sapiens
gtctctgccctgggctcctctt

SEQ ID NO: 5780173 - DNA, 15 bp, Homo sapiens
gtctctgccgcctgc

SEQ ID NO: 5780174 - DNA, 22 bp, Homo sapiens
gtctctgcctggagcaggggtg

SEQ ID NO: 5780175 - DNA, 15 bp, Homo sapiens
gtctctgccttgcct

SEQ ID NO: 5780176 - DNA, 12 bp, Homo sapiens
gtctctgctcca

SEQ ID NO: 5780177 - DNA, 21 bp, Homo sapiens
gtctctgctccacctttcagc

SEQ ID NO: 5780178 - DNA, 13 bp, Homo sapiens
gtctctgctccta

SEQ ID NO: 5780179 - DNA, 17 bp, Homo sapiens
gtctctgctctgctcag

SEQ ID NO: 5780180 - DNA, 16 bp, Homo sapiens
gtctctgctcttgcct

SEQ ID NO: 5780181 - DNA, 11 bp, Homo sapiens
gtctctgctgg

SEQ ID NO: 5780182 - DNA, 17 bp, Homo sapiens
gtctctgctggcccagc

SEQ ID NO: 5780183 - DNA, 20 bp, Homo sapiens
gtctctgctggcccagccaa

SEQ ID NO: 5780184 - DNA, 20 bp, Homo sapiens
gtctctgctttccttttctc

SEQ ID NO: 5780185 - DNA, 22 bp, Homo sapiens
gtctctggagtgatggtgtcct

SEQ ID NO: 5780186 - DNA, 17 bp, Homo sapiens
gtctctggcagagaagg

SEQ ID NO: 5780187 - DNA, 20 bp, Homo sapiens
gtctctggctactccctgga

SEQ ID NO: 5780188 - DNA, 15 bp, Homo sapiens
gtctctggctcagct

SEQ ID NO: 5780189 - DNA, 16 bp, Homo sapiens
gtctctgggagcccag

SEQ ID NO: 5780190 - DNA, 14 bp, Homo sapiens
gtctctgggcacag

SEQ ID NO: 5780191 - DNA, 19 bp, Homo sapiens
gtctctgggcctgtgtgtg

SEQ ID NO: 5780192 - DNA, 14 bp, Homo sapiens
gtctctgggctgag

SEQ ID NO: 5780193 - DNA, 20 bp, Homo sapiens
gtctctggggaccctccaga

SEQ ID NO: 5780194 - DNA, 17 bp, Homo sapiens
gtctctggggcagatcc

SEQ ID NO: 5780195 - DNA, 19 bp, Homo sapiens
gtctctggggcaggctgct

SEQ ID NO: 5780196 - DNA, 21 bp, Homo sapiens
gtctctggggcaggctgcttc

SEQ ID NO: 5780197 - DNA, 12 bp, Homo sapiens
gtctctgtcctc

SEQ ID NO: 5780198 - DNA, 18 bp, Homo sapiens
gtctctgtcgtggagcca

SEQ ID NO: 5780199 - DNA, 14 bp, Homo sapiens
gtctctgtgctttg

SEQ ID NO: 5780200 - DNA, 20 bp, Homo sapiens
gtctctgttcagatgtgcat

SEQ ID NO: 5780201 - DNA, 21 bp, Homo sapiens
gtctctgttcagatgtgcatt

SEQ ID NO: 5780202 - DNA, 18 bp, Homo sapiens
gtctctgttggtccactg

SEQ ID NO: 5780203 - DNA, 19 bp, Homo sapiens
gtctctgttggtccactgt

SEQ ID NO: 5780204 - DNA, 13 bp, Homo sapiens
gtctctgtttagt

SEQ ID NO: 5780205 - DNA, 13 bp, Homo sapiens
gtctctgtttcct

SEQ ID NO: 5780206 - DNA, 17 bp, Homo sapiens
gtctctgtttcctgaaa

SEQ ID NO: 5780207 - DNA, 20 bp, Homo sapiens
gtctctgtttcctgaaatat

SEQ ID NO: 5780208 - DNA, 18 bp, Homo sapiens
gtctcttaaatctcttaa

SEQ ID NO: 5780209 - DNA, 22 bp, Homo sapiens
gtctcttcatgtctattccatt

SEQ ID NO: 5780210 - DNA, 17 bp, Homo sapiens
gtctcttccacaggaag

SEQ ID NO: 5780211 - DNA, 16 bp, Homo sapiens
gtctcttccagcccag

SEQ ID NO: 5780212 - DNA, 16 bp, Homo sapiens
gtctcttcctctgcag

SEQ ID NO: 5780213 - DNA, 14 bp, Homo sapiens
gtctcttcctctgt

SEQ ID NO: 5780214 - DNA, 17 bp, Homo sapiens
gtctcttcctctgttct

SEQ ID NO: 5780215 - DNA, 16 bp, Homo sapiens
gtctcttcctgcctcc

SEQ ID NO: 5780216 - DNA, 18 bp, Homo sapiens
gtctcttcggcagggagg

SEQ ID NO: 5780217 - DNA, 17 bp, Homo sapiens
gtctcttctaacatctt

SEQ ID NO: 5780218 - DNA, 16 bp, Homo sapiens
gtctcttctccactgg

SEQ ID NO: 5780219 - DNA, 18 bp, Homo sapiens
gtctcttctccactggat

SEQ ID NO: 5780220 - DNA, 20 bp, Homo sapiens
gtctcttctgaataaagcaa

SEQ ID NO: 5780221 - DNA, 21 bp, Homo sapiens
gtctcttctgaataaagcaat

SEQ ID NO: 5780222 - DNA, 22 bp, Homo sapiens
gtctcttctgaataaagcaatt

SEQ ID NO: 5780223 - DNA, 21 bp, Homo sapiens
gtctcttctgggcgtctgagc

SEQ ID NO: 5780224 - DNA, 21 bp, Homo sapiens
gtctcttgagcatcaatcttg

SEQ ID NO: 5780225 - DNA, 24 bp, Homo sapiens
gtctcttgagcatcaatcttgtta

SEQ ID NO: 5780226 - DNA, 21 bp, Homo sapiens
gtctcttggaaatgttaagaa

SEQ ID NO: 5780227 - DNA, 23 bp, Homo sapiens
gtctcttggaaatgttaagaaag

SEQ ID NO: 5780228 - DNA, 20 bp, Homo sapiens
gtctcttggctttgtcactt

SEQ ID NO: 5780229 - DNA, 17 bp, Homo sapiens
gtctcttgggaagcagt

SEQ ID NO: 5780230 - DNA, 13 bp, Homo sapiens
gtctcttggtcct

SEQ ID NO: 5780231 - DNA, 19 bp, Homo sapiens
gtctcttggtcctgctgca

SEQ ID NO: 5780232 - DNA, 20 bp, Homo sapiens
gtctcttgtgactcagcaga

SEQ ID NO: 5780233 - DNA, 23 bp, Homo sapiens
gtctcttgtgactcagcagaggc

SEQ ID NO: 5780234 - DNA, 22 bp, Homo sapiens
gtctctttaaaaggaaagaaaa

SEQ ID NO: 5780235 - DNA, 17 bp, Homo sapiens
gtctctttaatcttcag

SEQ ID NO: 5780236 - DNA, 18 bp, Homo sapiens
gtctctttaatcttcagt

SEQ ID NO: 5780237 - DNA, 18 bp, Homo sapiens
gtctctttaatgtcacag

SEQ ID NO: 5780238 - DNA, 22 bp, Homo sapiens
gtctctttaatgtcacaggcag

SEQ ID NO: 5780239 - DNA, 23 bp, Homo sapiens
gtctctttaatgtcacaggcagg

SEQ ID NO: 5780240 - DNA, 17 bp, Homo sapiens
gtctctttattttacta

SEQ ID NO: 5780241 - DNA, 14 bp, Homo sapiens
gtctctttccactt

SEQ ID NO: 5780242 - DNA, 22 bp, Homo sapiens
gtctctttcctacaagttaacc

SEQ ID NO: 5780243 - DNA, 17 bp, Homo sapiens
gtctctttctgtacaag

SEQ ID NO: 5780244 - DNA, 19 bp, Homo sapiens
gtctctttcttcctttcta

SEQ ID NO: 5780245 - DNA, 14 bp, Homo sapiens
gtctctttctttcc

SEQ ID NO: 5780246 - DNA, 14 bp, Homo sapiens
gtctcttttaccct

SEQ ID NO: 5780247 - DNA, 18 bp, Homo sapiens
gtctcttttaccctggcc

SEQ ID NO: 5780248 - DNA, 20 bp, Homo sapiens
gtctcttttaccctggcccc

SEQ ID NO: 5780249 - DNA, 23 bp, Homo sapiens
gtctcttttaccctggcccctct

SEQ ID NO: 5780250 - DNA, 14 bp, Homo sapiens
gtctcttttctctt

SEQ ID NO: 5780251 - DNA, 12 bp, Homo sapiens
gtctcttttgta

SEQ ID NO: 5780252 - DNA, 22 bp, Homo sapiens
gtctcttttgttcctggctttg

SEQ ID NO: 5780253 - DNA, 15 bp, Homo sapiens
gtctcttttttacaa

SEQ ID NO: 5780254 - DNA, 19 bp, Homo sapiens
gtctgaaaatgttgttatg

SEQ ID NO: 5780255 - DNA, 15 bp, Homo sapiens
gtctgaaacatttca

SEQ ID NO: 5780256 - DNA, 16 bp, Homo sapiens
gtctgaaacatttcat

SEQ ID NO: 5780257 - DNA, 12 bp, Homo sapiens
gtctgaaactgg

SEQ ID NO: 5780258 - DNA, 21 bp, Homo sapiens
gtctgaaactggcttccccac

SEQ ID NO: 5780259 - DNA, 15 bp, Homo sapiens
gtctgaaagacagaa

SEQ ID NO: 5780260 - DNA, 22 bp, Homo sapiens
gtctgaaaggctatcctgctga

SEQ ID NO: 5780261 - DNA, 15 bp, Homo sapiens
gtctgaaaggggtgt

SEQ ID NO: 5780262 - DNA, 19 bp, Homo sapiens
gtctgaaatacctttgcct

SEQ ID NO: 5780263 - DNA, 21 bp, Homo sapiens
gtctgaaatggggctactgtt

SEQ ID NO: 5780264 - DNA, 21 bp, Homo sapiens
gtctgaacccaggcagctggc

SEQ ID NO: 5780265 - DNA, 19 bp, Homo sapiens
gtctgaagaaggaaggcct

SEQ ID NO: 5780266 - DNA, 21 bp, Homo sapiens
gtctgaagcccaaagcctgag

SEQ ID NO: 5780267 - DNA, 22 bp, Homo sapiens
gtctgaagctcgcatccagaca

SEQ ID NO: 5780268 - DNA, 21 bp, Homo sapiens
gtctgaaggaatagccagaga

SEQ ID NO: 5780269 - DNA, 21 bp, Homo sapiens
gtctgaaggacacttcctgcc

SEQ ID NO: 5780270 - DNA, 22 bp, Homo sapiens
gtctgaaggagaggagtgcgct

SEQ ID NO: 5780271 - DNA, 12 bp, Homo sapiens
gtctgaaggatt

SEQ ID NO: 5780272 - DNA, 22 bp, Homo sapiens
gtctgaagtgcctactgggggg

SEQ ID NO: 5780273 - DNA, 12 bp, Homo sapiens
gtctgaatattt

SEQ ID NO: 5780274 - DNA, 14 bp, Homo sapiens
gtctgaatgatctt

SEQ ID NO: 5780275 - DNA, 19 bp, Homo sapiens
gtctgaatggtgcgtgaag

SEQ ID NO: 5780276 - DNA, 14 bp, Homo sapiens
gtctgaatgttctg

SEQ ID NO: 5780277 - DNA, 13 bp, Homo sapiens
gtctgaatttatt

SEQ ID NO: 5780278 - DNA, 18 bp, Homo sapiens
gtctgacacatgctctca

SEQ ID NO: 5780279 - DNA, 17 bp, Homo sapiens
gtctgacagccagagcg

SEQ ID NO: 5780280 - DNA, 12 bp, Homo sapiens
gtctgacaggca

SEQ ID NO: 5780281 - DNA, 15 bp, Homo sapiens
gtctgacaggcaatg

SEQ ID NO: 5780282 - DNA, 16 bp, Homo sapiens
gtctgaccaagggctg

SEQ ID NO: 5780283 - DNA, 21 bp, Homo sapiens
gtctgaccagagaatgcacct

SEQ ID NO: 5780284 - DNA, 13 bp, Homo sapiens
gtctgacccactg

SEQ ID NO: 5780285 - DNA, 19 bp, Homo sapiens
gtctgaccccagcccagac

SEQ ID NO: 5780286 - DNA, 13 bp, Homo sapiens
gtctgaccctctg

SEQ ID NO: 5780287 - DNA, 14 bp, Homo sapiens
gtctgacctggtgg

SEQ ID NO: 5780288 - DNA, 13 bp, Homo sapiens
gtctgactccaga

SEQ ID NO: 5780289 - DNA, 14 bp, Homo sapiens
gtctgactccagag

SEQ ID NO: 5780290 - DNA, 23 bp, Homo sapiens
gtctgactccagagtctgagccc

SEQ ID NO: 5780291 - DNA, 18 bp, Homo sapiens
gtctgactccctccccac

SEQ ID NO: 5780292 - DNA, 22 bp, Homo sapiens
gtctgactccctccccacccaa

SEQ ID NO: 5780293 - DNA, 23 bp, Homo sapiens
gtctgactccctccccacccaag

SEQ ID NO: 5780294 - DNA, 14 bp, Homo sapiens
gtctgactctgggt

SEQ ID NO: 5780295 - DNA, 14 bp, Homo sapiens
gtctgactttctct

SEQ ID NO: 5780296 - DNA, 12 bp, Homo sapiens
gtctgagacagg

SEQ ID NO: 5780297 - DNA, 23 bp, Homo sapiens
gtctggagaccaggactctgcct

SEQ ID NO: 5780298 - DNA, 13 bp, Homo sapiens
gtctggagcctgc

SEQ ID NO: 5780299 - DNA, 13 bp, Homo sapiens
gtctggaggccga

SEQ ID NO: 5780300 - DNA, 10 bp, Homo sapiens
gtctggaggg

SEQ ID NO: 5780301 - DNA, 17 bp, Homo sapiens
gtctggaggtcccagac

SEQ ID NO: 5780302 - DNA, 22 bp, Homo sapiens
gtctggagtcccacccggacag

SEQ ID NO: 5780303 - DNA, 19 bp, Homo sapiens
gtctggagtcccctcctcc

SEQ ID NO: 5780304 - DNA, 18 bp, Homo sapiens
gtctggagtggtaacagc

SEQ ID NO: 5780305 - DNA, 16 bp, Homo sapiens
gtctggataacttcca

SEQ ID NO: 5780306 - DNA, 20 bp, Homo sapiens
gtctggataacttccacagg

SEQ ID NO: 5780307 - DNA, 14 bp, Homo sapiens
gtctggatcagtaa

SEQ ID NO: 5780308 - DNA, 20 bp, Homo sapiens
gtctggatccttcccaaggt

SEQ ID NO: 5780309 - DNA, 22 bp, Homo sapiens
gtctggatctgggaccctttcc

SEQ ID NO: 5780310 - DNA, 13 bp, Homo sapiens
gtctggatgggag

SEQ ID NO: 5780311 - DNA, 21 bp, Homo sapiens
gtctggatgggaggagagcca

SEQ ID NO: 5780312 - DNA, 15 bp, Homo sapiens
gtctggcaatgccac

SEQ ID NO: 5780313 - DNA, 13 bp, Homo sapiens
gtctggcacagcc

SEQ ID NO: 5780314 - DNA, 16 bp, Homo sapiens
gtctggcacagcctgc

SEQ ID NO: 5780315 - DNA, 19 bp, Homo sapiens
gtctggcacagcctggctg

SEQ ID NO: 5780316 - DNA, 23 bp, Homo sapiens
gtctggcaccatgttggcctctt

SEQ ID NO: 5780317 - DNA, 18 bp, Homo sapiens
gtctggcagagcctctga

SEQ ID NO: 5780318 - DNA, 21 bp, Homo sapiens
gtctggcagatgagggctggc

SEQ ID NO: 5780319 - DNA, 19 bp, Homo sapiens
gtctggcagggcagcagga

SEQ ID NO: 5780320 - DNA, 17 bp, Homo sapiens
gtctggcatctcccaca

SEQ ID NO: 5780321 - DNA, 13 bp, Homo sapiens
gtctggccaggga

SEQ ID NO: 5780322 - DNA, 21 bp, Homo sapiens
gtctggccagggaggagcccc

SEQ ID NO: 5780323 - DNA, 23 bp, Homo sapiens
gtctggcccaaaggaagtagcag

SEQ ID NO: 5780324 - DNA, 21 bp, Homo sapiens
gtctggcccagccatggctgg

SEQ ID NO: 5780325 - DNA, 20 bp, Homo sapiens
gtctggccctagactcgggg

SEQ ID NO: 5780326 - DNA, 14 bp, Homo sapiens
gtctggccctggcg

SEQ ID NO: 5780327 - DNA, 15 bp, Homo sapiens
gtctggccctggcgg

SEQ ID NO: 5780328 - DNA, 23 bp, Homo sapiens
gtctggccctggcgggtggctgc

SEQ ID NO: 5780329 - DNA, 14 bp, Homo sapiens
gtctggccctgggg

SEQ ID NO: 5780330 - DNA, 13 bp, Homo sapiens
gtctggcctcacg

SEQ ID NO: 5780331 - DNA, 15 bp, Homo sapiens
gtctggcctgaggtc

SEQ ID NO: 5780332 - DNA, 13 bp, Homo sapiens
gtctggcctgcca

SEQ ID NO: 5780333 - DNA, 19 bp, Homo sapiens
gtctggcctgccaggctcc

SEQ ID NO: 5780334 - DNA, 21 bp, Homo sapiens
gtctggcgagcccttagcctt

SEQ ID NO: 5780335 - DNA, 21 bp, Homo sapiens
gtctggcgccaggggcaggca

SEQ ID NO: 5780336 - DNA, 23 bp, Homo sapiens
gtctggcgccaggggcaggcagc

SEQ ID NO: 5780337 - DNA, 19 bp, Homo sapiens
gtctggcgttctcaagaat

SEQ ID NO: 5780338 - DNA, 21 bp, Homo sapiens
gtctggcgttctcaagaatct

SEQ ID NO: 5780339 - DNA, 19 bp, Homo sapiens
gtctggctagagggcccaa

SEQ ID NO: 5780340 - DNA, 14 bp, Homo sapiens
gtctggctccctgc

SEQ ID NO: 5780341 - DNA, 20 bp, Homo sapiens
gtctggctcggacccacccc

SEQ ID NO: 5780342 - DNA, 16 bp, Homo sapiens
gtctggctgagccctg

SEQ ID NO: 5780343 - DNA, 22 bp, Homo sapiens
gtctggctgcacccctttttcc

SEQ ID NO: 5780344 - DNA, 13 bp, Homo sapiens
gtctggctggtgt

SEQ ID NO: 5780345 - DNA, 16 bp, Homo sapiens
gtctggctgtggcccc

SEQ ID NO: 5780346 - DNA, 19 bp, Homo sapiens
gtctggctgtggcccctcc

SEQ ID NO: 5780347 - DNA, 21 bp, Homo sapiens
gtctggctgtggcccctcctt

SEQ ID NO: 5780348 - DNA, 12 bp, Homo sapiens
gtctggctgtgt

SEQ ID NO: 5780349 - DNA, 17 bp, Homo sapiens
gtctggctttggcactc

SEQ ID NO: 5780350 - DNA, 18 bp, Homo sapiens
gtctgggaaatgagcagg

SEQ ID NO: 5780351 - DNA, 20 bp, Homo sapiens
gtctgggacttccttgctct

SEQ ID NO: 5780352 - DNA, 21 bp, Homo sapiens
gtctgggacttccttgctctc

SEQ ID NO: 5780353 - DNA, 18 bp, Homo sapiens
gtctgggagagcctggca

SEQ ID NO: 5780354 - DNA, 20 bp, Homo sapiens
gtctgggagagcctggcaag

SEQ ID NO: 5780355 - DNA, 22 bp, Homo sapiens
gtctgggagagcctggcaaggc

SEQ ID NO: 5780356 - DNA, 19 bp, Homo sapiens
gtctgggagaggcagagtg

SEQ ID NO: 5780357 - DNA, 10 bp, Homo sapiens
gtctgggagg

SEQ ID NO: 5780358 - DNA, 20 bp, Homo sapiens
gtctgggaggaatggacaga

SEQ ID NO: 5780359 - DNA, 15 bp, Homo sapiens
gtctgggaggcaggt

SEQ ID NO: 5780360 - DNA, 17 bp, Homo sapiens
gtctgggagggggtgag

SEQ ID NO: 5780361 - DNA, 17 bp, Homo sapiens
gtctgggagtgttctgt

SEQ ID NO: 5780362 - DNA, 22 bp, Homo sapiens
gtctgggatcggggtggggaca

SEQ ID NO: 5780363 - DNA, 19 bp, Homo sapiens
gtctgggatgtagaacttc

SEQ ID NO: 5780364 - DNA, 22 bp, Homo sapiens
gtctgggatgtattcaagtgaa

SEQ ID NO: 5780365 - DNA, 17 bp, Homo sapiens
gtctgggattaagggca

SEQ ID NO: 5780366 - DNA, 12 bp, Homo sapiens
gtctgggcaagt

SEQ ID NO: 5780367 - DNA, 19 bp, Homo sapiens
gtctgggcaagtagcagga

SEQ ID NO: 5780368 - DNA, 20 bp, Homo sapiens
gtctgggcaagtagcaggac

SEQ ID NO: 5780369 - DNA, 17 bp, Homo sapiens
gtctgggcagtgccaca

SEQ ID NO: 5780370 - DNA, 20 bp, Homo sapiens
gtctgggcgtccagctcagc

SEQ ID NO: 5780371 - DNA, 11 bp, Homo sapiens
gtctgggctga

SEQ ID NO: 5780372 - DNA, 18 bp, Homo sapiens
gtctgggctgggcacctg

SEQ ID NO: 5780373 - DNA, 15 bp, Homo sapiens
gtctggggaccagct

SEQ ID NO: 5780374 - DNA, 22 bp, Homo sapiens
gtctggggagaaatccctcaga

SEQ ID NO: 5780375 - DNA, 22 bp, Homo sapiens
gtctggggagcgggtctgctcc

SEQ ID NO: 5780376 - DNA, 19 bp, Homo sapiens
gtctgggggcacaagactg

SEQ ID NO: 5780377 - DNA, 17 bp, Homo sapiens
gtctgggggcagctgtc

SEQ ID NO: 5780378 - DNA, 18 bp, Homo sapiens
gtctgggggcagctgtcc

SEQ ID NO: 5780379 - DNA, 19 bp, Homo sapiens
gtctgggggcagctgtcct

SEQ ID NO: 5780380 - DNA, 20 bp, Homo sapiens
gtctggggttcagcccctcc

SEQ ID NO: 5780381 - DNA, 18 bp, Homo sapiens
gtctgggtccaggcctgg

SEQ ID NO: 5780382 - DNA, 20 bp, Homo sapiens
gtctgggtggatgtgagcag

SEQ ID NO: 5780383 - DNA, 15 bp, Homo sapiens
gtctgggtggctcac

SEQ ID NO: 5780384 - DNA, 23 bp, Homo sapiens
gtctgggtggggcccaggcccgg

SEQ ID NO: 5780385 - DNA, 19 bp, Homo sapiens
gtctgggtgtccgccatcc

SEQ ID NO: 5780386 - DNA, 13 bp, Homo sapiens
gtctgggtgtctc

SEQ ID NO: 5780387 - DNA, 18 bp, Homo sapiens
gtctggtcagagccacag

SEQ ID NO: 5780388 - DNA, 21 bp, Homo sapiens
gtctggtcaggcaatgccctg

SEQ ID NO: 5780389 - DNA, 18 bp, Homo sapiens
gtctggtctcctcagcct

SEQ ID NO: 5780390 - DNA, 15 bp, Homo sapiens
gtctggtgaggtggc

SEQ ID NO: 5780391 - DNA, 23 bp, Homo sapiens
gtctggtgccaatcctgtaggca

SEQ ID NO: 5780392 - DNA, 20 bp, Homo sapiens
gtctggtgccctggtggcct

SEQ ID NO: 5780393 - DNA, 11 bp, Homo sapiens
gtctggtgtag

SEQ ID NO: 5780394 - DNA, 16 bp, Homo sapiens
gtctggttttaacaat

SEQ ID NO: 5780395 - DNA, 18 bp, Homo sapiens
gtctggttttaacaattt

SEQ ID NO: 5780396 - DNA, 15 bp, Homo sapiens
gtctgtaaaatacat

SEQ ID NO: 5780397 - DNA, 18 bp, Homo sapiens
gtctgtaaaatacatgta

SEQ ID NO: 5780398 - DNA, 12 bp, Homo sapiens
gtctgtaaaatc

SEQ ID NO: 5780399 - DNA, 23 bp, Homo sapiens
gtctgtaaatcaagaccaaagag

SEQ ID NO: 5780400 - DNA, 19 bp, Homo sapiens
gtctgtaaatctaacatta

SEQ ID NO: 5780401 - DNA, 17 bp, Homo sapiens
gtctgtaactgcccagc

SEQ ID NO: 5780402 - DNA, 12 bp, Homo sapiens
gtctgtaatgac

SEQ ID NO: 5780403 - DNA, 18 bp, Homo sapiens
gtctgtaatgacaaataa

SEQ ID NO: 5780404 - DNA, 11 bp, Homo sapiens
gtctgtaattt

SEQ ID NO: 5780405 - DNA, 14 bp, Homo sapiens
gtctgtacacgtgt

SEQ ID NO: 5780406 - DNA, 19 bp, Homo sapiens
gtctgtacacgtgtcctgt

SEQ ID NO: 5780407 - DNA, 21 bp, Homo sapiens
gtctgtacacgtgtcctgtag

SEQ ID NO: 5780408 - DNA, 12 bp, Homo sapiens
gtctgtacatac

SEQ ID NO: 5780409 - DNA, 13 bp, Homo sapiens
gtctgtacatact

SEQ ID NO: 5780410 - DNA, 19 bp, Homo sapiens
gtctgtagagggccctggt

SEQ ID NO: 5780411 - DNA, 22 bp, Homo sapiens
gtctgtagagggccctggtgtt

SEQ ID NO: 5780412 - DNA, 15 bp, Homo sapiens
gtctgtaggtgtctc

SEQ ID NO: 5780413 - DNA, 18 bp, Homo sapiens
gtctgtaggttgcacact

SEQ ID NO: 5780414 - DNA, 16 bp, Homo sapiens
gtctgtagttgctttg

SEQ ID NO: 5780415 - DNA, 20 bp, Homo sapiens
gtctgtatactcctgtcacc

SEQ ID NO: 5780416 - DNA, 20 bp, Homo sapiens
gtctgtatagtgtctgtatt

SEQ ID NO: 5780417 - DNA, 22 bp, Homo sapiens
gtctgtatccccagtgcccggt

SEQ ID NO: 5780418 - DNA, 20 bp, Homo sapiens
gtctgtatcggagacagtga

SEQ ID NO: 5780419 - DNA, 15 bp, Homo sapiens
gtctgtatgtcatgg

SEQ ID NO: 5780420 - DNA, 22 bp, Homo sapiens
gtctgtattcctgatatgccta

SEQ ID NO: 5780421 - DNA, 17 bp, Homo sapiens
gtctgtatttcatgtgg

SEQ ID NO: 5780422 - DNA, 20 bp, Homo sapiens
gtctgtatttcatgtggctg

SEQ ID NO: 5780423 - DNA, 13 bp, Homo sapiens
gtctgtcaaatgt

SEQ ID NO: 5780424 - DNA, 21 bp, Homo sapiens
gtctgtcaatcacagtctcag

SEQ ID NO: 5780425 - DNA, 20 bp, Homo sapiens
gtctgtcaccagctatctgt

SEQ ID NO: 5780426 - DNA, 15 bp, Homo sapiens
gtctgtcagaagaca

SEQ ID NO: 5780427 - DNA, 14 bp, Homo sapiens
gtctgtcagctgtg

SEQ ID NO: 5780428 - DNA, 14 bp, Homo sapiens
gtctgtcaggggct

SEQ ID NO: 5780429 - DNA, 20 bp, Homo sapiens
gtctgtcataatatttgaac

SEQ ID NO: 5780430 - DNA, 11 bp, Homo sapiens
gtctgtcatcc

SEQ ID NO: 5780431 - DNA, 17 bp, Homo sapiens
gtctgtcatcctctgga

SEQ ID NO: 5780432 - DNA, 13 bp, Homo sapiens
gtctgtcatctgc

SEQ ID NO: 5780433 - DNA, 22 bp, Homo sapiens
gtctgtcatgaacatgttcctg

SEQ ID NO: 5780434 - DNA, 20 bp, Homo sapiens
gtctgtcatttctctttcaa

SEQ ID NO: 5780435 - DNA, 13 bp, Homo sapiens
gtctgtccaaccc

SEQ ID NO: 5780436 - DNA, 17 bp, Homo sapiens
gtctgtccaacccctcc

SEQ ID NO: 5780437 - DNA, 21 bp, Homo sapiens
gtctgtccaacccctccccca

SEQ ID NO: 5780438 - DNA, 22 bp, Homo sapiens
gtctgtccaacccctcccccac

SEQ ID NO: 5780439 - DNA, 19 bp, Homo sapiens
gtctgtccacgtggagaga

SEQ ID NO: 5780440 - DNA, 14 bp, Homo sapiens
gtctgtccatctgc

SEQ ID NO: 5780441 - DNA, 17 bp, Homo sapiens
gtctgtccatctgtctg

SEQ ID NO: 5780442 - DNA, 15 bp, Homo sapiens
gtctgtcccaccagc

SEQ ID NO: 5780443 - DNA, 19 bp, Homo sapiens
gtctgtcccagttaactgt

SEQ ID NO: 5780444 - DNA, 16 bp, Homo sapiens
gtctgtcctacccgcc

SEQ ID NO: 5780445 - DNA, 16 bp, Homo sapiens
gtctgtcctcagagca

SEQ ID NO: 5780446 - DNA, 21 bp, Homo sapiens
gtctgtcctcagagcaggggc

SEQ ID NO: 5780447 - DNA, 13 bp, Homo sapiens
gtctgtcctctct

SEQ ID NO: 5780448 - DNA, 12 bp, Homo sapiens
gtctgtcctggt

SEQ ID NO: 5780449 - DNA, 13 bp, Homo sapiens
gtctgtcctggtc

SEQ ID NO: 5780450 - DNA, 14 bp, Homo sapiens
gtctgtcctggtca

SEQ ID NO: 5780451 - DNA, 23 bp, Homo sapiens
gtctgtccttctgaagtgtgtcc

SEQ ID NO: 5780452 - DNA, 17 bp, Homo sapiens
gtctgtcgctgggctgt

SEQ ID NO: 5780453 - DNA, 21 bp, Homo sapiens
gtctgtctacatttctgcaga

SEQ ID NO: 5780454 - DNA, 18 bp, Homo sapiens
gtctgtctagtgtctggg

SEQ ID NO: 5780455 - DNA, 21 bp, Homo sapiens
gtctgtctcagagtcccagga

SEQ ID NO: 5780456 - DNA, 16 bp, Homo sapiens
gtctgtctcgatgcct

SEQ ID NO: 5780457 - DNA, 13 bp, Homo sapiens
gtctgtctctaat

SEQ ID NO: 5780458 - DNA, 19 bp, Homo sapiens
gtctgtctctccccctctg

SEQ ID NO: 5780459 - DNA, 14 bp, Homo sapiens
gtctgtctctgtca

SEQ ID NO: 5780460 - DNA, 16 bp, Homo sapiens
gtctgtctgtcgccct

SEQ ID NO: 5780461 - DNA, 15 bp, Homo sapiens
gtctgtctgtgggct

SEQ ID NO: 5780462 - DNA, 14 bp, Homo sapiens
gtctgtcttctgta

SEQ ID NO: 5780463 - DNA, 15 bp, Homo sapiens
gtctgtcttctgtat

SEQ ID NO: 5780464 - DNA, 14 bp, Homo sapiens
gtctgtgaacttga

SEQ ID NO: 5780465 - DNA, 12 bp, Homo sapiens
gtctgtgactgg

SEQ ID NO: 5780466 - DNA, 14 bp, Homo sapiens
gtctgtgactggat

SEQ ID NO: 5780467 - DNA, 15 bp, Homo sapiens
gtctgtgactggatc

SEQ ID NO: 5780468 - DNA, 22 bp, Homo sapiens
gtctgtgagatgctagaactcc

SEQ ID NO: 5780469 - DNA, 17 bp, Homo sapiens
gtctgtgagtctgtcct

SEQ ID NO: 5780470 - DNA, 18 bp, Homo sapiens
gtctgtgagtctgtcctt

SEQ ID NO: 5780471 - DNA, 20 bp, Homo sapiens
gtctgtgagtgcgtctgagg

SEQ ID NO: 5780472 - DNA, 16 bp, Homo sapiens
gtctgtgcacatgcct

SEQ ID NO: 5780473 - DNA, 15 bp, Homo sapiens
gtctgtgccatggcc

SEQ ID NO: 5780474 - DNA, 16 bp, Homo sapiens
gtcttcatccttagca

SEQ ID NO: 5780475 - DNA, 23 bp, Homo sapiens
gtcttcatctccctgccatcccc

SEQ ID NO: 5780476 - DNA, 13 bp, Homo sapiens
gtcttcatgaaat

SEQ ID NO: 5780477 - DNA, 15 bp, Homo sapiens
gtcttcatgaaatgc

SEQ ID NO: 5780478 - DNA, 16 bp, Homo sapiens
gtcttcatgaaatgct

SEQ ID NO: 5780479 - DNA, 17 bp, Homo sapiens
gtcttcatttcattgta

SEQ ID NO: 5780480 - DNA, 20 bp, Homo sapiens
gtcttccaaccccagctggc

SEQ ID NO: 5780481 - DNA, 22 bp, Homo sapiens
gtcttccaaccccagctggcct

SEQ ID NO: 5780482 - DNA, 11 bp, Homo sapiens
gtcttccacaa

SEQ ID NO: 5780483 - DNA, 13 bp, Homo sapiens
gtcttccagagcc

SEQ ID NO: 5780484 - DNA, 13 bp, Homo sapiens
gtcttccataatg

SEQ ID NO: 5780485 - DNA, 15 bp, Homo sapiens
gtcttccataatgta

SEQ ID NO: 5780486 - DNA, 17 bp, Homo sapiens
gtcttccataatgtata

SEQ ID NO: 5780487 - DNA, 19 bp, Homo sapiens
gtcttccatcagcagtgat

SEQ ID NO: 5780488 - DNA, 15 bp, Homo sapiens
gtcttccatttgcaa

SEQ ID NO: 5780489 - DNA, 13 bp, Homo sapiens
gtcttcccagggt

SEQ ID NO: 5780490 - DNA, 20 bp, Homo sapiens
gtcttcccccctctcctccc

SEQ ID NO: 5780491 - DNA, 14 bp, Homo sapiens
gtcttcccctgaga

SEQ ID NO: 5780492 - DNA, 19 bp, Homo sapiens
gtcttcccgcaaggcctct

SEQ ID NO: 5780493 - DNA, 15 bp, Homo sapiens
gtcttccctacctca

SEQ ID NO: 5780494 - DNA, 21 bp, Homo sapiens
gtcttccctacctcaggcagg

SEQ ID NO: 5780495 - DNA, 21 bp, Homo sapiens
gtcttccctagggctgggtgt

SEQ ID NO: 5780496 - DNA, 12 bp, Homo sapiens
gtcttccctcag

SEQ ID NO: 5780497 - DNA, 19 bp, Homo sapiens
gtcttccctcttccctcag

SEQ ID NO: 5780498 - DNA, 13 bp, Homo sapiens
gtcttccctgcct

SEQ ID NO: 5780499 - DNA, 15 bp, Homo sapiens
gtcttccctgcctgt

SEQ ID NO: 5780500 - DNA, 15 bp, Homo sapiens
gtcttccctgcttca

SEQ ID NO: 5780501 - DNA, 15 bp, Homo sapiens
gtcttccgtctcccc

SEQ ID NO: 5780502 - DNA, 18 bp, Homo sapiens
gtcttcctatttcagaag

SEQ ID NO: 5780503 - DNA, 20 bp, Homo sapiens
gtcttcctatttcagaagtt

SEQ ID NO: 5780504 - DNA, 11 bp, Homo sapiens
gtcttcctcac

SEQ ID NO: 5780505 - DNA, 15 bp, Homo sapiens
gtcttcctccaaccc

SEQ ID NO: 5780506 - DNA, 23 bp, Homo sapiens
gtcttcctcccaagtggtgccta

SEQ ID NO: 5780507 - DNA, 14 bp, Homo sapiens
gtcttcctcctccc

SEQ ID NO: 5780508 - DNA, 16 bp, Homo sapiens
gtcttcctcctcccct

SEQ ID NO: 5780509 - DNA, 10 bp, Homo sapiens
gtcttcctct

SEQ ID NO: 5780510 - DNA, 11 bp, Homo sapiens
gtcttcctctg

SEQ ID NO: 5780511 - DNA, 13 bp, Homo sapiens
gtcttcctctgca

SEQ ID NO: 5780512 - DNA, 21 bp, Homo sapiens
gtcttcctctgcaagtgctca

SEQ ID NO: 5780513 - DNA, 13 bp, Homo sapiens
gtcttcctcttag

SEQ ID NO: 5780514 - DNA, 12 bp, Homo sapiens
gtcttcctgagt

SEQ ID NO: 5780515 - DNA, 19 bp, Homo sapiens
gtcttcctgagtggtgcca

SEQ ID NO: 5780516 - DNA, 17 bp, Homo sapiens
gtcttcctgcattcacc

SEQ ID NO: 5780517 - DNA, 12 bp, Homo sapiens
gtcttcctgtgg

SEQ ID NO: 5780518 - DNA, 17 bp, Homo sapiens
gtcttcctgtggctccc

SEQ ID NO: 5780519 - DNA, 18 bp, Homo sapiens
gtcttcctgtggctccct

SEQ ID NO: 5780520 - DNA, 14 bp, Homo sapiens
gtcttcctgtgggg

SEQ ID NO: 5780521 - DNA, 18 bp, Homo sapiens
gtcttccttctaccccaa

SEQ ID NO: 5780522 - DNA, 16 bp, Homo sapiens
gtcttcgctggctcct

SEQ ID NO: 5780523 - DNA, 13 bp, Homo sapiens
gtcttcgtacagt

SEQ ID NO: 5780524 - DNA, 16 bp, Homo sapiens
gtcttcgtacagttct

SEQ ID NO: 5780525 - DNA, 18 bp, Homo sapiens
gtcttcgtacagttcttc

SEQ ID NO: 5780526 - DNA, 20 bp, Homo sapiens
gtcttcgtacagttcttcgg

SEQ ID NO: 5780527 - DNA, 23 bp, Homo sapiens
gtcttctaaacttccccatcttc

SEQ ID NO: 5780528 - DNA, 15 bp, Homo sapiens
gtcttctactgcctt

SEQ ID NO: 5780529 - DNA, 14 bp, Homo sapiens
gtcttctatttatt

SEQ ID NO: 5780530 - DNA, 20 bp, Homo sapiens
gtcttctcacaagccagcca

SEQ ID NO: 5780531 - DNA, 23 bp, Homo sapiens
gtcttctcatagcattaactaat

SEQ ID NO: 5780532 - DNA, 16 bp, Homo sapiens
gtcttctccaccagcc

SEQ ID NO: 5780533 - DNA, 23 bp, Homo sapiens
gtcttctccaccagcccctcaca

SEQ ID NO: 5780534 - DNA, 12 bp, Homo sapiens
gtcttctccatc

SEQ ID NO: 5780535 - DNA, 21 bp, Homo sapiens
gtcttctcccaactcagcctg

SEQ ID NO: 5780536 - DNA, 22 bp, Homo sapiens
gtcttctcccaactcagcctgt

SEQ ID NO: 5780537 - DNA, 16 bp, Homo sapiens
gtcttctcccagagca

SEQ ID NO: 5780538 - DNA, 17 bp, Homo sapiens
gtcttctcccagagcac

SEQ ID NO: 5780539 - DNA, 20 bp, Homo sapiens
gtcttctccttcaaaacatt

SEQ ID NO: 5780540 - DNA, 19 bp, Homo sapiens
gtcttctctatcctctctc

SEQ ID NO: 5780541 - DNA, 21 bp, Homo sapiens
gtcttctctatcctctctctc

SEQ ID NO: 5780542 - DNA, 15 bp, Homo sapiens
gtcttctctccactt

SEQ ID NO: 5780543 - DNA, 14 bp, Homo sapiens
gtcttctctctggc

SEQ ID NO: 5780544 - DNA, 19 bp, Homo sapiens
gtcttctctctggctcagg

SEQ ID NO: 5780545 - DNA, 18 bp, Homo sapiens
gtcttctgacaaactgtg

SEQ ID NO: 5780546 - DNA, 21 bp, Homo sapiens
gtcttctgccctaacctgaca

SEQ ID NO: 5780547 - DNA, 15 bp, Homo sapiens
gtcttctgctgttct

SEQ ID NO: 5780548 - DNA, 22 bp, Homo sapiens
gtcttctgctttgttgtgtgcc

SEQ ID NO: 5780549 - DNA, 16 bp, Homo sapiens
gtcttctggtctgtgt

SEQ ID NO: 5780550 - DNA, 18 bp, Homo sapiens
gtcttctggtctgtgtgt

SEQ ID NO: 5780551 - DNA, 16 bp, Homo sapiens
gtcttcttatctaaac

SEQ ID NO: 5780552 - DNA, 11 bp, Homo sapiens
gtcttcttggc

SEQ ID NO: 5780553 - DNA, 15 bp, Homo sapiens
gtcttcttggcagct

SEQ ID NO: 5780554 - DNA, 17 bp, Homo sapiens
gtcttcttgtgtcctga

SEQ ID NO: 5780555 - DNA, 12 bp, Homo sapiens
gtcttctttctc

SEQ ID NO: 5780556 - DNA, 13 bp, Homo sapiens
gtcttcttttgtg

SEQ ID NO: 5780557 - DNA, 16 bp, Homo sapiens
gtcttgaaaaaaaata

SEQ ID NO: 5780558 - DNA, 22 bp, Homo sapiens
gtcttgaaaaaaaatagatgtt

SEQ ID NO: 5780559 - DNA, 15 bp, Homo sapiens
gtcttgaaatgaaag

SEQ ID NO: 5780560 - DNA, 20 bp, Homo sapiens
gtcttgaaatgaaagggaaa

SEQ ID NO: 5780561 - DNA, 20 bp, Homo sapiens
gtcttgaacgagcagcccag

SEQ ID NO: 5780562 - DNA, 21 bp, Homo sapiens
gtcttgaacgagcagcccagg

SEQ ID NO: 5780563 - DNA, 15 bp, Homo sapiens
gtcttgaagtcctgg

SEQ ID NO: 5780564 - DNA, 22 bp, Homo sapiens
gtcttgaatagattttctctgg

SEQ ID NO: 5780565 - DNA, 23 bp, Homo sapiens
gtcttgaatagattttctctgga

SEQ ID NO: 5780566 - DNA, 17 bp, Homo sapiens
gtcttgaatgtcttttg

SEQ ID NO: 5780567 - DNA, 18 bp, Homo sapiens
gtcttgacctgaactctg

SEQ ID NO: 5780568 - DNA, 21 bp, Homo sapiens
gtcttgacctgaactctgcaa

SEQ ID NO: 5780569 - DNA, 20 bp, Homo sapiens
gtcttgactcatggcagctg

SEQ ID NO: 5780570 - DNA, 21 bp, Homo sapiens
gtcttgactctaaatgcagtt

SEQ ID NO: 5780571 - DNA, 22 bp, Homo sapiens
gtcttgactctaaatgcagttt

SEQ ID NO: 5780572 - DNA, 13 bp, Homo sapiens
gtcttgagaaaaa

SEQ ID NO: 5780573 - DNA, 13 bp, Homo sapiens
gtcttgagccagt

SEQ ID NO: 5780574 - DNA, 19 bp, Homo sapiens
gtcttgagccagtaatctt

SEQ ID NO: 5780575 - DNA, 14 bp, Homo sapiens
gtcttgagctctat

SEQ ID NO: 5780576 - DNA, 22 bp, Homo sapiens
gtcttgagtgggccccctctct

SEQ ID NO: 5780577 - DNA, 19 bp, Homo sapiens
gtcttgatcctccaatgtc

SEQ ID NO: 5780578 - DNA, 19 bp, Homo sapiens
gtcttgatgtgtcatctaa

SEQ ID NO: 5780579 - DNA, 18 bp, Homo sapiens
gtcttgatttgttttaga

SEQ ID NO: 5780580 - DNA, 18 bp, Homo sapiens
gtcttgcaaagcctttaa

SEQ ID NO: 5780581 - DNA, 20 bp, Homo sapiens
gtcttgcaaagcctttaaat

SEQ ID NO: 5780582 - DNA, 22 bp, Homo sapiens
gtcttgcaaagcctttaaattg

SEQ ID NO: 5780583 - DNA, 12 bp, Homo sapiens
gtcttgcagtgg

SEQ ID NO: 5780584 - DNA, 12 bp, Homo sapiens
gtcttgcatttt

SEQ ID NO: 5780585 - DNA, 22 bp, Homo sapiens
gtcttgcccagcagctcaagaa

SEQ ID NO: 5780586 - DNA, 22 bp, Homo sapiens
gtcttgccccagtttggggtgc

SEQ ID NO: 5780587 - DNA, 14 bp, Homo sapiens
gtcttgccctatta

SEQ ID NO: 5780588 - DNA, 17 bp, Homo sapiens
gtcttgccctattataa

SEQ ID NO: 5780589 - DNA, 13 bp, Homo sapiens
gtcttgcctgcca

SEQ ID NO: 5780590 - DNA, 20 bp, Homo sapiens
gtcttgcctttttcattatt

SEQ ID NO: 5780591 - DNA, 18 bp, Homo sapiens
gtcttgctacctcagtca

SEQ ID NO: 5780592 - DNA, 14 bp, Homo sapiens
gtcttgctatgttg

SEQ ID NO: 5780593 - DNA, 14 bp, Homo sapiens
gtcttgctcctggg

SEQ ID NO: 5780594 - DNA, 12 bp, Homo sapiens
gtcttgctgtgc

SEQ ID NO: 5780595 - DNA, 16 bp, Homo sapiens
gtcttgctgtgcttta

SEQ ID NO: 5780596 - DNA, 15 bp, Homo sapiens
gtcttgctgttgaca

SEQ ID NO: 5780597 - DNA, 13 bp, Homo sapiens
gtcttgctttgct

SEQ ID NO: 5780598 - DNA, 16 bp, Homo sapiens
gtcttgctttgctgtc

SEQ ID NO: 5780599 - DNA, 16 bp, Homo sapiens
gtcttggaacttgcct

SEQ ID NO: 5780600 - DNA, 21 bp, Homo sapiens
gtcttggaagctgtttggaaa

SEQ ID NO: 5780601 - DNA, 22 bp, Homo sapiens
gtcttggaagctgtttggaaaa

SEQ ID NO: 5780602 - DNA, 17 bp, Homo sapiens
gtcttggaagtctgtct

SEQ ID NO: 5780603 - DNA, 22 bp, Homo sapiens
gtcttggacccacctgaaatgc

SEQ ID NO: 5780604 - DNA, 15 bp, Homo sapiens
gtcttggagaggagg

SEQ ID NO: 5780605 - DNA, 17 bp, Homo sapiens
gtcttggagctgagcct

SEQ ID NO: 5780606 - DNA, 18 bp, Homo sapiens
gtcttggcacaatctcac

SEQ ID NO: 5780607 - DNA, 15 bp, Homo sapiens
gtcttggcattaaac

SEQ ID NO: 5780608 - DNA, 14 bp, Homo sapiens
gtcttggccagcca

SEQ ID NO: 5780609 - DNA, 12 bp, Homo sapiens
gtcttggccatg

SEQ ID NO: 5780610 - DNA, 17 bp, Homo sapiens
gtcttggcctcccaaag

SEQ ID NO: 5780611 - DNA, 19 bp, Homo sapiens
gtcttgggcagagctggct

SEQ ID NO: 5780612 - DNA, 21 bp, Homo sapiens
gtcttgggcagagctggctct

SEQ ID NO: 5780613 - DNA, 20 bp, Homo sapiens
gtcttgggctactggcagct

SEQ ID NO: 5780614 - DNA, 23 bp, Homo sapiens
gtcttggggtcatgaagggctgg

SEQ ID NO: 5780615 - DNA, 18 bp, Homo sapiens
gtcttggtcatttgccaa

SEQ ID NO: 5780616 - DNA, 15 bp, Homo sapiens
gtcttggtgcctttt

SEQ ID NO: 5780617 - DNA, 14 bp, Homo sapiens
gtcttggtgctatc

SEQ ID NO: 5780618 - DNA, 15 bp, Homo sapiens
gtcttggtgtaattt

SEQ ID NO: 5780619 - DNA, 16 bp, Homo sapiens
gtcttggttagagaag

SEQ ID NO: 5780620 - DNA, 17 bp, Homo sapiens
gtcttggttccagcctg

SEQ ID NO: 5780621 - DNA, 19 bp, Homo sapiens
gtcttggttccagcctgcc

SEQ ID NO: 5780622 - DNA, 14 bp, Homo sapiens
gtcttggttctaaa

SEQ ID NO: 5780623 - DNA, 16 bp, Homo sapiens
gtcttggttctaaagg

SEQ ID NO: 5780624 - DNA, 17 bp, Homo sapiens
gtcttggttctaaaggt

SEQ ID NO: 5780625 - DNA, 14 bp, Homo sapiens
gtcttggtttggtt

SEQ ID NO: 5780626 - DNA, 21 bp, Homo sapiens
gtcttggtttggttcatggtg

SEQ ID NO: 5780627 - DNA, 19 bp, Homo sapiens
gtcttgtaaaaaggggagg

SEQ ID NO: 5780628 - DNA, 15 bp, Homo sapiens
gtcttgtacatgtgt

SEQ ID NO: 5780629 - DNA, 16 bp, Homo sapiens
gtcttgtaccttgagt

SEQ ID NO: 5780630 - DNA, 16 bp, Homo sapiens
gtcttgtacttctgtg

SEQ ID NO: 5780631 - DNA, 18 bp, Homo sapiens
gtcttgtacttctgtgtt

SEQ ID NO: 5780632 - DNA, 20 bp, Homo sapiens
gtcttgtacttctgtgttca

SEQ ID NO: 5780633 - DNA, 22 bp, Homo sapiens
gtcttgtagctagaacttctct

SEQ ID NO: 5780634 - DNA, 19 bp, Homo sapiens
gtcttgtatttaaaaacat

SEQ ID NO: 5780635 - DNA, 17 bp, Homo sapiens
gtcttgtccccacccat

SEQ ID NO: 5780636 - DNA, 22 bp, Homo sapiens
gtcttgtctcagattttattat

SEQ ID NO: 5780637 - DNA, 23 bp, Homo sapiens
gtcttgtctcagattttattatg

SEQ ID NO: 5780638 - DNA, 15 bp, Homo sapiens
gtcttgtgaaagtgt

SEQ ID NO: 5780639 - DNA, 15 bp, Homo sapiens
gtcttgtgaaattgt

SEQ ID NO: 5780640 - DNA, 17 bp, Homo sapiens
gtcttgtgaaattgtgt

SEQ ID NO: 5780641 - DNA, 21 bp, Homo sapiens
gtcttgtgactagtgctgaag

SEQ ID NO: 5780642 - DNA, 22 bp, Homo sapiens
gtcttgtgcataattcttccaa

SEQ ID NO: 5780643 - DNA, 23 bp, Homo sapiens
gtcttgtggatggaaatgtagtg

SEQ ID NO: 5780644 - DNA, 18 bp, Homo sapiens
gtcttgtggttgtgtgtg

SEQ ID NO: 5780645 - DNA, 19 bp, Homo sapiens
gtcttgtgtatttctctgt

SEQ ID NO: 5780646 - DNA, 20 bp, Homo sapiens
gtcttgttaagtgcagtctg

SEQ ID NO: 5780647 - DNA, 16 bp, Homo sapiens
gtcttgttaatattct

SEQ ID NO: 5780648 - DNA, 19 bp, Homo sapiens
gtcttgttatgtacaaact

SEQ ID NO: 5780649 - DNA, 14 bp, Homo sapiens
gtcttgttcatttt

SEQ ID NO: 5780650 - DNA, 12 bp, Homo sapiens
gtcttgttctgt

SEQ ID NO: 5780651 - DNA, 20 bp, Homo sapiens
gtcttgttgcggatggatgg

SEQ ID NO: 5780652 - DNA, 20 bp, Homo sapiens
gtcttgttgttattgatgtt

SEQ ID NO: 5780653 - DNA, 17 bp, Homo sapiens
gtgaaagaaagggaccc

SEQ ID NO: 5780654 - DNA, 15 bp, Homo sapiens
gtgaaagaaatcatg

SEQ ID NO: 5780655 - DNA, 19 bp, Homo sapiens
gtgaaagaaatcatgttat

SEQ ID NO: 5780656 - DNA, 18 bp, Homo sapiens
gtgaaagaagagaaaagg

SEQ ID NO: 5780657 - DNA, 13 bp, Homo sapiens
gtgaaagaagtaa

SEQ ID NO: 5780658 - DNA, 21 bp, Homo sapiens
gtgaaagagagtaccatgctg

SEQ ID NO: 5780659 - DNA, 15 bp, Homo sapiens
gtgaaagatgcatgt

SEQ ID NO: 5780660 - DNA, 17 bp, Homo sapiens
gtgaaagcatatgggtt

SEQ ID NO: 5780661 - DNA, 20 bp, Homo sapiens
gtgaaagctccatgtttaga

SEQ ID NO: 5780662 - DNA, 17 bp, Homo sapiens
gtgaaaggcagggccct

SEQ ID NO: 5780663 - DNA, 12 bp, Homo sapiens
gtgaaaggcctg

SEQ ID NO: 5780664 - DNA, 21 bp, Homo sapiens
gtgaaagggagctatcaggaa

SEQ ID NO: 5780665 - DNA, 12 bp, Homo sapiens
gtgaaagggcta

SEQ ID NO: 5780666 - DNA, 17 bp, Homo sapiens
gtgaaagtacatttgga

SEQ ID NO: 5780667 - DNA, 23 bp, Homo sapiens
gtgaaagtatgtgatatctgaac

SEQ ID NO: 5780668 - DNA, 21 bp, Homo sapiens
gtgaaagtcagatgcccagag

SEQ ID NO: 5780669 - DNA, 13 bp, Homo sapiens
gtgaaagtgctgc

SEQ ID NO: 5780670 - DNA, 16 bp, Homo sapiens
gtgaaagtgctgctct

SEQ ID NO: 5780671 - DNA, 19 bp, Homo sapiens
gtgaaagtgtaaaatagaa

SEQ ID NO: 5780672 - DNA, 15 bp, Homo sapiens
gtgaaagttgccatt

SEQ ID NO: 5780673 - DNA, 13 bp, Homo sapiens
gtgaaataaaatg

SEQ ID NO: 5780674 - DNA, 19 bp, Homo sapiens
gtgaaataacaaaatggac

SEQ ID NO: 5780675 - DNA, 15 bp, Homo sapiens
gtgaaataataaaat

SEQ ID NO: 5780676 - DNA, 22 bp, Homo sapiens
gtgaaataccaacctgaagaca

SEQ ID NO: 5780677 - DNA, 23 bp, Homo sapiens
gtgaaataccacaagcctgagaa

SEQ ID NO: 5780678 - DNA, 15 bp, Homo sapiens
gtgaaatattgtaaa

SEQ ID NO: 5780679 - DNA, 18 bp, Homo sapiens
gtgaaatcagaagtgcaa

SEQ ID NO: 5780680 - DNA, 14 bp, Homo sapiens
gtgaaatcctcagc

SEQ ID NO: 5780681 - DNA, 14 bp, Homo sapiens
gtgaaatctgtgca

SEQ ID NO: 5780682 - DNA, 15 bp, Homo sapiens
gtgaaatgtgaagga

SEQ ID NO: 5780683 - DNA, 14 bp, Homo sapiens
gtgaaattattttg

SEQ ID NO: 5780684 - DNA, 22 bp, Homo sapiens
gtgaaattcaacctgtgtctta

SEQ ID NO: 5780685 - DNA, 20 bp, Homo sapiens
gtgaaattgcatactttgta

SEQ ID NO: 5780686 - DNA, 12 bp, Homo sapiens
gtgaaattgtgt

SEQ ID NO: 5780687 - DNA, 15 bp, Homo sapiens
gtgaaatttcatgat

SEQ ID NO: 5780688 - DNA, 16 bp, Homo sapiens
gtgaaatttgcctctg

SEQ ID NO: 5780689 - DNA, 22 bp, Homo sapiens
gtgaaattttcttgatttgagt

SEQ ID NO: 5780690 - DNA, 18 bp, Homo sapiens
gtgaaatttttcatattt

SEQ ID NO: 5780691 - DNA, 14 bp, Homo sapiens
gtgaaatttttcca

SEQ ID NO: 5780692 - DNA, 23 bp, Homo sapiens
gtgaaatttttccacactatgtg

SEQ ID NO: 5780693 - DNA, 16 bp, Homo sapiens
gtgaacaaagaaaaga

SEQ ID NO: 5780694 - DNA, 18 bp, Homo sapiens
gtgaacaaagtgagaaat

SEQ ID NO: 5780695 - DNA, 19 bp, Homo sapiens
gtgaacaagcaaacccaga

SEQ ID NO: 5780696 - DNA, 14 bp, Homo sapiens
gtgaacaaggtaaa

SEQ ID NO: 5780697 - DNA, 21 bp, Homo sapiens
gtgaacactagccagacactc

SEQ ID NO: 5780698 - DNA, 14 bp, Homo sapiens
gtgaacacttttga

SEQ ID NO: 5780699 - DNA, 18 bp, Homo sapiens
gtgaacagagagaaccag

SEQ ID NO: 5780700 - DNA, 20 bp, Homo sapiens
gtgaacagagagaaccagga

SEQ ID NO: 5780701 - DNA, 22 bp, Homo sapiens
gtgaacagagagaaccaggagg

SEQ ID NO: 5780702 - DNA, 17 bp, Homo sapiens
gtgaacagagagaccct

SEQ ID NO: 5780703 - DNA, 15 bp, Homo sapiens
gtgaacagctggtgc

SEQ ID NO: 5780704 - DNA, 13 bp, Homo sapiens
gtgaacataactg

SEQ ID NO: 5780705 - DNA, 16 bp, Homo sapiens
gtgaacatgcctcctc

SEQ ID NO: 5780706 - DNA, 23 bp, Homo sapiens
gtgaacattattaaatcagaatc

SEQ ID NO: 5780707 - DNA, 12 bp, Homo sapiens
gtgaacattctg

SEQ ID NO: 5780708 - DNA, 20 bp, Homo sapiens
gtgaaccaacccccatctcc

SEQ ID NO: 5780709 - DNA, 15 bp, Homo sapiens
gtgaaccacaggttt

SEQ ID NO: 5780710 - DNA, 22 bp, Homo sapiens
gtgaaccaccacacccagccca

SEQ ID NO: 5780711 - DNA, 23 bp, Homo sapiens
gtgaaccaccacacccagcccac

SEQ ID NO: 5780712 - DNA, 17 bp, Homo sapiens
gtgaaccagagggtgtg

SEQ ID NO: 5780713 - DNA, 20 bp, Homo sapiens
gtgaaccatctcagaccttt

SEQ ID NO: 5780714 - DNA, 13 bp, Homo sapiens
gtgaacccaggac

SEQ ID NO: 5780715 - DNA, 22 bp, Homo sapiens
gtgaacctacctgccttggaga

SEQ ID NO: 5780716 - DNA, 16 bp, Homo sapiens
gtgaacctaccttcat

SEQ ID NO: 5780717 - DNA, 15 bp, Homo sapiens
gtgaacctcaccccg

SEQ ID NO: 5780718 - DNA, 12 bp, Homo sapiens
gtgaacctggag

SEQ ID NO: 5780719 - DNA, 14 bp, Homo sapiens
gtgaacctgtataa

SEQ ID NO: 5780720 - DNA, 16 bp, Homo sapiens
gtgaacgatttagaaa

SEQ ID NO: 5780721 - DNA, 23 bp, Homo sapiens
gtgaacgctgtgatgctgtgtgc

SEQ ID NO: 5780722 - DNA, 24 bp, Homo sapiens
gtgaacgtgggagttcagctgctt

SEQ ID NO: 5780723 - DNA, 21 bp, Homo sapiens
gtgaactaatgacaagtgact

SEQ ID NO: 5780724 - DNA, 22 bp, Homo sapiens
gtgaactaatttggtttttact

SEQ ID NO: 5780725 - DNA, 23 bp, Homo sapiens
gtgaactaatttggtttttactc

SEQ ID NO: 5780726 - DNA, 17 bp, Homo sapiens
gtgaactagggaagctc

SEQ ID NO: 5780727 - DNA, 18 bp, Homo sapiens
gtgaactcagccaagcac

SEQ ID NO: 5780728 - DNA, 21 bp, Homo sapiens
gtgaactcagccaagcacagt

SEQ ID NO: 5780729 - DNA, 19 bp, Homo sapiens
gtgaactcatcccttgttt

SEQ ID NO: 5780730 - DNA, 14 bp, Homo sapiens
gtgaactcctgcca

SEQ ID NO: 5780731 - DNA, 16 bp, Homo sapiens
gtgaactgcagtgatg

SEQ ID NO: 5780732 - DNA, 20 bp, Homo sapiens
gtgaactggaccctgttgct

SEQ ID NO: 5780733 - DNA, 21 bp, Homo sapiens
gtgaactggaccctgttgcta

SEQ ID NO: 5780734 - DNA, 15 bp, Homo sapiens
gtgaactgggcacag

SEQ ID NO: 5780735 - DNA, 21 bp, Homo sapiens
gtgaactgtgtgtgaatctgc

SEQ ID NO: 5780736 - DNA, 17 bp, Homo sapiens
gtgaactgttggagccc

SEQ ID NO: 5780737 - DNA, 14 bp, Homo sapiens
gtgaacttccctac

SEQ ID NO: 5780738 - DNA, 14 bp, Homo sapiens
gtgaacttgaaatt

SEQ ID NO: 5780739 - DNA, 14 bp, Homo sapiens
gtgaacttggaagc

SEQ ID NO: 5780740 - DNA, 19 bp, Homo sapiens
gtgaacttggctttcctgt

SEQ ID NO: 5780741 - DNA, 18 bp, Homo sapiens
gtgaacttgggagggggc

SEQ ID NO: 5780742 - DNA, 19 bp, Homo sapiens
gtgaacttgggccactgtg

SEQ ID NO: 5780743 - DNA, 18 bp, Homo sapiens
gtgaacttgtagctgtaa

SEQ ID NO: 5780744 - DNA, 15 bp, Homo sapiens
gtgaacttttgtaat

SEQ ID NO: 5780745 - DNA, 19 bp, Homo sapiens
gtgaacttttgtaatttga

SEQ ID NO: 5780746 - DNA, 20 bp, Homo sapiens
gtgaacttttgtaatttgaa

SEQ ID NO: 5780747 - DNA, 23 bp, Homo sapiens
gtgaacttttgtaatttgaattg

SEQ ID NO: 5780748 - DNA, 12 bp, Homo sapiens
gtgaactttttt

SEQ ID NO: 5780749 - DNA, 20 bp, Homo sapiens
gtgaagaaaaagacctgcat

SEQ ID NO: 5780750 - DNA, 12 bp, Homo sapiens
gtgaagaaagcc

SEQ ID NO: 5780751 - DNA, 20 bp, Homo sapiens
gtgaagaaataaatgaaact

SEQ ID NO: 5780752 - DNA, 14 bp, Homo sapiens
gtgaagaaccctat

SEQ ID NO: 5780753 - DNA, 20 bp, Homo sapiens
gtgaagaaccctgcagggcc

SEQ ID NO: 5780754 - DNA, 15 bp, Homo sapiens
gtgaagaagccctgt

SEQ ID NO: 5780755 - DNA, 21 bp, Homo sapiens
gtgaagaatgcacaagaatgg

SEQ ID NO: 5780756 - DNA, 17 bp, Homo sapiens
gtgaagaatttagatct

SEQ ID NO: 5780757 - DNA, 14 bp, Homo sapiens
gtgaagacagaagt

SEQ ID NO: 5780758 - DNA, 16 bp, Homo sapiens
gtgaagacagagcaga

SEQ ID NO: 5780759 - DNA, 16 bp, Homo sapiens
gtgaagagcaagagag

SEQ ID NO: 5780760 - DNA, 15 bp, Homo sapiens
gtgaagagccggtgg

SEQ ID NO: 5780761 - DNA, 18 bp, Homo sapiens
gtgaagagggacataaga

SEQ ID NO: 5780762 - DNA, 19 bp, Homo sapiens
gtgaagagggagaagcatg

SEQ ID NO: 5780763 - DNA, 18 bp, Homo sapiens
gtgaagaggggaagtctc

SEQ ID NO: 5780764 - DNA, 16 bp, Homo sapiens
gtgaagaggggcagcc

SEQ ID NO: 5780765 - DNA, 17 bp, Homo sapiens
gtgaagaggggcagccc

SEQ ID NO: 5780766 - DNA, 20 bp, Homo sapiens
gtgaagagtagaacccaggt

SEQ ID NO: 5780767 - DNA, 18 bp, Homo sapiens
gtgaagataatttgcata

SEQ ID NO: 5780768 - DNA, 13 bp, Homo sapiens
gtgaagatacttt

SEQ ID NO: 5780769 - DNA, 22 bp, Homo sapiens
gtgaagatctttggcatgattt

SEQ ID NO: 5780770 - DNA, 20 bp, Homo sapiens
gtgaagatgaagaagccttt

SEQ ID NO: 5780771 - DNA, 21 bp, Homo sapiens
gtgaagatgaagaagcctttg

SEQ ID NO: 5780772 - DNA, 18 bp, Homo sapiens
gtgaagatgctgtaaata

SEQ ID NO: 5780773 - DNA, 16 bp, Homo sapiens
gtgaagatgtgtaaat

SEQ ID NO: 5780774 - DNA, 13 bp, Homo sapiens
gtgaagatgttta

SEQ ID NO: 5780775 - DNA, 18 bp, Homo sapiens
gtgaagcaaacacagcat

SEQ ID NO: 5780776 - DNA, 20 bp, Homo sapiens
gtgaagcaatcatttcccct

SEQ ID NO: 5780777 - DNA, 18 bp, Homo sapiens
gtgaagcagcactgtgag

SEQ ID NO: 5780778 - DNA, 13 bp, Homo sapiens
gtgaagcagcagc

SEQ ID NO: 5780779 - DNA, 18 bp, Homo sapiens
gtgaagcagtcagccctt

SEQ ID NO: 5780780 - DNA, 17 bp, Homo sapiens
gtgaagcatgctttgct

SEQ ID NO: 5780781 - DNA, 18 bp, Homo sapiens
gtgaagcatgctttgctg

SEQ ID NO: 5780782 - DNA, 10 bp, Homo sapiens
gtgaagccaa

SEQ ID NO: 5780783 - DNA, 21 bp, Homo sapiens
gtgaagcccaggaggacctgg

SEQ ID NO: 5780784 - DNA, 12 bp, Homo sapiens
gtgaagccctgt

SEQ ID NO: 5780785 - DNA, 10 bp, Homo sapiens
gtgaagcctt

SEQ ID NO: 5780786 - DNA, 12 bp, Homo sapiens
gtgaagccttcc

SEQ ID NO: 5780787 - DNA, 15 bp, Homo sapiens
gtgaagcctttatct

SEQ ID NO: 5780788 - DNA, 22 bp, Homo sapiens
gtgaagcctttatctatgggag

SEQ ID NO: 5780789 - DNA, 14 bp, Homo sapiens
gtgaagcgcctcag

SEQ ID NO: 5780790 - DNA, 11 bp, Homo sapiens
gtgaagctaat

SEQ ID NO: 5780791 - DNA, 16 bp, Homo sapiens
gtgaagctaatgacca

SEQ ID NO: 5780792 - DNA, 15 bp, Homo sapiens
gtgaagctctcaccc

SEQ ID NO: 5780793 - DNA, 13 bp, Homo sapiens
gtgaaggaaataa

SEQ ID NO: 5780794 - DNA, 14 bp, Homo sapiens
gtgaaggacatgag

SEQ ID NO: 5780795 - DNA, 24 bp, Homo sapiens
gtgaaggacatgagactaagagaa

SEQ ID NO: 5780796 - DNA, 13 bp, Homo sapiens
gtgaaggaccctt

SEQ ID NO: 5780797 - DNA, 22 bp, Homo sapiens
gtgaaggacttagccgactgcg

SEQ ID NO: 5780798 - DNA, 18 bp, Homo sapiens
gtgaaggagaaaggagcc

SEQ ID NO: 5780799 - DNA, 19 bp, Homo sapiens
gtgaaggagaaaggagccg

SEQ ID NO: 5780800 - DNA, 21 bp, Homo sapiens
gtgaaggagaaaggagccgga

SEQ ID NO: 5780801 - DNA, 17 bp, Homo sapiens
gtgaaggaggctccagg

SEQ ID NO: 5780802 - DNA, 18 bp, Homo sapiens
gtgaaggagtaatgggat

SEQ ID NO: 5780803 - DNA, 18 bp, Homo sapiens
gtgaaggatccaggaata

SEQ ID NO: 5780804 - DNA, 23 bp, Homo sapiens
gtgaaggcccaagagcagagtct

SEQ ID NO: 5780805 - DNA, 16 bp, Homo sapiens
gtgaaggcccatgaag

SEQ ID NO: 5780806 - DNA, 15 bp, Homo sapiens
gtgaaggctctcaga

SEQ ID NO: 5780807 - DNA, 18 bp, Homo sapiens
gtgaagggaagagacagc

SEQ ID NO: 5780808 - DNA, 18 bp, Homo sapiens
gtgaagggatgggggaag

SEQ ID NO: 5780809 - DNA, 16 bp, Homo sapiens
gtgaaggtcttgcctg

SEQ ID NO: 5780810 - DNA, 16 bp, Homo sapiens
gtgaaggtgacagcag

SEQ ID NO: 5780811 - DNA, 17 bp, Homo sapiens
gtgaaggttcccaagga

SEQ ID NO: 5780812 - DNA, 21 bp, Homo sapiens
gtgaaggttcccaaggacatg

SEQ ID NO: 5780813 - DNA, 16 bp, Homo sapiens
gtgaagtacacctgtg

SEQ ID NO: 5780814 - DNA, 19 bp, Homo sapiens
gtgaagtatactgtatttt

SEQ ID NO: 5780815 - DNA, 15 bp, Homo sapiens
gtgaagtattgctga

SEQ ID NO: 5780816 - DNA, 23 bp, Homo sapiens
gtgaagtccagtgaccctggagc

SEQ ID NO: 5780817 - DNA, 18 bp, Homo sapiens
gtgaagtctagaatcata

SEQ ID NO: 5780818 - DNA, 14 bp, Homo sapiens
gtgaagtgaagaca

SEQ ID NO: 5780819 - DNA, 18 bp, Homo sapiens
gtgaagtgagaactccat

SEQ ID NO: 5780820 - DNA, 20 bp, Homo sapiens
gtgaagtgaggacaaaatca

SEQ ID NO: 5780821 - DNA, 17 bp, Homo sapiens
gtgaagtgtggctggtg

SEQ ID NO: 5780822 - DNA, 18 bp, Homo sapiens
gtgaagtgttaatacatc

SEQ ID NO: 5780823 - DNA, 14 bp, Homo sapiens
gtgaagttagaatt

SEQ ID NO: 5780824 - DNA, 17 bp, Homo sapiens
gtgaagttagaattcct

SEQ ID NO: 5780825 - DNA, 15 bp, Homo sapiens
gtgaagttcatcttg

SEQ ID NO: 5780826 - DNA, 14 bp, Homo sapiens
gtgaagttgctgct

SEQ ID NO: 5780827 - DNA, 15 bp, Homo sapiens
gtgaagttgcttctt

SEQ ID NO: 5780828 - DNA, 19 bp, Homo sapiens
gtgaagtttaattgactta

SEQ ID NO: 5780829 - DNA, 14 bp, Homo sapiens
gtgaagtttacatt

SEQ ID NO: 5780830 - DNA, 15 bp, Homo sapiens
gtgaataaaaaccct

SEQ ID NO: 5780831 - DNA, 15 bp, Homo sapiens
gtgaccaatgtcttg

SEQ ID NO: 5780832 - DNA, 18 bp, Homo sapiens
gtgaccaattgccctgcc

SEQ ID NO: 5780833 - DNA, 13 bp, Homo sapiens
gtgaccaccttct

SEQ ID NO: 5780834 - DNA, 22 bp, Homo sapiens
gtgaccaccttctgtccccagc

SEQ ID NO: 5780835 - DNA, 22 bp, Homo sapiens
gtgaccactgaattcactccag

SEQ ID NO: 5780836 - DNA, 22 bp, Homo sapiens
gtgaccagcggaaacaggtgtg

SEQ ID NO: 5780837 - DNA, 16 bp, Homo sapiens
gtgaccaggcagtttt

SEQ ID NO: 5780838 - DNA, 20 bp, Homo sapiens
gtgaccaggcttttgtagat

SEQ ID NO: 5780839 - DNA, 12 bp, Homo sapiens
gtgaccaggtcc

SEQ ID NO: 5780840 - DNA, 14 bp, Homo sapiens
gtgaccagtttctt

SEQ ID NO: 5780841 - DNA, 15 bp, Homo sapiens
gtgaccagtttctta

SEQ ID NO: 5780842 - DNA, 21 bp, Homo sapiens
gtgaccagttttgatatttat

SEQ ID NO: 5780843 - DNA, 18 bp, Homo sapiens
gtgaccatgttttgttta

SEQ ID NO: 5780844 - DNA, 14 bp, Homo sapiens
gtgaccattctgcc

SEQ ID NO: 5780845 - DNA, 17 bp, Homo sapiens
gtgaccattctgcctct

SEQ ID NO: 5780846 - DNA, 15 bp, Homo sapiens
gtgacccaagaactc

SEQ ID NO: 5780847 - DNA, 13 bp, Homo sapiens
gtgacccacagct

SEQ ID NO: 5780848 - DNA, 15 bp, Homo sapiens
gtgacccacagctct

SEQ ID NO: 5780849 - DNA, 21 bp, Homo sapiens
gtgacccacagctctgggcct

SEQ ID NO: 5780850 - DNA, 20 bp, Homo sapiens
gtgacccacccgccttggcc

SEQ ID NO: 5780851 - DNA, 23 bp, Homo sapiens
gtgacccacccgccttggcctcc

SEQ ID NO: 5780852 - DNA, 11 bp, Homo sapiens
gtgacccagct

SEQ ID NO: 5780853 - DNA, 14 bp, Homo sapiens
gtgacccaggtcct

SEQ ID NO: 5780854 - DNA, 15 bp, Homo sapiens
gtgacccagtcagag

SEQ ID NO: 5780855 - DNA, 13 bp, Homo sapiens
gtgacccatctgt

SEQ ID NO: 5780856 - DNA, 16 bp, Homo sapiens
gtgacccatctgtagt

SEQ ID NO: 5780857 - DNA, 22 bp, Homo sapiens
gtgaccccagctccaggcagga

SEQ ID NO: 5780858 - DNA, 13 bp, Homo sapiens
gtgaccccagggc

SEQ ID NO: 5780859 - DNA, 14 bp, Homo sapiens
gtgaccccagggca

SEQ ID NO: 5780860 - DNA, 21 bp, Homo sapiens
gtgaccccagggcacaggagc

SEQ ID NO: 5780861 - DNA, 23 bp, Homo sapiens
gtgaccccagggcacaggagcta

SEQ ID NO: 5780862 - DNA, 14 bp, Homo sapiens
gtgaccccagggcc

SEQ ID NO: 5780863 - DNA, 15 bp, Homo sapiens
gtgacccccagctcc

SEQ ID NO: 5780864 - DNA, 21 bp, Homo sapiens
gtgacccctgctttgccccac

SEQ ID NO: 5780865 - DNA, 22 bp, Homo sapiens
gtgacccctgctttgccccact

SEQ ID NO: 5780866 - DNA, 16 bp, Homo sapiens
gtgacccctttcactt

SEQ ID NO: 5780867 - DNA, 23 bp, Homo sapiens
gtgaccccttttagtcaggagag

SEQ ID NO: 5780868 - DNA, 23 bp, Homo sapiens
gtgaccccttttcagcttctgct

SEQ ID NO: 5780869 - DNA, 22 bp, Homo sapiens
gtgacccggcaccccctgcagc

SEQ ID NO: 5780870 - DNA, 18 bp, Homo sapiens
gtgaccctcagctgtcac

SEQ ID NO: 5780871 - DNA, 19 bp, Homo sapiens
gtgaccctcagctgtcacc

SEQ ID NO: 5780872 - DNA, 12 bp, Homo sapiens
gtgaccctccaa

SEQ ID NO: 5780873 - DNA, 12 bp, Homo sapiens
gtgaccctctca

SEQ ID NO: 5780874 - DNA, 21 bp, Homo sapiens
gtgaccctctgaatggtccag

SEQ ID NO: 5780875 - DNA, 21 bp, Homo sapiens
gtgaccctctgctgaagactt

SEQ ID NO: 5780876 - DNA, 19 bp, Homo sapiens
gtgaccctgagggctcctc

SEQ ID NO: 5780877 - DNA, 13 bp, Homo sapiens
gtgaccctggagc

SEQ ID NO: 5780878 - DNA, 16 bp, Homo sapiens
gtgaccctggctcctt

SEQ ID NO: 5780879 - DNA, 14 bp, Homo sapiens
gtgaccctgtgccc

SEQ ID NO: 5780880 - DNA, 23 bp, Homo sapiens
gtgacccttcccaatcagcactg

SEQ ID NO: 5780881 - DNA, 21 bp, Homo sapiens
gtgaccgattatgctttcttt

SEQ ID NO: 5780882 - DNA, 20 bp, Homo sapiens
gtgaccgcctcctgctctgc

SEQ ID NO: 5780883 - DNA, 15 bp, Homo sapiens
gtgaccggcccgcca

SEQ ID NO: 5780884 - DNA, 20 bp, Homo sapiens
gtgaccggcccgccaccttg

SEQ ID NO: 5780885 - DNA, 18 bp, Homo sapiens
gtgaccgggggaagctga

SEQ ID NO: 5780886 - DNA, 20 bp, Homo sapiens
gtgaccgggggaagctgagc

SEQ ID NO: 5780887 - DNA, 18 bp, Homo sapiens
gtgaccgggggctgctgg

SEQ ID NO: 5780888 - DNA, 19 bp, Homo sapiens
gtgaccgggggctgctggg

SEQ ID NO: 5780889 - DNA, 16 bp, Homo sapiens
gtgaccggggtcctga

SEQ ID NO: 5780890 - DNA, 15 bp, Homo sapiens
gtgacctaagaacaa

SEQ ID NO: 5780891 - DNA, 18 bp, Homo sapiens
gtgacctcacacacctct

SEQ ID NO: 5780892 - DNA, 12 bp, Homo sapiens
gtgacctcaggc

SEQ ID NO: 5780893 - DNA, 18 bp, Homo sapiens
gtgacctccacagctacc

SEQ ID NO: 5780894 - DNA, 13 bp, Homo sapiens
gtgacctcctgtc

SEQ ID NO: 5780895 - DNA, 16 bp, Homo sapiens
gtgacctcctgtcact

SEQ ID NO: 5780896 - DNA, 21 bp, Homo sapiens
gtgacctcggacagagccccc

SEQ ID NO: 5780897 - DNA, 13 bp, Homo sapiens
gtgacctctctct

SEQ ID NO: 5780898 - DNA, 16 bp, Homo sapiens
gtgacctctctctctg

SEQ ID NO: 5780899 - DNA, 14 bp, Homo sapiens
gtgacctctgcctg

SEQ ID NO: 5780900 - DNA, 15 bp, Homo sapiens
gtgacctctgcctga

SEQ ID NO: 5780901 - DNA, 13 bp, Homo sapiens
gtgacctcttcaa

SEQ ID NO: 5780902 - DNA, 14 bp, Homo sapiens
gtgacctgaagttc

SEQ ID NO: 5780903 - DNA, 21 bp, Homo sapiens
gtgacctgacacctgccgctg

SEQ ID NO: 5780904 - DNA, 13 bp, Homo sapiens
gtgacctgagggc

SEQ ID NO: 5780905 - DNA, 13 bp, Homo sapiens
gtgacctgctagg

SEQ ID NO: 5780906 - DNA, 17 bp, Homo sapiens
gtgacctgctcctgccc

SEQ ID NO: 5780907 - DNA, 18 bp, Homo sapiens
gtgacctgctcctgccca

SEQ ID NO: 5780908 - DNA, 13 bp, Homo sapiens
gtgacctgctgag

SEQ ID NO: 5780909 - DNA, 20 bp, Homo sapiens
gtgacctgctgagctctgag

SEQ ID NO: 5780910 - DNA, 21 bp, Homo sapiens
gtgacctgggtatcccctgcc

SEQ ID NO: 5780911 - DNA, 15 bp, Homo sapiens
gtgacctggtctggt

SEQ ID NO: 5780912 - DNA, 13 bp, Homo sapiens
gtgacctgtttat

SEQ ID NO: 5780913 - DNA, 22 bp, Homo sapiens
gtgaccttagtgtttctgtgca

SEQ ID NO: 5780914 - DNA, 23 bp, Homo sapiens
gtgaccttagtgtttctgtgcat

SEQ ID NO: 5780915 - DNA, 18 bp, Homo sapiens
gtgaccttttaatcagag

SEQ ID NO: 5780916 - DNA, 13 bp, Homo sapiens
gtgaccttttctt

SEQ ID NO: 5780917 - DNA, 22 bp, Homo sapiens
gtgacctttttaatccaggccc

SEQ ID NO: 5780918 - DNA, 18 bp, Homo sapiens
gtgacgatgggtgttgct

SEQ ID NO: 5780919 - DNA, 19 bp, Homo sapiens
gtgacgatgggtgttgctg

SEQ ID NO: 5780920 - DNA, 18 bp, Homo sapiens
gtgacgcccaccttcggg

SEQ ID NO: 5780921 - DNA, 21 bp, Homo sapiens
gtgacgcctgagacagcacca

SEQ ID NO: 5780922 - DNA, 18 bp, Homo sapiens
gtgacgctgaataaatgt

SEQ ID NO: 5780923 - DNA, 19 bp, Homo sapiens
gtgacgctgaataaatgtc

SEQ ID NO: 5780924 - DNA, 14 bp, Homo sapiens
gtgacggccctcat

SEQ ID NO: 5780925 - DNA, 13 bp, Homo sapiens
gtgacggcggggt

SEQ ID NO: 5780926 - DNA, 18 bp, Homo sapiens
gtgacgggagcctcctct

SEQ ID NO: 5780927 - DNA, 13 bp, Homo sapiens
gtgacggtcccac

SEQ ID NO: 5780928 - DNA, 15 bp, Homo sapiens
gtgacggtcccacac

SEQ ID NO: 5780929 - DNA, 22 bp, Homo sapiens
gtgacggtcccacactggtgac

SEQ ID NO: 5780930 - DNA, 24 bp, Homo sapiens
gtgacggtcctttaggcagcctgc

SEQ ID NO: 5780931 - DNA, 21 bp, Homo sapiens
gtgacgtctgggtggccctta

SEQ ID NO: 5780932 - DNA, 16 bp, Homo sapiens
gtgacgtgactcagag

SEQ ID NO: 5780933 - DNA, 17 bp, Homo sapiens
gtgacgtgactcagagc

SEQ ID NO: 5780934 - DNA, 18 bp, Homo sapiens
gtgacgtgactcagagct

SEQ ID NO: 5780935 - DNA, 15 bp, Homo sapiens
gtgactaagttgcaa

SEQ ID NO: 5780936 - DNA, 18 bp, Homo sapiens
gtgactaattgtataaca

SEQ ID NO: 5780937 - DNA, 19 bp, Homo sapiens
gtgactaattgtataacag

SEQ ID NO: 5780938 - DNA, 20 bp, Homo sapiens
gtgactaattgtataacagg

SEQ ID NO: 5780939 - DNA, 21 bp, Homo sapiens
gtgactaccacttatttctaa

SEQ ID NO: 5780940 - DNA, 18 bp, Homo sapiens
gtgactagcgcctggcct

SEQ ID NO: 5780941 - DNA, 19 bp, Homo sapiens
gtgactagcgcctggcctt

SEQ ID NO: 5780942 - DNA, 20 bp, Homo sapiens
gtgactaggcatacactgta

SEQ ID NO: 5780943 - DNA, 19 bp, Homo sapiens
gtgactagtacaaattata

SEQ ID NO: 5780944 - DNA, 17 bp, Homo sapiens
gtgactagtgctgaagc

SEQ ID NO: 5780945 - DNA, 14 bp, Homo sapiens
gtgactataaagct

SEQ ID NO: 5780946 - DNA, 23 bp, Homo sapiens
gtgactatgaaacgaatataagc

SEQ ID NO: 5780947 - DNA, 21 bp, Homo sapiens
gtgactattaaatgttgcaca

SEQ ID NO: 5780948 - DNA, 19 bp, Homo sapiens
gtgactatttggagaatag

SEQ ID NO: 5780949 - DNA, 15 bp, Homo sapiens
gtgactcacccaagc

SEQ ID NO: 5780950 - DNA, 13 bp, Homo sapiens
gtgactcagagct

SEQ ID NO: 5780951 - DNA, 14 bp, Homo sapiens
gtgactcagagctt

SEQ ID NO: 5780952 - DNA, 17 bp, Homo sapiens
gtgactcagcagaggca

SEQ ID NO: 5780953 - DNA, 18 bp, Homo sapiens
gtgactcagcagaggcag

SEQ ID NO: 5780954 - DNA, 14 bp, Homo sapiens
gtgactcagcagcc

SEQ ID NO: 5780955 - DNA, 16 bp, Homo sapiens
gtgactcagcagcctg

SEQ ID NO: 5780956 - DNA, 16 bp, Homo sapiens
gtgactcattcccagt

SEQ ID NO: 5780957 - DNA, 11 bp, Homo sapiens
gtgactccagg

SEQ ID NO: 5780958 - DNA, 14 bp, Homo sapiens
gtgactccagggtg

SEQ ID NO: 5780959 - DNA, 20 bp, Homo sapiens
gtgactccagggtgacaagg

SEQ ID NO: 5780960 - DNA, 13 bp, Homo sapiens
gtgactccccagc

SEQ ID NO: 5780961 - DNA, 15 bp, Homo sapiens
gtgactccctgggag

SEQ ID NO: 5780962 - DNA, 19 bp, Homo sapiens
gtgactccttatctctttc

SEQ ID NO: 5780963 - DNA, 20 bp, Homo sapiens
gtgactccttatctctttcc

SEQ ID NO: 5780964 - DNA, 17 bp, Homo sapiens
gtgactcgggagctgca

SEQ ID NO: 5780965 - DNA, 17 bp, Homo sapiens
gtgactcgggctcctgt

SEQ ID NO: 5780966 - DNA, 18 bp, Homo sapiens
gtgactcgggctcctgtg

SEQ ID NO: 5780967 - DNA, 20 bp, Homo sapiens
gtgactcgggggctgtctca

SEQ ID NO: 5780968 - DNA, 21 bp, Homo sapiens
gtgactctaagctcagtgctc

SEQ ID NO: 5780969 - DNA, 19 bp, Homo sapiens
gtgactctagcaaggctca

SEQ ID NO: 5780970 - DNA, 20 bp, Homo sapiens
gtgactctttcctaaagcca

SEQ ID NO: 5780971 - DNA, 22 bp, Homo sapiens
gtgactctttttagggccaggc

SEQ ID NO: 5780972 - DNA, 18 bp, Homo sapiens
gtgactgaaaccattttc

SEQ ID NO: 5780973 - DNA, 12 bp, Homo sapiens
gtgactgaaggg

SEQ ID NO: 5780974 - DNA, 21 bp, Homo sapiens
gtgactgaaggggcacaccac

SEQ ID NO: 5780975 - DNA, 18 bp, Homo sapiens
gtgactgaatttcttttg

SEQ ID NO: 5780976 - DNA, 17 bp, Homo sapiens
gtgactgaatttgggcc

SEQ ID NO: 5780977 - DNA, 21 bp, Homo sapiens
gtgactgaatttgggcctctt

SEQ ID NO: 5780978 - DNA, 23 bp, Homo sapiens
gtgactgagcaagaccctgtctc

SEQ ID NO: 5780979 - DNA, 21 bp, Homo sapiens
gtgactgatgttaggctgggc

SEQ ID NO: 5780980 - DNA, 14 bp, Homo sapiens
gtgactgatttcaa

SEQ ID NO: 5780981 - DNA, 16 bp, Homo sapiens
gtgactgccccaactc

SEQ ID NO: 5780982 - DNA, 23 bp, Homo sapiens
gtgactgccccaactcctggaag

SEQ ID NO: 5780983 - DNA, 21 bp, Homo sapiens
gtgactggaagttgtggatat

SEQ ID NO: 5780984 - DNA, 21 bp, Homo sapiens
gtgactggagcccgagggcct

SEQ ID NO: 5780985 - DNA, 12 bp, Homo sapiens
gtgactggcaag

SEQ ID NO: 5780986 - DNA, 18 bp, Homo sapiens
gtgactggcaagaggcct

SEQ ID NO: 5780987 - DNA, 12 bp, Homo sapiens
gtgactggcacc

SEQ ID NO: 5780988 - DNA, 24 bp, Homo sapiens
gtgactggcaggtgcagatgggct

SEQ ID NO: 5780989 - DNA, 18 bp, Homo sapiens
gtgactgggccctgtcca

SEQ ID NO: 5780990 - DNA, 15 bp, Homo sapiens
gtgactgtatctgtg

SEQ ID NO: 5780991 - DNA, 21 bp, Homo sapiens
gtgactgtcaagtacaagcaa

SEQ ID NO: 5780992 - DNA, 16 bp, Homo sapiens
gtgactgtcacttgct

SEQ ID NO: 5780993 - DNA, 13 bp, Homo sapiens
gtgactgtcccac

SEQ ID NO: 5780994 - DNA, 19 bp, Homo sapiens
gtgactgtcgtgtttacaa

SEQ ID NO: 5780995 - DNA, 15 bp, Homo sapiens
gtgactgtctgggga

SEQ ID NO: 5780996 - DNA, 14 bp, Homo sapiens
gtgactgtgctgtg

SEQ ID NO: 5780997 - DNA, 22 bp, Homo sapiens
gtgactgtgtaactttctctta

SEQ ID NO: 5780998 - DNA, 23 bp, Homo sapiens
gtgactgttgtagcattttcctg

SEQ ID NO: 5780999 - DNA, 14 bp, Homo sapiens
gtgactgtttggct

SEQ ID NO: 5781000 - DNA, 16 bp, Homo sapiens
gtgactgtttggctta

SEQ ID NO: 5781001 - DNA, 18 bp, Homo sapiens
gtgacttacaatttgcac

SEQ ID NO: 5781002 - DNA, 23 bp, Homo sapiens
gtgacttattccctgagactttt

SEQ ID NO: 5781003 - DNA, 15 bp, Homo sapiens
gtgacttctccaggt

SEQ ID NO: 5781004 - DNA, 18 bp, Homo sapiens
gtgacttctcccctgccc

SEQ ID NO: 5781005 - DNA, 11 bp, Homo sapiens
gtgacttctga

SEQ ID NO: 5781006 - DNA, 17 bp, Homo sapiens
gtgacttctgaatcctt

SEQ ID NO: 5781007 - DNA, 17 bp, Homo sapiens
gtgacttgaatgtacaa

SEQ ID NO: 5781008 - DNA, 16 bp, Homo sapiens
gtgagcggagatcgca

SEQ ID NO: 5781009 - DNA, 20 bp, Homo sapiens
gtgagcgtggccttgggagg

SEQ ID NO: 5781010 - DNA, 24 bp, Homo sapiens
gtgagctaagcattttctcctgtg

SEQ ID NO: 5781011 - DNA, 12 bp, Homo sapiens
gtgagctcagct

SEQ ID NO: 5781012 - DNA, 22 bp, Homo sapiens
gtgagctcccaggtgcagccag

SEQ ID NO: 5781013 - DNA, 14 bp, Homo sapiens
gtgagctctctcag

SEQ ID NO: 5781014 - DNA, 19 bp, Homo sapiens
gtgagctctgacccttggg

SEQ ID NO: 5781015 - DNA, 23 bp, Homo sapiens
gtgagctctggttatttttctct

SEQ ID NO: 5781016 - DNA, 14 bp, Homo sapiens
gtgagctgagcagg

SEQ ID NO: 5781017 - DNA, 13 bp, Homo sapiens
gtgagctgatgtg

SEQ ID NO: 5781018 - DNA, 13 bp, Homo sapiens
gtgagctgcccgg

SEQ ID NO: 5781019 - DNA, 17 bp, Homo sapiens
gtgagctggaggaacat

SEQ ID NO: 5781020 - DNA, 19 bp, Homo sapiens
gtgagctggatagacttgg

SEQ ID NO: 5781021 - DNA, 12 bp, Homo sapiens
gtgagctgggca

SEQ ID NO: 5781022 - DNA, 12 bp, Homo sapiens
gtgagctgggga

SEQ ID NO: 5781023 - DNA, 14 bp, Homo sapiens
gtgagctggggact

SEQ ID NO: 5781024 - DNA, 13 bp, Homo sapiens
gtgagctggtgcc

SEQ ID NO: 5781025 - DNA, 14 bp, Homo sapiens
gtgagctgtgatca

SEQ ID NO: 5781026 - DNA, 15 bp, Homo sapiens
gtgagctttgctgct

SEQ ID NO: 5781027 - DNA, 23 bp, Homo sapiens
gtgagctttttgttccctcattc

SEQ ID NO: 5781028 - DNA, 15 bp, Homo sapiens
gtgaggaaagtcatt

SEQ ID NO: 5781029 - DNA, 18 bp, Homo sapiens
gtgaggaaccctgatctc

SEQ ID NO: 5781030 - DNA, 11 bp, Homo sapiens
gtgaggaagcc

SEQ ID NO: 5781031 - DNA, 16 bp, Homo sapiens
gtgaggaagccgctgg

SEQ ID NO: 5781032 - DNA, 19 bp, Homo sapiens
gtgaggaagccgctggggc

SEQ ID NO: 5781033 - DNA, 14 bp, Homo sapiens
gtgaggaagcctaa

SEQ ID NO: 5781034 - DNA, 16 bp, Homo sapiens
gtgaggaagctccagt

SEQ ID NO: 5781035 - DNA, 21 bp, Homo sapiens
gtgaggaagtgtggaaaaata

SEQ ID NO: 5781036 - DNA, 20 bp, Homo sapiens
gtgaggaatagttgagcccc

SEQ ID NO: 5781037 - DNA, 17 bp, Homo sapiens
gtgaggaatgctctgtg

SEQ ID NO: 5781038 - DNA, 16 bp, Homo sapiens
gtgaggaatttgaagc

SEQ ID NO: 5781039 - DNA, 13 bp, Homo sapiens
gtgaggacagggc

SEQ ID NO: 5781040 - DNA, 19 bp, Homo sapiens
gtgaggacctgcggccttg

SEQ ID NO: 5781041 - DNA, 16 bp, Homo sapiens
gtgaggacgcaccgcc

SEQ ID NO: 5781042 - DNA, 17 bp, Homo sapiens
gtgaggactcggccact

SEQ ID NO: 5781043 - DNA, 22 bp, Homo sapiens
gtgaggactctttccgactgcc

SEQ ID NO: 5781044 - DNA, 23 bp, Homo sapiens
gtgaggactctttccgactgccc

SEQ ID NO: 5781045 - DNA, 22 bp, Homo sapiens
gtgaggagaatgaaatgtatgt

SEQ ID NO: 5781046 - DNA, 15 bp, Homo sapiens
gtgaggaggaggcag

SEQ ID NO: 5781047 - DNA, 16 bp, Homo sapiens
gtgaggatgagaccca

SEQ ID NO: 5781048 - DNA, 15 bp, Homo sapiens
gtgaggatgtctggg

SEQ ID NO: 5781049 - DNA, 23 bp, Homo sapiens
gtgaggattaaataatgtaaata

SEQ ID NO: 5781050 - DNA, 14 bp, Homo sapiens
gtgaggattccaaa

SEQ ID NO: 5781051 - DNA, 22 bp, Homo sapiens
gtgaggcaagatccccgccacc

SEQ ID NO: 5781052 - DNA, 23 bp, Homo sapiens
gtgaggcaataagaattactttg

SEQ ID NO: 5781053 - DNA, 12 bp, Homo sapiens
gtgaggcagccg

SEQ ID NO: 5781054 - DNA, 16 bp, Homo sapiens
gtgaggcaggtgacag

SEQ ID NO: 5781055 - DNA, 23 bp, Homo sapiens
gtgaggcagtgggtcccacttcc

SEQ ID NO: 5781056 - DNA, 18 bp, Homo sapiens
gtgaggcatctctctggg

SEQ ID NO: 5781057 - DNA, 22 bp, Homo sapiens
gtgaggcatggcaattctggaa

SEQ ID NO: 5781058 - DNA, 11 bp, Homo sapiens
gtgaggccaag

SEQ ID NO: 5781059 - DNA, 18 bp, Homo sapiens
gtgaggccacacccagag

SEQ ID NO: 5781060 - DNA, 22 bp, Homo sapiens
gtgaggccacacccagagtagc

SEQ ID NO: 5781061 - DNA, 16 bp, Homo sapiens
gtgaggccactgaaga

SEQ ID NO: 5781062 - DNA, 20 bp, Homo sapiens
gtgaggccactgaagaggag

SEQ ID NO: 5781063 - DNA, 23 bp, Homo sapiens
gtgaggccactgaagaggaggag

SEQ ID NO: 5781064 - DNA, 15 bp, Homo sapiens
gtgaggccagggcag

SEQ ID NO: 5781065 - DNA, 16 bp, Homo sapiens
gtgaggcccaaggagc

SEQ ID NO: 5781066 - DNA, 17 bp, Homo sapiens
gtgaggcccaaggagct

SEQ ID NO: 5781067 - DNA, 15 bp, Homo sapiens
gtgaggcccagcctg

SEQ ID NO: 5781068 - DNA, 20 bp, Homo sapiens
gtgaggcccccggaggcgcc

SEQ ID NO: 5781069 - DNA, 13 bp, Homo sapiens
gtgaggcccctgg

SEQ ID NO: 5781070 - DNA, 16 bp, Homo sapiens
gtgaggcccctgtgca

SEQ ID NO: 5781071 - DNA, 19 bp, Homo sapiens
gtgaggccggccctgcccc

SEQ ID NO: 5781072 - DNA, 23 bp, Homo sapiens
gtgaggccggccctgcccctccc

SEQ ID NO: 5781073 - DNA, 14 bp, Homo sapiens
gtgaggcctggcca

SEQ ID NO: 5781074 - DNA, 11 bp, Homo sapiens
gtgaggcctgt

SEQ ID NO: 5781075 - DNA, 19 bp, Homo sapiens
gtgaggcgtgggatccaga

SEQ ID NO: 5781076 - DNA, 21 bp, Homo sapiens
gtgaggcgtgggatccagaga

SEQ ID NO: 5781077 - DNA, 16 bp, Homo sapiens
gtgaggcgttctcctg

SEQ ID NO: 5781078 - DNA, 17 bp, Homo sapiens
gtgaggctctgcccttg

SEQ ID NO: 5781079 - DNA, 13 bp, Homo sapiens
gtgaggctgctgc

SEQ ID NO: 5781080 - DNA, 12 bp, Homo sapiens
gtgaggctggga

SEQ ID NO: 5781081 - DNA, 12 bp, Homo sapiens
gtgaggctgggc

SEQ ID NO: 5781082 - DNA, 12 bp, Homo sapiens
gtgaggctgtgt

SEQ ID NO: 5781083 - DNA, 15 bp, Homo sapiens
gtgaggctgtgtctc

SEQ ID NO: 5781084 - DNA, 17 bp, Homo sapiens
gtgaggcttgcccagga

SEQ ID NO: 5781085 - DNA, 19 bp, Homo sapiens
gtgaggcttgcccaggagc

SEQ ID NO: 5781086 - DNA, 14 bp, Homo sapiens
gtgagggaaggaga

SEQ ID NO: 5781087 - DNA, 22 bp, Homo sapiens
gtgagggacatgctcacctcta

SEQ ID NO: 5781088 - DNA, 14 bp, Homo sapiens
gtgagggagagaac

SEQ ID NO: 5781089 - DNA, 15 bp, Homo sapiens
gtgagggaggcctga

SEQ ID NO: 5781090 - DNA, 19 bp, Homo sapiens
gtgagggagttagggagag

SEQ ID NO: 5781091 - DNA, 23 bp, Homo sapiens
gtgagggatgccataccttgaga

SEQ ID NO: 5781092 - DNA, 19 bp, Homo sapiens
gtgagggcaaaccaggctg

SEQ ID NO: 5781093 - DNA, 20 bp, Homo sapiens
gtgagggcaaaccaggctgc

SEQ ID NO: 5781094 - DNA, 23 bp, Homo sapiens
gtgagggcaaaccaggctgcagg

SEQ ID NO: 5781095 - DNA, 13 bp, Homo sapiens
gtgagggcaagag

SEQ ID NO: 5781096 - DNA, 22 bp, Homo sapiens
gtgagggcaagaggtgcctggg

SEQ ID NO: 5781097 - DNA, 15 bp, Homo sapiens
gtgagggcaccacca

SEQ ID NO: 5781098 - DNA, 15 bp, Homo sapiens
gtgagggcagcactg

SEQ ID NO: 5781099 - DNA, 14 bp, Homo sapiens
gtgagggcctcaga

SEQ ID NO: 5781100 - DNA, 17 bp, Homo sapiens
gtgagggcctcagagcc

SEQ ID NO: 5781101 - DNA, 18 bp, Homo sapiens
gtgagggcctcagagcct

SEQ ID NO: 5781102 - DNA, 13 bp, Homo sapiens
gtgagggccttct

SEQ ID NO: 5781103 - DNA, 17 bp, Homo sapiens
gtgagggccttcttaag

SEQ ID NO: 5781104 - DNA, 16 bp, Homo sapiens
gtgaggggagatgctg

SEQ ID NO: 5781105 - DNA, 15 bp, Homo sapiens
gtgaggggaggggcc

SEQ ID NO: 5781106 - DNA, 15 bp, Homo sapiens
gtgaggggcaggacc

SEQ ID NO: 5781107 - DNA, 22 bp, Homo sapiens
gtgaggggctttctcttcccct

SEQ ID NO: 5781108 - DNA, 22 bp, Homo sapiens
gtgaggggggggtgggtgagag

SEQ ID NO: 5781109 - DNA, 13 bp, Homo sapiens
gtgaggggtccct

SEQ ID NO: 5781110 - DNA, 15 bp, Homo sapiens
gtgagggtcctgcag

SEQ ID NO: 5781111 - DNA, 19 bp, Homo sapiens
gtgagggtgacagagggac

SEQ ID NO: 5781112 - DNA, 21 bp, Homo sapiens
gtgagggtgcggggcctgcag

SEQ ID NO: 5781113 - DNA, 14 bp, Homo sapiens
gtgagggtggtggg

SEQ ID NO: 5781114 - DNA, 19 bp, Homo sapiens
gtgagggtttctgagctgc

SEQ ID NO: 5781115 - DNA, 21 bp, Homo sapiens
gtgaggtcacaataaagtgta

SEQ ID NO: 5781116 - DNA, 22 bp, Homo sapiens
gtgaggtcacatgttggtgctg

SEQ ID NO: 5781117 - DNA, 17 bp, Homo sapiens
gtgaggtcctgggggcc

SEQ ID NO: 5781118 - DNA, 19 bp, Homo sapiens
gtgaggtcctgtcctggct

SEQ ID NO: 5781119 - DNA, 17 bp, Homo sapiens
gtgaggtgacttgcctg

SEQ ID NO: 5781120 - DNA, 14 bp, Homo sapiens
gtgaggtgctgatg

SEQ ID NO: 5781121 - DNA, 13 bp, Homo sapiens
gtgaggtggccca

SEQ ID NO: 5781122 - DNA, 20 bp, Homo sapiens
gtgaggtgggttttcttccc

SEQ ID NO: 5781123 - DNA, 18 bp, Homo sapiens
gtgaggtgtgcctggcct

SEQ ID NO: 5781124 - DNA, 15 bp, Homo sapiens
gtgaggtgttgcagc

SEQ ID NO: 5781125 - DNA, 16 bp, Homo sapiens
gtgaggttgtgctgcc

SEQ ID NO: 5781126 - DNA, 16 bp, Homo sapiens
gtgaggtttcacctcc

SEQ ID NO: 5781127 - DNA, 20 bp, Homo sapiens
gtgaggtttcagtagctcct

SEQ ID NO: 5781128 - DNA, 14 bp, Homo sapiens
gtgaggtttcccaa

SEQ ID NO: 5781129 - DNA, 15 bp, Homo sapiens
gtgaggtttcccaat

SEQ ID NO: 5781130 - DNA, 22 bp, Homo sapiens
gtgaggtttcccaatggtgttt

SEQ ID NO: 5781131 - DNA, 15 bp, Homo sapiens
gtgagtaagagctgg

SEQ ID NO: 5781132 - DNA, 20 bp, Homo sapiens
gtgagtacctgcaaaaatga

SEQ ID NO: 5781133 - DNA, 22 bp, Homo sapiens
gtgagtattctatgtaaaaata

SEQ ID NO: 5781134 - DNA, 17 bp, Homo sapiens
gtgagtcacctgctcca

SEQ ID NO: 5781135 - DNA, 21 bp, Homo sapiens
gtgagtcacctgctccagaag

SEQ ID NO: 5781136 - DNA, 12 bp, Homo sapiens
gtgagtcagcac

SEQ ID NO: 5781137 - DNA, 17 bp, Homo sapiens
gtgagtcatttaaatgt

SEQ ID NO: 5781138 - DNA, 15 bp, Homo sapiens
gtgagtccattctcc

SEQ ID NO: 5781139 - DNA, 17 bp, Homo sapiens
gtgagtcctccagaact

SEQ ID NO: 5781140 - DNA, 18 bp, Homo sapiens
gtgagtcctccagaactc

SEQ ID NO: 5781141 - DNA, 20 bp, Homo sapiens
gtgagtcctggcatgggaat

SEQ ID NO: 5781142 - DNA, 15 bp, Homo sapiens
gtgagtcgaggacag

SEQ ID NO: 5781143 - DNA, 17 bp, Homo sapiens
gtgagtctgtcataata

SEQ ID NO: 5781144 - DNA, 16 bp, Homo sapiens
gtgagtcttggcggca

SEQ ID NO: 5781145 - DNA, 17 bp, Homo sapiens
gtgagtcttggcggcag

SEQ ID NO: 5781146 - DNA, 18 bp, Homo sapiens
gtgagtgaaactcccacc

SEQ ID NO: 5781147 - DNA, 19 bp, Homo sapiens
gtgagtgacaaagcctctg

SEQ ID NO: 5781148 - DNA, 20 bp, Homo sapiens
gtgagtgacatagcctcatg

SEQ ID NO: 5781149 - DNA, 22 bp, Homo sapiens
gtgagtgactcggtgtaaaacc

SEQ ID NO: 5781150 - DNA, 14 bp, Homo sapiens
gtgagtgagcctgg

SEQ ID NO: 5781151 - DNA, 15 bp, Homo sapiens
gtgagtgagcctggc

SEQ ID NO: 5781152 - DNA, 17 bp, Homo sapiens
gtgagtgagggagacag

SEQ ID NO: 5781153 - DNA, 20 bp, Homo sapiens
gtgagtgcaagagcctgaga

SEQ ID NO: 5781154 - DNA, 15 bp, Homo sapiens
gtgagtggcctgcta

SEQ ID NO: 5781155 - DNA, 14 bp, Homo sapiens
gtgagtgtatgtat

SEQ ID NO: 5781156 - DNA, 17 bp, Homo sapiens
gtgagtgtatgtataca

SEQ ID NO: 5781157 - DNA, 17 bp, Homo sapiens
gtgagtgtatgtgtgtg

SEQ ID NO: 5781158 - DNA, 23 bp, Homo sapiens
gtgagtgtccgttgacgtgacca

SEQ ID NO: 5781159 - DNA, 14 bp, Homo sapiens
gtgagtgtgacagg

SEQ ID NO: 5781160 - DNA, 15 bp, Homo sapiens
gtgagtgtgacaggg

SEQ ID NO: 5781161 - DNA, 16 bp, Homo sapiens
gtgagtgtgacagggc

SEQ ID NO: 5781162 - DNA, 17 bp, Homo sapiens
gtgagtgtgacagggcc

SEQ ID NO: 5781163 - DNA, 19 bp, Homo sapiens
gtgagtgtgacagggccag

SEQ ID NO: 5781164 - DNA, 20 bp, Homo sapiens
gtgagtgtgacagggccagt

SEQ ID NO: 5781165 - DNA, 15 bp, Homo sapiens
gtgagtgtgactttt

SEQ ID NO: 5781166 - DNA, 17 bp, Homo sapiens
gtgagtgtgagtgtgag

SEQ ID NO: 5781167 - DNA, 13 bp, Homo sapiens
gtgagtgtgtgca

SEQ ID NO: 5781168 - DNA, 13 bp, Homo sapiens
gtgagtgtgtgtg

SEQ ID NO: 5781169 - DNA, 15 bp, Homo sapiens
gtgagtgtttctatg

SEQ ID NO: 5781170 - DNA, 17 bp, Homo sapiens
gtgagtgtttttatctt

SEQ ID NO: 5781171 - DNA, 17 bp, Homo sapiens
gtgagttacagcgagag

SEQ ID NO: 5781172 - DNA, 15 bp, Homo sapiens
gtgagttctcagggc

SEQ ID NO: 5781173 - DNA, 17 bp, Homo sapiens
gtgagttgggattggac

SEQ ID NO: 5781174 - DNA, 17 bp, Homo sapiens
gtgagtttcagaaattc

SEQ ID NO: 5781175 - DNA, 15 bp, Homo sapiens
gtgagtttgagctgc

SEQ ID NO: 5781176 - DNA, 17 bp, Homo sapiens
gtgagtttgagctgcct

SEQ ID NO: 5781177 - DNA, 21 bp, Homo sapiens
gtgagtttgctggttgtaaat

SEQ ID NO: 5781178 - DNA, 19 bp, Homo sapiens
gtgagtttggtctggactg

SEQ ID NO: 5781179 - DNA, 12 bp, Homo sapiens
gtgagtttgttt

SEQ ID NO: 5781180 - DNA, 22 bp, Homo sapiens
gtgagtttgtttctttgaattt

SEQ ID NO: 5781181 - DNA, 21 bp, Homo sapiens
gtgagttttactcttaaatca

SEQ ID NO: 5781182 - DNA, 13 bp, Homo sapiens
gtgataaaatcat

SEQ ID NO: 5781183 - DNA, 21 bp, Homo sapiens
gtgataaaatcataagtattt

SEQ ID NO: 5781184 - DNA, 16 bp, Homo sapiens
gtgataaaatgttgaa

SEQ ID NO: 5781185 - DNA, 17 bp, Homo sapiens
gtgataaaatgttgaac

SEQ ID NO: 5781186 - DNA, 14 bp, Homo sapiens
gtgataaactttgc

SEQ ID NO: 5781187 - DNA, 14 bp, Homo sapiens
gtgatgtttgctct

SEQ ID NO: 5781188 - DNA, 18 bp, Homo sapiens
gtgatgtttggattgata

SEQ ID NO: 5781189 - DNA, 22 bp, Homo sapiens
gtgatgtttggattgatatcgt

SEQ ID NO: 5781190 - DNA, 13 bp, Homo sapiens
gtgattaaaattt

SEQ ID NO: 5781191 - DNA, 19 bp, Homo sapiens
gtgattaaacgtgcagact

SEQ ID NO: 5781192 - DNA, 22 bp, Homo sapiens
gtgattaaatatttaatgatgt

SEQ ID NO: 5781193 - DNA, 14 bp, Homo sapiens
gtgattaacttgct

SEQ ID NO: 5781194 - DNA, 21 bp, Homo sapiens
gtgattaatgttttcattatg

SEQ ID NO: 5781195 - DNA, 16 bp, Homo sapiens
gtgattaccagggact

SEQ ID NO: 5781196 - DNA, 17 bp, Homo sapiens
gtgattaccagggactg

SEQ ID NO: 5781197 - DNA, 17 bp, Homo sapiens
gtgattaccccgggaga

SEQ ID NO: 5781198 - DNA, 16 bp, Homo sapiens
gtgattactgcaatca

SEQ ID NO: 5781199 - DNA, 22 bp, Homo sapiens
gtgattagagggaggagaatga

SEQ ID NO: 5781200 - DNA, 13 bp, Homo sapiens
gtgattagtgaaa

SEQ ID NO: 5781201 - DNA, 14 bp, Homo sapiens
gtgattatatttca

SEQ ID NO: 5781202 - DNA, 21 bp, Homo sapiens
gtgattatatttttgggggct

SEQ ID NO: 5781203 - DNA, 18 bp, Homo sapiens
gtgattatctctttgatc

SEQ ID NO: 5781204 - DNA, 19 bp, Homo sapiens
gtgattatctctttgatct

SEQ ID NO: 5781205 - DNA, 21 bp, Homo sapiens
gtgattatgaaatgccagact

SEQ ID NO: 5781206 - DNA, 15 bp, Homo sapiens
gtgattatgccattg

SEQ ID NO: 5781207 - DNA, 17 bp, Homo sapiens
gtgattatgccattgca

SEQ ID NO: 5781208 - DNA, 14 bp, Homo sapiens
gtgattatttttta

SEQ ID NO: 5781209 - DNA, 12 bp, Homo sapiens
gtgattcaaatg

SEQ ID NO: 5781210 - DNA, 23 bp, Homo sapiens
gtgattcaatctgtaaactgtgt

SEQ ID NO: 5781211 - DNA, 20 bp, Homo sapiens
gtgattcacagtgtgaatct

SEQ ID NO: 5781212 - DNA, 20 bp, Homo sapiens
gtgattcactgccttcctct

SEQ ID NO: 5781213 - DNA, 13 bp, Homo sapiens
gtgattcactgtg

SEQ ID NO: 5781214 - DNA, 15 bp, Homo sapiens
gtgattcagcaggcc

SEQ ID NO: 5781215 - DNA, 23 bp, Homo sapiens
gtgattccactacacctggctga

SEQ ID NO: 5781216 - DNA, 13 bp, Homo sapiens
gtgattccatgga

SEQ ID NO: 5781217 - DNA, 12 bp, Homo sapiens
gtgattcctccc

SEQ ID NO: 5781218 - DNA, 23 bp, Homo sapiens
gtgattcctcccaggaggtgctt

SEQ ID NO: 5781219 - DNA, 16 bp, Homo sapiens
gtgattctaatgtctt

SEQ ID NO: 5781220 - DNA, 20 bp, Homo sapiens
gtgattctcatgcctcagcc

SEQ ID NO: 5781221 - DNA, 18 bp, Homo sapiens
gtgattctcctgcctcag

SEQ ID NO: 5781222 - DNA, 23 bp, Homo sapiens
gtgattctcctgcctcagcctcc

SEQ ID NO: 5781223 - DNA, 17 bp, Homo sapiens
gtgattcttagcaaaaa

SEQ ID NO: 5781224 - DNA, 14 bp, Homo sapiens
gtgattgaaagaaa

SEQ ID NO: 5781225 - DNA, 12 bp, Homo sapiens
gtgattgaaagt

SEQ ID NO: 5781226 - DNA, 15 bp, Homo sapiens
gtgattgacaactga

SEQ ID NO: 5781227 - DNA, 23 bp, Homo sapiens
gtgattgacagctttgctgctga

SEQ ID NO: 5781228 - DNA, 15 bp, Homo sapiens
gtgattgactttttg

SEQ ID NO: 5781229 - DNA, 13 bp, Homo sapiens
gtgattgcacaga

SEQ ID NO: 5781230 - DNA, 19 bp, Homo sapiens
gtgattgcagctttatgtt

SEQ ID NO: 5781231 - DNA, 18 bp, Homo sapiens
gtgattgccatttcttcc

SEQ ID NO: 5781232 - DNA, 17 bp, Homo sapiens
gtgattggcaggaggca

SEQ ID NO: 5781233 - DNA, 24 bp, Homo sapiens
gtgattggcctgtagagttgctga

SEQ ID NO: 5781234 - DNA, 13 bp, Homo sapiens
gtgattggctgca

SEQ ID NO: 5781235 - DNA, 11 bp, Homo sapiens
gtgattgtgaa

SEQ ID NO: 5781236 - DNA, 19 bp, Homo sapiens
gtgattgtggaatggagat

SEQ ID NO: 5781237 - DNA, 17 bp, Homo sapiens
gtgatttaagggcccag

SEQ ID NO: 5781238 - DNA, 15 bp, Homo sapiens
gtgatttaatagtgt

SEQ ID NO: 5781239 - DNA, 16 bp, Homo sapiens
gtgatttaatagtgtt

SEQ ID NO: 5781240 - DNA, 23 bp, Homo sapiens
gtgatttagaactgtatgtcaga

SEQ ID NO: 5781241 - DNA, 21 bp, Homo sapiens
gtgatttcccgtggccccagc

SEQ ID NO: 5781242 - DNA, 22 bp, Homo sapiens
gtgatttcccgtggccccagcc

SEQ ID NO: 5781243 - DNA, 15 bp, Homo sapiens
gtgatttcctaaaca

SEQ ID NO: 5781244 - DNA, 14 bp, Homo sapiens
gtgatttcctctaa

SEQ ID NO: 5781245 - DNA, 22 bp, Homo sapiens
gtgatttctcaccctctgtcct

SEQ ID NO: 5781246 - DNA, 11 bp, Homo sapiens
gtgatttctga

SEQ ID NO: 5781247 - DNA, 19 bp, Homo sapiens
gtgatttctgagattttag

SEQ ID NO: 5781248 - DNA, 16 bp, Homo sapiens
gtgatttctgtgccat

SEQ ID NO: 5781249 - DNA, 16 bp, Homo sapiens
gtgatttcttctccct

SEQ ID NO: 5781250 - DNA, 21 bp, Homo sapiens
gtgatttctttaaaagaatga

SEQ ID NO: 5781251 - DNA, 19 bp, Homo sapiens
gtgatttgactgtttttac

SEQ ID NO: 5781252 - DNA, 21 bp, Homo sapiens
gtgatttgactgtttttaccc

SEQ ID NO: 5781253 - DNA, 12 bp, Homo sapiens
gtgatttgctat

SEQ ID NO: 5781254 - DNA, 20 bp, Homo sapiens
gtgatttggaagagaggcac

SEQ ID NO: 5781255 - DNA, 17 bp, Homo sapiens
gtgatttgtctctgagc

SEQ ID NO: 5781256 - DNA, 18 bp, Homo sapiens
gtgattttaactctgtct

SEQ ID NO: 5781257 - DNA, 19 bp, Homo sapiens
gtgattttaagacaagctg

SEQ ID NO: 5781258 - DNA, 22 bp, Homo sapiens
gtgattttcaaacctcaaatat

SEQ ID NO: 5781259 - DNA, 20 bp, Homo sapiens
gtgattttcaaatatgtaaa

SEQ ID NO: 5781260 - DNA, 12 bp, Homo sapiens
gtgattttcatt

SEQ ID NO: 5781261 - DNA, 12 bp, Homo sapiens
gtgattttcctt

SEQ ID NO: 5781262 - DNA, 20 bp, Homo sapiens
gtgattttcctttgtagcta

SEQ ID NO: 5781263 - DNA, 15 bp, Homo sapiens
gtgattttgccctcc

SEQ ID NO: 5781264 - DNA, 20 bp, Homo sapiens
gtgattttgtacagaatttt

SEQ ID NO: 5781265 - DNA, 18 bp, Homo sapiens
gtgatttttgtaattttt

SEQ ID NO: 5781266 - DNA, 14 bp, Homo sapiens
gtgatttttttgtc

SEQ ID NO: 5781267 - DNA, 13 bp, Homo sapiens
gtgcaaaaaaaaa

SEQ ID NO: 5781268 - DNA, 23 bp, Homo sapiens
gtgcaaaaactgtaaaagtgtac

SEQ ID NO: 5781269 - DNA, 21 bp, Homo sapiens
gtgcaaaaagctgagtatggt

SEQ ID NO: 5781270 - DNA, 14 bp, Homo sapiens
gtgcaaaaaggact

SEQ ID NO: 5781271 - DNA, 16 bp, Homo sapiens
gtgcaaaaaggactgg

SEQ ID NO: 5781272 - DNA, 21 bp, Homo sapiens
gtgcaaaaataaaaggaaaac

SEQ ID NO: 5781273 - DNA, 18 bp, Homo sapiens
gtgcaaaaatttttggat

SEQ ID NO: 5781274 - DNA, 19 bp, Homo sapiens
gtgcaaaaatttttggatt

SEQ ID NO: 5781275 - DNA, 19 bp, Homo sapiens
gtgcaaaacatgctacctg

SEQ ID NO: 5781276 - DNA, 17 bp, Homo sapiens
gtgcaaaactgtgtcac

SEQ ID NO: 5781277 - DNA, 17 bp, Homo sapiens
gtgcaaaataaaatgag

SEQ ID NO: 5781278 - DNA, 21 bp, Homo sapiens
gtgcaaaatgtcttgtgtatt

SEQ ID NO: 5781279 - DNA, 22 bp, Homo sapiens
gtgcaaaatgtgtttcagccgt

SEQ ID NO: 5781280 - DNA, 17 bp, Homo sapiens
gtgcaaacaacctgaat

SEQ ID NO: 5781281 - DNA, 19 bp, Homo sapiens
gtgcaaacagaagtgcatc

SEQ ID NO: 5781282 - DNA, 14 bp, Homo sapiens
gtgcaaagaaaaga

SEQ ID NO: 5781283 - DNA, 21 bp, Homo sapiens
gtgcaaagactctgagccaag

SEQ ID NO: 5781284 - DNA, 18 bp, Homo sapiens
gtgcaaagattgcctctt

SEQ ID NO: 5781285 - DNA, 13 bp, Homo sapiens
gtgcaaagctgct

SEQ ID NO: 5781286 - DNA, 18 bp, Homo sapiens
gtgcaaagctgcttgaat

SEQ ID NO: 5781287 - DNA, 15 bp, Homo sapiens
gtgcaaagtgccctc

SEQ ID NO: 5781288 - DNA, 18 bp, Homo sapiens
gtgcaaattcagaactga

SEQ ID NO: 5781289 - DNA, 20 bp, Homo sapiens
gtgcaaattttgcatttagt

SEQ ID NO: 5781290 - DNA, 20 bp, Homo sapiens
gtgcaacaagagcaaaatga

SEQ ID NO: 5781291 - DNA, 13 bp, Homo sapiens
gtgcaacagactg

SEQ ID NO: 5781292 - DNA, 23 bp, Homo sapiens
gtgcaacagcactggctctctcc

SEQ ID NO: 5781293 - DNA, 24 bp, Homo sapiens
gtgcaacagggtatggactatctg

SEQ ID NO: 5781294 - DNA, 22 bp, Homo sapiens
gtgcaacccaaggactgaggga

SEQ ID NO: 5781295 - DNA, 23 bp, Homo sapiens
gtgcaacctcttggcctgatcag

SEQ ID NO: 5781296 - DNA, 16 bp, Homo sapiens
gtgcaacctgtggctc

SEQ ID NO: 5781297 - DNA, 20 bp, Homo sapiens
gtgcaacctgtggctcaggg

SEQ ID NO: 5781298 - DNA, 18 bp, Homo sapiens
gtgcaacggcatgatttt

SEQ ID NO: 5781299 - DNA, 13 bp, Homo sapiens
gtgcaacttttta

SEQ ID NO: 5781300 - DNA, 16 bp, Homo sapiens
gtgcaactttttaaag

SEQ ID NO: 5781301 - DNA, 17 bp, Homo sapiens
gtgcaactttttaaagt

SEQ ID NO: 5781302 - DNA, 16 bp, Homo sapiens
gtgcaagacacccagt

SEQ ID NO: 5781303 - DNA, 13 bp, Homo sapiens
gtgcaagagacag

SEQ ID NO: 5781304 - DNA, 19 bp, Homo sapiens
gtgcaagagacagagcccc

SEQ ID NO: 5781305 - DNA, 20 bp, Homo sapiens
gtgcaagagactctggcctc

SEQ ID NO: 5781306 - DNA, 20 bp, Homo sapiens
gtgcaagagactttgtcact

SEQ ID NO: 5781307 - DNA, 14 bp, Homo sapiens
gtgcaagagcctga

SEQ ID NO: 5781308 - DNA, 19 bp, Homo sapiens
gtgcaagagcctgagactg

SEQ ID NO: 5781309 - DNA, 21 bp, Homo sapiens
gtgcaagagcctgagactgga

SEQ ID NO: 5781310 - DNA, 22 bp, Homo sapiens
gtgcaaggactcccggagcctg

SEQ ID NO: 5781311 - DNA, 15 bp, Homo sapiens
gtgcaaggcagccgt

SEQ ID NO: 5781312 - DNA, 15 bp, Homo sapiens
gtgcaaggggctcag

SEQ ID NO: 5781313 - DNA, 21 bp, Homo sapiens
gtgcaaggggctcagcaaggt

SEQ ID NO: 5781314 - DNA, 20 bp, Homo sapiens
gtgcaaggtgataggaaaac

SEQ ID NO: 5781315 - DNA, 22 bp, Homo sapiens
gtgcaaggtggcctttgtgctg

SEQ ID NO: 5781316 - DNA, 17 bp, Homo sapiens
gtgcaagtagcacatgg

SEQ ID NO: 5781317 - DNA, 20 bp, Homo sapiens
gtgcaagtatgtgagtgtgt

SEQ ID NO: 5781318 - DNA, 17 bp, Homo sapiens
gtgcaagtgtctgtgtg

SEQ ID NO: 5781319 - DNA, 20 bp, Homo sapiens
gtgcaagtgtgtgcatgtgt

SEQ ID NO: 5781320 - DNA, 21 bp, Homo sapiens
gtgcaataaaactcccttcct

SEQ ID NO: 5781321 - DNA, 21 bp, Homo sapiens
gtgcaataatttgtacaatgg

SEQ ID NO: 5781322 - DNA, 21 bp, Homo sapiens
gtgcaatacttagagaaccta

SEQ ID NO: 5781323 - DNA, 12 bp, Homo sapiens
gtgcaatatgag

SEQ ID NO: 5781324 - DNA, 21 bp, Homo sapiens
gtgcaatcagagtgtacaaat

SEQ ID NO: 5781325 - DNA, 18 bp, Homo sapiens
gtgcaatgacctttcaat

SEQ ID NO: 5781326 - DNA, 22 bp, Homo sapiens
gtgcaatgacctttcaatagga

SEQ ID NO: 5781327 - DNA, 15 bp, Homo sapiens
gtgcaatgagccaga

SEQ ID NO: 5781328 - DNA, 17 bp, Homo sapiens
gtgcaatgagccagatg

SEQ ID NO: 5781329 - DNA, 21 bp, Homo sapiens
gtgcaatgcgtgttgtacata

SEQ ID NO: 5781330 - DNA, 13 bp, Homo sapiens
gtgcaatggaata

SEQ ID NO: 5781331 - DNA, 20 bp, Homo sapiens
gtgcaatgggtaagggaggg

SEQ ID NO: 5781332 - DNA, 23 bp, Homo sapiens
gtgcaatgggtaagggagggaag

SEQ ID NO: 5781333 - DNA, 17 bp, Homo sapiens
gtgcaatgtgtataaac

SEQ ID NO: 5781334 - DNA, 17 bp, Homo sapiens
gtgcaattaactctgga

SEQ ID NO: 5781335 - DNA, 20 bp, Homo sapiens
gtgcaattccaagaaaatat

SEQ ID NO: 5781336 - DNA, 14 bp, Homo sapiens
gtgcaattgtcttt

SEQ ID NO: 5781337 - DNA, 16 bp, Homo sapiens
gtgcaattgtgaggga

SEQ ID NO: 5781338 - DNA, 18 bp, Homo sapiens
gtgcaatttcaaggttct

SEQ ID NO: 5781339 - DNA, 19 bp, Homo sapiens
gtgcaatttcaaggttcta

SEQ ID NO: 5781340 - DNA, 14 bp, Homo sapiens
gtgcaatttctgta

SEQ ID NO: 5781341 - DNA, 15 bp, Homo sapiens
gtgcaatttgtcttt

SEQ ID NO: 5781342 - DNA, 22 bp, Homo sapiens
gtgcaatttgtctttggaaaat

SEQ ID NO: 5781343 - DNA, 13 bp, Homo sapiens
gtgcacaaaatga

SEQ ID NO: 5781344 - DNA, 21 bp, Homo sapiens
gtgcacaaagtggcataaaaa

SEQ ID NO: 5781345 - DNA, 23 bp, Homo sapiens
gtgcacaaagtggcataaaaaac

SEQ ID NO: 5781346 - DNA, 14 bp, Homo sapiens
gtgcacaaatacaa

SEQ ID NO: 5781347 - DNA, 13 bp, Homo sapiens
gtgcacaagctcc

SEQ ID NO: 5781348 - DNA, 16 bp, Homo sapiens
gtgcacaagctccaag

SEQ ID NO: 5781349 - DNA, 17 bp, Homo sapiens
gtgcacaagtctttcca

SEQ ID NO: 5781350 - DNA, 13 bp, Homo sapiens
gtgcacaagtgtg

SEQ ID NO: 5781351 - DNA, 11 bp, Homo sapiens
gtgcacacaca

SEQ ID NO: 5781352 - DNA, 20 bp, Homo sapiens
gtgcacacacacgcactctc

SEQ ID NO: 5781353 - DNA, 17 bp, Homo sapiens
gtgcacacaccagagcc

SEQ ID NO: 5781354 - DNA, 16 bp, Homo sapiens
gtgcacacacctgcac

SEQ ID NO: 5781355 - DNA, 18 bp, Homo sapiens
gtgcacacacctgcacac

SEQ ID NO: 5781356 - DNA, 19 bp, Homo sapiens
gtgcacacacctgcacacc

SEQ ID NO: 5781357 - DNA, 11 bp, Homo sapiens
gtgcacacaga

SEQ ID NO: 5781358 - DNA, 17 bp, Homo sapiens
gtgcacacatcaccagg

SEQ ID NO: 5781359 - DNA, 13 bp, Homo sapiens
gtgcacacctgta

SEQ ID NO: 5781360 - DNA, 17 bp, Homo sapiens
gtgcacacgtgtgtatg

SEQ ID NO: 5781361 - DNA, 16 bp, Homo sapiens
gtgcacactaagaaat

SEQ ID NO: 5781362 - DNA, 13 bp, Homo sapiens
gtgcacacttgta

SEQ ID NO: 5781363 - DNA, 22 bp, Homo sapiens
gtgcacagagacggtctggaag

SEQ ID NO: 5781364 - DNA, 13 bp, Homo sapiens
gtgcatcctgtga

SEQ ID NO: 5781365 - DNA, 21 bp, Homo sapiens
gtgcatccttgtaatacctga

SEQ ID NO: 5781366 - DNA, 15 bp, Homo sapiens
gtgcatcgaaatgta

SEQ ID NO: 5781367 - DNA, 18 bp, Homo sapiens
gtgcatcgaaatgtattc

SEQ ID NO: 5781368 - DNA, 23 bp, Homo sapiens
gtgcatcgaaatgtattcacctt

SEQ ID NO: 5781369 - DNA, 15 bp, Homo sapiens
gtgcatctcagatgc

SEQ ID NO: 5781370 - DNA, 13 bp, Homo sapiens
gtgcatctcagcc

SEQ ID NO: 5781371 - DNA, 22 bp, Homo sapiens
gtgcatctgcaggcaccgggct

SEQ ID NO: 5781372 - DNA, 14 bp, Homo sapiens
gtgcatctggccta

SEQ ID NO: 5781373 - DNA, 15 bp, Homo sapiens
gtgcatctggcctat

SEQ ID NO: 5781374 - DNA, 16 bp, Homo sapiens
gtgcatctggcctatg

SEQ ID NO: 5781375 - DNA, 15 bp, Homo sapiens
gtgcatgaaagagaa

SEQ ID NO: 5781376 - DNA, 22 bp, Homo sapiens
gtgcatgaaggtttctgaaaat

SEQ ID NO: 5781377 - DNA, 18 bp, Homo sapiens
gtgcatgatggtgagagc

SEQ ID NO: 5781378 - DNA, 16 bp, Homo sapiens
gtgcatgcaaaaatga

SEQ ID NO: 5781379 - DNA, 19 bp, Homo sapiens
gtgcatgcaaaaatgaatt

SEQ ID NO: 5781380 - DNA, 17 bp, Homo sapiens
gtgcatgcactgtctca

SEQ ID NO: 5781381 - DNA, 18 bp, Homo sapiens
gtgcatgcactgtctcag

SEQ ID NO: 5781382 - DNA, 21 bp, Homo sapiens
gtgcatgcatgccctctctga

SEQ ID NO: 5781383 - DNA, 13 bp, Homo sapiens
gtgcatgcatgtt

SEQ ID NO: 5781384 - DNA, 16 bp, Homo sapiens
gtgcatgcatgttggg

SEQ ID NO: 5781385 - DNA, 21 bp, Homo sapiens
gtgcatgcattgagctgcctc

SEQ ID NO: 5781386 - DNA, 15 bp, Homo sapiens
gtgcatgcccctgag

SEQ ID NO: 5781387 - DNA, 22 bp, Homo sapiens
gtgcatgctagtgttgtatttc

SEQ ID NO: 5781388 - DNA, 12 bp, Homo sapiens
gtgcatgctctg

SEQ ID NO: 5781389 - DNA, 24 bp, Homo sapiens
gtgcatggaagtaattaaggtaca

SEQ ID NO: 5781390 - DNA, 23 bp, Homo sapiens
gtgcatggcactgactgaatgct

SEQ ID NO: 5781391 - DNA, 19 bp, Homo sapiens
gtgcatggccacagccacc

SEQ ID NO: 5781392 - DNA, 19 bp, Homo sapiens
gtgcatggtatgtgggtga

SEQ ID NO: 5781393 - DNA, 21 bp, Homo sapiens
gtgcatgtatgtgcacatgtg

SEQ ID NO: 5781394 - DNA, 22 bp, Homo sapiens
gtgcatgtatgtgtgtgtgtat

SEQ ID NO: 5781395 - DNA, 12 bp, Homo sapiens
gtgcatgtcaca

SEQ ID NO: 5781396 - DNA, 14 bp, Homo sapiens
gtgcatgtgaagca

SEQ ID NO: 5781397 - DNA, 19 bp, Homo sapiens
gtgcatgtgagcacatgcg

SEQ ID NO: 5781398 - DNA, 14 bp, Homo sapiens
gtgcatgtgcaggt

SEQ ID NO: 5781399 - DNA, 21 bp, Homo sapiens
gtgcatgtgcgtggaagtgtt

SEQ ID NO: 5781400 - DNA, 22 bp, Homo sapiens
gtgcatgtgcgtggaagtgttc

SEQ ID NO: 5781401 - DNA, 18 bp, Homo sapiens
gtgcatgtgtgtgtctgt

SEQ ID NO: 5781402 - DNA, 12 bp, Homo sapiens
gtgcatgttaaa

SEQ ID NO: 5781403 - DNA, 16 bp, Homo sapiens
gtgcatgttaaaataa

SEQ ID NO: 5781404 - DNA, 20 bp, Homo sapiens
gtgcatgttaaaataattat

SEQ ID NO: 5781405 - DNA, 16 bp, Homo sapiens
gtgcatgttgccatga

SEQ ID NO: 5781406 - DNA, 22 bp, Homo sapiens
gtgcattagcacagattttaat

SEQ ID NO: 5781407 - DNA, 9 bp, Homo sapiens
gtgcattca

SEQ ID NO: 5781408 - DNA, 20 bp, Homo sapiens
gtgcattcaaccttaccaaa

SEQ ID NO: 5781409 - DNA, 12 bp, Homo sapiens
gtgcattgtcct

SEQ ID NO: 5781410 - DNA, 11 bp, Homo sapiens
gtgcattgtgc

SEQ ID NO: 5781411 - DNA, 13 bp, Homo sapiens
gtgcattgtgctt

SEQ ID NO: 5781412 - DNA, 14 bp, Homo sapiens
gtgcattgttattt

SEQ ID NO: 5781413 - DNA, 16 bp, Homo sapiens
gtgcatttaaggagat

SEQ ID NO: 5781414 - DNA, 20 bp, Homo sapiens
gtgcatttcacctgtgacaa

SEQ ID NO: 5781415 - DNA, 16 bp, Homo sapiens
gtgcatttctgggcct

SEQ ID NO: 5781416 - DNA, 11 bp, Homo sapiens
gtgcatttctt

SEQ ID NO: 5781417 - DNA, 20 bp, Homo sapiens
gtgcatttcttggtttatgt

SEQ ID NO: 5781418 - DNA, 22 bp, Homo sapiens
gtgcatttgagagaagccacgc

SEQ ID NO: 5781419 - DNA, 21 bp, Homo sapiens
gtgcatttgaggtctgttctt

SEQ ID NO: 5781420 - DNA, 23 bp, Homo sapiens
gtgcatttgtgagccaaagagaa

SEQ ID NO: 5781421 - DNA, 18 bp, Homo sapiens
gtgcatttgtgtctgcct

SEQ ID NO: 5781422 - DNA, 18 bp, Homo sapiens
gtgcatttgttcagctcc

SEQ ID NO: 5781423 - DNA, 15 bp, Homo sapiens
gtgcattttattgac

SEQ ID NO: 5781424 - DNA, 16 bp, Homo sapiens
gtgcatttttgtgaaa

SEQ ID NO: 5781425 - DNA, 18 bp, Homo sapiens
gtgccaaaaggccccttc

SEQ ID NO: 5781426 - DNA, 17 bp, Homo sapiens
gtgccaaagcctggggc

SEQ ID NO: 5781427 - DNA, 20 bp, Homo sapiens
gtgccaaatagccccagact

SEQ ID NO: 5781428 - DNA, 15 bp, Homo sapiens
gtgccaaatcctggg

SEQ ID NO: 5781429 - DNA, 16 bp, Homo sapiens
gtgccaaccacctctg

SEQ ID NO: 5781430 - DNA, 23 bp, Homo sapiens
gtgccaacctgatgccccttccc

SEQ ID NO: 5781431 - DNA, 21 bp, Homo sapiens
gtgccaactactactggtgat

SEQ ID NO: 5781432 - DNA, 15 bp, Homo sapiens
gtgccaactcctcac

SEQ ID NO: 5781433 - DNA, 14 bp, Homo sapiens
gtgccaactgccag

SEQ ID NO: 5781434 - DNA, 18 bp, Homo sapiens
gtgccaactgtggctggt

SEQ ID NO: 5781435 - DNA, 18 bp, Homo sapiens
gtgccaacttcccctcta

SEQ ID NO: 5781436 - DNA, 14 bp, Homo sapiens
gtgccaagcacagt

SEQ ID NO: 5781437 - DNA, 22 bp, Homo sapiens
gtgccaagggccccaggggcag

SEQ ID NO: 5781438 - DNA, 23 bp, Homo sapiens
gtgccaagggccccaggggcagc

SEQ ID NO: 5781439 - DNA, 19 bp, Homo sapiens
gtgccaagtccaggtcctg

SEQ ID NO: 5781440 - DNA, 20 bp, Homo sapiens
gtgccaataaccaagtttat

SEQ ID NO: 5781441 - DNA, 20 bp, Homo sapiens
gtgccaatatgtattgtaaa

SEQ ID NO: 5781442 - DNA, 18 bp, Homo sapiens
gtgccaatcctgtaggca

SEQ ID NO: 5781443 - DNA, 15 bp, Homo sapiens
gtgccaatgacagga

SEQ ID NO: 5781444 - DNA, 12 bp, Homo sapiens
gtgccaatgact

SEQ ID NO: 5781445 - DNA, 12 bp, Homo sapiens
gtgccaattttg

SEQ ID NO: 5781446 - DNA, 21 bp, Homo sapiens
gtgccacacttcgctcttgag

SEQ ID NO: 5781447 - DNA, 10 bp, Homo sapiens
gtgccacaga

SEQ ID NO: 5781448 - DNA, 12 bp, Homo sapiens
gtgccacagaga

SEQ ID NO: 5781449 - DNA, 15 bp, Homo sapiens
gtgccacagagaaga

SEQ ID NO: 5781450 - DNA, 13 bp, Homo sapiens
gtgccacagaggc

SEQ ID NO: 5781451 - DNA, 14 bp, Homo sapiens
gtgccacagaggcc

SEQ ID NO: 5781452 - DNA, 15 bp, Homo sapiens
gtgccacagaggccc

SEQ ID NO: 5781453 - DNA, 18 bp, Homo sapiens
gtgccacagaggccccac

SEQ ID NO: 5781454 - DNA, 21 bp, Homo sapiens
gtgccacagagggctgtgtct

SEQ ID NO: 5781455 - DNA, 17 bp, Homo sapiens
gtgccacagcctgctgg

SEQ ID NO: 5781456 - DNA, 20 bp, Homo sapiens
gtgccacagcctgctggcag

SEQ ID NO: 5781457 - DNA, 21 bp, Homo sapiens
gtgccacagcctgctggcagg

SEQ ID NO: 5781458 - DNA, 22 bp, Homo sapiens
gtgccacagcctgctggcaggg

SEQ ID NO: 5781459 - DNA, 23 bp, Homo sapiens
gtgccacagcctgctggcagggc

SEQ ID NO: 5781460 - DNA, 20 bp, Homo sapiens
gtgccacatggccgctgccc

SEQ ID NO: 5781461 - DNA, 13 bp, Homo sapiens
gtgccacattttc

SEQ ID NO: 5781462 - DNA, 15 bp, Homo sapiens
gtgccacattttctt

SEQ ID NO: 5781463 - DNA, 15 bp, Homo sapiens
gtgccaccaagctca

SEQ ID NO: 5781464 - DNA, 23 bp, Homo sapiens
gtgccaccaagctcacacctgtc

SEQ ID NO: 5781465 - DNA, 14 bp, Homo sapiens
gtgccaccaataaa

SEQ ID NO: 5781466 - DNA, 17 bp, Homo sapiens
gtgccaccaataaaaat

SEQ ID NO: 5781467 - DNA, 23 bp, Homo sapiens
gtgccaccacccctccctctgct

SEQ ID NO: 5781468 - DNA, 16 bp, Homo sapiens
gtgccaccaccctgcc

SEQ ID NO: 5781469 - DNA, 19 bp, Homo sapiens
gtgccaccacgcccagcta

SEQ ID NO: 5781470 - DNA, 20 bp, Homo sapiens
gtgccacccagtagcccaga

SEQ ID NO: 5781471 - DNA, 21 bp, Homo sapiens
gtgccacccatgcagctgctc

SEQ ID NO: 5781472 - DNA, 21 bp, Homo sapiens
gtgccaccccttcctcagcct

SEQ ID NO: 5781473 - DNA, 23 bp, Homo sapiens
gtgccaccccttcctcagcctgg

SEQ ID NO: 5781474 - DNA, 21 bp, Homo sapiens
gtgccaccctcctccctccaa

SEQ ID NO: 5781475 - DNA, 15 bp, Homo sapiens
gtgccaccctctgca

SEQ ID NO: 5781476 - DNA, 16 bp, Homo sapiens
gtgccaccctctgcag

SEQ ID NO: 5781477 - DNA, 17 bp, Homo sapiens
gtgccaccctctgcagg

SEQ ID NO: 5781478 - DNA, 23 bp, Homo sapiens
gtgccaccctctgcagggcagcc

SEQ ID NO: 5781479 - DNA, 20 bp, Homo sapiens
gtgccaccgtccctctgcag

SEQ ID NO: 5781480 - DNA, 17 bp, Homo sapiens
gtgccacctatgcctgt

SEQ ID NO: 5781481 - DNA, 18 bp, Homo sapiens
gtgccacctatgcctgtg

SEQ ID NO: 5781482 - DNA, 20 bp, Homo sapiens
gtgccacctatgcctgtggt

SEQ ID NO: 5781483 - DNA, 16 bp, Homo sapiens
gtgccacgcgctctgc

SEQ ID NO: 5781484 - DNA, 13 bp, Homo sapiens
gtgccacgtggcc

SEQ ID NO: 5781485 - DNA, 13 bp, Homo sapiens
gtgccactccctg

SEQ ID NO: 5781486 - DNA, 16 bp, Homo sapiens
gtgccactccctgagc

SEQ ID NO: 5781487 - DNA, 21 bp, Homo sapiens
gtgccactgaccgggatccag

SEQ ID NO: 5781488 - DNA, 17 bp, Homo sapiens
gtgccactgcccgagct

SEQ ID NO: 5781489 - DNA, 23 bp, Homo sapiens
gtgccactgcccgagctggtgca

SEQ ID NO: 5781490 - DNA, 22 bp, Homo sapiens
gtgccacttcttaaaggcctgg

SEQ ID NO: 5781491 - DNA, 16 bp, Homo sapiens
gtgccactttccacca

SEQ ID NO: 5781492 - DNA, 12 bp, Homo sapiens
gtgccagagcct

SEQ ID NO: 5781493 - DNA, 13 bp, Homo sapiens
gtgccagagcctg

SEQ ID NO: 5781494 - DNA, 14 bp, Homo sapiens
gtgccagagcctgg

SEQ ID NO: 5781495 - DNA, 20 bp, Homo sapiens
gtgccagaggaatcctggca

SEQ ID NO: 5781496 - DNA, 18 bp, Homo sapiens
gtgccagaggtgggcagg

SEQ ID NO: 5781497 - DNA, 21 bp, Homo sapiens
gtgccagaggtgggcaggtgg

SEQ ID NO: 5781498 - DNA, 21 bp, Homo sapiens
gtgccagatataactgtcttg

SEQ ID NO: 5781499 - DNA, 18 bp, Homo sapiens
gtgccagcaaagccccat

SEQ ID NO: 5781500 - DNA, 12 bp, Homo sapiens
gtgccagcaact

SEQ ID NO: 5781501 - DNA, 20 bp, Homo sapiens
gtgccagcaccacagccggt

SEQ ID NO: 5781502 - DNA, 12 bp, Homo sapiens
gtgccagcagcc

SEQ ID NO: 5781503 - DNA, 18 bp, Homo sapiens
gtgccagcagcccttgtt

SEQ ID NO: 5781504 - DNA, 23 bp, Homo sapiens
gtgccagcagcctcgcacaggcc

SEQ ID NO: 5781505 - DNA, 20 bp, Homo sapiens
gtgccagcaggggggctgtg

SEQ ID NO: 5781506 - DNA, 16 bp, Homo sapiens
gtgccagcattccaga

SEQ ID NO: 5781507 - DNA, 21 bp, Homo sapiens
gtgccagcattccagacttca

SEQ ID NO: 5781508 - DNA, 12 bp, Homo sapiens
gtgccagccaat

SEQ ID NO: 5781509 - DNA, 21 bp, Homo sapiens
gtgccagccaatccctggcca

SEQ ID NO: 5781510 - DNA, 14 bp, Homo sapiens
gtgccagcccagag

SEQ ID NO: 5781511 - DNA, 12 bp, Homo sapiens
gtgccagcccct

SEQ ID NO: 5781512 - DNA, 17 bp, Homo sapiens
gtgccagcccctgctgg

SEQ ID NO: 5781513 - DNA, 19 bp, Homo sapiens
gtgccagcccctgctggct

SEQ ID NO: 5781514 - DNA, 13 bp, Homo sapiens
gtgccagccttcc

SEQ ID NO: 5781515 - DNA, 12 bp, Homo sapiens
gtgccagctcag

SEQ ID NO: 5781516 - DNA, 11 bp, Homo sapiens
gtgccagctcc

SEQ ID NO: 5781517 - DNA, 14 bp, Homo sapiens
gtgccagctccagt

SEQ ID NO: 5781518 - DNA, 15 bp, Homo sapiens
gtgccagctctagtt

SEQ ID NO: 5781519 - DNA, 15 bp, Homo sapiens
gtgccagctgccctt

SEQ ID NO: 5781520 - DNA, 21 bp, Homo sapiens
gtgccagctgcccttgcaggg

SEQ ID NO: 5781521 - DNA, 16 bp, Homo sapiens
gtgccagctgcttctg

SEQ ID NO: 5781522 - DNA, 15 bp, Homo sapiens
gtgccaggacagctg

SEQ ID NO: 5781523 - DNA, 13 bp, Homo sapiens
gtgccaggaccag

SEQ ID NO: 5781524 - DNA, 16 bp, Homo sapiens
gtgccaggaccagcct

SEQ ID NO: 5781525 - DNA, 16 bp, Homo sapiens
gtgccaggaccagtca

SEQ ID NO: 5781526 - DNA, 17 bp, Homo sapiens
gtgccaggactctcttt

SEQ ID NO: 5781527 - DNA, 11 bp, Homo sapiens
gtgccaggagc

SEQ ID NO: 5781528 - DNA, 15 bp, Homo sapiens
gtgccaggagcaatg

SEQ ID NO: 5781529 - DNA, 18 bp, Homo sapiens
gtgccaggagggcacagc

SEQ ID NO: 5781530 - DNA, 22 bp, Homo sapiens
gtgccaggagggcacagcaggg

SEQ ID NO: 5781531 - DNA, 22 bp, Homo sapiens
gtgccaggcattcaatcctcag

SEQ ID NO: 5781532 - DNA, 15 bp, Homo sapiens
gtgccaggccaaaga

SEQ ID NO: 5781533 - DNA, 12 bp, Homo sapiens
gtgccaggcccg

SEQ ID NO: 5781534 - DNA, 20 bp, Homo sapiens
gtgccaggcccggggctggc

SEQ ID NO: 5781535 - DNA, 18 bp, Homo sapiens
gtgccaggcgcgtgtaaa

SEQ ID NO: 5781536 - DNA, 19 bp, Homo sapiens
gtgccaggctgggaggctc

SEQ ID NO: 5781537 - DNA, 17 bp, Homo sapiens
gtgccaggctgtaagca

SEQ ID NO: 5781538 - DNA, 14 bp, Homo sapiens
gtgccaggcttgcc

SEQ ID NO: 5781539 - DNA, 16 bp, Homo sapiens
gtgccaggcttgcctg

SEQ ID NO: 5781540 - DNA, 21 bp, Homo sapiens
gtgccaggcttgcctgggctg

SEQ ID NO: 5781541 - DNA, 22 bp, Homo sapiens
gtgccaggcttgcctgggctgg

SEQ ID NO: 5781542 - DNA, 19 bp, Homo sapiens
gtgcctgtgctcctgccca

SEQ ID NO: 5781543 - DNA, 22 bp, Homo sapiens
gtgcctgtgtccatgcgctcag

SEQ ID NO: 5781544 - DNA, 21 bp, Homo sapiens
gtgcctgtgtgcgagtctgag

SEQ ID NO: 5781545 - DNA, 22 bp, Homo sapiens
gtgcctgttgctttcttcctgc

SEQ ID NO: 5781546 - DNA, 19 bp, Homo sapiens
gtgccttaaaaggagagaa

SEQ ID NO: 5781547 - DNA, 18 bp, Homo sapiens
gtgccttacatcttttct

SEQ ID NO: 5781548 - DNA, 19 bp, Homo sapiens
gtgccttacctcctgccca

SEQ ID NO: 5781549 - DNA, 19 bp, Homo sapiens
gtgccttactgactgtagc

SEQ ID NO: 5781550 - DNA, 18 bp, Homo sapiens
gtgccttattacccagga

SEQ ID NO: 5781551 - DNA, 15 bp, Homo sapiens
gtgccttcactgggc

SEQ ID NO: 5781552 - DNA, 19 bp, Homo sapiens
gtgccttcactgggccagt

SEQ ID NO: 5781553 - DNA, 14 bp, Homo sapiens
gtgccttcagccaa

SEQ ID NO: 5781554 - DNA, 15 bp, Homo sapiens
gtgccttcagctcta

SEQ ID NO: 5781555 - DNA, 12 bp, Homo sapiens
gtgccttccaac

SEQ ID NO: 5781556 - DNA, 15 bp, Homo sapiens
gtgccttccataatt

SEQ ID NO: 5781557 - DNA, 22 bp, Homo sapiens
gtgccttccataattatgacag

SEQ ID NO: 5781558 - DNA, 21 bp, Homo sapiens
gtgccttccccgtgcggcccg

SEQ ID NO: 5781559 - DNA, 16 bp, Homo sapiens
gtgccttcccttctct

SEQ ID NO: 5781560 - DNA, 20 bp, Homo sapiens
gtgccttcccttctctggtc

SEQ ID NO: 5781561 - DNA, 16 bp, Homo sapiens
gtgccttcctccccgc

SEQ ID NO: 5781562 - DNA, 20 bp, Homo sapiens
gtgccttcgcggtggaaggc

SEQ ID NO: 5781563 - DNA, 23 bp, Homo sapiens
gtgccttcgcttggagacccaca

SEQ ID NO: 5781564 - DNA, 22 bp, Homo sapiens
gtgccttctccttccccaggat

SEQ ID NO: 5781565 - DNA, 22 bp, Homo sapiens
gtgccttctctcagctcccagg

SEQ ID NO: 5781566 - DNA, 12 bp, Homo sapiens
gtgccttctggg

SEQ ID NO: 5781567 - DNA, 15 bp, Homo sapiens
gtgccttctgggaag

SEQ ID NO: 5781568 - DNA, 19 bp, Homo sapiens
gtgccttcttcagggcctg

SEQ ID NO: 5781569 - DNA, 14 bp, Homo sapiens
gtgccttgagctgc

SEQ ID NO: 5781570 - DNA, 22 bp, Homo sapiens
gtgccttgagctgcctgctctg

SEQ ID NO: 5781571 - DNA, 13 bp, Homo sapiens
gtgccttgatttt

SEQ ID NO: 5781572 - DNA, 23 bp, Homo sapiens
gtgccttgattttaattcaggtg

SEQ ID NO: 5781573 - DNA, 20 bp, Homo sapiens
gtgccttgccacattaaatt

SEQ ID NO: 5781574 - DNA, 15 bp, Homo sapiens
gtgccttgcccacag

SEQ ID NO: 5781575 - DNA, 19 bp, Homo sapiens
gtgccttgctcatttgaaa

SEQ ID NO: 5781576 - DNA, 14 bp, Homo sapiens
gtgccttggagcag

SEQ ID NO: 5781577 - DNA, 23 bp, Homo sapiens
gtgccttggagggtcccaagctg

SEQ ID NO: 5781578 - DNA, 22 bp, Homo sapiens
gtgccttggggaaatgtggaga

SEQ ID NO: 5781579 - DNA, 20 bp, Homo sapiens
gtgccttggggaatttcctc

SEQ ID NO: 5781580 - DNA, 21 bp, Homo sapiens
gtgccttggggaatttcctct

SEQ ID NO: 5781581 - DNA, 17 bp, Homo sapiens
gtgccttggtctctcct

SEQ ID NO: 5781582 - DNA, 17 bp, Homo sapiens
gtgccttgtccaggaac

SEQ ID NO: 5781583 - DNA, 20 bp, Homo sapiens
gtgcctttatctcagccatc

SEQ ID NO: 5781584 - DNA, 13 bp, Homo sapiens
gtgcctttcaaat

SEQ ID NO: 5781585 - DNA, 18 bp, Homo sapiens
gtgcctttcaaatttaga

SEQ ID NO: 5781586 - DNA, 16 bp, Homo sapiens
gtgcctttcaggatct

SEQ ID NO: 5781587 - DNA, 16 bp, Homo sapiens
gtgcctttcccgggcc

SEQ ID NO: 5781588 - DNA, 19 bp, Homo sapiens
gtgcctttctctggctcca

SEQ ID NO: 5781589 - DNA, 17 bp, Homo sapiens
gtgcctttctttgcctc

SEQ ID NO: 5781590 - DNA, 18 bp, Homo sapiens
gtgcctttctttgcctct

SEQ ID NO: 5781591 - DNA, 19 bp, Homo sapiens
gtgcctttctttgcctctg

SEQ ID NO: 5781592 - DNA, 15 bp, Homo sapiens
gtgcctttgggcacg

SEQ ID NO: 5781593 - DNA, 16 bp, Homo sapiens
gtgccttttgcacccc

SEQ ID NO: 5781594 - DNA, 22 bp, Homo sapiens
gtgccttttgcacccctcccat

SEQ ID NO: 5781595 - DNA, 15 bp, Homo sapiens
gtgccttttgtgtga

SEQ ID NO: 5781596 - DNA, 18 bp, Homo sapiens
gtgccttttgtgtgatgc

SEQ ID NO: 5781597 - DNA, 14 bp, Homo sapiens
gtgcgaatggactt

SEQ ID NO: 5781598 - DNA, 17 bp, Homo sapiens
gtgcgaccagaggtggg

SEQ ID NO: 5781599 - DNA, 16 bp, Homo sapiens
gtgcgaccccatctgc

SEQ ID NO: 5781600 - DNA, 20 bp, Homo sapiens
gtgcgacttcacaaaatgca

SEQ ID NO: 5781601 - DNA, 19 bp, Homo sapiens
gtgcgagaacacaagccac

SEQ ID NO: 5781602 - DNA, 21 bp, Homo sapiens
gtgcgagagaggtgggcagca

SEQ ID NO: 5781603 - DNA, 13 bp, Homo sapiens
gtgcgagctgccg

SEQ ID NO: 5781604 - DNA, 14 bp, Homo sapiens
gtgcgagtgtgtgc

SEQ ID NO: 5781605 - DNA, 22 bp, Homo sapiens
gtgcgattatagcccggtgcag

SEQ ID NO: 5781606 - DNA, 19 bp, Homo sapiens
gtgcgcagatctgtgcctg

SEQ ID NO: 5781607 - DNA, 22 bp, Homo sapiens
gtgcgcagccgcgctctgcccc

SEQ ID NO: 5781608 - DNA, 18 bp, Homo sapiens
gtgcgcatcttgcctcca

SEQ ID NO: 5781609 - DNA, 16 bp, Homo sapiens
gtgcgcccagggctgg

SEQ ID NO: 5781610 - DNA, 13 bp, Homo sapiens
gtgcgcctcacca

SEQ ID NO: 5781611 - DNA, 16 bp, Homo sapiens
gtgcgcctgagtgagt

SEQ ID NO: 5781612 - DNA, 15 bp, Homo sapiens
gtgcgcgtgagtgtg

SEQ ID NO: 5781613 - DNA, 20 bp, Homo sapiens
gtgcgcgtgagtgtgtgagc

SEQ ID NO: 5781614 - DNA, 17 bp, Homo sapiens
gtgcgctaaacttttct

SEQ ID NO: 5781615 - DNA, 19 bp, Homo sapiens
gtgcgctcttggtccctgg

SEQ ID NO: 5781616 - DNA, 23 bp, Homo sapiens
gtgcgctgctctgcaggctgggg

SEQ ID NO: 5781617 - DNA, 19 bp, Homo sapiens
gtgcgctgggcacttccct

SEQ ID NO: 5781618 - DNA, 12 bp, Homo sapiens
gtgcgctgtgct

SEQ ID NO: 5781619 - DNA, 15 bp, Homo sapiens
gtgcggacccttccc

SEQ ID NO: 5781620 - DNA, 22 bp, Homo sapiens
gtgcggacccttcccagccctc

SEQ ID NO: 5781621 - DNA, 13 bp, Homo sapiens
gtgcggagctgat

SEQ ID NO: 5781622 - DNA, 15 bp, Homo sapiens
gtgcggaggcaggag

SEQ ID NO: 5781623 - DNA, 17 bp, Homo sapiens
gtgcggaggcaggagca

SEQ ID NO: 5781624 - DNA, 20 bp, Homo sapiens
gtgcggcaggagcaggaaca

SEQ ID NO: 5781625 - DNA, 17 bp, Homo sapiens
gtgcggcagggcaggag

SEQ ID NO: 5781626 - DNA, 23 bp, Homo sapiens
gtgcggcctcaccaggcccacga

SEQ ID NO: 5781627 - DNA, 23 bp, Homo sapiens
gtgcggcgtggagactggcaggc

SEQ ID NO: 5781628 - DNA, 17 bp, Homo sapiens
gtgcgggcacaataaat

SEQ ID NO: 5781629 - DNA, 13 bp, Homo sapiens
gtgcgggcctggc

SEQ ID NO: 5781630 - DNA, 17 bp, Homo sapiens
gtgcggggcctgcaggc

SEQ ID NO: 5781631 - DNA, 16 bp, Homo sapiens
gtgcggtaggtgctgg

SEQ ID NO: 5781632 - DNA, 17 bp, Homo sapiens
gtgcggtaggtgctggc

SEQ ID NO: 5781633 - DNA, 15 bp, Homo sapiens
gtgcgtaaggatgtg

SEQ ID NO: 5781634 - DNA, 13 bp, Homo sapiens
gtgcgtcccagct

SEQ ID NO: 5781635 - DNA, 22 bp, Homo sapiens
gtgcgtcccccgttgtgcctgg

SEQ ID NO: 5781636 - DNA, 21 bp, Homo sapiens
gtgcgtctctgtcgtggacac

SEQ ID NO: 5781637 - DNA, 16 bp, Homo sapiens
gtgcgtgccgtgtgag

SEQ ID NO: 5781638 - DNA, 12 bp, Homo sapiens
gtgcgtgctcag

SEQ ID NO: 5781639 - DNA, 15 bp, Homo sapiens
gtgcgtggaagtgtt

SEQ ID NO: 5781640 - DNA, 14 bp, Homo sapiens
gtgcgtggctgtgg

SEQ ID NO: 5781641 - DNA, 12 bp, Homo sapiens
gtgcgtgggtga

SEQ ID NO: 5781642 - DNA, 15 bp, Homo sapiens
gtgcgtggtggtccc

SEQ ID NO: 5781643 - DNA, 14 bp, Homo sapiens
gtgcgtgtgcgtgt

SEQ ID NO: 5781644 - DNA, 13 bp, Homo sapiens
gtgcgtgtggccc

SEQ ID NO: 5781645 - DNA, 21 bp, Homo sapiens
gtgcgtgttagtgtgtgtgca

SEQ ID NO: 5781646 - DNA, 14 bp, Homo sapiens
gtgcgttttagagt

SEQ ID NO: 5781647 - DNA, 23 bp, Homo sapiens
gtgctaaaaaattaaaccaagca

SEQ ID NO: 5781648 - DNA, 16 bp, Homo sapiens
gtgctaaaaatgaaaa

SEQ ID NO: 5781649 - DNA, 22 bp, Homo sapiens
gtgctaaaaatgggacttcttt

SEQ ID NO: 5781650 - DNA, 14 bp, Homo sapiens
gtgctaaacgtgta

SEQ ID NO: 5781651 - DNA, 20 bp, Homo sapiens
gtgctaaacgtgtatgtttt

SEQ ID NO: 5781652 - DNA, 16 bp, Homo sapiens
gtgctaaattttcagt

SEQ ID NO: 5781653 - DNA, 16 bp, Homo sapiens
gtgctaaccccgtctg

SEQ ID NO: 5781654 - DNA, 13 bp, Homo sapiens
gtgctaactgtat

SEQ ID NO: 5781655 - DNA, 18 bp, Homo sapiens
gtgctaagctgccctgag

SEQ ID NO: 5781656 - DNA, 16 bp, Homo sapiens
gtgctaagtctttccc

SEQ ID NO: 5781657 - DNA, 13 bp, Homo sapiens
gtgctaagtgctt

SEQ ID NO: 5781658 - DNA, 13 bp, Homo sapiens
gtgctaagtgtga

SEQ ID NO: 5781659 - DNA, 20 bp, Homo sapiens
gtgctaagtgtgaactggac

SEQ ID NO: 5781660 - DNA, 13 bp, Homo sapiens
gtgctaatatttt

SEQ ID NO: 5781661 - DNA, 17 bp, Homo sapiens
gtgctaatattttattt

SEQ ID NO: 5781662 - DNA, 19 bp, Homo sapiens
gtgctaatattttatttga

SEQ ID NO: 5781663 - DNA, 20 bp, Homo sapiens
gtgctaatgtgtctgtggac

SEQ ID NO: 5781664 - DNA, 16 bp, Homo sapiens
gtgctaatttctgtcc

SEQ ID NO: 5781665 - DNA, 15 bp, Homo sapiens
gtgctaattttgaaa

SEQ ID NO: 5781666 - DNA, 22 bp, Homo sapiens
gtgctacaaaaacacagcaagg

SEQ ID NO: 5781667 - DNA, 16 bp, Homo sapiens
gtgctacaacatgtga

SEQ ID NO: 5781668 - DNA, 15 bp, Homo sapiens
gtgctacagagaaaa

SEQ ID NO: 5781669 - DNA, 19 bp, Homo sapiens
gtgctacagggaatttgta

SEQ ID NO: 5781670 - DNA, 16 bp, Homo sapiens
gtgctacaggggccag

SEQ ID NO: 5781671 - DNA, 19 bp, Homo sapiens
gtgctacaggggccagaag

SEQ ID NO: 5781672 - DNA, 19 bp, Homo sapiens
gtgctacctctctcttccc

SEQ ID NO: 5781673 - DNA, 16 bp, Homo sapiens
gtgctacctgggtcct

SEQ ID NO: 5781674 - DNA, 20 bp, Homo sapiens
gtgctacgtgtgaaatctgt

SEQ ID NO: 5781675 - DNA, 13 bp, Homo sapiens
gtgctactgggga

SEQ ID NO: 5781676 - DNA, 15 bp, Homo sapiens
gtgctactgtctttg

SEQ ID NO: 5781677 - DNA, 20 bp, Homo sapiens
gtgctactgtctttggaaaa

SEQ ID NO: 5781678 - DNA, 17 bp, Homo sapiens
gtgctacttgcttgaag

SEQ ID NO: 5781679 - DNA, 21 bp, Homo sapiens
gtgctagaaaatttagccctt

SEQ ID NO: 5781680 - DNA, 19 bp, Homo sapiens
gtgctagaatactttttaa

SEQ ID NO: 5781681 - DNA, 20 bp, Homo sapiens
gtgctagggaaacttcccgt

SEQ ID NO: 5781682 - DNA, 15 bp, Homo sapiens
gtgctagggtgcctg

SEQ ID NO: 5781683 - DNA, 16 bp, Homo sapiens
gtgctagggtgcctgc

SEQ ID NO: 5781684 - DNA, 17 bp, Homo sapiens
gtgctagggtgcctgct

SEQ ID NO: 5781685 - DNA, 13 bp, Homo sapiens
gtgctagtaaatt

SEQ ID NO: 5781686 - DNA, 15 bp, Homo sapiens
gtgctagtcactggc

SEQ ID NO: 5781687 - DNA, 18 bp, Homo sapiens
gtgctagtcactggcagc

SEQ ID NO: 5781688 - DNA, 16 bp, Homo sapiens
gtgctataaatgccag

SEQ ID NO: 5781689 - DNA, 20 bp, Homo sapiens
gtgctataaatgccagagcc

SEQ ID NO: 5781690 - DNA, 22 bp, Homo sapiens
gtgctataaatgccagagccaa

SEQ ID NO: 5781691 - DNA, 22 bp, Homo sapiens
gtgctataatctgtttttacgt

SEQ ID NO: 5781692 - DNA, 17 bp, Homo sapiens
gtgctatacacacacac

SEQ ID NO: 5781693 - DNA, 13 bp, Homo sapiens
gtgctatagtatt

SEQ ID NO: 5781694 - DNA, 15 bp, Homo sapiens
gtgctatataaatat

SEQ ID NO: 5781695 - DNA, 22 bp, Homo sapiens
gtgctatatccagttcctgctc

SEQ ID NO: 5781696 - DNA, 23 bp, Homo sapiens
gtgctatatccagttcctgctct

SEQ ID NO: 5781697 - DNA, 14 bp, Homo sapiens
gtgctatgaagcca

SEQ ID NO: 5781698 - DNA, 15 bp, Homo sapiens
gtgctatgaagccaa

SEQ ID NO: 5781699 - DNA, 17 bp, Homo sapiens
gtgctatgcggaggaaa

SEQ ID NO: 5781700 - DNA, 24 bp, Homo sapiens
gtgctattacgaagttcaagatca

SEQ ID NO: 5781701 - DNA, 18 bp, Homo sapiens
gtgctattgaactgagcc

SEQ ID NO: 5781702 - DNA, 20 bp, Homo sapiens
gtgctatttaacatgggagg

SEQ ID NO: 5781703 - DNA, 18 bp, Homo sapiens
gtgctatttaacatttta

SEQ ID NO: 5781704 - DNA, 13 bp, Homo sapiens
gtgctatttcagc

SEQ ID NO: 5781705 - DNA, 13 bp, Homo sapiens
gtgctatttctat

SEQ ID NO: 5781706 - DNA, 22 bp, Homo sapiens
gtgctatttgtacaaataaacc

SEQ ID NO: 5781707 - DNA, 22 bp, Homo sapiens
gtgctcaaagatgtactgagag

SEQ ID NO: 5781708 - DNA, 19 bp, Homo sapiens
gtgctcaacctacagtgga

SEQ ID NO: 5781709 - DNA, 23 bp, Homo sapiens
gtgctcaacctacagtggaggga

SEQ ID NO: 5781710 - DNA, 13 bp, Homo sapiens
gtgctcaaggcca

SEQ ID NO: 5781711 - DNA, 13 bp, Homo sapiens
gtgctcaataaac

SEQ ID NO: 5781712 - DNA, 19 bp, Homo sapiens
gtgctcaataaacttgtgc

SEQ ID NO: 5781713 - DNA, 23 bp, Homo sapiens
gtgctcaataaacttgtgcctcc

SEQ ID NO: 5781714 - DNA, 17 bp, Homo sapiens
gtgctcacaatgttctg

SEQ ID NO: 5781715 - DNA, 23 bp, Homo sapiens
gtgctcaccgcctgctacacagg

SEQ ID NO: 5781716 - DNA, 18 bp, Homo sapiens
gtgctcacgactcttcct

SEQ ID NO: 5781717 - DNA, 17 bp, Homo sapiens
gtgctcacgctcccccg

SEQ ID NO: 5781718 - DNA, 20 bp, Homo sapiens
gtgctcacgctcccccgcag

SEQ ID NO: 5781719 - DNA, 19 bp, Homo sapiens
gtggaaaggattctaaaca

SEQ ID NO: 5781720 - DNA, 20 bp, Homo sapiens
gtggaaagggtgctgcttcc

SEQ ID NO: 5781721 - DNA, 22 bp, Homo sapiens
gtggaaagtcacctacaggact

SEQ ID NO: 5781722 - DNA, 24 bp, Homo sapiens
gtggaaagtcaggctagctgtgct

SEQ ID NO: 5781723 - DNA, 16 bp, Homo sapiens
gtggaaagtgaatttg

SEQ ID NO: 5781724 - DNA, 19 bp, Homo sapiens
gtggaaagtgaatttgaat

SEQ ID NO: 5781725 - DNA, 16 bp, Homo sapiens
gtggaaagtgtaaagc

SEQ ID NO: 5781726 - DNA, 22 bp, Homo sapiens
gtggaaagtgttcattgcacaa

SEQ ID NO: 5781727 - DNA, 19 bp, Homo sapiens
gtggaaatatgcaacctgt

SEQ ID NO: 5781728 - DNA, 20 bp, Homo sapiens
gtggaaatgagcgaaatcat

SEQ ID NO: 5781729 - DNA, 18 bp, Homo sapiens
gtggaaattaagaagaaa

SEQ ID NO: 5781730 - DNA, 21 bp, Homo sapiens
gtggaaattaagaagaaacta

SEQ ID NO: 5781731 - DNA, 19 bp, Homo sapiens
gtggaacacaaatgaaaat

SEQ ID NO: 5781732 - DNA, 19 bp, Homo sapiens
gtggaacactaaagagcta

SEQ ID NO: 5781733 - DNA, 16 bp, Homo sapiens
gtggaacatctataga

SEQ ID NO: 5781734 - DNA, 16 bp, Homo sapiens
gtggaaccaaagctgg

SEQ ID NO: 5781735 - DNA, 21 bp, Homo sapiens
gtggaaccactgactactggc

SEQ ID NO: 5781736 - DNA, 20 bp, Homo sapiens
gtggaacctctgtctcatcc

SEQ ID NO: 5781737 - DNA, 24 bp, Homo sapiens
gtggaacctctgtctcatcctcct

SEQ ID NO: 5781738 - DNA, 23 bp, Homo sapiens
gtggaactacattagtacacagc

SEQ ID NO: 5781739 - DNA, 22 bp, Homo sapiens
gtggaactctcctgctcctcag

SEQ ID NO: 5781740 - DNA, 13 bp, Homo sapiens
gtggaactgccac

SEQ ID NO: 5781741 - DNA, 23 bp, Homo sapiens
gtggaactgccaccttgggtctg

SEQ ID NO: 5781742 - DNA, 15 bp, Homo sapiens
gtggaactgctgcca

SEQ ID NO: 5781743 - DNA, 11 bp, Homo sapiens
gtggaagaaaa

SEQ ID NO: 5781744 - DNA, 20 bp, Homo sapiens
gtggaagaaaatggtttatt

SEQ ID NO: 5781745 - DNA, 17 bp, Homo sapiens
gtggaagaagagggaga

SEQ ID NO: 5781746 - DNA, 15 bp, Homo sapiens
gtggaagaagggaga

SEQ ID NO: 5781747 - DNA, 20 bp, Homo sapiens
gtggaagacagagatggcag

SEQ ID NO: 5781748 - DNA, 23 bp, Homo sapiens
gtggaagacagagatggcagagc

SEQ ID NO: 5781749 - DNA, 17 bp, Homo sapiens
gtggaagaggggacagg

SEQ ID NO: 5781750 - DNA, 17 bp, Homo sapiens
gtggaagaggttctcag

SEQ ID NO: 5781751 - DNA, 20 bp, Homo sapiens
gtggaagaggttctcagcaa

SEQ ID NO: 5781752 - DNA, 16 bp, Homo sapiens
gtggaagcaaggctgg

SEQ ID NO: 5781753 - DNA, 16 bp, Homo sapiens
gtggaagcagaggccc

SEQ ID NO: 5781754 - DNA, 21 bp, Homo sapiens
gtggaagcagaggccctgccc

SEQ ID NO: 5781755 - DNA, 22 bp, Homo sapiens
gtggaagcaggttgcttcaaga

SEQ ID NO: 5781756 - DNA, 14 bp, Homo sapiens
gtggaagcatggct

SEQ ID NO: 5781757 - DNA, 16 bp, Homo sapiens
gtggaagccctccttc

SEQ ID NO: 5781758 - DNA, 20 bp, Homo sapiens
gtggaagcctcagaggcctt

SEQ ID NO: 5781759 - DNA, 14 bp, Homo sapiens
gtggaagctgggtg

SEQ ID NO: 5781760 - DNA, 13 bp, Homo sapiens
gtggaagcttcta

SEQ ID NO: 5781761 - DNA, 16 bp, Homo sapiens
gtggaaggaccctgtg

SEQ ID NO: 5781762 - DNA, 21 bp, Homo sapiens
gtggaaggactgtggctgcag

SEQ ID NO: 5781763 - DNA, 15 bp, Homo sapiens
gtggaaggagcctgc

SEQ ID NO: 5781764 - DNA, 23 bp, Homo sapiens
gtggaaggagcctgcggctgctg

SEQ ID NO: 5781765 - DNA, 16 bp, Homo sapiens
gtggaaggcaagccag

SEQ ID NO: 5781766 - DNA, 15 bp, Homo sapiens
gtggaaggcagacag

SEQ ID NO: 5781767 - DNA, 20 bp, Homo sapiens
gtggaaggcatcagtcccta

SEQ ID NO: 5781768 - DNA, 13 bp, Homo sapiens
gtggaagggcagg

SEQ ID NO: 5781769 - DNA, 14 bp, Homo sapiens
gtggaagggcagga

SEQ ID NO: 5781770 - DNA, 15 bp, Homo sapiens
gtggaagggggagga

SEQ ID NO: 5781771 - DNA, 18 bp, Homo sapiens
gtggaagggggtgtgcgt

SEQ ID NO: 5781772 - DNA, 19 bp, Homo sapiens
gtggaagtagtggagcccc

SEQ ID NO: 5781773 - DNA, 17 bp, Homo sapiens
gtggaagtatacctggc

SEQ ID NO: 5781774 - DNA, 18 bp, Homo sapiens
gtggaagtatacctggct

SEQ ID NO: 5781775 - DNA, 13 bp, Homo sapiens
gtggaagtcttgg

SEQ ID NO: 5781776 - DNA, 15 bp, Homo sapiens
gtggaagtgcccagc

SEQ ID NO: 5781777 - DNA, 21 bp, Homo sapiens
gtggaagtgtgggtctgtgtg

SEQ ID NO: 5781778 - DNA, 14 bp, Homo sapiens
gtggaagtgttcct

SEQ ID NO: 5781779 - DNA, 15 bp, Homo sapiens
gtggaagtgttcctg

SEQ ID NO: 5781780 - DNA, 16 bp, Homo sapiens
gtggaagtgttcctgt

SEQ ID NO: 5781781 - DNA, 21 bp, Homo sapiens
gtggaagttcttcaagaggaa

SEQ ID NO: 5781782 - DNA, 22 bp, Homo sapiens
gtggaagttcttcaagaggaaa

SEQ ID NO: 5781783 - DNA, 20 bp, Homo sapiens
gtggaatagtatcctccagg

SEQ ID NO: 5781784 - DNA, 23 bp, Homo sapiens
gtggaatagtatcctccaggttt

SEQ ID NO: 5781785 - DNA, 18 bp, Homo sapiens
gtggaatataaggaaagc

SEQ ID NO: 5781786 - DNA, 22 bp, Homo sapiens
gtggaatccagtgtggctccca

SEQ ID NO: 5781787 - DNA, 18 bp, Homo sapiens
gtggaatgagtgtgcatg

SEQ ID NO: 5781788 - DNA, 17 bp, Homo sapiens
gtggaatgttggataag

SEQ ID NO: 5781789 - DNA, 14 bp, Homo sapiens
gtggaattagagtg

SEQ ID NO: 5781790 - DNA, 20 bp, Homo sapiens
gtggaattattagcaccagc

SEQ ID NO: 5781791 - DNA, 15 bp, Homo sapiens
gtggaattattttaa

SEQ ID NO: 5781792 - DNA, 21 bp, Homo sapiens
gtggaattccaacttgaagga

SEQ ID NO: 5781793 - DNA, 22 bp, Homo sapiens
gtggaattccaacttgaaggat

SEQ ID NO: 5781794 - DNA, 23 bp, Homo sapiens
gtggaatttcttgtttctccaga

SEQ ID NO: 5781795 - DNA, 20 bp, Homo sapiens
gtggaattttgagaaaaata

SEQ ID NO: 5781796 - DNA, 20 bp, Homo sapiens
gtggacaaactggagtctgg

SEQ ID NO: 5781797 - DNA, 16 bp, Homo sapiens
gtggacaagtcatgga

SEQ ID NO: 5781798 - DNA, 20 bp, Homo sapiens
gtggacacaacagcagtctc

SEQ ID NO: 5781799 - DNA, 16 bp, Homo sapiens
gtggacacacacagac

SEQ ID NO: 5781800 - DNA, 22 bp, Homo sapiens
gtggacaccaggagtccctggt

SEQ ID NO: 5781801 - DNA, 16 bp, Homo sapiens
gtggacaccgctcagt

SEQ ID NO: 5781802 - DNA, 11 bp, Homo sapiens
gtggacacctg

SEQ ID NO: 5781803 - DNA, 23 bp, Homo sapiens
gtggacacgcgtgattgaccctt

SEQ ID NO: 5781804 - DNA, 22 bp, Homo sapiens
gtggacagagggagaagggaga

SEQ ID NO: 5781805 - DNA, 14 bp, Homo sapiens
gtggacagcagctg

SEQ ID NO: 5781806 - DNA, 15 bp, Homo sapiens
gtggacagcagctgg

SEQ ID NO: 5781807 - DNA, 15 bp, Homo sapiens
gtggacaggcccagc

SEQ ID NO: 5781808 - DNA, 21 bp, Homo sapiens
gtggacaggcgcctggtgtga

SEQ ID NO: 5781809 - DNA, 21 bp, Homo sapiens
gtggacagggcccccggccac

SEQ ID NO: 5781810 - DNA, 21 bp, Homo sapiens
gtggacatcgtaggcagccac

SEQ ID NO: 5781811 - DNA, 22 bp, Homo sapiens
gtggacatcgtaggcagccacg

SEQ ID NO: 5781812 - DNA, 12 bp, Homo sapiens
gtggacatgcac

SEQ ID NO: 5781813 - DNA, 13 bp, Homo sapiens
gtggacatgcacc

SEQ ID NO: 5781814 - DNA, 17 bp, Homo sapiens
gtggacatgcacccgca

SEQ ID NO: 5781815 - DNA, 18 bp, Homo sapiens
gtggacatgcacccgcat

SEQ ID NO: 5781816 - DNA, 13 bp, Homo sapiens
gtggacatggtca

SEQ ID NO: 5781817 - DNA, 18 bp, Homo sapiens
gtggacatgtgggtggag

SEQ ID NO: 5781818 - DNA, 22 bp, Homo sapiens
gtggaccaaacccttagcagcc

SEQ ID NO: 5781819 - DNA, 22 bp, Homo sapiens
gtggaccacccgccctggcagt

SEQ ID NO: 5781820 - DNA, 14 bp, Homo sapiens
gtggaccaggacag

SEQ ID NO: 5781821 - DNA, 17 bp, Homo sapiens
gtggaccaggcctggag

SEQ ID NO: 5781822 - DNA, 18 bp, Homo sapiens
gtggaccaggcctggagg

SEQ ID NO: 5781823 - DNA, 21 bp, Homo sapiens
gtggaccagttccctcagccc

SEQ ID NO: 5781824 - DNA, 19 bp, Homo sapiens
gtggacccagcgggcaggt

SEQ ID NO: 5781825 - DNA, 12 bp, Homo sapiens
gtggaccctcgc

SEQ ID NO: 5781826 - DNA, 18 bp, Homo sapiens
gtggaccctgtaaataca

SEQ ID NO: 5781827 - DNA, 15 bp, Homo sapiens
gtggaccgtggacag

SEQ ID NO: 5781828 - DNA, 16 bp, Homo sapiens
gtggaccgtggacagg

SEQ ID NO: 5781829 - DNA, 13 bp, Homo sapiens
gtggacctagcct

SEQ ID NO: 5781830 - DNA, 17 bp, Homo sapiens
gtggacctagcctggat

SEQ ID NO: 5781831 - DNA, 18 bp, Homo sapiens
gtggacctagcctggatg

SEQ ID NO: 5781832 - DNA, 18 bp, Homo sapiens
gtggacctcaccagagac

SEQ ID NO: 5781833 - DNA, 23 bp, Homo sapiens
gtggacctgggacaagcaggccg

SEQ ID NO: 5781834 - DNA, 14 bp, Homo sapiens
gtggacctgtgctg

SEQ ID NO: 5781835 - DNA, 15 bp, Homo sapiens
gtggaccttcctgcc

SEQ ID NO: 5781836 - DNA, 21 bp, Homo sapiens
gtggaccttttaaagtgtttc

SEQ ID NO: 5781837 - DNA, 18 bp, Homo sapiens
gtggacgagagggctgtg

SEQ ID NO: 5781838 - DNA, 13 bp, Homo sapiens
gtggacgagggag

SEQ ID NO: 5781839 - DNA, 20 bp, Homo sapiens
gtggacgcaattgtgggatg

SEQ ID NO: 5781840 - DNA, 13 bp, Homo sapiens
gtggacgctgtgc

SEQ ID NO: 5781841 - DNA, 15 bp, Homo sapiens
gtggacgtcacgctc

SEQ ID NO: 5781842 - DNA, 15 bp, Homo sapiens
gtggactaaaagata

SEQ ID NO: 5781843 - DNA, 23 bp, Homo sapiens
gtggactaaaagatataagtgct

SEQ ID NO: 5781844 - DNA, 20 bp, Homo sapiens
gtggactaaatatctgtcat

SEQ ID NO: 5781845 - DNA, 21 bp, Homo sapiens
gtggactagacctccagctgt

SEQ ID NO: 5781846 - DNA, 18 bp, Homo sapiens
gtggactcagaaagccaa

SEQ ID NO: 5781847 - DNA, 16 bp, Homo sapiens
gtggactcagggcagc

SEQ ID NO: 5781848 - DNA, 17 bp, Homo sapiens
gtggactcgcgagaggg

SEQ ID NO: 5781849 - DNA, 13 bp, Homo sapiens
gtggactctctga

SEQ ID NO: 5781850 - DNA, 18 bp, Homo sapiens
gtggactctctgcctgct

SEQ ID NO: 5781851 - DNA, 23 bp, Homo sapiens
gtggactctttggtggctttgca

SEQ ID NO: 5781852 - DNA, 23 bp, Homo sapiens
gtggactgaaccgacttttctaa

SEQ ID NO: 5781853 - DNA, 14 bp, Homo sapiens
gtggactgcattta

SEQ ID NO: 5781854 - DNA, 15 bp, Homo sapiens
gtggactggctgtgc

SEQ ID NO: 5781855 - DNA, 23 bp, Homo sapiens
gtggactgtcctgaggagccctg

SEQ ID NO: 5781856 - DNA, 19 bp, Homo sapiens
gtggactgtgcctcaggcc

SEQ ID NO: 5781857 - DNA, 22 bp, Homo sapiens
gtggactgtggcacttgcctgg

SEQ ID NO: 5781858 - DNA, 13 bp, Homo sapiens
gtggacttctgaa

SEQ ID NO: 5781859 - DNA, 19 bp, Homo sapiens
gtggacttgaactttcctg

SEQ ID NO: 5781860 - DNA, 14 bp, Homo sapiens
gtggacttggagct

SEQ ID NO: 5781861 - DNA, 16 bp, Homo sapiens
gtggacttgtctccca

SEQ ID NO: 5781862 - DNA, 13 bp, Homo sapiens
gtggacttttatt

SEQ ID NO: 5781863 - DNA, 22 bp, Homo sapiens
gtggagaaattccttgattcac

SEQ ID NO: 5781864 - DNA, 16 bp, Homo sapiens
gtggagaacaaagacc

SEQ ID NO: 5781865 - DNA, 22 bp, Homo sapiens
gtggagaactcagtgccacacc

SEQ ID NO: 5781866 - DNA, 20 bp, Homo sapiens
gtggagaagatcgcatggca

SEQ ID NO: 5781867 - DNA, 15 bp, Homo sapiens
gtggagaagcacact

SEQ ID NO: 5781868 - DNA, 15 bp, Homo sapiens
gtggagaagggaggg

SEQ ID NO: 5781869 - DNA, 11 bp, Homo sapiens
gtggagaagtg

SEQ ID NO: 5781870 - DNA, 17 bp, Homo sapiens
gtggagaatcacaggct

SEQ ID NO: 5781871 - DNA, 18 bp, Homo sapiens
gtggagaatcacaggctg

SEQ ID NO: 5781872 - DNA, 21 bp, Homo sapiens
gtggagaatcacaggctgggc

SEQ ID NO: 5781873 - DNA, 16 bp, Homo sapiens
gtggagaatctgaggg

SEQ ID NO: 5781874 - DNA, 21 bp, Homo sapiens
gtggagaatttttactgggga

SEQ ID NO: 5781875 - DNA, 18 bp, Homo sapiens
gtggagacaatgtctgca

SEQ ID NO: 5781876 - DNA, 19 bp, Homo sapiens
gtggagacaatgtctgcag

SEQ ID NO: 5781877 - DNA, 12 bp, Homo sapiens
gtggagacagcc

SEQ ID NO: 5781878 - DNA, 14 bp, Homo sapiens
gtggagacagccct

SEQ ID NO: 5781879 - DNA, 11 bp, Homo sapiens
gtggagacagt

SEQ ID NO: 5781880 - DNA, 23 bp, Homo sapiens
gtggagaccctgccacagccaga

SEQ ID NO: 5781881 - DNA, 19 bp, Homo sapiens
gtggagactgatggccagg

SEQ ID NO: 5781882 - DNA, 14 bp, Homo sapiens
gtggagactgctcc

SEQ ID NO: 5781883 - DNA, 15 bp, Homo sapiens
gtggagactgctcct

SEQ ID NO: 5781884 - DNA, 16 bp, Homo sapiens
gtggagactgcttccc

SEQ ID NO: 5781885 - DNA, 15 bp, Homo sapiens
gtggagactggcagg

SEQ ID NO: 5781886 - DNA, 19 bp, Homo sapiens
gtggagactggggggcttg

SEQ ID NO: 5781887 - DNA, 18 bp, Homo sapiens
gtggagagagcagggcta

SEQ ID NO: 5781888 - DNA, 17 bp, Homo sapiens
gtggagagctggtgccc

SEQ ID NO: 5781889 - DNA, 18 bp, Homo sapiens
gtggagagggaatgtgaa

SEQ ID NO: 5781890 - DNA, 20 bp, Homo sapiens
gtggagagggagactcctgg

SEQ ID NO: 5781891 - DNA, 18 bp, Homo sapiens
gtggagagtgttcctgtt

SEQ ID NO: 5781892 - DNA, 21 bp, Homo sapiens
gtggagagttgggggccagca

SEQ ID NO: 5781893 - DNA, 17 bp, Homo sapiens
gtggagatagtgccagg

SEQ ID NO: 5781894 - DNA, 21 bp, Homo sapiens
gtggagatcacagccccaccc

SEQ ID NO: 5781895 - DNA, 18 bp, Homo sapiens
gtggctcgggaggcgaag

SEQ ID NO: 5781896 - DNA, 18 bp, Homo sapiens
gtggctcgggtgcccagg

SEQ ID NO: 5781897 - DNA, 14 bp, Homo sapiens
gtggctctcagagc

SEQ ID NO: 5781898 - DNA, 20 bp, Homo sapiens
gtggctctcagagcagcaga

SEQ ID NO: 5781899 - DNA, 16 bp, Homo sapiens
gtggctctgccctgga

SEQ ID NO: 5781900 - DNA, 20 bp, Homo sapiens
gtggctctgggatcctgggg

SEQ ID NO: 5781901 - DNA, 19 bp, Homo sapiens
gtggctgaccaggccctgc

SEQ ID NO: 5781902 - DNA, 15 bp, Homo sapiens
gtggctgcaaaacta

SEQ ID NO: 5781903 - DNA, 23 bp, Homo sapiens
gtggctgcagcagcggtggcctc

SEQ ID NO: 5781904 - DNA, 17 bp, Homo sapiens
gtggctgcagcctcagg

SEQ ID NO: 5781905 - DNA, 21 bp, Homo sapiens
gtggctgcaggcaccgctggg

SEQ ID NO: 5781906 - DNA, 16 bp, Homo sapiens
gtggctgccagggggc

SEQ ID NO: 5781907 - DNA, 14 bp, Homo sapiens
gtggctgcctttga

SEQ ID NO: 5781908 - DNA, 21 bp, Homo sapiens
gtggctgcctttgatcacagg

SEQ ID NO: 5781909 - DNA, 22 bp, Homo sapiens
gtggctgcctttgatcacagga

SEQ ID NO: 5781910 - DNA, 18 bp, Homo sapiens
gtggctgcgcccccagct

SEQ ID NO: 5781911 - DNA, 18 bp, Homo sapiens
gtggctgcggcacccttg

SEQ ID NO: 5781912 - DNA, 19 bp, Homo sapiens
gtggctgcgtgcccctgct

SEQ ID NO: 5781913 - DNA, 17 bp, Homo sapiens
gtggctgctagcacttg

SEQ ID NO: 5781914 - DNA, 19 bp, Homo sapiens
gtggctgctagcacttgga

SEQ ID NO: 5781915 - DNA, 15 bp, Homo sapiens
gtggctgctgcccag

SEQ ID NO: 5781916 - DNA, 16 bp, Homo sapiens
gtggctgcttcaagga

SEQ ID NO: 5781917 - DNA, 19 bp, Homo sapiens
gtggctgcttcaaggatcc

SEQ ID NO: 5781918 - DNA, 23 bp, Homo sapiens
gtggctgcttcaaggatcctgag

SEQ ID NO: 5781919 - DNA, 24 bp, Homo sapiens
gtggctggaaccacattgaagaat

SEQ ID NO: 5781920 - DNA, 20 bp, Homo sapiens
gtggctggaagatcctgcgg

SEQ ID NO: 5781921 - DNA, 15 bp, Homo sapiens
gtggctggagcccca

SEQ ID NO: 5781922 - DNA, 23 bp, Homo sapiens
gtggctggagccccatcgcctgg

SEQ ID NO: 5781923 - DNA, 20 bp, Homo sapiens
gtggctggaggagctggcct

SEQ ID NO: 5781924 - DNA, 21 bp, Homo sapiens
gtggctggaggagctggcctg

SEQ ID NO: 5781925 - DNA, 17 bp, Homo sapiens
gtggctggatctgtgag

SEQ ID NO: 5781926 - DNA, 18 bp, Homo sapiens
gtggctggcctttcaggt

SEQ ID NO: 5781927 - DNA, 15 bp, Homo sapiens
gtggctggctctacc

SEQ ID NO: 5781928 - DNA, 12 bp, Homo sapiens
gtggctgggacc

SEQ ID NO: 5781929 - DNA, 20 bp, Homo sapiens
gtggctgggactcctggtgc

SEQ ID NO: 5781930 - DNA, 20 bp, Homo sapiens
gtggctgggcccagcagggg

SEQ ID NO: 5781931 - DNA, 13 bp, Homo sapiens
gtggctgggctgc

SEQ ID NO: 5781932 - DNA, 13 bp, Homo sapiens
gtggctggggcat

SEQ ID NO: 5781933 - DNA, 16 bp, Homo sapiens
gtggctggggctggca

SEQ ID NO: 5781934 - DNA, 16 bp, Homo sapiens
gtggctgggtgccctc

SEQ ID NO: 5781935 - DNA, 12 bp, Homo sapiens
gtggctgggtgg

SEQ ID NO: 5781936 - DNA, 19 bp, Homo sapiens
gtggctgggtgggcccaga

SEQ ID NO: 5781937 - DNA, 18 bp, Homo sapiens
gtggctgggtttacacgc

SEQ ID NO: 5781938 - DNA, 12 bp, Homo sapiens
gtggctggtctg

SEQ ID NO: 5781939 - DNA, 15 bp, Homo sapiens
gtggctggtctggag

SEQ ID NO: 5781940 - DNA, 17 bp, Homo sapiens
gtggctggtgagacccc

SEQ ID NO: 5781941 - DNA, 19 bp, Homo sapiens
gtggctggtgcccatgaag

SEQ ID NO: 5781942 - DNA, 19 bp, Homo sapiens
gtggctggtggtcatgaat

SEQ ID NO: 5781943 - DNA, 16 bp, Homo sapiens
gtggctggtgtcccct

SEQ ID NO: 5781944 - DNA, 23 bp, Homo sapiens
gtggctggtgtccccttcccctg

SEQ ID NO: 5781945 - DNA, 22 bp, Homo sapiens
gtggctgtcaaatccatgtgtc

SEQ ID NO: 5781946 - DNA, 15 bp, Homo sapiens
gtggctgtccagtgc

SEQ ID NO: 5781947 - DNA, 18 bp, Homo sapiens
gtggctgtccagtgccca

SEQ ID NO: 5781948 - DNA, 19 bp, Homo sapiens
gtggctgtccagtgcccat

SEQ ID NO: 5781949 - DNA, 16 bp, Homo sapiens
gtggctgtccctgtgg

SEQ ID NO: 5781950 - DNA, 23 bp, Homo sapiens
gtggctgtcctcttaagacacta

SEQ ID NO: 5781951 - DNA, 13 bp, Homo sapiens
gtggctgtctgga

SEQ ID NO: 5781952 - DNA, 15 bp, Homo sapiens
gtggctgtctggaaa

SEQ ID NO: 5781953 - DNA, 13 bp, Homo sapiens
gtggctgtgatta

SEQ ID NO: 5781954 - DNA, 13 bp, Homo sapiens
gtggctgtttctt

SEQ ID NO: 5781955 - DNA, 20 bp, Homo sapiens
gtggcttactacatgtggga

SEQ ID NO: 5781956 - DNA, 16 bp, Homo sapiens
gtggcttagctgccat

SEQ ID NO: 5781957 - DNA, 23 bp, Homo sapiens
gtggcttcactcctgctgtaaat

SEQ ID NO: 5781958 - DNA, 12 bp, Homo sapiens
gtggcttcatgt

SEQ ID NO: 5781959 - DNA, 20 bp, Homo sapiens
gtggcttcattagagcaggc

SEQ ID NO: 5781960 - DNA, 21 bp, Homo sapiens
gtggcttcattagagcaggcg

SEQ ID NO: 5781961 - DNA, 18 bp, Homo sapiens
gtggcttcccgctcagcc

SEQ ID NO: 5781962 - DNA, 20 bp, Homo sapiens
gtggcttcccgctcagccct

SEQ ID NO: 5781963 - DNA, 21 bp, Homo sapiens
gtggcttcccgctcagccctc

SEQ ID NO: 5781964 - DNA, 12 bp, Homo sapiens
gtggcttctcca

SEQ ID NO: 5781965 - DNA, 13 bp, Homo sapiens
gtggcttctccca

SEQ ID NO: 5781966 - DNA, 16 bp, Homo sapiens
gtggcttctccttggc

SEQ ID NO: 5781967 - DNA, 13 bp, Homo sapiens
gtggcttctcttt

SEQ ID NO: 5781968 - DNA, 23 bp, Homo sapiens
gtggcttgctttcttctcctgtg

SEQ ID NO: 5781969 - DNA, 19 bp, Homo sapiens
gtggcttggcatctgtgtg

SEQ ID NO: 5781970 - DNA, 24 bp, Homo sapiens
gtggcttgggacatggcacaggcc

SEQ ID NO: 5781971 - DNA, 15 bp, Homo sapiens
gtggctttaattgta

SEQ ID NO: 5781972 - DNA, 18 bp, Homo sapiens
gtggctttaattgtataa

SEQ ID NO: 5781973 - DNA, 17 bp, Homo sapiens
gtggctttcaaggctgg

SEQ ID NO: 5781974 - DNA, 21 bp, Homo sapiens
gtggctttcaaggctggggca

SEQ ID NO: 5781975 - DNA, 18 bp, Homo sapiens
gtggctttcagcctctgg

SEQ ID NO: 5781976 - DNA, 15 bp, Homo sapiens
gtggctttcatttct

SEQ ID NO: 5781977 - DNA, 18 bp, Homo sapiens
gtggctttcatttcttat

SEQ ID NO: 5781978 - DNA, 23 bp, Homo sapiens
gtggctttccaggcaccctcagg

SEQ ID NO: 5781979 - DNA, 23 bp, Homo sapiens
gtggctttccttgtggcagagga

SEQ ID NO: 5781980 - DNA, 23 bp, Homo sapiens
gtggcttttctggaatggaattg

SEQ ID NO: 5781981 - DNA, 13 bp, Homo sapiens
gtgggaaatatgc

SEQ ID NO: 5781982 - DNA, 14 bp, Homo sapiens
gtgggaactgtgca

SEQ ID NO: 5781983 - DNA, 23 bp, Homo sapiens
gtgggaactgtgcaaagggctgc

SEQ ID NO: 5781984 - DNA, 22 bp, Homo sapiens
gtgggaagaccaaaggaaggaa

SEQ ID NO: 5781985 - DNA, 13 bp, Homo sapiens
gtgggaaggccag

SEQ ID NO: 5781986 - DNA, 21 bp, Homo sapiens
gtgggaatgtggtagtaccca

SEQ ID NO: 5781987 - DNA, 21 bp, Homo sapiens
gtgggaatgttctttctgctc

SEQ ID NO: 5781988 - DNA, 13 bp, Homo sapiens
gtgggacaccctg

SEQ ID NO: 5781989 - DNA, 17 bp, Homo sapiens
gtgggacagacagcagc

SEQ ID NO: 5781990 - DNA, 15 bp, Homo sapiens
gtgggacagagtctg

SEQ ID NO: 5781991 - DNA, 13 bp, Homo sapiens
gtgggacagccca

SEQ ID NO: 5781992 - DNA, 18 bp, Homo sapiens
gtgggacagcccagagcc

SEQ ID NO: 5781993 - DNA, 14 bp, Homo sapiens
gtgggacagcccca

SEQ ID NO: 5781994 - DNA, 13 bp, Homo sapiens
gtgggacaggctc

SEQ ID NO: 5781995 - DNA, 14 bp, Homo sapiens
gtgggacagggagg

SEQ ID NO: 5781996 - DNA, 15 bp, Homo sapiens
gtgggacagggcttc

SEQ ID NO: 5781997 - DNA, 21 bp, Homo sapiens
gtgggacagtcacctcatgga

SEQ ID NO: 5781998 - DNA, 23 bp, Homo sapiens
gtgggacagttcctgagaccagc

SEQ ID NO: 5781999 - DNA, 21 bp, Homo sapiens
gtgggacccaggctcccagcc

SEQ ID NO: 5782000 - DNA, 22 bp, Homo sapiens
gtgggacccatagatcttctga

SEQ ID NO: 5782001 - DNA, 14 bp, Homo sapiens
gtgggaccccaggc

SEQ ID NO: 5782002 - DNA, 19 bp, Homo sapiens
gtgggaccgcctggccctc

SEQ ID NO: 5782003 - DNA, 15 bp, Homo sapiens
gtgggacctgggcca

SEQ ID NO: 5782004 - DNA, 19 bp, Homo sapiens
gtgggactcatccttgccc

SEQ ID NO: 5782005 - DNA, 15 bp, Homo sapiens
gtgggactgtacaca

SEQ ID NO: 5782006 - DNA, 22 bp, Homo sapiens
gtgggactgtacacactttatt

SEQ ID NO: 5782007 - DNA, 23 bp, Homo sapiens
gtgggacttggagagcaaaggcc

SEQ ID NO: 5782008 - DNA, 13 bp, Homo sapiens
gtgggagaaggga

SEQ ID NO: 5782009 - DNA, 15 bp, Homo sapiens
gtgggagaagggaca

SEQ ID NO: 5782010 - DNA, 14 bp, Homo sapiens
gtgggagacaagga

SEQ ID NO: 5782011 - DNA, 15 bp, Homo sapiens
gtgggagacagcagc

SEQ ID NO: 5782012 - DNA, 19 bp, Homo sapiens
gtgggagacagcagcctgt

SEQ ID NO: 5782013 - DNA, 19 bp, Homo sapiens
gtgggagagacactcccag

SEQ ID NO: 5782014 - DNA, 21 bp, Homo sapiens
gtgggagagacactcccaggg

SEQ ID NO: 5782015 - DNA, 16 bp, Homo sapiens
gtgggagaggaagcca

SEQ ID NO: 5782016 - DNA, 21 bp, Homo sapiens
gtgggagaggagaggctgctg

SEQ ID NO: 5782017 - DNA, 13 bp, Homo sapiens
gtgggagaggcag

SEQ ID NO: 5782018 - DNA, 14 bp, Homo sapiens
gtgggagaggctgg

SEQ ID NO: 5782019 - DNA, 18 bp, Homo sapiens
gtgggagaggctgggagg

SEQ ID NO: 5782020 - DNA, 19 bp, Homo sapiens
gtgggagcagcggtttggg

SEQ ID NO: 5782021 - DNA, 13 bp, Homo sapiens
gtgggagcagctt

SEQ ID NO: 5782022 - DNA, 12 bp, Homo sapiens
gtgggagcagga

SEQ ID NO: 5782023 - DNA, 22 bp, Homo sapiens
gtgggagccaatactgagtgcc

SEQ ID NO: 5782024 - DNA, 21 bp, Homo sapiens
gtgggagccaccactcctgcc

SEQ ID NO: 5782025 - DNA, 23 bp, Homo sapiens
gtgggagccaccactcctgcctg

SEQ ID NO: 5782026 - DNA, 19 bp, Homo sapiens
gtgggagcccagcacactg

SEQ ID NO: 5782027 - DNA, 19 bp, Homo sapiens
gtgggagccgcagagcctg

SEQ ID NO: 5782028 - DNA, 12 bp, Homo sapiens
gtgggagctcag

SEQ ID NO: 5782029 - DNA, 13 bp, Homo sapiens
gtgggagctgagc

SEQ ID NO: 5782030 - DNA, 18 bp, Homo sapiens
gtgggagctgcctgttca

SEQ ID NO: 5782031 - DNA, 19 bp, Homo sapiens
gtgggaggaaagggcctgg

SEQ ID NO: 5782032 - DNA, 21 bp, Homo sapiens
gtgggaggaaagggcctggcc

SEQ ID NO: 5782033 - DNA, 12 bp, Homo sapiens
gtgggaggacag

SEQ ID NO: 5782034 - DNA, 15 bp, Homo sapiens
gtgggaggagatgaa

SEQ ID NO: 5782035 - DNA, 14 bp, Homo sapiens
gtgggaggaggcct

SEQ ID NO: 5782036 - DNA, 12 bp, Homo sapiens
gtgggaggcccg

SEQ ID NO: 5782037 - DNA, 19 bp, Homo sapiens
gtgggagggagcagacagg

SEQ ID NO: 5782038 - DNA, 22 bp, Homo sapiens
gtgggagggcgtcaggcagagg

SEQ ID NO: 5782039 - DNA, 11 bp, Homo sapiens
gtgggagggga

SEQ ID NO: 5782040 - DNA, 12 bp, Homo sapiens
gtgggaggggaa

SEQ ID NO: 5782041 - DNA, 13 bp, Homo sapiens
gtgggaggggcag

SEQ ID NO: 5782042 - DNA, 15 bp, Homo sapiens
gtgggaggggcaggc

SEQ ID NO: 5782043 - DNA, 17 bp, Homo sapiens
gtgggaggggcaggctg

SEQ ID NO: 5782044 - DNA, 21 bp, Homo sapiens
gtgggaggggtgttccaaaga

SEQ ID NO: 5782045 - DNA, 15 bp, Homo sapiens
gtgggagggtaccag

SEQ ID NO: 5782046 - DNA, 13 bp, Homo sapiens
gtgggaggtcagg

SEQ ID NO: 5782047 - DNA, 15 bp, Homo sapiens
gtgggagtcatctca

SEQ ID NO: 5782048 - DNA, 15 bp, Homo sapiens
gtgggagtgggagag

SEQ ID NO: 5782049 - DNA, 14 bp, Homo sapiens
gtgggagtgggccc

SEQ ID NO: 5782050 - DNA, 17 bp, Homo sapiens
gtgggagtgtgtgcctg

SEQ ID NO: 5782051 - DNA, 16 bp, Homo sapiens
gtgggatcaaagctag

SEQ ID NO: 5782052 - DNA, 21 bp, Homo sapiens
gtgggatcaaagctaggaaag

SEQ ID NO: 5782053 - DNA, 22 bp, Homo sapiens
gtgggatcattgcatttccaga

SEQ ID NO: 5782054 - DNA, 18 bp, Homo sapiens
gtgggatccacttcttgg

SEQ ID NO: 5782055 - DNA, 17 bp, Homo sapiens
gtgggatccagagagaa

SEQ ID NO: 5782056 - DNA, 20 bp, Homo sapiens
gtgggatccagagagaagca

SEQ ID NO: 5782057 - DNA, 13 bp, Homo sapiens
gtgggatcctcca

SEQ ID NO: 5782058 - DNA, 18 bp, Homo sapiens
gtgggatcctccaggtgc

SEQ ID NO: 5782059 - DNA, 16 bp, Homo sapiens
gtgggatcctccctca

SEQ ID NO: 5782060 - DNA, 18 bp, Homo sapiens
gtgggatctgcccctccc

SEQ ID NO: 5782061 - DNA, 15 bp, Homo sapiens
gtgggatctggggag

SEQ ID NO: 5782062 - DNA, 16 bp, Homo sapiens
gtgggatgaaccagcc

SEQ ID NO: 5782063 - DNA, 17 bp, Homo sapiens
gtgggatgaaccagccg

SEQ ID NO: 5782064 - DNA, 14 bp, Homo sapiens
gtgggatgctgaag

SEQ ID NO: 5782065 - DNA, 14 bp, Homo sapiens
gtgggatggaggag

SEQ ID NO: 5782066 - DNA, 14 bp, Homo sapiens
gtgggatgggcagg

SEQ ID NO: 5782067 - DNA, 20 bp, Homo sapiens
gtgggatgtggttttcttaa

SEQ ID NO: 5782068 - DNA, 16 bp, Homo sapiens
gtgggattacaggtgt

SEQ ID NO: 5782069 - DNA, 22 bp, Homo sapiens
gtgggattatgggtcacaggaa

SEQ ID NO: 5782070 - DNA, 17 bp, Homo sapiens
gtgggattcaggaatgg

SEQ ID NO: 5782071 - DNA, 20 bp, Homo sapiens
gtgggatttccagaaccaca

SEQ ID NO: 5782072 - DNA, 21 bp, Homo sapiens
gtgggatttggggcctcaaga

SEQ ID NO: 5782073 - DNA, 16 bp, Homo sapiens
gtggtaactgccagcc

SEQ ID NO: 5782074 - DNA, 18 bp, Homo sapiens
gtggtaacttctttgaag

SEQ ID NO: 5782075 - DNA, 14 bp, Homo sapiens
gtggtaacttgaga

SEQ ID NO: 5782076 - DNA, 17 bp, Homo sapiens
gtggtaatctacaccaa

SEQ ID NO: 5782077 - DNA, 18 bp, Homo sapiens
gtggtaattctatttgta

SEQ ID NO: 5782078 - DNA, 17 bp, Homo sapiens
gtggtacaaatgtgata

SEQ ID NO: 5782079 - DNA, 20 bp, Homo sapiens
gtggtacaatctggctcact

SEQ ID NO: 5782080 - DNA, 13 bp, Homo sapiens
gtggtacagagaa

SEQ ID NO: 5782081 - DNA, 15 bp, Homo sapiens
gtggtacagagaagc

SEQ ID NO: 5782082 - DNA, 16 bp, Homo sapiens
gtggtacagagaagcc

SEQ ID NO: 5782083 - DNA, 17 bp, Homo sapiens
gtggtacagagaagcca

SEQ ID NO: 5782084 - DNA, 18 bp, Homo sapiens
gtggtacagagaagccag

SEQ ID NO: 5782085 - DNA, 14 bp, Homo sapiens
gtggtacaggaagg

SEQ ID NO: 5782086 - DNA, 23 bp, Homo sapiens
gtggtacccaggctttagcatta

SEQ ID NO: 5782087 - DNA, 14 bp, Homo sapiens
gtggtaccctctgg

SEQ ID NO: 5782088 - DNA, 17 bp, Homo sapiens
gtggtaccttcagccct

SEQ ID NO: 5782089 - DNA, 20 bp, Homo sapiens
gtggtaccttcagccctggc

SEQ ID NO: 5782090 - DNA, 12 bp, Homo sapiens
gtggtactctga

SEQ ID NO: 5782091 - DNA, 22 bp, Homo sapiens
gtggtactctgtgtctggcagg

SEQ ID NO: 5782092 - DNA, 20 bp, Homo sapiens
gtggtacttaagctcccctg

SEQ ID NO: 5782093 - DNA, 22 bp, Homo sapiens
gtggtacttaagctcccctgcc

SEQ ID NO: 5782094 - DNA, 22 bp, Homo sapiens
gtggtacttggcaccaataaag

SEQ ID NO: 5782095 - DNA, 21 bp, Homo sapiens
gtggtactttattcttgctgg

SEQ ID NO: 5782096 - DNA, 13 bp, Homo sapiens
gtggtagaaacaa

SEQ ID NO: 5782097 - DNA, 13 bp, Homo sapiens
gtggtagaggcct

SEQ ID NO: 5782098 - DNA, 17 bp, Homo sapiens
gtggtagagtgtgcctg

SEQ ID NO: 5782099 - DNA, 14 bp, Homo sapiens
gtggtagcaggaaa

SEQ ID NO: 5782100 - DNA, 13 bp, Homo sapiens
gtggtagctccag

SEQ ID NO: 5782101 - DNA, 15 bp, Homo sapiens
gtggtagctctgagc

SEQ ID NO: 5782102 - DNA, 19 bp, Homo sapiens
gtggtagctctgagccctc

SEQ ID NO: 5782103 - DNA, 17 bp, Homo sapiens
gtggtaggcctataaaa

SEQ ID NO: 5782104 - DNA, 23 bp, Homo sapiens
gtggtaggccttttaacattttg

SEQ ID NO: 5782105 - DNA, 19 bp, Homo sapiens
gtggtagtcctcccaagct

SEQ ID NO: 5782106 - DNA, 24 bp, Homo sapiens
gtggtagtcctcccaagctgtgct

SEQ ID NO: 5782107 - DNA, 23 bp, Homo sapiens
gtggtatacatgtgtacatatat

SEQ ID NO: 5782108 - DNA, 13 bp, Homo sapiens
gtggtatatacaa

SEQ ID NO: 5782109 - DNA, 19 bp, Homo sapiens
gtggtatatttgtgtatgt

SEQ ID NO: 5782110 - DNA, 14 bp, Homo sapiens
gtggtatcttgcag

SEQ ID NO: 5782111 - DNA, 19 bp, Homo sapiens
gtggtatctttaattgtat

SEQ ID NO: 5782112 - DNA, 12 bp, Homo sapiens
gtggtatgaggg

SEQ ID NO: 5782113 - DNA, 17 bp, Homo sapiens
gtggtatgagggggtgg

SEQ ID NO: 5782114 - DNA, 16 bp, Homo sapiens
gtggtatgtatgggag

SEQ ID NO: 5782115 - DNA, 13 bp, Homo sapiens
gtggtattctgtc

SEQ ID NO: 5782116 - DNA, 14 bp, Homo sapiens
gtggtattctgtca

SEQ ID NO: 5782117 - DNA, 23 bp, Homo sapiens
gtggtattggccgatgagctggt

SEQ ID NO: 5782118 - DNA, 23 bp, Homo sapiens
gtggtatttgctgtcacatagtt

SEQ ID NO: 5782119 - DNA, 14 bp, Homo sapiens
gtggtatttttata

SEQ ID NO: 5782120 - DNA, 16 bp, Homo sapiens
gtggtcacagcggagg

SEQ ID NO: 5782121 - DNA, 13 bp, Homo sapiens
gtggtcaccttcg

SEQ ID NO: 5782122 - DNA, 15 bp, Homo sapiens
gtggtcactgctgtc

SEQ ID NO: 5782123 - DNA, 20 bp, Homo sapiens
gtggtcactggtcagggcag

SEQ ID NO: 5782124 - DNA, 21 bp, Homo sapiens
gtggtcactggtcagggcagt

SEQ ID NO: 5782125 - DNA, 14 bp, Homo sapiens
gtggtcactgtgca

SEQ ID NO: 5782126 - DNA, 21 bp, Homo sapiens
gtggtcactgtgcactgccct

SEQ ID NO: 5782127 - DNA, 23 bp, Homo sapiens
gtggtcagagagggaagctgagg

SEQ ID NO: 5782128 - DNA, 23 bp, Homo sapiens
gtggtcagcagaaacccccagga

SEQ ID NO: 5782129 - DNA, 22 bp, Homo sapiens
gtggtcagcagatgccagtgaa

SEQ ID NO: 5782130 - DNA, 17 bp, Homo sapiens
gtggtcagcgattcctg

SEQ ID NO: 5782131 - DNA, 15 bp, Homo sapiens
gtggtcaggcccagc

SEQ ID NO: 5782132 - DNA, 18 bp, Homo sapiens
gtggtcagggcagggctc

SEQ ID NO: 5782133 - DNA, 12 bp, Homo sapiens
gtggtcatgctc

SEQ ID NO: 5782134 - DNA, 16 bp, Homo sapiens
gtggtcatgctcagcc

SEQ ID NO: 5782135 - DNA, 18 bp, Homo sapiens
gtggtcatgctcagcctt

SEQ ID NO: 5782136 - DNA, 20 bp, Homo sapiens
gtggtcatgctcagccttgc

SEQ ID NO: 5782137 - DNA, 12 bp, Homo sapiens
gtggtccaaata

SEQ ID NO: 5782138 - DNA, 22 bp, Homo sapiens
gtggtccacaagcttctgtcct

SEQ ID NO: 5782139 - DNA, 18 bp, Homo sapiens
gtggtccagcgtcactcc

SEQ ID NO: 5782140 - DNA, 20 bp, Homo sapiens
gtggtccagcgtcactccag

SEQ ID NO: 5782141 - DNA, 21 bp, Homo sapiens
gtggtcccgaggaagggccag

SEQ ID NO: 5782142 - DNA, 17 bp, Homo sapiens
gtggtccctccactagg

SEQ ID NO: 5782143 - DNA, 18 bp, Homo sapiens
gtggtcctaatcttctga

SEQ ID NO: 5782144 - DNA, 20 bp, Homo sapiens
gtggtcctcctatctccctg

SEQ ID NO: 5782145 - DNA, 12 bp, Homo sapiens
gtggtcctgact

SEQ ID NO: 5782146 - DNA, 20 bp, Homo sapiens
gtggtcgtcaactttcctca

SEQ ID NO: 5782147 - DNA, 19 bp, Homo sapiens
gtggtctagaccagggctg

SEQ ID NO: 5782148 - DNA, 11 bp, Homo sapiens
gtggtctcagg

SEQ ID NO: 5782149 - DNA, 13 bp, Homo sapiens
gtggtctccagct

SEQ ID NO: 5782150 - DNA, 16 bp, Homo sapiens
gtggtctcctctcagc

SEQ ID NO: 5782151 - DNA, 18 bp, Homo sapiens
gtggtctcctctcagctt

SEQ ID NO: 5782152 - DNA, 17 bp, Homo sapiens
gtggtctccttggaaat

SEQ ID NO: 5782153 - DNA, 19 bp, Homo sapiens
gtggtctcgatgctgctgg

SEQ ID NO: 5782154 - DNA, 20 bp, Homo sapiens
gtggtctcttcttggggccc

SEQ ID NO: 5782155 - DNA, 23 bp, Homo sapiens
gtggtctcttcttggggcccagt

SEQ ID NO: 5782156 - DNA, 19 bp, Homo sapiens
gtggtctgaactgcttgct

SEQ ID NO: 5782157 - DNA, 13 bp, Homo sapiens
gtggtctgaatgt

SEQ ID NO: 5782158 - DNA, 18 bp, Homo sapiens
gtggtctgaatgttctga

SEQ ID NO: 5782159 - DNA, 20 bp, Homo sapiens
gtggtctgaatgttctgaca

SEQ ID NO: 5782160 - DNA, 23 bp, Homo sapiens
gtggtctgaatgttctgacatta

SEQ ID NO: 5782161 - DNA, 20 bp, Homo sapiens
gtggtctgagctgtcccaag

SEQ ID NO: 5782162 - DNA, 14 bp, Homo sapiens
gtggtctgcaggca

SEQ ID NO: 5782163 - DNA, 16 bp, Homo sapiens
gtggtctgcaggcagg

SEQ ID NO: 5782164 - DNA, 14 bp, Homo sapiens
gtggtctgccaatc

SEQ ID NO: 5782165 - DNA, 16 bp, Homo sapiens
gtggtctgtggatcag

SEQ ID NO: 5782166 - DNA, 13 bp, Homo sapiens
gtggtctgtgtgt

SEQ ID NO: 5782167 - DNA, 15 bp, Homo sapiens
gtggtctgtgtgtga

SEQ ID NO: 5782168 - DNA, 21 bp, Homo sapiens
gtggtctgttggcaggctggc

SEQ ID NO: 5782169 - DNA, 18 bp, Homo sapiens
gtggtcttcaagcctggc

SEQ ID NO: 5782170 - DNA, 15 bp, Homo sapiens
gtggtcttctccacc

SEQ ID NO: 5782171 - DNA, 18 bp, Homo sapiens
gtggtcttggagaggagg

SEQ ID NO: 5782172 - DNA, 17 bp, Homo sapiens
gtggtctttctggagag

SEQ ID NO: 5782173 - DNA, 11 bp, Homo sapiens
gtggtctttga

SEQ ID NO: 5782174 - DNA, 16 bp, Homo sapiens
gtggtctttgaataaa

SEQ ID NO: 5782175 - DNA, 17 bp, Homo sapiens
gtggtctttgaataaag

SEQ ID NO: 5782176 - DNA, 15 bp, Homo sapiens
gtggtctttgtaaga

SEQ ID NO: 5782177 - DNA, 14 bp, Homo sapiens
gtggtcttttcctc

SEQ ID NO: 5782178 - DNA, 23 bp, Homo sapiens
gtggtgaaaagcaggttgataaa

SEQ ID NO: 5782179 - DNA, 18 bp, Homo sapiens
gtggtgaaggggctggtg

SEQ ID NO: 5782180 - DNA, 18 bp, Homo sapiens
gtggtgaccccaggaggg

SEQ ID NO: 5782181 - DNA, 23 bp, Homo sapiens
gtggtgacctcacacacctctgc

SEQ ID NO: 5782182 - DNA, 13 bp, Homo sapiens
gtggtgactttgg

SEQ ID NO: 5782183 - DNA, 13 bp, Homo sapiens
gtggtgagcaagc

SEQ ID NO: 5782184 - DNA, 23 bp, Homo sapiens
gtggtgagcagaagtggagctgg

SEQ ID NO: 5782185 - DNA, 20 bp, Homo sapiens
gtggtgaggggccactgggc

SEQ ID NO: 5782186 - DNA, 22 bp, Homo sapiens
gtggtgaggggctttctcttcc

SEQ ID NO: 5782187 - DNA, 20 bp, Homo sapiens
gtggtgatcgcacaaggaca

SEQ ID NO: 5782188 - DNA, 18 bp, Homo sapiens
gtggtgatttgaaaaata

SEQ ID NO: 5782189 - DNA, 21 bp, Homo sapiens
gtggtgatttgaaaaatataa

SEQ ID NO: 5782190 - DNA, 19 bp, Homo sapiens
gtggtgcagccttcccctc

SEQ ID NO: 5782191 - DNA, 20 bp, Homo sapiens
gtggtgcagccttcccctcc

SEQ ID NO: 5782192 - DNA, 18 bp, Homo sapiens
gtggtgccatcattgctg

SEQ ID NO: 5782193 - DNA, 21 bp, Homo sapiens
gtggtgcgtttataattggct

SEQ ID NO: 5782194 - DNA, 14 bp, Homo sapiens
gtggtggagccagt

SEQ ID NO: 5782195 - DNA, 16 bp, Homo sapiens
gtggtggaggaggagg

SEQ ID NO: 5782196 - DNA, 22 bp, Homo sapiens
gtggtggaggggcgcccagggt

SEQ ID NO: 5782197 - DNA, 20 bp, Homo sapiens
gtggtggagggggctgggct

SEQ ID NO: 5782198 - DNA, 21 bp, Homo sapiens
gtggtggagggggctgggctc

SEQ ID NO: 5782199 - DNA, 17 bp, Homo sapiens
gtggtggagtggagtga

SEQ ID NO: 5782200 - DNA, 20 bp, Homo sapiens
gtggtggatctgtccaagga

SEQ ID NO: 5782201 - DNA, 16 bp, Homo sapiens
gtggtggcacaggccc

SEQ ID NO: 5782202 - DNA, 23 bp, Homo sapiens
gtggtggcaggcacctgtagtcc

SEQ ID NO: 5782203 - DNA, 21 bp, Homo sapiens
gtggtggcagggcctagctgc

SEQ ID NO: 5782204 - DNA, 22 bp, Homo sapiens
gtggtggcagtgcagcaaccag

SEQ ID NO: 5782205 - DNA, 23 bp, Homo sapiens
gtggtggcatacgcctgtagtcc

SEQ ID NO: 5782206 - DNA, 13 bp, Homo sapiens
gtggtggcctggt

SEQ ID NO: 5782207 - DNA, 14 bp, Homo sapiens
gtggtggctcggga

SEQ ID NO: 5782208 - DNA, 15 bp, Homo sapiens
gtggtggctctgaga

SEQ ID NO: 5782209 - DNA, 16 bp, Homo sapiens
gtggtggctgtctctg

SEQ ID NO: 5782210 - DNA, 14 bp, Homo sapiens
gtggtgggcgctgg

SEQ ID NO: 5782211 - DNA, 16 bp, Homo sapiens
gtggtgggcggggaga

SEQ ID NO: 5782212 - DNA, 19 bp, Homo sapiens
gtggtgggcttctgcgtcc

SEQ ID NO: 5782213 - DNA, 23 bp, Homo sapiens
gtggtgggggaggagcctctggc

SEQ ID NO: 5782214 - DNA, 20 bp, Homo sapiens
gtggtggtaaccctggtggt

SEQ ID NO: 5782215 - DNA, 18 bp, Homo sapiens
gtggtggtagaaatgatt

SEQ ID NO: 5782216 - DNA, 15 bp, Homo sapiens
gtggtggtccctggg

SEQ ID NO: 5782217 - DNA, 20 bp, Homo sapiens
gtggtggtgaaggggctggt

SEQ ID NO: 5782218 - DNA, 12 bp, Homo sapiens
gtggtggtgcta

SEQ ID NO: 5782219 - DNA, 15 bp, Homo sapiens
gtggtggtggtgaag

SEQ ID NO: 5782220 - DNA, 14 bp, Homo sapiens
gtggtggtgttttt

SEQ ID NO: 5782221 - DNA, 20 bp, Homo sapiens
gtggtggttcattccacagg

SEQ ID NO: 5782222 - DNA, 17 bp, Homo sapiens
gtggtgtaaagctggcc

SEQ ID NO: 5782223 - DNA, 18 bp, Homo sapiens
gtggtgtaaagctggccc

SEQ ID NO: 5782224 - DNA, 22 bp, Homo sapiens
gtggtgtaaagctggccctgcc

SEQ ID NO: 5782225 - DNA, 15 bp, Homo sapiens
gtggtgtatttgaga

SEQ ID NO: 5782226 - DNA, 21 bp, Homo sapiens
gtggtgtattttttaaaaaat

SEQ ID NO: 5782227 - DNA, 18 bp, Homo sapiens
gtggtgtcactgtccctc

SEQ ID NO: 5782228 - DNA, 19 bp, Homo sapiens
gtggtgtcactgtccctcc

SEQ ID NO: 5782229 - DNA, 13 bp, Homo sapiens
gtggtgtccttct

SEQ ID NO: 5782230 - DNA, 16 bp, Homo sapiens
gtggtgtcgtctgtga

SEQ ID NO: 5782231 - DNA, 14 bp, Homo sapiens
gtggtgtgatctta

SEQ ID NO: 5782232 - DNA, 21 bp, Homo sapiens
gtggtgtgtccctggacacag

SEQ ID NO: 5782233 - DNA, 14 bp, Homo sapiens
gtggtgtgtgaagt

SEQ ID NO: 5782234 - DNA, 14 bp, Homo sapiens
gtggtgttcctgaa

SEQ ID NO: 5782235 - DNA, 16 bp, Homo sapiens
gtggtgtttcctggca

SEQ ID NO: 5782236 - DNA, 17 bp, Homo sapiens
gtggtgtttgtaggctg

SEQ ID NO: 5782237 - DNA, 20 bp, Homo sapiens
gtggtgtttgtaggctgtgg

SEQ ID NO: 5782238 - DNA, 23 bp, Homo sapiens
gtggttaatgccatggacagaag

SEQ ID NO: 5782239 - DNA, 21 bp, Homo sapiens
gtggttaccgagtatctgtaa

SEQ ID NO: 5782240 - DNA, 14 bp, Homo sapiens
gtggttaggcagca

SEQ ID NO: 5782241 - DNA, 14 bp, Homo sapiens
gtggttatgtccca

SEQ ID NO: 5782242 - DNA, 16 bp, Homo sapiens
gtggttatgtcccatg

SEQ ID NO: 5782243 - DNA, 20 bp, Homo sapiens
gtggttattggactccaggc

SEQ ID NO: 5782244 - DNA, 14 bp, Homo sapiens
gtggttatttctca

SEQ ID NO: 5782245 - DNA, 17 bp, Homo sapiens
gtggttcaagcacactg

SEQ ID NO: 5782246 - DNA, 20 bp, Homo sapiens
gtggttcaatacctgtttag

SEQ ID NO: 5782247 - DNA, 21 bp, Homo sapiens
gtggttcagagactggcagcc

SEQ ID NO: 5782248 - DNA, 17 bp, Homo sapiens
gtggttcattccacagg

SEQ ID NO: 5782249 - DNA, 18 bp, Homo sapiens
gtggttcattccacagga

SEQ ID NO: 5782250 - DNA, 18 bp, Homo sapiens
gtgtcccaaggagctgat

SEQ ID NO: 5782251 - DNA, 18 bp, Homo sapiens
gtgtcccagaagatgact

SEQ ID NO: 5782252 - DNA, 14 bp, Homo sapiens
gtgtcccagccacg

SEQ ID NO: 5782253 - DNA, 22 bp, Homo sapiens
gtgtcccagccacgcagggcca

SEQ ID NO: 5782254 - DNA, 21 bp, Homo sapiens
gtgtcccattcccccagtgcg

SEQ ID NO: 5782255 - DNA, 14 bp, Homo sapiens
gtgtccccaacgtc

SEQ ID NO: 5782256 - DNA, 13 bp, Homo sapiens
gtgtccccaccat

SEQ ID NO: 5782257 - DNA, 17 bp, Homo sapiens
gtgtccccaccatctgc

SEQ ID NO: 5782258 - DNA, 18 bp, Homo sapiens
gtgtccccaccatctgct

SEQ ID NO: 5782259 - DNA, 19 bp, Homo sapiens
gtgtccccaggggcacact

SEQ ID NO: 5782260 - DNA, 16 bp, Homo sapiens
gtgtcccccctgtggt

SEQ ID NO: 5782261 - DNA, 20 bp, Homo sapiens
gtgtcccccctgtggtctgt

SEQ ID NO: 5782262 - DNA, 22 bp, Homo sapiens
gtgtcccccctgtggtctgtgt

SEQ ID NO: 5782263 - DNA, 23 bp, Homo sapiens
gtgtcccccctgtggtctgtgtg

SEQ ID NO: 5782264 - DNA, 14 bp, Homo sapiens
gtgtccccctctgt

SEQ ID NO: 5782265 - DNA, 21 bp, Homo sapiens
gtgtccccgctgctgtgcaac

SEQ ID NO: 5782266 - DNA, 19 bp, Homo sapiens
gtgtcccctatcctcccct

SEQ ID NO: 5782267 - DNA, 20 bp, Homo sapiens
gtgtcccctcacgcaagtgc

SEQ ID NO: 5782268 - DNA, 20 bp, Homo sapiens
gtgtcccctcactctgtcag

SEQ ID NO: 5782269 - DNA, 21 bp, Homo sapiens
gtgtcccctcactctgtcagc

SEQ ID NO: 5782270 - DNA, 23 bp, Homo sapiens
gtgtcccctcactctgtcagcca

SEQ ID NO: 5782271 - DNA, 13 bp, Homo sapiens
gtgtcccctccac

SEQ ID NO: 5782272 - DNA, 13 bp, Homo sapiens
gtgtcccctgacc

SEQ ID NO: 5782273 - DNA, 16 bp, Homo sapiens
gtgtcccgcggtgctg

SEQ ID NO: 5782274 - DNA, 16 bp, Homo sapiens
gtgtccctctctctgg

SEQ ID NO: 5782275 - DNA, 18 bp, Homo sapiens
gtgtccctctctctggaa

SEQ ID NO: 5782276 - DNA, 22 bp, Homo sapiens
gtgtccctgctggggtctcagg

SEQ ID NO: 5782277 - DNA, 18 bp, Homo sapiens
gtgtccctggacacagct

SEQ ID NO: 5782278 - DNA, 19 bp, Homo sapiens
gtgtccctggacacagctc

SEQ ID NO: 5782279 - DNA, 20 bp, Homo sapiens
gtgtccctggacacagctct

SEQ ID NO: 5782280 - DNA, 21 bp, Homo sapiens
gtgtccctggacacagctctt

SEQ ID NO: 5782281 - DNA, 22 bp, Homo sapiens
gtgtccctggacacagctcttc

SEQ ID NO: 5782282 - DNA, 12 bp, Homo sapiens
gtgtccctgtgg

SEQ ID NO: 5782283 - DNA, 13 bp, Homo sapiens
gtgtccctgtggt

SEQ ID NO: 5782284 - DNA, 20 bp, Homo sapiens
gtgtccgccatccagggtct

SEQ ID NO: 5782285 - DNA, 20 bp, Homo sapiens
gtgtccgctctctcatgtgg

SEQ ID NO: 5782286 - DNA, 18 bp, Homo sapiens
gtgtccgtccacccttcc

SEQ ID NO: 5782287 - DNA, 19 bp, Homo sapiens
gtgtccgtccacccttcca

SEQ ID NO: 5782288 - DNA, 15 bp, Homo sapiens
gtgtcctaaaaatgg

SEQ ID NO: 5782289 - DNA, 16 bp, Homo sapiens
gtgtcctaaggcccat

SEQ ID NO: 5782290 - DNA, 12 bp, Homo sapiens
gtgtcctacaga

SEQ ID NO: 5782291 - DNA, 14 bp, Homo sapiens
gtgtcctaggagta

SEQ ID NO: 5782292 - DNA, 15 bp, Homo sapiens
gtgtcctccaagtgc

SEQ ID NO: 5782293 - DNA, 15 bp, Homo sapiens
gtgtcctccaccatg

SEQ ID NO: 5782294 - DNA, 19 bp, Homo sapiens
gtgtcctccaccatgcact

SEQ ID NO: 5782295 - DNA, 14 bp, Homo sapiens
gtgtcctcctctga

SEQ ID NO: 5782296 - DNA, 13 bp, Homo sapiens
gtgtcctcctgct

SEQ ID NO: 5782297 - DNA, 15 bp, Homo sapiens
gtgtcctcctgctct

SEQ ID NO: 5782298 - DNA, 21 bp, Homo sapiens
gtgtcctcctgctctgcttcc

SEQ ID NO: 5782299 - DNA, 23 bp, Homo sapiens
gtgtcctcctgctctgcttcctc

SEQ ID NO: 5782300 - DNA, 20 bp, Homo sapiens
gtgtcctcctggggttcttt

SEQ ID NO: 5782301 - DNA, 12 bp, Homo sapiens
gtgtcctctccc

SEQ ID NO: 5782302 - DNA, 15 bp, Homo sapiens
gtgtcctctcccctc

SEQ ID NO: 5782303 - DNA, 16 bp, Homo sapiens
gtgtcctctccctgcc

SEQ ID NO: 5782304 - DNA, 11 bp, Homo sapiens
gtgtcctctgt

SEQ ID NO: 5782305 - DNA, 23 bp, Homo sapiens
gtgtcctctgtccgtctgtcctg

SEQ ID NO: 5782306 - DNA, 20 bp, Homo sapiens
gtgtcctgaaacgctccttt

SEQ ID NO: 5782307 - DNA, 14 bp, Homo sapiens
gtgtcctgaagctg

SEQ ID NO: 5782308 - DNA, 20 bp, Homo sapiens
gtgtcctgacacctccaagt

SEQ ID NO: 5782309 - DNA, 13 bp, Homo sapiens
gtgtcctgaccac

SEQ ID NO: 5782310 - DNA, 10 bp, Homo sapiens
gtgtcctgag

SEQ ID NO: 5782311 - DNA, 15 bp, Homo sapiens
gtgtcctgagctcag

SEQ ID NO: 5782312 - DNA, 22 bp, Homo sapiens
gtgtcctgagctcagcgtggag

SEQ ID NO: 5782313 - DNA, 13 bp, Homo sapiens
gtgtcctgaggcc

SEQ ID NO: 5782314 - DNA, 13 bp, Homo sapiens
gtgtcctgcatgt

SEQ ID NO: 5782315 - DNA, 16 bp, Homo sapiens
gtgtcctgcctgtctg

SEQ ID NO: 5782316 - DNA, 12 bp, Homo sapiens
gtgtcctgcctt

SEQ ID NO: 5782317 - DNA, 17 bp, Homo sapiens
gtgtcctgctacctttg

SEQ ID NO: 5782318 - DNA, 24 bp, Homo sapiens
gtgtcctgctacctttgtctcacg

SEQ ID NO: 5782319 - DNA, 19 bp, Homo sapiens
gtgtcctggaccctggcct

SEQ ID NO: 5782320 - DNA, 13 bp, Homo sapiens
gtgtcctggtgct

SEQ ID NO: 5782321 - DNA, 20 bp, Homo sapiens
gtgtcctgtgctttctgcat

SEQ ID NO: 5782322 - DNA, 12 bp, Homo sapiens
gtgtccttccct

SEQ ID NO: 5782323 - DNA, 23 bp, Homo sapiens
gtgtccttccctgccccaccacg

SEQ ID NO: 5782324 - DNA, 18 bp, Homo sapiens
gtgtccttcctctgtcct

SEQ ID NO: 5782325 - DNA, 19 bp, Homo sapiens
gtgtccttcctctgtcctc

SEQ ID NO: 5782326 - DNA, 14 bp, Homo sapiens
gtgtccttctcctc

SEQ ID NO: 5782327 - DNA, 15 bp, Homo sapiens
gtgtccttcttcctc

SEQ ID NO: 5782328 - DNA, 22 bp, Homo sapiens
gtgtccttgaactgaggccctg

SEQ ID NO: 5782329 - DNA, 17 bp, Homo sapiens
gtgtccttgcacctgca

SEQ ID NO: 5782330 - DNA, 19 bp, Homo sapiens
gtgtccttgcacctgcatc

SEQ ID NO: 5782331 - DNA, 14 bp, Homo sapiens
gtgtccttgtgcat

SEQ ID NO: 5782332 - DNA, 16 bp, Homo sapiens
gtgtcctttccctcca

SEQ ID NO: 5782333 - DNA, 14 bp, Homo sapiens
gtgtcctttctgaa

SEQ ID NO: 5782334 - DNA, 23 bp, Homo sapiens
gtgtcgaggccacattgctggct

SEQ ID NO: 5782335 - DNA, 19 bp, Homo sapiens
gtgtcgccgtccctctgcc

SEQ ID NO: 5782336 - DNA, 16 bp, Homo sapiens
gtgtcgggcaggtcag

SEQ ID NO: 5782337 - DNA, 21 bp, Homo sapiens
gtgtcgtcctgcagtgtgaga

SEQ ID NO: 5782338 - DNA, 18 bp, Homo sapiens
gtgtcgtctgtgaatgct

SEQ ID NO: 5782339 - DNA, 14 bp, Homo sapiens
gtgtcgttcccttg

SEQ ID NO: 5782340 - DNA, 17 bp, Homo sapiens
gtgtctaaaaacaccaa

SEQ ID NO: 5782341 - DNA, 22 bp, Homo sapiens
gtgtctaaaacactattctcca

SEQ ID NO: 5782342 - DNA, 16 bp, Homo sapiens
gtgtctaagattctag

SEQ ID NO: 5782343 - DNA, 15 bp, Homo sapiens
gtgtctaccttgtta

SEQ ID NO: 5782344 - DNA, 23 bp, Homo sapiens
gtgtctactctaggactgggccc

SEQ ID NO: 5782345 - DNA, 19 bp, Homo sapiens
gtgtctagaggcaggtagg

SEQ ID NO: 5782346 - DNA, 16 bp, Homo sapiens
gtgtctagcaaagcca

SEQ ID NO: 5782347 - DNA, 20 bp, Homo sapiens
gtgtctagggcagagtatgt

SEQ ID NO: 5782348 - DNA, 23 bp, Homo sapiens
gtgtctatgatgttgctgttcac

SEQ ID NO: 5782349 - DNA, 15 bp, Homo sapiens
gtgtctatttctgaa

SEQ ID NO: 5782350 - DNA, 16 bp, Homo sapiens
gtgtctcaaaaataat

SEQ ID NO: 5782351 - DNA, 18 bp, Homo sapiens
gtgtctcactaaagcatg

SEQ ID NO: 5782352 - DNA, 14 bp, Homo sapiens
gtgtctcagcctct

SEQ ID NO: 5782353 - DNA, 17 bp, Homo sapiens
gtgtctcagcctctgcc

SEQ ID NO: 5782354 - DNA, 18 bp, Homo sapiens
gtgtctcagcctctgcca

SEQ ID NO: 5782355 - DNA, 13 bp, Homo sapiens
gtgtctcaggaaa

SEQ ID NO: 5782356 - DNA, 11 bp, Homo sapiens
gtgtctcaggc

SEQ ID NO: 5782357 - DNA, 14 bp, Homo sapiens
gtgtctcaggctgc

SEQ ID NO: 5782358 - DNA, 18 bp, Homo sapiens
gtgtctcatttgccagga

SEQ ID NO: 5782359 - DNA, 13 bp, Homo sapiens
gtgtctccaaccc

SEQ ID NO: 5782360 - DNA, 17 bp, Homo sapiens
gtgtctccaacccccca

SEQ ID NO: 5782361 - DNA, 23 bp, Homo sapiens
gtgtctccaagcctctgtctttt

SEQ ID NO: 5782362 - DNA, 15 bp, Homo sapiens
gtgtctcccaacatg

SEQ ID NO: 5782363 - DNA, 14 bp, Homo sapiens
gtgtctcccagaac

SEQ ID NO: 5782364 - DNA, 22 bp, Homo sapiens
gtgtctccccgtgtcctctccc

SEQ ID NO: 5782365 - DNA, 17 bp, Homo sapiens
gtgtctcccttcatcct

SEQ ID NO: 5782366 - DNA, 23 bp, Homo sapiens
gtgtctcctgcatgcagaaaggg

SEQ ID NO: 5782367 - DNA, 18 bp, Homo sapiens
gtgtctcctgtttcagac

SEQ ID NO: 5782368 - DNA, 20 bp, Homo sapiens
gtgtctcctgtttcagacca

SEQ ID NO: 5782369 - DNA, 21 bp, Homo sapiens
gtgtctcctgtttcagaccag

SEQ ID NO: 5782370 - DNA, 22 bp, Homo sapiens
gtgtctcctgtttcagaccagc

SEQ ID NO: 5782371 - DNA, 22 bp, Homo sapiens
gtgtctccttaagctgcagaga

SEQ ID NO: 5782372 - DNA, 16 bp, Homo sapiens
gtgtctcgctgcatca

SEQ ID NO: 5782373 - DNA, 13 bp, Homo sapiens
gtgtctctattta

SEQ ID NO: 5782374 - DNA, 14 bp, Homo sapiens
gtgtctctcccacc

SEQ ID NO: 5782375 - DNA, 20 bp, Homo sapiens
gtgtctctggaacccaggac

SEQ ID NO: 5782376 - DNA, 22 bp, Homo sapiens
gtgtctctggaacccaggacct

SEQ ID NO: 5782377 - DNA, 12 bp, Homo sapiens
gtgtctctgggc

SEQ ID NO: 5782378 - DNA, 15 bp, Homo sapiens
gtgtctctgggcctg

SEQ ID NO: 5782379 - DNA, 17 bp, Homo sapiens
gtgtctctgggcctgtg

SEQ ID NO: 5782380 - DNA, 22 bp, Homo sapiens
gtgtctcttttctctttctcct

SEQ ID NO: 5782381 - DNA, 13 bp, Homo sapiens
gtgtctgaagact

SEQ ID NO: 5782382 - DNA, 19 bp, Homo sapiens
gtgtctgaatcatgtctgt

SEQ ID NO: 5782383 - DNA, 20 bp, Homo sapiens
gtgtctgacgattttggaaa

SEQ ID NO: 5782384 - DNA, 16 bp, Homo sapiens
gtgtctgactcaggcg

SEQ ID NO: 5782385 - DNA, 22 bp, Homo sapiens
gtgtctgactcaggcgcctggc

SEQ ID NO: 5782386 - DNA, 22 bp, Homo sapiens
gtgtctgagccctcaaagtgag

SEQ ID NO: 5782387 - DNA, 18 bp, Homo sapiens
gtgtctgatgtgtgccca

SEQ ID NO: 5782388 - DNA, 15 bp, Homo sapiens
gtgtctgatgtttgt

SEQ ID NO: 5782389 - DNA, 13 bp, Homo sapiens
gtgtctgcacagg

SEQ ID NO: 5782390 - DNA, 21 bp, Homo sapiens
gtgtctgcacccaggggtggg

SEQ ID NO: 5782391 - DNA, 12 bp, Homo sapiens
gtgtctgcagct

SEQ ID NO: 5782392 - DNA, 15 bp, Homo sapiens
gtgtctgcagctcct

SEQ ID NO: 5782393 - DNA, 15 bp, Homo sapiens
gtgtctgcagtcctg

SEQ ID NO: 5782394 - DNA, 16 bp, Homo sapiens
gtgtctgccaaacaca

SEQ ID NO: 5782395 - DNA, 14 bp, Homo sapiens
gtgtctgccccctc

SEQ ID NO: 5782396 - DNA, 18 bp, Homo sapiens
gtgtctgctgctgcctcc

SEQ ID NO: 5782397 - DNA, 11 bp, Homo sapiens
gtgtctgctgt

SEQ ID NO: 5782398 - DNA, 21 bp, Homo sapiens
gtgtctgctttaaagggcctg

SEQ ID NO: 5782399 - DNA, 18 bp, Homo sapiens
gtgtctggaaaagcactt

SEQ ID NO: 5782400 - DNA, 11 bp, Homo sapiens
gtgtctggaag

SEQ ID NO: 5782401 - DNA, 19 bp, Homo sapiens
gtgtctggaagctgagcag

SEQ ID NO: 5782402 - DNA, 22 bp, Homo sapiens
gtgtctggaatcccagctccgc

SEQ ID NO: 5782403 - DNA, 22 bp, Homo sapiens
gtgtctggacattcagaacacc

SEQ ID NO: 5782404 - DNA, 15 bp, Homo sapiens
gtgtctggagcctgc

SEQ ID NO: 5782405 - DNA, 14 bp, Homo sapiens
gtgtctggagcggc

SEQ ID NO: 5782406 - DNA, 17 bp, Homo sapiens
gtgtctggagcggctgc

SEQ ID NO: 5782407 - DNA, 16 bp, Homo sapiens
gtgtctggatcagtaa

SEQ ID NO: 5782408 - DNA, 17 bp, Homo sapiens
gtgtctggcccagccat

SEQ ID NO: 5782409 - DNA, 12 bp, Homo sapiens
gtgtctggcctg

SEQ ID NO: 5782410 - DNA, 14 bp, Homo sapiens
gtgtctggcctgag

SEQ ID NO: 5782411 - DNA, 16 bp, Homo sapiens
gtgtctggcctgaggt

SEQ ID NO: 5782412 - DNA, 12 bp, Homo sapiens
gtgtctggcttt

SEQ ID NO: 5782413 - DNA, 18 bp, Homo sapiens
gtgtctggggtgagggag

SEQ ID NO: 5782414 - DNA, 22 bp, Homo sapiens
gtgtctgggtttggcccaagac

SEQ ID NO: 5782415 - DNA, 21 bp, Homo sapiens
gtgtctggtttctgtccccgg

SEQ ID NO: 5782416 - DNA, 18 bp, Homo sapiens
gtgtctgtaaaagagcct

SEQ ID NO: 5782417 - DNA, 18 bp, Homo sapiens
gtgtctgtaaggactcag

SEQ ID NO: 5782418 - DNA, 12 bp, Homo sapiens
gtgtctgtacac

SEQ ID NO: 5782419 - DNA, 16 bp, Homo sapiens
gtgtctgtacacgtgt

SEQ ID NO: 5782420 - DNA, 22 bp, Homo sapiens
gtgtctgtacacgtgtcctgta

SEQ ID NO: 5782421 - DNA, 12 bp, Homo sapiens
gtgtctgtattc

SEQ ID NO: 5782422 - DNA, 13 bp, Homo sapiens
gtgtctgtattta

SEQ ID NO: 5782423 - DNA, 14 bp, Homo sapiens
gtgtctgtatttat

SEQ ID NO: 5782424 - DNA, 13 bp, Homo sapiens
gtgtctgtcacag

SEQ ID NO: 5782425 - DNA, 18 bp, Homo sapiens
gtgtctgtcaccacatct

SEQ ID NO: 5782426 - DNA, 22 bp, Homo sapiens
gtgtctgtcaccacatcttgtc

SEQ ID NO: 5782427 - DNA, 12 bp, Homo sapiens
gtgtctgtcagc

SEQ ID NO: 5782428 - DNA, 18 bp, Homo sapiens
gtgtctgtccatctgtct

SEQ ID NO: 5782429 - DNA, 13 bp, Homo sapiens
gtgtgtgctcagc

SEQ ID NO: 5782430 - DNA, 20 bp, Homo sapiens
gtgtgtggaaggcagggaca

SEQ ID NO: 5782431 - DNA, 21 bp, Homo sapiens
gtgtgtggcagccaggatgac

SEQ ID NO: 5782432 - DNA, 18 bp, Homo sapiens
gtgtgtggccgcctggca

SEQ ID NO: 5782433 - DNA, 12 bp, Homo sapiens
gtgtgtggccgg

SEQ ID NO: 5782434 - DNA, 17 bp, Homo sapiens
gtgtgtggcgtggcccg

SEQ ID NO: 5782435 - DNA, 16 bp, Homo sapiens
gtgtgtgggagtgtgt

SEQ ID NO: 5782436 - DNA, 13 bp, Homo sapiens
gtgtgtgggtgtg

SEQ ID NO: 5782437 - DNA, 23 bp, Homo sapiens
gtgtgtggtcaacatttctcatg

SEQ ID NO: 5782438 - DNA, 18 bp, Homo sapiens
gtgtgtggtgtgtgtgct

SEQ ID NO: 5782439 - DNA, 18 bp, Homo sapiens
gtgtgtgtacctgtggct

SEQ ID NO: 5782440 - DNA, 21 bp, Homo sapiens
gtgtgtgtctccatgcacatg

SEQ ID NO: 5782441 - DNA, 14 bp, Homo sapiens
gtgtgtgtctgtct

SEQ ID NO: 5782442 - DNA, 13 bp, Homo sapiens
gtgtgtgtgaatg

SEQ ID NO: 5782443 - DNA, 12 bp, Homo sapiens
gtgtgtgtgcac

SEQ ID NO: 5782444 - DNA, 14 bp, Homo sapiens
gtgtgtgtgcatgt

SEQ ID NO: 5782445 - DNA, 15 bp, Homo sapiens
gtgtgtgtggcaggg

SEQ ID NO: 5782446 - DNA, 12 bp, Homo sapiens
gtgtgtgtgtat

SEQ ID NO: 5782447 - DNA, 13 bp, Homo sapiens
gtgtgtgtgtggc

SEQ ID NO: 5782448 - DNA, 12 bp, Homo sapiens
gtgtgtgtgtgt

SEQ ID NO: 5782449 - DNA, 13 bp, Homo sapiens
gtgtgtgtgtgtg

SEQ ID NO: 5782450 - DNA, 15 bp, Homo sapiens
gtgtgtgtgtgtgtg

SEQ ID NO: 5782451 - DNA, 16 bp, Homo sapiens
gtgtgttaagctctgc

SEQ ID NO: 5782452 - DNA, 13 bp, Homo sapiens
gtgtgttaatgtc

SEQ ID NO: 5782453 - DNA, 22 bp, Homo sapiens
gtgtgttatattccaaggaaaa

SEQ ID NO: 5782454 - DNA, 13 bp, Homo sapiens
gtgtgttcctggc

SEQ ID NO: 5782455 - DNA, 21 bp, Homo sapiens
gtgtgttctgatgaggcattt

SEQ ID NO: 5782456 - DNA, 19 bp, Homo sapiens
gtgtgttcttcaagccagc

SEQ ID NO: 5782457 - DNA, 19 bp, Homo sapiens
gtgtgttcttttgagtcct

SEQ ID NO: 5782458 - DNA, 22 bp, Homo sapiens
gtgtgttcttttgagtccttgt

SEQ ID NO: 5782459 - DNA, 16 bp, Homo sapiens
gtgtgttcttttgata

SEQ ID NO: 5782460 - DNA, 17 bp, Homo sapiens
gtgtgttcttttgatac

SEQ ID NO: 5782461 - DNA, 21 bp, Homo sapiens
gtgtgttgatactgttgcacg

SEQ ID NO: 5782462 - DNA, 22 bp, Homo sapiens
gtgtgttgatactgttgcacgt

SEQ ID NO: 5782463 - DNA, 23 bp, Homo sapiens
gtgtgttgatactgttgcacgtg

SEQ ID NO: 5782464 - DNA, 14 bp, Homo sapiens
gtgtgttgcttatg

SEQ ID NO: 5782465 - DNA, 16 bp, Homo sapiens
gtgtgttgtcttgaaa

SEQ ID NO: 5782466 - DNA, 19 bp, Homo sapiens
gtgtgtttaaataaagtat

SEQ ID NO: 5782467 - DNA, 13 bp, Homo sapiens
gtgtgtttagaag

SEQ ID NO: 5782468 - DNA, 17 bp, Homo sapiens
gtgtgtttagaagccta

SEQ ID NO: 5782469 - DNA, 14 bp, Homo sapiens
gtgtgtttcacttt

SEQ ID NO: 5782470 - DNA, 15 bp, Homo sapiens
gtgtgtttcaggaca

SEQ ID NO: 5782471 - DNA, 20 bp, Homo sapiens
gtgtgtttcaggacagctgc

SEQ ID NO: 5782472 - DNA, 15 bp, Homo sapiens
gtgtgtttctgatct

SEQ ID NO: 5782473 - DNA, 19 bp, Homo sapiens
gtgtgtttctgtcctgtaa

SEQ ID NO: 5782474 - DNA, 14 bp, Homo sapiens
gtgtgtttcttgct

SEQ ID NO: 5782475 - DNA, 14 bp, Homo sapiens
gtgtgtttgtgatt

SEQ ID NO: 5782476 - DNA, 14 bp, Homo sapiens
gtgtgtttgtgtga

SEQ ID NO: 5782477 - DNA, 10 bp, Homo sapiens
gtgtgtttta

SEQ ID NO: 5782478 - DNA, 17 bp, Homo sapiens
gtgtgttttcataataa

SEQ ID NO: 5782479 - DNA, 18 bp, Homo sapiens
gtgtgttttcataataaa

SEQ ID NO: 5782480 - DNA, 20 bp, Homo sapiens
gtgtgttttcccaaagcact

SEQ ID NO: 5782481 - DNA, 16 bp, Homo sapiens
gtgtgttttctcctag

SEQ ID NO: 5782482 - DNA, 14 bp, Homo sapiens
gtgtgtttttcata

SEQ ID NO: 5782483 - DNA, 15 bp, Homo sapiens
gtgtgtttttctatt

SEQ ID NO: 5782484 - DNA, 16 bp, Homo sapiens
gtgtgtttttctatta

SEQ ID NO: 5782485 - DNA, 21 bp, Homo sapiens
gtgtgtttttctattaaaaga

SEQ ID NO: 5782486 - DNA, 19 bp, Homo sapiens
gtgttaaaaggaaaaataa

SEQ ID NO: 5782487 - DNA, 21 bp, Homo sapiens
gtgttaaaaggaaaaataaca

SEQ ID NO: 5782488 - DNA, 21 bp, Homo sapiens
gtgttaaactaaaaatttaca

SEQ ID NO: 5782489 - DNA, 13 bp, Homo sapiens
gtgttaaactttt

SEQ ID NO: 5782490 - DNA, 15 bp, Homo sapiens
gtgttaaagctgtac

SEQ ID NO: 5782491 - DNA, 17 bp, Homo sapiens
gtgttaaagctgtacac

SEQ ID NO: 5782492 - DNA, 18 bp, Homo sapiens
gtgttaaagctgtacacc

SEQ ID NO: 5782493 - DNA, 17 bp, Homo sapiens
gtgttaaatcacagaaa

SEQ ID NO: 5782494 - DNA, 20 bp, Homo sapiens
gtgttaaatcacagaaaaaa

SEQ ID NO: 5782495 - DNA, 21 bp, Homo sapiens
gtgttaaatgtgatgaatact

SEQ ID NO: 5782496 - DNA, 23 bp, Homo sapiens
gtgttaacagaagggagggcaga

SEQ ID NO: 5782497 - DNA, 15 bp, Homo sapiens
gtgttaagctctgct

SEQ ID NO: 5782498 - DNA, 20 bp, Homo sapiens
gtgttaaggcaacattcctt

SEQ ID NO: 5782499 - DNA, 14 bp, Homo sapiens
gtgttaataaatgg

SEQ ID NO: 5782500 - DNA, 16 bp, Homo sapiens
gtgttaataataactt

SEQ ID NO: 5782501 - DNA, 15 bp, Homo sapiens
gtgttaatacatcac

SEQ ID NO: 5782502 - DNA, 16 bp, Homo sapiens
gtgttaatactgagaa

SEQ ID NO: 5782503 - DNA, 19 bp, Homo sapiens
gtgttaatctgagtaactt

SEQ ID NO: 5782504 - DNA, 23 bp, Homo sapiens
gtgttaattataaacagcagggt

SEQ ID NO: 5782505 - DNA, 13 bp, Homo sapiens
gtgttaattgaaa

SEQ ID NO: 5782506 - DNA, 16 bp, Homo sapiens
gtgttaatttaagttt

SEQ ID NO: 5782507 - DNA, 14 bp, Homo sapiens
gtgttaattttgct

SEQ ID NO: 5782508 - DNA, 21 bp, Homo sapiens
gtgttaattttgctaactggg

SEQ ID NO: 5782509 - DNA, 16 bp, Homo sapiens
gtgttacaaggcactt

SEQ ID NO: 5782510 - DNA, 20 bp, Homo sapiens
gtgttacagaggacatacca

SEQ ID NO: 5782511 - DNA, 16 bp, Homo sapiens
gtgttacattattcca

SEQ ID NO: 5782512 - DNA, 14 bp, Homo sapiens
gtgttacccactgc

SEQ ID NO: 5782513 - DNA, 23 bp, Homo sapiens
gtgttacccaggctggtctcaaa

SEQ ID NO: 5782514 - DNA, 23 bp, Homo sapiens
gtgttactagcctcaaaatacat

SEQ ID NO: 5782515 - DNA, 15 bp, Homo sapiens
gtgttactcatcttt

SEQ ID NO: 5782516 - DNA, 15 bp, Homo sapiens
gtgttactgctttgc

SEQ ID NO: 5782517 - DNA, 18 bp, Homo sapiens
gtgttactggaaaaatta

SEQ ID NO: 5782518 - DNA, 19 bp, Homo sapiens
gtgttactgtaattcctca

SEQ ID NO: 5782519 - DNA, 13 bp, Homo sapiens
gtgttacttgaag

SEQ ID NO: 5782520 - DNA, 19 bp, Homo sapiens
gtgttacttgaagtaacta

SEQ ID NO: 5782521 - DNA, 19 bp, Homo sapiens
gtgttagaagcccattcat

SEQ ID NO: 5782522 - DNA, 22 bp, Homo sapiens
gtgttagcactgatagtccttt

SEQ ID NO: 5782523 - DNA, 21 bp, Homo sapiens
gtgttagccttttttccccag

SEQ ID NO: 5782524 - DNA, 23 bp, Homo sapiens
gtgttagggaagggcctgccaca

SEQ ID NO: 5782525 - DNA, 14 bp, Homo sapiens
gtgttaggtcaata

SEQ ID NO: 5782526 - DNA, 21 bp, Homo sapiens
gtgttagtggcaccgcctccc

SEQ ID NO: 5782527 - DNA, 17 bp, Homo sapiens
gtgttagtgtctgtcca

SEQ ID NO: 5782528 - DNA, 14 bp, Homo sapiens
gtgttagtgtgtgt

SEQ ID NO: 5782529 - DNA, 20 bp, Homo sapiens
gtgttataatgggtaatata

SEQ ID NO: 5782530 - DNA, 16 bp, Homo sapiens
gtgttatcaggcgtcc

SEQ ID NO: 5782531 - DNA, 12 bp, Homo sapiens
gtgttatctacc

SEQ ID NO: 5782532 - DNA, 20 bp, Homo sapiens
gtgttatctacctcaaggta

SEQ ID NO: 5782533 - DNA, 13 bp, Homo sapiens
gtgttatgtattt

SEQ ID NO: 5782534 - DNA, 16 bp, Homo sapiens
gtgttatttaaagaag

SEQ ID NO: 5782535 - DNA, 17 bp, Homo sapiens
gtgttatttaaatgagt

SEQ ID NO: 5782536 - DNA, 17 bp, Homo sapiens
gtgttcaaaacaaaatg

SEQ ID NO: 5782537 - DNA, 19 bp, Homo sapiens
gtgttcaaattaaaaaagc

SEQ ID NO: 5782538 - DNA, 14 bp, Homo sapiens
gtgttcaaattctg

SEQ ID NO: 5782539 - DNA, 14 bp, Homo sapiens
gtgttcaagaaata

SEQ ID NO: 5782540 - DNA, 15 bp, Homo sapiens
gtgttcaagaaataa

SEQ ID NO: 5782541 - DNA, 16 bp, Homo sapiens
gtgttcaatattttct

SEQ ID NO: 5782542 - DNA, 18 bp, Homo sapiens
gtgttcaatccagagagc

SEQ ID NO: 5782543 - DNA, 15 bp, Homo sapiens
gtgttcaatctgtga

SEQ ID NO: 5782544 - DNA, 21 bp, Homo sapiens
gtgttcaccttcaaaatgttc

SEQ ID NO: 5782545 - DNA, 14 bp, Homo sapiens
gtgttcagaagaat

SEQ ID NO: 5782546 - DNA, 15 bp, Homo sapiens
gtgttcagattgtaa

SEQ ID NO: 5782547 - DNA, 22 bp, Homo sapiens
gtgttcagccaaacagtatgat

SEQ ID NO: 5782548 - DNA, 18 bp, Homo sapiens
gtgttcagctctttccaa

SEQ ID NO: 5782549 - DNA, 23 bp, Homo sapiens
gtgttcagtgttagcagtgggtc

SEQ ID NO: 5782550 - DNA, 13 bp, Homo sapiens
gtgttcagtgttg

SEQ ID NO: 5782551 - DNA, 15 bp, Homo sapiens
gtgttcagtgttgac

SEQ ID NO: 5782552 - DNA, 16 bp, Homo sapiens
gtgttcagtgttgaca

SEQ ID NO: 5782553 - DNA, 18 bp, Homo sapiens
gtgttcagtgttgacata

SEQ ID NO: 5782554 - DNA, 12 bp, Homo sapiens
gtgttcatacat

SEQ ID NO: 5782555 - DNA, 23 bp, Homo sapiens
gtgttcatgctgaatccacctcg

SEQ ID NO: 5782556 - DNA, 16 bp, Homo sapiens
gtgttcattgcacaat

SEQ ID NO: 5782557 - DNA, 11 bp, Homo sapiens
gtgttcatttt

SEQ ID NO: 5782558 - DNA, 15 bp, Homo sapiens
gtgttccaacaacca

SEQ ID NO: 5782559 - DNA, 17 bp, Homo sapiens
gtgttccaagtttccaa

SEQ ID NO: 5782560 - DNA, 16 bp, Homo sapiens
gtgttccatgacttca

SEQ ID NO: 5782561 - DNA, 12 bp, Homo sapiens
gtgttcccccca

SEQ ID NO: 5782562 - DNA, 20 bp, Homo sapiens
gtgttcccctcttgtctccc

SEQ ID NO: 5782563 - DNA, 22 bp, Homo sapiens
gtgttccccttccactgagggc

SEQ ID NO: 5782564 - DNA, 15 bp, Homo sapiens
gtgttccctatccaa

SEQ ID NO: 5782565 - DNA, 13 bp, Homo sapiens
gtgttcccttggc

SEQ ID NO: 5782566 - DNA, 14 bp, Homo sapiens
gtgttcccttggca

SEQ ID NO: 5782567 - DNA, 15 bp, Homo sapiens
gtgttccctttgtct

SEQ ID NO: 5782568 - DNA, 17 bp, Homo sapiens
gtgttccctttttcata

SEQ ID NO: 5782569 - DNA, 22 bp, Homo sapiens
gtgttccgaagatgctgtagta

SEQ ID NO: 5782570 - DNA, 22 bp, Homo sapiens
gtgttcctatattccaggttta

SEQ ID NO: 5782571 - DNA, 17 bp, Homo sapiens
gtgttcctcagtagctt

SEQ ID NO: 5782572 - DNA, 14 bp, Homo sapiens
gtgttcctccattt

SEQ ID NO: 5782573 - DNA, 18 bp, Homo sapiens
gtgttcctccattttctt

SEQ ID NO: 5782574 - DNA, 13 bp, Homo sapiens
gtgttcctcctgc

SEQ ID NO: 5782575 - DNA, 20 bp, Homo sapiens
gtgttcctcggtgggccaga

SEQ ID NO: 5782576 - DNA, 23 bp, Homo sapiens
gtgttcctcggtgggccagagct

SEQ ID NO: 5782577 - DNA, 13 bp, Homo sapiens
gtgttcctctttg

SEQ ID NO: 5782578 - DNA, 16 bp, Homo sapiens
gtgttcctgcttttct

SEQ ID NO: 5782579 - DNA, 12 bp, Homo sapiens
gtgttcctggaa

SEQ ID NO: 5782580 - DNA, 21 bp, Homo sapiens
gtgttcctggcccactctgta

SEQ ID NO: 5782581 - DNA, 15 bp, Homo sapiens
gtgttccttctgtga

SEQ ID NO: 5782582 - DNA, 17 bp, Homo sapiens
gtgttccttctgtgaag

SEQ ID NO: 5782583 - DNA, 20 bp, Homo sapiens
gtgttccttctgtgaagaag

SEQ ID NO: 5782584 - DNA, 20 bp, Homo sapiens
gtgttcctttttaaatgtga

SEQ ID NO: 5782585 - DNA, 21 bp, Homo sapiens
gtgttcctttttaaatgtgaa

SEQ ID NO: 5782586 - DNA, 19 bp, Homo sapiens
gtgttcgggggagcagaga

SEQ ID NO: 5782587 - DNA, 19 bp, Homo sapiens
gtgttcggttttgttgttc

SEQ ID NO: 5782588 - DNA, 14 bp, Homo sapiens
gtgttcgtcagtgt

SEQ ID NO: 5782589 - DNA, 16 bp, Homo sapiens
gtgttcgtggagccac

SEQ ID NO: 5782590 - DNA, 21 bp, Homo sapiens
gtgttcgttcttgttctgttt

SEQ ID NO: 5782591 - DNA, 21 bp, Homo sapiens
gtgttcgttgcacagctgttt

SEQ ID NO: 5782592 - DNA, 23 bp, Homo sapiens
gtgttcgtttccatcatgtctgt

SEQ ID NO: 5782593 - DNA, 13 bp, Homo sapiens
gtgttctaagatg

SEQ ID NO: 5782594 - DNA, 23 bp, Homo sapiens
gtgttctatccaaacatgtattt

SEQ ID NO: 5782595 - DNA, 16 bp, Homo sapiens
gtgttctcaacacaca

SEQ ID NO: 5782596 - DNA, 12 bp, Homo sapiens
gtgttctcagag

SEQ ID NO: 5782597 - DNA, 12 bp, Homo sapiens
gtgttctcagca

SEQ ID NO: 5782598 - DNA, 13 bp, Homo sapiens
gtgttctcagcac

SEQ ID NO: 5782599 - DNA, 21 bp, Homo sapiens
gtgttctcatgaagcaggagg

SEQ ID NO: 5782600 - DNA, 20 bp, Homo sapiens
gtgttctccactaatactgg

SEQ ID NO: 5782601 - DNA, 13 bp, Homo sapiens
gtgttctcctcca

SEQ ID NO: 5782602 - DNA, 14 bp, Homo sapiens
gtgttctctagaat

SEQ ID NO: 5782603 - DNA, 22 bp, Homo sapiens
gtgttctctccccttgcactgg

SEQ ID NO: 5782604 - DNA, 22 bp, Homo sapiens
gtgttctgagtacttgatttca

SEQ ID NO: 5782605 - DNA, 21 bp, Homo sapiens
gtgttctgctcctgcttttct

SEQ ID NO: 5782606 - DNA, 14 bp, Homo sapiens
gtgttctggcctct

SEQ ID NO: 5782607 - DNA, 15 bp, Homo sapiens
gtgttctggcctctg

SEQ ID NO: 5782608 - DNA, 14 bp, Homo sapiens
gttactctgaaggg

SEQ ID NO: 5782609 - DNA, 23 bp, Homo sapiens
gttactctgcctttctaagactc

SEQ ID NO: 5782610 - DNA, 18 bp, Homo sapiens
gttactgaagttatctgt

SEQ ID NO: 5782611 - DNA, 18 bp, Homo sapiens
gttactgatcatgcattg

SEQ ID NO: 5782612 - DNA, 19 bp, Homo sapiens
gttactgatcatgcattgt

SEQ ID NO: 5782613 - DNA, 15 bp, Homo sapiens
gttactgattctcct

SEQ ID NO: 5782614 - DNA, 13 bp, Homo sapiens
gttactgcagtga

SEQ ID NO: 5782615 - DNA, 20 bp, Homo sapiens
gttactgccaaaaccaaatt

SEQ ID NO: 5782616 - DNA, 18 bp, Homo sapiens
gttactggataaattgtt

SEQ ID NO: 5782617 - DNA, 19 bp, Homo sapiens
gttactggcacctgaaatt

SEQ ID NO: 5782618 - DNA, 20 bp, Homo sapiens
gttactggcacctgaaatta

SEQ ID NO: 5782619 - DNA, 21 bp, Homo sapiens
gttactggcacctgaaattaa

SEQ ID NO: 5782620 - DNA, 17 bp, Homo sapiens
gttactgggccctgagt

SEQ ID NO: 5782621 - DNA, 22 bp, Homo sapiens
gttactggtgatgttgaaatat

SEQ ID NO: 5782622 - DNA, 22 bp, Homo sapiens
gttactggttggtgttcttccc

SEQ ID NO: 5782623 - DNA, 17 bp, Homo sapiens
gttactgtaaaatgcaa

SEQ ID NO: 5782624 - DNA, 19 bp, Homo sapiens
gttactgtctgtagtgttt

SEQ ID NO: 5782625 - DNA, 18 bp, Homo sapiens
gttactgtgtaaactcat

SEQ ID NO: 5782626 - DNA, 9 bp, Homo sapiens
gttactgtt

SEQ ID NO: 5782627 - DNA, 12 bp, Homo sapiens
gttactgttctt

SEQ ID NO: 5782628 - DNA, 16 bp, Homo sapiens
gttactgttcttgctg

SEQ ID NO: 5782629 - DNA, 23 bp, Homo sapiens
gttactgttcttgctgctagaac

SEQ ID NO: 5782630 - DNA, 12 bp, Homo sapiens
gttacttaaaca

SEQ ID NO: 5782631 - DNA, 20 bp, Homo sapiens
gttacttaaacatcattgga

SEQ ID NO: 5782632 - DNA, 14 bp, Homo sapiens
gttacttacacacc

SEQ ID NO: 5782633 - DNA, 16 bp, Homo sapiens
gttacttagaatgcca

SEQ ID NO: 5782634 - DNA, 17 bp, Homo sapiens
gttacttagaatgccat

SEQ ID NO: 5782635 - DNA, 22 bp, Homo sapiens
gttacttagaatgccataaaat

SEQ ID NO: 5782636 - DNA, 22 bp, Homo sapiens
gttacttagcaagacctgaaaa

SEQ ID NO: 5782637 - DNA, 14 bp, Homo sapiens
gttacttcaagtaa

SEQ ID NO: 5782638 - DNA, 14 bp, Homo sapiens
gttacttccctttc

SEQ ID NO: 5782639 - DNA, 13 bp, Homo sapiens
gttacttcctact

SEQ ID NO: 5782640 - DNA, 15 bp, Homo sapiens
gttacttcttctctt

SEQ ID NO: 5782641 - DNA, 14 bp, Homo sapiens
gttacttgaaataa

SEQ ID NO: 5782642 - DNA, 15 bp, Homo sapiens
gttacttgaaataag

SEQ ID NO: 5782643 - DNA, 14 bp, Homo sapiens
gttacttgaagtaa

SEQ ID NO: 5782644 - DNA, 16 bp, Homo sapiens
gttacttgaagtaact

SEQ ID NO: 5782645 - DNA, 14 bp, Homo sapiens
gttacttgctataa

SEQ ID NO: 5782646 - DNA, 17 bp, Homo sapiens
gttacttgctgctcaca

SEQ ID NO: 5782647 - DNA, 17 bp, Homo sapiens
gttacttgcttcagtgg

SEQ ID NO: 5782648 - DNA, 12 bp, Homo sapiens
gttactttacat

SEQ ID NO: 5782649 - DNA, 21 bp, Homo sapiens
gttactttagttagcatgcgc

SEQ ID NO: 5782650 - DNA, 20 bp, Homo sapiens
gttactttccaattctcctt

SEQ ID NO: 5782651 - DNA, 18 bp, Homo sapiens
gttactttcttaatgtga

SEQ ID NO: 5782652 - DNA, 14 bp, Homo sapiens
gttactttgaatag

SEQ ID NO: 5782653 - DNA, 16 bp, Homo sapiens
gttactttgaatagtc

SEQ ID NO: 5782654 - DNA, 23 bp, Homo sapiens
gttactttgaatagtcctaaaaa

SEQ ID NO: 5782655 - DNA, 20 bp, Homo sapiens
gttactttgtaatttttggg

SEQ ID NO: 5782656 - DNA, 18 bp, Homo sapiens
gttacttttcatatttgc

SEQ ID NO: 5782657 - DNA, 22 bp, Homo sapiens
gttacttttcatatttgcacta

SEQ ID NO: 5782658 - DNA, 15 bp, Homo sapiens
gttagaaaggcagcc

SEQ ID NO: 5782659 - DNA, 13 bp, Homo sapiens
gttagaaagtgct

SEQ ID NO: 5782660 - DNA, 19 bp, Homo sapiens
gttagaaatgcagaatcct

SEQ ID NO: 5782661 - DNA, 21 bp, Homo sapiens
gttagaacactattttcagaa

SEQ ID NO: 5782662 - DNA, 16 bp, Homo sapiens
gttagaaccacagcag

SEQ ID NO: 5782663 - DNA, 17 bp, Homo sapiens
gttagaaccacagcaga

SEQ ID NO: 5782664 - DNA, 14 bp, Homo sapiens
gttagaaggcttaa

SEQ ID NO: 5782665 - DNA, 11 bp, Homo sapiens
gttagaatcaa

SEQ ID NO: 5782666 - DNA, 18 bp, Homo sapiens
gttagaatcttgttttgt

SEQ ID NO: 5782667 - DNA, 19 bp, Homo sapiens
gttagaatcttgttttgtt

SEQ ID NO: 5782668 - DNA, 22 bp, Homo sapiens
gttagaattaggtaatggatat

SEQ ID NO: 5782669 - DNA, 20 bp, Homo sapiens
gttagaattccttcagggtg

SEQ ID NO: 5782670 - DNA, 16 bp, Homo sapiens
gttagacaagcctgga

SEQ ID NO: 5782671 - DNA, 22 bp, Homo sapiens
gttagacaatagtttttaaaag

SEQ ID NO: 5782672 - DNA, 22 bp, Homo sapiens
gttagaccgctctcttttctgt

SEQ ID NO: 5782673 - DNA, 18 bp, Homo sapiens
gttagacgccttccaggt

SEQ ID NO: 5782674 - DNA, 22 bp, Homo sapiens
gttagacgccttccaggtcagg

SEQ ID NO: 5782675 - DNA, 18 bp, Homo sapiens
gttagacttgtgtgcatg

SEQ ID NO: 5782676 - DNA, 23 bp, Homo sapiens
gttagagaactaaactagttttt

SEQ ID NO: 5782677 - DNA, 22 bp, Homo sapiens
gttagagagggaccatgtgtca

SEQ ID NO: 5782678 - DNA, 20 bp, Homo sapiens
gttagagaggtagcgagctg

SEQ ID NO: 5782679 - DNA, 17 bp, Homo sapiens
gttagagataattctga

SEQ ID NO: 5782680 - DNA, 10 bp, Homo sapiens
gttagagcac

SEQ ID NO: 5782681 - DNA, 18 bp, Homo sapiens
gttagagcaggactgatg

SEQ ID NO: 5782682 - DNA, 22 bp, Homo sapiens
gttagatatttcgaccctgggg

SEQ ID NO: 5782683 - DNA, 14 bp, Homo sapiens
gttagatctaccct

SEQ ID NO: 5782684 - DNA, 21 bp, Homo sapiens
gttagatctttgtaaatgcat

SEQ ID NO: 5782685 - DNA, 11 bp, Homo sapiens
gttagatgttt

SEQ ID NO: 5782686 - DNA, 13 bp, Homo sapiens
gttagattaagaa

SEQ ID NO: 5782687 - DNA, 20 bp, Homo sapiens
gttagcaaactatttcagtg

SEQ ID NO: 5782688 - DNA, 15 bp, Homo sapiens
gttagcaaactttgt

SEQ ID NO: 5782689 - DNA, 20 bp, Homo sapiens
gttagcactgaactgctttt

SEQ ID NO: 5782690 - DNA, 20 bp, Homo sapiens
gttagcactgatagtccttt

SEQ ID NO: 5782691 - DNA, 13 bp, Homo sapiens
gttagcagacagg

SEQ ID NO: 5782692 - DNA, 14 bp, Homo sapiens
gttagcaggaaata

SEQ ID NO: 5782693 - DNA, 19 bp, Homo sapiens
gttagcattaaagttctag

SEQ ID NO: 5782694 - DNA, 17 bp, Homo sapiens
gttagcattgtttctag

SEQ ID NO: 5782695 - DNA, 14 bp, Homo sapiens
gttagccactgctg

SEQ ID NO: 5782696 - DNA, 18 bp, Homo sapiens
gttagcccaatggagaaa

SEQ ID NO: 5782697 - DNA, 21 bp, Homo sapiens
gttagcccaatggagaaatga

SEQ ID NO: 5782698 - DNA, 23 bp, Homo sapiens
gttagcccggccaaggacactga

SEQ ID NO: 5782699 - DNA, 13 bp, Homo sapiens
gttagcctgcacc

SEQ ID NO: 5782700 - DNA, 22 bp, Homo sapiens
gttagcctggatagccttgaaa

SEQ ID NO: 5782701 - DNA, 23 bp, Homo sapiens
gttagccttttttccccagactt

SEQ ID NO: 5782702 - DNA, 21 bp, Homo sapiens
gttagcgtccatttcttattt

SEQ ID NO: 5782703 - DNA, 21 bp, Homo sapiens
gttagctaaaccaagaaggag

SEQ ID NO: 5782704 - DNA, 21 bp, Homo sapiens
gttagctaataaaaagctttt

SEQ ID NO: 5782705 - DNA, 15 bp, Homo sapiens
gttagctcacaggac

SEQ ID NO: 5782706 - DNA, 21 bp, Homo sapiens
gttagctcagccccagcccag

SEQ ID NO: 5782707 - DNA, 20 bp, Homo sapiens
gttagctcaggaggcttgga

SEQ ID NO: 5782708 - DNA, 21 bp, Homo sapiens
gttagctccctgtggggcagg

SEQ ID NO: 5782709 - DNA, 14 bp, Homo sapiens
gttagctcctgtgg

SEQ ID NO: 5782710 - DNA, 21 bp, Homo sapiens
gttagctgacagtcagctgtg

SEQ ID NO: 5782711 - DNA, 21 bp, Homo sapiens
gttagctgtttactgacatgg

SEQ ID NO: 5782712 - DNA, 17 bp, Homo sapiens
gttagcttcctgcagga

SEQ ID NO: 5782713 - DNA, 21 bp, Homo sapiens
gttagctttccaaggaagcag

SEQ ID NO: 5782714 - DNA, 21 bp, Homo sapiens
gttaggaaataaaacctttca

SEQ ID NO: 5782715 - DNA, 22 bp, Homo sapiens
gttaggaaataaaacctttcaa

SEQ ID NO: 5782716 - DNA, 22 bp, Homo sapiens
gttaggaacccggcatgccgag

SEQ ID NO: 5782717 - DNA, 16 bp, Homo sapiens
gttaggaagttacctg

SEQ ID NO: 5782718 - DNA, 17 bp, Homo sapiens
gttaggacaaggctgtg

SEQ ID NO: 5782719 - DNA, 19 bp, Homo sapiens
gttaggacaaggctgtgcc

SEQ ID NO: 5782720 - DNA, 20 bp, Homo sapiens
gttaggaggacaaaaggaat

SEQ ID NO: 5782721 - DNA, 18 bp, Homo sapiens
gttaggaggctgcatgct

SEQ ID NO: 5782722 - DNA, 22 bp, Homo sapiens
gttaggaggctgcatgctctgg

SEQ ID NO: 5782723 - DNA, 20 bp, Homo sapiens
gttaggatgcggctttctct

SEQ ID NO: 5782724 - DNA, 15 bp, Homo sapiens
gttaggatttaacag

SEQ ID NO: 5782725 - DNA, 18 bp, Homo sapiens
gttaggcattaatgtttc

SEQ ID NO: 5782726 - DNA, 19 bp, Homo sapiens
gttaggccaaagacaaata

SEQ ID NO: 5782727 - DNA, 15 bp, Homo sapiens
gttaggccacgctcc

SEQ ID NO: 5782728 - DNA, 16 bp, Homo sapiens
gttaggccaggcctta

SEQ ID NO: 5782729 - DNA, 15 bp, Homo sapiens
gttaggcctggcaca

SEQ ID NO: 5782730 - DNA, 15 bp, Homo sapiens
gttagggaaaacatt

SEQ ID NO: 5782731 - DNA, 20 bp, Homo sapiens
gttagggaaaacattccatc

SEQ ID NO: 5782732 - DNA, 23 bp, Homo sapiens
gttagggaaatccaactccaggg

SEQ ID NO: 5782733 - DNA, 14 bp, Homo sapiens
gttagggaagagaa

SEQ ID NO: 5782734 - DNA, 20 bp, Homo sapiens
gttagggactgaccagcagc

SEQ ID NO: 5782735 - DNA, 21 bp, Homo sapiens
gttagggagagagaagcaggc

SEQ ID NO: 5782736 - DNA, 22 bp, Homo sapiens
gttagggagatgagttgcagtt

SEQ ID NO: 5782737 - DNA, 17 bp, Homo sapiens
gttaggggaaaatagta

SEQ ID NO: 5782738 - DNA, 13 bp, Homo sapiens
gttaggggtgggg

SEQ ID NO: 5782739 - DNA, 21 bp, Homo sapiens
gttaggggtgggggagaatgg

SEQ ID NO: 5782740 - DNA, 23 bp, Homo sapiens
gttagggtgctctggaagagagg

SEQ ID NO: 5782741 - DNA, 14 bp, Homo sapiens
gttaggttacagat

SEQ ID NO: 5782742 - DNA, 16 bp, Homo sapiens
gttaggttttctatgt

SEQ ID NO: 5782743 - DNA, 16 bp, Homo sapiens
gttagtaaaggaacca

SEQ ID NO: 5782744 - DNA, 13 bp, Homo sapiens
gttagtagaactt

SEQ ID NO: 5782745 - DNA, 17 bp, Homo sapiens
gttagtagcagaaatat

SEQ ID NO: 5782746 - DNA, 16 bp, Homo sapiens
gttagtatctaacatg

SEQ ID NO: 5782747 - DNA, 17 bp, Homo sapiens
gttagtatcttttgata

SEQ ID NO: 5782748 - DNA, 21 bp, Homo sapiens
gttagtattttaatcctgtac

SEQ ID NO: 5782749 - DNA, 13 bp, Homo sapiens
gttagtcacctgc

SEQ ID NO: 5782750 - DNA, 12 bp, Homo sapiens
gttagtcatttg

SEQ ID NO: 5782751 - DNA, 18 bp, Homo sapiens
gttagtcgtgagctcttg

SEQ ID NO: 5782752 - DNA, 21 bp, Homo sapiens
gttagtctactcttaagccat

SEQ ID NO: 5782753 - DNA, 22 bp, Homo sapiens
gttagtctactcttaagccatc

SEQ ID NO: 5782754 - DNA, 22 bp, Homo sapiens
gttagtctcttgtattaaactc

SEQ ID NO: 5782755 - DNA, 14 bp, Homo sapiens
gttagtgacattta

SEQ ID NO: 5782756 - DNA, 14 bp, Homo sapiens
gttagtgatgcagt

SEQ ID NO: 5782757 - DNA, 15 bp, Homo sapiens
gttagtgatttgcta

SEQ ID NO: 5782758 - DNA, 18 bp, Homo sapiens
gttagtgatttgctatca

SEQ ID NO: 5782759 - DNA, 17 bp, Homo sapiens
gttagtgcatgtcacat

SEQ ID NO: 5782760 - DNA, 15 bp, Homo sapiens
gttagtgggaagagc

SEQ ID NO: 5782761 - DNA, 15 bp, Homo sapiens
gttagtgggcaggtg

SEQ ID NO: 5782762 - DNA, 17 bp, Homo sapiens
gttagtgtgttgtctgt

SEQ ID NO: 5782763 - DNA, 18 bp, Homo sapiens
gttagtgtgttgtctgtg

SEQ ID NO: 5782764 - DNA, 19 bp, Homo sapiens
gttagttaaaggcttaaat

SEQ ID NO: 5782765 - DNA, 23 bp, Homo sapiens
gttagttataaaactatgtgttc

SEQ ID NO: 5782766 - DNA, 23 bp, Homo sapiens
gttagttcaatcctgattcatat

SEQ ID NO: 5782767 - DNA, 18 bp, Homo sapiens
gttagttcagtagcttat

SEQ ID NO: 5782768 - DNA, 13 bp, Homo sapiens
gttagtttacaat

SEQ ID NO: 5782769 - DNA, 14 bp, Homo sapiens
gttagtttacaata

SEQ ID NO: 5782770 - DNA, 15 bp, Homo sapiens
gttagtttacaatat

SEQ ID NO: 5782771 - DNA, 22 bp, Homo sapiens
gttagtttagtgtgtgtgcaga

SEQ ID NO: 5782772 - DNA, 21 bp, Homo sapiens
gttagtttgtatatattatta

SEQ ID NO: 5782773 - DNA, 22 bp, Homo sapiens
gttataaaagtgattgttggca

SEQ ID NO: 5782774 - DNA, 21 bp, Homo sapiens
gttataaaatctgtattgcta

SEQ ID NO: 5782775 - DNA, 18 bp, Homo sapiens
gttataaaccaatgaaat

SEQ ID NO: 5782776 - DNA, 20 bp, Homo sapiens
gttataaagaaagattgtaa

SEQ ID NO: 5782777 - DNA, 14 bp, Homo sapiens
gttataaagataca

SEQ ID NO: 5782778 - DNA, 13 bp, Homo sapiens
gttataaatagcc

SEQ ID NO: 5782779 - DNA, 17 bp, Homo sapiens
gttataaatttatcaac

SEQ ID NO: 5782780 - DNA, 18 bp, Homo sapiens
gttataacagatgtgaaa

SEQ ID NO: 5782781 - DNA, 14 bp, Homo sapiens
gttataacttaatg

SEQ ID NO: 5782782 - DNA, 21 bp, Homo sapiens
gttataacttaatgaaaacaa

SEQ ID NO: 5782783 - DNA, 17 bp, Homo sapiens
gttataacttcataaaa

SEQ ID NO: 5782784 - DNA, 18 bp, Homo sapiens
gttcagaaatgctgcctg

SEQ ID NO: 5782785 - DNA, 21 bp, Homo sapiens
gttcagaaatgctgcctgcct

SEQ ID NO: 5782786 - DNA, 21 bp, Homo sapiens
gttcagaacttcatctgccac

SEQ ID NO: 5782787 - DNA, 19 bp, Homo sapiens
gttcagaatggcagtcctg

SEQ ID NO: 5782788 - DNA, 20 bp, Homo sapiens
gttcagaattaaacttttaa

SEQ ID NO: 5782789 - DNA, 22 bp, Homo sapiens
gttcagaatttagtgtatccat

SEQ ID NO: 5782790 - DNA, 13 bp, Homo sapiens
gttcagaattttg

SEQ ID NO: 5782791 - DNA, 19 bp, Homo sapiens
gttcagaattttggaaaaa

SEQ ID NO: 5782792 - DNA, 14 bp, Homo sapiens
gttcagacacagct

SEQ ID NO: 5782793 - DNA, 15 bp, Homo sapiens
gttcagacacagctc

SEQ ID NO: 5782794 - DNA, 17 bp, Homo sapiens
gttcagacccctgcctg

SEQ ID NO: 5782795 - DNA, 15 bp, Homo sapiens
gttcagacttagttt

SEQ ID NO: 5782796 - DNA, 16 bp, Homo sapiens
gttcagagactcaggg

SEQ ID NO: 5782797 - DNA, 17 bp, Homo sapiens
gttcagagactcagggc

SEQ ID NO: 5782798 - DNA, 14 bp, Homo sapiens
gttcagagatcagg

SEQ ID NO: 5782799 - DNA, 14 bp, Homo sapiens
gttcagagctgccc

SEQ ID NO: 5782800 - DNA, 15 bp, Homo sapiens
gttcagagctgccct

SEQ ID NO: 5782801 - DNA, 17 bp, Homo sapiens
gttcagagctgccctct

SEQ ID NO: 5782802 - DNA, 14 bp, Homo sapiens
gttcagaggaagca

SEQ ID NO: 5782803 - DNA, 11 bp, Homo sapiens
gttcagaggca

SEQ ID NO: 5782804 - DNA, 16 bp, Homo sapiens
gttcagcaccacccta

SEQ ID NO: 5782805 - DNA, 13 bp, Homo sapiens
gttcagcacttgt

SEQ ID NO: 5782806 - DNA, 22 bp, Homo sapiens
gttcagcacttgtctcatttta

SEQ ID NO: 5782807 - DNA, 23 bp, Homo sapiens
gttcagcacttgtctcattttaa

SEQ ID NO: 5782808 - DNA, 18 bp, Homo sapiens
gttcagcagtacagccga

SEQ ID NO: 5782809 - DNA, 19 bp, Homo sapiens
gttcagcatggcatccaag

SEQ ID NO: 5782810 - DNA, 16 bp, Homo sapiens
gttcagcattcttagc

SEQ ID NO: 5782811 - DNA, 23 bp, Homo sapiens
gttcagccaaacagtatgatgga

SEQ ID NO: 5782812 - DNA, 15 bp, Homo sapiens
gttcagccaaggttt

SEQ ID NO: 5782813 - DNA, 20 bp, Homo sapiens
gttcagcccctcctctgcca

SEQ ID NO: 5782814 - DNA, 20 bp, Homo sapiens
gttcagcccctgatctctga

SEQ ID NO: 5782815 - DNA, 13 bp, Homo sapiens
gttcagcctggcc

SEQ ID NO: 5782816 - DNA, 16 bp, Homo sapiens
gttcagcctggcctgc

SEQ ID NO: 5782817 - DNA, 18 bp, Homo sapiens
gttcagcctggcctgccc

SEQ ID NO: 5782818 - DNA, 11 bp, Homo sapiens
gttcagcctgt

SEQ ID NO: 5782819 - DNA, 18 bp, Homo sapiens
gttcagccttcgtgtggc

SEQ ID NO: 5782820 - DNA, 19 bp, Homo sapiens
gttcagctaagctaggaat

SEQ ID NO: 5782821 - DNA, 13 bp, Homo sapiens
gttcagctactcc

SEQ ID NO: 5782822 - DNA, 13 bp, Homo sapiens
gttcagctccagc

SEQ ID NO: 5782823 - DNA, 19 bp, Homo sapiens
gttcagctcccccaggctg

SEQ ID NO: 5782824 - DNA, 21 bp, Homo sapiens
gttcagctctttccaaattaa

SEQ ID NO: 5782825 - DNA, 15 bp, Homo sapiens
gttcagctgccccac

SEQ ID NO: 5782826 - DNA, 19 bp, Homo sapiens
gttcagctttaaaggccag

SEQ ID NO: 5782827 - DNA, 19 bp, Homo sapiens
gttcaggaacccttctcca

SEQ ID NO: 5782828 - DNA, 18 bp, Homo sapiens
gttcaggagagtaaaaat

SEQ ID NO: 5782829 - DNA, 22 bp, Homo sapiens
gttcaggagagtaaaaattcat

SEQ ID NO: 5782830 - DNA, 20 bp, Homo sapiens
gttcaggagtccaaaccttc

SEQ ID NO: 5782831 - DNA, 15 bp, Homo sapiens
gttcaggagtcccaa

SEQ ID NO: 5782832 - DNA, 14 bp, Homo sapiens
gttcaggctctgag

SEQ ID NO: 5782833 - DNA, 23 bp, Homo sapiens
gttcagggaactgcttgcccagg

SEQ ID NO: 5782834 - DNA, 20 bp, Homo sapiens
gttcagggaagcaggcagag

SEQ ID NO: 5782835 - DNA, 20 bp, Homo sapiens
gttcagggaccgtccagggg

SEQ ID NO: 5782836 - DNA, 22 bp, Homo sapiens
gttcagggaggggccggctggc

SEQ ID NO: 5782837 - DNA, 16 bp, Homo sapiens
gttcagggcttttctt

SEQ ID NO: 5782838 - DNA, 19 bp, Homo sapiens
gttcaggggactcagccct

SEQ ID NO: 5782839 - DNA, 17 bp, Homo sapiens
gttcagggttggcccct

SEQ ID NO: 5782840 - DNA, 18 bp, Homo sapiens
gttcagggttggcccctg

SEQ ID NO: 5782841 - DNA, 19 bp, Homo sapiens
gttcagggttggcccctgc

SEQ ID NO: 5782842 - DNA, 20 bp, Homo sapiens
gttcagggttggcccctgcc

SEQ ID NO: 5782843 - DNA, 19 bp, Homo sapiens
gttcaggtacacatatttt

SEQ ID NO: 5782844 - DNA, 13 bp, Homo sapiens
gttcaggtagctg

SEQ ID NO: 5782845 - DNA, 19 bp, Homo sapiens
gttcaggtcccctttcaga

SEQ ID NO: 5782846 - DNA, 19 bp, Homo sapiens
gttcagtagatttcctttt

SEQ ID NO: 5782847 - DNA, 18 bp, Homo sapiens
gttcagtattatgtagtt

SEQ ID NO: 5782848 - DNA, 13 bp, Homo sapiens
gttcagtctttca

SEQ ID NO: 5782849 - DNA, 13 bp, Homo sapiens
gttcagtgccttc

SEQ ID NO: 5782850 - DNA, 15 bp, Homo sapiens
gttcagtgccttcct

SEQ ID NO: 5782851 - DNA, 18 bp, Homo sapiens
gttcagtggcagggctca

SEQ ID NO: 5782852 - DNA, 16 bp, Homo sapiens
gttcagtgtaaatagt

SEQ ID NO: 5782853 - DNA, 12 bp, Homo sapiens
gttcagtgtaat

SEQ ID NO: 5782854 - DNA, 13 bp, Homo sapiens
gttcagtgtaatt

SEQ ID NO: 5782855 - DNA, 18 bp, Homo sapiens
gttcagtgtcccaggcag

SEQ ID NO: 5782856 - DNA, 17 bp, Homo sapiens
gttcagtgttaagtgat

SEQ ID NO: 5782857 - DNA, 11 bp, Homo sapiens
gttcagtgttg

SEQ ID NO: 5782858 - DNA, 21 bp, Homo sapiens
gttcagtgttgacatagcctt

SEQ ID NO: 5782859 - DNA, 13 bp, Homo sapiens
gttcagttacaga

SEQ ID NO: 5782860 - DNA, 16 bp, Homo sapiens
gttcagttccagcttt

SEQ ID NO: 5782861 - DNA, 22 bp, Homo sapiens
gttcataaaggtttacagtgaa

SEQ ID NO: 5782862 - DNA, 13 bp, Homo sapiens
gttcataaatgaa

SEQ ID NO: 5782863 - DNA, 23 bp, Homo sapiens
gttcataaatttgttgtcatgtg

SEQ ID NO: 5782864 - DNA, 17 bp, Homo sapiens
gttcataataaaagtga

SEQ ID NO: 5782865 - DNA, 16 bp, Homo sapiens
gttcatacagttttat

SEQ ID NO: 5782866 - DNA, 13 bp, Homo sapiens
gttcatacatatt

SEQ ID NO: 5782867 - DNA, 11 bp, Homo sapiens
gttcatacatt

SEQ ID NO: 5782868 - DNA, 16 bp, Homo sapiens
gttcatacatttgagg

SEQ ID NO: 5782869 - DNA, 16 bp, Homo sapiens
gttcatacctaagtac

SEQ ID NO: 5782870 - DNA, 20 bp, Homo sapiens
gttcatacctaagtactgta

SEQ ID NO: 5782871 - DNA, 22 bp, Homo sapiens
gttcatagagttcccatgaact

SEQ ID NO: 5782872 - DNA, 14 bp, Homo sapiens
gttcatagcccagt

SEQ ID NO: 5782873 - DNA, 22 bp, Homo sapiens
gttcatagggtctcttcaggtt

SEQ ID NO: 5782874 - DNA, 17 bp, Homo sapiens
gttcatatagccaggga

SEQ ID NO: 5782875 - DNA, 21 bp, Homo sapiens
gttcatatgcagaacgtattt

SEQ ID NO: 5782876 - DNA, 19 bp, Homo sapiens
gttcatattccatatttat

SEQ ID NO: 5782877 - DNA, 12 bp, Homo sapiens
gttcatcagtgt

SEQ ID NO: 5782878 - DNA, 21 bp, Homo sapiens
gttcatcagtgttaaaaaatt

SEQ ID NO: 5782879 - DNA, 22 bp, Homo sapiens
gttcatcatccagatgtggcta

SEQ ID NO: 5782880 - DNA, 15 bp, Homo sapiens
gttcatcatccctcc

SEQ ID NO: 5782881 - DNA, 16 bp, Homo sapiens
gttcatcatccctccc

SEQ ID NO: 5782882 - DNA, 17 bp, Homo sapiens
gttcatccaaggctgtt

SEQ ID NO: 5782883 - DNA, 15 bp, Homo sapiens
gttcatccaatcctc

SEQ ID NO: 5782884 - DNA, 19 bp, Homo sapiens
gttcatccaatcctcactg

SEQ ID NO: 5782885 - DNA, 18 bp, Homo sapiens
gttcatcccttctcttcc

SEQ ID NO: 5782886 - DNA, 20 bp, Homo sapiens
gttcatcctattctttcgaa

SEQ ID NO: 5782887 - DNA, 21 bp, Homo sapiens
gttcatcctcattgcctcctg

SEQ ID NO: 5782888 - DNA, 20 bp, Homo sapiens
gttcatctatggcagtccag

SEQ ID NO: 5782889 - DNA, 14 bp, Homo sapiens
gttcatctctgctg

SEQ ID NO: 5782890 - DNA, 15 bp, Homo sapiens
gttcatctctgctga

SEQ ID NO: 5782891 - DNA, 18 bp, Homo sapiens
gttcatctctttgtcctg

SEQ ID NO: 5782892 - DNA, 14 bp, Homo sapiens
gttcatctgaggag

SEQ ID NO: 5782893 - DNA, 18 bp, Homo sapiens
gttcatctgaggagtcca

SEQ ID NO: 5782894 - DNA, 20 bp, Homo sapiens
gttcatctggaagtattttc

SEQ ID NO: 5782895 - DNA, 15 bp, Homo sapiens
gttcatctgtccatg

SEQ ID NO: 5782896 - DNA, 12 bp, Homo sapiens
gttcatcttgaa

SEQ ID NO: 5782897 - DNA, 18 bp, Homo sapiens
gttcatcttgaattgtaa

SEQ ID NO: 5782898 - DNA, 12 bp, Homo sapiens
gttcatgaatac

SEQ ID NO: 5782899 - DNA, 12 bp, Homo sapiens
gttcatgacaat

SEQ ID NO: 5782900 - DNA, 19 bp, Homo sapiens
gttcatgagaatctatatt

SEQ ID NO: 5782901 - DNA, 15 bp, Homo sapiens
gttcatgagtggatg

SEQ ID NO: 5782902 - DNA, 22 bp, Homo sapiens
gttcatgcagacaaagccctgt

SEQ ID NO: 5782903 - DNA, 23 bp, Homo sapiens
gttcatgcagacaaagccctgtc

SEQ ID NO: 5782904 - DNA, 16 bp, Homo sapiens
gttcatgcagctgtgg

SEQ ID NO: 5782905 - DNA, 13 bp, Homo sapiens
gttcatgcctggg

SEQ ID NO: 5782906 - DNA, 14 bp, Homo sapiens
gttcatgcctgggg

SEQ ID NO: 5782907 - DNA, 15 bp, Homo sapiens
gttcatgcctggggt

SEQ ID NO: 5782908 - DNA, 16 bp, Homo sapiens
gttcatgcctggggtg

SEQ ID NO: 5782909 - DNA, 17 bp, Homo sapiens
gttcatgctccaagact

SEQ ID NO: 5782910 - DNA, 16 bp, Homo sapiens
gttcatgctgaatcca

SEQ ID NO: 5782911 - DNA, 13 bp, Homo sapiens
gttcatggaattg

SEQ ID NO: 5782912 - DNA, 17 bp, Homo sapiens
gttcatggcaagtgggg

SEQ ID NO: 5782913 - DNA, 21 bp, Homo sapiens
gttcatggcaagtggggctgg

SEQ ID NO: 5782914 - DNA, 22 bp, Homo sapiens
gttcatggcagatgtaggaggg

SEQ ID NO: 5782915 - DNA, 19 bp, Homo sapiens
gttcatgggcacctcatgg

SEQ ID NO: 5782916 - DNA, 19 bp, Homo sapiens
gttcatggggatctggggg

SEQ ID NO: 5782917 - DNA, 20 bp, Homo sapiens
gttcatgggggagggggcag

SEQ ID NO: 5782918 - DNA, 14 bp, Homo sapiens
gttcatgtctctga

SEQ ID NO: 5782919 - DNA, 16 bp, Homo sapiens
gttcatgtgcctctgc

SEQ ID NO: 5782920 - DNA, 19 bp, Homo sapiens
gttcatgttttgctaatgc

SEQ ID NO: 5782921 - DNA, 12 bp, Homo sapiens
gttcattaaaca

SEQ ID NO: 5782922 - DNA, 16 bp, Homo sapiens
gttcattaaagcatga

SEQ ID NO: 5782923 - DNA, 20 bp, Homo sapiens
gttcattaaagcatgaatgg

SEQ ID NO: 5782924 - DNA, 18 bp, Homo sapiens
gttcattagaaatatttt

SEQ ID NO: 5782925 - DNA, 18 bp, Homo sapiens
gttcattataatctcaaa

SEQ ID NO: 5782926 - DNA, 19 bp, Homo sapiens
gttcattataatctcaaag

SEQ ID NO: 5782927 - DNA, 22 bp, Homo sapiens
gttcattattggaattaacctg

SEQ ID NO: 5782928 - DNA, 21 bp, Homo sapiens
gttcattcaaaatgtccagct

SEQ ID NO: 5782929 - DNA, 22 bp, Homo sapiens
gttcattcaaaatgtccagctt

SEQ ID NO: 5782930 - DNA, 11 bp, Homo sapiens
gttcattcaca

SEQ ID NO: 5782931 - DNA, 16 bp, Homo sapiens
gttcattcatattaca

SEQ ID NO: 5782932 - DNA, 12 bp, Homo sapiens
gttcattccaca

SEQ ID NO: 5782933 - DNA, 13 bp, Homo sapiens
gttcattcccaga

SEQ ID NO: 5782934 - DNA, 15 bp, Homo sapiens
gttcattcctccagg

SEQ ID NO: 5782935 - DNA, 20 bp, Homo sapiens
gttcattctatgacaataaa

SEQ ID NO: 5782936 - DNA, 19 bp, Homo sapiens
gttcattctgcattgagaa

SEQ ID NO: 5782937 - DNA, 23 bp, Homo sapiens
gttcattctgcattgagaaggaa

SEQ ID NO: 5782938 - DNA, 20 bp, Homo sapiens
gttcattcttaccgagaaaa

SEQ ID NO: 5782939 - DNA, 22 bp, Homo sapiens
gttcattcttaccgagaaaagg

SEQ ID NO: 5782940 - DNA, 16 bp, Homo sapiens
gttcattgcactttga

SEQ ID NO: 5782941 - DNA, 21 bp, Homo sapiens
gttcattggcattctttgcaa

SEQ ID NO: 5782942 - DNA, 22 bp, Homo sapiens
gttcattggcattctttgcaat

SEQ ID NO: 5782943 - DNA, 18 bp, Homo sapiens
gttcattgtaatgttact

SEQ ID NO: 5782944 - DNA, 20 bp, Homo sapiens
gttcatttcaaatacatctt

SEQ ID NO: 5782945 - DNA, 11 bp, Homo sapiens
gttcatttcac

SEQ ID NO: 5782946 - DNA, 14 bp, Homo sapiens
gttcatttctgtct

SEQ ID NO: 5782947 - DNA, 21 bp, Homo sapiens
gttcatttggtgttcctggaa

SEQ ID NO: 5782948 - DNA, 18 bp, Homo sapiens
gttcatttgttattctta

SEQ ID NO: 5782949 - DNA, 14 bp, Homo sapiens
gttcattttaagta

SEQ ID NO: 5782950 - DNA, 21 bp, Homo sapiens
gttcattttaagtaacgtgct

SEQ ID NO: 5782951 - DNA, 20 bp, Homo sapiens
gttcattttctctgtatgaa

SEQ ID NO: 5782952 - DNA, 20 bp, Homo sapiens
gttcattttgagtattttta

SEQ ID NO: 5782953 - DNA, 15 bp, Homo sapiens
gttcatttttaaagc

SEQ ID NO: 5782954 - DNA, 19 bp, Homo sapiens
gttcatttttaaagcctgg

SEQ ID NO: 5782955 - DNA, 21 bp, Homo sapiens
gttccaaaaataccatttatc

SEQ ID NO: 5782956 - DNA, 22 bp, Homo sapiens
gttccaaaccagtttattctgt

SEQ ID NO: 5782957 - DNA, 17 bp, Homo sapiens
gttccaaaccctcctgg

SEQ ID NO: 5782958 - DNA, 23 bp, Homo sapiens
gttccaaagccagtgaaatgtga

SEQ ID NO: 5782959 - DNA, 21 bp, Homo sapiens
gttccaaagtcacaggaagaa

SEQ ID NO: 5782960 - DNA, 15 bp, Homo sapiens
gttccaaattcagtt

SEQ ID NO: 5782961 - DNA, 20 bp, Homo sapiens
gttccaaattcagtttcata

SEQ ID NO: 5782962 - DNA, 17 bp, Homo sapiens
gttcggatcgctccgcc

SEQ ID NO: 5782963 - DNA, 15 bp, Homo sapiens
gttcggcctgtgtcc

SEQ ID NO: 5782964 - DNA, 14 bp, Homo sapiens
gttcggctctgggt

SEQ ID NO: 5782965 - DNA, 23 bp, Homo sapiens
gttcgggggaaatagttccattc

SEQ ID NO: 5782966 - DNA, 20 bp, Homo sapiens
gttcgggggagcagagagag

SEQ ID NO: 5782967 - DNA, 19 bp, Homo sapiens
gttcggtttttttcctgtt

SEQ ID NO: 5782968 - DNA, 22 bp, Homo sapiens
gttcgtggagccacaggcagac

SEQ ID NO: 5782969 - DNA, 17 bp, Homo sapiens
gttcgtttccatcatgt

SEQ ID NO: 5782970 - DNA, 16 bp, Homo sapiens
gttctaaaaggtgtga

SEQ ID NO: 5782971 - DNA, 14 bp, Homo sapiens
gttctaaaatataa

SEQ ID NO: 5782972 - DNA, 21 bp, Homo sapiens
gttctaaaatcaagtgcacct

SEQ ID NO: 5782973 - DNA, 17 bp, Homo sapiens
gttctaaagatggaaaa

SEQ ID NO: 5782974 - DNA, 10 bp, Homo sapiens
gttctaaagc

SEQ ID NO: 5782975 - DNA, 12 bp, Homo sapiens
gttctaaagctc

SEQ ID NO: 5782976 - DNA, 14 bp, Homo sapiens
gttctaaagttcta

SEQ ID NO: 5782977 - DNA, 19 bp, Homo sapiens
gttctaaagttctaagatt

SEQ ID NO: 5782978 - DNA, 21 bp, Homo sapiens
gttctaaagttctaagattct

SEQ ID NO: 5782979 - DNA, 18 bp, Homo sapiens
gttctaaatatgaatgaa

SEQ ID NO: 5782980 - DNA, 12 bp, Homo sapiens
gttctaaatgca

SEQ ID NO: 5782981 - DNA, 16 bp, Homo sapiens
gttctaaatgcaataa

SEQ ID NO: 5782982 - DNA, 16 bp, Homo sapiens
gttctaaattctataa

SEQ ID NO: 5782983 - DNA, 13 bp, Homo sapiens
gttctaacctcct

SEQ ID NO: 5782984 - DNA, 16 bp, Homo sapiens
gttctaacctttacat

SEQ ID NO: 5782985 - DNA, 19 bp, Homo sapiens
gttctaactcttagaagtg

SEQ ID NO: 5782986 - DNA, 11 bp, Homo sapiens
gttctaacttc

SEQ ID NO: 5782987 - DNA, 15 bp, Homo sapiens
gttctaagactcaaa

SEQ ID NO: 5782988 - DNA, 21 bp, Homo sapiens
gttctaagactcaaatgttct

SEQ ID NO: 5782989 - DNA, 13 bp, Homo sapiens
gttctaagatgtg

SEQ ID NO: 5782990 - DNA, 21 bp, Homo sapiens
gttctaagatgtgatattcta

SEQ ID NO: 5782991 - DNA, 15 bp, Homo sapiens
gttctaagattctga

SEQ ID NO: 5782992 - DNA, 17 bp, Homo sapiens
gttctaaggctctgaga

SEQ ID NO: 5782993 - DNA, 14 bp, Homo sapiens
gttctaaggggacc

SEQ ID NO: 5782994 - DNA, 14 bp, Homo sapiens
gttctaagggggag

SEQ ID NO: 5782995 - DNA, 19 bp, Homo sapiens
gttctaagtctttccattg

SEQ ID NO: 5782996 - DNA, 19 bp, Homo sapiens
gttctaataatttctaatg

SEQ ID NO: 5782997 - DNA, 21 bp, Homo sapiens
gttctaattaagaaaactatt

SEQ ID NO: 5782998 - DNA, 14 bp, Homo sapiens
gttctacaagcata

SEQ ID NO: 5782999 - DNA, 17 bp, Homo sapiens
gttctacaagcatattt

SEQ ID NO: 5783000 - DNA, 20 bp, Homo sapiens
gttctacaatctatttattg

SEQ ID NO: 5783001 - DNA, 16 bp, Homo sapiens
gttctacactcatctt

SEQ ID NO: 5783002 - DNA, 21 bp, Homo sapiens
gttctaccgtggatttgtact

SEQ ID NO: 5783003 - DNA, 19 bp, Homo sapiens
gttctacggatcatcaaca

SEQ ID NO: 5783004 - DNA, 15 bp, Homo sapiens
gttctactccttccc

SEQ ID NO: 5783005 - DNA, 21 bp, Homo sapiens
gttctactcttaatgatgtta

SEQ ID NO: 5783006 - DNA, 22 bp, Homo sapiens
gttctactcttaatgatgttat

SEQ ID NO: 5783007 - DNA, 21 bp, Homo sapiens
gttctagaaaaacaggcactt

SEQ ID NO: 5783008 - DNA, 14 bp, Homo sapiens
gttctagaaccact

SEQ ID NO: 5783009 - DNA, 15 bp, Homo sapiens
gttctagaaccactt

SEQ ID NO: 5783010 - DNA, 21 bp, Homo sapiens
gttctagaaggggcgaggctt

SEQ ID NO: 5783011 - DNA, 13 bp, Homo sapiens
gttctagaatcat

SEQ ID NO: 5783012 - DNA, 20 bp, Homo sapiens
gttctagacatggaggttct

SEQ ID NO: 5783013 - DNA, 22 bp, Homo sapiens
gttctagacatggaggttctaa

SEQ ID NO: 5783014 - DNA, 20 bp, Homo sapiens
gttctagacgcccctcccaa

SEQ ID NO: 5783015 - DNA, 15 bp, Homo sapiens
gttctagagaagagg

SEQ ID NO: 5783016 - DNA, 23 bp, Homo sapiens
gttctagcacttcatctggctgc

SEQ ID NO: 5783017 - DNA, 18 bp, Homo sapiens
gttctagcatggcatatt

SEQ ID NO: 5783018 - DNA, 19 bp, Homo sapiens
gttctagcatggcatattt

SEQ ID NO: 5783019 - DNA, 19 bp, Homo sapiens
gttctagcatggctgccaa

SEQ ID NO: 5783020 - DNA, 17 bp, Homo sapiens
gttctaggaaaataaaa

SEQ ID NO: 5783021 - DNA, 23 bp, Homo sapiens
gttctaggatagttgatgcatgt

SEQ ID NO: 5783022 - DNA, 22 bp, Homo sapiens
gttctaggcatacttttcaaag

SEQ ID NO: 5783023 - DNA, 20 bp, Homo sapiens
gttctaggctaccagaagag

SEQ ID NO: 5783024 - DNA, 15 bp, Homo sapiens
gttctaggctgctgc

SEQ ID NO: 5783025 - DNA, 22 bp, Homo sapiens
gttctaggggagaagagccctg

SEQ ID NO: 5783026 - DNA, 23 bp, Homo sapiens
gttctagtccttggtctgctggt

SEQ ID NO: 5783027 - DNA, 14 bp, Homo sapiens
gttctagtgttttc

SEQ ID NO: 5783028 - DNA, 21 bp, Homo sapiens
gttctagttagcaggaaatag

SEQ ID NO: 5783029 - DNA, 14 bp, Homo sapiens
gttctagtttgcat

SEQ ID NO: 5783030 - DNA, 13 bp, Homo sapiens
gttctagttttca

SEQ ID NO: 5783031 - DNA, 17 bp, Homo sapiens
gttctataaatgaatgt

SEQ ID NO: 5783032 - DNA, 15 bp, Homo sapiens
gttctatataatttt

SEQ ID NO: 5783033 - DNA, 19 bp, Homo sapiens
gttctatattgtgccaagc

SEQ ID NO: 5783034 - DNA, 21 bp, Homo sapiens
gttctatcagtgacttctgaa

SEQ ID NO: 5783035 - DNA, 13 bp, Homo sapiens
gttctatgatata

SEQ ID NO: 5783036 - DNA, 15 bp, Homo sapiens
gttctatgatttgta

SEQ ID NO: 5783037 - DNA, 15 bp, Homo sapiens
gttctatgcctttag

SEQ ID NO: 5783038 - DNA, 16 bp, Homo sapiens
gttctatgcttcctcg

SEQ ID NO: 5783039 - DNA, 23 bp, Homo sapiens
gttctattagttttttggccttg

SEQ ID NO: 5783040 - DNA, 15 bp, Homo sapiens
gttctatttaaaatg

SEQ ID NO: 5783041 - DNA, 14 bp, Homo sapiens
gttctatttctatc

SEQ ID NO: 5783042 - DNA, 17 bp, Homo sapiens
gttctatttctatccca

SEQ ID NO: 5783043 - DNA, 18 bp, Homo sapiens
gttctatttctatcccaa

SEQ ID NO: 5783044 - DNA, 15 bp, Homo sapiens
gttctatttctatct

SEQ ID NO: 5783045 - DNA, 17 bp, Homo sapiens
gttctatttctatctgc

SEQ ID NO: 5783046 - DNA, 14 bp, Homo sapiens
gttctatttggaat

SEQ ID NO: 5783047 - DNA, 18 bp, Homo sapiens
gttctattttactgtctt

SEQ ID NO: 5783048 - DNA, 18 bp, Homo sapiens
gttctatttttgtttaca

SEQ ID NO: 5783049 - DNA, 15 bp, Homo sapiens
gttctcaaaccctgt

SEQ ID NO: 5783050 - DNA, 14 bp, Homo sapiens
gttctcaaagttaa

SEQ ID NO: 5783051 - DNA, 14 bp, Homo sapiens
gttctcaaatgtgt

SEQ ID NO: 5783052 - DNA, 15 bp, Homo sapiens
gttctcaacacacag

SEQ ID NO: 5783053 - DNA, 18 bp, Homo sapiens
gttctcaacacacagtat

SEQ ID NO: 5783054 - DNA, 18 bp, Homo sapiens
gttctcaataaaacagaa

SEQ ID NO: 5783055 - DNA, 16 bp, Homo sapiens
gttctcaatgtgaaaa

SEQ ID NO: 5783056 - DNA, 17 bp, Homo sapiens
gttctcacacccaccgt

SEQ ID NO: 5783057 - DNA, 21 bp, Homo sapiens
gttctcacactggtctgctgt

SEQ ID NO: 5783058 - DNA, 16 bp, Homo sapiens
gttctcactatgtttc

SEQ ID NO: 5783059 - DNA, 21 bp, Homo sapiens
gttctcactcctaggagagcc

SEQ ID NO: 5783060 - DNA, 15 bp, Homo sapiens
gttctcactgggaag

SEQ ID NO: 5783061 - DNA, 16 bp, Homo sapiens
gttctcactgttccct

SEQ ID NO: 5783062 - DNA, 19 bp, Homo sapiens
gttctcagaaatgtcatga

SEQ ID NO: 5783063 - DNA, 23 bp, Homo sapiens
gttctcagaatcccttaacagtt

SEQ ID NO: 5783064 - DNA, 15 bp, Homo sapiens
gttctcagagctcca

SEQ ID NO: 5783065 - DNA, 18 bp, Homo sapiens
gttctcagatcttgacag

SEQ ID NO: 5783066 - DNA, 11 bp, Homo sapiens
gttctcagcaa

SEQ ID NO: 5783067 - DNA, 16 bp, Homo sapiens
gttctcagcaagtgta

SEQ ID NO: 5783068 - DNA, 19 bp, Homo sapiens
gttctcagcttgcagctgg

SEQ ID NO: 5783069 - DNA, 15 bp, Homo sapiens
gttctcagggctcct

SEQ ID NO: 5783070 - DNA, 17 bp, Homo sapiens
gttctcaggttcactca

SEQ ID NO: 5783071 - DNA, 16 bp, Homo sapiens
gttctcatctttcttg

SEQ ID NO: 5783072 - DNA, 14 bp, Homo sapiens
gttctcatgaacta

SEQ ID NO: 5783073 - DNA, 19 bp, Homo sapiens
gttctcatgaactacccca

SEQ ID NO: 5783074 - DNA, 22 bp, Homo sapiens
gttctcatgataccacctttac

SEQ ID NO: 5783075 - DNA, 18 bp, Homo sapiens
gttctcatgtttgtgcat

SEQ ID NO: 5783076 - DNA, 21 bp, Homo sapiens
gttctcatgtttgtgcatgta

SEQ ID NO: 5783077 - DNA, 19 bp, Homo sapiens
gttctccaagaaactgaat

SEQ ID NO: 5783078 - DNA, 22 bp, Homo sapiens
gttctccacccaccagtcaggg

SEQ ID NO: 5783079 - DNA, 13 bp, Homo sapiens
gttctccactggg

SEQ ID NO: 5783080 - DNA, 11 bp, Homo sapiens
gttctccagat

SEQ ID NO: 5783081 - DNA, 13 bp, Homo sapiens
gttctccagccca

SEQ ID NO: 5783082 - DNA, 14 bp, Homo sapiens
gttctccagcccac

SEQ ID NO: 5783083 - DNA, 14 bp, Homo sapiens
gttctccaggcttc

SEQ ID NO: 5783084 - DNA, 19 bp, Homo sapiens
gttctccaggcttcacagt

SEQ ID NO: 5783085 - DNA, 14 bp, Homo sapiens
gttctccatcccca

SEQ ID NO: 5783086 - DNA, 21 bp, Homo sapiens
gttctcccagcactgcctcct

SEQ ID NO: 5783087 - DNA, 22 bp, Homo sapiens
gttctcccagcactgcctcctg

SEQ ID NO: 5783088 - DNA, 23 bp, Homo sapiens
gttctcccagggagtgagcagct

SEQ ID NO: 5783089 - DNA, 20 bp, Homo sapiens
gttctccctcccaccttaaa

SEQ ID NO: 5783090 - DNA, 20 bp, Homo sapiens
gttctccctgtacagtgtta

SEQ ID NO: 5783091 - DNA, 14 bp, Homo sapiens
gttctccctttctc

SEQ ID NO: 5783092 - DNA, 17 bp, Homo sapiens
gttctccctttctctct

SEQ ID NO: 5783093 - DNA, 19 bp, Homo sapiens
gttctccctttctctctcc

SEQ ID NO: 5783094 - DNA, 20 bp, Homo sapiens
gttctcctaatgctctgaaa

SEQ ID NO: 5783095 - DNA, 19 bp, Homo sapiens
gttctcctatatcctcctt

SEQ ID NO: 5783096 - DNA, 12 bp, Homo sapiens
gttctcctgatt

SEQ ID NO: 5783097 - DNA, 17 bp, Homo sapiens
gttctcctgctgctccc

SEQ ID NO: 5783098 - DNA, 15 bp, Homo sapiens
gttctcctgcttgta

SEQ ID NO: 5783099 - DNA, 17 bp, Homo sapiens
gttctcctgtccctcca

SEQ ID NO: 5783100 - DNA, 18 bp, Homo sapiens
gttctcctgtccctccat

SEQ ID NO: 5783101 - DNA, 14 bp, Homo sapiens
gttctccttcctca

SEQ ID NO: 5783102 - DNA, 20 bp, Homo sapiens
gttctccttcctcagcctcc

SEQ ID NO: 5783103 - DNA, 16 bp, Homo sapiens
gttctccttgtacttg

SEQ ID NO: 5783104 - DNA, 17 bp, Homo sapiens
gttctccttttgaactt

SEQ ID NO: 5783105 - DNA, 17 bp, Homo sapiens
gttctcgtgacccagtg

SEQ ID NO: 5783106 - DNA, 15 bp, Homo sapiens
gttctcgtgccctta

SEQ ID NO: 5783107 - DNA, 23 bp, Homo sapiens
gttctcgttttgggccagaggca

SEQ ID NO: 5783108 - DNA, 15 bp, Homo sapiens
gttctctagaaagaa

SEQ ID NO: 5783109 - DNA, 17 bp, Homo sapiens
gttctctatcatttaat

SEQ ID NO: 5783110 - DNA, 21 bp, Homo sapiens
gttctctattttgcctttaaa

SEQ ID NO: 5783111 - DNA, 13 bp, Homo sapiens
gttctctccagga

SEQ ID NO: 5783112 - DNA, 12 bp, Homo sapiens
gttctctcccct

SEQ ID NO: 5783113 - DNA, 19 bp, Homo sapiens
gttctctccccttgcactg

SEQ ID NO: 5783114 - DNA, 16 bp, Homo sapiens
gttctctcctccccaa

SEQ ID NO: 5783115 - DNA, 13 bp, Homo sapiens
gttctctccttct

SEQ ID NO: 5783116 - DNA, 21 bp, Homo sapiens
gttctctctactggtcctctt

SEQ ID NO: 5783117 - DNA, 15 bp, Homo sapiens
gttctctctatggta

SEQ ID NO: 5783118 - DNA, 23 bp, Homo sapiens
gttctctctatggtaaagatatt

SEQ ID NO: 5783119 - DNA, 13 bp, Homo sapiens
gttctctctgcct

SEQ ID NO: 5783120 - DNA, 17 bp, Homo sapiens
gttctctctgcctgtga

SEQ ID NO: 5783121 - DNA, 19 bp, Homo sapiens
gttctctcttggtctcttt

SEQ ID NO: 5783122 - DNA, 15 bp, Homo sapiens
gttctctctttgcat

SEQ ID NO: 5783123 - DNA, 15 bp, Homo sapiens
gttctctgatgcaga

SEQ ID NO: 5783124 - DNA, 12 bp, Homo sapiens
gttctctgccaa

SEQ ID NO: 5783125 - DNA, 12 bp, Homo sapiens
gttctctgctga

SEQ ID NO: 5783126 - DNA, 14 bp, Homo sapiens
gttctctgctgagg

SEQ ID NO: 5783127 - DNA, 16 bp, Homo sapiens
gttctctgctgagggc

SEQ ID NO: 5783128 - DNA, 14 bp, Homo sapiens
gttctctgcttttc

SEQ ID NO: 5783129 - DNA, 20 bp, Homo sapiens
gttctctgggagaaaatcat

SEQ ID NO: 5783130 - DNA, 15 bp, Homo sapiens
gttctctgtaattac

SEQ ID NO: 5783131 - DNA, 14 bp, Homo sapiens
gttctctgtcccca

SEQ ID NO: 5783132 - DNA, 23 bp, Homo sapiens
gttctcttactgccgaaaccctt

SEQ ID NO: 5783133 - DNA, 16 bp, Homo sapiens
gttctcttcattccca

SEQ ID NO: 5783134 - DNA, 15 bp, Homo sapiens
gttctcttcccaggc

SEQ ID NO: 5783135 - DNA, 12 bp, Homo sapiens
gttctcttgctt

SEQ ID NO: 5783136 - DNA, 15 bp, Homo sapiens
gttctcttggctgca

SEQ ID NO: 5783137 - DNA, 18 bp, Homo sapiens
gttctcttgtatagctga

SEQ ID NO: 5783138 - DNA, 22 bp, Homo sapiens
gttctctttgccttgatgttgt

SEQ ID NO: 5783139 - DNA, 14 bp, Homo sapiens
gttctctttggaaa

SEQ ID NO: 5783140 - DNA, 15 bp, Homo sapiens
gttctctttggaaat

SEQ ID NO: 5783141 - DNA, 11 bp, Homo sapiens
gttgccacagg

SEQ ID NO: 5783142 - DNA, 14 bp, Homo sapiens
gttgccacaggaca

SEQ ID NO: 5783143 - DNA, 16 bp, Homo sapiens
gttgccacaggacaca

SEQ ID NO: 5783144 - DNA, 19 bp, Homo sapiens
gttgccacagtagaactgt

SEQ ID NO: 5783145 - DNA, 20 bp, Homo sapiens
gttgccaccacctctgtggc

SEQ ID NO: 5783146 - DNA, 17 bp, Homo sapiens
gttgccaccatgtattc

SEQ ID NO: 5783147 - DNA, 15 bp, Homo sapiens
gttgccagagatgga

SEQ ID NO: 5783148 - DNA, 16 bp, Homo sapiens
gttgccagaggccctg

SEQ ID NO: 5783149 - DNA, 12 bp, Homo sapiens
gttgccagcaga

SEQ ID NO: 5783150 - DNA, 17 bp, Homo sapiens
gttgccaggttgcagct

SEQ ID NO: 5783151 - DNA, 19 bp, Homo sapiens
gttgccaggttgcagctgc

SEQ ID NO: 5783152 - DNA, 16 bp, Homo sapiens
gttgccagtcaccccg

SEQ ID NO: 5783153 - DNA, 14 bp, Homo sapiens
gttgccagtcagca

SEQ ID NO: 5783154 - DNA, 12 bp, Homo sapiens
gttgccagtgct

SEQ ID NO: 5783155 - DNA, 15 bp, Homo sapiens
gttgccatgaggcct

SEQ ID NO: 5783156 - DNA, 19 bp, Homo sapiens
gttgccattattctatgta

SEQ ID NO: 5783157 - DNA, 18 bp, Homo sapiens
gttgccatttctctgctt

SEQ ID NO: 5783158 - DNA, 20 bp, Homo sapiens
gttgcccaaggttgcacagc

SEQ ID NO: 5783159 - DNA, 15 bp, Homo sapiens
gttgcccaggcaggt

SEQ ID NO: 5783160 - DNA, 17 bp, Homo sapiens
gttgcccaggcaggtct

SEQ ID NO: 5783161 - DNA, 13 bp, Homo sapiens
gttgcccaggctg

SEQ ID NO: 5783162 - DNA, 17 bp, Homo sapiens
gttgcccaggctggcgt

SEQ ID NO: 5783163 - DNA, 18 bp, Homo sapiens
gttgccccattcctaaga

SEQ ID NO: 5783164 - DNA, 20 bp, Homo sapiens
gttgcccccaaagcccatgc

SEQ ID NO: 5783165 - DNA, 19 bp, Homo sapiens
gttgcccccattcccagcc

SEQ ID NO: 5783166 - DNA, 15 bp, Homo sapiens
gttgcccccatttct

SEQ ID NO: 5783167 - DNA, 16 bp, Homo sapiens
gttgccccgtctctgt

SEQ ID NO: 5783168 - DNA, 17 bp, Homo sapiens
gttgccccttccccatc

SEQ ID NO: 5783169 - DNA, 21 bp, Homo sapiens
gttgcccgaaactaagccagg

SEQ ID NO: 5783170 - DNA, 16 bp, Homo sapiens
gttgcccgccctccac

SEQ ID NO: 5783171 - DNA, 17 bp, Homo sapiens
gttgcccgccctccacc

SEQ ID NO: 5783172 - DNA, 22 bp, Homo sapiens
gttgccctgtttcctgctgctt

SEQ ID NO: 5783173 - DNA, 22 bp, Homo sapiens
gttgccgcagcggtgggaagga

SEQ ID NO: 5783174 - DNA, 18 bp, Homo sapiens
gttgcctaagcattgcct

SEQ ID NO: 5783175 - DNA, 17 bp, Homo sapiens
gttgcctaagtattaaa

SEQ ID NO: 5783176 - DNA, 15 bp, Homo sapiens
gttgcctaattggaa

SEQ ID NO: 5783177 - DNA, 16 bp, Homo sapiens
gttgcctcaacagcag

SEQ ID NO: 5783178 - DNA, 21 bp, Homo sapiens
gttgcctcaacagcaggaggc

SEQ ID NO: 5783179 - DNA, 12 bp, Homo sapiens
gttgcctccccc

SEQ ID NO: 5783180 - DNA, 20 bp, Homo sapiens
gttgcctcctcccatccagc

SEQ ID NO: 5783181 - DNA, 12 bp, Homo sapiens
gttgcctcctct

SEQ ID NO: 5783182 - DNA, 14 bp, Homo sapiens
gttgcctcctctct

SEQ ID NO: 5783183 - DNA, 22 bp, Homo sapiens
gttgcctcgagtccccccaccc

SEQ ID NO: 5783184 - DNA, 14 bp, Homo sapiens
gttgcctctctaag

SEQ ID NO: 5783185 - DNA, 16 bp, Homo sapiens
gttgcctctctgccag

SEQ ID NO: 5783186 - DNA, 20 bp, Homo sapiens
gttgcctctgattttctcca

SEQ ID NO: 5783187 - DNA, 15 bp, Homo sapiens
gttgcctgaaaaatg

SEQ ID NO: 5783188 - DNA, 14 bp, Homo sapiens
gttgcctgtcgctt

SEQ ID NO: 5783189 - DNA, 15 bp, Homo sapiens
gttgcctgtcgcttt

SEQ ID NO: 5783190 - DNA, 18 bp, Homo sapiens
gttgccttaaagaaagtc

SEQ ID NO: 5783191 - DNA, 17 bp, Homo sapiens
gttgccttatttctcat

SEQ ID NO: 5783192 - DNA, 20 bp, Homo sapiens
gttgcctttttcattttcca

SEQ ID NO: 5783193 - DNA, 17 bp, Homo sapiens
gttgcgacggagagaaa

SEQ ID NO: 5783194 - DNA, 16 bp, Homo sapiens
gttgcgggggagctgg

SEQ ID NO: 5783195 - DNA, 20 bp, Homo sapiens
gttgcgggggagctggaaat

SEQ ID NO: 5783196 - DNA, 15 bp, Homo sapiens
gttgcgtctgaggcc

SEQ ID NO: 5783197 - DNA, 15 bp, Homo sapiens
gttgctaaacactgc

SEQ ID NO: 5783198 - DNA, 20 bp, Homo sapiens
gttgctaaattataaaattg

SEQ ID NO: 5783199 - DNA, 14 bp, Homo sapiens
gttgctaacagcaa

SEQ ID NO: 5783200 - DNA, 22 bp, Homo sapiens
gttgctaacctcaatttatgtt

SEQ ID NO: 5783201 - DNA, 17 bp, Homo sapiens
gttgctaagccccagca

SEQ ID NO: 5783202 - DNA, 17 bp, Homo sapiens
gttgctaatgcctttca

SEQ ID NO: 5783203 - DNA, 20 bp, Homo sapiens
gttgctagggagagggaaga

SEQ ID NO: 5783204 - DNA, 15 bp, Homo sapiens
gttgctattgtaagg

SEQ ID NO: 5783205 - DNA, 23 bp, Homo sapiens
gttgctattgtaaggtctttgta

SEQ ID NO: 5783206 - DNA, 17 bp, Homo sapiens
gttgctatttttgtaaa

SEQ ID NO: 5783207 - DNA, 22 bp, Homo sapiens
gttgctcagcaaggggctctgc

SEQ ID NO: 5783208 - DNA, 22 bp, Homo sapiens
gttgctcagtctccctttccct

SEQ ID NO: 5783209 - DNA, 22 bp, Homo sapiens
gttgctccgcctggcctggcca

SEQ ID NO: 5783210 - DNA, 20 bp, Homo sapiens
gttgctccggcctgcgtctc

SEQ ID NO: 5783211 - DNA, 21 bp, Homo sapiens
gttgctcctacccctgtcctg

SEQ ID NO: 5783212 - DNA, 15 bp, Homo sapiens
gttgctcgaagactg

SEQ ID NO: 5783213 - DNA, 18 bp, Homo sapiens
gttgctctgtttcttcct

SEQ ID NO: 5783214 - DNA, 23 bp, Homo sapiens
gttgctctttggctgaaattctt

SEQ ID NO: 5783215 - DNA, 16 bp, Homo sapiens
gttgctgaagatgcct

SEQ ID NO: 5783216 - DNA, 21 bp, Homo sapiens
gttgctgaccagctggagtga

SEQ ID NO: 5783217 - DNA, 16 bp, Homo sapiens
gttgctgagccagctg

SEQ ID NO: 5783218 - DNA, 18 bp, Homo sapiens
gttgctgagccagctgca

SEQ ID NO: 5783219 - DNA, 16 bp, Homo sapiens
gttgctgatccctgct

SEQ ID NO: 5783220 - DNA, 22 bp, Homo sapiens
gttgctgatggcccctccagca

SEQ ID NO: 5783221 - DNA, 20 bp, Homo sapiens
gttgctgattcaagaaacag

SEQ ID NO: 5783222 - DNA, 13 bp, Homo sapiens
gttgctgattttg

SEQ ID NO: 5783223 - DNA, 12 bp, Homo sapiens
gttgctgctgct

SEQ ID NO: 5783224 - DNA, 14 bp, Homo sapiens
gttgctgctgctgc

SEQ ID NO: 5783225 - DNA, 20 bp, Homo sapiens
gttgctgctgtccagtgcct

SEQ ID NO: 5783226 - DNA, 14 bp, Homo sapiens
gttgctggaaaatc

SEQ ID NO: 5783227 - DNA, 13 bp, Homo sapiens
gttgctggagggg

SEQ ID NO: 5783228 - DNA, 15 bp, Homo sapiens
gttgctggaggggct

SEQ ID NO: 5783229 - DNA, 22 bp, Homo sapiens
gttgctggcttgttgtaaagca

SEQ ID NO: 5783230 - DNA, 16 bp, Homo sapiens
gttgctggtaaaatga

SEQ ID NO: 5783231 - DNA, 17 bp, Homo sapiens
gttgctggtcaggtccc

SEQ ID NO: 5783232 - DNA, 15 bp, Homo sapiens
gttgctggtcctgca

SEQ ID NO: 5783233 - DNA, 21 bp, Homo sapiens
gttgctggtcctgcacatgag

SEQ ID NO: 5783234 - DNA, 16 bp, Homo sapiens
gttgctggttgctgtg

SEQ ID NO: 5783235 - DNA, 19 bp, Homo sapiens
gttgctggttgctgtgtgg

SEQ ID NO: 5783236 - DNA, 21 bp, Homo sapiens
gttgctggttggattaatctt

SEQ ID NO: 5783237 - DNA, 17 bp, Homo sapiens
gttgctgtgccgtgtcc

SEQ ID NO: 5783238 - DNA, 12 bp, Homo sapiens
gttgctgtggac

SEQ ID NO: 5783239 - DNA, 20 bp, Homo sapiens
gttgctgtggaccaatgcat

SEQ ID NO: 5783240 - DNA, 13 bp, Homo sapiens
gttgctgtggctc

SEQ ID NO: 5783241 - DNA, 17 bp, Homo sapiens
gttgctgttaatctgat

SEQ ID NO: 5783242 - DNA, 16 bp, Homo sapiens
gttgctgttcacagct

SEQ ID NO: 5783243 - DNA, 17 bp, Homo sapiens
gttgctgttgctgttgg

SEQ ID NO: 5783244 - DNA, 20 bp, Homo sapiens
gttgctgttggcatcttgct

SEQ ID NO: 5783245 - DNA, 15 bp, Homo sapiens
gttgctgtttcacaa

SEQ ID NO: 5783246 - DNA, 21 bp, Homo sapiens
gttgctgttttcctcccttct

SEQ ID NO: 5783247 - DNA, 19 bp, Homo sapiens
gttgcttacggtttctttg

SEQ ID NO: 5783248 - DNA, 13 bp, Homo sapiens
gttgcttcagtaa

SEQ ID NO: 5783249 - DNA, 22 bp, Homo sapiens
gttgcttctggctcctccttcc

SEQ ID NO: 5783250 - DNA, 23 bp, Homo sapiens
gttgctttaaagtacctgtagtg

SEQ ID NO: 5783251 - DNA, 18 bp, Homo sapiens
gttgctttaatatgagct

SEQ ID NO: 5783252 - DNA, 13 bp, Homo sapiens
gttgctttcctct

SEQ ID NO: 5783253 - DNA, 17 bp, Homo sapiens
gttgctttgaaaaagcc

SEQ ID NO: 5783254 - DNA, 14 bp, Homo sapiens
gttgctttgccaga

SEQ ID NO: 5783255 - DNA, 19 bp, Homo sapiens
gttgctttgccagagcagg

SEQ ID NO: 5783256 - DNA, 17 bp, Homo sapiens
gttgctttgcccaagat

SEQ ID NO: 5783257 - DNA, 15 bp, Homo sapiens
gttgctttgccctgg

SEQ ID NO: 5783258 - DNA, 15 bp, Homo sapiens
gttgctttgttacaa

SEQ ID NO: 5783259 - DNA, 14 bp, Homo sapiens
gttgctttgttgca

SEQ ID NO: 5783260 - DNA, 14 bp, Homo sapiens
gttgcttttgaaaa

SEQ ID NO: 5783261 - DNA, 19 bp, Homo sapiens
gttgcttttttagatttat

SEQ ID NO: 5783262 - DNA, 13 bp, Homo sapiens
gttggaaaaaatt

SEQ ID NO: 5783263 - DNA, 20 bp, Homo sapiens
gttggaaaacatatgaaata

SEQ ID NO: 5783264 - DNA, 22 bp, Homo sapiens
gttggaaaagaatacagaaaga

SEQ ID NO: 5783265 - DNA, 15 bp, Homo sapiens
gttggaaacactaaa

SEQ ID NO: 5783266 - DNA, 23 bp, Homo sapiens
gttggaaacactaaatgttaaag

SEQ ID NO: 5783267 - DNA, 16 bp, Homo sapiens
gttggaaactgtaaaa

SEQ ID NO: 5783268 - DNA, 17 bp, Homo sapiens
gttggaaagaacattta

SEQ ID NO: 5783269 - DNA, 21 bp, Homo sapiens
gttggaactatacccgggacc

SEQ ID NO: 5783270 - DNA, 15 bp, Homo sapiens
gttggaactgctgcc

SEQ ID NO: 5783271 - DNA, 14 bp, Homo sapiens
gttggaagagaatc

SEQ ID NO: 5783272 - DNA, 15 bp, Homo sapiens
gttggaagaggaaca

SEQ ID NO: 5783273 - DNA, 22 bp, Homo sapiens
gttggaagctaccagagctcta

SEQ ID NO: 5783274 - DNA, 17 bp, Homo sapiens
gttggaaggatctgctg

SEQ ID NO: 5783275 - DNA, 18 bp, Homo sapiens
gttggaaggatctgctga

SEQ ID NO: 5783276 - DNA, 22 bp, Homo sapiens
gttggaaggggccttgctgagt

SEQ ID NO: 5783277 - DNA, 18 bp, Homo sapiens
gttggaatcacctggagg

SEQ ID NO: 5783278 - DNA, 16 bp, Homo sapiens
gttggaatcttttata

SEQ ID NO: 5783279 - DNA, 17 bp, Homo sapiens
gttggaatggatttttc

SEQ ID NO: 5783280 - DNA, 17 bp, Homo sapiens
gttggaattaaaacaat

SEQ ID NO: 5783281 - DNA, 22 bp, Homo sapiens
gttggaattccacgcccgggag

SEQ ID NO: 5783282 - DNA, 17 bp, Homo sapiens
gttggacacactgtaaa

SEQ ID NO: 5783283 - DNA, 21 bp, Homo sapiens
gttggacacctttaggttctt

SEQ ID NO: 5783284 - DNA, 15 bp, Homo sapiens
gttggacagacactg

SEQ ID NO: 5783285 - DNA, 19 bp, Homo sapiens
gttggacagcaaaaccatt

SEQ ID NO: 5783286 - DNA, 23 bp, Homo sapiens
gttggacagcaaaaccattgctt

SEQ ID NO: 5783287 - DNA, 14 bp, Homo sapiens
gttggacagccccc

SEQ ID NO: 5783288 - DNA, 14 bp, Homo sapiens
gttggacagctgct

SEQ ID NO: 5783289 - DNA, 21 bp, Homo sapiens
gttggaccagaggaagcccct

SEQ ID NO: 5783290 - DNA, 20 bp, Homo sapiens
gttggacccgctctggacca

SEQ ID NO: 5783291 - DNA, 22 bp, Homo sapiens
gttggacgggatgacctccaga

SEQ ID NO: 5783292 - DNA, 18 bp, Homo sapiens
gttggactaaatgcctag

SEQ ID NO: 5783293 - DNA, 14 bp, Homo sapiens
gttggactctcagg

SEQ ID NO: 5783294 - DNA, 15 bp, Homo sapiens
gttggactctgagct

SEQ ID NO: 5783295 - DNA, 16 bp, Homo sapiens
gttggactgtgcctgg

SEQ ID NO: 5783296 - DNA, 13 bp, Homo sapiens
gttggactgtggc

SEQ ID NO: 5783297 - DNA, 21 bp, Homo sapiens
gttggacttttcgttaacatt

SEQ ID NO: 5783298 - DNA, 10 bp, Homo sapiens
gttggagaaa

SEQ ID NO: 5783299 - DNA, 13 bp, Homo sapiens
gttggagaaagaa

SEQ ID NO: 5783300 - DNA, 13 bp, Homo sapiens
gttggagagccct

SEQ ID NO: 5783301 - DNA, 14 bp, Homo sapiens
gttggagagccctg

SEQ ID NO: 5783302 - DNA, 16 bp, Homo sapiens
gttggagagccctgga

SEQ ID NO: 5783303 - DNA, 12 bp, Homo sapiens
gttggagccact

SEQ ID NO: 5783304 - DNA, 19 bp, Homo sapiens
gttggagccactctgttcc

SEQ ID NO: 5783305 - DNA, 16 bp, Homo sapiens
gttggagccgcacatc

SEQ ID NO: 5783306 - DNA, 12 bp, Homo sapiens
gttggagcctgc

SEQ ID NO: 5783307 - DNA, 16 bp, Homo sapiens
gttggagctcattctg

SEQ ID NO: 5783308 - DNA, 13 bp, Homo sapiens
gttggagctccag

SEQ ID NO: 5783309 - DNA, 22 bp, Homo sapiens
gttggaggaccccgagggctga

SEQ ID NO: 5783310 - DNA, 17 bp, Homo sapiens
gttggaggagagagcct

SEQ ID NO: 5783311 - DNA, 20 bp, Homo sapiens
gttggaggagagagccttgg

SEQ ID NO: 5783312 - DNA, 16 bp, Homo sapiens
gttggaggcaatgtgg

SEQ ID NO: 5783313 - DNA, 22 bp, Homo sapiens
gttggaggcccttttctggctc

SEQ ID NO: 5783314 - DNA, 14 bp, Homo sapiens
gttggaggcctcac

SEQ ID NO: 5783315 - DNA, 13 bp, Homo sapiens
gttggaggcctgg

SEQ ID NO: 5783316 - DNA, 13 bp, Homo sapiens
gttggagggaacc

SEQ ID NO: 5783317 - DNA, 12 bp, Homo sapiens
gttggaggggca

SEQ ID NO: 5783318 - DNA, 15 bp, Homo sapiens
gttggaggggcaggc

SEQ ID NO: 5783319 - DNA, 16 bp, Homo sapiens
gttggaggggcaggcc

SEQ ID NO: 5783320 - DNA, 14 bp, Homo sapiens
gttgtaaattggca

SEQ ID NO: 5783321 - DNA, 16 bp, Homo sapiens
gttgtaaattggcatg

SEQ ID NO: 5783322 - DNA, 16 bp, Homo sapiens
gttgtaacatttcaca

SEQ ID NO: 5783323 - DNA, 17 bp, Homo sapiens
gttgtaacctgctgtga

SEQ ID NO: 5783324 - DNA, 19 bp, Homo sapiens
gttgtaactaggctcagag

SEQ ID NO: 5783325 - DNA, 15 bp, Homo sapiens
gttgtaacttatatt

SEQ ID NO: 5783326 - DNA, 19 bp, Homo sapiens
gttgtaacttatgtagata

SEQ ID NO: 5783327 - DNA, 16 bp, Homo sapiens
gttgtaagaggatgtg

SEQ ID NO: 5783328 - DNA, 21 bp, Homo sapiens
gttgtaaggatataaaaagta

SEQ ID NO: 5783329 - DNA, 20 bp, Homo sapiens
gttgtaagtaataatttgta

SEQ ID NO: 5783330 - DNA, 20 bp, Homo sapiens
gttgtaatatcagttacagt

SEQ ID NO: 5783331 - DNA, 14 bp, Homo sapiens
gttgtaattgcatt

SEQ ID NO: 5783332 - DNA, 14 bp, Homo sapiens
gttgtaatttgaat

SEQ ID NO: 5783333 - DNA, 17 bp, Homo sapiens
gttgtaattttactttt

SEQ ID NO: 5783334 - DNA, 14 bp, Homo sapiens
gttgtacaaatgta

SEQ ID NO: 5783335 - DNA, 18 bp, Homo sapiens
gttgtacaagctcaggag

SEQ ID NO: 5783336 - DNA, 16 bp, Homo sapiens
gttgtacaatcatgtt

SEQ ID NO: 5783337 - DNA, 18 bp, Homo sapiens
gttgtacacttgggtgaa

SEQ ID NO: 5783338 - DNA, 15 bp, Homo sapiens
gttgtacatagtggt

SEQ ID NO: 5783339 - DNA, 14 bp, Homo sapiens
gttgtacatgaaat

SEQ ID NO: 5783340 - DNA, 16 bp, Homo sapiens
gttgtacatgaaattt

SEQ ID NO: 5783341 - DNA, 23 bp, Homo sapiens
gttgtacatttatgatttaataa

SEQ ID NO: 5783342 - DNA, 14 bp, Homo sapiens
gttgtaccactgct

SEQ ID NO: 5783343 - DNA, 18 bp, Homo sapiens
gttgtaccactgctaata

SEQ ID NO: 5783344 - DNA, 20 bp, Homo sapiens
gttgtaccactgctaataaa

SEQ ID NO: 5783345 - DNA, 23 bp, Homo sapiens
gttgtaccactgctaataaatga

SEQ ID NO: 5783346 - DNA, 16 bp, Homo sapiens
gttgtaccatatgtag

SEQ ID NO: 5783347 - DNA, 19 bp, Homo sapiens
gttgtaccatatgtagcat

SEQ ID NO: 5783348 - DNA, 18 bp, Homo sapiens
gttgtaccctctccaggc

SEQ ID NO: 5783349 - DNA, 16 bp, Homo sapiens
gttgtacgtaatgtat

SEQ ID NO: 5783350 - DNA, 19 bp, Homo sapiens
gttgtactattgtttaaaa

SEQ ID NO: 5783351 - DNA, 14 bp, Homo sapiens
gttgtacttcattt

SEQ ID NO: 5783352 - DNA, 13 bp, Homo sapiens
gttgtactttaaa

SEQ ID NO: 5783353 - DNA, 23 bp, Homo sapiens
gttgtactttatatcttgtttac

SEQ ID NO: 5783354 - DNA, 13 bp, Homo sapiens
gttgtagaatgta

SEQ ID NO: 5783355 - DNA, 20 bp, Homo sapiens
gttgtagagaaaacatgcag

SEQ ID NO: 5783356 - DNA, 14 bp, Homo sapiens
gttgtagcattttc

SEQ ID NO: 5783357 - DNA, 15 bp, Homo sapiens
gttgtaggactaaat

SEQ ID NO: 5783358 - DNA, 15 bp, Homo sapiens
gttgtagtgtccccc

SEQ ID NO: 5783359 - DNA, 16 bp, Homo sapiens
gttgtataaaaacatg

SEQ ID NO: 5783360 - DNA, 19 bp, Homo sapiens
gttgtataaatttatttac

SEQ ID NO: 5783361 - DNA, 14 bp, Homo sapiens
gttgtataatttcg

SEQ ID NO: 5783362 - DNA, 22 bp, Homo sapiens
gttgtatatcactaaaagcatg

SEQ ID NO: 5783363 - DNA, 18 bp, Homo sapiens
gttgtatcagcacgtgtg

SEQ ID NO: 5783364 - DNA, 15 bp, Homo sapiens
gttgtatcatactct

SEQ ID NO: 5783365 - DNA, 14 bp, Homo sapiens
gttgtatgccttta

SEQ ID NO: 5783366 - DNA, 14 bp, Homo sapiens
gttgtattaactgg

SEQ ID NO: 5783367 - DNA, 12 bp, Homo sapiens
gttgtattcatt

SEQ ID NO: 5783368 - DNA, 19 bp, Homo sapiens
gttgtattcctgcctttga

SEQ ID NO: 5783369 - DNA, 20 bp, Homo sapiens
gttgtattcctgcctttgat

SEQ ID NO: 5783370 - DNA, 13 bp, Homo sapiens
gttgtattcttct

SEQ ID NO: 5783371 - DNA, 21 bp, Homo sapiens
gttgtattgatcaatgcatgt

SEQ ID NO: 5783372 - DNA, 23 bp, Homo sapiens
gttgtattgatttttaagaaagt

SEQ ID NO: 5783373 - DNA, 21 bp, Homo sapiens
gttgtattgcatgcaatttga

SEQ ID NO: 5783374 - DNA, 14 bp, Homo sapiens
gttgtatttctata

SEQ ID NO: 5783375 - DNA, 18 bp, Homo sapiens
gttgtatttctatacagt

SEQ ID NO: 5783376 - DNA, 23 bp, Homo sapiens
gttgtattttaactcataccttt

SEQ ID NO: 5783377 - DNA, 16 bp, Homo sapiens
gttgtcaaagagaggg

SEQ ID NO: 5783378 - DNA, 18 bp, Homo sapiens
gttgtcaagaatagcatt

SEQ ID NO: 5783379 - DNA, 22 bp, Homo sapiens
gttgtcaagaatagcattgtaa

SEQ ID NO: 5783380 - DNA, 15 bp, Homo sapiens
gttgtcaaggaagaa

SEQ ID NO: 5783381 - DNA, 16 bp, Homo sapiens
gttgtcaaggaagaag

SEQ ID NO: 5783382 - DNA, 13 bp, Homo sapiens
gttgtcaataaat

SEQ ID NO: 5783383 - DNA, 16 bp, Homo sapiens
gttgtcaatattaaat

SEQ ID NO: 5783384 - DNA, 17 bp, Homo sapiens
gttgtcaatattaaata

SEQ ID NO: 5783385 - DNA, 19 bp, Homo sapiens
gttgtcaatattaaataca

SEQ ID NO: 5783386 - DNA, 20 bp, Homo sapiens
gttgtcacagtcttgtgaac

SEQ ID NO: 5783387 - DNA, 18 bp, Homo sapiens
gttgtcacatctcaggga

SEQ ID NO: 5783388 - DNA, 18 bp, Homo sapiens
gttgtcacctatgagacc

SEQ ID NO: 5783389 - DNA, 23 bp, Homo sapiens
gttgtcacctctctctgaggaca

SEQ ID NO: 5783390 - DNA, 11 bp, Homo sapiens
gttgtcagaat

SEQ ID NO: 5783391 - DNA, 22 bp, Homo sapiens
gttgtcagaatggaatccatct

SEQ ID NO: 5783392 - DNA, 21 bp, Homo sapiens
gttgtcagcaggcaggctggg

SEQ ID NO: 5783393 - DNA, 13 bp, Homo sapiens
gttgtcagcctgt

SEQ ID NO: 5783394 - DNA, 12 bp, Homo sapiens
gttgtcagctga

SEQ ID NO: 5783395 - DNA, 20 bp, Homo sapiens
gttgtccaatttgtaagtaa

SEQ ID NO: 5783396 - DNA, 22 bp, Homo sapiens
gttgtccagagataaaaatcat

SEQ ID NO: 5783397 - DNA, 12 bp, Homo sapiens
gttgtccaggaa

SEQ ID NO: 5783398 - DNA, 13 bp, Homo sapiens
gttgtccaggctg

SEQ ID NO: 5783399 - DNA, 11 bp, Homo sapiens
gttgtccaggt

SEQ ID NO: 5783400 - DNA, 23 bp, Homo sapiens
gttgtccaggtctagaaggccag

SEQ ID NO: 5783401 - DNA, 18 bp, Homo sapiens
gttgtccatattttcaca

SEQ ID NO: 5783402 - DNA, 18 bp, Homo sapiens
gttgtcccaatgaaatac

SEQ ID NO: 5783403 - DNA, 18 bp, Homo sapiens
gttgtccccgctggctca

SEQ ID NO: 5783404 - DNA, 13 bp, Homo sapiens
gttgtccctgcag

SEQ ID NO: 5783405 - DNA, 19 bp, Homo sapiens
gttgtcctatggacaactt

SEQ ID NO: 5783406 - DNA, 23 bp, Homo sapiens
gttgtcctatggacaacttattt

SEQ ID NO: 5783407 - DNA, 17 bp, Homo sapiens
gttgtcctcagccccgc

SEQ ID NO: 5783408 - DNA, 14 bp, Homo sapiens
gttgtcctcccagg

SEQ ID NO: 5783409 - DNA, 19 bp, Homo sapiens
gttgtcctcccaggaacca

SEQ ID NO: 5783410 - DNA, 16 bp, Homo sapiens
gttgtcctccccttgg

SEQ ID NO: 5783411 - DNA, 18 bp, Homo sapiens
gttgtcctgtgtcatctg

SEQ ID NO: 5783412 - DNA, 21 bp, Homo sapiens
gttgtcctgtgtcatctgtca

SEQ ID NO: 5783413 - DNA, 15 bp, Homo sapiens
gttgtcctgttaatt

SEQ ID NO: 5783414 - DNA, 13 bp, Homo sapiens
gttgtctacatta

SEQ ID NO: 5783415 - DNA, 22 bp, Homo sapiens
gttgtctattttttctgaggaa

SEQ ID NO: 5783416 - DNA, 23 bp, Homo sapiens
gttgtctattttttctgaggaat

SEQ ID NO: 5783417 - DNA, 12 bp, Homo sapiens
gttgtctccctc

SEQ ID NO: 5783418 - DNA, 15 bp, Homo sapiens
gttgtctccctggcc

SEQ ID NO: 5783419 - DNA, 16 bp, Homo sapiens
gttgtctccctggccc

SEQ ID NO: 5783420 - DNA, 23 bp, Homo sapiens
gttgtctctcttcggtggccttg

SEQ ID NO: 5783421 - DNA, 11 bp, Homo sapiens
gttgtctctga

SEQ ID NO: 5783422 - DNA, 18 bp, Homo sapiens
gttgtctctgatgcagct

SEQ ID NO: 5783423 - DNA, 23 bp, Homo sapiens
gttgtctctgttggtccactgtg

SEQ ID NO: 5783424 - DNA, 17 bp, Homo sapiens
gttgtctcttctcctta

SEQ ID NO: 5783425 - DNA, 14 bp, Homo sapiens
gttgtctgaaacat

SEQ ID NO: 5783426 - DNA, 15 bp, Homo sapiens
gttgtctgaacccag

SEQ ID NO: 5783427 - DNA, 21 bp, Homo sapiens
gttgtctgaacccaggcagct

SEQ ID NO: 5783428 - DNA, 23 bp, Homo sapiens
gttgtctgaacccaggcagctgg

SEQ ID NO: 5783429 - DNA, 19 bp, Homo sapiens
gttgtctgaagtcactgca

SEQ ID NO: 5783430 - DNA, 22 bp, Homo sapiens
gttgtctgaattgagaaaagag

SEQ ID NO: 5783431 - DNA, 20 bp, Homo sapiens
gttgtctgcgcctgaaaagg

SEQ ID NO: 5783432 - DNA, 12 bp, Homo sapiens
gttgtctgtcca

SEQ ID NO: 5783433 - DNA, 12 bp, Homo sapiens
gttgtctgtgct

SEQ ID NO: 5783434 - DNA, 21 bp, Homo sapiens
gttgtctgtggacccccccag

SEQ ID NO: 5783435 - DNA, 14 bp, Homo sapiens
gttgtcttagcatg

SEQ ID NO: 5783436 - DNA, 16 bp, Homo sapiens
gttgtcttatgtgaaa

SEQ ID NO: 5783437 - DNA, 22 bp, Homo sapiens
gttgtcttatgtgaaaaattaa

SEQ ID NO: 5783438 - DNA, 14 bp, Homo sapiens
gttgtcttattgca

SEQ ID NO: 5783439 - DNA, 15 bp, Homo sapiens
gttgtcttattgcac

SEQ ID NO: 5783440 - DNA, 15 bp, Homo sapiens
gttgtcttgaaacct

SEQ ID NO: 5783441 - DNA, 12 bp, Homo sapiens
gttgtctttctt

SEQ ID NO: 5783442 - DNA, 17 bp, Homo sapiens
gttgtgaaactaaaatt

SEQ ID NO: 5783443 - DNA, 19 bp, Homo sapiens
gttgtgaaactaaaatttt

SEQ ID NO: 5783444 - DNA, 19 bp, Homo sapiens
gttgtgaaagttttgagta

SEQ ID NO: 5783445 - DNA, 14 bp, Homo sapiens
gttgtgaataatta

SEQ ID NO: 5783446 - DNA, 22 bp, Homo sapiens
gttgtgaatcaccaaaggagct

SEQ ID NO: 5783447 - DNA, 17 bp, Homo sapiens
gttgtgacctgaagttc

SEQ ID NO: 5783448 - DNA, 18 bp, Homo sapiens
gttgtgacctgaagttca

SEQ ID NO: 5783449 - DNA, 23 bp, Homo sapiens
gttgtgactctaagctcagtgct

SEQ ID NO: 5783450 - DNA, 23 bp, Homo sapiens
gttgtgactctaggcttcaggtt

SEQ ID NO: 5783451 - DNA, 18 bp, Homo sapiens
gttgtgactgctgccatt

SEQ ID NO: 5783452 - DNA, 14 bp, Homo sapiens
gttgtgagaatggc

SEQ ID NO: 5783453 - DNA, 22 bp, Homo sapiens
gttgtgagaatggcctggagca

SEQ ID NO: 5783454 - DNA, 14 bp, Homo sapiens
gttgtgagccctct

SEQ ID NO: 5783455 - DNA, 18 bp, Homo sapiens
gttgtgagccctctaggg

SEQ ID NO: 5783456 - DNA, 14 bp, Homo sapiens
gttgtgaggcctgg

SEQ ID NO: 5783457 - DNA, 9 bp, Homo sapiens
gttgtgatt

SEQ ID NO: 5783458 - DNA, 18 bp, Homo sapiens
gttgtgattccccggagc

SEQ ID NO: 5783459 - DNA, 20 bp, Homo sapiens
gttgtgattccccggagctg

SEQ ID NO: 5783460 - DNA, 22 bp, Homo sapiens
gttgtgattccccggagctggg

SEQ ID NO: 5783461 - DNA, 23 bp, Homo sapiens
gttgtgattccccggagctggga

SEQ ID NO: 5783462 - DNA, 18 bp, Homo sapiens
gttgtgattgacagaacc

SEQ ID NO: 5783463 - DNA, 19 bp, Homo sapiens
gttgtgattttgtacagaa

SEQ ID NO: 5783464 - DNA, 20 bp, Homo sapiens
gttgtgattttgtacagaat

SEQ ID NO: 5783465 - DNA, 17 bp, Homo sapiens
gttgtgcaaattaacag

SEQ ID NO: 5783466 - DNA, 10 bp, Homo sapiens
gttgtgcagc

SEQ ID NO: 5783467 - DNA, 18 bp, Homo sapiens
gttgtgcagcttttggtc

SEQ ID NO: 5783468 - DNA, 19 bp, Homo sapiens
gttgtgcagtgtgcctgtc

SEQ ID NO: 5783469 - DNA, 21 bp, Homo sapiens
gttgtgcatgcccctgagtgt

SEQ ID NO: 5783470 - DNA, 16 bp, Homo sapiens
gttgtgcatgtatgta

SEQ ID NO: 5783471 - DNA, 22 bp, Homo sapiens
gttgtgcatttgttcagctccc

SEQ ID NO: 5783472 - DNA, 21 bp, Homo sapiens
gttgtgccacagagtgtagcc

SEQ ID NO: 5783473 - DNA, 16 bp, Homo sapiens
gttgtgcccctttcca

SEQ ID NO: 5783474 - DNA, 18 bp, Homo sapiens
gttgtgcctccctggtga

SEQ ID NO: 5783475 - DNA, 23 bp, Homo sapiens
gttgtgcctggttcgtgccatgc

SEQ ID NO: 5783476 - DNA, 21 bp, Homo sapiens
gttgtgctaatttctgtccag

SEQ ID NO: 5783477 - DNA, 22 bp, Homo sapiens
gttgtgcttgctggtactaaga

SEQ ID NO: 5783478 - DNA, 19 bp, Homo sapiens
gttgtggaaagcctctgct

SEQ ID NO: 5783479 - DNA, 15 bp, Homo sapiens
gttgtggaggaggtg

SEQ ID NO: 5783480 - DNA, 14 bp, Homo sapiens
gttgtggatgctcc

SEQ ID NO: 5783481 - DNA, 15 bp, Homo sapiens
gttgtggatgggagg

SEQ ID NO: 5783482 - DNA, 20 bp, Homo sapiens
gttgtggatgggaggctcct

SEQ ID NO: 5783483 - DNA, 22 bp, Homo sapiens
gttgtggatttaacagaaatgt

SEQ ID NO: 5783484 - DNA, 21 bp, Homo sapiens
gttgtggcccccgccccctcc

SEQ ID NO: 5783485 - DNA, 21 bp, Homo sapiens
gttgtggcctttgcgctcctg

SEQ ID NO: 5783486 - DNA, 18 bp, Homo sapiens
gttgtgggcttcctgctg

SEQ ID NO: 5783487 - DNA, 18 bp, Homo sapiens
gttgtggggaggctgcac

SEQ ID NO: 5783488 - DNA, 20 bp, Homo sapiens
gttgtggggcctcaggctcc

SEQ ID NO: 5783489 - DNA, 16 bp, Homo sapiens
gttgtgggtgggagag

SEQ ID NO: 5783490 - DNA, 17 bp, Homo sapiens
gttgtggtgctgacaaa

SEQ ID NO: 5783491 - DNA, 14 bp, Homo sapiens
gttgtggttaatct

SEQ ID NO: 5783492 - DNA, 17 bp, Homo sapiens
gttgtgtaagagaatgt

SEQ ID NO: 5783493 - DNA, 21 bp, Homo sapiens
gttgtgtaagagaatgttgaa

SEQ ID NO: 5783494 - DNA, 14 bp, Homo sapiens
gttgtgtataattt

SEQ ID NO: 5783495 - DNA, 15 bp, Homo sapiens
gttgtgtataattta

SEQ ID NO: 5783496 - DNA, 15 bp, Homo sapiens
gttgtgtatattaca

SEQ ID NO: 5783497 - DNA, 21 bp, Homo sapiens
gtttatatttttttaactgtg

SEQ ID NO: 5783498 - DNA, 22 bp, Homo sapiens
gtttatatttttttaactgtga

SEQ ID NO: 5783499 - DNA, 18 bp, Homo sapiens
gtttatcaactcaagaat

SEQ ID NO: 5783500 - DNA, 16 bp, Homo sapiens
gtttatcagatacatc

SEQ ID NO: 5783501 - DNA, 14 bp, Homo sapiens
gtttatcatgaagc

SEQ ID NO: 5783502 - DNA, 22 bp, Homo sapiens
gtttatcctttcatatagttag

SEQ ID NO: 5783503 - DNA, 22 bp, Homo sapiens
gtttatcgccctggcaggcagg

SEQ ID NO: 5783504 - DNA, 19 bp, Homo sapiens
gtttatctatcggaagaac

SEQ ID NO: 5783505 - DNA, 21 bp, Homo sapiens
gtttatctatcggaagaacat

SEQ ID NO: 5783506 - DNA, 22 bp, Homo sapiens
gtttatctttgcacaatcaata

SEQ ID NO: 5783507 - DNA, 23 bp, Homo sapiens
gtttatgaaatgccactgggaca

SEQ ID NO: 5783508 - DNA, 22 bp, Homo sapiens
gtttatgaagaaagatactaat

SEQ ID NO: 5783509 - DNA, 21 bp, Homo sapiens
gtttatgaattataaatgtgt

SEQ ID NO: 5783510 - DNA, 15 bp, Homo sapiens
gtttatgatatttct

SEQ ID NO: 5783511 - DNA, 18 bp, Homo sapiens
gtttatgatctatttgta

SEQ ID NO: 5783512 - DNA, 18 bp, Homo sapiens
gtttatgcagtgctgctt

SEQ ID NO: 5783513 - DNA, 16 bp, Homo sapiens
gtttatgcattgcctt

SEQ ID NO: 5783514 - DNA, 15 bp, Homo sapiens
gtttatgcatttcaa

SEQ ID NO: 5783515 - DNA, 16 bp, Homo sapiens
gtttatgcatttcaat

SEQ ID NO: 5783516 - DNA, 16 bp, Homo sapiens
gtttatgccaaatgtt

SEQ ID NO: 5783517 - DNA, 18 bp, Homo sapiens
gtttatggatatgctgct

SEQ ID NO: 5783518 - DNA, 18 bp, Homo sapiens
gtttatggccacatttaa

SEQ ID NO: 5783519 - DNA, 15 bp, Homo sapiens
gtttatgggtttctt

SEQ ID NO: 5783520 - DNA, 22 bp, Homo sapiens
gtttatggtattttcgtgcatt

SEQ ID NO: 5783521 - DNA, 18 bp, Homo sapiens
gtttatgtaaatgtttgt

SEQ ID NO: 5783522 - DNA, 16 bp, Homo sapiens
gtttatgtaacatagt

SEQ ID NO: 5783523 - DNA, 15 bp, Homo sapiens
gtttatgtctaaaga

SEQ ID NO: 5783524 - DNA, 14 bp, Homo sapiens
gtttatgtcttgtt

SEQ ID NO: 5783525 - DNA, 15 bp, Homo sapiens
gtttatgtcttgttc

SEQ ID NO: 5783526 - DNA, 20 bp, Homo sapiens
gtttatgtgaacattcctat

SEQ ID NO: 5783527 - DNA, 21 bp, Homo sapiens
gtttatgttccattaaacgat

SEQ ID NO: 5783528 - DNA, 15 bp, Homo sapiens
gtttatgttcttata

SEQ ID NO: 5783529 - DNA, 21 bp, Homo sapiens
gtttatgttcttatagaataa

SEQ ID NO: 5783530 - DNA, 23 bp, Homo sapiens
gtttatgtttgtggttttgggaa

SEQ ID NO: 5783531 - DNA, 12 bp, Homo sapiens
gtttatgttttg

SEQ ID NO: 5783532 - DNA, 13 bp, Homo sapiens
gtttattaacaaa

SEQ ID NO: 5783533 - DNA, 23 bp, Homo sapiens
gtttattaacaaattatgttaca

SEQ ID NO: 5783534 - DNA, 23 bp, Homo sapiens
gtttattaatcttagtgtatgat

SEQ ID NO: 5783535 - DNA, 15 bp, Homo sapiens
gtttattacaagttt

SEQ ID NO: 5783536 - DNA, 15 bp, Homo sapiens
gtttattacttattt

SEQ ID NO: 5783537 - DNA, 16 bp, Homo sapiens
gtttattacttatttg

SEQ ID NO: 5783538 - DNA, 17 bp, Homo sapiens
gtttattacttatttgg

SEQ ID NO: 5783539 - DNA, 14 bp, Homo sapiens
gtttattagatgaa

SEQ ID NO: 5783540 - DNA, 16 bp, Homo sapiens
gtttattataaagctt

SEQ ID NO: 5783541 - DNA, 20 bp, Homo sapiens
gtttattataaagcttaaat

SEQ ID NO: 5783542 - DNA, 21 bp, Homo sapiens
gtttattataaagcttaaatt

SEQ ID NO: 5783543 - DNA, 22 bp, Homo sapiens
gtttattataaagcttaaattt

SEQ ID NO: 5783544 - DNA, 21 bp, Homo sapiens
gtttattatagtctgtacttc

SEQ ID NO: 5783545 - DNA, 19 bp, Homo sapiens
gtttattatcctgatcaag

SEQ ID NO: 5783546 - DNA, 16 bp, Homo sapiens
gtttattatgacaaat

SEQ ID NO: 5783547 - DNA, 15 bp, Homo sapiens
gtttattatttacat

SEQ ID NO: 5783548 - DNA, 13 bp, Homo sapiens
gtttattcaaaat

SEQ ID NO: 5783549 - DNA, 17 bp, Homo sapiens
gtttattcaaaatattt

SEQ ID NO: 5783550 - DNA, 19 bp, Homo sapiens
gtttattcaaactgaaaag

SEQ ID NO: 5783551 - DNA, 16 bp, Homo sapiens
gtttattcatatgcat

SEQ ID NO: 5783552 - DNA, 17 bp, Homo sapiens
gtttattcatccagcag

SEQ ID NO: 5783553 - DNA, 13 bp, Homo sapiens
gtttattctgatt

SEQ ID NO: 5783554 - DNA, 19 bp, Homo sapiens
gtttattctgggaaatgtt

SEQ ID NO: 5783555 - DNA, 23 bp, Homo sapiens
gtttattctgggaaatgttttaa

SEQ ID NO: 5783556 - DNA, 21 bp, Homo sapiens
gtttattctgtggttctataa

SEQ ID NO: 5783557 - DNA, 17 bp, Homo sapiens
gtttattcttccagaat

SEQ ID NO: 5783558 - DNA, 19 bp, Homo sapiens
gtttattcttccagaatgc

SEQ ID NO: 5783559 - DNA, 20 bp, Homo sapiens
gtttattcttccagaatgct

SEQ ID NO: 5783560 - DNA, 16 bp, Homo sapiens
gtttattcttctagag

SEQ ID NO: 5783561 - DNA, 16 bp, Homo sapiens
gtttattcttgatgaa

SEQ ID NO: 5783562 - DNA, 17 bp, Homo sapiens
gtttattcttgatgaaa

SEQ ID NO: 5783563 - DNA, 18 bp, Homo sapiens
gtttattcttgatgaaaa

SEQ ID NO: 5783564 - DNA, 14 bp, Homo sapiens
gtttattctttgca

SEQ ID NO: 5783565 - DNA, 22 bp, Homo sapiens
gtttattgagtttgtaggtaaa

SEQ ID NO: 5783566 - DNA, 22 bp, Homo sapiens
gtttatttaacttttagtaaag

SEQ ID NO: 5783567 - DNA, 13 bp, Homo sapiens
gtttatttaagga

SEQ ID NO: 5783568 - DNA, 20 bp, Homo sapiens
gtttatttaaggatggatgg

SEQ ID NO: 5783569 - DNA, 23 bp, Homo sapiens
gtttatttaaggatggatggcac

SEQ ID NO: 5783570 - DNA, 14 bp, Homo sapiens
gtttatttattcac

SEQ ID NO: 5783571 - DNA, 19 bp, Homo sapiens
gtttatttatttccagtgg

SEQ ID NO: 5783572 - DNA, 12 bp, Homo sapiens
gtttatttcatg

SEQ ID NO: 5783573 - DNA, 16 bp, Homo sapiens
gtttatttctgtgaaa

SEQ ID NO: 5783574 - DNA, 19 bp, Homo sapiens
gtttatttctgtttctcat

SEQ ID NO: 5783575 - DNA, 15 bp, Homo sapiens
gtttatttgagaaaa

SEQ ID NO: 5783576 - DNA, 16 bp, Homo sapiens
gtttattttaaaacaa

SEQ ID NO: 5783577 - DNA, 13 bp, Homo sapiens
gtttattttaaga

SEQ ID NO: 5783578 - DNA, 14 bp, Homo sapiens
gtttattttatatt

SEQ ID NO: 5783579 - DNA, 16 bp, Homo sapiens
gtttattttctgtgta

SEQ ID NO: 5783580 - DNA, 19 bp, Homo sapiens
gtttattttctgtgtaaaa

SEQ ID NO: 5783581 - DNA, 14 bp, Homo sapiens
gtttatttttcata

SEQ ID NO: 5783582 - DNA, 16 bp, Homo sapiens
gtttatttttcatatt

SEQ ID NO: 5783583 - DNA, 17 bp, Homo sapiens
gtttatttttctgttac

SEQ ID NO: 5783584 - DNA, 13 bp, Homo sapiens
gtttattttttct

SEQ ID NO: 5783585 - DNA, 20 bp, Homo sapiens
gtttcaaaaacacagtgttt

SEQ ID NO: 5783586 - DNA, 17 bp, Homo sapiens
gtttcaaaaactgtatt

SEQ ID NO: 5783587 - DNA, 17 bp, Homo sapiens
gtttcaaaaataaaaga

SEQ ID NO: 5783588 - DNA, 16 bp, Homo sapiens
gtttcaaaaatctgaa

SEQ ID NO: 5783589 - DNA, 20 bp, Homo sapiens
gtttcaaaaccatgcctggt

SEQ ID NO: 5783590 - DNA, 15 bp, Homo sapiens
gtttcaaaataaaaa

SEQ ID NO: 5783591 - DNA, 20 bp, Homo sapiens
gtttcaaaatagacaagttt

SEQ ID NO: 5783592 - DNA, 15 bp, Homo sapiens
gtttcaaactgaatt

SEQ ID NO: 5783593 - DNA, 14 bp, Homo sapiens
gtttcaaactgtaa

SEQ ID NO: 5783594 - DNA, 16 bp, Homo sapiens
gtttcaaactgtaaaa

SEQ ID NO: 5783595 - DNA, 12 bp, Homo sapiens
gtttcaaacttt

SEQ ID NO: 5783596 - DNA, 13 bp, Homo sapiens
gtttcaaacttta

SEQ ID NO: 5783597 - DNA, 14 bp, Homo sapiens
gtttcaaagaaaga

SEQ ID NO: 5783598 - DNA, 20 bp, Homo sapiens
gtttcaaagctttcctgttt

SEQ ID NO: 5783599 - DNA, 19 bp, Homo sapiens
gtttcaaagggattgcttt

SEQ ID NO: 5783600 - DNA, 20 bp, Homo sapiens
gtttcaaagggtaaattata

SEQ ID NO: 5783601 - DNA, 22 bp, Homo sapiens
gtttcaaagtgtctcattctca

SEQ ID NO: 5783602 - DNA, 16 bp, Homo sapiens
gtttcaaatggactgt

SEQ ID NO: 5783603 - DNA, 13 bp, Homo sapiens
gtttcaaatgtgc

SEQ ID NO: 5783604 - DNA, 12 bp, Homo sapiens
gtttcaacaaat

SEQ ID NO: 5783605 - DNA, 23 bp, Homo sapiens
gtttcaacaaatttcattgcact

SEQ ID NO: 5783606 - DNA, 23 bp, Homo sapiens
gtttcaaccaagtcatgtgcatt

SEQ ID NO: 5783607 - DNA, 14 bp, Homo sapiens
gtttcaactttctt

SEQ ID NO: 5783608 - DNA, 16 bp, Homo sapiens
gtttcaagaaaatctt

SEQ ID NO: 5783609 - DNA, 20 bp, Homo sapiens
gtttcaagaggagcccccac

SEQ ID NO: 5783610 - DNA, 18 bp, Homo sapiens
gtttcaaggtcagaacag

SEQ ID NO: 5783611 - DNA, 17 bp, Homo sapiens
gtttcaagttttaaagt

SEQ ID NO: 5783612 - DNA, 16 bp, Homo sapiens
gtttcaataaagtttg

SEQ ID NO: 5783613 - DNA, 15 bp, Homo sapiens
gtttcaatcactgtc

SEQ ID NO: 5783614 - DNA, 21 bp, Homo sapiens
gtttcaatgcatacaataaaa

SEQ ID NO: 5783615 - DNA, 18 bp, Homo sapiens
gtttcaattctgtaatta

SEQ ID NO: 5783616 - DNA, 22 bp, Homo sapiens
gtttcaattgcatctcccagat

SEQ ID NO: 5783617 - DNA, 17 bp, Homo sapiens
gtttcacaacagatttc

SEQ ID NO: 5783618 - DNA, 22 bp, Homo sapiens
gtttcacaacagatttctaagt

SEQ ID NO: 5783619 - DNA, 20 bp, Homo sapiens
gtttcacaacaggcattcca

SEQ ID NO: 5783620 - DNA, 19 bp, Homo sapiens
gtttcacaaggtctttaaa

SEQ ID NO: 5783621 - DNA, 15 bp, Homo sapiens
gtttcacacaaacaa

SEQ ID NO: 5783622 - DNA, 14 bp, Homo sapiens
gtttcacagaaaat

SEQ ID NO: 5783623 - DNA, 23 bp, Homo sapiens
gtttcacagcctataaccagaca

SEQ ID NO: 5783624 - DNA, 22 bp, Homo sapiens
gtttcacaggtcaataaactta

SEQ ID NO: 5783625 - DNA, 18 bp, Homo sapiens
gtttcacagtgtctgtaa

SEQ ID NO: 5783626 - DNA, 13 bp, Homo sapiens
gtttcacatctgt

SEQ ID NO: 5783627 - DNA, 17 bp, Homo sapiens
gtttcaccacaaccctg

SEQ ID NO: 5783628 - DNA, 22 bp, Homo sapiens
gtttcaccatccttagaccaag

SEQ ID NO: 5783629 - DNA, 21 bp, Homo sapiens
gtttcaccatgttggccaggc

SEQ ID NO: 5783630 - DNA, 21 bp, Homo sapiens
gtttcaccatgttggtcaggc

SEQ ID NO: 5783631 - DNA, 16 bp, Homo sapiens
gtttcaccctgtccct

SEQ ID NO: 5783632 - DNA, 21 bp, Homo sapiens
gtttcacccttaacccaagga

SEQ ID NO: 5783633 - DNA, 22 bp, Homo sapiens
gtttcaccttccatgtcaggcc

SEQ ID NO: 5783634 - DNA, 19 bp, Homo sapiens
gtttcactatgattttcta

SEQ ID NO: 5783635 - DNA, 14 bp, Homo sapiens
gtttcactccctct

SEQ ID NO: 5783636 - DNA, 15 bp, Homo sapiens
gtttcactccctctt

SEQ ID NO: 5783637 - DNA, 18 bp, Homo sapiens
gtttcactccctcttggt

SEQ ID NO: 5783638 - DNA, 21 bp, Homo sapiens
gtttcactctttccagataag

SEQ ID NO: 5783639 - DNA, 12 bp, Homo sapiens
gtttcactgcaa

SEQ ID NO: 5783640 - DNA, 21 bp, Homo sapiens
gtttcactgcaaacacacctt

SEQ ID NO: 5783641 - DNA, 14 bp, Homo sapiens
gtttcagaaatgtg

SEQ ID NO: 5783642 - DNA, 18 bp, Homo sapiens
gtttcagaaatgtgttat

SEQ ID NO: 5783643 - DNA, 13 bp, Homo sapiens
gtttcagaagcag

SEQ ID NO: 5783644 - DNA, 17 bp, Homo sapiens
gtttcagaagcaggcag

SEQ ID NO: 5783645 - DNA, 18 bp, Homo sapiens
gtttcagaagcaggcagg

SEQ ID NO: 5783646 - DNA, 19 bp, Homo sapiens
gtttcagaagcaggcaggg

SEQ ID NO: 5783647 - DNA, 18 bp, Homo sapiens
gtttcagaagtactggca

SEQ ID NO: 5783648 - DNA, 17 bp, Homo sapiens
gtttcagaataaaatta

SEQ ID NO: 5783649 - DNA, 12 bp, Homo sapiens
gtttcagacagg

SEQ ID NO: 5783650 - DNA, 12 bp, Homo sapiens
gtttcagaccag

SEQ ID NO: 5783651 - DNA, 14 bp, Homo sapiens
gtttcagacccccc

SEQ ID NO: 5783652 - DNA, 22 bp, Homo sapiens
gtttcagagagtcaatgtcatt

SEQ ID NO: 5783653 - DNA, 15 bp, Homo sapiens
gtttcagagatggac

SEQ ID NO: 5783654 - DNA, 17 bp, Homo sapiens
gtttcagagatggacag

SEQ ID NO: 5783655 - DNA, 17 bp, Homo sapiens
gtttcagagcataaaac

SEQ ID NO: 5783656 - DNA, 19 bp, Homo sapiens
gtttcagagcataaaacct

SEQ ID NO: 5783657 - DNA, 22 bp, Homo sapiens
gtttcagataaatcatgggcat

SEQ ID NO: 5783658 - DNA, 13 bp, Homo sapiens
gtttcagatgagg

SEQ ID NO: 5783659 - DNA, 20 bp, Homo sapiens
gtttcagattttttaaaatt

SEQ ID NO: 5783660 - DNA, 21 bp, Homo sapiens
gtttcagccaaggggctgcgc

SEQ ID NO: 5783661 - DNA, 14 bp, Homo sapiens
gtttcagctggaaa

SEQ ID NO: 5783662 - DNA, 23 bp, Homo sapiens
gtttcaggagagagttgaaccta

SEQ ID NO: 5783663 - DNA, 20 bp, Homo sapiens
gtttcaggagattgttaatt

SEQ ID NO: 5783664 - DNA, 19 bp, Homo sapiens
gtttcaggatcagatcaat

SEQ ID NO: 5783665 - DNA, 13 bp, Homo sapiens
gtttcagggctga

SEQ ID NO: 5783666 - DNA, 19 bp, Homo sapiens
gtttcaggtagaggtgcat

SEQ ID NO: 5783667 - DNA, 23 bp, Homo sapiens
gtttcaggtagaggtgcatgcct

SEQ ID NO: 5783668 - DNA, 16 bp, Homo sapiens
gtttcagtaatagctg

SEQ ID NO: 5783669 - DNA, 21 bp, Homo sapiens
gtttcagtaatagctgaacct

SEQ ID NO: 5783670 - DNA, 10 bp, Homo sapiens
gtttcagttg

SEQ ID NO: 5783671 - DNA, 15 bp, Homo sapiens
gtttcatagttttct

SEQ ID NO: 5783672 - DNA, 17 bp, Homo sapiens
gtttcatattctcagat

SEQ ID NO: 5783673 - DNA, 19 bp, Homo sapiens
gtttcatattttaaatctg

SEQ ID NO: 5783674 - DNA, 22 bp, Homo sapiens
gtttggttagctcacaggactt

SEQ ID NO: 5783675 - DNA, 13 bp, Homo sapiens
gtttggttcaaat

SEQ ID NO: 5783676 - DNA, 13 bp, Homo sapiens
gtttggttcaatt

SEQ ID NO: 5783677 - DNA, 14 bp, Homo sapiens
gtttggttctgggg

SEQ ID NO: 5783678 - DNA, 19 bp, Homo sapiens
gtttggttggttttatact

SEQ ID NO: 5783679 - DNA, 14 bp, Homo sapiens
gtttggtttataat

SEQ ID NO: 5783680 - DNA, 15 bp, Homo sapiens
gtttggtttcttcat

SEQ ID NO: 5783681 - DNA, 17 bp, Homo sapiens
gtttggttttaaaatac

SEQ ID NO: 5783682 - DNA, 14 bp, Homo sapiens
gtttggttttacat

SEQ ID NO: 5783683 - DNA, 15 bp, Homo sapiens
gtttgtaaaaatgta

SEQ ID NO: 5783684 - DNA, 17 bp, Homo sapiens
gtttgtaaaatccacag

SEQ ID NO: 5783685 - DNA, 15 bp, Homo sapiens
gtttgtaaatgcctc

SEQ ID NO: 5783686 - DNA, 14 bp, Homo sapiens
gtttgtaaatgtta

SEQ ID NO: 5783687 - DNA, 19 bp, Homo sapiens
gtttgtaaattaactttta

SEQ ID NO: 5783688 - DNA, 17 bp, Homo sapiens
gtttgtaaattatttgc

SEQ ID NO: 5783689 - DNA, 22 bp, Homo sapiens
gtttgtaaattctggaaatgtc

SEQ ID NO: 5783690 - DNA, 19 bp, Homo sapiens
gtttgtaactttttacatt

SEQ ID NO: 5783691 - DNA, 13 bp, Homo sapiens
gtttgtaagaaaa

SEQ ID NO: 5783692 - DNA, 20 bp, Homo sapiens
gtttgtaagtaagtaagaaa

SEQ ID NO: 5783693 - DNA, 14 bp, Homo sapiens
gtttgtaccattta

SEQ ID NO: 5783694 - DNA, 22 bp, Homo sapiens
gtttgtaccttccttaagccag

SEQ ID NO: 5783695 - DNA, 19 bp, Homo sapiens
gtttgtagcatttttctaa

SEQ ID NO: 5783696 - DNA, 15 bp, Homo sapiens
gtttgtagccaggta

SEQ ID NO: 5783697 - DNA, 12 bp, Homo sapiens
gtttgtagcttt

SEQ ID NO: 5783698 - DNA, 17 bp, Homo sapiens
gtttgtagctttcctgg

SEQ ID NO: 5783699 - DNA, 16 bp, Homo sapiens
gtttgtagtaaaagtg

SEQ ID NO: 5783700 - DNA, 22 bp, Homo sapiens
gtttgtagtgccactgttgttt

SEQ ID NO: 5783701 - DNA, 17 bp, Homo sapiens
gtttgtagttgttttaa

SEQ ID NO: 5783702 - DNA, 20 bp, Homo sapiens
gtttgtagtttttgctgaag

SEQ ID NO: 5783703 - DNA, 22 bp, Homo sapiens
gtttgtataccatgatgcatgg

SEQ ID NO: 5783704 - DNA, 14 bp, Homo sapiens
gtttgtatgagatg

SEQ ID NO: 5783705 - DNA, 19 bp, Homo sapiens
gtttgtatgagatggttaa

SEQ ID NO: 5783706 - DNA, 20 bp, Homo sapiens
gtttgtatgagatggttaaa

SEQ ID NO: 5783707 - DNA, 16 bp, Homo sapiens
gtttgtatgtataatt

SEQ ID NO: 5783708 - DNA, 20 bp, Homo sapiens
gtttgtatttttagtagaga

SEQ ID NO: 5783709 - DNA, 16 bp, Homo sapiens
gtttgtattttttatt

SEQ ID NO: 5783710 - DNA, 23 bp, Homo sapiens
gtttgtcaacacaaagacacagg

SEQ ID NO: 5783711 - DNA, 21 bp, Homo sapiens
gtttgtcaacacaaagacatg

SEQ ID NO: 5783712 - DNA, 15 bp, Homo sapiens
gtttgtcacaagtgg

SEQ ID NO: 5783713 - DNA, 14 bp, Homo sapiens
gtttgtcagaggaa

SEQ ID NO: 5783714 - DNA, 17 bp, Homo sapiens
gtttgtcagcatctgac

SEQ ID NO: 5783715 - DNA, 19 bp, Homo sapiens
gtttgtcagcatctgacca

SEQ ID NO: 5783716 - DNA, 13 bp, Homo sapiens
gtttgtcagtaaa

SEQ ID NO: 5783717 - DNA, 15 bp, Homo sapiens
gtttgtcatatattc

SEQ ID NO: 5783718 - DNA, 15 bp, Homo sapiens
gtttgtcatggtgaa

SEQ ID NO: 5783719 - DNA, 18 bp, Homo sapiens
gtttgtcgctcatgtgtg

SEQ ID NO: 5783720 - DNA, 14 bp, Homo sapiens
gtttgtctatttta

SEQ ID NO: 5783721 - DNA, 15 bp, Homo sapiens
gtttgtctctccttt

SEQ ID NO: 5783722 - DNA, 16 bp, Homo sapiens
gtttgtctctcctttt

SEQ ID NO: 5783723 - DNA, 18 bp, Homo sapiens
gtttgtctgtcttcatag

SEQ ID NO: 5783724 - DNA, 16 bp, Homo sapiens
gtttgtcttctcccca

SEQ ID NO: 5783725 - DNA, 18 bp, Homo sapiens
gtttgtctttcttaaaac

SEQ ID NO: 5783726 - DNA, 16 bp, Homo sapiens
gtttgtgacagggcgg

SEQ ID NO: 5783727 - DNA, 19 bp, Homo sapiens
gtttgtgacagtaaccatt

SEQ ID NO: 5783728 - DNA, 23 bp, Homo sapiens
gtttgtgacagtaaccatttcag

SEQ ID NO: 5783729 - DNA, 22 bp, Homo sapiens
gtttgtgagcatgggtgtgccc

SEQ ID NO: 5783730 - DNA, 14 bp, Homo sapiens
gtttgtgagccttg

SEQ ID NO: 5783731 - DNA, 15 bp, Homo sapiens
gtttgtgagccttgc

SEQ ID NO: 5783732 - DNA, 19 bp, Homo sapiens
gtttgtgatattaaatttc

SEQ ID NO: 5783733 - DNA, 19 bp, Homo sapiens
gtttgtgcatatctgcctc

SEQ ID NO: 5783734 - DNA, 16 bp, Homo sapiens
gtttgtgcatcctgtg

SEQ ID NO: 5783735 - DNA, 16 bp, Homo sapiens
gtttgtgctgcagaca

SEQ ID NO: 5783736 - DNA, 15 bp, Homo sapiens
gtttgtggcctcaga

SEQ ID NO: 5783737 - DNA, 16 bp, Homo sapiens
gtttgtggcctcagaa

SEQ ID NO: 5783738 - DNA, 20 bp, Homo sapiens
gtttgtggctgggggcagga

SEQ ID NO: 5783739 - DNA, 22 bp, Homo sapiens
gtttgtggctgggggcaggagg

SEQ ID NO: 5783740 - DNA, 15 bp, Homo sapiens
gtttgtggggctgga

SEQ ID NO: 5783741 - DNA, 17 bp, Homo sapiens
gtttgtggggctggaag

SEQ ID NO: 5783742 - DNA, 16 bp, Homo sapiens
gtttgtgggtatttct

SEQ ID NO: 5783743 - DNA, 23 bp, Homo sapiens
gtttgtgggtatttcttggcatg

SEQ ID NO: 5783744 - DNA, 16 bp, Homo sapiens
gtttgtggtaatttgt

SEQ ID NO: 5783745 - DNA, 19 bp, Homo sapiens
gtttgtgtgatttcctaaa

SEQ ID NO: 5783746 - DNA, 16 bp, Homo sapiens
gtttgtgtgtatttgt

SEQ ID NO: 5783747 - DNA, 12 bp, Homo sapiens
gtttgtgtgtct

SEQ ID NO: 5783748 - DNA, 20 bp, Homo sapiens
gtttgtgttctgtttgttaa

SEQ ID NO: 5783749 - DNA, 22 bp, Homo sapiens
gtttgtgttctgtttgttaaaa

SEQ ID NO: 5783750 - DNA, 13 bp, Homo sapiens
gtttgttaaaact

SEQ ID NO: 5783751 - DNA, 15 bp, Homo sapiens
gtttgttaaaactgg

SEQ ID NO: 5783752 - DNA, 17 bp, Homo sapiens
gtttgttaaaactggca

SEQ ID NO: 5783753 - DNA, 15 bp, Homo sapiens
gtttgttaaagcctg

SEQ ID NO: 5783754 - DNA, 18 bp, Homo sapiens
gtttgttaaagcctgttc

SEQ ID NO: 5783755 - DNA, 17 bp, Homo sapiens
gtttgttacataggtat

SEQ ID NO: 5783756 - DNA, 16 bp, Homo sapiens
gtttgttatagattta

SEQ ID NO: 5783757 - DNA, 22 bp, Homo sapiens
gtttgttatttacactggtcta

SEQ ID NO: 5783758 - DNA, 17 bp, Homo sapiens
gtttgttcataataaaa

SEQ ID NO: 5783759 - DNA, 20 bp, Homo sapiens
gtttgttcataataaaagtg

SEQ ID NO: 5783760 - DNA, 18 bp, Homo sapiens
gtttgttccccaagacat

SEQ ID NO: 5783761 - DNA, 12 bp, Homo sapiens
gtttgttccttt

SEQ ID NO: 5783762 - DNA, 22 bp, Homo sapiens
gtttgttctacatggctttgat

SEQ ID NO: 5783763 - DNA, 14 bp, Homo sapiens
gtttgttctgttct

SEQ ID NO: 5783764 - DNA, 14 bp, Homo sapiens
gtttgttcttcaga

SEQ ID NO: 5783765 - DNA, 17 bp, Homo sapiens
gtttgttgatcttttaa

SEQ ID NO: 5783766 - DNA, 21 bp, Homo sapiens
gtttgttggatccgtttgacc

SEQ ID NO: 5783767 - DNA, 16 bp, Homo sapiens
gtttgttggtcacatg

SEQ ID NO: 5783768 - DNA, 20 bp, Homo sapiens
gtttgttggttgattgttta

SEQ ID NO: 5783769 - DNA, 22 bp, Homo sapiens
gtttgttggttggttttcttct

SEQ ID NO: 5783770 - DNA, 22 bp, Homo sapiens
gtttgtttaaacacttatcttc

SEQ ID NO: 5783771 - DNA, 11 bp, Homo sapiens
gtttgtttaag

SEQ ID NO: 5783772 - DNA, 21 bp, Homo sapiens
gtttgtttacataagagaaag

SEQ ID NO: 5783773 - DNA, 23 bp, Homo sapiens
gtttgtttcatatatacaggcat

SEQ ID NO: 5783774 - DNA, 20 bp, Homo sapiens
gtttgtttctccccctgggc

SEQ ID NO: 5783775 - DNA, 18 bp, Homo sapiens
gtttgtttctgaaaggga

SEQ ID NO: 5783776 - DNA, 20 bp, Homo sapiens
gtttgtttctgaaagggacg

SEQ ID NO: 5783777 - DNA, 14 bp, Homo sapiens
gtttgtttcttgtg

SEQ ID NO: 5783778 - DNA, 12 bp, Homo sapiens
gtttgtttcttt

SEQ ID NO: 5783779 - DNA, 14 bp, Homo sapiens
gtttgtttgtattt

SEQ ID NO: 5783780 - DNA, 17 bp, Homo sapiens
gtttgtttgtttgtctg

SEQ ID NO: 5783781 - DNA, 15 bp, Homo sapiens
gtttgtttgttttgt

SEQ ID NO: 5783782 - DNA, 16 bp, Homo sapiens
gtttgtttgttttgtt

SEQ ID NO: 5783783 - DNA, 13 bp, Homo sapiens
gtttgttttacaa

SEQ ID NO: 5783784 - DNA, 17 bp, Homo sapiens
gtttgttttcaaaatac

SEQ ID NO: 5783785 - DNA, 14 bp, Homo sapiens
gtttgttttggatt

SEQ ID NO: 5783786 - DNA, 17 bp, Homo sapiens
gtttgttttgtttttta

SEQ ID NO: 5783787 - DNA, 13 bp, Homo sapiens
gtttgtttttgct

SEQ ID NO: 5783788 - DNA, 23 bp, Homo sapiens
gtttgtttttgtttggtataaat

SEQ ID NO: 5783789 - DNA, 17 bp, Homo sapiens
gtttgttttttcatgcg

SEQ ID NO: 5783790 - DNA, 17 bp, Homo sapiens
gtttgtttttttgccac

SEQ ID NO: 5783791 - DNA, 17 bp, Homo sapiens
gttttaaaaaaactgaa

SEQ ID NO: 5783792 - DNA, 18 bp, Homo sapiens
gttttaaaaaaactgaag

SEQ ID NO: 5783793 - DNA, 19 bp, Homo sapiens
gttttaaaaaaactgaagg

SEQ ID NO: 5783794 - DNA, 23 bp, Homo sapiens
gttttaaaaaaactgaaggtttt

SEQ ID NO: 5783795 - DNA, 19 bp, Homo sapiens
gttttaaaaaaataaaaca

SEQ ID NO: 5783796 - DNA, 22 bp, Homo sapiens
gttttaaaaaaataaaacattt

SEQ ID NO: 5783797 - DNA, 16 bp, Homo sapiens
gttttaaaaaagcatt

SEQ ID NO: 5783798 - DNA, 16 bp, Homo sapiens
gttttaaaaaatacag

SEQ ID NO: 5783799 - DNA, 18 bp, Homo sapiens
gttttaaaaaatacagta

SEQ ID NO: 5783800 - DNA, 21 bp, Homo sapiens
gttttaaaaaggaactgcagc

SEQ ID NO: 5783801 - DNA, 19 bp, Homo sapiens
gttttaaaaataagtttta

SEQ ID NO: 5783802 - DNA, 21 bp, Homo sapiens
gttttaaaacgtgtaaatgaa

SEQ ID NO: 5783803 - DNA, 18 bp, Homo sapiens
gttttaaaactggacctg

SEQ ID NO: 5783804 - DNA, 12 bp, Homo sapiens
gttttaaaagca

SEQ ID NO: 5783805 - DNA, 16 bp, Homo sapiens
gttttaaaagccttgg

SEQ ID NO: 5783806 - DNA, 18 bp, Homo sapiens
gttttaaaatactgtaga

SEQ ID NO: 5783807 - DNA, 17 bp, Homo sapiens
gttttaaaatgagaaat

SEQ ID NO: 5783808 - DNA, 15 bp, Homo sapiens
gttttaaaatgcaga

SEQ ID NO: 5783809 - DNA, 19 bp, Homo sapiens
gttttaaacatagaaagtt

SEQ ID NO: 5783810 - DNA, 23 bp, Homo sapiens
gttttaaacctttaatgagaaaa

SEQ ID NO: 5783811 - DNA, 16 bp, Homo sapiens
gttttaaacgactttt

SEQ ID NO: 5783812 - DNA, 15 bp, Homo sapiens
gttttaaagaaattt

SEQ ID NO: 5783813 - DNA, 22 bp, Homo sapiens
gttttaaagacctgacaccttt

SEQ ID NO: 5783814 - DNA, 13 bp, Homo sapiens
gttttaaagctaa

SEQ ID NO: 5783815 - DNA, 23 bp, Homo sapiens
gttttaaagggagccatgctctt

SEQ ID NO: 5783816 - DNA, 12 bp, Homo sapiens
gttttaaataaa

SEQ ID NO: 5783817 - DNA, 15 bp, Homo sapiens
gttttaaataaagtt

SEQ ID NO: 5783818 - DNA, 15 bp, Homo sapiens
gttttaaatatgaac

SEQ ID NO: 5783819 - DNA, 16 bp, Homo sapiens
gttttaaatctgcttt

SEQ ID NO: 5783820 - DNA, 17 bp, Homo sapiens
gttttaaatctgcttta

SEQ ID NO: 5783821 - DNA, 22 bp, Homo sapiens
gttttaaatgtacagacatatt

SEQ ID NO: 5783822 - DNA, 21 bp, Homo sapiens
gttttaaattgcatttctatg

SEQ ID NO: 5783823 - DNA, 20 bp, Homo sapiens
gttttaacaatccattcaca

SEQ ID NO: 5783824 - DNA, 13 bp, Homo sapiens
gttttaacaccaa

SEQ ID NO: 5783825 - DNA, 18 bp, Homo sapiens
gttttaacaccaacactg

SEQ ID NO: 5783826 - DNA, 15 bp, Homo sapiens
gttttaacagaacca

SEQ ID NO: 5783827 - DNA, 17 bp, Homo sapiens
gttttaacagaaccaga

SEQ ID NO: 5783828 - DNA, 19 bp, Homo sapiens
gttttaacagaaccagagg

SEQ ID NO: 5783829 - DNA, 15 bp, Homo sapiens
gttttaacattttta

SEQ ID NO: 5783830 - DNA, 15 bp, Homo sapiens
gttttaacctcccct

SEQ ID NO: 5783831 - DNA, 15 bp, Homo sapiens
gttttaactgtggat

SEQ ID NO: 5783832 - DNA, 16 bp, Homo sapiens
gttttaactgtggata

SEQ ID NO: 5783833 - DNA, 17 bp, Homo sapiens
gttttaacttatttata

SEQ ID NO: 5783834 - DNA, 13 bp, Homo sapiens
gttttaactttgt

SEQ ID NO: 5783835 - DNA, 14 bp, Homo sapiens
gttttaactttgtt

SEQ ID NO: 5783836 - DNA, 15 bp, Homo sapiens
gttttaagaaatgta

SEQ ID NO: 5783837 - DNA, 16 bp, Homo sapiens
gttttaagaggcaggg

SEQ ID NO: 5783838 - DNA, 23 bp, Homo sapiens
gttttaagctaaagcctgaattt

SEQ ID NO: 5783839 - DNA, 18 bp, Homo sapiens
gttttaaggactgactga

SEQ ID NO: 5783840 - DNA, 19 bp, Homo sapiens
gttttaaggactgactgag

SEQ ID NO: 5783841 - DNA, 18 bp, Homo sapiens
gttttaagttgtttgcat

SEQ ID NO: 5783842 - DNA, 21 bp, Homo sapiens
gttttaataaaagatttacat

SEQ ID NO: 5783843 - DNA, 15 bp, Homo sapiens
gttttaatctacttt

SEQ ID NO: 5783844 - DNA, 16 bp, Homo sapiens
gttttaatctgaaatt

SEQ ID NO: 5783845 - DNA, 12 bp, Homo sapiens
gttttaatctta

SEQ ID NO: 5783846 - DNA, 21 bp, Homo sapiens
gttttaatcttagcttttaat

SEQ ID NO: 5783847 - DNA, 16 bp, Homo sapiens
gttttaattccatgaa

SEQ ID NO: 5783848 - DNA, 19 bp, Homo sapiens
gttttaattccatgtcaga

SEQ ID NO: 5783849 - DNA, 19 bp, Homo sapiens
gttttaattgaaggaaaga

SEQ ID NO: 5783850 - DNA, 14 bp, Homo sapiens
gttttaatttaaac

SEQ ID NO: 5783851 - DNA, 20 bp, Homo sapiens
gttttaattttttgaacttt

SEQ ID NO: 5783852 - DNA, 17 bp, Homo sapiens
gttttttttctaaaact

SEQ ID NO: 5783853 - DNA, 17 bp, Homo sapiens
gttttttttgtttgcct

SEQ ID NO: 5783854 - DNA, 23 bp, Homo sapiens
gtttttttttaaaaaagaaacat

SEQ ID NO: 5783855 - DNA, 15 bp, Homo sapiens
gtttttttttaaaga

SEQ ID NO: 5783856 - DNA, 17 bp, Homo sapiens
gtttttttttaaagact

SEQ ID NO: 5783857 - DNA, 14 bp, Homo sapiens
gtttttttttcctc

SEQ ID NO: 5783858 - DNA, 14 bp, Homo sapiens
gtttttttttgtat

SEQ ID NO: 5783859 - DNA, 15 bp, Homo sapiens
gttttttttttctga

SEQ ID NO: 5783860 - DNA, 16 bp, Homo sapiens
gttttttttttctgaa

SEQ ID NO: 5783861 - DNA, 17 bp, Homo sapiens
gttttttttttgtttgt

SEQ ID NO: 5783862 - DNA, 21 bp, Homo sapiens
gtttttttttttaaaaaaaga

SEQ ID NO: 5783863 - DNA, 17 bp, Homo sapiens
gtttttttttttccaga

SEQ ID NO: 5783864 - DNA, 17 bp, Homo sapiens
gttttttttttttcctt

SEQ ID NO: 5783865 - DNA, 23 bp, Homo sapiens
gttttttttttttctttttgtcc

SEQ ID NO: 5783866 - DNA, 15 bp, Homo sapiens
gttttttttttttgt

SEQ ID NO: 5783867 - DNA, 16 bp, Homo sapiens
gttttttttttttgta

SEQ ID NO: 5783868 - DNA, 22 bp, Homo sapiens
gttttttttttttgtatttctt

SEQ ID NO: 5783869 - DNA, 20 bp, Homo sapiens
gtttttttttttttacatgt

SEQ ID NO: 5783870 - DNA, 17 bp, Homo sapiens
gttttttttttttttgg

SEQ ID NO: 5783871 - DNA, 18 bp, Homo sapiens
taaaaaaaaaaaaaagct

SEQ ID NO: 5783872 - DNA, 22 bp, Homo sapiens
taaaaaaaaaaaaaggaaaaaa

SEQ ID NO: 5783873 - DNA, 23 bp, Homo sapiens
taaaaaaaaaaaaaggaaaaaaa

SEQ ID NO: 5783874 - DNA, 13 bp, Homo sapiens
taaaaaaaaaaac

SEQ ID NO: 5783875 - DNA, 16 bp, Homo sapiens
taaaaaaaaaaactgt

SEQ ID NO: 5783876 - DNA, 16 bp, Homo sapiens
taaaaaaaaaaagtac

SEQ ID NO: 5783877 - DNA, 19 bp, Homo sapiens
taaaaaaaaaactgcttta

SEQ ID NO: 5783878 - DNA, 17 bp, Homo sapiens
taaaaaaaaaaggatga

SEQ ID NO: 5783879 - DNA, 15 bp, Homo sapiens
taaaaaaaaaagtca

SEQ ID NO: 5783880 - DNA, 14 bp, Homo sapiens
taaaaaaaaaattg

SEQ ID NO: 5783881 - DNA, 16 bp, Homo sapiens
taaaaaaaaaggcata

SEQ ID NO: 5783882 - DNA, 19 bp, Homo sapiens
taaaaaaaaagtcagagac

SEQ ID NO: 5783883 - DNA, 14 bp, Homo sapiens
taaaaaaaaagttg

SEQ ID NO: 5783884 - DNA, 17 bp, Homo sapiens
taaaaaaaaatactctt

SEQ ID NO: 5783885 - DNA, 22 bp, Homo sapiens
taaaaaaaaatactctttcaat

SEQ ID NO: 5783886 - DNA, 15 bp, Homo sapiens
taaaaaaaaatgcct

SEQ ID NO: 5783887 - DNA, 13 bp, Homo sapiens
taaaaaaaacaaa

SEQ ID NO: 5783888 - DNA, 17 bp, Homo sapiens
taaaaaaaacaaaaaga

SEQ ID NO: 5783889 - DNA, 21 bp, Homo sapiens
taaaaaaaacaaaaagaacaa

SEQ ID NO: 5783890 - DNA, 11 bp, Homo sapiens
taaaaaaaaga

SEQ ID NO: 5783891 - DNA, 16 bp, Homo sapiens
taaaaaaaagaaaaaa

SEQ ID NO: 5783892 - DNA, 16 bp, Homo sapiens
taaaaaaaagaaatga

SEQ ID NO: 5783893 - DNA, 17 bp, Homo sapiens
taaaaaaaagaagtgtg

SEQ ID NO: 5783894 - DNA, 12 bp, Homo sapiens
taaaaaaaagcc

SEQ ID NO: 5783895 - DNA, 17 bp, Homo sapiens
taaaaaaaataataaat

SEQ ID NO: 5783896 - DNA, 16 bp, Homo sapiens
taaaaaaaatagttga

SEQ ID NO: 5783897 - DNA, 23 bp, Homo sapiens
taaaaaaaatagttgagccagca

SEQ ID NO: 5783898 - DNA, 19 bp, Homo sapiens
taaaaaaaatccttctaat

SEQ ID NO: 5783899 - DNA, 17 bp, Homo sapiens
taaaaaaaatgaaatgt

SEQ ID NO: 5783900 - DNA, 15 bp, Homo sapiens
taaaaaaaatgtgaa

SEQ ID NO: 5783901 - DNA, 23 bp, Homo sapiens
taaaaaaacaaacagaaacacaa

SEQ ID NO: 5783902 - DNA, 11 bp, Homo sapiens
taaaaaaactg

SEQ ID NO: 5783903 - DNA, 13 bp, Homo sapiens
taaaaaaactgaa

SEQ ID NO: 5783904 - DNA, 14 bp, Homo sapiens
taaaaaaactgaag

SEQ ID NO: 5783905 - DNA, 18 bp, Homo sapiens
taaaaaaactgaaggttt

SEQ ID NO: 5783906 - DNA, 19 bp, Homo sapiens
taaaaaaactgaaggtttt

SEQ ID NO: 5783907 - DNA, 20 bp, Homo sapiens
taaaaaaactggccttttga

SEQ ID NO: 5783908 - DNA, 21 bp, Homo sapiens
taaaaaaactggccttttgat

SEQ ID NO: 5783909 - DNA, 12 bp, Homo sapiens
taaaaaaagaaa

SEQ ID NO: 5783910 - DNA, 15 bp, Homo sapiens
taaaaaaagaaaaaa

SEQ ID NO: 5783911 - DNA, 15 bp, Homo sapiens
taaaaaaagaaagca

SEQ ID NO: 5783912 - DNA, 15 bp, Homo sapiens
taaaaaaagagaatt

SEQ ID NO: 5783913 - DNA, 21 bp, Homo sapiens
taaaaaaagcaaaaatgacaa

SEQ ID NO: 5783914 - DNA, 13 bp, Homo sapiens
taaaaaaaggaaa

SEQ ID NO: 5783915 - DNA, 18 bp, Homo sapiens
taaaaaaagtatatattc

SEQ ID NO: 5783916 - DNA, 11 bp, Homo sapiens
taaaaaaataa

SEQ ID NO: 5783917 - DNA, 15 bp, Homo sapiens
taaaaaaataagaag

SEQ ID NO: 5783918 - DNA, 14 bp, Homo sapiens
taaaaaaataatat

SEQ ID NO: 5783919 - DNA, 21 bp, Homo sapiens
taaaaaaatagaaaaaaagaa

SEQ ID NO: 5783920 - DNA, 18 bp, Homo sapiens
taaaaaaatatatacaga

SEQ ID NO: 5783921 - DNA, 21 bp, Homo sapiens
taaaaaaatgatgcagctgtt

SEQ ID NO: 5783922 - DNA, 14 bp, Homo sapiens
taaaaaaatgtttt

SEQ ID NO: 5783923 - DNA, 19 bp, Homo sapiens
taaaaaaatgtttttagaa

SEQ ID NO: 5783924 - DNA, 16 bp, Homo sapiens
taaaaaaatttaagtg

SEQ ID NO: 5783925 - DNA, 17 bp, Homo sapiens
taaaaaaatttaagtgc

SEQ ID NO: 5783926 - DNA, 21 bp, Homo sapiens
taaaaaaatttttataaatta

SEQ ID NO: 5783927 - DNA, 18 bp, Homo sapiens
taaaaaaatttttgcaaa

SEQ ID NO: 5783928 - DNA, 13 bp, Homo sapiens
taaaaaacaaaaa

SEQ ID NO: 5783929 - DNA, 17 bp, Homo sapiens
taaaaaacaaaaaaaga

SEQ ID NO: 5783930 - DNA, 11 bp, Homo sapiens
taaaaaacaac

SEQ ID NO: 5783931 - DNA, 19 bp, Homo sapiens
taaaaaacagcttgttcta

SEQ ID NO: 5783932 - DNA, 12 bp, Homo sapiens
taaaaaacattt

SEQ ID NO: 5783933 - DNA, 14 bp, Homo sapiens
taaaaaacatttat

SEQ ID NO: 5783934 - DNA, 17 bp, Homo sapiens
taaaaaacatttgtaca

SEQ ID NO: 5783935 - DNA, 13 bp, Homo sapiens
taaaaaacatttt

SEQ ID NO: 5783936 - DNA, 18 bp, Homo sapiens
taaaaaacatttttaatt

SEQ ID NO: 5783937 - DNA, 19 bp, Homo sapiens
taaaaaactaaaaactaga

SEQ ID NO: 5783938 - DNA, 13 bp, Homo sapiens
taaaaaactcttt

SEQ ID NO: 5783939 - DNA, 15 bp, Homo sapiens
taaaaaactctttgg

SEQ ID NO: 5783940 - DNA, 14 bp, Homo sapiens
taaaaaagaaagaa

SEQ ID NO: 5783941 - DNA, 18 bp, Homo sapiens
taaaaaagaaattatctt

SEQ ID NO: 5783942 - DNA, 16 bp, Homo sapiens
taaaaaagaagaggtt

SEQ ID NO: 5783943 - DNA, 12 bp, Homo sapiens
taaaaaagataa

SEQ ID NO: 5783944 - DNA, 19 bp, Homo sapiens
taaaaaagattctactaac

SEQ ID NO: 5783945 - DNA, 17 bp, Homo sapiens
taaaaaagatttgtaga

SEQ ID NO: 5783946 - DNA, 13 bp, Homo sapiens
taaaaaagcatta

SEQ ID NO: 5783947 - DNA, 18 bp, Homo sapiens
taaaaaagctcttttaat

SEQ ID NO: 5783948 - DNA, 17 bp, Homo sapiens
taaaaaagcttaaaact

SEQ ID NO: 5783949 - DNA, 18 bp, Homo sapiens
taaaaaagcttaaaactt

SEQ ID NO: 5783950 - DNA, 14 bp, Homo sapiens
taaaaaagtctcta

SEQ ID NO: 5783951 - DNA, 18 bp, Homo sapiens
taaaaaagtctctattta

SEQ ID NO: 5783952 - DNA, 19 bp, Homo sapiens
taaaaaagtctctatttaa

SEQ ID NO: 5783953 - DNA, 21 bp, Homo sapiens
taaaaaagtctctatttaaat

SEQ ID NO: 5783954 - DNA, 22 bp, Homo sapiens
taaaaaagtctctatttaaatt

SEQ ID NO: 5783955 - DNA, 14 bp, Homo sapiens
taaaaaagtgttct

SEQ ID NO: 5783956 - DNA, 13 bp, Homo sapiens
taaaaaagttgtg

SEQ ID NO: 5783957 - DNA, 22 bp, Homo sapiens
taaaaaagtttagaatgtgtgt

SEQ ID NO: 5783958 - DNA, 20 bp, Homo sapiens
taaaaaataaagtacgtgtt

SEQ ID NO: 5783959 - DNA, 14 bp, Homo sapiens
taaaaaataacata

SEQ ID NO: 5783960 - DNA, 18 bp, Homo sapiens
taaaaaataacatattct

SEQ ID NO: 5783961 - DNA, 12 bp, Homo sapiens
taaaaaatacac

SEQ ID NO: 5783962 - DNA, 14 bp, Homo sapiens
taaaaaatatatgt

SEQ ID NO: 5783963 - DNA, 17 bp, Homo sapiens
taaaaaatattttaaga

SEQ ID NO: 5783964 - DNA, 21 bp, Homo sapiens
taaaaaatattttaagaaaga

SEQ ID NO: 5783965 - DNA, 12 bp, Homo sapiens
taaaaaatcaaa

SEQ ID NO: 5783966 - DNA, 12 bp, Homo sapiens
taaaaaatcaat

SEQ ID NO: 5783967 - DNA, 14 bp, Homo sapiens
taaaaaatcaatca

SEQ ID NO: 5783968 - DNA, 13 bp, Homo sapiens
taaaaaatctgaa

SEQ ID NO: 5783969 - DNA, 15 bp, Homo sapiens
taaaaaatgcagaat

SEQ ID NO: 5783970 - DNA, 14 bp, Homo sapiens
taaaaaatgctggg

SEQ ID NO: 5783971 - DNA, 11 bp, Homo sapiens
taaaaaatgga

SEQ ID NO: 5783972 - DNA, 14 bp, Homo sapiens
taaaaaatggtcac

SEQ ID NO: 5783973 - DNA, 15 bp, Homo sapiens
taaaaaatgtgtgta

SEQ ID NO: 5783974 - DNA, 22 bp, Homo sapiens
taaaaaatgtgtgtattcttaa

SEQ ID NO: 5783975 - DNA, 19 bp, Homo sapiens
taaaaaatgttattactga

SEQ ID NO: 5783976 - DNA, 18 bp, Homo sapiens
taaaaaattatgacaatg

SEQ ID NO: 5783977 - DNA, 15 bp, Homo sapiens
taaaaaattcacata

SEQ ID NO: 5783978 - DNA, 21 bp, Homo sapiens
taaaaaatttaaaaagcccaa

SEQ ID NO: 5783979 - DNA, 13 bp, Homo sapiens
taaaaaatttgta

SEQ ID NO: 5783980 - DNA, 10 bp, Homo sapiens
taaaaacaaa

SEQ ID NO: 5783981 - DNA, 23 bp, Homo sapiens
taaaaacaaaacaaacacacaca

SEQ ID NO: 5783982 - DNA, 16 bp, Homo sapiens
taaaaacaaaatgaaa

SEQ ID NO: 5783983 - DNA, 15 bp, Homo sapiens
taaaaacaaccaaca

SEQ ID NO: 5783984 - DNA, 19 bp, Homo sapiens
taaaaacaactttataccc

SEQ ID NO: 5783985 - DNA, 16 bp, Homo sapiens
taaaaacaatatatgt

SEQ ID NO: 5783986 - DNA, 15 bp, Homo sapiens
taaaaacacctaagt

SEQ ID NO: 5783987 - DNA, 18 bp, Homo sapiens
taaaaacacctaagtgac

SEQ ID NO: 5783988 - DNA, 14 bp, Homo sapiens
taaaaacagaaaat

SEQ ID NO: 5783989 - DNA, 20 bp, Homo sapiens
taaaaacagcattgctttct

SEQ ID NO: 5783990 - DNA, 22 bp, Homo sapiens
taaaaacagcattgctttctga

SEQ ID NO: 5783991 - DNA, 14 bp, Homo sapiens
taaaaacagtgcta

SEQ ID NO: 5783992 - DNA, 13 bp, Homo sapiens
taaaaacataaaa

SEQ ID NO: 5783993 - DNA, 17 bp, Homo sapiens
taaaaacataaaatata

SEQ ID NO: 5783994 - DNA, 16 bp, Homo sapiens
taaaaacatagaaaaa

SEQ ID NO: 5783995 - DNA, 15 bp, Homo sapiens
taaaaacatgagaaa

SEQ ID NO: 5783996 - DNA, 16 bp, Homo sapiens
taaaaacatgagaaat

SEQ ID NO: 5783997 - DNA, 11 bp, Homo sapiens
taaaaacattc

SEQ ID NO: 5783998 - DNA, 17 bp, Homo sapiens
taaaaacattgaaatat

SEQ ID NO: 5783999 - DNA, 19 bp, Homo sapiens
taaaaacattgcctttgaa

SEQ ID NO: 5784000 - DNA, 21 bp, Homo sapiens
taaaaacattgcctttgaatg

SEQ ID NO: 5784001 - DNA, 14 bp, Homo sapiens
taaaaacattttaa

SEQ ID NO: 5784002 - DNA, 19 bp, Homo sapiens
taaaaacattttaaaatca

SEQ ID NO: 5784003 - DNA, 23 bp, Homo sapiens
taaaaacattttaaaatcaactt

SEQ ID NO: 5784004 - DNA, 15 bp, Homo sapiens
taaaaacattttgaa

SEQ ID NO: 5784005 - DNA, 19 bp, Homo sapiens
taaaaaccaaacccagaca

SEQ ID NO: 5784006 - DNA, 23 bp, Homo sapiens
taaaaaccaaactctgtgtcagc

SEQ ID NO: 5784007 - DNA, 14 bp, Homo sapiens
taaaaaccaagaag

SEQ ID NO: 5784008 - DNA, 10 bp, Homo sapiens
taaaaaccat

SEQ ID NO: 5784009 - DNA, 16 bp, Homo sapiens
taaaaaccataaacat

SEQ ID NO: 5784010 - DNA, 14 bp, Homo sapiens
taaaaacccaaaat

SEQ ID NO: 5784011 - DNA, 19 bp, Homo sapiens
taaaaacccctaaaaacaa

SEQ ID NO: 5784012 - DNA, 20 bp, Homo sapiens
taaaaacccctaaaaacaaa

SEQ ID NO: 5784013 - DNA, 13 bp, Homo sapiens
taaaaaccctgta

SEQ ID NO: 5784014 - DNA, 20 bp, Homo sapiens
taaaaaccgaataaatgttt

SEQ ID NO: 5784015 - DNA, 22 bp, Homo sapiens
taaaaacctcttagcttttctg

SEQ ID NO: 5784016 - DNA, 20 bp, Homo sapiens
taaaaacctgaactttcatt

SEQ ID NO: 5784017 - DNA, 19 bp, Homo sapiens
taaaaacctgcttggtgtg

SEQ ID NO: 5784018 - DNA, 15 bp, Homo sapiens
taaaaacctgttcaa

SEQ ID NO: 5784019 - DNA, 17 bp, Homo sapiens
taaaaaccttaagtgct

SEQ ID NO: 5784020 - DNA, 20 bp, Homo sapiens
taaaaaccttaagtgctgca

SEQ ID NO: 5784021 - DNA, 14 bp, Homo sapiens
taaaaacctttttg

SEQ ID NO: 5784022 - DNA, 18 bp, Homo sapiens
taaaaacgaaaacctgac

SEQ ID NO: 5784023 - DNA, 21 bp, Homo sapiens
taaaaactactgaataaatca

SEQ ID NO: 5784024 - DNA, 20 bp, Homo sapiens
taaaaactagaggtgagaaa

SEQ ID NO: 5784025 - DNA, 14 bp, Homo sapiens
taaaaactcaagga

SEQ ID NO: 5784026 - DNA, 15 bp, Homo sapiens
taaaaactcctgggc

SEQ ID NO: 5784027 - DNA, 13 bp, Homo sapiens
taaaaactcttca

SEQ ID NO: 5784028 - DNA, 15 bp, Homo sapiens
taaaaactgaagttc

SEQ ID NO: 5784029 - DNA, 16 bp, Homo sapiens
taaaaactgaagttct

SEQ ID NO: 5784030 - DNA, 13 bp, Homo sapiens
taaaaactgctta

SEQ ID NO: 5784031 - DNA, 11 bp, Homo sapiens
taaaaactgtg

SEQ ID NO: 5784032 - DNA, 18 bp, Homo sapiens
taaaaactgtgtatcatt

SEQ ID NO: 5784033 - DNA, 12 bp, Homo sapiens
taaaagttcttt

SEQ ID NO: 5784034 - DNA, 19 bp, Homo sapiens
taaaagttgggaaaagtgt

SEQ ID NO: 5784035 - DNA, 21 bp, Homo sapiens
taaaagttgtactgcatctta

SEQ ID NO: 5784036 - DNA, 23 bp, Homo sapiens
taaaagttgtgcatgtatgtata

SEQ ID NO: 5784037 - DNA, 14 bp, Homo sapiens
taaaagttgtgggg

SEQ ID NO: 5784038 - DNA, 15 bp, Homo sapiens
taaaagtttaaagaa

SEQ ID NO: 5784039 - DNA, 11 bp, Homo sapiens
taaaagtttag

SEQ ID NO: 5784040 - DNA, 13 bp, Homo sapiens
taaaagtttcaat

SEQ ID NO: 5784041 - DNA, 12 bp, Homo sapiens
taaaagtttcta

SEQ ID NO: 5784042 - DNA, 20 bp, Homo sapiens
taaaagtttgaaaagcaata

SEQ ID NO: 5784043 - DNA, 20 bp, Homo sapiens
taaaagtttgaggaatattt

SEQ ID NO: 5784044 - DNA, 23 bp, Homo sapiens
taaaagtttgggtgtattttctt

SEQ ID NO: 5784045 - DNA, 15 bp, Homo sapiens
taaaagtttgtcctt

SEQ ID NO: 5784046 - DNA, 16 bp, Homo sapiens
taaaagttttctccaa

SEQ ID NO: 5784047 - DNA, 11 bp, Homo sapiens
taaaagttttg

SEQ ID NO: 5784048 - DNA, 21 bp, Homo sapiens
taaaagttttgaaggaaacct

SEQ ID NO: 5784049 - DNA, 20 bp, Homo sapiens
taaaagttttgatatttatt

SEQ ID NO: 5784050 - DNA, 17 bp, Homo sapiens
taaaagttttgttcttt

SEQ ID NO: 5784051 - DNA, 22 bp, Homo sapiens
taaaagtttttgtcactatctt

SEQ ID NO: 5784052 - DNA, 21 bp, Homo sapiens
taaaagttttttattatgcat

SEQ ID NO: 5784053 - DNA, 22 bp, Homo sapiens
taaaagttttttattatgcatt

SEQ ID NO: 5784054 - DNA, 14 bp, Homo sapiens
taaaataaaaacca

SEQ ID NO: 5784055 - DNA, 13 bp, Homo sapiens
taaaataaaaatg

SEQ ID NO: 5784056 - DNA, 15 bp, Homo sapiens
taaaataaaaatgaa

SEQ ID NO: 5784057 - DNA, 20 bp, Homo sapiens
taaaataaaacaagccttaa

SEQ ID NO: 5784058 - DNA, 16 bp, Homo sapiens
taaaataaaactctca

SEQ ID NO: 5784059 - DNA, 16 bp, Homo sapiens
taaaataaaataaaat

SEQ ID NO: 5784060 - DNA, 16 bp, Homo sapiens
taaaataaaatgaaaa

SEQ ID NO: 5784061 - DNA, 20 bp, Homo sapiens
taaaataaaatgaaaattgt

SEQ ID NO: 5784062 - DNA, 22 bp, Homo sapiens
taaaataaaatgaaaattgtat

SEQ ID NO: 5784063 - DNA, 17 bp, Homo sapiens
taaaataaacagttgtg

SEQ ID NO: 5784064 - DNA, 13 bp, Homo sapiens
taaaataaaccaa

SEQ ID NO: 5784065 - DNA, 17 bp, Homo sapiens
taaaataaacctgttta

SEQ ID NO: 5784066 - DNA, 14 bp, Homo sapiens
taaaataaacgaaa

SEQ ID NO: 5784067 - DNA, 18 bp, Homo sapiens
taaaataaactgtaaact

SEQ ID NO: 5784068 - DNA, 14 bp, Homo sapiens
taaaataaacttct

SEQ ID NO: 5784069 - DNA, 15 bp, Homo sapiens
taaaataaacttctt

SEQ ID NO: 5784070 - DNA, 16 bp, Homo sapiens
taaaataaacttctta

SEQ ID NO: 5784071 - DNA, 17 bp, Homo sapiens
taaaataaacttcttaa

SEQ ID NO: 5784072 - DNA, 14 bp, Homo sapiens
taaaataaactttc

SEQ ID NO: 5784073 - DNA, 17 bp, Homo sapiens
taaaataaagaaataga

SEQ ID NO: 5784074 - DNA, 23 bp, Homo sapiens
taaaataaagcctatttttcaaa

SEQ ID NO: 5784075 - DNA, 22 bp, Homo sapiens
taaaataaagctaccatgttaa

SEQ ID NO: 5784076 - DNA, 21 bp, Homo sapiens
taaaataaagcttacatagtt

SEQ ID NO: 5784077 - DNA, 19 bp, Homo sapiens
taaaataaaggctctgtgc

SEQ ID NO: 5784078 - DNA, 16 bp, Homo sapiens
taaaataaataaactt

SEQ ID NO: 5784079 - DNA, 18 bp, Homo sapiens
taaaataaataaactttg

SEQ ID NO: 5784080 - DNA, 14 bp, Homo sapiens
taaaataaataatt

SEQ ID NO: 5784081 - DNA, 17 bp, Homo sapiens
taaaataaataccaaag

SEQ ID NO: 5784082 - DNA, 18 bp, Homo sapiens
taaaataaataccaaaga

SEQ ID NO: 5784083 - DNA, 14 bp, Homo sapiens
taaaataaatatac

SEQ ID NO: 5784084 - DNA, 14 bp, Homo sapiens
taaaataaatatat

SEQ ID NO: 5784085 - DNA, 13 bp, Homo sapiens
taaaataaatggt

SEQ ID NO: 5784086 - DNA, 14 bp, Homo sapiens
taaaataaatgttt

SEQ ID NO: 5784087 - DNA, 17 bp, Homo sapiens
taaaataaatgttttgg

SEQ ID NO: 5784088 - DNA, 12 bp, Homo sapiens
taaaataaatta

SEQ ID NO: 5784089 - DNA, 11 bp, Homo sapiens
taaaataacta

SEQ ID NO: 5784090 - DNA, 17 bp, Homo sapiens
taaaataactaaaatgt

SEQ ID NO: 5784091 - DNA, 14 bp, Homo sapiens
taaaataactatca

SEQ ID NO: 5784092 - DNA, 18 bp, Homo sapiens
taaaataactatcaggca

SEQ ID NO: 5784093 - DNA, 22 bp, Homo sapiens
taaaataactatcaggcagaag

SEQ ID NO: 5784094 - DNA, 21 bp, Homo sapiens
taaaataagcaggtggatcta

SEQ ID NO: 5784095 - DNA, 20 bp, Homo sapiens
taaaataagctttctcagaa

SEQ ID NO: 5784096 - DNA, 21 bp, Homo sapiens
taaaataagctttctcagaat

SEQ ID NO: 5784097 - DNA, 15 bp, Homo sapiens
taaaataagtaacat

SEQ ID NO: 5784098 - DNA, 20 bp, Homo sapiens
taaaataagtcctaaagtga

SEQ ID NO: 5784099 - DNA, 18 bp, Homo sapiens
taaaataagtctgattta

SEQ ID NO: 5784100 - DNA, 14 bp, Homo sapiens
taaaataagtgaat

SEQ ID NO: 5784101 - DNA, 14 bp, Homo sapiens
taaaataagttaaa

SEQ ID NO: 5784102 - DNA, 14 bp, Homo sapiens
taaaataatgcttt

SEQ ID NO: 5784103 - DNA, 15 bp, Homo sapiens
taaaataatgggatt

SEQ ID NO: 5784104 - DNA, 21 bp, Homo sapiens
taaaataattaaataaatgaa

SEQ ID NO: 5784105 - DNA, 18 bp, Homo sapiens
taaaataattatataact

SEQ ID NO: 5784106 - DNA, 19 bp, Homo sapiens
taaaataattatataactg

SEQ ID NO: 5784107 - DNA, 17 bp, Homo sapiens
taaaataattatatgaa

SEQ ID NO: 5784108 - DNA, 14 bp, Homo sapiens
taaaataattcata

SEQ ID NO: 5784109 - DNA, 22 bp, Homo sapiens
taaaataatttatcaaaaaaca

SEQ ID NO: 5784110 - DNA, 13 bp, Homo sapiens
taaaataattttg

SEQ ID NO: 5784111 - DNA, 15 bp, Homo sapiens
taaaataattttgta

SEQ ID NO: 5784112 - DNA, 20 bp, Homo sapiens
taaaataatttttatatttg

SEQ ID NO: 5784113 - DNA, 18 bp, Homo sapiens
taaaatacaagtaaagct

SEQ ID NO: 5784114 - DNA, 16 bp, Homo sapiens
taaaatacacaacaca

SEQ ID NO: 5784115 - DNA, 23 bp, Homo sapiens
taaaatacagctgcactgaggca

SEQ ID NO: 5784116 - DNA, 17 bp, Homo sapiens
taaaatacataaaagaa

SEQ ID NO: 5784117 - DNA, 20 bp, Homo sapiens
taaaatacataaaagaatgt

SEQ ID NO: 5784118 - DNA, 15 bp, Homo sapiens
taaaatacataactt

SEQ ID NO: 5784119 - DNA, 19 bp, Homo sapiens
taaaatacatagtgaaaat

SEQ ID NO: 5784120 - DNA, 14 bp, Homo sapiens
taaaatacatttaa

SEQ ID NO: 5784121 - DNA, 17 bp, Homo sapiens
taaaataccactgtaat

SEQ ID NO: 5784122 - DNA, 23 bp, Homo sapiens
taaaatactatattaaattctga

SEQ ID NO: 5784123 - DNA, 19 bp, Homo sapiens
taaaatactatgcagtatc

SEQ ID NO: 5784124 - DNA, 12 bp, Homo sapiens
taaaatactatt

SEQ ID NO: 5784125 - DNA, 21 bp, Homo sapiens
taaaatactattggacagaca

SEQ ID NO: 5784126 - DNA, 22 bp, Homo sapiens
taaaatactattggacagacac

SEQ ID NO: 5784127 - DNA, 15 bp, Homo sapiens
taaaatactattttt

SEQ ID NO: 5784128 - DNA, 22 bp, Homo sapiens
taaaatactctagcctgggcca

SEQ ID NO: 5784129 - DNA, 20 bp, Homo sapiens
taaaatactgcttttgcaaa

SEQ ID NO: 5784130 - DNA, 12 bp, Homo sapiens
taaaatactgta

SEQ ID NO: 5784131 - DNA, 14 bp, Homo sapiens
taaaatactgtaga

SEQ ID NO: 5784132 - DNA, 17 bp, Homo sapiens
taaaatactgtagataa

SEQ ID NO: 5784133 - DNA, 12 bp, Homo sapiens
taaaatactgtt

SEQ ID NO: 5784134 - DNA, 21 bp, Homo sapiens
taaaatacttttactctgcct

SEQ ID NO: 5784135 - DNA, 14 bp, Homo sapiens
taaaatactttttg

SEQ ID NO: 5784136 - DNA, 20 bp, Homo sapiens
taaaatagaatatagcatct

SEQ ID NO: 5784137 - DNA, 22 bp, Homo sapiens
taaaatagaatgatagaacttt

SEQ ID NO: 5784138 - DNA, 23 bp, Homo sapiens
taaaatagaatgatagaactttg

SEQ ID NO: 5784139 - DNA, 15 bp, Homo sapiens
taaaatagatataaa

SEQ ID NO: 5784140 - DNA, 18 bp, Homo sapiens
taaaatagattatcccac

SEQ ID NO: 5784141 - DNA, 13 bp, Homo sapiens
taaaatagcaaaa

SEQ ID NO: 5784142 - DNA, 21 bp, Homo sapiens
taaaatagcaacactctatat

SEQ ID NO: 5784143 - DNA, 13 bp, Homo sapiens
taaaatagcaata

SEQ ID NO: 5784144 - DNA, 15 bp, Homo sapiens
taaaatagcaataac

SEQ ID NO: 5784145 - DNA, 19 bp, Homo sapiens
taaaatagcaataactgaa

SEQ ID NO: 5784146 - DNA, 20 bp, Homo sapiens
taaaatagcaataactgaaa

SEQ ID NO: 5784147 - DNA, 21 bp, Homo sapiens
taaaatagcaataactgaaaa

SEQ ID NO: 5784148 - DNA, 16 bp, Homo sapiens
taaaatagcatactgt

SEQ ID NO: 5784149 - DNA, 19 bp, Homo sapiens
taaaatagcatactgtgta

SEQ ID NO: 5784150 - DNA, 15 bp, Homo sapiens
taaaatagccactta

SEQ ID NO: 5784151 - DNA, 23 bp, Homo sapiens
taaaatagccacttaccttcaat

SEQ ID NO: 5784152 - DNA, 17 bp, Homo sapiens
taaaatagcgttcttgt

SEQ ID NO: 5784153 - DNA, 20 bp, Homo sapiens
taaaataggcaccattgctt

SEQ ID NO: 5784154 - DNA, 19 bp, Homo sapiens
taaaatagtctcattgcca

SEQ ID NO: 5784155 - DNA, 18 bp, Homo sapiens
taaaatagtctctttaaa

SEQ ID NO: 5784156 - DNA, 21 bp, Homo sapiens
taaaatagttccagataaaaa

SEQ ID NO: 5784157 - DNA, 23 bp, Homo sapiens
taaaatagttgtccatattttca

SEQ ID NO: 5784158 - DNA, 21 bp, Homo sapiens
taaaatagtttaaaaatattc

SEQ ID NO: 5784159 - DNA, 16 bp, Homo sapiens
taaaatataaaactga

SEQ ID NO: 5784160 - DNA, 18 bp, Homo sapiens
taaaatataaaactgaaa

SEQ ID NO: 5784161 - DNA, 16 bp, Homo sapiens
taaaatataaattaag

SEQ ID NO: 5784162 - DNA, 20 bp, Homo sapiens
taaaatataacacagtttgt

SEQ ID NO: 5784163 - DNA, 21 bp, Homo sapiens
taaaatataacacagtttgta

SEQ ID NO: 5784164 - DNA, 12 bp, Homo sapiens
taaaatataatt

SEQ ID NO: 5784165 - DNA, 15 bp, Homo sapiens
taaaatatagaaaac

SEQ ID NO: 5784166 - DNA, 23 bp, Homo sapiens
taaaatatagagacaggacagaa

SEQ ID NO: 5784167 - DNA, 19 bp, Homo sapiens
taaaatatagctgtacaaa

SEQ ID NO: 5784168 - DNA, 21 bp, Homo sapiens
taaaatatatactatatgaaa

SEQ ID NO: 5784169 - DNA, 19 bp, Homo sapiens
taaaatatatgtatttaaa

SEQ ID NO: 5784170 - DNA, 14 bp, Homo sapiens
taaaatatatgtct

SEQ ID NO: 5784171 - DNA, 16 bp, Homo sapiens
taaaatatatgtctat

SEQ ID NO: 5784172 - DNA, 13 bp, Homo sapiens
taaaatatatgtt

SEQ ID NO: 5784173 - DNA, 15 bp, Homo sapiens
taaaatatatgttct

SEQ ID NO: 5784174 - DNA, 16 bp, Homo sapiens
taaaatatcctcaggg

SEQ ID NO: 5784175 - DNA, 14 bp, Homo sapiens
taaaatatctatat

SEQ ID NO: 5784176 - DNA, 17 bp, Homo sapiens
taaaatatctatttgaa

SEQ ID NO: 5784177 - DNA, 22 bp, Homo sapiens
taaaatatctatttgaataaat

SEQ ID NO: 5784178 - DNA, 16 bp, Homo sapiens
taaaatatcttccttt

SEQ ID NO: 5784179 - DNA, 20 bp, Homo sapiens
taaaatatgaagacataaac

SEQ ID NO: 5784180 - DNA, 17 bp, Homo sapiens
taaaatatgatgtttaa

SEQ ID NO: 5784181 - DNA, 19 bp, Homo sapiens
taaaatatgcactaagtct

SEQ ID NO: 5784182 - DNA, 13 bp, Homo sapiens
taaaatatgtgaa

SEQ ID NO: 5784183 - DNA, 15 bp, Homo sapiens
taaaatatgtgaagt

SEQ ID NO: 5784184 - DNA, 12 bp, Homo sapiens
taaaatattatt

SEQ ID NO: 5784185 - DNA, 18 bp, Homo sapiens
taaaatattatttgatat

SEQ ID NO: 5784186 - DNA, 16 bp, Homo sapiens
taaaatattcactctc

SEQ ID NO: 5784187 - DNA, 18 bp, Homo sapiens
taaaatattcactctcca

SEQ ID NO: 5784188 - DNA, 19 bp, Homo sapiens
taaaatattcactctccat

SEQ ID NO: 5784189 - DNA, 13 bp, Homo sapiens
taaaatattcctg

SEQ ID NO: 5784190 - DNA, 17 bp, Homo sapiens
taaaatattcgaaattc

SEQ ID NO: 5784191 - DNA, 17 bp, Homo sapiens
taaaatattgtgtaaga

SEQ ID NO: 5784192 - DNA, 16 bp, Homo sapiens
taaaatattgttacta

SEQ ID NO: 5784193 - DNA, 18 bp, Homo sapiens
taaaatattgttttccta

SEQ ID NO: 5784194 - DNA, 11 bp, Homo sapiens
taaaatattta

SEQ ID NO: 5784195 - DNA, 12 bp, Homo sapiens
taaaatatttaa

SEQ ID NO: 5784196 - DNA, 23 bp, Homo sapiens
taaaatatttaaacctttttctt

SEQ ID NO: 5784197 - DNA, 15 bp, Homo sapiens
taaaatatttaactt

SEQ ID NO: 5784198 - DNA, 18 bp, Homo sapiens
taaaatatttataaatga

SEQ ID NO: 5784199 - DNA, 19 bp, Homo sapiens
taaaatatttataaatgaa

SEQ ID NO: 5784200 - DNA, 16 bp, Homo sapiens
taaaatatttatgaag

SEQ ID NO: 5784201 - DNA, 20 bp, Homo sapiens
taaaatatttatgaagaaaa

SEQ ID NO: 5784202 - DNA, 21 bp, Homo sapiens
taaaatatttatgaagaaaat

SEQ ID NO: 5784203 - DNA, 14 bp, Homo sapiens
taaaatatttgaat

SEQ ID NO: 5784204 - DNA, 20 bp, Homo sapiens
taaaatatttgaatgaaaac

SEQ ID NO: 5784205 - DNA, 18 bp, Homo sapiens
taaaatatttgcctccat

SEQ ID NO: 5784206 - DNA, 15 bp, Homo sapiens
taaaatattttctgt

SEQ ID NO: 5784207 - DNA, 23 bp, Homo sapiens
taaaatattttctgtgtgttcct

SEQ ID NO: 5784208 - DNA, 14 bp, Homo sapiens
taaaatattttgaa

SEQ ID NO: 5784209 - DNA, 16 bp, Homo sapiens
taaaatattttggatg

SEQ ID NO: 5784210 - DNA, 17 bp, Homo sapiens
taaaatatttttgaaag

SEQ ID NO: 5784211 - DNA, 21 bp, Homo sapiens
taaacacaacaataactttta

SEQ ID NO: 5784212 - DNA, 23 bp, Homo sapiens
taaacacaacaataacttttata

SEQ ID NO: 5784213 - DNA, 22 bp, Homo sapiens
taaacacacagatacacacaca

SEQ ID NO: 5784214 - DNA, 18 bp, Homo sapiens
taaacacagattatttgt

SEQ ID NO: 5784215 - DNA, 17 bp, Homo sapiens
taaacacaggctgtcct

SEQ ID NO: 5784216 - DNA, 17 bp, Homo sapiens
taaacacagggaaagca

SEQ ID NO: 5784217 - DNA, 21 bp, Homo sapiens
taaacacagtcaaaataattc

SEQ ID NO: 5784218 - DNA, 15 bp, Homo sapiens
taaacacataaatga

SEQ ID NO: 5784219 - DNA, 17 bp, Homo sapiens
taaacacataaatgaaa

SEQ ID NO: 5784220 - DNA, 20 bp, Homo sapiens
taaacacataaatgaaagaa

SEQ ID NO: 5784221 - DNA, 21 bp, Homo sapiens
taaacacataaatgaaagaaa

SEQ ID NO: 5784222 - DNA, 12 bp, Homo sapiens
taaacacattaa

SEQ ID NO: 5784223 - DNA, 22 bp, Homo sapiens
taaacacattaaaagacaaata

SEQ ID NO: 5784224 - DNA, 23 bp, Homo sapiens
taaacacatttccattcatggat

SEQ ID NO: 5784225 - DNA, 18 bp, Homo sapiens
taaacaccaacccaggaa

SEQ ID NO: 5784226 - DNA, 22 bp, Homo sapiens
taaacacccatgaatcaaagac

SEQ ID NO: 5784227 - DNA, 18 bp, Homo sapiens
taaacacccttcacatac

SEQ ID NO: 5784228 - DNA, 16 bp, Homo sapiens
taaacacctgacacat

SEQ ID NO: 5784229 - DNA, 22 bp, Homo sapiens
taaacaccttatccctaacatg

SEQ ID NO: 5784230 - DNA, 11 bp, Homo sapiens
taaacactaca

SEQ ID NO: 5784231 - DNA, 16 bp, Homo sapiens
taaacactcaccttct

SEQ ID NO: 5784232 - DNA, 14 bp, Homo sapiens
taaacactcagctg

SEQ ID NO: 5784233 - DNA, 15 bp, Homo sapiens
taaacactccacagt

SEQ ID NO: 5784234 - DNA, 15 bp, Homo sapiens
taaacactcttgaaa

SEQ ID NO: 5784235 - DNA, 18 bp, Homo sapiens
taaacactgcctatatat

SEQ ID NO: 5784236 - DNA, 18 bp, Homo sapiens
taaacactggctctggga

SEQ ID NO: 5784237 - DNA, 13 bp, Homo sapiens
taaacactgtaat

SEQ ID NO: 5784238 - DNA, 16 bp, Homo sapiens
taaacactgtaatctt

SEQ ID NO: 5784239 - DNA, 16 bp, Homo sapiens
taaacactgtattgta

SEQ ID NO: 5784240 - DNA, 21 bp, Homo sapiens
taaacacttatcttctggatt

SEQ ID NO: 5784241 - DNA, 22 bp, Homo sapiens
taaacacttatcttctggatta

SEQ ID NO: 5784242 - DNA, 15 bp, Homo sapiens
taaacactttttctg

SEQ ID NO: 5784243 - DNA, 19 bp, Homo sapiens
taaacagaaaactcccaat

SEQ ID NO: 5784244 - DNA, 20 bp, Homo sapiens
taaacagaaaactcccaata

SEQ ID NO: 5784245 - DNA, 16 bp, Homo sapiens
taaacagaaatccttt

SEQ ID NO: 5784246 - DNA, 12 bp, Homo sapiens
taaacagaaatg

SEQ ID NO: 5784247 - DNA, 12 bp, Homo sapiens
taaacagaagca

SEQ ID NO: 5784248 - DNA, 16 bp, Homo sapiens
taaacagacaaaaaca

SEQ ID NO: 5784249 - DNA, 17 bp, Homo sapiens
taaacagacaggaattt

SEQ ID NO: 5784250 - DNA, 20 bp, Homo sapiens
taaacagatatcttcagttt

SEQ ID NO: 5784251 - DNA, 13 bp, Homo sapiens
taaacagatattc

SEQ ID NO: 5784252 - DNA, 20 bp, Homo sapiens
taaacagatgatgagaattt

SEQ ID NO: 5784253 - DNA, 21 bp, Homo sapiens
taaacagatgtccatcagatg

SEQ ID NO: 5784254 - DNA, 22 bp, Homo sapiens
taaacagatgtccatcagatga

SEQ ID NO: 5784255 - DNA, 23 bp, Homo sapiens
taaacagatgtccatcagatgac

SEQ ID NO: 5784256 - DNA, 18 bp, Homo sapiens
taaacagcaaaagttctt

SEQ ID NO: 5784257 - DNA, 20 bp, Homo sapiens
taaacagcaaagccatattc

SEQ ID NO: 5784258 - DNA, 18 bp, Homo sapiens
taaacagcacacctgtgt

SEQ ID NO: 5784259 - DNA, 22 bp, Homo sapiens
taaacagcaccaccatttaatt

SEQ ID NO: 5784260 - DNA, 13 bp, Homo sapiens
taaacagcagtgt

SEQ ID NO: 5784261 - DNA, 11 bp, Homo sapiens
taaacagctat

SEQ ID NO: 5784262 - DNA, 22 bp, Homo sapiens
taaacaggaattttattttgct

SEQ ID NO: 5784263 - DNA, 23 bp, Homo sapiens
taaacaggcccagcattgctggt

SEQ ID NO: 5784264 - DNA, 20 bp, Homo sapiens
taaacaggtggttcttttta

SEQ ID NO: 5784265 - DNA, 17 bp, Homo sapiens
taaacagtgagaaaaga

SEQ ID NO: 5784266 - DNA, 17 bp, Homo sapiens
taaacagtgtcttctta

SEQ ID NO: 5784267 - DNA, 19 bp, Homo sapiens
taaacagttatgaaaactt

SEQ ID NO: 5784268 - DNA, 16 bp, Homo sapiens
taaacagttatttctg

SEQ ID NO: 5784269 - DNA, 17 bp, Homo sapiens
taaacagttgcacagca

SEQ ID NO: 5784270 - DNA, 22 bp, Homo sapiens
taaacagttgcacagcatctca

SEQ ID NO: 5784271 - DNA, 17 bp, Homo sapiens
taaacagttgttactta

SEQ ID NO: 5784272 - DNA, 21 bp, Homo sapiens
taaacagttttggagaaaaat

SEQ ID NO: 5784273 - DNA, 22 bp, Homo sapiens
taaacataaaaactgatttgct

SEQ ID NO: 5784274 - DNA, 14 bp, Homo sapiens
taaacataagctaa

SEQ ID NO: 5784275 - DNA, 16 bp, Homo sapiens
taaacataatgaaaat

SEQ ID NO: 5784276 - DNA, 20 bp, Homo sapiens
taaacataattcttgtatat

SEQ ID NO: 5784277 - DNA, 13 bp, Homo sapiens
taaacataattgt

SEQ ID NO: 5784278 - DNA, 21 bp, Homo sapiens
taaacataattgtggattata

SEQ ID NO: 5784279 - DNA, 15 bp, Homo sapiens
taaacatacatgttg

SEQ ID NO: 5784280 - DNA, 23 bp, Homo sapiens
taaacatagtggtattttaacat

SEQ ID NO: 5784281 - DNA, 20 bp, Homo sapiens
taaacatatccaagtttgaa

SEQ ID NO: 5784282 - DNA, 18 bp, Homo sapiens
taaacatatgatttcact

SEQ ID NO: 5784283 - DNA, 14 bp, Homo sapiens
taaacatatgcaaa

SEQ ID NO: 5784284 - DNA, 20 bp, Homo sapiens
taaacatatttttatacttt

SEQ ID NO: 5784285 - DNA, 21 bp, Homo sapiens
taaacatatttttatacttta

SEQ ID NO: 5784286 - DNA, 23 bp, Homo sapiens
taaacatatttttatactttatt

SEQ ID NO: 5784287 - DNA, 21 bp, Homo sapiens
taaacatcacatggcatgttt

SEQ ID NO: 5784288 - DNA, 16 bp, Homo sapiens
taaacatcaggttagg

SEQ ID NO: 5784289 - DNA, 17 bp, Homo sapiens
taaacatcaggttaggc

SEQ ID NO: 5784290 - DNA, 13 bp, Homo sapiens
taaacatcataaa

SEQ ID NO: 5784291 - DNA, 17 bp, Homo sapiens
taaacatcatagtttct

SEQ ID NO: 5784292 - DNA, 20 bp, Homo sapiens
taaacatctagcagtaaata

SEQ ID NO: 5784293 - DNA, 12 bp, Homo sapiens
taaacatctgat

SEQ ID NO: 5784294 - DNA, 16 bp, Homo sapiens
taaacatctgtgtctg

SEQ ID NO: 5784295 - DNA, 22 bp, Homo sapiens
taaacatgaaaacacttgaaat

SEQ ID NO: 5784296 - DNA, 14 bp, Homo sapiens
taaacatgaaggga

SEQ ID NO: 5784297 - DNA, 18 bp, Homo sapiens
taaacatgaatttaatgt

SEQ ID NO: 5784298 - DNA, 15 bp, Homo sapiens
taaacatgatgtcaa

SEQ ID NO: 5784299 - DNA, 16 bp, Homo sapiens
taaacatgattatctt

SEQ ID NO: 5784300 - DNA, 17 bp, Homo sapiens
taaacatgattatcttg

SEQ ID NO: 5784301 - DNA, 22 bp, Homo sapiens
taaacatgctgtacatactttt

SEQ ID NO: 5784302 - DNA, 23 bp, Homo sapiens
taaacatgctgtacatacttttt

SEQ ID NO: 5784303 - DNA, 18 bp, Homo sapiens
taaacatgtatgtaaata

SEQ ID NO: 5784304 - DNA, 20 bp, Homo sapiens
taaacatgtcacaatacagt

SEQ ID NO: 5784305 - DNA, 13 bp, Homo sapiens
taaacatgtgttt

SEQ ID NO: 5784306 - DNA, 15 bp, Homo sapiens
taaacatgtgtttta

SEQ ID NO: 5784307 - DNA, 21 bp, Homo sapiens
taaacattaaaagaagactgg

SEQ ID NO: 5784308 - DNA, 19 bp, Homo sapiens
taaacattaaacactgtaa

SEQ ID NO: 5784309 - DNA, 16 bp, Homo sapiens
taaacattaaatgtct

SEQ ID NO: 5784310 - DNA, 19 bp, Homo sapiens
taaacattaattttgtgca

SEQ ID NO: 5784311 - DNA, 23 bp, Homo sapiens
taaacattaattttgtgcattct

SEQ ID NO: 5784312 - DNA, 18 bp, Homo sapiens
taaacattacggtacaga

SEQ ID NO: 5784313 - DNA, 18 bp, Homo sapiens
taaacattagttctattt

SEQ ID NO: 5784314 - DNA, 15 bp, Homo sapiens
taaacattatttttc

SEQ ID NO: 5784315 - DNA, 21 bp, Homo sapiens
taaacattcaattccagagaa

SEQ ID NO: 5784316 - DNA, 14 bp, Homo sapiens
taaacattctttta

SEQ ID NO: 5784317 - DNA, 18 bp, Homo sapiens
taaacattgaagtaatga

SEQ ID NO: 5784318 - DNA, 15 bp, Homo sapiens
taaacatttccctgc

SEQ ID NO: 5784319 - DNA, 17 bp, Homo sapiens
taaacatttccctgctg

SEQ ID NO: 5784320 - DNA, 21 bp, Homo sapiens
taaacatttgtaaaaatactg

SEQ ID NO: 5784321 - DNA, 14 bp, Homo sapiens
taaacatttgttcc

SEQ ID NO: 5784322 - DNA, 18 bp, Homo sapiens
taaacatttgttcctgga

SEQ ID NO: 5784323 - DNA, 15 bp, Homo sapiens
taaacattttacatg

SEQ ID NO: 5784324 - DNA, 11 bp, Homo sapiens
taaacattttc

SEQ ID NO: 5784325 - DNA, 14 bp, Homo sapiens
taaacattttcata

SEQ ID NO: 5784326 - DNA, 15 bp, Homo sapiens
taaacattttcatgc

SEQ ID NO: 5784327 - DNA, 11 bp, Homo sapiens
taaacattttt

SEQ ID NO: 5784328 - DNA, 14 bp, Homo sapiens
taaacattttttct

SEQ ID NO: 5784329 - DNA, 14 bp, Homo sapiens
taaaccaaaaacat

SEQ ID NO: 5784330 - DNA, 17 bp, Homo sapiens
taaaccaaaaacatttg

SEQ ID NO: 5784331 - DNA, 18 bp, Homo sapiens
taaaccaaaaacatttga

SEQ ID NO: 5784332 - DNA, 16 bp, Homo sapiens
taaaccaaacccagcc

SEQ ID NO: 5784333 - DNA, 18 bp, Homo sapiens
taaaccaaacccagccac

SEQ ID NO: 5784334 - DNA, 19 bp, Homo sapiens
taaaccaaacccagccact

SEQ ID NO: 5784335 - DNA, 15 bp, Homo sapiens
taaaccaaaggacat

SEQ ID NO: 5784336 - DNA, 19 bp, Homo sapiens
taaaccaaaggacattatg

SEQ ID NO: 5784337 - DNA, 18 bp, Homo sapiens
taaaccaaatatgttaaa

SEQ ID NO: 5784338 - DNA, 20 bp, Homo sapiens
taaaccaacctttaaaattg

SEQ ID NO: 5784339 - DNA, 21 bp, Homo sapiens
taaaccaacctttaaaattgt

SEQ ID NO: 5784340 - DNA, 16 bp, Homo sapiens
taaaccaactctaata

SEQ ID NO: 5784341 - DNA, 22 bp, Homo sapiens
taaaccaagattatgtgacttg

SEQ ID NO: 5784342 - DNA, 17 bp, Homo sapiens
taaaccaaggactgagc

SEQ ID NO: 5784343 - DNA, 18 bp, Homo sapiens
taaaccaagttatttttc

SEQ ID NO: 5784344 - DNA, 15 bp, Homo sapiens
taaaccaatgaaatt

SEQ ID NO: 5784345 - DNA, 14 bp, Homo sapiens
taaaccacaagcat

SEQ ID NO: 5784346 - DNA, 16 bp, Homo sapiens
taaaccacaagcatct

SEQ ID NO: 5784347 - DNA, 23 bp, Homo sapiens
taaaccacatcatggaccaaatg

SEQ ID NO: 5784348 - DNA, 22 bp, Homo sapiens
taaaccaccagtgcccaaagtc

SEQ ID NO: 5784349 - DNA, 17 bp, Homo sapiens
taaaccaccctctgggg

SEQ ID NO: 5784350 - DNA, 21 bp, Homo sapiens
taaaccaccctctggggacag

SEQ ID NO: 5784351 - DNA, 22 bp, Homo sapiens
taaaccacctcagaaaggattt

SEQ ID NO: 5784352 - DNA, 19 bp, Homo sapiens
taaaccacctcccaaaggc

SEQ ID NO: 5784353 - DNA, 20 bp, Homo sapiens
taaaccactgaaaaaatata

SEQ ID NO: 5784354 - DNA, 19 bp, Homo sapiens
taaaccacttctctgctgc

SEQ ID NO: 5784355 - DNA, 13 bp, Homo sapiens
taaaccagaaaaa

SEQ ID NO: 5784356 - DNA, 21 bp, Homo sapiens
taaaccagaaaaaataaatgt

SEQ ID NO: 5784357 - DNA, 21 bp, Homo sapiens
taaaccagcagaaaagtgctt

SEQ ID NO: 5784358 - DNA, 14 bp, Homo sapiens
taaaccaggaaaaa

SEQ ID NO: 5784359 - DNA, 22 bp, Homo sapiens
taaaccagggatgtctgttgaa

SEQ ID NO: 5784360 - DNA, 23 bp, Homo sapiens
taaaccagggatgtctgttgaaa

SEQ ID NO: 5784361 - DNA, 21 bp, Homo sapiens
taaaccaggtttagacagtat

SEQ ID NO: 5784362 - DNA, 12 bp, Homo sapiens
taaaccagtgtg

SEQ ID NO: 5784363 - DNA, 14 bp, Homo sapiens
taaaccagtgtgaa

SEQ ID NO: 5784364 - DNA, 18 bp, Homo sapiens
taaaccagtttagatttc

SEQ ID NO: 5784365 - DNA, 16 bp, Homo sapiens
taaaccatctccctgg

SEQ ID NO: 5784366 - DNA, 14 bp, Homo sapiens
taaaccattgtgca

SEQ ID NO: 5784367 - DNA, 22 bp, Homo sapiens
taaaccatttttgctgaattca

SEQ ID NO: 5784368 - DNA, 18 bp, Homo sapiens
taaaccatttttgttact

SEQ ID NO: 5784369 - DNA, 14 bp, Homo sapiens
taaacccaaataaa

SEQ ID NO: 5784370 - DNA, 19 bp, Homo sapiens
taaacccaatcagatgcct

SEQ ID NO: 5784371 - DNA, 13 bp, Homo sapiens
taaacccatacaa

SEQ ID NO: 5784372 - DNA, 14 bp, Homo sapiens
taaacccatacaat

SEQ ID NO: 5784373 - DNA, 18 bp, Homo sapiens
taaacccatacaatgtat

SEQ ID NO: 5784374 - DNA, 18 bp, Homo sapiens
taaacccatctgtaatat

SEQ ID NO: 5784375 - DNA, 18 bp, Homo sapiens
taaaccccaagcttccca

SEQ ID NO: 5784376 - DNA, 19 bp, Homo sapiens
taaaccccaagcttcccaa

SEQ ID NO: 5784377 - DNA, 17 bp, Homo sapiens
taaacccccgctccaga

SEQ ID NO: 5784378 - DNA, 15 bp, Homo sapiens
taaacccctgtccca

SEQ ID NO: 5784379 - DNA, 15 bp, Homo sapiens
taaacccgcacccca

SEQ ID NO: 5784380 - DNA, 13 bp, Homo sapiens
taaaccctccaag

SEQ ID NO: 5784381 - DNA, 16 bp, Homo sapiens
taaaccgccaaggctg

SEQ ID NO: 5784382 - DNA, 20 bp, Homo sapiens
taaaccgctttggcctgagt

SEQ ID NO: 5784383 - DNA, 18 bp, Homo sapiens
taaaccggatcctgttgc

SEQ ID NO: 5784384 - DNA, 15 bp, Homo sapiens
taaaccgtgtattta

SEQ ID NO: 5784385 - DNA, 18 bp, Homo sapiens
taaacctaatattcaatg

SEQ ID NO: 5784386 - DNA, 21 bp, Homo sapiens
taaacctaatgtctgtataaa

SEQ ID NO: 5784387 - DNA, 23 bp, Homo sapiens
taaagacctgctgtaataaatgt

SEQ ID NO: 5784388 - DNA, 17 bp, Homo sapiens
taaagacgatttgtcag

SEQ ID NO: 5784389 - DNA, 21 bp, Homo sapiens
taaagacgttttataagcatc

SEQ ID NO: 5784390 - DNA, 18 bp, Homo sapiens
taaagactacctgggacc

SEQ ID NO: 5784391 - DNA, 16 bp, Homo sapiens
taaagactcttggact

SEQ ID NO: 5784392 - DNA, 13 bp, Homo sapiens
taaagactgaaat

SEQ ID NO: 5784393 - DNA, 17 bp, Homo sapiens
taaagactgagcagaac

SEQ ID NO: 5784394 - DNA, 14 bp, Homo sapiens
taaagactggcttt

SEQ ID NO: 5784395 - DNA, 15 bp, Homo sapiens
taaagactggctttt

SEQ ID NO: 5784396 - DNA, 13 bp, Homo sapiens
taaagactggttt

SEQ ID NO: 5784397 - DNA, 19 bp, Homo sapiens
taaagactggttttctgcc

SEQ ID NO: 5784398 - DNA, 13 bp, Homo sapiens
taaagactgtgct

SEQ ID NO: 5784399 - DNA, 23 bp, Homo sapiens
taaagacttgatgaataaacact

SEQ ID NO: 5784400 - DNA, 19 bp, Homo sapiens
taaagacttttatgtgaga

SEQ ID NO: 5784401 - DNA, 13 bp, Homo sapiens
taaagagaaaaat

SEQ ID NO: 5784402 - DNA, 14 bp, Homo sapiens
taaagagaaaattg

SEQ ID NO: 5784403 - DNA, 16 bp, Homo sapiens
taaagagaaaattgaa

SEQ ID NO: 5784404 - DNA, 17 bp, Homo sapiens
taaagagaaaattgaat

SEQ ID NO: 5784405 - DNA, 20 bp, Homo sapiens
taaagagaaaattgaattta

SEQ ID NO: 5784406 - DNA, 23 bp, Homo sapiens
taaagagaaaattgaatttaaca

SEQ ID NO: 5784407 - DNA, 12 bp, Homo sapiens
taaagagaaact

SEQ ID NO: 5784408 - DNA, 20 bp, Homo sapiens
taaagagaaactttgtgcta

SEQ ID NO: 5784409 - DNA, 13 bp, Homo sapiens
taaagagaaatat

SEQ ID NO: 5784410 - DNA, 22 bp, Homo sapiens
taaagagaaatatatttgtcac

SEQ ID NO: 5784411 - DNA, 15 bp, Homo sapiens
taaagagaacaagag

SEQ ID NO: 5784412 - DNA, 22 bp, Homo sapiens
taaagagacagtgatattggaa

SEQ ID NO: 5784413 - DNA, 17 bp, Homo sapiens
taaagagaccatcttct

SEQ ID NO: 5784414 - DNA, 20 bp, Homo sapiens
taaagagacctacctcaggt

SEQ ID NO: 5784415 - DNA, 23 bp, Homo sapiens
taaagagatttcccttcatttaa

SEQ ID NO: 5784416 - DNA, 18 bp, Homo sapiens
taaagagcacgttttcca

SEQ ID NO: 5784417 - DNA, 15 bp, Homo sapiens
taaagagcatcctga

SEQ ID NO: 5784418 - DNA, 16 bp, Homo sapiens
taaagagcatcctgat

SEQ ID NO: 5784419 - DNA, 20 bp, Homo sapiens
taaagagcatctgattcttg

SEQ ID NO: 5784420 - DNA, 23 bp, Homo sapiens
taaagagcatggaaaaatactgc

SEQ ID NO: 5784421 - DNA, 19 bp, Homo sapiens
taaagagcccttgcctccc

SEQ ID NO: 5784422 - DNA, 18 bp, Homo sapiens
taaagagctgcacagcaa

SEQ ID NO: 5784423 - DNA, 20 bp, Homo sapiens
taaagagctgcacagcaaaa

SEQ ID NO: 5784424 - DNA, 20 bp, Homo sapiens
taaagaggaaaagtgcaatg

SEQ ID NO: 5784425 - DNA, 17 bp, Homo sapiens
taaagaggaagccttgc

SEQ ID NO: 5784426 - DNA, 12 bp, Homo sapiens
taaagaggagat

SEQ ID NO: 5784427 - DNA, 21 bp, Homo sapiens
taaagaggagataaggtggct

SEQ ID NO: 5784428 - DNA, 23 bp, Homo sapiens
taaagaggagataaggtggcttc

SEQ ID NO: 5784429 - DNA, 19 bp, Homo sapiens
taaagaggagcctttccag

SEQ ID NO: 5784430 - DNA, 22 bp, Homo sapiens
taaagaggagtgttattgcatg

SEQ ID NO: 5784431 - DNA, 22 bp, Homo sapiens
taaagaggattgggtagcatat

SEQ ID NO: 5784432 - DNA, 20 bp, Homo sapiens
taaagaggcgttgctttcac

SEQ ID NO: 5784433 - DNA, 15 bp, Homo sapiens
taaagaggctgtgtg

SEQ ID NO: 5784434 - DNA, 20 bp, Homo sapiens
taaagagtatttacaataaa

SEQ ID NO: 5784435 - DNA, 13 bp, Homo sapiens
taaagagtctaga

SEQ ID NO: 5784436 - DNA, 18 bp, Homo sapiens
taaagagtctagattcaa

SEQ ID NO: 5784437 - DNA, 21 bp, Homo sapiens
taaagagtgtgttataaaata

SEQ ID NO: 5784438 - DNA, 22 bp, Homo sapiens
taaagagtgtgttataaaataa

SEQ ID NO: 5784439 - DNA, 12 bp, Homo sapiens
taaagagttatt

SEQ ID NO: 5784440 - DNA, 22 bp, Homo sapiens
taaagagttctccttgtacttg

SEQ ID NO: 5784441 - DNA, 20 bp, Homo sapiens
taaagataacccttattcca

SEQ ID NO: 5784442 - DNA, 21 bp, Homo sapiens
taaagataacccttattccat

SEQ ID NO: 5784443 - DNA, 17 bp, Homo sapiens
taaagataagtctacat

SEQ ID NO: 5784444 - DNA, 15 bp, Homo sapiens
taaagataatattac

SEQ ID NO: 5784445 - DNA, 19 bp, Homo sapiens
taaagataatcgaagcaaa

SEQ ID NO: 5784446 - DNA, 13 bp, Homo sapiens
taaagatacatga

SEQ ID NO: 5784447 - DNA, 20 bp, Homo sapiens
taaagatatatagagatgca

SEQ ID NO: 5784448 - DNA, 14 bp, Homo sapiens
taaagatattattc

SEQ ID NO: 5784449 - DNA, 16 bp, Homo sapiens
taaagatattattcac

SEQ ID NO: 5784450 - DNA, 17 bp, Homo sapiens
taaagatattgtatctc

SEQ ID NO: 5784451 - DNA, 17 bp, Homo sapiens
taaagatatttccaaga

SEQ ID NO: 5784452 - DNA, 18 bp, Homo sapiens
taaagatatttttatctt

SEQ ID NO: 5784453 - DNA, 13 bp, Homo sapiens
taaagatcacaca

SEQ ID NO: 5784454 - DNA, 13 bp, Homo sapiens
taaagatcacaga

SEQ ID NO: 5784455 - DNA, 17 bp, Homo sapiens
taaagatctcggtgctg

SEQ ID NO: 5784456 - DNA, 16 bp, Homo sapiens
taaagatgaactctga

SEQ ID NO: 5784457 - DNA, 13 bp, Homo sapiens
taaagatgagttg

SEQ ID NO: 5784458 - DNA, 21 bp, Homo sapiens
taaagatgatctactcagaaa

SEQ ID NO: 5784459 - DNA, 17 bp, Homo sapiens
taaagatgattgttctt

SEQ ID NO: 5784460 - DNA, 18 bp, Homo sapiens
taaagatgccatagcata

SEQ ID NO: 5784461 - DNA, 17 bp, Homo sapiens
taaagatggagtttcta

SEQ ID NO: 5784462 - DNA, 17 bp, Homo sapiens
taaagatgggaggagac

SEQ ID NO: 5784463 - DNA, 17 bp, Homo sapiens
taaagatggtcgtgtgt

SEQ ID NO: 5784464 - DNA, 20 bp, Homo sapiens
taaagatggtcgtgtgtgtg

SEQ ID NO: 5784465 - DNA, 16 bp, Homo sapiens
taaagatggtttatgc

SEQ ID NO: 5784466 - DNA, 16 bp, Homo sapiens
taaagatgtaactagg

SEQ ID NO: 5784467 - DNA, 14 bp, Homo sapiens
taaagatgtcaaat

SEQ ID NO: 5784468 - DNA, 13 bp, Homo sapiens
taaagatgtctgc

SEQ ID NO: 5784469 - DNA, 12 bp, Homo sapiens
taaagatgtgaa

SEQ ID NO: 5784470 - DNA, 13 bp, Homo sapiens
taaagatgtgaaa

SEQ ID NO: 5784471 - DNA, 17 bp, Homo sapiens
taaagatgtgaaaactc

SEQ ID NO: 5784472 - DNA, 15 bp, Homo sapiens
taaagatgttaaaaa

SEQ ID NO: 5784473 - DNA, 20 bp, Homo sapiens
taaagattacccccagtcct

SEQ ID NO: 5784474 - DNA, 21 bp, Homo sapiens
taaagattatagctcccaaaa

SEQ ID NO: 5784475 - DNA, 16 bp, Homo sapiens
taaagattattttttg

SEQ ID NO: 5784476 - DNA, 18 bp, Homo sapiens
taaagattctacaacaca

SEQ ID NO: 5784477 - DNA, 23 bp, Homo sapiens
taaagattctctttaaaaaagac

SEQ ID NO: 5784478 - DNA, 18 bp, Homo sapiens
taaagattggaatgtgtt

SEQ ID NO: 5784479 - DNA, 15 bp, Homo sapiens
taaagattgtactta

SEQ ID NO: 5784480 - DNA, 17 bp, Homo sapiens
taaagatttaggccaat

SEQ ID NO: 5784481 - DNA, 15 bp, Homo sapiens
taaagatttctgttc

SEQ ID NO: 5784482 - DNA, 14 bp, Homo sapiens
taaagatttcttga

SEQ ID NO: 5784483 - DNA, 16 bp, Homo sapiens
taaagattttttaata

SEQ ID NO: 5784484 - DNA, 21 bp, Homo sapiens
taaagattttttaataattta

SEQ ID NO: 5784485 - DNA, 22 bp, Homo sapiens
taaagattttttaataatttag

SEQ ID NO: 5784486 - DNA, 13 bp, Homo sapiens
taaagcaaaaaac

SEQ ID NO: 5784487 - DNA, 15 bp, Homo sapiens
taaagcaaaatagta

SEQ ID NO: 5784488 - DNA, 19 bp, Homo sapiens
taaagcaaaccagcctcag

SEQ ID NO: 5784489 - DNA, 21 bp, Homo sapiens
taaagcaaagcgctaagtaaa

SEQ ID NO: 5784490 - DNA, 21 bp, Homo sapiens
taaagcaactgtctatttctg

SEQ ID NO: 5784491 - DNA, 23 bp, Homo sapiens
taaagcaactgtctatttctgct

SEQ ID NO: 5784492 - DNA, 20 bp, Homo sapiens
taaagcaactgttatgaaat

SEQ ID NO: 5784493 - DNA, 21 bp, Homo sapiens
taaagcaagctcacttgcttt

SEQ ID NO: 5784494 - DNA, 16 bp, Homo sapiens
taaagcaataaaattt

SEQ ID NO: 5784495 - DNA, 14 bp, Homo sapiens
taaagcaatagaaa

SEQ ID NO: 5784496 - DNA, 15 bp, Homo sapiens
taaagcaatagaaac

SEQ ID NO: 5784497 - DNA, 19 bp, Homo sapiens
taaagcaatctgattcagc

SEQ ID NO: 5784498 - DNA, 14 bp, Homo sapiens
taaagcaatcttgg

SEQ ID NO: 5784499 - DNA, 13 bp, Homo sapiens
taaagcaattttc

SEQ ID NO: 5784500 - DNA, 14 bp, Homo sapiens
taaagcaattttcc

SEQ ID NO: 5784501 - DNA, 16 bp, Homo sapiens
taaagcaattttcctt

SEQ ID NO: 5784502 - DNA, 17 bp, Homo sapiens
taaagcaattttccttg

SEQ ID NO: 5784503 - DNA, 22 bp, Homo sapiens
taaagcaattttccttgaagcc

SEQ ID NO: 5784504 - DNA, 12 bp, Homo sapiens
taaagcacactt

SEQ ID NO: 5784505 - DNA, 21 bp, Homo sapiens
taaagcaccagcagtgtttaa

SEQ ID NO: 5784506 - DNA, 18 bp, Homo sapiens
taaagcactattgtttag

SEQ ID NO: 5784507 - DNA, 15 bp, Homo sapiens
taaagcagacagtca

SEQ ID NO: 5784508 - DNA, 17 bp, Homo sapiens
taaagcagagccaaggc

SEQ ID NO: 5784509 - DNA, 19 bp, Homo sapiens
taaagcagagccaaggcca

SEQ ID NO: 5784510 - DNA, 21 bp, Homo sapiens
taaagcagagccaaggccacc

SEQ ID NO: 5784511 - DNA, 11 bp, Homo sapiens
taaagcagagt

SEQ ID NO: 5784512 - DNA, 13 bp, Homo sapiens
taaagcagccagc

SEQ ID NO: 5784513 - DNA, 17 bp, Homo sapiens
taaagcagcgtttctat

SEQ ID NO: 5784514 - DNA, 19 bp, Homo sapiens
taaagcaggccttttgata

SEQ ID NO: 5784515 - DNA, 20 bp, Homo sapiens
taaagcaggccttttgatat

SEQ ID NO: 5784516 - DNA, 17 bp, Homo sapiens
taaagcaggttcttgtt

SEQ ID NO: 5784517 - DNA, 20 bp, Homo sapiens
taaagcagtaaaataaaaaa

SEQ ID NO: 5784518 - DNA, 13 bp, Homo sapiens
taaagcagtggac

SEQ ID NO: 5784519 - DNA, 13 bp, Homo sapiens
taaagcagtgttt

SEQ ID NO: 5784520 - DNA, 16 bp, Homo sapiens
taaagcagtgtttgct

SEQ ID NO: 5784521 - DNA, 17 bp, Homo sapiens
taaagcataagtataca

SEQ ID NO: 5784522 - DNA, 23 bp, Homo sapiens
taaagcatatccattcagaatga

SEQ ID NO: 5784523 - DNA, 14 bp, Homo sapiens
taaagcatcagaga

SEQ ID NO: 5784524 - DNA, 21 bp, Homo sapiens
taaagcatcagagatggtaat

SEQ ID NO: 5784525 - DNA, 20 bp, Homo sapiens
taaagcatcctcctcctgga

SEQ ID NO: 5784526 - DNA, 14 bp, Homo sapiens
taaagcatctaaac

SEQ ID NO: 5784527 - DNA, 16 bp, Homo sapiens
taaagcatctaaactt

SEQ ID NO: 5784528 - DNA, 18 bp, Homo sapiens
taaagcatctaaacttta

SEQ ID NO: 5784529 - DNA, 15 bp, Homo sapiens
taaagcatctgtaaa

SEQ ID NO: 5784530 - DNA, 16 bp, Homo sapiens
taaagcatgaaatgtg

SEQ ID NO: 5784531 - DNA, 19 bp, Homo sapiens
taaagcatgaaatgtgaat

SEQ ID NO: 5784532 - DNA, 21 bp, Homo sapiens
taaagcatgaaatgtgaattt

SEQ ID NO: 5784533 - DNA, 15 bp, Homo sapiens
taaagcattccaaca

SEQ ID NO: 5784534 - DNA, 16 bp, Homo sapiens
taaagcattccaacaa

SEQ ID NO: 5784535 - DNA, 23 bp, Homo sapiens
taaagccaaaaccatcttctgtg

SEQ ID NO: 5784536 - DNA, 16 bp, Homo sapiens
taaagccaaccagcct

SEQ ID NO: 5784537 - DNA, 12 bp, Homo sapiens
taaagccaggaa

SEQ ID NO: 5784538 - DNA, 22 bp, Homo sapiens
taaagccaggctcaggagaagc

SEQ ID NO: 5784539 - DNA, 13 bp, Homo sapiens
taaagccagtcat

SEQ ID NO: 5784540 - DNA, 18 bp, Homo sapiens
taaagccagttggcttct

SEQ ID NO: 5784541 - DNA, 11 bp, Homo sapiens
taaagccatgt

SEQ ID NO: 5784542 - DNA, 14 bp, Homo sapiens
taaagccatttctt

SEQ ID NO: 5784543 - DNA, 16 bp, Homo sapiens
taaagccatttcttat

SEQ ID NO: 5784544 - DNA, 16 bp, Homo sapiens
taaagcccccttctcc

SEQ ID NO: 5784545 - DNA, 14 bp, Homo sapiens
taaagccctcagat

SEQ ID NO: 5784546 - DNA, 17 bp, Homo sapiens
taaagccctcagatccc

SEQ ID NO: 5784547 - DNA, 20 bp, Homo sapiens
taaagccctgtgttaagtgt

SEQ ID NO: 5784548 - DNA, 18 bp, Homo sapiens
taaagcctgaaaattcca

SEQ ID NO: 5784549 - DNA, 18 bp, Homo sapiens
taaagcctgaatttggga

SEQ ID NO: 5784550 - DNA, 20 bp, Homo sapiens
taaagcctgagtttgctttc

SEQ ID NO: 5784551 - DNA, 14 bp, Homo sapiens
taaagcctgctctc

SEQ ID NO: 5784552 - DNA, 21 bp, Homo sapiens
taaagcctgctttttaagtgt

SEQ ID NO: 5784553 - DNA, 20 bp, Homo sapiens
taaagcctgtattctcaaac

SEQ ID NO: 5784554 - DNA, 13 bp, Homo sapiens
taaagccttctgg

SEQ ID NO: 5784555 - DNA, 16 bp, Homo sapiens
taaagccttctggatc

SEQ ID NO: 5784556 - DNA, 20 bp, Homo sapiens
taaagcctttgatgcacaaa

SEQ ID NO: 5784557 - DNA, 17 bp, Homo sapiens
taaagccttttaaatca

SEQ ID NO: 5784558 - DNA, 14 bp, Homo sapiens
taaagcgaaaaact

SEQ ID NO: 5784559 - DNA, 13 bp, Homo sapiens
taaagcgtcctct

SEQ ID NO: 5784560 - DNA, 15 bp, Homo sapiens
taaagctaaaataaa

SEQ ID NO: 5784561 - DNA, 22 bp, Homo sapiens
taaagctaaaataaagaaatag

SEQ ID NO: 5784562 - DNA, 23 bp, Homo sapiens
taaagctaaaataaagaaataga

SEQ ID NO: 5784563 - DNA, 14 bp, Homo sapiens
taaagctaaactga

SEQ ID NO: 5784564 - DNA, 17 bp, Homo sapiens
taaagctaccattttac

SEQ ID NO: 5784565 - DNA, 20 bp, Homo sapiens
taaatatatatttttaaaat

SEQ ID NO: 5784566 - DNA, 18 bp, Homo sapiens
taaatatatatttttcaa

SEQ ID NO: 5784567 - DNA, 23 bp, Homo sapiens
taaatatatatttttcaaataga

SEQ ID NO: 5784568 - DNA, 17 bp, Homo sapiens
taaatatatctttgtaa

SEQ ID NO: 5784569 - DNA, 22 bp, Homo sapiens
taaatatatctttgtaaattat

SEQ ID NO: 5784570 - DNA, 18 bp, Homo sapiens
taaatatatgctaagtct

SEQ ID NO: 5784571 - DNA, 18 bp, Homo sapiens
taaatatatgtatacata

SEQ ID NO: 5784572 - DNA, 20 bp, Homo sapiens
taaatatatgtatgtaaaaa

SEQ ID NO: 5784573 - DNA, 17 bp, Homo sapiens
taaatatatgtctgata

SEQ ID NO: 5784574 - DNA, 12 bp, Homo sapiens
taaatatatgtt

SEQ ID NO: 5784575 - DNA, 21 bp, Homo sapiens
taaatatatgttttgagaaaa

SEQ ID NO: 5784576 - DNA, 13 bp, Homo sapiens
taaatatattatt

SEQ ID NO: 5784577 - DNA, 15 bp, Homo sapiens
taaatatattattac

SEQ ID NO: 5784578 - DNA, 18 bp, Homo sapiens
taaatatattattacttg

SEQ ID NO: 5784579 - DNA, 22 bp, Homo sapiens
taaatatatttaagataattat

SEQ ID NO: 5784580 - DNA, 16 bp, Homo sapiens
taaatatattttaaga

SEQ ID NO: 5784581 - DNA, 15 bp, Homo sapiens
taaatatattttcaa

SEQ ID NO: 5784582 - DNA, 15 bp, Homo sapiens
taaatatattttctt

SEQ ID NO: 5784583 - DNA, 22 bp, Homo sapiens
taaatatcaatcaagccatgta

SEQ ID NO: 5784584 - DNA, 17 bp, Homo sapiens
taaatatcacagtatta

SEQ ID NO: 5784585 - DNA, 18 bp, Homo sapiens
taaatatcagtattctga

SEQ ID NO: 5784586 - DNA, 13 bp, Homo sapiens
taaatatcattct

SEQ ID NO: 5784587 - DNA, 15 bp, Homo sapiens
taaatatcattcttt

SEQ ID NO: 5784588 - DNA, 12 bp, Homo sapiens
taaatatccaaa

SEQ ID NO: 5784589 - DNA, 14 bp, Homo sapiens
taaatatccacaga

SEQ ID NO: 5784590 - DNA, 19 bp, Homo sapiens
taaatatccacagtactca

SEQ ID NO: 5784591 - DNA, 18 bp, Homo sapiens
taaatatccatttatctt

SEQ ID NO: 5784592 - DNA, 23 bp, Homo sapiens
taaatatccatttatcttttgta

SEQ ID NO: 5784593 - DNA, 16 bp, Homo sapiens
taaatatcccagagaa

SEQ ID NO: 5784594 - DNA, 24 bp, Homo sapiens
taaatatctagtgctaaacctatc

SEQ ID NO: 5784595 - DNA, 23 bp, Homo sapiens
taaatatctatttatctgtctga

SEQ ID NO: 5784596 - DNA, 21 bp, Homo sapiens
taaatatctgaacatttacta

SEQ ID NO: 5784597 - DNA, 22 bp, Homo sapiens
taaatatctgtacttcttcgat

SEQ ID NO: 5784598 - DNA, 22 bp, Homo sapiens
taaatatcttttatgtttgaat

SEQ ID NO: 5784599 - DNA, 16 bp, Homo sapiens
taaatatctttttcct

SEQ ID NO: 5784600 - DNA, 14 bp, Homo sapiens
taaatatgaaattt

SEQ ID NO: 5784601 - DNA, 15 bp, Homo sapiens
taaatatgaacaaag

SEQ ID NO: 5784602 - DNA, 19 bp, Homo sapiens
taaatatgaagctcacctg

SEQ ID NO: 5784603 - DNA, 13 bp, Homo sapiens
taaatatgacagt

SEQ ID NO: 5784604 - DNA, 14 bp, Homo sapiens
taaatatgactcct

SEQ ID NO: 5784605 - DNA, 18 bp, Homo sapiens
taaatatgagactattat

SEQ ID NO: 5784606 - DNA, 21 bp, Homo sapiens
taaatatggactgctcaggaa

SEQ ID NO: 5784607 - DNA, 23 bp, Homo sapiens
taaatatggactgctcaggaaac

SEQ ID NO: 5784608 - DNA, 19 bp, Homo sapiens
taaatatgggaatgtctaa

SEQ ID NO: 5784609 - DNA, 20 bp, Homo sapiens
taaatatgtacaattgtggg

SEQ ID NO: 5784610 - DNA, 14 bp, Homo sapiens
taaatatgtacatt

SEQ ID NO: 5784611 - DNA, 16 bp, Homo sapiens
taaatatgtacatttc

SEQ ID NO: 5784612 - DNA, 13 bp, Homo sapiens
taaatatgtatta

SEQ ID NO: 5784613 - DNA, 15 bp, Homo sapiens
taaatatgtgaaaat

SEQ ID NO: 5784614 - DNA, 19 bp, Homo sapiens
taaatatgtgaaaatgatt

SEQ ID NO: 5784615 - DNA, 20 bp, Homo sapiens
taaatatgtgaagaaaaaga

SEQ ID NO: 5784616 - DNA, 18 bp, Homo sapiens
taaatatgtgacattcct

SEQ ID NO: 5784617 - DNA, 13 bp, Homo sapiens
taaatatgtttca

SEQ ID NO: 5784618 - DNA, 18 bp, Homo sapiens
taaatatgttttttagat

SEQ ID NO: 5784619 - DNA, 12 bp, Homo sapiens
taaatattaaag

SEQ ID NO: 5784620 - DNA, 18 bp, Homo sapiens
taaatattagttaatgga

SEQ ID NO: 5784621 - DNA, 22 bp, Homo sapiens
taaatattatgccttgagaatg

SEQ ID NO: 5784622 - DNA, 15 bp, Homo sapiens
taaatattatttgat

SEQ ID NO: 5784623 - DNA, 12 bp, Homo sapiens
taaatattcata

SEQ ID NO: 5784624 - DNA, 15 bp, Homo sapiens
taaatattcatatta

SEQ ID NO: 5784625 - DNA, 23 bp, Homo sapiens
taaatattctacacatgtaaaat

SEQ ID NO: 5784626 - DNA, 14 bp, Homo sapiens
taaatattctgaat

SEQ ID NO: 5784627 - DNA, 17 bp, Homo sapiens
taaatattcttgtccac

SEQ ID NO: 5784628 - DNA, 13 bp, Homo sapiens
taaatattgactt

SEQ ID NO: 5784629 - DNA, 18 bp, Homo sapiens
taaatattgaggctttgt

SEQ ID NO: 5784630 - DNA, 15 bp, Homo sapiens
taaatattgctaaaa

SEQ ID NO: 5784631 - DNA, 17 bp, Homo sapiens
taaatattgcttcaatt

SEQ ID NO: 5784632 - DNA, 20 bp, Homo sapiens
taaatattgcttcaatttca

SEQ ID NO: 5784633 - DNA, 15 bp, Homo sapiens
taaatattgtaatat

SEQ ID NO: 5784634 - DNA, 16 bp, Homo sapiens
taaatattgtaatatg

SEQ ID NO: 5784635 - DNA, 14 bp, Homo sapiens
taaatattgtattt

SEQ ID NO: 5784636 - DNA, 17 bp, Homo sapiens
taaatattgtattttag

SEQ ID NO: 5784637 - DNA, 20 bp, Homo sapiens
taaatattgtattttagata

SEQ ID NO: 5784638 - DNA, 21 bp, Homo sapiens
taaatattgtcctgtttcttc

SEQ ID NO: 5784639 - DNA, 13 bp, Homo sapiens
taaatattgtctt

SEQ ID NO: 5784640 - DNA, 16 bp, Homo sapiens
taaatattgtcttttt

SEQ ID NO: 5784641 - DNA, 20 bp, Homo sapiens
taaatattgtctttttgtat

SEQ ID NO: 5784642 - DNA, 19 bp, Homo sapiens
taaatattgttttgcattg

SEQ ID NO: 5784643 - DNA, 22 bp, Homo sapiens
taaatattgttttgcattgtct

SEQ ID NO: 5784644 - DNA, 21 bp, Homo sapiens
taaatatttacatatgaaatt

SEQ ID NO: 5784645 - DNA, 19 bp, Homo sapiens
taaatatttaccttgaaaa

SEQ ID NO: 5784646 - DNA, 19 bp, Homo sapiens
taaatatttactctttgca

SEQ ID NO: 5784647 - DNA, 13 bp, Homo sapiens
taaatatttatgc

SEQ ID NO: 5784648 - DNA, 15 bp, Homo sapiens
taaatatttatgcag

SEQ ID NO: 5784649 - DNA, 21 bp, Homo sapiens
taaatatttatgcagaaggta

SEQ ID NO: 5784650 - DNA, 12 bp, Homo sapiens
taaatatttcaa

SEQ ID NO: 5784651 - DNA, 22 bp, Homo sapiens
taaatatttcatgattcacaac

SEQ ID NO: 5784652 - DNA, 14 bp, Homo sapiens
taaatatttcctta

SEQ ID NO: 5784653 - DNA, 15 bp, Homo sapiens
taaatatttccttaa

SEQ ID NO: 5784654 - DNA, 21 bp, Homo sapiens
taaatatttgaaaattacctt

SEQ ID NO: 5784655 - DNA, 14 bp, Homo sapiens
taaatatttgagac

SEQ ID NO: 5784656 - DNA, 19 bp, Homo sapiens
taaatatttggtctctatt

SEQ ID NO: 5784657 - DNA, 20 bp, Homo sapiens
taaatatttgttacttttag

SEQ ID NO: 5784658 - DNA, 10 bp, Homo sapiens
taaatatttt

SEQ ID NO: 5784659 - DNA, 17 bp, Homo sapiens
taaatattttaaagaat

SEQ ID NO: 5784660 - DNA, 15 bp, Homo sapiens
taaatattttcaaga

SEQ ID NO: 5784661 - DNA, 13 bp, Homo sapiens
taaatattttcca

SEQ ID NO: 5784662 - DNA, 13 bp, Homo sapiens
taaatattttcta

SEQ ID NO: 5784663 - DNA, 16 bp, Homo sapiens
taaatattttctattt

SEQ ID NO: 5784664 - DNA, 15 bp, Homo sapiens
taaatattttgactt

SEQ ID NO: 5784665 - DNA, 19 bp, Homo sapiens
taaatattttgacttgttg

SEQ ID NO: 5784666 - DNA, 13 bp, Homo sapiens
taaatattttgat

SEQ ID NO: 5784667 - DNA, 18 bp, Homo sapiens
taaatattttgctaactg

SEQ ID NO: 5784668 - DNA, 21 bp, Homo sapiens
taaatattttgctaactggtt

SEQ ID NO: 5784669 - DNA, 17 bp, Homo sapiens
taaatatttttccctcc

SEQ ID NO: 5784670 - DNA, 18 bp, Homo sapiens
taaatatttttccctccg

SEQ ID NO: 5784671 - DNA, 11 bp, Homo sapiens
taaatcaaaaa

SEQ ID NO: 5784672 - DNA, 14 bp, Homo sapiens
taaatcaaaaactt

SEQ ID NO: 5784673 - DNA, 22 bp, Homo sapiens
taaatcaaaaacttttcatttc

SEQ ID NO: 5784674 - DNA, 16 bp, Homo sapiens
taaatcaactccagct

SEQ ID NO: 5784675 - DNA, 20 bp, Homo sapiens
taaatcaagtcccaaattca

SEQ ID NO: 5784676 - DNA, 19 bp, Homo sapiens
taaatcaagttggcttcta

SEQ ID NO: 5784677 - DNA, 22 bp, Homo sapiens
taaatcaattctgatacagcct

SEQ ID NO: 5784678 - DNA, 15 bp, Homo sapiens
taaatcacacatgct

SEQ ID NO: 5784679 - DNA, 17 bp, Homo sapiens
taaatcacacattcagt

SEQ ID NO: 5784680 - DNA, 14 bp, Homo sapiens
taaatcacagaaaa

SEQ ID NO: 5784681 - DNA, 19 bp, Homo sapiens
taaatcacagaaaatttaa

SEQ ID NO: 5784682 - DNA, 20 bp, Homo sapiens
taaatcaccatagggctggg

SEQ ID NO: 5784683 - DNA, 16 bp, Homo sapiens
taaatcacgctttttg

SEQ ID NO: 5784684 - DNA, 17 bp, Homo sapiens
taaatcacttgtaaata

SEQ ID NO: 5784685 - DNA, 22 bp, Homo sapiens
taaatcacttgtaaataaatag

SEQ ID NO: 5784686 - DNA, 15 bp, Homo sapiens
taaatcactttaatt

SEQ ID NO: 5784687 - DNA, 21 bp, Homo sapiens
taaatcactttaatttagaag

SEQ ID NO: 5784688 - DNA, 12 bp, Homo sapiens
taaatcagaaag

SEQ ID NO: 5784689 - DNA, 22 bp, Homo sapiens
taaatcagaaagtaacaatcta

SEQ ID NO: 5784690 - DNA, 13 bp, Homo sapiens
taaatcagaataa

SEQ ID NO: 5784691 - DNA, 16 bp, Homo sapiens
taaatcagaataaatt

SEQ ID NO: 5784692 - DNA, 15 bp, Homo sapiens
taaatcagaatcttt

SEQ ID NO: 5784693 - DNA, 20 bp, Homo sapiens
taaatcaggcccaatatcag

SEQ ID NO: 5784694 - DNA, 18 bp, Homo sapiens
taaatcagtaagaggtgt

SEQ ID NO: 5784695 - DNA, 16 bp, Homo sapiens
taaatcagttggagtt

SEQ ID NO: 5784696 - DNA, 14 bp, Homo sapiens
taaatcagttttgt

SEQ ID NO: 5784697 - DNA, 20 bp, Homo sapiens
taaatcatatataataaatt

SEQ ID NO: 5784698 - DNA, 12 bp, Homo sapiens
taaatcatattc

SEQ ID NO: 5784699 - DNA, 15 bp, Homo sapiens
taaatcatattctca

SEQ ID NO: 5784700 - DNA, 20 bp, Homo sapiens
taaatcatattgatgaaaag

SEQ ID NO: 5784701 - DNA, 14 bp, Homo sapiens
taaatcatcctcat

SEQ ID NO: 5784702 - DNA, 23 bp, Homo sapiens
taaatcatgtatgttatgatatt

SEQ ID NO: 5784703 - DNA, 21 bp, Homo sapiens
taaatcatgttaatcctagct

SEQ ID NO: 5784704 - DNA, 22 bp, Homo sapiens
taaatcatgttaatcctagctg

SEQ ID NO: 5784705 - DNA, 15 bp, Homo sapiens
taaatcatgttttga

SEQ ID NO: 5784706 - DNA, 21 bp, Homo sapiens
taaatcattagagcttaaatt

SEQ ID NO: 5784707 - DNA, 14 bp, Homo sapiens
taaatcattcattc

SEQ ID NO: 5784708 - DNA, 12 bp, Homo sapiens
taaatcatttca

SEQ ID NO: 5784709 - DNA, 16 bp, Homo sapiens
taaatcattttcatta

SEQ ID NO: 5784710 - DNA, 17 bp, Homo sapiens
taaatccaacacaagtt

SEQ ID NO: 5784711 - DNA, 23 bp, Homo sapiens
taaatccaatagtctgccacaag

SEQ ID NO: 5784712 - DNA, 11 bp, Homo sapiens
taaatccacag

SEQ ID NO: 5784713 - DNA, 22 bp, Homo sapiens
taaatccacagccaacaaacat

SEQ ID NO: 5784714 - DNA, 15 bp, Homo sapiens
taaatccacagtgag

SEQ ID NO: 5784715 - DNA, 19 bp, Homo sapiens
taaatccacccatgttatc

SEQ ID NO: 5784716 - DNA, 14 bp, Homo sapiens
taaatccagttcta

SEQ ID NO: 5784717 - DNA, 16 bp, Homo sapiens
taaatccatttggaaa

SEQ ID NO: 5784718 - DNA, 17 bp, Homo sapiens
taaatcccattattcaa

SEQ ID NO: 5784719 - DNA, 23 bp, Homo sapiens
taaatcccattattcaaagttgc

SEQ ID NO: 5784720 - DNA, 13 bp, Homo sapiens
taaatcccctcac

SEQ ID NO: 5784721 - DNA, 17 bp, Homo sapiens
taaatccgcttctcctg

SEQ ID NO: 5784722 - DNA, 14 bp, Homo sapiens
taaatcctaccaaa

SEQ ID NO: 5784723 - DNA, 16 bp, Homo sapiens
taaatcctgaagagca

SEQ ID NO: 5784724 - DNA, 18 bp, Homo sapiens
taaatcctgaagagcatt

SEQ ID NO: 5784725 - DNA, 17 bp, Homo sapiens
taaatcctgagctcaaa

SEQ ID NO: 5784726 - DNA, 12 bp, Homo sapiens
taaatcctgtgt

SEQ ID NO: 5784727 - DNA, 22 bp, Homo sapiens
taaatcctgtgtttcattactt

SEQ ID NO: 5784728 - DNA, 18 bp, Homo sapiens
taaatcctgttgaaaagc

SEQ ID NO: 5784729 - DNA, 20 bp, Homo sapiens
taaatccttaacatttctct

SEQ ID NO: 5784730 - DNA, 19 bp, Homo sapiens
taaatccttttgttttgaa

SEQ ID NO: 5784731 - DNA, 19 bp, Homo sapiens
taaatcctttttctttata

SEQ ID NO: 5784732 - DNA, 19 bp, Homo sapiens
taaatcgaggcagaaagat

SEQ ID NO: 5784733 - DNA, 15 bp, Homo sapiens
taaatcgatccatgt

SEQ ID NO: 5784734 - DNA, 18 bp, Homo sapiens
taaatctaaacaaaaaat

SEQ ID NO: 5784735 - DNA, 15 bp, Homo sapiens
taaatctaaatataa

SEQ ID NO: 5784736 - DNA, 19 bp, Homo sapiens
taaatctaaatctatttat

SEQ ID NO: 5784737 - DNA, 20 bp, Homo sapiens
taaatctaaatgattatctt

SEQ ID NO: 5784738 - DNA, 16 bp, Homo sapiens
taaatctaaattaact

SEQ ID NO: 5784739 - DNA, 17 bp, Homo sapiens
taaatctaaattaactt

SEQ ID NO: 5784740 - DNA, 21 bp, Homo sapiens
taaatctaaattaacttctat

SEQ ID NO: 5784741 - DNA, 17 bp, Homo sapiens
taaatctagagtttata

SEQ ID NO: 5784742 - DNA, 21 bp, Homo sapiens
taaatctagagtttatacagt

SEQ ID NO: 5784743 - DNA, 14 bp, Homo sapiens
taaattattacata

SEQ ID NO: 5784744 - DNA, 13 bp, Homo sapiens
taaattattactt

SEQ ID NO: 5784745 - DNA, 15 bp, Homo sapiens
taaattattacttta

SEQ ID NO: 5784746 - DNA, 17 bp, Homo sapiens
taaattattagagattt

SEQ ID NO: 5784747 - DNA, 20 bp, Homo sapiens
taaattattagcatttgttt

SEQ ID NO: 5784748 - DNA, 19 bp, Homo sapiens
taaattattagtttacatc

SEQ ID NO: 5784749 - DNA, 20 bp, Homo sapiens
taaattattatgacaccttt

SEQ ID NO: 5784750 - DNA, 15 bp, Homo sapiens
taaattattatttag

SEQ ID NO: 5784751 - DNA, 22 bp, Homo sapiens
taaattattcagttaagaaaaa

SEQ ID NO: 5784752 - DNA, 15 bp, Homo sapiens
taaattattgatgat

SEQ ID NO: 5784753 - DNA, 18 bp, Homo sapiens
taaattattgtaaacttt

SEQ ID NO: 5784754 - DNA, 18 bp, Homo sapiens
taaattattgtttttctt

SEQ ID NO: 5784755 - DNA, 17 bp, Homo sapiens
taaattatttccttttt

SEQ ID NO: 5784756 - DNA, 23 bp, Homo sapiens
taaattatttgattatttaagac

SEQ ID NO: 5784757 - DNA, 15 bp, Homo sapiens
taaattatttgctaa

SEQ ID NO: 5784758 - DNA, 18 bp, Homo sapiens
taaattattttatgtcat

SEQ ID NO: 5784759 - DNA, 18 bp, Homo sapiens
taaattattttttctatg

SEQ ID NO: 5784760 - DNA, 15 bp, Homo sapiens
taaattcaaagaagt

SEQ ID NO: 5784761 - DNA, 18 bp, Homo sapiens
taaattcaacacttattt

SEQ ID NO: 5784762 - DNA, 22 bp, Homo sapiens
taaattcaacacttattttctg

SEQ ID NO: 5784763 - DNA, 19 bp, Homo sapiens
taaattcaactttgtaaaa

SEQ ID NO: 5784764 - DNA, 12 bp, Homo sapiens
taaattcaatgc

SEQ ID NO: 5784765 - DNA, 17 bp, Homo sapiens
taaattcacaatagaaa

SEQ ID NO: 5784766 - DNA, 16 bp, Homo sapiens
taaattcactttcatt

SEQ ID NO: 5784767 - DNA, 13 bp, Homo sapiens
taaattcagacaa

SEQ ID NO: 5784768 - DNA, 16 bp, Homo sapiens
taaattcagacaacat

SEQ ID NO: 5784769 - DNA, 20 bp, Homo sapiens
taaattcagacaacattatg

SEQ ID NO: 5784770 - DNA, 15 bp, Homo sapiens
taaattcagatcaaa

SEQ ID NO: 5784771 - DNA, 16 bp, Homo sapiens
taaattcagatcaaaa

SEQ ID NO: 5784772 - DNA, 18 bp, Homo sapiens
taaattcagtcctaagaa

SEQ ID NO: 5784773 - DNA, 17 bp, Homo sapiens
taaattcatcagaatcc

SEQ ID NO: 5784774 - DNA, 20 bp, Homo sapiens
taaattcattttaattttgt

SEQ ID NO: 5784775 - DNA, 14 bp, Homo sapiens
taaattccaaagat

SEQ ID NO: 5784776 - DNA, 15 bp, Homo sapiens
taaattccaaagatc

SEQ ID NO: 5784777 - DNA, 21 bp, Homo sapiens
taaattccaaagatctgaatg

SEQ ID NO: 5784778 - DNA, 21 bp, Homo sapiens
taaattccaatacaagttaca

SEQ ID NO: 5784779 - DNA, 16 bp, Homo sapiens
taaattccactgaaaa

SEQ ID NO: 5784780 - DNA, 18 bp, Homo sapiens
taaattccatatgctcca

SEQ ID NO: 5784781 - DNA, 21 bp, Homo sapiens
taaattccatatgctccagga

SEQ ID NO: 5784782 - DNA, 21 bp, Homo sapiens
taaattcccaaatcctagact

SEQ ID NO: 5784783 - DNA, 18 bp, Homo sapiens
taaattcccaacttctct

SEQ ID NO: 5784784 - DNA, 19 bp, Homo sapiens
taaattcccgttttgtcac

SEQ ID NO: 5784785 - DNA, 14 bp, Homo sapiens
taaattcctaattc

SEQ ID NO: 5784786 - DNA, 15 bp, Homo sapiens
taaattcctaattct

SEQ ID NO: 5784787 - DNA, 22 bp, Homo sapiens
taaattcctactccctcttcca

SEQ ID NO: 5784788 - DNA, 19 bp, Homo sapiens
taaattcctcaacagtgtt

SEQ ID NO: 5784789 - DNA, 14 bp, Homo sapiens
taaattcctctttg

SEQ ID NO: 5784790 - DNA, 18 bp, Homo sapiens
taaattcctctttgcttt

SEQ ID NO: 5784791 - DNA, 12 bp, Homo sapiens
taaattctaaat

SEQ ID NO: 5784792 - DNA, 15 bp, Homo sapiens
taaattctataaaaa

SEQ ID NO: 5784793 - DNA, 16 bp, Homo sapiens
taaattctatgttaaa

SEQ ID NO: 5784794 - DNA, 22 bp, Homo sapiens
taaattctatgttaaatactgt

SEQ ID NO: 5784795 - DNA, 23 bp, Homo sapiens
taaattctatgttaaatactgtg

SEQ ID NO: 5784796 - DNA, 16 bp, Homo sapiens
taaattctcaaagttt

SEQ ID NO: 5784797 - DNA, 13 bp, Homo sapiens
taaattctccaac

SEQ ID NO: 5784798 - DNA, 14 bp, Homo sapiens
taaattctctctaa

SEQ ID NO: 5784799 - DNA, 17 bp, Homo sapiens
taaattctctctaacat

SEQ ID NO: 5784800 - DNA, 15 bp, Homo sapiens
taaattctgagacat

SEQ ID NO: 5784801 - DNA, 22 bp, Homo sapiens
taaattctgagacatgtgtcaa

SEQ ID NO: 5784802 - DNA, 14 bp, Homo sapiens
taaattctgattct

SEQ ID NO: 5784803 - DNA, 15 bp, Homo sapiens
taaattctgattctt

SEQ ID NO: 5784804 - DNA, 14 bp, Homo sapiens
taaattctgatttc

SEQ ID NO: 5784805 - DNA, 16 bp, Homo sapiens
taaattctgctcctga

SEQ ID NO: 5784806 - DNA, 12 bp, Homo sapiens
taaattctggaa

SEQ ID NO: 5784807 - DNA, 16 bp, Homo sapiens
taaattctggaaatgt

SEQ ID NO: 5784808 - DNA, 18 bp, Homo sapiens
taaattctggaaatgtct

SEQ ID NO: 5784809 - DNA, 15 bp, Homo sapiens
taaattctgggtgaa

SEQ ID NO: 5784810 - DNA, 19 bp, Homo sapiens
taaattctggtatacattg

SEQ ID NO: 5784811 - DNA, 22 bp, Homo sapiens
taaattctgttagctgctcact

SEQ ID NO: 5784812 - DNA, 15 bp, Homo sapiens
taaattcttaaaact

SEQ ID NO: 5784813 - DNA, 20 bp, Homo sapiens
taaattcttaatgttcacat

SEQ ID NO: 5784814 - DNA, 17 bp, Homo sapiens
taaattcttgcaaagta

SEQ ID NO: 5784815 - DNA, 21 bp, Homo sapiens
taaattctttatttctgtcat

SEQ ID NO: 5784816 - DNA, 13 bp, Homo sapiens
taaattctttcct

SEQ ID NO: 5784817 - DNA, 18 bp, Homo sapiens
taaattcttttttaaatt

SEQ ID NO: 5784818 - DNA, 20 bp, Homo sapiens
taaattgaaatataatgcaa

SEQ ID NO: 5784819 - DNA, 21 bp, Homo sapiens
taaattgaaatgggaacaata

SEQ ID NO: 5784820 - DNA, 16 bp, Homo sapiens
taaattgaataatggt

SEQ ID NO: 5784821 - DNA, 16 bp, Homo sapiens
taaattgaatacacaa

SEQ ID NO: 5784822 - DNA, 21 bp, Homo sapiens
taaattgaataggtagtatca

SEQ ID NO: 5784823 - DNA, 21 bp, Homo sapiens
taaattgataacatggaaatg

SEQ ID NO: 5784824 - DNA, 16 bp, Homo sapiens
taaattgatgttgctg

SEQ ID NO: 5784825 - DNA, 17 bp, Homo sapiens
taaattgcaacatatta

SEQ ID NO: 5784826 - DNA, 13 bp, Homo sapiens
taaattgcacaga

SEQ ID NO: 5784827 - DNA, 15 bp, Homo sapiens
taaattgcacagagc

SEQ ID NO: 5784828 - DNA, 21 bp, Homo sapiens
taaattgcaccagaaatgttt

SEQ ID NO: 5784829 - DNA, 18 bp, Homo sapiens
taaattgcagtttacagt

SEQ ID NO: 5784830 - DNA, 22 bp, Homo sapiens
taaattgcagtttacagtattt

SEQ ID NO: 5784831 - DNA, 17 bp, Homo sapiens
taaattgcataaagcat

SEQ ID NO: 5784832 - DNA, 18 bp, Homo sapiens
taaattgcataaagcata

SEQ ID NO: 5784833 - DNA, 12 bp, Homo sapiens
taaattgcatca

SEQ ID NO: 5784834 - DNA, 18 bp, Homo sapiens
taaattgcatcactgtat

SEQ ID NO: 5784835 - DNA, 15 bp, Homo sapiens
taaattgcatgctgc

SEQ ID NO: 5784836 - DNA, 18 bp, Homo sapiens
taaattgcatgctgcttt

SEQ ID NO: 5784837 - DNA, 14 bp, Homo sapiens
taaattgcatttct

SEQ ID NO: 5784838 - DNA, 19 bp, Homo sapiens
taaattgccataatatgat

SEQ ID NO: 5784839 - DNA, 18 bp, Homo sapiens
taaattgcctcccttcct

SEQ ID NO: 5784840 - DNA, 19 bp, Homo sapiens
taaattgcctcccttcctc

SEQ ID NO: 5784841 - DNA, 19 bp, Homo sapiens
taaattgcctgatttgttt

SEQ ID NO: 5784842 - DNA, 13 bp, Homo sapiens
taaattgccttct

SEQ ID NO: 5784843 - DNA, 22 bp, Homo sapiens
taaattgcctttgtaatatgag

SEQ ID NO: 5784844 - DNA, 16 bp, Homo sapiens
taaattgctaatgttg

SEQ ID NO: 5784845 - DNA, 19 bp, Homo sapiens
taaattgctcacagttatt

SEQ ID NO: 5784846 - DNA, 15 bp, Homo sapiens
taaattgctccttga

SEQ ID NO: 5784847 - DNA, 13 bp, Homo sapiens
taaattgctctgt

SEQ ID NO: 5784848 - DNA, 22 bp, Homo sapiens
taaattgctttctatatcttct

SEQ ID NO: 5784849 - DNA, 13 bp, Homo sapiens
taaattggaaagc

SEQ ID NO: 5784850 - DNA, 16 bp, Homo sapiens
taaattggaattttct

SEQ ID NO: 5784851 - DNA, 18 bp, Homo sapiens
taaattggattattttct

SEQ ID NO: 5784852 - DNA, 17 bp, Homo sapiens
taaattggcatggaaat

SEQ ID NO: 5784853 - DNA, 20 bp, Homo sapiens
taaattggcatggaaattta

SEQ ID NO: 5784854 - DNA, 13 bp, Homo sapiens
taaattggctcct

SEQ ID NO: 5784855 - DNA, 20 bp, Homo sapiens
taaattggctcctttcccac

SEQ ID NO: 5784856 - DNA, 23 bp, Homo sapiens
taaattggggtttatttcagcaa

SEQ ID NO: 5784857 - DNA, 17 bp, Homo sapiens
taaattggtgataagtg

SEQ ID NO: 5784858 - DNA, 22 bp, Homo sapiens
taaattggtgataagtggaaaa

SEQ ID NO: 5784859 - DNA, 23 bp, Homo sapiens
taaattggtgataagtggaaaaa

SEQ ID NO: 5784860 - DNA, 13 bp, Homo sapiens
taaattgtaaaac

SEQ ID NO: 5784861 - DNA, 14 bp, Homo sapiens
taaattgtaatttg

SEQ ID NO: 5784862 - DNA, 15 bp, Homo sapiens
taaattgtacatttt

SEQ ID NO: 5784863 - DNA, 19 bp, Homo sapiens
taaattgtacattttgtaa

SEQ ID NO: 5784864 - DNA, 21 bp, Homo sapiens
taaattgtattctcataatac

SEQ ID NO: 5784865 - DNA, 21 bp, Homo sapiens
taaattgtcagatcgttcatt

SEQ ID NO: 5784866 - DNA, 12 bp, Homo sapiens
taaattgtcatt

SEQ ID NO: 5784867 - DNA, 13 bp, Homo sapiens
taaattgtggatg

SEQ ID NO: 5784868 - DNA, 19 bp, Homo sapiens
taaattgttataacttcat

SEQ ID NO: 5784869 - DNA, 16 bp, Homo sapiens
taaattgttcctcttt

SEQ ID NO: 5784870 - DNA, 19 bp, Homo sapiens
taaattgttcctctttgtt

SEQ ID NO: 5784871 - DNA, 15 bp, Homo sapiens
taaattgttgtttca

SEQ ID NO: 5784872 - DNA, 12 bp, Homo sapiens
taaattgtttga

SEQ ID NO: 5784873 - DNA, 23 bp, Homo sapiens
taaattgtttggcttcctcctga

SEQ ID NO: 5784874 - DNA, 15 bp, Homo sapiens
taaatttaaaaatca

SEQ ID NO: 5784875 - DNA, 14 bp, Homo sapiens
taaatttaaagata

SEQ ID NO: 5784876 - DNA, 16 bp, Homo sapiens
taaatttaaagatatt

SEQ ID NO: 5784877 - DNA, 21 bp, Homo sapiens
taaatttaaagatattgttca

SEQ ID NO: 5784878 - DNA, 22 bp, Homo sapiens
taaatttaaagatattgttcaa

SEQ ID NO: 5784879 - DNA, 12 bp, Homo sapiens
taaatttaaatg

SEQ ID NO: 5784880 - DNA, 16 bp, Homo sapiens
taaatttaactgcata

SEQ ID NO: 5784881 - DNA, 18 bp, Homo sapiens
taaatttaactgcatata

SEQ ID NO: 5784882 - DNA, 15 bp, Homo sapiens
taaatttaactttaa

SEQ ID NO: 5784883 - DNA, 22 bp, Homo sapiens
taaatttaagtaagttttataa

SEQ ID NO: 5784884 - DNA, 17 bp, Homo sapiens
taaatttaataccagat

SEQ ID NO: 5784885 - DNA, 14 bp, Homo sapiens
taaatttaatcctt

SEQ ID NO: 5784886 - DNA, 22 bp, Homo sapiens
taaatttaatccttctttgtaa

SEQ ID NO: 5784887 - DNA, 16 bp, Homo sapiens
taaatttaatgctgcc

SEQ ID NO: 5784888 - DNA, 15 bp, Homo sapiens
taaatttaattcttc

SEQ ID NO: 5784889 - DNA, 23 bp, Homo sapiens
taaatttacagaatattatataa

SEQ ID NO: 5784890 - DNA, 13 bp, Homo sapiens
taaatttacgtat

SEQ ID NO: 5784891 - DNA, 14 bp, Homo sapiens
taaatttagtattt

SEQ ID NO: 5784892 - DNA, 18 bp, Homo sapiens
taaatttatatacttttt

SEQ ID NO: 5784893 - DNA, 15 bp, Homo sapiens
taaatttatattcat

SEQ ID NO: 5784894 - DNA, 23 bp, Homo sapiens
taaatttatattcataaagttac

SEQ ID NO: 5784895 - DNA, 19 bp, Homo sapiens
taaatttatcacattgaat

SEQ ID NO: 5784896 - DNA, 12 bp, Homo sapiens
taaatttattaa

SEQ ID NO: 5784897 - DNA, 17 bp, Homo sapiens
taaatttattaaatgtt

SEQ ID NO: 5784898 - DNA, 18 bp, Homo sapiens
taaatttattaaatgttg

SEQ ID NO: 5784899 - DNA, 14 bp, Homo sapiens
taaatttatttact

SEQ ID NO: 5784900 - DNA, 18 bp, Homo sapiens
taaatttatttactgcta

SEQ ID NO: 5784901 - DNA, 17 bp, Homo sapiens
taaatttatttgaaaat

SEQ ID NO: 5784902 - DNA, 15 bp, Homo sapiens
taaatttattttctt

SEQ ID NO: 5784903 - DNA, 12 bp, Homo sapiens
taaatttcaaat

SEQ ID NO: 5784904 - DNA, 13 bp, Homo sapiens
taaatttcagaat

SEQ ID NO: 5784905 - DNA, 18 bp, Homo sapiens
taaatttccccaacagtg

SEQ ID NO: 5784906 - DNA, 21 bp, Homo sapiens
taaatttccccaacagtgtga

SEQ ID NO: 5784907 - DNA, 20 bp, Homo sapiens
taaatttctatttttatctg

SEQ ID NO: 5784908 - DNA, 18 bp, Homo sapiens
taaatttcttatgtgaca

SEQ ID NO: 5784909 - DNA, 15 bp, Homo sapiens
taaatttcttctggt

SEQ ID NO: 5784910 - DNA, 17 bp, Homo sapiens
taaatttcttggcaaat

SEQ ID NO: 5784911 - DNA, 16 bp, Homo sapiens
taaatttcttttatta

SEQ ID NO: 5784912 - DNA, 23 bp, Homo sapiens
taaatttcttttattaatacttt

SEQ ID NO: 5784913 - DNA, 13 bp, Homo sapiens
taaatttgaatct

SEQ ID NO: 5784914 - DNA, 22 bp, Homo sapiens
taaatttgaatgttaagcagat

SEQ ID NO: 5784915 - DNA, 18 bp, Homo sapiens
taaatttgacttttctgt

SEQ ID NO: 5784916 - DNA, 19 bp, Homo sapiens
taaatttgacttttctgta

SEQ ID NO: 5784917 - DNA, 20 bp, Homo sapiens
taaatttgatttacatatat

SEQ ID NO: 5784918 - DNA, 14 bp, Homo sapiens
taaatttggaactt

SEQ ID NO: 5784919 - DNA, 13 bp, Homo sapiens
taaatttggattt

SEQ ID NO: 5784920 - DNA, 18 bp, Homo sapiens
taaatttggccatgaaag

SEQ ID NO: 5784921 - DNA, 20 bp, Homo sapiens
taacaattgtgtagcctttt

SEQ ID NO: 5784922 - DNA, 15 bp, Homo sapiens
taacaatttccttta

SEQ ID NO: 5784923 - DNA, 16 bp, Homo sapiens
taacacaagccacaga

SEQ ID NO: 5784924 - DNA, 15 bp, Homo sapiens
taacacacacagaaa

SEQ ID NO: 5784925 - DNA, 20 bp, Homo sapiens
taacacacacagaaaagcat

SEQ ID NO: 5784926 - DNA, 21 bp, Homo sapiens
taacacacacagaaaagcata

SEQ ID NO: 5784927 - DNA, 12 bp, Homo sapiens
taacacacagct

SEQ ID NO: 5784928 - DNA, 14 bp, Homo sapiens
taacacacagctcc

SEQ ID NO: 5784929 - DNA, 20 bp, Homo sapiens
taacacacataaaggataaa

SEQ ID NO: 5784930 - DNA, 14 bp, Homo sapiens
taacacactgaacc

SEQ ID NO: 5784931 - DNA, 13 bp, Homo sapiens
taacacactggcc

SEQ ID NO: 5784932 - DNA, 15 bp, Homo sapiens
taacacactggccat

SEQ ID NO: 5784933 - DNA, 18 bp, Homo sapiens
taacacactttttattag

SEQ ID NO: 5784934 - DNA, 12 bp, Homo sapiens
taacacagagag

SEQ ID NO: 5784935 - DNA, 17 bp, Homo sapiens
taacacagattattcat

SEQ ID NO: 5784936 - DNA, 20 bp, Homo sapiens
taacacagccttccttctgc

SEQ ID NO: 5784937 - DNA, 23 bp, Homo sapiens
taacacaggataaagttattctt

SEQ ID NO: 5784938 - DNA, 14 bp, Homo sapiens
taacacagtattat

SEQ ID NO: 5784939 - DNA, 15 bp, Homo sapiens
taacacagtattatg

SEQ ID NO: 5784940 - DNA, 21 bp, Homo sapiens
taacacagtgccttcaataaa

SEQ ID NO: 5784941 - DNA, 17 bp, Homo sapiens
taacacagtgtttcaat

SEQ ID NO: 5784942 - DNA, 13 bp, Homo sapiens
taacacataaaca

SEQ ID NO: 5784943 - DNA, 22 bp, Homo sapiens
taacacattatcgggagcagtg

SEQ ID NO: 5784944 - DNA, 22 bp, Homo sapiens
taacacattctttataaaatgt

SEQ ID NO: 5784945 - DNA, 12 bp, Homo sapiens
taacacattttt

SEQ ID NO: 5784946 - DNA, 15 bp, Homo sapiens
taacacatttttaaa

SEQ ID NO: 5784947 - DNA, 19 bp, Homo sapiens
taacacatttttttgcatg

SEQ ID NO: 5784948 - DNA, 20 bp, Homo sapiens
taacaccaagagtagcacct

SEQ ID NO: 5784949 - DNA, 23 bp, Homo sapiens
taacaccaatcccagggctggct

SEQ ID NO: 5784950 - DNA, 13 bp, Homo sapiens
taacaccagtggg

SEQ ID NO: 5784951 - DNA, 18 bp, Homo sapiens
taacaccatgattaacca

SEQ ID NO: 5784952 - DNA, 15 bp, Homo sapiens
taacacccttccttc

SEQ ID NO: 5784953 - DNA, 23 bp, Homo sapiens
taacacccttccttctgtaaata

SEQ ID NO: 5784954 - DNA, 17 bp, Homo sapiens
taacaccgtcccagggc

SEQ ID NO: 5784955 - DNA, 14 bp, Homo sapiens
taacacctgatgtg

SEQ ID NO: 5784956 - DNA, 17 bp, Homo sapiens
taacacctgatgtgtac

SEQ ID NO: 5784957 - DNA, 14 bp, Homo sapiens
taacaccttggact

SEQ ID NO: 5784958 - DNA, 16 bp, Homo sapiens
taacacgctgcctggt

SEQ ID NO: 5784959 - DNA, 19 bp, Homo sapiens
taacacgctgcctggtctg

SEQ ID NO: 5784960 - DNA, 23 bp, Homo sapiens
taacacgctgcctggtctgtctg

SEQ ID NO: 5784961 - DNA, 13 bp, Homo sapiens
taacactaaattg

SEQ ID NO: 5784962 - DNA, 17 bp, Homo sapiens
taacactaaattgcagt

SEQ ID NO: 5784963 - DNA, 20 bp, Homo sapiens
taacactaatatatttaaaa

SEQ ID NO: 5784964 - DNA, 22 bp, Homo sapiens
taacactaatatatttaaaaat

SEQ ID NO: 5784965 - DNA, 14 bp, Homo sapiens
taacactacttaaa

SEQ ID NO: 5784966 - DNA, 16 bp, Homo sapiens
taacactagaaaacat

SEQ ID NO: 5784967 - DNA, 22 bp, Homo sapiens
taacactagtagctgttttgaa

SEQ ID NO: 5784968 - DNA, 19 bp, Homo sapiens
taacactatgtttatttac

SEQ ID NO: 5784969 - DNA, 16 bp, Homo sapiens
taacactattacagta

SEQ ID NO: 5784970 - DNA, 22 bp, Homo sapiens
taacactcaagactatgttctc

SEQ ID NO: 5784971 - DNA, 14 bp, Homo sapiens
taacactcctctgc

SEQ ID NO: 5784972 - DNA, 15 bp, Homo sapiens
taacactgagtgaaa

SEQ ID NO: 5784973 - DNA, 21 bp, Homo sapiens
taacactgagtgaaatattac

SEQ ID NO: 5784974 - DNA, 13 bp, Homo sapiens
taacactgtaata

SEQ ID NO: 5784975 - DNA, 17 bp, Homo sapiens
taacactgtaatatctt

SEQ ID NO: 5784976 - DNA, 18 bp, Homo sapiens
taacactgtaatatcttt

SEQ ID NO: 5784977 - DNA, 14 bp, Homo sapiens
taacactgtatttt

SEQ ID NO: 5784978 - DNA, 15 bp, Homo sapiens
taacactgtgaagag

SEQ ID NO: 5784979 - DNA, 15 bp, Homo sapiens
taacactgttaagag

SEQ ID NO: 5784980 - DNA, 16 bp, Homo sapiens
taacacttaaatttct

SEQ ID NO: 5784981 - DNA, 17 bp, Homo sapiens
taacacttcaccttctg

SEQ ID NO: 5784982 - DNA, 14 bp, Homo sapiens
taacacttgaaaag

SEQ ID NO: 5784983 - DNA, 17 bp, Homo sapiens
taacacttgaaaagtgt

SEQ ID NO: 5784984 - DNA, 18 bp, Homo sapiens
taacacttgaaaagtgtg

SEQ ID NO: 5784985 - DNA, 21 bp, Homo sapiens
taacactttagttatattcac

SEQ ID NO: 5784986 - DNA, 21 bp, Homo sapiens
taacactttccagcctatagc

SEQ ID NO: 5784987 - DNA, 18 bp, Homo sapiens
taacactttgtattactt

SEQ ID NO: 5784988 - DNA, 16 bp, Homo sapiens
taacagaaactttcaa

SEQ ID NO: 5784989 - DNA, 23 bp, Homo sapiens
taacagaaagggcaacaataaaa

SEQ ID NO: 5784990 - DNA, 17 bp, Homo sapiens
taacagaaatacatcat

SEQ ID NO: 5784991 - DNA, 19 bp, Homo sapiens
taacagaaatacatcatat

SEQ ID NO: 5784992 - DNA, 11 bp, Homo sapiens
taacagaaatg

SEQ ID NO: 5784993 - DNA, 12 bp, Homo sapiens
taacagaaatgt

SEQ ID NO: 5784994 - DNA, 14 bp, Homo sapiens
taacagaaatgtac

SEQ ID NO: 5784995 - DNA, 15 bp, Homo sapiens
taacagaaatgtaca

SEQ ID NO: 5784996 - DNA, 12 bp, Homo sapiens
taacagaacagc

SEQ ID NO: 5784997 - DNA, 17 bp, Homo sapiens
taacagaacagcttcag

SEQ ID NO: 5784998 - DNA, 16 bp, Homo sapiens
taacagacactgtaaa

SEQ ID NO: 5784999 - DNA, 19 bp, Homo sapiens
taacagagaatggtggtat

SEQ ID NO: 5785000 - DNA, 17 bp, Homo sapiens
taacagagagaatgaga

SEQ ID NO: 5785001 - DNA, 18 bp, Homo sapiens
taacagagctaagaaata

SEQ ID NO: 5785002 - DNA, 22 bp, Homo sapiens
taacagagtagttttggttttt

SEQ ID NO: 5785003 - DNA, 23 bp, Homo sapiens
taacagagtgatttgtaaaacag

SEQ ID NO: 5785004 - DNA, 22 bp, Homo sapiens
taacagataaagaaactgaggc

SEQ ID NO: 5785005 - DNA, 17 bp, Homo sapiens
taacagatacagctcgg

SEQ ID NO: 5785006 - DNA, 14 bp, Homo sapiens
taacagatatttaa

SEQ ID NO: 5785007 - DNA, 15 bp, Homo sapiens
taacagatatttaaa

SEQ ID NO: 5785008 - DNA, 18 bp, Homo sapiens
taacagatcctttcaaaa

SEQ ID NO: 5785009 - DNA, 13 bp, Homo sapiens
taacagatgtgaa

SEQ ID NO: 5785010 - DNA, 20 bp, Homo sapiens
taacagattataataaattg

SEQ ID NO: 5785011 - DNA, 13 bp, Homo sapiens
taacagatttgct

SEQ ID NO: 5785012 - DNA, 20 bp, Homo sapiens
taacagcaattttcataata

SEQ ID NO: 5785013 - DNA, 17 bp, Homo sapiens
taacagcagtttcaggt

SEQ ID NO: 5785014 - DNA, 20 bp, Homo sapiens
taacagcatgacaaaaatta

SEQ ID NO: 5785015 - DNA, 15 bp, Homo sapiens
taacagcatgctgct

SEQ ID NO: 5785016 - DNA, 16 bp, Homo sapiens
taacagccaagaagcc

SEQ ID NO: 5785017 - DNA, 20 bp, Homo sapiens
taacagccctcctctgcact

SEQ ID NO: 5785018 - DNA, 15 bp, Homo sapiens
taacagccgctccag

SEQ ID NO: 5785019 - DNA, 16 bp, Homo sapiens
taacagccgctccaga

SEQ ID NO: 5785020 - DNA, 18 bp, Homo sapiens
taacagccgctccagagt

SEQ ID NO: 5785021 - DNA, 15 bp, Homo sapiens
taacagcctctgtga

SEQ ID NO: 5785022 - DNA, 13 bp, Homo sapiens
taacagcctcttg

SEQ ID NO: 5785023 - DNA, 14 bp, Homo sapiens
taacagcctcttgc

SEQ ID NO: 5785024 - DNA, 16 bp, Homo sapiens
taacagcctcttgccc

SEQ ID NO: 5785025 - DNA, 17 bp, Homo sapiens
taacagccttttccttc

SEQ ID NO: 5785026 - DNA, 20 bp, Homo sapiens
taacagcgtgtcaactttca

SEQ ID NO: 5785027 - DNA, 18 bp, Homo sapiens
taacagctaccatgacaa

SEQ ID NO: 5785028 - DNA, 20 bp, Homo sapiens
taacagctccttgggaggaa

SEQ ID NO: 5785029 - DNA, 13 bp, Homo sapiens
taacagctctctt

SEQ ID NO: 5785030 - DNA, 17 bp, Homo sapiens
taacagctgaagtaatg

SEQ ID NO: 5785031 - DNA, 12 bp, Homo sapiens
taacagctgtat

SEQ ID NO: 5785032 - DNA, 15 bp, Homo sapiens
taacagctttcttat

SEQ ID NO: 5785033 - DNA, 19 bp, Homo sapiens
taacagctttcttattcag

SEQ ID NO: 5785034 - DNA, 16 bp, Homo sapiens
taacaggattagacag

SEQ ID NO: 5785035 - DNA, 22 bp, Homo sapiens
taacaggcaaacattttctctt

SEQ ID NO: 5785036 - DNA, 14 bp, Homo sapiens
taacaggcactttg

SEQ ID NO: 5785037 - DNA, 15 bp, Homo sapiens
taacaggcatttgtt

SEQ ID NO: 5785038 - DNA, 18 bp, Homo sapiens
taacaggctgatttggag

SEQ ID NO: 5785039 - DNA, 13 bp, Homo sapiens
taacaggctgtag

SEQ ID NO: 5785040 - DNA, 21 bp, Homo sapiens
taacaggcttagtgatgtaat

SEQ ID NO: 5785041 - DNA, 14 bp, Homo sapiens
taacaggcttctgg

SEQ ID NO: 5785042 - DNA, 22 bp, Homo sapiens
taacagggaacgtgattagtga

SEQ ID NO: 5785043 - DNA, 23 bp, Homo sapiens
taacagggaacgtgattagtgaa

SEQ ID NO: 5785044 - DNA, 20 bp, Homo sapiens
taacagggaaggcaggcagg

SEQ ID NO: 5785045 - DNA, 22 bp, Homo sapiens
taacagggaaggcaggcagggc

SEQ ID NO: 5785046 - DNA, 23 bp, Homo sapiens
taacagggagaagtagctagtag

SEQ ID NO: 5785047 - DNA, 15 bp, Homo sapiens
taacagggtaaatta

SEQ ID NO: 5785048 - DNA, 20 bp, Homo sapiens
taacagggtaaattattcag

SEQ ID NO: 5785049 - DNA, 15 bp, Homo sapiens
taacaggtctcctct

SEQ ID NO: 5785050 - DNA, 18 bp, Homo sapiens
taacaggtctcctcttaa

SEQ ID NO: 5785051 - DNA, 12 bp, Homo sapiens
taacagtaaata

SEQ ID NO: 5785052 - DNA, 15 bp, Homo sapiens
taacagtaaatatac

SEQ ID NO: 5785053 - DNA, 16 bp, Homo sapiens
taacagtaaatataca

SEQ ID NO: 5785054 - DNA, 15 bp, Homo sapiens
taacagtaacgcagg

SEQ ID NO: 5785055 - DNA, 15 bp, Homo sapiens
taacagtatctcaaa

SEQ ID NO: 5785056 - DNA, 15 bp, Homo sapiens
taacagtatttccat

SEQ ID NO: 5785057 - DNA, 22 bp, Homo sapiens
taacagtatttgtacaaatact

SEQ ID NO: 5785058 - DNA, 15 bp, Homo sapiens
taacagtcatcattt

SEQ ID NO: 5785059 - DNA, 13 bp, Homo sapiens
taacagtcattta

SEQ ID NO: 5785060 - DNA, 15 bp, Homo sapiens
taacagtcatttaaa

SEQ ID NO: 5785061 - DNA, 18 bp, Homo sapiens
taacagtcatttaaaaaa

SEQ ID NO: 5785062 - DNA, 23 bp, Homo sapiens
taacagtccccgtggccatccct

SEQ ID NO: 5785063 - DNA, 19 bp, Homo sapiens
taacagtgccattgtcttt

SEQ ID NO: 5785064 - DNA, 15 bp, Homo sapiens
taacagtggagctga

SEQ ID NO: 5785065 - DNA, 16 bp, Homo sapiens
taacagtggagctgaa

SEQ ID NO: 5785066 - DNA, 19 bp, Homo sapiens
taacagtgtctttctagcc

SEQ ID NO: 5785067 - DNA, 14 bp, Homo sapiens
taacagtgtttaaa

SEQ ID NO: 5785068 - DNA, 15 bp, Homo sapiens
taacagttataaaga

SEQ ID NO: 5785069 - DNA, 17 bp, Homo sapiens
taacagttatatttttg

SEQ ID NO: 5785070 - DNA, 20 bp, Homo sapiens
taacagttatatttttgtgt

SEQ ID NO: 5785071 - DNA, 14 bp, Homo sapiens
taacagttgaagaa

SEQ ID NO: 5785072 - DNA, 14 bp, Homo sapiens
taacagttgctttg

SEQ ID NO: 5785073 - DNA, 19 bp, Homo sapiens
taacagttgtatttaacag

SEQ ID NO: 5785074 - DNA, 23 bp, Homo sapiens
taacagtttgcctgctgtattta

SEQ ID NO: 5785075 - DNA, 12 bp, Homo sapiens
taacagttttag

SEQ ID NO: 5785076 - DNA, 15 bp, Homo sapiens
taacagttttccatg

SEQ ID NO: 5785077 - DNA, 20 bp, Homo sapiens
taacagttttccatgaaaac

SEQ ID NO: 5785078 - DNA, 20 bp, Homo sapiens
taacataaaatctgtgaatt

SEQ ID NO: 5785079 - DNA, 19 bp, Homo sapiens
taacataaacttgtactta

SEQ ID NO: 5785080 - DNA, 19 bp, Homo sapiens
taacataaataaaaattca

SEQ ID NO: 5785081 - DNA, 16 bp, Homo sapiens
taacataaatctgtga

SEQ ID NO: 5785082 - DNA, 20 bp, Homo sapiens
taacataaatctgtgaactt

SEQ ID NO: 5785083 - DNA, 17 bp, Homo sapiens
taacataacaacaacag

SEQ ID NO: 5785084 - DNA, 15 bp, Homo sapiens
taacataactgcttc

SEQ ID NO: 5785085 - DNA, 23 bp, Homo sapiens
taacataagctagaaaaattaga

SEQ ID NO: 5785086 - DNA, 19 bp, Homo sapiens
taacataagctatttttct

SEQ ID NO: 5785087 - DNA, 17 bp, Homo sapiens
taacataataaattaaa

SEQ ID NO: 5785088 - DNA, 17 bp, Homo sapiens
taacataatcacaagta

SEQ ID NO: 5785089 - DNA, 18 bp, Homo sapiens
taacatacaagaaaatgt

SEQ ID NO: 5785090 - DNA, 22 bp, Homo sapiens
taacatacctaagaagtacatt

SEQ ID NO: 5785091 - DNA, 17 bp, Homo sapiens
taacataggcttataca

SEQ ID NO: 5785092 - DNA, 17 bp, Homo sapiens
taacatagtaacgtgtt

SEQ ID NO: 5785093 - DNA, 21 bp, Homo sapiens
taacatagtaacgtgttactg

SEQ ID NO: 5785094 - DNA, 22 bp, Homo sapiens
taacatagtaacgtgttactgg

SEQ ID NO: 5785095 - DNA, 19 bp, Homo sapiens
taacatagtcctgttacta

SEQ ID NO: 5785096 - DNA, 19 bp, Homo sapiens
taacatagtgtctgctgct

SEQ ID NO: 5785097 - DNA, 14 bp, Homo sapiens
taacatataaatta

SEQ ID NO: 5785098 - DNA, 15 bp, Homo sapiens
taacatataaattaa

SEQ ID NO: 5785099 - DNA, 17 bp, Homo sapiens
taacatataaattaata

SEQ ID NO: 5785100 - DNA, 21 bp, Homo sapiens
taactgaggagctagtgttaa

SEQ ID NO: 5785101 - DNA, 19 bp, Homo sapiens
taactgagggctgatcttt

SEQ ID NO: 5785102 - DNA, 20 bp, Homo sapiens
taactgagtagctctcctga

SEQ ID NO: 5785103 - DNA, 16 bp, Homo sapiens
taactgagtgcctttt

SEQ ID NO: 5785104 - DNA, 17 bp, Homo sapiens
taactgagtgccttttg

SEQ ID NO: 5785105 - DNA, 14 bp, Homo sapiens
taactgagttatat

SEQ ID NO: 5785106 - DNA, 16 bp, Homo sapiens
taactgagttatattg

SEQ ID NO: 5785107 - DNA, 19 bp, Homo sapiens
taactgagttatattggaa

SEQ ID NO: 5785108 - DNA, 17 bp, Homo sapiens
taactgatctcaagtat

SEQ ID NO: 5785109 - DNA, 13 bp, Homo sapiens
taactgatgaatt

SEQ ID NO: 5785110 - DNA, 19 bp, Homo sapiens
taactgatttccatccaaa

SEQ ID NO: 5785111 - DNA, 15 bp, Homo sapiens
taactgatttctatg

SEQ ID NO: 5785112 - DNA, 21 bp, Homo sapiens
taactgatttctatggctttc

SEQ ID NO: 5785113 - DNA, 12 bp, Homo sapiens
taactgcaattt

SEQ ID NO: 5785114 - DNA, 13 bp, Homo sapiens
taactgcagacca

SEQ ID NO: 5785115 - DNA, 20 bp, Homo sapiens
taactgcagttgactttctc

SEQ ID NO: 5785116 - DNA, 20 bp, Homo sapiens
taactgcattagaaaccatg

SEQ ID NO: 5785117 - DNA, 13 bp, Homo sapiens
taactgccaaaac

SEQ ID NO: 5785118 - DNA, 15 bp, Homo sapiens
taactgccaatcctt

SEQ ID NO: 5785119 - DNA, 11 bp, Homo sapiens
taactgccagc

SEQ ID NO: 5785120 - DNA, 17 bp, Homo sapiens
taactgcccaaagcagc

SEQ ID NO: 5785121 - DNA, 11 bp, Homo sapiens
taactgcccag

SEQ ID NO: 5785122 - DNA, 13 bp, Homo sapiens
taactgcccagcc

SEQ ID NO: 5785123 - DNA, 21 bp, Homo sapiens
taactgcccttttaaatggca

SEQ ID NO: 5785124 - DNA, 17 bp, Homo sapiens
taactgccgtaatttaa

SEQ ID NO: 5785125 - DNA, 20 bp, Homo sapiens
taactgcctaaaatgttctc

SEQ ID NO: 5785126 - DNA, 14 bp, Homo sapiens
taactgcctaccag

SEQ ID NO: 5785127 - DNA, 16 bp, Homo sapiens
taactgcctaccagtc

SEQ ID NO: 5785128 - DNA, 18 bp, Homo sapiens
taactgcctggcctggca

SEQ ID NO: 5785129 - DNA, 18 bp, Homo sapiens
taactgccttaaaacttt

SEQ ID NO: 5785130 - DNA, 16 bp, Homo sapiens
taactgctcagagctt

SEQ ID NO: 5785131 - DNA, 17 bp, Homo sapiens
taactgctcagagcttt

SEQ ID NO: 5785132 - DNA, 19 bp, Homo sapiens
taactgctcttgggcaata

SEQ ID NO: 5785133 - DNA, 11 bp, Homo sapiens
taactgctgca

SEQ ID NO: 5785134 - DNA, 18 bp, Homo sapiens
taactgcttcatctcctt

SEQ ID NO: 5785135 - DNA, 21 bp, Homo sapiens
taactgcttttgcccatataa

SEQ ID NO: 5785136 - DNA, 20 bp, Homo sapiens
taactggaaaacagaacact

SEQ ID NO: 5785137 - DNA, 21 bp, Homo sapiens
taactggaaaacagaacactt

SEQ ID NO: 5785138 - DNA, 22 bp, Homo sapiens
taactggaaaacagaacactta

SEQ ID NO: 5785139 - DNA, 14 bp, Homo sapiens
taactggaaacaaa

SEQ ID NO: 5785140 - DNA, 14 bp, Homo sapiens
taactggaaagaag

SEQ ID NO: 5785141 - DNA, 10 bp, Homo sapiens
taactggaac

SEQ ID NO: 5785142 - DNA, 22 bp, Homo sapiens
taactggaagcatgtaggagaa

SEQ ID NO: 5785143 - DNA, 16 bp, Homo sapiens
taactggaaggctgct

SEQ ID NO: 5785144 - DNA, 17 bp, Homo sapiens
taactggaaggctgctt

SEQ ID NO: 5785145 - DNA, 21 bp, Homo sapiens
taactggacagcctcttctgt

SEQ ID NO: 5785146 - DNA, 15 bp, Homo sapiens
taactggattttgaa

SEQ ID NO: 5785147 - DNA, 17 bp, Homo sapiens
taactggattttgaacg

SEQ ID NO: 5785148 - DNA, 15 bp, Homo sapiens
taactggcccagaag

SEQ ID NO: 5785149 - DNA, 11 bp, Homo sapiens
taactggcccc

SEQ ID NO: 5785150 - DNA, 16 bp, Homo sapiens
taactggccccaggcg

SEQ ID NO: 5785151 - DNA, 14 bp, Homo sapiens
taactggccctcgg

SEQ ID NO: 5785152 - DNA, 21 bp, Homo sapiens
taactggccctcgggccctct

SEQ ID NO: 5785153 - DNA, 22 bp, Homo sapiens
taactggccttacgatggcaat

SEQ ID NO: 5785154 - DNA, 19 bp, Homo sapiens
taactggctgctccctgct

SEQ ID NO: 5785155 - DNA, 20 bp, Homo sapiens
taactggctgctccctgctc

SEQ ID NO: 5785156 - DNA, 16 bp, Homo sapiens
taactggcttcatttt

SEQ ID NO: 5785157 - DNA, 22 bp, Homo sapiens
taactggcttctgcttgtcatc

SEQ ID NO: 5785158 - DNA, 19 bp, Homo sapiens
taactggctttcctgctgg

SEQ ID NO: 5785159 - DNA, 19 bp, Homo sapiens
taactgggaaccccttctt

SEQ ID NO: 5785160 - DNA, 20 bp, Homo sapiens
taactgggtaatgaaacaaa

SEQ ID NO: 5785161 - DNA, 23 bp, Homo sapiens
taactgggtacccaaaacacatt

SEQ ID NO: 5785162 - DNA, 21 bp, Homo sapiens
taactgggttaaatattttgc

SEQ ID NO: 5785163 - DNA, 17 bp, Homo sapiens
taactgggttcaaaaag

SEQ ID NO: 5785164 - DNA, 13 bp, Homo sapiens
taactggtataga

SEQ ID NO: 5785165 - DNA, 15 bp, Homo sapiens
taactggtgaagaga

SEQ ID NO: 5785166 - DNA, 22 bp, Homo sapiens
taactggttaaaaaacaaatgt

SEQ ID NO: 5785167 - DNA, 14 bp, Homo sapiens
taactgtaaacttg

SEQ ID NO: 5785168 - DNA, 21 bp, Homo sapiens
taactgtaaacttggaatcaa

SEQ ID NO: 5785169 - DNA, 16 bp, Homo sapiens
taactgtaaagatgaa

SEQ ID NO: 5785170 - DNA, 22 bp, Homo sapiens
taactgtaaagatgaatgtcag

SEQ ID NO: 5785171 - DNA, 23 bp, Homo sapiens
taactgtaaagatgtttatttca

SEQ ID NO: 5785172 - DNA, 12 bp, Homo sapiens
taactgtaaatc

SEQ ID NO: 5785173 - DNA, 15 bp, Homo sapiens
taactgtaaatcact

SEQ ID NO: 5785174 - DNA, 21 bp, Homo sapiens
taactgtaaatcacttgtaaa

SEQ ID NO: 5785175 - DNA, 20 bp, Homo sapiens
taactgtagctcaagtttaa

SEQ ID NO: 5785176 - DNA, 22 bp, Homo sapiens
taactgtagtgtagtcaggtgc

SEQ ID NO: 5785177 - DNA, 12 bp, Homo sapiens
taactgtatctt

SEQ ID NO: 5785178 - DNA, 14 bp, Homo sapiens
taactgtatttgaa

SEQ ID NO: 5785179 - DNA, 19 bp, Homo sapiens
taactgtccagtccagtga

SEQ ID NO: 5785180 - DNA, 13 bp, Homo sapiens
taactgtcccagc

SEQ ID NO: 5785181 - DNA, 14 bp, Homo sapiens
taactgtcccagcg

SEQ ID NO: 5785182 - DNA, 18 bp, Homo sapiens
taactgtccctgctttct

SEQ ID NO: 5785183 - DNA, 14 bp, Homo sapiens
taactgtcctgtcc

SEQ ID NO: 5785184 - DNA, 17 bp, Homo sapiens
taactgtcctgtcctgc

SEQ ID NO: 5785185 - DNA, 17 bp, Homo sapiens
taactgtcttgagagaa

SEQ ID NO: 5785186 - DNA, 22 bp, Homo sapiens
taactgtcttgagagaaaagaa

SEQ ID NO: 5785187 - DNA, 23 bp, Homo sapiens
taactgtcttgagagaaaagaaa

SEQ ID NO: 5785188 - DNA, 16 bp, Homo sapiens
taactgtcttgtttca

SEQ ID NO: 5785189 - DNA, 21 bp, Homo sapiens
taactgtgatgaaatatgaaa

SEQ ID NO: 5785190 - DNA, 14 bp, Homo sapiens
taactgtgatttgt

SEQ ID NO: 5785191 - DNA, 18 bp, Homo sapiens
taactgtgcaaagcagag

SEQ ID NO: 5785192 - DNA, 12 bp, Homo sapiens
taactgtgcatg

SEQ ID NO: 5785193 - DNA, 18 bp, Homo sapiens
taactgtgccagttcttt

SEQ ID NO: 5785194 - DNA, 21 bp, Homo sapiens
taactgtgcgttaaataagca

SEQ ID NO: 5785195 - DNA, 17 bp, Homo sapiens
taactgtgctgaatgct

SEQ ID NO: 5785196 - DNA, 20 bp, Homo sapiens
taactgtgctgtactgagca

SEQ ID NO: 5785197 - DNA, 15 bp, Homo sapiens
taactgtggaatata

SEQ ID NO: 5785198 - DNA, 21 bp, Homo sapiens
taactgtggaatataaatagc

SEQ ID NO: 5785199 - DNA, 13 bp, Homo sapiens
taactgtgtatgt

SEQ ID NO: 5785200 - DNA, 18 bp, Homo sapiens
taactgttaacccagtgt

SEQ ID NO: 5785201 - DNA, 19 bp, Homo sapiens
taactgttaacccagtgtt

SEQ ID NO: 5785202 - DNA, 14 bp, Homo sapiens
taactgttacagta

SEQ ID NO: 5785203 - DNA, 13 bp, Homo sapiens
taactgttaccat

SEQ ID NO: 5785204 - DNA, 15 bp, Homo sapiens
taactgttaccattg

SEQ ID NO: 5785205 - DNA, 23 bp, Homo sapiens
taactgttcagtattgcaataaa

SEQ ID NO: 5785206 - DNA, 22 bp, Homo sapiens
taactgttcccttatctgtttt

SEQ ID NO: 5785207 - DNA, 12 bp, Homo sapiens
taactgttcttt

SEQ ID NO: 5785208 - DNA, 21 bp, Homo sapiens
taactgttctttgcagtgaag

SEQ ID NO: 5785209 - DNA, 23 bp, Homo sapiens
taactgttgcacttttgaatgtc

SEQ ID NO: 5785210 - DNA, 15 bp, Homo sapiens
taactgtttatatgt

SEQ ID NO: 5785211 - DNA, 19 bp, Homo sapiens
taactgtttatatgtgttg

SEQ ID NO: 5785212 - DNA, 17 bp, Homo sapiens
taactgtttcaaagcca

SEQ ID NO: 5785213 - DNA, 14 bp, Homo sapiens
taactgttttagaa

SEQ ID NO: 5785214 - DNA, 21 bp, Homo sapiens
taacttaaaataattaaataa

SEQ ID NO: 5785215 - DNA, 13 bp, Homo sapiens
taacttaaaattg

SEQ ID NO: 5785216 - DNA, 16 bp, Homo sapiens
taacttaaatagcttt

SEQ ID NO: 5785217 - DNA, 16 bp, Homo sapiens
taacttaacattgcat

SEQ ID NO: 5785218 - DNA, 13 bp, Homo sapiens
taacttaactgaa

SEQ ID NO: 5785219 - DNA, 13 bp, Homo sapiens
taacttaataaat

SEQ ID NO: 5785220 - DNA, 21 bp, Homo sapiens
taacttaataatcaagagcct

SEQ ID NO: 5785221 - DNA, 15 bp, Homo sapiens
taacttaatactcta

SEQ ID NO: 5785222 - DNA, 18 bp, Homo sapiens
taacttacatgactttct

SEQ ID NO: 5785223 - DNA, 13 bp, Homo sapiens
taacttacatttg

SEQ ID NO: 5785224 - DNA, 15 bp, Homo sapiens
taacttacatttgta

SEQ ID NO: 5785225 - DNA, 18 bp, Homo sapiens
taacttaccattcctata

SEQ ID NO: 5785226 - DNA, 15 bp, Homo sapiens
taacttactgtatat

SEQ ID NO: 5785227 - DNA, 16 bp, Homo sapiens
taacttactgtatatg

SEQ ID NO: 5785228 - DNA, 24 bp, Homo sapiens
taacttagaaggatggcatctcca

SEQ ID NO: 5785229 - DNA, 14 bp, Homo sapiens
taacttagaatgct

SEQ ID NO: 5785230 - DNA, 18 bp, Homo sapiens
taacttagagactttaga

SEQ ID NO: 5785231 - DNA, 15 bp, Homo sapiens
taacttagcatgtgt

SEQ ID NO: 5785232 - DNA, 13 bp, Homo sapiens
taacttagtattt

SEQ ID NO: 5785233 - DNA, 19 bp, Homo sapiens
taacttatattgtaagaaa

SEQ ID NO: 5785234 - DNA, 19 bp, Homo sapiens
taacttatggactgttttg

SEQ ID NO: 5785235 - DNA, 16 bp, Homo sapiens
taacttattaaattta

SEQ ID NO: 5785236 - DNA, 15 bp, Homo sapiens
taacttattccgaga

SEQ ID NO: 5785237 - DNA, 19 bp, Homo sapiens
taacttattgctgatttta

SEQ ID NO: 5785238 - DNA, 23 bp, Homo sapiens
taacttattgctgattttaatgg

SEQ ID NO: 5785239 - DNA, 19 bp, Homo sapiens
taacttattgttgctgaaa

SEQ ID NO: 5785240 - DNA, 15 bp, Homo sapiens
taacttatttagaga

SEQ ID NO: 5785241 - DNA, 19 bp, Homo sapiens
taacttatttatatgaagc

SEQ ID NO: 5785242 - DNA, 23 bp, Homo sapiens
taacttatttatgttaaaagatt

SEQ ID NO: 5785243 - DNA, 17 bp, Homo sapiens
taacttcaaatatagag

SEQ ID NO: 5785244 - DNA, 22 bp, Homo sapiens
taacttcacattaaaaaatgaa

SEQ ID NO: 5785245 - DNA, 12 bp, Homo sapiens
taacttcacctt

SEQ ID NO: 5785246 - DNA, 14 bp, Homo sapiens
taacttcagagaag

SEQ ID NO: 5785247 - DNA, 15 bp, Homo sapiens
taacttcagagaagt

SEQ ID NO: 5785248 - DNA, 20 bp, Homo sapiens
taacttcagatacttgtgaa

SEQ ID NO: 5785249 - DNA, 20 bp, Homo sapiens
taacttcagatgtttccaag

SEQ ID NO: 5785250 - DNA, 20 bp, Homo sapiens
taacttcagtgcaagagact

SEQ ID NO: 5785251 - DNA, 15 bp, Homo sapiens
taacttcatattaat

SEQ ID NO: 5785252 - DNA, 20 bp, Homo sapiens
taacttcatttttctaataa

SEQ ID NO: 5785253 - DNA, 15 bp, Homo sapiens
taacttccaaataaa

SEQ ID NO: 5785254 - DNA, 17 bp, Homo sapiens
taacttccaatttacat

SEQ ID NO: 5785255 - DNA, 14 bp, Homo sapiens
taacttccactgtt

SEQ ID NO: 5785256 - DNA, 18 bp, Homo sapiens
taacttccactttgtata

SEQ ID NO: 5785257 - DNA, 21 bp, Homo sapiens
taacttccactttgtataaat

SEQ ID NO: 5785258 - DNA, 17 bp, Homo sapiens
taacttccatgtgaggg

SEQ ID NO: 5785259 - DNA, 13 bp, Homo sapiens
taacttcctctta

SEQ ID NO: 5785260 - DNA, 13 bp, Homo sapiens
taacttcctgctg

SEQ ID NO: 5785261 - DNA, 17 bp, Homo sapiens
taacttccttgcccctg

SEQ ID NO: 5785262 - DNA, 21 bp, Homo sapiens
taacttccttgcccctgctct

SEQ ID NO: 5785263 - DNA, 21 bp, Homo sapiens
taacttccttggactcatttt

SEQ ID NO: 5785264 - DNA, 17 bp, Homo sapiens
taacttcgaatatatct

SEQ ID NO: 5785265 - DNA, 19 bp, Homo sapiens
taacttcgtattttttgat

SEQ ID NO: 5785266 - DNA, 17 bp, Homo sapiens
taacttctaaaactgta

SEQ ID NO: 5785267 - DNA, 20 bp, Homo sapiens
taacttctaaaactgtactt

SEQ ID NO: 5785268 - DNA, 22 bp, Homo sapiens
taacttctatattttaatagaa

SEQ ID NO: 5785269 - DNA, 16 bp, Homo sapiens
taacttctgaaagagc

SEQ ID NO: 5785270 - DNA, 23 bp, Homo sapiens
taacttctgatagcgttggaatt

SEQ ID NO: 5785271 - DNA, 13 bp, Homo sapiens
taacttctgcctg

SEQ ID NO: 5785272 - DNA, 22 bp, Homo sapiens
taacttctgtaatttaaaagct

SEQ ID NO: 5785273 - DNA, 12 bp, Homo sapiens
taacttctgttt

SEQ ID NO: 5785274 - DNA, 23 bp, Homo sapiens
taacttcttaaaccatttttgct

SEQ ID NO: 5785275 - DNA, 15 bp, Homo sapiens
taacttcttaaagtt

SEQ ID NO: 5785276 - DNA, 12 bp, Homo sapiens
taacttcttcca

SEQ ID NO: 5785277 - DNA, 19 bp, Homo sapiens
taacttcttgaaaaagatg

SEQ ID NO: 5785278 - DNA, 20 bp, Homo sapiens
taagatttttctcaaagttt

SEQ ID NO: 5785279 - DNA, 23 bp, Homo sapiens
taagcaaaaacaaaaagaaaaga

SEQ ID NO: 5785280 - DNA, 15 bp, Homo sapiens
taagcaaaagaaaaa

SEQ ID NO: 5785281 - DNA, 14 bp, Homo sapiens
taagcaaaatgtga

SEQ ID NO: 5785282 - DNA, 21 bp, Homo sapiens
taagcaaaatgtgatatgtac

SEQ ID NO: 5785283 - DNA, 21 bp, Homo sapiens
taagcaaagcacccatttcaa

SEQ ID NO: 5785284 - DNA, 20 bp, Homo sapiens
taagcaaaggaaaccaaagg

SEQ ID NO: 5785285 - DNA, 13 bp, Homo sapiens
taagcaaaggctc

SEQ ID NO: 5785286 - DNA, 17 bp, Homo sapiens
taagcaaaggggacagc

SEQ ID NO: 5785287 - DNA, 15 bp, Homo sapiens
taagcaaataaacag

SEQ ID NO: 5785288 - DNA, 15 bp, Homo sapiens
taagcaaatgcattc

SEQ ID NO: 5785289 - DNA, 14 bp, Homo sapiens
taagcaaatgttaa

SEQ ID NO: 5785290 - DNA, 13 bp, Homo sapiens
taagcaaatttca

SEQ ID NO: 5785291 - DNA, 20 bp, Homo sapiens
taagcaaatttcaaaagaca

SEQ ID NO: 5785292 - DNA, 16 bp, Homo sapiens
taagcaaatttctaaa

SEQ ID NO: 5785293 - DNA, 20 bp, Homo sapiens
taagcaacaaaactatggaa

SEQ ID NO: 5785294 - DNA, 22 bp, Homo sapiens
taagcaacaaaactatggaaat

SEQ ID NO: 5785295 - DNA, 16 bp, Homo sapiens
taagcaacaattttca

SEQ ID NO: 5785296 - DNA, 15 bp, Homo sapiens
taagcaacagaaata

SEQ ID NO: 5785297 - DNA, 21 bp, Homo sapiens
taagcaacatgaattaagaac

SEQ ID NO: 5785298 - DNA, 20 bp, Homo sapiens
taagcaaccttaaagcaata

SEQ ID NO: 5785299 - DNA, 14 bp, Homo sapiens
taagcaactggaaa

SEQ ID NO: 5785300 - DNA, 14 bp, Homo sapiens
taagcaagaaggca

SEQ ID NO: 5785301 - DNA, 13 bp, Homo sapiens
taagcaagaccat

SEQ ID NO: 5785302 - DNA, 14 bp, Homo sapiens
taagcaagaccatg

SEQ ID NO: 5785303 - DNA, 13 bp, Homo sapiens
taagcaagagaga

SEQ ID NO: 5785304 - DNA, 14 bp, Homo sapiens
taagcaagccagga

SEQ ID NO: 5785305 - DNA, 22 bp, Homo sapiens
taagcaagtatatttatttcta

SEQ ID NO: 5785306 - DNA, 19 bp, Homo sapiens
taagcaagtggttgtttta

SEQ ID NO: 5785307 - DNA, 21 bp, Homo sapiens
taagcaagttaagtgtcctcc

SEQ ID NO: 5785308 - DNA, 12 bp, Homo sapiens
taagcaataaaa

SEQ ID NO: 5785309 - DNA, 20 bp, Homo sapiens
taagcaataaggaaatgtat

SEQ ID NO: 5785310 - DNA, 21 bp, Homo sapiens
taagcaatcactgggcccaga

SEQ ID NO: 5785311 - DNA, 14 bp, Homo sapiens
taagcaattctaag

SEQ ID NO: 5785312 - DNA, 21 bp, Homo sapiens
taagcacaaccatgttcttga

SEQ ID NO: 5785313 - DNA, 14 bp, Homo sapiens
taagcacaattaat

SEQ ID NO: 5785314 - DNA, 21 bp, Homo sapiens
taagcacacacatctggccct

SEQ ID NO: 5785315 - DNA, 22 bp, Homo sapiens
taagcacacacatctggccctg

SEQ ID NO: 5785316 - DNA, 18 bp, Homo sapiens
taagcacatcagtacttt

SEQ ID NO: 5785317 - DNA, 16 bp, Homo sapiens
taagcaccatggcctt

SEQ ID NO: 5785318 - DNA, 19 bp, Homo sapiens
taagcaccctagaggacta

SEQ ID NO: 5785319 - DNA, 21 bp, Homo sapiens
taagcacctaaaacccaaagg

SEQ ID NO: 5785320 - DNA, 12 bp, Homo sapiens
taagcacctggg

SEQ ID NO: 5785321 - DNA, 15 bp, Homo sapiens
taagcacctgggctg

SEQ ID NO: 5785322 - DNA, 16 bp, Homo sapiens
taagcactacataaac

SEQ ID NO: 5785323 - DNA, 22 bp, Homo sapiens
taagcactacataaactgactt

SEQ ID NO: 5785324 - DNA, 13 bp, Homo sapiens
taagcactcttaa

SEQ ID NO: 5785325 - DNA, 18 bp, Homo sapiens
taagcactgtgtttatat

SEQ ID NO: 5785326 - DNA, 17 bp, Homo sapiens
taagcactgtttttcca

SEQ ID NO: 5785327 - DNA, 14 bp, Homo sapiens
taagcacttgcctg

SEQ ID NO: 5785328 - DNA, 17 bp, Homo sapiens
taagcacttgcctggaa

SEQ ID NO: 5785329 - DNA, 19 bp, Homo sapiens
taagcacttgcctggaata

SEQ ID NO: 5785330 - DNA, 22 bp, Homo sapiens
taagcacttgcctggaataaaa

SEQ ID NO: 5785331 - DNA, 23 bp, Homo sapiens
taagcacttgcctggaataaaat

SEQ ID NO: 5785332 - DNA, 22 bp, Homo sapiens
taagcactttaacacagtgtct

SEQ ID NO: 5785333 - DNA, 17 bp, Homo sapiens
taagcactttgaaaata

SEQ ID NO: 5785334 - DNA, 17 bp, Homo sapiens
taagcagaacactgcag

SEQ ID NO: 5785335 - DNA, 18 bp, Homo sapiens
taagcagaacatactgtt

SEQ ID NO: 5785336 - DNA, 17 bp, Homo sapiens
taagcagaattggaaaa

SEQ ID NO: 5785337 - DNA, 17 bp, Homo sapiens
taagcagaccactgata

SEQ ID NO: 5785338 - DNA, 20 bp, Homo sapiens
taagcagaccactgataaaa

SEQ ID NO: 5785339 - DNA, 20 bp, Homo sapiens
taagcagactggaaaagtga

SEQ ID NO: 5785340 - DNA, 19 bp, Homo sapiens
taagcagagcagaactttt

SEQ ID NO: 5785341 - DNA, 15 bp, Homo sapiens
taagcagattacaat

SEQ ID NO: 5785342 - DNA, 17 bp, Homo sapiens
taagcagattacaataa

SEQ ID NO: 5785343 - DNA, 23 bp, Homo sapiens
taagcagattacaataaatcctt

SEQ ID NO: 5785344 - DNA, 17 bp, Homo sapiens
taagcagattgctttaa

SEQ ID NO: 5785345 - DNA, 21 bp, Homo sapiens
taagcagatttaacaattcca

SEQ ID NO: 5785346 - DNA, 12 bp, Homo sapiens
taagcagcaaca

SEQ ID NO: 5785347 - DNA, 17 bp, Homo sapiens
taagcagcatggaaaaa

SEQ ID NO: 5785348 - DNA, 18 bp, Homo sapiens
taagcagcatggaaaaat

SEQ ID NO: 5785349 - DNA, 19 bp, Homo sapiens
taagcagcatttctgaagt

SEQ ID NO: 5785350 - DNA, 16 bp, Homo sapiens
taagcagctaaatttt

SEQ ID NO: 5785351 - DNA, 17 bp, Homo sapiens
taagcagctaaattttc

SEQ ID NO: 5785352 - DNA, 22 bp, Homo sapiens
taagcagctaaattttctgaaa

SEQ ID NO: 5785353 - DNA, 12 bp, Homo sapiens
taagcagctctt

SEQ ID NO: 5785354 - DNA, 23 bp, Homo sapiens
taagcaggaaggtctcatgcctg

SEQ ID NO: 5785355 - DNA, 17 bp, Homo sapiens
taagcaggcattgcttt

SEQ ID NO: 5785356 - DNA, 16 bp, Homo sapiens
taagcaggcgcaaggg

SEQ ID NO: 5785357 - DNA, 18 bp, Homo sapiens
taagcaggcgcaagggag

SEQ ID NO: 5785358 - DNA, 21 bp, Homo sapiens
taagcaggttgttatttaggt

SEQ ID NO: 5785359 - DNA, 15 bp, Homo sapiens
taagcagtaaaaact

SEQ ID NO: 5785360 - DNA, 21 bp, Homo sapiens
taagcagtacatcttgtgcat

SEQ ID NO: 5785361 - DNA, 23 bp, Homo sapiens
taagcagtacatcttgtgcatgc

SEQ ID NO: 5785362 - DNA, 21 bp, Homo sapiens
taagcagtatattagtattat

SEQ ID NO: 5785363 - DNA, 17 bp, Homo sapiens
taagcagtgttacttgc

SEQ ID NO: 5785364 - DNA, 16 bp, Homo sapiens
taagcagttcattcta

SEQ ID NO: 5785365 - DNA, 14 bp, Homo sapiens
taagcagttttgta

SEQ ID NO: 5785366 - DNA, 16 bp, Homo sapiens
taagcataaaagatca

SEQ ID NO: 5785367 - DNA, 20 bp, Homo sapiens
taagcataatctgaaaacat

SEQ ID NO: 5785368 - DNA, 19 bp, Homo sapiens
taagcatcattatttatgt

SEQ ID NO: 5785369 - DNA, 17 bp, Homo sapiens
taagcatctaaggacaa

SEQ ID NO: 5785370 - DNA, 19 bp, Homo sapiens
taagcatgatcttgttaat

SEQ ID NO: 5785371 - DNA, 24 bp, Homo sapiens
taagcatgctttctttgagtttta

SEQ ID NO: 5785372 - DNA, 15 bp, Homo sapiens
taagcatgtgatgtt

SEQ ID NO: 5785373 - DNA, 17 bp, Homo sapiens
taagcattactcttgta

SEQ ID NO: 5785374 - DNA, 18 bp, Homo sapiens
taagcattactcttgtaa

SEQ ID NO: 5785375 - DNA, 21 bp, Homo sapiens
taagcattactcttgtaagat

SEQ ID NO: 5785376 - DNA, 15 bp, Homo sapiens
taagcattactttat

SEQ ID NO: 5785377 - DNA, 15 bp, Homo sapiens
taagcattagcttta

SEQ ID NO: 5785378 - DNA, 21 bp, Homo sapiens
taagcattctgagctgggctt

SEQ ID NO: 5785379 - DNA, 20 bp, Homo sapiens
taagcattgaaattatagtt

SEQ ID NO: 5785380 - DNA, 17 bp, Homo sapiens
taagcattgctcaagag

SEQ ID NO: 5785381 - DNA, 15 bp, Homo sapiens
taagcattgtgagta

SEQ ID NO: 5785382 - DNA, 20 bp, Homo sapiens
taagcattgtttgcttattg

SEQ ID NO: 5785383 - DNA, 21 bp, Homo sapiens
taagcattgtttgcttattgt

SEQ ID NO: 5785384 - DNA, 12 bp, Homo sapiens
taagcatttatt

SEQ ID NO: 5785385 - DNA, 14 bp, Homo sapiens
taagcatttgtaca

SEQ ID NO: 5785386 - DNA, 22 bp, Homo sapiens
taagcatttgtacatcttcttt

SEQ ID NO: 5785387 - DNA, 13 bp, Homo sapiens
taagcatttgtat

SEQ ID NO: 5785388 - DNA, 15 bp, Homo sapiens
taagcatttgtatat

SEQ ID NO: 5785389 - DNA, 15 bp, Homo sapiens
taagcattttactgt

SEQ ID NO: 5785390 - DNA, 16 bp, Homo sapiens
taagccaaaaggattc

SEQ ID NO: 5785391 - DNA, 15 bp, Homo sapiens
taagccaaagaaaca

SEQ ID NO: 5785392 - DNA, 17 bp, Homo sapiens
taagccaaagaaacaag

SEQ ID NO: 5785393 - DNA, 16 bp, Homo sapiens
taagccaaagaaatga

SEQ ID NO: 5785394 - DNA, 20 bp, Homo sapiens
taagccaaagaaatgaacat

SEQ ID NO: 5785395 - DNA, 21 bp, Homo sapiens
taagccaaagaaatgaacatt

SEQ ID NO: 5785396 - DNA, 22 bp, Homo sapiens
taagccaacaaccacagtgcca

SEQ ID NO: 5785397 - DNA, 20 bp, Homo sapiens
taagccaagaagtgaggcct

SEQ ID NO: 5785398 - DNA, 21 bp, Homo sapiens
taagccaagaagtgaggcctg

SEQ ID NO: 5785399 - DNA, 16 bp, Homo sapiens
taagccaagctgtgtt

SEQ ID NO: 5785400 - DNA, 19 bp, Homo sapiens
taagccaagctgtgttcat

SEQ ID NO: 5785401 - DNA, 10 bp, Homo sapiens
taagccaagg

SEQ ID NO: 5785402 - DNA, 14 bp, Homo sapiens
taagccaataaata

SEQ ID NO: 5785403 - DNA, 14 bp, Homo sapiens
taagccaatataat

SEQ ID NO: 5785404 - DNA, 15 bp, Homo sapiens
taagccaatttcaat

SEQ ID NO: 5785405 - DNA, 15 bp, Homo sapiens
taagccaatttttct

SEQ ID NO: 5785406 - DNA, 19 bp, Homo sapiens
taagccaatttttctgcac

SEQ ID NO: 5785407 - DNA, 18 bp, Homo sapiens
taagccacaaagtttgtg

SEQ ID NO: 5785408 - DNA, 14 bp, Homo sapiens
taagccacttgaaa

SEQ ID NO: 5785409 - DNA, 21 bp, Homo sapiens
taagccagacatcaacagata

SEQ ID NO: 5785410 - DNA, 13 bp, Homo sapiens
taagccagagcct

SEQ ID NO: 5785411 - DNA, 13 bp, Homo sapiens
taagccagagtca

SEQ ID NO: 5785412 - DNA, 17 bp, Homo sapiens
taagccagagtcaacaa

SEQ ID NO: 5785413 - DNA, 24 bp, Homo sapiens
taagccagcctggtccatgcaggg

SEQ ID NO: 5785414 - DNA, 16 bp, Homo sapiens
taagccaggaccccaa

SEQ ID NO: 5785415 - DNA, 21 bp, Homo sapiens
taagccagggcccctggatct

SEQ ID NO: 5785416 - DNA, 18 bp, Homo sapiens
taagccagtgttgcctaa

SEQ ID NO: 5785417 - DNA, 16 bp, Homo sapiens
taagccagttggatct

SEQ ID NO: 5785418 - DNA, 15 bp, Homo sapiens
taagccatagcccca

SEQ ID NO: 5785419 - DNA, 17 bp, Homo sapiens
taagccatagccccagg

SEQ ID NO: 5785420 - DNA, 22 bp, Homo sapiens
taagccatatgacaatttcaaa

SEQ ID NO: 5785421 - DNA, 13 bp, Homo sapiens
taagccatgagaa

SEQ ID NO: 5785422 - DNA, 14 bp, Homo sapiens
taagccatgagaat

SEQ ID NO: 5785423 - DNA, 20 bp, Homo sapiens
taagccattctgactcatat

SEQ ID NO: 5785424 - DNA, 23 bp, Homo sapiens
taagcccaagctaagctgcaggc

SEQ ID NO: 5785425 - DNA, 19 bp, Homo sapiens
taagcccagtgctgctgta

SEQ ID NO: 5785426 - DNA, 23 bp, Homo sapiens
taagccccaacatgttcagaaaa

SEQ ID NO: 5785427 - DNA, 15 bp, Homo sapiens
taagcccccagggcc

SEQ ID NO: 5785428 - DNA, 22 bp, Homo sapiens
taagcccccagggcctccaggg

SEQ ID NO: 5785429 - DNA, 21 bp, Homo sapiens
taagccctcgaaccaaggcag

SEQ ID NO: 5785430 - DNA, 11 bp, Homo sapiens
taagccctgct

SEQ ID NO: 5785431 - DNA, 12 bp, Homo sapiens
taagccctgctc

SEQ ID NO: 5785432 - DNA, 20 bp, Homo sapiens
taagccctgctctttctctg

SEQ ID NO: 5785433 - DNA, 22 bp, Homo sapiens
taagccctgctctttctctgag

SEQ ID NO: 5785434 - DNA, 11 bp, Homo sapiens
taagccctgtc

SEQ ID NO: 5785435 - DNA, 20 bp, Homo sapiens
taagccctgtcgagacactt

SEQ ID NO: 5785436 - DNA, 22 bp, Homo sapiens
taagccctgtcgagacacttgc

SEQ ID NO: 5785437 - DNA, 17 bp, Homo sapiens
taagccctttgctctgg

SEQ ID NO: 5785438 - DNA, 18 bp, Homo sapiens
taagccgatggtcactat

SEQ ID NO: 5785439 - DNA, 15 bp, Homo sapiens
taagcctacctgctc

SEQ ID NO: 5785440 - DNA, 16 bp, Homo sapiens
taagcctcaggcctgg

SEQ ID NO: 5785441 - DNA, 19 bp, Homo sapiens
taagcctcaggcctggccc

SEQ ID NO: 5785442 - DNA, 14 bp, Homo sapiens
taagcctccattta

SEQ ID NO: 5785443 - DNA, 20 bp, Homo sapiens
taagcctccatttagttctt

SEQ ID NO: 5785444 - DNA, 14 bp, Homo sapiens
taagcctgaagagc

SEQ ID NO: 5785445 - DNA, 11 bp, Homo sapiens
taagcctgagc

SEQ ID NO: 5785446 - DNA, 14 bp, Homo sapiens
taagcctgagcctt

SEQ ID NO: 5785447 - DNA, 21 bp, Homo sapiens
taagcctgcggcgccagcctc

SEQ ID NO: 5785448 - DNA, 15 bp, Homo sapiens
taagcctggaagcca

SEQ ID NO: 5785449 - DNA, 16 bp, Homo sapiens
taagcctggaagccat

SEQ ID NO: 5785450 - DNA, 21 bp, Homo sapiens
taagcctggacacagtcaggg

SEQ ID NO: 5785451 - DNA, 22 bp, Homo sapiens
taagcctggcttagaaggcact

SEQ ID NO: 5785452 - DNA, 13 bp, Homo sapiens
taagcctgtcccc

SEQ ID NO: 5785453 - DNA, 16 bp, Homo sapiens
taagcctgtccccaga

SEQ ID NO: 5785454 - DNA, 17 bp, Homo sapiens
taagcctgtccccagac

SEQ ID NO: 5785455 - DNA, 17 bp, Homo sapiens
taagtgtggttttgtaa

SEQ ID NO: 5785456 - DNA, 19 bp, Homo sapiens
taagtgtgtataaaacatt

SEQ ID NO: 5785457 - DNA, 16 bp, Homo sapiens
taagtgtgtcttccta

SEQ ID NO: 5785458 - DNA, 21 bp, Homo sapiens
taagtgtgtggtagaaacaaa

SEQ ID NO: 5785459 - DNA, 21 bp, Homo sapiens
taagtgtgtgtatactgtaat

SEQ ID NO: 5785460 - DNA, 15 bp, Homo sapiens
taagtgttcagtgtt

SEQ ID NO: 5785461 - DNA, 20 bp, Homo sapiens
taagtgttcagtgttgacat

SEQ ID NO: 5785462 - DNA, 13 bp, Homo sapiens
taagtgttcattt

SEQ ID NO: 5785463 - DNA, 18 bp, Homo sapiens
taagtgttcattttaagt

SEQ ID NO: 5785464 - DNA, 23 bp, Homo sapiens
taagtgttcgtctttagttttga

SEQ ID NO: 5785465 - DNA, 13 bp, Homo sapiens
taagtgttctgtg

SEQ ID NO: 5785466 - DNA, 17 bp, Homo sapiens
taagtgttgaaaaatat

SEQ ID NO: 5785467 - DNA, 22 bp, Homo sapiens
taagtgttggccatcatttcat

SEQ ID NO: 5785468 - DNA, 17 bp, Homo sapiens
taagtgttgttcattat

SEQ ID NO: 5785469 - DNA, 15 bp, Homo sapiens
taagtgtttagaaat

SEQ ID NO: 5785470 - DNA, 19 bp, Homo sapiens
taagtgtttcacagtgtct

SEQ ID NO: 5785471 - DNA, 14 bp, Homo sapiens
taagtgtttctcaa

SEQ ID NO: 5785472 - DNA, 18 bp, Homo sapiens
taagtgtttctcaaaaga

SEQ ID NO: 5785473 - DNA, 15 bp, Homo sapiens
taagtgtttgaaaac

SEQ ID NO: 5785474 - DNA, 22 bp, Homo sapiens
taagttaaactacctaaaataa

SEQ ID NO: 5785475 - DNA, 22 bp, Homo sapiens
taagttaaaggcagtccagagc

SEQ ID NO: 5785476 - DNA, 15 bp, Homo sapiens
taagttaaatcattt

SEQ ID NO: 5785477 - DNA, 16 bp, Homo sapiens
taagttaataaataag

SEQ ID NO: 5785478 - DNA, 22 bp, Homo sapiens
taagttaataagttgatgtttt

SEQ ID NO: 5785479 - DNA, 14 bp, Homo sapiens
taagttaataatgt

SEQ ID NO: 5785480 - DNA, 14 bp, Homo sapiens
taagttaatgaaat

SEQ ID NO: 5785481 - DNA, 16 bp, Homo sapiens
taagttaatgaaataa

SEQ ID NO: 5785482 - DNA, 15 bp, Homo sapiens
taagttacaatgttt

SEQ ID NO: 5785483 - DNA, 17 bp, Homo sapiens
taagttacaattacatc

SEQ ID NO: 5785484 - DNA, 21 bp, Homo sapiens
taagttacacatttttcagat

SEQ ID NO: 5785485 - DNA, 15 bp, Homo sapiens
taagttacttgaaat

SEQ ID NO: 5785486 - DNA, 18 bp, Homo sapiens
taagttataccagcaaaa

SEQ ID NO: 5785487 - DNA, 15 bp, Homo sapiens
taagttatcaacttt

SEQ ID NO: 5785488 - DNA, 13 bp, Homo sapiens
taagttatctttg

SEQ ID NO: 5785489 - DNA, 17 bp, Homo sapiens
taagttatgtgcagggg

SEQ ID NO: 5785490 - DNA, 13 bp, Homo sapiens
taagttattacct

SEQ ID NO: 5785491 - DNA, 12 bp, Homo sapiens
taagttattgca

SEQ ID NO: 5785492 - DNA, 14 bp, Homo sapiens
taagttattgcagt

SEQ ID NO: 5785493 - DNA, 20 bp, Homo sapiens
taagttattgcagtttatca

SEQ ID NO: 5785494 - DNA, 12 bp, Homo sapiens
taagttattgct

SEQ ID NO: 5785495 - DNA, 19 bp, Homo sapiens
taagttattgctgcataaa

SEQ ID NO: 5785496 - DNA, 13 bp, Homo sapiens
taagttattgtta

SEQ ID NO: 5785497 - DNA, 20 bp, Homo sapiens
taagttatttcttgtttgtt

SEQ ID NO: 5785498 - DNA, 18 bp, Homo sapiens
taagttattttacctgtt

SEQ ID NO: 5785499 - DNA, 19 bp, Homo sapiens
taagttatttttgtacatg

SEQ ID NO: 5785500 - DNA, 12 bp, Homo sapiens
taagttcataca

SEQ ID NO: 5785501 - DNA, 18 bp, Homo sapiens
taagttcatgtttgtaaa

SEQ ID NO: 5785502 - DNA, 23 bp, Homo sapiens
taagttcccatttccttgtctaa

SEQ ID NO: 5785503 - DNA, 15 bp, Homo sapiens
taagttcctatacct

SEQ ID NO: 5785504 - DNA, 17 bp, Homo sapiens
taagttcctatcttttg

SEQ ID NO: 5785505 - DNA, 17 bp, Homo sapiens
taagttcgaacatgttt

SEQ ID NO: 5785506 - DNA, 17 bp, Homo sapiens
taagttcgaggtggcta

SEQ ID NO: 5785507 - DNA, 15 bp, Homo sapiens
taagttctgtgcagt

SEQ ID NO: 5785508 - DNA, 20 bp, Homo sapiens
taagttcttagatatctttt

SEQ ID NO: 5785509 - DNA, 20 bp, Homo sapiens
taagttctttgatttgtacc

SEQ ID NO: 5785510 - DNA, 20 bp, Homo sapiens
taagttgaaaaaggaaatat

SEQ ID NO: 5785511 - DNA, 13 bp, Homo sapiens
taagttgaaggaa

SEQ ID NO: 5785512 - DNA, 17 bp, Homo sapiens
taagttgaagggaaatc

SEQ ID NO: 5785513 - DNA, 20 bp, Homo sapiens
taagttgacaccacttagat

SEQ ID NO: 5785514 - DNA, 18 bp, Homo sapiens
taagttgagaaggtgcct

SEQ ID NO: 5785515 - DNA, 21 bp, Homo sapiens
taagttgagaaggtgcctgcc

SEQ ID NO: 5785516 - DNA, 15 bp, Homo sapiens
taagttgaggcattt

SEQ ID NO: 5785517 - DNA, 18 bp, Homo sapiens
taagttgagtggaatgtg

SEQ ID NO: 5785518 - DNA, 15 bp, Homo sapiens
taagttgatgttttc

SEQ ID NO: 5785519 - DNA, 16 bp, Homo sapiens
taagttgatgttttct

SEQ ID NO: 5785520 - DNA, 16 bp, Homo sapiens
taagttgcaagatctt

SEQ ID NO: 5785521 - DNA, 13 bp, Homo sapiens
taagttgcattta

SEQ ID NO: 5785522 - DNA, 17 bp, Homo sapiens
taagttgctattttcat

SEQ ID NO: 5785523 - DNA, 23 bp, Homo sapiens
taagttgctgtgtgtctgtcctg

SEQ ID NO: 5785524 - DNA, 13 bp, Homo sapiens
taagttgctttcc

SEQ ID NO: 5785525 - DNA, 12 bp, Homo sapiens
taagttggaaac

SEQ ID NO: 5785526 - DNA, 23 bp, Homo sapiens
taagttggaaacactaaatgtta

SEQ ID NO: 5785527 - DNA, 17 bp, Homo sapiens
taagttggaccagagga

SEQ ID NO: 5785528 - DNA, 15 bp, Homo sapiens
taagttggagcaggg

SEQ ID NO: 5785529 - DNA, 16 bp, Homo sapiens
taagttggcttctgtt

SEQ ID NO: 5785530 - DNA, 13 bp, Homo sapiens
taagttgggcttg

SEQ ID NO: 5785531 - DNA, 16 bp, Homo sapiens
taagttgggcttgcta

SEQ ID NO: 5785532 - DNA, 18 bp, Homo sapiens
taagttgggcttgctatt

SEQ ID NO: 5785533 - DNA, 16 bp, Homo sapiens
taagttggtaaagtat

SEQ ID NO: 5785534 - DNA, 13 bp, Homo sapiens
taagttgtaaaat

SEQ ID NO: 5785535 - DNA, 12 bp, Homo sapiens
taagttgtaaac

SEQ ID NO: 5785536 - DNA, 13 bp, Homo sapiens
taagttgtaaacg

SEQ ID NO: 5785537 - DNA, 20 bp, Homo sapiens
taagttgtacaaatgtattt

SEQ ID NO: 5785538 - DNA, 23 bp, Homo sapiens
taagttgtacaaatgtattttga

SEQ ID NO: 5785539 - DNA, 13 bp, Homo sapiens
taagttgtaccaa

SEQ ID NO: 5785540 - DNA, 16 bp, Homo sapiens
taagttgtaccaaaac

SEQ ID NO: 5785541 - DNA, 18 bp, Homo sapiens
taagttgtaccaaaacat

SEQ ID NO: 5785542 - DNA, 19 bp, Homo sapiens
taagttgtaccaaaacatc

SEQ ID NO: 5785543 - DNA, 20 bp, Homo sapiens
taagttgtaccaaaacatcc

SEQ ID NO: 5785544 - DNA, 22 bp, Homo sapiens
taagttgtataggctaaatgtt

SEQ ID NO: 5785545 - DNA, 14 bp, Homo sapiens
taagttgtattaaa

SEQ ID NO: 5785546 - DNA, 17 bp, Homo sapiens
taagttgtctgtctgaa

SEQ ID NO: 5785547 - DNA, 14 bp, Homo sapiens
taagttgtcttaca

SEQ ID NO: 5785548 - DNA, 16 bp, Homo sapiens
taagttgttatttcag

SEQ ID NO: 5785549 - DNA, 19 bp, Homo sapiens
taagtttaactttaaaact

SEQ ID NO: 5785550 - DNA, 15 bp, Homo sapiens
taagtttagaaatta

SEQ ID NO: 5785551 - DNA, 22 bp, Homo sapiens
taagtttatccaaatcttgaat

SEQ ID NO: 5785552 - DNA, 18 bp, Homo sapiens
taagtttatgtctaaaga

SEQ ID NO: 5785553 - DNA, 17 bp, Homo sapiens
taagtttattttttcta

SEQ ID NO: 5785554 - DNA, 20 bp, Homo sapiens
taagtttcaaacttactatt

SEQ ID NO: 5785555 - DNA, 19 bp, Homo sapiens
taagtttcaggtgacatgt

SEQ ID NO: 5785556 - DNA, 17 bp, Homo sapiens
taagtttcagttgattt

SEQ ID NO: 5785557 - DNA, 12 bp, Homo sapiens
taagtttcattc

SEQ ID NO: 5785558 - DNA, 12 bp, Homo sapiens
taagtttcccct

SEQ ID NO: 5785559 - DNA, 13 bp, Homo sapiens
taagtttctaaga

SEQ ID NO: 5785560 - DNA, 15 bp, Homo sapiens
taagtttctaagatt

SEQ ID NO: 5785561 - DNA, 18 bp, Homo sapiens
taagtttctaagattcta

SEQ ID NO: 5785562 - DNA, 19 bp, Homo sapiens
taagtttctaagattctaa

SEQ ID NO: 5785563 - DNA, 23 bp, Homo sapiens
taagtttctaagattctaaaggt

SEQ ID NO: 5785564 - DNA, 13 bp, Homo sapiens
taagtttctcagc

SEQ ID NO: 5785565 - DNA, 14 bp, Homo sapiens
taagtttctcagct

SEQ ID NO: 5785566 - DNA, 16 bp, Homo sapiens
taagtttctcttcacc

SEQ ID NO: 5785567 - DNA, 14 bp, Homo sapiens
taagtttctgggac

SEQ ID NO: 5785568 - DNA, 12 bp, Homo sapiens
taagtttgaagg

SEQ ID NO: 5785569 - DNA, 12 bp, Homo sapiens
taagtttgatca

SEQ ID NO: 5785570 - DNA, 20 bp, Homo sapiens
taagtttgcaacatttattg

SEQ ID NO: 5785571 - DNA, 21 bp, Homo sapiens
taagtttggcaaacagaatgt

SEQ ID NO: 5785572 - DNA, 17 bp, Homo sapiens
taagtttgtgttagaaa

SEQ ID NO: 5785573 - DNA, 15 bp, Homo sapiens
taagttttagtcttt

SEQ ID NO: 5785574 - DNA, 19 bp, Homo sapiens
taagttttagtctttagaa

SEQ ID NO: 5785575 - DNA, 16 bp, Homo sapiens
taagttttatacataa

SEQ ID NO: 5785576 - DNA, 21 bp, Homo sapiens
taagttttatacataaacagt

SEQ ID NO: 5785577 - DNA, 21 bp, Homo sapiens
taagttttatttaacttttct

SEQ ID NO: 5785578 - DNA, 14 bp, Homo sapiens
taagttttgatata

SEQ ID NO: 5785579 - DNA, 18 bp, Homo sapiens
taagttttgatataatct

SEQ ID NO: 5785580 - DNA, 19 bp, Homo sapiens
taagttttgtgtgtatata

SEQ ID NO: 5785581 - DNA, 14 bp, Homo sapiens
taagtttttcactt

SEQ ID NO: 5785582 - DNA, 15 bp, Homo sapiens
taagttttttttctg

SEQ ID NO: 5785583 - DNA, 21 bp, Homo sapiens
taataaaaaaatatatacaga

SEQ ID NO: 5785584 - DNA, 17 bp, Homo sapiens
taataaaaaacaagaaa

SEQ ID NO: 5785585 - DNA, 15 bp, Homo sapiens
taataaaaaattatg

SEQ ID NO: 5785586 - DNA, 16 bp, Homo sapiens
taataaaaagattgaa

SEQ ID NO: 5785587 - DNA, 22 bp, Homo sapiens
taataaaaagcatttggtgcct

SEQ ID NO: 5785588 - DNA, 14 bp, Homo sapiens
taataaaaagccac

SEQ ID NO: 5785589 - DNA, 14 bp, Homo sapiens
taataaaaagcctc

SEQ ID NO: 5785590 - DNA, 21 bp, Homo sapiens
taataaaaaggagtatacaaa

SEQ ID NO: 5785591 - DNA, 23 bp, Homo sapiens
taataaaaaggagtatacaaaca

SEQ ID NO: 5785592 - DNA, 12 bp, Homo sapiens
taataaaaatac

SEQ ID NO: 5785593 - DNA, 14 bp, Homo sapiens
taataaaaatatat

SEQ ID NO: 5785594 - DNA, 16 bp, Homo sapiens
taataaaaatatatat

SEQ ID NO: 5785595 - DNA, 13 bp, Homo sapiens
taataaaaattat

SEQ ID NO: 5785596 - DNA, 13 bp, Homo sapiens
taataaaaattgt

SEQ ID NO: 5785597 - DNA, 14 bp, Homo sapiens
taataaaaattgta

SEQ ID NO: 5785598 - DNA, 19 bp, Homo sapiens
taataaaaatttattattt

SEQ ID NO: 5785599 - DNA, 17 bp, Homo sapiens
taataaaaatttgttta

SEQ ID NO: 5785600 - DNA, 19 bp, Homo sapiens
taataaaaccaaagaatag

SEQ ID NO: 5785601 - DNA, 22 bp, Homo sapiens
taataaaactgcgaggacatca

SEQ ID NO: 5785602 - DNA, 18 bp, Homo sapiens
taataaaactgtttgact

SEQ ID NO: 5785603 - DNA, 23 bp, Homo sapiens
taataaaactgtttgacttctca

SEQ ID NO: 5785604 - DNA, 11 bp, Homo sapiens
taataaaagaa

SEQ ID NO: 5785605 - DNA, 14 bp, Homo sapiens
taataaaagaacat

SEQ ID NO: 5785606 - DNA, 12 bp, Homo sapiens
taataaaagaat

SEQ ID NO: 5785607 - DNA, 12 bp, Homo sapiens
taataaaagatt

SEQ ID NO: 5785608 - DNA, 19 bp, Homo sapiens
taataaaagcatcttgatc

SEQ ID NO: 5785609 - DNA, 13 bp, Homo sapiens
taataaaaggaaa

SEQ ID NO: 5785610 - DNA, 20 bp, Homo sapiens
taataaaaggaaaagcaaat

SEQ ID NO: 5785611 - DNA, 23 bp, Homo sapiens
taataaaataagtggattttgta

SEQ ID NO: 5785612 - DNA, 13 bp, Homo sapiens
taataaaatacat

SEQ ID NO: 5785613 - DNA, 14 bp, Homo sapiens
taataaaatacata

SEQ ID NO: 5785614 - DNA, 23 bp, Homo sapiens
taataaaataccttttatgtaga

SEQ ID NO: 5785615 - DNA, 13 bp, Homo sapiens
taataaaatactt

SEQ ID NO: 5785616 - DNA, 12 bp, Homo sapiens
taataaaatata

SEQ ID NO: 5785617 - DNA, 12 bp, Homo sapiens
taataaaatatc

SEQ ID NO: 5785618 - DNA, 16 bp, Homo sapiens
taataaaatatcattc

SEQ ID NO: 5785619 - DNA, 17 bp, Homo sapiens
taataaaatatcattca

SEQ ID NO: 5785620 - DNA, 18 bp, Homo sapiens
taataaaatatcattcag

SEQ ID NO: 5785621 - DNA, 12 bp, Homo sapiens
taataaaatatt

SEQ ID NO: 5785622 - DNA, 15 bp, Homo sapiens
taataaaatattttc

SEQ ID NO: 5785623 - DNA, 17 bp, Homo sapiens
taataaaatattttctg

SEQ ID NO: 5785624 - DNA, 18 bp, Homo sapiens
taataaaatattttctgt

SEQ ID NO: 5785625 - DNA, 19 bp, Homo sapiens
taataaaatattttctgtg

SEQ ID NO: 5785626 - DNA, 21 bp, Homo sapiens
taataaaatattttctgtgtg

SEQ ID NO: 5785627 - DNA, 11 bp, Homo sapiens
taataaaatgc

SEQ ID NO: 5785628 - DNA, 12 bp, Homo sapiens
taataaaatgca

SEQ ID NO: 5785629 - DNA, 15 bp, Homo sapiens
taataaaatgcaaat

SEQ ID NO: 5785630 - DNA, 18 bp, Homo sapiens
taataaaatgtgttgaaa

SEQ ID NO: 5785631 - DNA, 22 bp, Homo sapiens
taataaaatgtgttgaaactgc

SEQ ID NO: 5785632 - DNA, 12 bp, Homo sapiens
taataaacactc

SEQ ID NO: 5785633 - DNA, 20 bp, Homo sapiens
taataaacactggctctggg

SEQ ID NO: 5785634 - DNA, 22 bp, Homo sapiens
taataaacactggctctgggac

SEQ ID NO: 5785635 - DNA, 14 bp, Homo sapiens
taatcactcccatt

SEQ ID NO: 5785636 - DNA, 20 bp, Homo sapiens
taatcactcccatttttact

SEQ ID NO: 5785637 - DNA, 22 bp, Homo sapiens
taatcactcccatttttactta

SEQ ID NO: 5785638 - DNA, 13 bp, Homo sapiens
taatcactgtgta

SEQ ID NO: 5785639 - DNA, 19 bp, Homo sapiens
taatcacttaacattccta

SEQ ID NO: 5785640 - DNA, 19 bp, Homo sapiens
taatcacttaacctgcttt

SEQ ID NO: 5785641 - DNA, 19 bp, Homo sapiens
taatcacttttttccacat

SEQ ID NO: 5785642 - DNA, 20 bp, Homo sapiens
taatcagaaaagtaattttg

SEQ ID NO: 5785643 - DNA, 13 bp, Homo sapiens
taatcagaaaccc

SEQ ID NO: 5785644 - DNA, 22 bp, Homo sapiens
taatcagaaaccccacttccat

SEQ ID NO: 5785645 - DNA, 22 bp, Homo sapiens
taatcagaatggaagagagaaa

SEQ ID NO: 5785646 - DNA, 20 bp, Homo sapiens
taatcagagttaccattatt

SEQ ID NO: 5785647 - DNA, 22 bp, Homo sapiens
taatcagatgatggccatttct

SEQ ID NO: 5785648 - DNA, 20 bp, Homo sapiens
taatcagcaatattgcctgt

SEQ ID NO: 5785649 - DNA, 16 bp, Homo sapiens
taatcagccccagagt

SEQ ID NO: 5785650 - DNA, 21 bp, Homo sapiens
taatcagccccagagtgcttt

SEQ ID NO: 5785651 - DNA, 15 bp, Homo sapiens
taatcagcctcttaa

SEQ ID NO: 5785652 - DNA, 16 bp, Homo sapiens
taatcagctgttgcag

SEQ ID NO: 5785653 - DNA, 18 bp, Homo sapiens
taatcagctgttgcaggc

SEQ ID NO: 5785654 - DNA, 17 bp, Homo sapiens
taatcaggaaaaatgag

SEQ ID NO: 5785655 - DNA, 15 bp, Homo sapiens
taatcaggcaaggag

SEQ ID NO: 5785656 - DNA, 14 bp, Homo sapiens
taatcaggcagcct

SEQ ID NO: 5785657 - DNA, 15 bp, Homo sapiens
taatcaggcagcctt

SEQ ID NO: 5785658 - DNA, 19 bp, Homo sapiens
taatcaggtcctcagagaa

SEQ ID NO: 5785659 - DNA, 18 bp, Homo sapiens
taatcaggttgttaatgt

SEQ ID NO: 5785660 - DNA, 13 bp, Homo sapiens
taatcagtaaata

SEQ ID NO: 5785661 - DNA, 14 bp, Homo sapiens
taatcagtcatttc

SEQ ID NO: 5785662 - DNA, 14 bp, Homo sapiens
taatcagtgactga

SEQ ID NO: 5785663 - DNA, 21 bp, Homo sapiens
taatcagtgactgaaaccatt

SEQ ID NO: 5785664 - DNA, 22 bp, Homo sapiens
taatcagtgtagccccaagaag

SEQ ID NO: 5785665 - DNA, 17 bp, Homo sapiens
taatcagtgtctcacac

SEQ ID NO: 5785666 - DNA, 12 bp, Homo sapiens
taatcagtgtga

SEQ ID NO: 5785667 - DNA, 18 bp, Homo sapiens
taatcagtgtgtctaaat

SEQ ID NO: 5785668 - DNA, 23 bp, Homo sapiens
taatcagtgtgtctaaatttgaa

SEQ ID NO: 5785669 - DNA, 22 bp, Homo sapiens
taatcagttactggtatctgtc

SEQ ID NO: 5785670 - DNA, 17 bp, Homo sapiens
taatcagttctgtgtgg

SEQ ID NO: 5785671 - DNA, 14 bp, Homo sapiens
taatcatacaaact

SEQ ID NO: 5785672 - DNA, 15 bp, Homo sapiens
taatcatacaaactc

SEQ ID NO: 5785673 - DNA, 18 bp, Homo sapiens
taatcatacaaactctca

SEQ ID NO: 5785674 - DNA, 17 bp, Homo sapiens
taatcatagttactgtg

SEQ ID NO: 5785675 - DNA, 15 bp, Homo sapiens
taatcatatttgaaa

SEQ ID NO: 5785676 - DNA, 22 bp, Homo sapiens
taatcatcaagagaatttgggg

SEQ ID NO: 5785677 - DNA, 20 bp, Homo sapiens
taatcatccccatcctccag

SEQ ID NO: 5785678 - DNA, 20 bp, Homo sapiens
taatcatccttttttaaaaa

SEQ ID NO: 5785679 - DNA, 13 bp, Homo sapiens
taatcatcttctc

SEQ ID NO: 5785680 - DNA, 18 bp, Homo sapiens
taatcatcttctcttttt

SEQ ID NO: 5785681 - DNA, 16 bp, Homo sapiens
taatcatgaaattact

SEQ ID NO: 5785682 - DNA, 21 bp, Homo sapiens
taatcatgaaattacttatca

SEQ ID NO: 5785683 - DNA, 15 bp, Homo sapiens
taatcatgaaccaat

SEQ ID NO: 5785684 - DNA, 13 bp, Homo sapiens
taatcatgaatgt

SEQ ID NO: 5785685 - DNA, 17 bp, Homo sapiens
taatcatgaatgtgtaa

SEQ ID NO: 5785686 - DNA, 16 bp, Homo sapiens
taatcatgagaaaaac

SEQ ID NO: 5785687 - DNA, 21 bp, Homo sapiens
taatcatgagcctgtttattg

SEQ ID NO: 5785688 - DNA, 21 bp, Homo sapiens
taatcatgctcatgtatattt

SEQ ID NO: 5785689 - DNA, 19 bp, Homo sapiens
taatcatggctcttagaaa

SEQ ID NO: 5785690 - DNA, 19 bp, Homo sapiens
taatcatgtgggtgagcca

SEQ ID NO: 5785691 - DNA, 13 bp, Homo sapiens
taatcattacctt

SEQ ID NO: 5785692 - DNA, 14 bp, Homo sapiens
taatcattatttga

SEQ ID NO: 5785693 - DNA, 20 bp, Homo sapiens
taatcattcttatttcatga

SEQ ID NO: 5785694 - DNA, 22 bp, Homo sapiens
taatcattcttatttcatgaaa

SEQ ID NO: 5785695 - DNA, 20 bp, Homo sapiens
taatcattgcttatgtcaaa

SEQ ID NO: 5785696 - DNA, 23 bp, Homo sapiens
taatcatttatcttatctagcaa

SEQ ID NO: 5785697 - DNA, 19 bp, Homo sapiens
taatcatttccagcaaaat

SEQ ID NO: 5785698 - DNA, 16 bp, Homo sapiens
taatcatttccccata

SEQ ID NO: 5785699 - DNA, 12 bp, Homo sapiens
taatcatttctt

SEQ ID NO: 5785700 - DNA, 19 bp, Homo sapiens
taatcatttgatttaaaca

SEQ ID NO: 5785701 - DNA, 19 bp, Homo sapiens
taatcattttaataaagtt

SEQ ID NO: 5785702 - DNA, 13 bp, Homo sapiens
taatcattttcat

SEQ ID NO: 5785703 - DNA, 18 bp, Homo sapiens
taatcattttcattccta

SEQ ID NO: 5785704 - DNA, 22 bp, Homo sapiens
taatccaaagcttattttgtaa

SEQ ID NO: 5785705 - DNA, 23 bp, Homo sapiens
taatccaaagcttattttgtaag

SEQ ID NO: 5785706 - DNA, 19 bp, Homo sapiens
taatccaatacctcttgga

SEQ ID NO: 5785707 - DNA, 14 bp, Homo sapiens
taatccacccccag

SEQ ID NO: 5785708 - DNA, 13 bp, Homo sapiens
taatccagctgat

SEQ ID NO: 5785709 - DNA, 12 bp, Homo sapiens
taatccagtaaa

SEQ ID NO: 5785710 - DNA, 18 bp, Homo sapiens
taatccattccaaaatac

SEQ ID NO: 5785711 - DNA, 18 bp, Homo sapiens
taatccatttcaggactc

SEQ ID NO: 5785712 - DNA, 21 bp, Homo sapiens
taatcccagcattttgggaag

SEQ ID NO: 5785713 - DNA, 23 bp, Homo sapiens
taatcccagctacccaggaggct

SEQ ID NO: 5785714 - DNA, 20 bp, Homo sapiens
taatcccagctacttgggaa

SEQ ID NO: 5785715 - DNA, 15 bp, Homo sapiens
taatcccccaggaga

SEQ ID NO: 5785716 - DNA, 15 bp, Homo sapiens
taatcccgtgcccct

SEQ ID NO: 5785717 - DNA, 14 bp, Homo sapiens
taatccctgctttt

SEQ ID NO: 5785718 - DNA, 20 bp, Homo sapiens
taatcctagccccgagacac

SEQ ID NO: 5785719 - DNA, 17 bp, Homo sapiens
taatcctagctgtgtgc

SEQ ID NO: 5785720 - DNA, 21 bp, Homo sapiens
taatcctatctggggagctcc

SEQ ID NO: 5785721 - DNA, 13 bp, Homo sapiens
taatcctgaattc

SEQ ID NO: 5785722 - DNA, 21 bp, Homo sapiens
taatcctgtaccaaatctgac

SEQ ID NO: 5785723 - DNA, 22 bp, Homo sapiens
taatcctgtaggaaggtactgt

SEQ ID NO: 5785724 - DNA, 19 bp, Homo sapiens
taatccttctagtttccca

SEQ ID NO: 5785725 - DNA, 16 bp, Homo sapiens
taatccttgataatat

SEQ ID NO: 5785726 - DNA, 16 bp, Homo sapiens
taatcctttgttttct

SEQ ID NO: 5785727 - DNA, 22 bp, Homo sapiens
taatcctttgttttctgactaa

SEQ ID NO: 5785728 - DNA, 15 bp, Homo sapiens
taatccttttcctta

SEQ ID NO: 5785729 - DNA, 20 bp, Homo sapiens
taatccttttccttatttgc

SEQ ID NO: 5785730 - DNA, 13 bp, Homo sapiens
taatcgaagcaaa

SEQ ID NO: 5785731 - DNA, 23 bp, Homo sapiens
taatcgactcaaaaataagtcat

SEQ ID NO: 5785732 - DNA, 18 bp, Homo sapiens
taatcgagtctacctctt

SEQ ID NO: 5785733 - DNA, 15 bp, Homo sapiens
taatcggttgaccct

SEQ ID NO: 5785734 - DNA, 23 bp, Homo sapiens
taatcggttgaccctactgtgga

SEQ ID NO: 5785735 - DNA, 16 bp, Homo sapiens
taatcgttatgtgtgt

SEQ ID NO: 5785736 - DNA, 18 bp, Homo sapiens
taatcgttatgtgtgtat

SEQ ID NO: 5785737 - DNA, 16 bp, Homo sapiens
taatcgtttttgtttt

SEQ ID NO: 5785738 - DNA, 14 bp, Homo sapiens
taatctaaaatgat

SEQ ID NO: 5785739 - DNA, 20 bp, Homo sapiens
taatctaagtatatgtgaga

SEQ ID NO: 5785740 - DNA, 17 bp, Homo sapiens
taatctaattctaagga

SEQ ID NO: 5785741 - DNA, 10 bp, Homo sapiens
taatctacac

SEQ ID NO: 5785742 - DNA, 17 bp, Homo sapiens
taatctacaccaatgaa

SEQ ID NO: 5785743 - DNA, 19 bp, Homo sapiens
taatctacaccaatgaaaa

SEQ ID NO: 5785744 - DNA, 20 bp, Homo sapiens
taatctacaccaatgaaaac

SEQ ID NO: 5785745 - DNA, 14 bp, Homo sapiens
taatctaccagtgg

SEQ ID NO: 5785746 - DNA, 22 bp, Homo sapiens
taatctaccagtggtgctcaat

SEQ ID NO: 5785747 - DNA, 22 bp, Homo sapiens
taatctactccttgtaaagact

SEQ ID NO: 5785748 - DNA, 16 bp, Homo sapiens
taatctactgcattta

SEQ ID NO: 5785749 - DNA, 20 bp, Homo sapiens
taatctactttttgtattta

SEQ ID NO: 5785750 - DNA, 21 bp, Homo sapiens
taatctactttttgtatttag

SEQ ID NO: 5785751 - DNA, 22 bp, Homo sapiens
taatctagaacacaggcaaaat

SEQ ID NO: 5785752 - DNA, 16 bp, Homo sapiens
taatctagagctatgc

SEQ ID NO: 5785753 - DNA, 23 bp, Homo sapiens
taatctagagctatgcacaccaa

SEQ ID NO: 5785754 - DNA, 20 bp, Homo sapiens
taatctagtgacacctcagt

SEQ ID NO: 5785755 - DNA, 16 bp, Homo sapiens
taatctagttgtcaat

SEQ ID NO: 5785756 - DNA, 12 bp, Homo sapiens
taatctatatta

SEQ ID NO: 5785757 - DNA, 14 bp, Homo sapiens
taatctatattaaa

SEQ ID NO: 5785758 - DNA, 17 bp, Homo sapiens
taatctatattaaatga

SEQ ID NO: 5785759 - DNA, 18 bp, Homo sapiens
taatctatgtgtttctgt

SEQ ID NO: 5785760 - DNA, 24 bp, Homo sapiens
taatctatgtgtttctgtaacaaa

SEQ ID NO: 5785761 - DNA, 14 bp, Homo sapiens
taatctatgtttat

SEQ ID NO: 5785762 - DNA, 15 bp, Homo sapiens
taatctatgtttata

SEQ ID NO: 5785763 - DNA, 16 bp, Homo sapiens
taatctattgggttca

SEQ ID NO: 5785764 - DNA, 18 bp, Homo sapiens
taatctattgggttcatt

SEQ ID NO: 5785765 - DNA, 22 bp, Homo sapiens
taatctattgggttcattattg

SEQ ID NO: 5785766 - DNA, 15 bp, Homo sapiens
taatctcaaaggaga

SEQ ID NO: 5785767 - DNA, 17 bp, Homo sapiens
taatctcaaaggagaaa

SEQ ID NO: 5785768 - DNA, 22 bp, Homo sapiens
taatctcaatttaagatacaaa

SEQ ID NO: 5785769 - DNA, 21 bp, Homo sapiens
taatctcacagcatttgccaa

SEQ ID NO: 5785770 - DNA, 16 bp, Homo sapiens
taatctcacttcatca

SEQ ID NO: 5785771 - DNA, 14 bp, Homo sapiens
taatctcatccccc

SEQ ID NO: 5785772 - DNA, 16 bp, Homo sapiens
taatctccaactttat

SEQ ID NO: 5785773 - DNA, 18 bp, Homo sapiens
taatctccaactttattt

SEQ ID NO: 5785774 - DNA, 22 bp, Homo sapiens
taatctccaactttattttgaa

SEQ ID NO: 5785775 - DNA, 13 bp, Homo sapiens
taatctccacagt

SEQ ID NO: 5785776 - DNA, 12 bp, Homo sapiens
taatctcccagc

SEQ ID NO: 5785777 - DNA, 23 bp, Homo sapiens
taatctcctattccttcacacag

SEQ ID NO: 5785778 - DNA, 18 bp, Homo sapiens
taatctcctcttttatct

SEQ ID NO: 5785779 - DNA, 13 bp, Homo sapiens
taatctctaaaat

SEQ ID NO: 5785780 - DNA, 18 bp, Homo sapiens
taatctctaaaattctag

SEQ ID NO: 5785781 - DNA, 14 bp, Homo sapiens
taatctctaggaag

SEQ ID NO: 5785782 - DNA, 13 bp, Homo sapiens
taatctctccacc

SEQ ID NO: 5785783 - DNA, 20 bp, Homo sapiens
taatctctccaccttccaaa

SEQ ID NO: 5785784 - DNA, 17 bp, Homo sapiens
taatctctctgcagctg

SEQ ID NO: 5785785 - DNA, 18 bp, Homo sapiens
taatctctctgcagctgc

SEQ ID NO: 5785786 - DNA, 20 bp, Homo sapiens
taatctctctgcagctgccg

SEQ ID NO: 5785787 - DNA, 13 bp, Homo sapiens
taatctctggaaa

SEQ ID NO: 5785788 - DNA, 17 bp, Homo sapiens
taatctctgttatgtac

SEQ ID NO: 5785789 - DNA, 21 bp, Homo sapiens
taatctctgttatgtactgta

SEQ ID NO: 5785790 - DNA, 15 bp, Homo sapiens
taatctcttcttata

SEQ ID NO: 5785791 - DNA, 19 bp, Homo sapiens
taatctcttgtcattctca

SEQ ID NO: 5785792 - DNA, 22 bp, Homo sapiens
taatctctttggttcctgtata

SEQ ID NO: 5785793 - DNA, 21 bp, Homo sapiens
taatctgaaaggatgtggaag

SEQ ID NO: 5785794 - DNA, 23 bp, Homo sapiens
taatctgaagatatatttcactt

SEQ ID NO: 5785795 - DNA, 13 bp, Homo sapiens
taatctgaataaa

SEQ ID NO: 5785796 - DNA, 20 bp, Homo sapiens
taatctgaataaagtgtaac

SEQ ID NO: 5785797 - DNA, 17 bp, Homo sapiens
taatctgacttctcact

SEQ ID NO: 5785798 - DNA, 14 bp, Homo sapiens
taatctgagaaaca

SEQ ID NO: 5785799 - DNA, 12 bp, Homo sapiens
taatctgagcag

SEQ ID NO: 5785800 - DNA, 20 bp, Homo sapiens
taatctgagctgcagcctgg

SEQ ID NO: 5785801 - DNA, 20 bp, Homo sapiens
taatctgatggcttctccag

SEQ ID NO: 5785802 - DNA, 13 bp, Homo sapiens
taatctgatgtat

SEQ ID NO: 5785803 - DNA, 20 bp, Homo sapiens
taatctgatgtataatgtaa

SEQ ID NO: 5785804 - DNA, 22 bp, Homo sapiens
taatctgattatacaccatttt

SEQ ID NO: 5785805 - DNA, 14 bp, Homo sapiens
taatctgcatttat

SEQ ID NO: 5785806 - DNA, 12 bp, Homo sapiens
taatctgcctgg

SEQ ID NO: 5785807 - DNA, 22 bp, Homo sapiens
taatctgctttgttaatgaaaa

SEQ ID NO: 5785808 - DNA, 19 bp, Homo sapiens
taatctggcactactcagt

SEQ ID NO: 5785809 - DNA, 17 bp, Homo sapiens
taatctgggcagacatt

SEQ ID NO: 5785810 - DNA, 15 bp, Homo sapiens
taatctggtgacaaa

SEQ ID NO: 5785811 - DNA, 23 bp, Homo sapiens
taatctgtacattttgttgtaaa

SEQ ID NO: 5785812 - DNA, 11 bp, Homo sapiens
taatgtatctt

SEQ ID NO: 5785813 - DNA, 12 bp, Homo sapiens
taatgtatctta

SEQ ID NO: 5785814 - DNA, 13 bp, Homo sapiens
taatgtatcttaa

SEQ ID NO: 5785815 - DNA, 14 bp, Homo sapiens
taatgtatcttatt

SEQ ID NO: 5785816 - DNA, 20 bp, Homo sapiens
taatgtatgtaggagctgca

SEQ ID NO: 5785817 - DNA, 16 bp, Homo sapiens
taatgtattatgagcc

SEQ ID NO: 5785818 - DNA, 14 bp, Homo sapiens
taatgtattcatat

SEQ ID NO: 5785819 - DNA, 20 bp, Homo sapiens
taatgtattcatatttgtac

SEQ ID NO: 5785820 - DNA, 14 bp, Homo sapiens
taatgtattccctt

SEQ ID NO: 5785821 - DNA, 14 bp, Homo sapiens
taatgtatttgaaa

SEQ ID NO: 5785822 - DNA, 23 bp, Homo sapiens
taatgtatttgaaaattacatgt

SEQ ID NO: 5785823 - DNA, 19 bp, Homo sapiens
taatgtattttattgtaac

SEQ ID NO: 5785824 - DNA, 16 bp, Homo sapiens
taatgtatttttgtaa

SEQ ID NO: 5785825 - DNA, 17 bp, Homo sapiens
taatgtcacaggcaggt

SEQ ID NO: 5785826 - DNA, 18 bp, Homo sapiens
taatgtcacaggcaggtc

SEQ ID NO: 5785827 - DNA, 15 bp, Homo sapiens
taatgtcaccacctt

SEQ ID NO: 5785828 - DNA, 22 bp, Homo sapiens
taatgtcaccaccttcccagct

SEQ ID NO: 5785829 - DNA, 11 bp, Homo sapiens
taatgtcactg

SEQ ID NO: 5785830 - DNA, 17 bp, Homo sapiens
taatgtcagtatttcaa

SEQ ID NO: 5785831 - DNA, 15 bp, Homo sapiens
taatgtcatggcctt

SEQ ID NO: 5785832 - DNA, 13 bp, Homo sapiens
taatgtcattgct

SEQ ID NO: 5785833 - DNA, 16 bp, Homo sapiens
taatgtcattgctaaa

SEQ ID NO: 5785834 - DNA, 16 bp, Homo sapiens
taatgtccccactccc

SEQ ID NO: 5785835 - DNA, 15 bp, Homo sapiens
taatgtctagatttt

SEQ ID NO: 5785836 - DNA, 19 bp, Homo sapiens
taatgtctagattttgaaa

SEQ ID NO: 5785837 - DNA, 16 bp, Homo sapiens
taatgtctcttctaac

SEQ ID NO: 5785838 - DNA, 17 bp, Homo sapiens
taatgtctgcagctcaa

SEQ ID NO: 5785839 - DNA, 17 bp, Homo sapiens
taatgtctggtgtttgt

SEQ ID NO: 5785840 - DNA, 21 bp, Homo sapiens
taatgtctggtgtttgtcatg

SEQ ID NO: 5785841 - DNA, 19 bp, Homo sapiens
taatgtctgtataaataat

SEQ ID NO: 5785842 - DNA, 17 bp, Homo sapiens
taatgtctgtttattaa

SEQ ID NO: 5785843 - DNA, 15 bp, Homo sapiens
taatgtcttcataaa

SEQ ID NO: 5785844 - DNA, 19 bp, Homo sapiens
taatgtcttcatttcattg

SEQ ID NO: 5785845 - DNA, 21 bp, Homo sapiens
taatgtcttcatttcattgta

SEQ ID NO: 5785846 - DNA, 13 bp, Homo sapiens
taatgtcttgagc

SEQ ID NO: 5785847 - DNA, 13 bp, Homo sapiens
taatgtcttgtta

SEQ ID NO: 5785848 - DNA, 19 bp, Homo sapiens
taatgtctttaaaaagcat

SEQ ID NO: 5785849 - DNA, 14 bp, Homo sapiens
taatgtctttgtgt

SEQ ID NO: 5785850 - DNA, 13 bp, Homo sapiens
taatgtgaaaatc

SEQ ID NO: 5785851 - DNA, 14 bp, Homo sapiens
taatgtgaaaatca

SEQ ID NO: 5785852 - DNA, 21 bp, Homo sapiens
taatgtgaaaatggtccagga

SEQ ID NO: 5785853 - DNA, 12 bp, Homo sapiens
taatgtgaaact

SEQ ID NO: 5785854 - DNA, 22 bp, Homo sapiens
taatgtgaaatatgatgagatt

SEQ ID NO: 5785855 - DNA, 23 bp, Homo sapiens
taatgtgaaatgtaactgtccgt

SEQ ID NO: 5785856 - DNA, 10 bp, Homo sapiens
taatgtgaac

SEQ ID NO: 5785857 - DNA, 21 bp, Homo sapiens
taatgtgaactctcccctccc

SEQ ID NO: 5785858 - DNA, 18 bp, Homo sapiens
taatgtgaagacattttt

SEQ ID NO: 5785859 - DNA, 16 bp, Homo sapiens
taatgtgaaggcccaa

SEQ ID NO: 5785860 - DNA, 10 bp, Homo sapiens
taatgtgaat

SEQ ID NO: 5785861 - DNA, 20 bp, Homo sapiens
taatgtgaatatgccagtga

SEQ ID NO: 5785862 - DNA, 13 bp, Homo sapiens
taatgtgaatttt

SEQ ID NO: 5785863 - DNA, 21 bp, Homo sapiens
taatgtgaatttttgcctatc

SEQ ID NO: 5785864 - DNA, 20 bp, Homo sapiens
taatgtgacagtgttcagta

SEQ ID NO: 5785865 - DNA, 19 bp, Homo sapiens
taatgtgagacagcaagtt

SEQ ID NO: 5785866 - DNA, 20 bp, Homo sapiens
taatgtgagtttggtctgga

SEQ ID NO: 5785867 - DNA, 22 bp, Homo sapiens
taatgtgatcatatgaggacct

SEQ ID NO: 5785868 - DNA, 20 bp, Homo sapiens
taatgtgatgatgtaattga

SEQ ID NO: 5785869 - DNA, 13 bp, Homo sapiens
taatgtgattttt

SEQ ID NO: 5785870 - DNA, 17 bp, Homo sapiens
taatgtgcaaattttgc

SEQ ID NO: 5785871 - DNA, 21 bp, Homo sapiens
taatgtgcaaattttgcattt

SEQ ID NO: 5785872 - DNA, 22 bp, Homo sapiens
taatgtgcagggatattgcctt

SEQ ID NO: 5785873 - DNA, 23 bp, Homo sapiens
taatgtgcagggatattgcctta

SEQ ID NO: 5785874 - DNA, 22 bp, Homo sapiens
taatgtgccaaaatgtcaattt

SEQ ID NO: 5785875 - DNA, 19 bp, Homo sapiens
taatgtgccccatgtccaa

SEQ ID NO: 5785876 - DNA, 11 bp, Homo sapiens
taatgtgcctg

SEQ ID NO: 5785877 - DNA, 14 bp, Homo sapiens
taatgtgctgctgc

SEQ ID NO: 5785878 - DNA, 12 bp, Homo sapiens
taatgtgctgtg

SEQ ID NO: 5785879 - DNA, 15 bp, Homo sapiens
taatgtgctgtgtaa

SEQ ID NO: 5785880 - DNA, 22 bp, Homo sapiens
taatgtgctgtgtaaagttagt

SEQ ID NO: 5785881 - DNA, 17 bp, Homo sapiens
taatgtggaagaaaatg

SEQ ID NO: 5785882 - DNA, 17 bp, Homo sapiens
taatgtggaataggata

SEQ ID NO: 5785883 - DNA, 23 bp, Homo sapiens
taatgtggatttcctattttaaa

SEQ ID NO: 5785884 - DNA, 18 bp, Homo sapiens
taatgtgggaagaaacaa

SEQ ID NO: 5785885 - DNA, 22 bp, Homo sapiens
taatgtgggaagaaacaaaccc

SEQ ID NO: 5785886 - DNA, 12 bp, Homo sapiens
taatgtggtagt

SEQ ID NO: 5785887 - DNA, 20 bp, Homo sapiens
taatgtgtaaaattggatta

SEQ ID NO: 5785888 - DNA, 17 bp, Homo sapiens
taatgtgtagttcatgt

SEQ ID NO: 5785889 - DNA, 21 bp, Homo sapiens
taatgtgtatttactgtacta

SEQ ID NO: 5785890 - DNA, 16 bp, Homo sapiens
taatgtgtcaaagaga

SEQ ID NO: 5785891 - DNA, 16 bp, Homo sapiens
taatgtgtctgtggac

SEQ ID NO: 5785892 - DNA, 13 bp, Homo sapiens
taatgtgtgtatg

SEQ ID NO: 5785893 - DNA, 15 bp, Homo sapiens
taatgtgtgtatgtg

SEQ ID NO: 5785894 - DNA, 16 bp, Homo sapiens
taatgtgtgtatgtgt

SEQ ID NO: 5785895 - DNA, 17 bp, Homo sapiens
taatgtgtgttgtgtga

SEQ ID NO: 5785896 - DNA, 18 bp, Homo sapiens
taatgttaaacaccattt

SEQ ID NO: 5785897 - DNA, 22 bp, Homo sapiens
taatgttaaatttgtaagtttc

SEQ ID NO: 5785898 - DNA, 17 bp, Homo sapiens
taatgttaactttcaaa

SEQ ID NO: 5785899 - DNA, 15 bp, Homo sapiens
taatgttacaacaac

SEQ ID NO: 5785900 - DNA, 18 bp, Homo sapiens
taatgttacatagtaaat

SEQ ID NO: 5785901 - DNA, 12 bp, Homo sapiens
taatgttactga

SEQ ID NO: 5785902 - DNA, 19 bp, Homo sapiens
taatgttaggggtatttaa

SEQ ID NO: 5785903 - DNA, 22 bp, Homo sapiens
taatgttatacatcctattttg

SEQ ID NO: 5785904 - DNA, 18 bp, Homo sapiens
taatgttatatcatatgt

SEQ ID NO: 5785905 - DNA, 16 bp, Homo sapiens
taatgttatttcttaa

SEQ ID NO: 5785906 - DNA, 16 bp, Homo sapiens
taatgttattttcctt

SEQ ID NO: 5785907 - DNA, 20 bp, Homo sapiens
taatgttattttccttctga

SEQ ID NO: 5785908 - DNA, 16 bp, Homo sapiens
taatgttcattttgaa

SEQ ID NO: 5785909 - DNA, 18 bp, Homo sapiens
taatgttccccgtggcta

SEQ ID NO: 5785910 - DNA, 16 bp, Homo sapiens
taatgttctaaattct

SEQ ID NO: 5785911 - DNA, 20 bp, Homo sapiens
taatgttctgaataatttct

SEQ ID NO: 5785912 - DNA, 18 bp, Homo sapiens
taatgttctgacagttgt

SEQ ID NO: 5785913 - DNA, 18 bp, Homo sapiens
taatgttctgtgatacag

SEQ ID NO: 5785914 - DNA, 23 bp, Homo sapiens
taatgttcttatgcaaaatggaa

SEQ ID NO: 5785915 - DNA, 16 bp, Homo sapiens
taatgttctttaatgt

SEQ ID NO: 5785916 - DNA, 13 bp, Homo sapiens
taatgttgaatgt

SEQ ID NO: 5785917 - DNA, 13 bp, Homo sapiens
taatgttgataat

SEQ ID NO: 5785918 - DNA, 19 bp, Homo sapiens
taatgttgataatatatat

SEQ ID NO: 5785919 - DNA, 18 bp, Homo sapiens
taatgttgatcagcaaat

SEQ ID NO: 5785920 - DNA, 20 bp, Homo sapiens
taatgttgattttaatcctg

SEQ ID NO: 5785921 - DNA, 22 bp, Homo sapiens
taatgttgccttggaaacattt

SEQ ID NO: 5785922 - DNA, 14 bp, Homo sapiens
taatgttggtgtgg

SEQ ID NO: 5785923 - DNA, 20 bp, Homo sapiens
taatgttgtatgtcttgttt

SEQ ID NO: 5785924 - DNA, 20 bp, Homo sapiens
taatgtttaaaatttcttag

SEQ ID NO: 5785925 - DNA, 20 bp, Homo sapiens
taatgtttaaatcatgtatg

SEQ ID NO: 5785926 - DNA, 19 bp, Homo sapiens
taatgtttactatatagaa

SEQ ID NO: 5785927 - DNA, 15 bp, Homo sapiens
taatgtttatacaga

SEQ ID NO: 5785928 - DNA, 17 bp, Homo sapiens
taatgtttatgagccag

SEQ ID NO: 5785929 - DNA, 16 bp, Homo sapiens
taatgtttattaaatg

SEQ ID NO: 5785930 - DNA, 14 bp, Homo sapiens
taatgtttcaaaca

SEQ ID NO: 5785931 - DNA, 18 bp, Homo sapiens
taatgtttccctcaagaa

SEQ ID NO: 5785932 - DNA, 11 bp, Homo sapiens
taatgtttcct

SEQ ID NO: 5785933 - DNA, 21 bp, Homo sapiens
taatgtttctgatttctgaag

SEQ ID NO: 5785934 - DNA, 22 bp, Homo sapiens
taatgtttctggatttcatact

SEQ ID NO: 5785935 - DNA, 14 bp, Homo sapiens
taatgtttgaacaa

SEQ ID NO: 5785936 - DNA, 17 bp, Homo sapiens
taatgtttgatagtaaa

SEQ ID NO: 5785937 - DNA, 16 bp, Homo sapiens
taatgtttgatttagt

SEQ ID NO: 5785938 - DNA, 15 bp, Homo sapiens
taatgtttgcatata

SEQ ID NO: 5785939 - DNA, 16 bp, Homo sapiens
taatgtttgcatataa

SEQ ID NO: 5785940 - DNA, 13 bp, Homo sapiens
taatgtttgctat

SEQ ID NO: 5785941 - DNA, 12 bp, Homo sapiens
taatgtttgtaa

SEQ ID NO: 5785942 - DNA, 17 bp, Homo sapiens
taatgtttgtaagcaat

SEQ ID NO: 5785943 - DNA, 14 bp, Homo sapiens
taatgtttgtgaga

SEQ ID NO: 5785944 - DNA, 17 bp, Homo sapiens
taatgttttaaatgtac

SEQ ID NO: 5785945 - DNA, 20 bp, Homo sapiens
taatgttttaaatgtacaga

SEQ ID NO: 5785946 - DNA, 18 bp, Homo sapiens
taatgttttctttgcaaa

SEQ ID NO: 5785947 - DNA, 22 bp, Homo sapiens
taatgttttctttgcaaagtat

SEQ ID NO: 5785948 - DNA, 15 bp, Homo sapiens
taatgttttgtatat

SEQ ID NO: 5785949 - DNA, 22 bp, Homo sapiens
taatgttttgtatatacagtta

SEQ ID NO: 5785950 - DNA, 10 bp, Homo sapiens
taatgttttt

SEQ ID NO: 5785951 - DNA, 16 bp, Homo sapiens
taatgtttttaatatt

SEQ ID NO: 5785952 - DNA, 23 bp, Homo sapiens
taatgtttttatttcaattgttt

SEQ ID NO: 5785953 - DNA, 23 bp, Homo sapiens
taatgtttttctctataaagggt

SEQ ID NO: 5785954 - DNA, 23 bp, Homo sapiens
taatgttttttgccacagctttt

SEQ ID NO: 5785955 - DNA, 22 bp, Homo sapiens
taattaaaaaaatttttttccc

SEQ ID NO: 5785956 - DNA, 19 bp, Homo sapiens
taattaaaaactagtagtt

SEQ ID NO: 5785957 - DNA, 23 bp, Homo sapiens
taattaaaaactgtgatttttat

SEQ ID NO: 5785958 - DNA, 14 bp, Homo sapiens
taattaaaaacttt

SEQ ID NO: 5785959 - DNA, 20 bp, Homo sapiens
taattaaaaactttaaagat

SEQ ID NO: 5785960 - DNA, 22 bp, Homo sapiens
taattaaaaagcgaattatact

SEQ ID NO: 5785961 - DNA, 17 bp, Homo sapiens
taattaaaacacaacat

SEQ ID NO: 5785962 - DNA, 15 bp, Homo sapiens
taattaaaactattt

SEQ ID NO: 5785963 - DNA, 20 bp, Homo sapiens
taattaaaagaatattttaa

SEQ ID NO: 5785964 - DNA, 15 bp, Homo sapiens
taattaaaataagaa

SEQ ID NO: 5785965 - DNA, 17 bp, Homo sapiens
taattaaaatgtgcagt

SEQ ID NO: 5785966 - DNA, 14 bp, Homo sapiens
taattaaaatttgg

SEQ ID NO: 5785967 - DNA, 15 bp, Homo sapiens
taattaaaatttggg

SEQ ID NO: 5785968 - DNA, 21 bp, Homo sapiens
taattaaacattgtgatcatt

SEQ ID NO: 5785969 - DNA, 22 bp, Homo sapiens
taattaaaccagactctgttgc

SEQ ID NO: 5785970 - DNA, 18 bp, Homo sapiens
taattaaactagtttaag

SEQ ID NO: 5785971 - DNA, 15 bp, Homo sapiens
taattaaacttcttt

SEQ ID NO: 5785972 - DNA, 17 bp, Homo sapiens
taattaaagaaaattgc

SEQ ID NO: 5785973 - DNA, 12 bp, Homo sapiens
taattaaagatg

SEQ ID NO: 5785974 - DNA, 17 bp, Homo sapiens
taattaaagatgccata

SEQ ID NO: 5785975 - DNA, 18 bp, Homo sapiens
taattaaagatgccatag

SEQ ID NO: 5785976 - DNA, 23 bp, Homo sapiens
taattaaagccttaagcacaatt

SEQ ID NO: 5785977 - DNA, 21 bp, Homo sapiens
taattaaagcttaaactgaat

SEQ ID NO: 5785978 - DNA, 15 bp, Homo sapiens
taattaaagtagatt

SEQ ID NO: 5785979 - DNA, 16 bp, Homo sapiens
taattaaagtgtccat

SEQ ID NO: 5785980 - DNA, 21 bp, Homo sapiens
taattaaataaaaatctgtgg

SEQ ID NO: 5785981 - DNA, 14 bp, Homo sapiens
taattaaataatac

SEQ ID NO: 5785982 - DNA, 17 bp, Homo sapiens
taattaaataatacaac

SEQ ID NO: 5785983 - DNA, 15 bp, Homo sapiens
taattaaatagcttt

SEQ ID NO: 5785984 - DNA, 16 bp, Homo sapiens
taattaaatctcaaat

SEQ ID NO: 5785985 - DNA, 21 bp, Homo sapiens
taattaaatctctttaagaat

SEQ ID NO: 5785986 - DNA, 22 bp, Homo sapiens
taattaaatgaaatacttgaca

SEQ ID NO: 5785987 - DNA, 14 bp, Homo sapiens
taattaaatgtatt

SEQ ID NO: 5785988 - DNA, 13 bp, Homo sapiens
taattaaatttaa

SEQ ID NO: 5785989 - DNA, 14 bp, Homo sapiens
taattaaatttaac

SEQ ID NO: 5785990 - DNA, 20 bp, Homo sapiens
taattgttttttaaagcaag

SEQ ID NO: 5785991 - DNA, 21 bp, Homo sapiens
taattgttttttaaagcaagt

SEQ ID NO: 5785992 - DNA, 21 bp, Homo sapiens
taatttaaaaaagcaaatgga

SEQ ID NO: 5785993 - DNA, 22 bp, Homo sapiens
taatttaaaaagtgctatacta

SEQ ID NO: 5785994 - DNA, 16 bp, Homo sapiens
taatttaaaattgtga

SEQ ID NO: 5785995 - DNA, 20 bp, Homo sapiens
taatttaaaattgtgatgtg

SEQ ID NO: 5785996 - DNA, 14 bp, Homo sapiens
taatttaaaccagc

SEQ ID NO: 5785997 - DNA, 20 bp, Homo sapiens
taatttaaaccagcagaaaa

SEQ ID NO: 5785998 - DNA, 22 bp, Homo sapiens
taatttaaaccagcagaaaagt

SEQ ID NO: 5785999 - DNA, 19 bp, Homo sapiens
taatttaaagaaacactaa

SEQ ID NO: 5786000 - DNA, 21 bp, Homo sapiens
taatttaaagaaacactaaat

SEQ ID NO: 5786001 - DNA, 19 bp, Homo sapiens
taatttaaagccacaacca

SEQ ID NO: 5786002 - DNA, 17 bp, Homo sapiens
taatttaaagctgtttc

SEQ ID NO: 5786003 - DNA, 12 bp, Homo sapiens
taatttaaatga

SEQ ID NO: 5786004 - DNA, 14 bp, Homo sapiens
taatttaaatgata

SEQ ID NO: 5786005 - DNA, 13 bp, Homo sapiens
taatttaaatgct

SEQ ID NO: 5786006 - DNA, 15 bp, Homo sapiens
taatttaacaaacta

SEQ ID NO: 5786007 - DNA, 22 bp, Homo sapiens
taatttaacagaagttgtgaaa

SEQ ID NO: 5786008 - DNA, 16 bp, Homo sapiens
taatttaacccagctc

SEQ ID NO: 5786009 - DNA, 14 bp, Homo sapiens
taatttaactaatt

SEQ ID NO: 5786010 - DNA, 18 bp, Homo sapiens
taatttaactaatttaaa

SEQ ID NO: 5786011 - DNA, 21 bp, Homo sapiens
taatttaactaatttaaacca

SEQ ID NO: 5786012 - DNA, 11 bp, Homo sapiens
taatttaactt

SEQ ID NO: 5786013 - DNA, 13 bp, Homo sapiens
taatttaactttc

SEQ ID NO: 5786014 - DNA, 17 bp, Homo sapiens
taatttaactttccagt

SEQ ID NO: 5786015 - DNA, 21 bp, Homo sapiens
taatttaagagctaaccagtt

SEQ ID NO: 5786016 - DNA, 21 bp, Homo sapiens
taatttaaggtctgtttgctg

SEQ ID NO: 5786017 - DNA, 20 bp, Homo sapiens
taatttaagtcattttcatg

SEQ ID NO: 5786018 - DNA, 13 bp, Homo sapiens
taatttaagtgac

SEQ ID NO: 5786019 - DNA, 20 bp, Homo sapiens
taatttaagtgacacagaca

SEQ ID NO: 5786020 - DNA, 15 bp, Homo sapiens
taatttaagttttga

SEQ ID NO: 5786021 - DNA, 14 bp, Homo sapiens
taatttaatgtaaa

SEQ ID NO: 5786022 - DNA, 13 bp, Homo sapiens
taatttaattgct

SEQ ID NO: 5786023 - DNA, 17 bp, Homo sapiens
taatttaattgctttga

SEQ ID NO: 5786024 - DNA, 16 bp, Homo sapiens
taatttaatttttcct

SEQ ID NO: 5786025 - DNA, 19 bp, Homo sapiens
taatttacaaaaatataaa

SEQ ID NO: 5786026 - DNA, 21 bp, Homo sapiens
taatttacaggttcttaggct

SEQ ID NO: 5786027 - DNA, 12 bp, Homo sapiens
taatttaccaag

SEQ ID NO: 5786028 - DNA, 22 bp, Homo sapiens
taatttaccattattttacagt

SEQ ID NO: 5786029 - DNA, 18 bp, Homo sapiens
taatttacctgaagtctt

SEQ ID NO: 5786030 - DNA, 20 bp, Homo sapiens
taatttactgattccagcaa

SEQ ID NO: 5786031 - DNA, 20 bp, Homo sapiens
taatttacttaagtgttcat

SEQ ID NO: 5786032 - DNA, 21 bp, Homo sapiens
taatttacttaagtgttcatt

SEQ ID NO: 5786033 - DNA, 16 bp, Homo sapiens
taatttacttgttttg

SEQ ID NO: 5786034 - DNA, 20 bp, Homo sapiens
taatttacttgttttggatg

SEQ ID NO: 5786035 - DNA, 22 bp, Homo sapiens
taatttactttggaatgttgaa

SEQ ID NO: 5786036 - DNA, 18 bp, Homo sapiens
taatttactttgtagact

SEQ ID NO: 5786037 - DNA, 16 bp, Homo sapiens
taatttagaaaacttt

SEQ ID NO: 5786038 - DNA, 13 bp, Homo sapiens
taatttagaaact

SEQ ID NO: 5786039 - DNA, 20 bp, Homo sapiens
taatttagaaactgaaaaat

SEQ ID NO: 5786040 - DNA, 15 bp, Homo sapiens
taatttagaaatcat

SEQ ID NO: 5786041 - DNA, 20 bp, Homo sapiens
taatttagagcgtttggtta

SEQ ID NO: 5786042 - DNA, 21 bp, Homo sapiens
taatttagatattcatacttt

SEQ ID NO: 5786043 - DNA, 16 bp, Homo sapiens
taatttagattgtaaa

SEQ ID NO: 5786044 - DNA, 21 bp, Homo sapiens
taatttagggtactaaattta

SEQ ID NO: 5786045 - DNA, 15 bp, Homo sapiens
taatttagtaaatgt

SEQ ID NO: 5786046 - DNA, 16 bp, Homo sapiens
taatttagtaaatgtt

SEQ ID NO: 5786047 - DNA, 19 bp, Homo sapiens
taatttagtcccttaaaaa

SEQ ID NO: 5786048 - DNA, 18 bp, Homo sapiens
taatttagtctaacacag

SEQ ID NO: 5786049 - DNA, 18 bp, Homo sapiens
taatttagttaataaaat

SEQ ID NO: 5786050 - DNA, 16 bp, Homo sapiens
taatttagttgtttct

SEQ ID NO: 5786051 - DNA, 17 bp, Homo sapiens
taatttagtttcatata

SEQ ID NO: 5786052 - DNA, 12 bp, Homo sapiens
taatttataaag

SEQ ID NO: 5786053 - DNA, 15 bp, Homo sapiens
taatttataaataca

SEQ ID NO: 5786054 - DNA, 17 bp, Homo sapiens
taatttatacaggtcat

SEQ ID NO: 5786055 - DNA, 19 bp, Homo sapiens
taatttataggcagatctt

SEQ ID NO: 5786056 - DNA, 23 bp, Homo sapiens
taatttatatagatgtcagcaat

SEQ ID NO: 5786057 - DNA, 14 bp, Homo sapiens
taatttatatttga

SEQ ID NO: 5786058 - DNA, 18 bp, Homo sapiens
taatttatatttgaaatt

SEQ ID NO: 5786059 - DNA, 14 bp, Homo sapiens
taatttatatttgt

SEQ ID NO: 5786060 - DNA, 15 bp, Homo sapiens
taatttatcagattg

SEQ ID NO: 5786061 - DNA, 15 bp, Homo sapiens
taatttatcagtaca

SEQ ID NO: 5786062 - DNA, 17 bp, Homo sapiens
taatttatgaagatagt

SEQ ID NO: 5786063 - DNA, 11 bp, Homo sapiens
taatttatgca

SEQ ID NO: 5786064 - DNA, 14 bp, Homo sapiens
taatttatgcagag

SEQ ID NO: 5786065 - DNA, 13 bp, Homo sapiens
taatttatggttt

SEQ ID NO: 5786066 - DNA, 12 bp, Homo sapiens
taatttatgtaa

SEQ ID NO: 5786067 - DNA, 20 bp, Homo sapiens
taatttattaattgctttga

SEQ ID NO: 5786068 - DNA, 20 bp, Homo sapiens
taatttattattgaaattgt

SEQ ID NO: 5786069 - DNA, 13 bp, Homo sapiens
taatttatttgtt

SEQ ID NO: 5786070 - DNA, 14 bp, Homo sapiens
taatttatttgttt

SEQ ID NO: 5786071 - DNA, 20 bp, Homo sapiens
taatttattttgctccctct

SEQ ID NO: 5786072 - DNA, 15 bp, Homo sapiens
taatttcaaatctgt

SEQ ID NO: 5786073 - DNA, 13 bp, Homo sapiens
taatttcaagaat

SEQ ID NO: 5786074 - DNA, 14 bp, Homo sapiens
taatttcaagaatg

SEQ ID NO: 5786075 - DNA, 15 bp, Homo sapiens
taatttcaagaatgt

SEQ ID NO: 5786076 - DNA, 23 bp, Homo sapiens
taatttcaagaatgtttcagtta

SEQ ID NO: 5786077 - DNA, 18 bp, Homo sapiens
taatttcaatcaaccaaa

SEQ ID NO: 5786078 - DNA, 22 bp, Homo sapiens
taatttcacagataatttactt

SEQ ID NO: 5786079 - DNA, 18 bp, Homo sapiens
taatttcacagatgctgt

SEQ ID NO: 5786080 - DNA, 22 bp, Homo sapiens
taatttcacttaataattttta

SEQ ID NO: 5786081 - DNA, 13 bp, Homo sapiens
taatttcaggaaa

SEQ ID NO: 5786082 - DNA, 21 bp, Homo sapiens
taatttcaggaaaatgtattg

SEQ ID NO: 5786083 - DNA, 22 bp, Homo sapiens
taatttcaggaggaatactgaa

SEQ ID NO: 5786084 - DNA, 12 bp, Homo sapiens
taatttcagggt

SEQ ID NO: 5786085 - DNA, 15 bp, Homo sapiens
taatttcagtgtaaa

SEQ ID NO: 5786086 - DNA, 16 bp, Homo sapiens
taatttcagtgtaaag

SEQ ID NO: 5786087 - DNA, 13 bp, Homo sapiens
taatttcataaat

SEQ ID NO: 5786088 - DNA, 16 bp, Homo sapiens
taatttcataaattgg

SEQ ID NO: 5786089 - DNA, 15 bp, Homo sapiens
taatttcatgtgtat

SEQ ID NO: 5786090 - DNA, 13 bp, Homo sapiens
taatttcattcaa

SEQ ID NO: 5786091 - DNA, 18 bp, Homo sapiens
taatttccaggaaaaaat

SEQ ID NO: 5786092 - DNA, 20 bp, Homo sapiens
taatttccatgatacaaaga

SEQ ID NO: 5786093 - DNA, 17 bp, Homo sapiens
taatttcctcactgcct

SEQ ID NO: 5786094 - DNA, 18 bp, Homo sapiens
taatttcctcactgcctg

SEQ ID NO: 5786095 - DNA, 17 bp, Homo sapiens
taatttcctggtgtgaa

SEQ ID NO: 5786096 - DNA, 12 bp, Homo sapiens
taatttcctgtg

SEQ ID NO: 5786097 - DNA, 17 bp, Homo sapiens
taatttcctgtgaggat

SEQ ID NO: 5786098 - DNA, 10 bp, Homo sapiens
taatttcctt

SEQ ID NO: 5786099 - DNA, 15 bp, Homo sapiens
taatttccttcaggc

SEQ ID NO: 5786100 - DNA, 19 bp, Homo sapiens
taatttccttcaggcagct

SEQ ID NO: 5786101 - DNA, 17 bp, Homo sapiens
taatttccttctgttaa

SEQ ID NO: 5786102 - DNA, 21 bp, Homo sapiens
taatttccttctgttaagaaa

SEQ ID NO: 5786103 - DNA, 13 bp, Homo sapiens
taatttccttttt

SEQ ID NO: 5786104 - DNA, 20 bp, Homo sapiens
taatttcctttttgacactg

SEQ ID NO: 5786105 - DNA, 14 bp, Homo sapiens
taatttcggttata

SEQ ID NO: 5786106 - DNA, 14 bp, Homo sapiens
taatttctaaagca

SEQ ID NO: 5786107 - DNA, 16 bp, Homo sapiens
taatttctaggcaggt

SEQ ID NO: 5786108 - DNA, 23 bp, Homo sapiens
taatttctgataaagttccttaa

SEQ ID NO: 5786109 - DNA, 18 bp, Homo sapiens
taatttctgcaaatgtaa

SEQ ID NO: 5786110 - DNA, 21 bp, Homo sapiens
taatttctgcacaggtctctg

SEQ ID NO: 5786111 - DNA, 20 bp, Homo sapiens
taatttctgccaataaattc

SEQ ID NO: 5786112 - DNA, 18 bp, Homo sapiens
taatttctgccatttcat

SEQ ID NO: 5786113 - DNA, 18 bp, Homo sapiens
taatttctgcctttcccc

SEQ ID NO: 5786114 - DNA, 18 bp, Homo sapiens
taatttctgtcagaatgc

SEQ ID NO: 5786115 - DNA, 17 bp, Homo sapiens
taatttctgttgtttta

SEQ ID NO: 5786116 - DNA, 11 bp, Homo sapiens
taatttcttca

SEQ ID NO: 5786117 - DNA, 15 bp, Homo sapiens
taatttcttcaaaat

SEQ ID NO: 5786118 - DNA, 24 bp, Homo sapiens
taatttcttcatgtgatgtcatga

SEQ ID NO: 5786119 - DNA, 15 bp, Homo sapiens
taatttcttctcaaa

SEQ ID NO: 5786120 - DNA, 21 bp, Homo sapiens
taatttcttgcaatttgaagg

SEQ ID NO: 5786121 - DNA, 22 bp, Homo sapiens
taatttcttgcaatttgaaggt

SEQ ID NO: 5786122 - DNA, 17 bp, Homo sapiens
taatttctttaaatgtg

SEQ ID NO: 5786123 - DNA, 13 bp, Homo sapiens
taatttgaaaaag

SEQ ID NO: 5786124 - DNA, 12 bp, Homo sapiens
taatttgaactt

SEQ ID NO: 5786125 - DNA, 13 bp, Homo sapiens
taatttgaacttt

SEQ ID NO: 5786126 - DNA, 15 bp, Homo sapiens
taatttgaactttgg

SEQ ID NO: 5786127 - DNA, 13 bp, Homo sapiens
taatttgaataaa

SEQ ID NO: 5786128 - DNA, 14 bp, Homo sapiens
taatttgaatcaga

SEQ ID NO: 5786129 - DNA, 18 bp, Homo sapiens
taatttgaatgagttttt

SEQ ID NO: 5786130 - DNA, 13 bp, Homo sapiens
taatttgaatgta

SEQ ID NO: 5786131 - DNA, 16 bp, Homo sapiens
taatttgaatgtattt

SEQ ID NO: 5786132 - DNA, 13 bp, Homo sapiens
taatttgaattgg

SEQ ID NO: 5786133 - DNA, 16 bp, Homo sapiens
taatttgactagaaaa

SEQ ID NO: 5786134 - DNA, 13 bp, Homo sapiens
taatttgagaatt

SEQ ID NO: 5786135 - DNA, 22 bp, Homo sapiens
taatttgagatcgtccactgtc

SEQ ID NO: 5786136 - DNA, 12 bp, Homo sapiens
taatttgataaa

SEQ ID NO: 5786137 - DNA, 16 bp, Homo sapiens
taatttgatgaaagct

SEQ ID NO: 5786138 - DNA, 17 bp, Homo sapiens
taatttgatgaaagctg

SEQ ID NO: 5786139 - DNA, 20 bp, Homo sapiens
taatttgatgcccaatatat

SEQ ID NO: 5786140 - DNA, 21 bp, Homo sapiens
taatttgatggtatttctttc

SEQ ID NO: 5786141 - DNA, 16 bp, Homo sapiens
taatttgattaacaaa

SEQ ID NO: 5786142 - DNA, 13 bp, Homo sapiens
taatttgcacagt

SEQ ID NO: 5786143 - DNA, 17 bp, Homo sapiens
taatttgcattaaattc

SEQ ID NO: 5786144 - DNA, 19 bp, Homo sapiens
taatttgccaaaataatgt

SEQ ID NO: 5786145 - DNA, 22 bp, Homo sapiens
taatttgccaaaataatgtctt

SEQ ID NO: 5786146 - DNA, 16 bp, Homo sapiens
taatttgccattatct

SEQ ID NO: 5786147 - DNA, 15 bp, Homo sapiens
taatttgccattttt

SEQ ID NO: 5786148 - DNA, 14 bp, Homo sapiens
taatttgctctgtg

SEQ ID NO: 5786149 - DNA, 15 bp, Homo sapiens
taatttgctctgtgg

SEQ ID NO: 5786150 - DNA, 18 bp, Homo sapiens
taatttgctctgtggtaa

SEQ ID NO: 5786151 - DNA, 17 bp, Homo sapiens
taatttggaaactaata

SEQ ID NO: 5786152 - DNA, 23 bp, Homo sapiens
taatttggaaactaataaaatat

SEQ ID NO: 5786153 - DNA, 23 bp, Homo sapiens
taatttggagcacaaaattcaaa

SEQ ID NO: 5786154 - DNA, 17 bp, Homo sapiens
taatttggataataaaa

SEQ ID NO: 5786155 - DNA, 20 bp, Homo sapiens
taatttggataataaaaatt

SEQ ID NO: 5786156 - DNA, 21 bp, Homo sapiens
taatttggcttttcttattta

SEQ ID NO: 5786157 - DNA, 21 bp, Homo sapiens
taatttgggaaaagaagctgt

SEQ ID NO: 5786158 - DNA, 19 bp, Homo sapiens
taatttggtagatgacaaa

SEQ ID NO: 5786159 - DNA, 17 bp, Homo sapiens
taatttgtaaaacttct

SEQ ID NO: 5786160 - DNA, 13 bp, Homo sapiens
taatttgtaaact

SEQ ID NO: 5786161 - DNA, 14 bp, Homo sapiens
taatttgtaaactt

SEQ ID NO: 5786162 - DNA, 23 bp, Homo sapiens
taatttgtaaacttctgaagact

SEQ ID NO: 5786163 - DNA, 12 bp, Homo sapiens
taatttgtaaag

SEQ ID NO: 5786164 - DNA, 21 bp, Homo sapiens
taatttgtaaatgattttaat

SEQ ID NO: 5786165 - DNA, 19 bp, Homo sapiens
taatttgtacaatggttta

SEQ ID NO: 5786166 - DNA, 20 bp, Homo sapiens
taatttgtagtgttggagaa

SEQ ID NO: 5786167 - DNA, 16 bp, Homo sapiens
taatttgtatcggagg

SEQ ID NO: 5786168 - DNA, 13 bp, Homo sapiens
taatttgtatctg

SEQ ID NO: 5786169 - DNA, 14 bp, Homo sapiens
tacaatctggctca

SEQ ID NO: 5786170 - DNA, 14 bp, Homo sapiens
tacaatctgtatct

SEQ ID NO: 5786171 - DNA, 18 bp, Homo sapiens
tacaatcttagtgaatgg

SEQ ID NO: 5786172 - DNA, 18 bp, Homo sapiens
tacaatctttcaccaagt

SEQ ID NO: 5786173 - DNA, 23 bp, Homo sapiens
tacaatgaaaaggactttataga

SEQ ID NO: 5786174 - DNA, 21 bp, Homo sapiens
tacaatgaacacttataagtg

SEQ ID NO: 5786175 - DNA, 19 bp, Homo sapiens
tacaatgaactgcttttcc

SEQ ID NO: 5786176 - DNA, 16 bp, Homo sapiens
tacaatgaccacatag

SEQ ID NO: 5786177 - DNA, 20 bp, Homo sapiens
tacaatgagtaaaatcacag

SEQ ID NO: 5786178 - DNA, 23 bp, Homo sapiens
tacaatgatatccaatattaaaa

SEQ ID NO: 5786179 - DNA, 16 bp, Homo sapiens
tacaatgatgtaaata

SEQ ID NO: 5786180 - DNA, 16 bp, Homo sapiens
tacaatgatttgtaaa

SEQ ID NO: 5786181 - DNA, 19 bp, Homo sapiens
tacaatgcacttttatgaa

SEQ ID NO: 5786182 - DNA, 23 bp, Homo sapiens
tacaatgcacttttatgaagttt

SEQ ID NO: 5786183 - DNA, 15 bp, Homo sapiens
tacaatgcagaattt

SEQ ID NO: 5786184 - DNA, 14 bp, Homo sapiens
tacaatgctgtgcc

SEQ ID NO: 5786185 - DNA, 17 bp, Homo sapiens
tacaatggaaaccattt

SEQ ID NO: 5786186 - DNA, 15 bp, Homo sapiens
tacaatggccagccc

SEQ ID NO: 5786187 - DNA, 18 bp, Homo sapiens
tacaatggccagcccaga

SEQ ID NO: 5786188 - DNA, 22 bp, Homo sapiens
tacaatggcccgacatttcttc

SEQ ID NO: 5786189 - DNA, 16 bp, Homo sapiens
tacaatgggaaaactt

SEQ ID NO: 5786190 - DNA, 14 bp, Homo sapiens
tacaatgggaaaag

SEQ ID NO: 5786191 - DNA, 17 bp, Homo sapiens
tacaatggtaaaatgag

SEQ ID NO: 5786192 - DNA, 22 bp, Homo sapiens
tacaatggtttattcccaagta

SEQ ID NO: 5786193 - DNA, 18 bp, Homo sapiens
tacaatgtacaattatgt

SEQ ID NO: 5786194 - DNA, 22 bp, Homo sapiens
tacaatgtacaattatgtctct

SEQ ID NO: 5786195 - DNA, 16 bp, Homo sapiens
tacaatgtatctttat

SEQ ID NO: 5786196 - DNA, 21 bp, Homo sapiens
tacaatgtatgtaatttgttt

SEQ ID NO: 5786197 - DNA, 14 bp, Homo sapiens
tacaatgtatgtac

SEQ ID NO: 5786198 - DNA, 18 bp, Homo sapiens
tacaatgtatttatttaa

SEQ ID NO: 5786199 - DNA, 20 bp, Homo sapiens
tacaatgtatttatttaaaa

SEQ ID NO: 5786200 - DNA, 17 bp, Homo sapiens
tacaatgtcatatactg

SEQ ID NO: 5786201 - DNA, 17 bp, Homo sapiens
tacaatgtgactttgaa

SEQ ID NO: 5786202 - DNA, 20 bp, Homo sapiens
tacaatgtgactttgaaaat

SEQ ID NO: 5786203 - DNA, 17 bp, Homo sapiens
tacaatgtgtatcaaaa

SEQ ID NO: 5786204 - DNA, 13 bp, Homo sapiens
tacaatgtgtttt

SEQ ID NO: 5786205 - DNA, 17 bp, Homo sapiens
tacaatgtgtttttctc

SEQ ID NO: 5786206 - DNA, 19 bp, Homo sapiens
tacaatgtgtttttctcca

SEQ ID NO: 5786207 - DNA, 21 bp, Homo sapiens
tacaatgtgtttttctccagt

SEQ ID NO: 5786208 - DNA, 15 bp, Homo sapiens
tacaatgttatcaac

SEQ ID NO: 5786209 - DNA, 16 bp, Homo sapiens
tacaatgttcatccca

SEQ ID NO: 5786210 - DNA, 20 bp, Homo sapiens
tacaatgttgtatttgttat

SEQ ID NO: 5786211 - DNA, 12 bp, Homo sapiens
tacaatgtttta

SEQ ID NO: 5786212 - DNA, 22 bp, Homo sapiens
tacaattaaaaaaaaagatctg

SEQ ID NO: 5786213 - DNA, 19 bp, Homo sapiens
tacaattaaagctgttatt

SEQ ID NO: 5786214 - DNA, 22 bp, Homo sapiens
tacaattacatctctaattttg

SEQ ID NO: 5786215 - DNA, 19 bp, Homo sapiens
tacaattactaaattgtat

SEQ ID NO: 5786216 - DNA, 22 bp, Homo sapiens
tacaattactgtgagaactgtg

SEQ ID NO: 5786217 - DNA, 23 bp, Homo sapiens
tacaattaggaactgagtatgtg

SEQ ID NO: 5786218 - DNA, 19 bp, Homo sapiens
tacaattatatcagtcctc

SEQ ID NO: 5786219 - DNA, 16 bp, Homo sapiens
tacaattatgtctctt

SEQ ID NO: 5786220 - DNA, 17 bp, Homo sapiens
tacaattatgtctcttg

SEQ ID NO: 5786221 - DNA, 19 bp, Homo sapiens
tacaattatgtctcttgag

SEQ ID NO: 5786222 - DNA, 14 bp, Homo sapiens
tacaattcaaatgc

SEQ ID NO: 5786223 - DNA, 15 bp, Homo sapiens
tacaattcaaatgct

SEQ ID NO: 5786224 - DNA, 12 bp, Homo sapiens
tacaattcattg

SEQ ID NO: 5786225 - DNA, 13 bp, Homo sapiens
tacaattcattgt

SEQ ID NO: 5786226 - DNA, 21 bp, Homo sapiens
tacaattcattgtgttacctg

SEQ ID NO: 5786227 - DNA, 22 bp, Homo sapiens
tacaattcattgttttgcaaaa

SEQ ID NO: 5786228 - DNA, 19 bp, Homo sapiens
tacaattcctggcaaacac

SEQ ID NO: 5786229 - DNA, 18 bp, Homo sapiens
tacaattctacattgtca

SEQ ID NO: 5786230 - DNA, 21 bp, Homo sapiens
tacaattctttgttgcttaat

SEQ ID NO: 5786231 - DNA, 14 bp, Homo sapiens
tacaattgaactta

SEQ ID NO: 5786232 - DNA, 20 bp, Homo sapiens
tacaattgaacttaaataaa

SEQ ID NO: 5786233 - DNA, 13 bp, Homo sapiens
tacaattgtgggc

SEQ ID NO: 5786234 - DNA, 22 bp, Homo sapiens
tacaattgtgggcataaactgt

SEQ ID NO: 5786235 - DNA, 15 bp, Homo sapiens
tacaatttacaaagt

SEQ ID NO: 5786236 - DNA, 22 bp, Homo sapiens
tacaatttacaaagtgtgtatt

SEQ ID NO: 5786237 - DNA, 20 bp, Homo sapiens
tacaatttcaaaagaacatt

SEQ ID NO: 5786238 - DNA, 12 bp, Homo sapiens
tacaatttctat

SEQ ID NO: 5786239 - DNA, 22 bp, Homo sapiens
tacaatttctattatttttcaa

SEQ ID NO: 5786240 - DNA, 19 bp, Homo sapiens
tacaatttctttaaatcat

SEQ ID NO: 5786241 - DNA, 22 bp, Homo sapiens
tacaatttgcacaatatttctt

SEQ ID NO: 5786242 - DNA, 19 bp, Homo sapiens
tacaatttgcactgttact

SEQ ID NO: 5786243 - DNA, 19 bp, Homo sapiens
tacaatttgtattactttc

SEQ ID NO: 5786244 - DNA, 16 bp, Homo sapiens
tacaatttgttaattc

SEQ ID NO: 5786245 - DNA, 23 bp, Homo sapiens
tacaatttgttaattcctatgaa

SEQ ID NO: 5786246 - DNA, 16 bp, Homo sapiens
tacaattttaaagttc

SEQ ID NO: 5786247 - DNA, 22 bp, Homo sapiens
tacaattttaaagttcttattt

SEQ ID NO: 5786248 - DNA, 23 bp, Homo sapiens
tacaattttatataattctgaaa

SEQ ID NO: 5786249 - DNA, 18 bp, Homo sapiens
tacaattttatctgtttc

SEQ ID NO: 5786250 - DNA, 17 bp, Homo sapiens
tacaattttcatcccac

SEQ ID NO: 5786251 - DNA, 21 bp, Homo sapiens
tacaattttccctcttcactt

SEQ ID NO: 5786252 - DNA, 19 bp, Homo sapiens
tacaattttctcccaggaa

SEQ ID NO: 5786253 - DNA, 14 bp, Homo sapiens
tacaattttctgta

SEQ ID NO: 5786254 - DNA, 16 bp, Homo sapiens
tacaattttgtttctg

SEQ ID NO: 5786255 - DNA, 20 bp, Homo sapiens
tacaatttttttaattttgt

SEQ ID NO: 5786256 - DNA, 22 bp, Homo sapiens
tacaatttttttaattttgtat

SEQ ID NO: 5786257 - DNA, 15 bp, Homo sapiens
tacacaaaaaagtat

SEQ ID NO: 5786258 - DNA, 20 bp, Homo sapiens
tacacaaagaacttgctgct

SEQ ID NO: 5786259 - DNA, 21 bp, Homo sapiens
tacacaaagaacttgctgctg

SEQ ID NO: 5786260 - DNA, 23 bp, Homo sapiens
tacacaaagaacttgctgctgcc

SEQ ID NO: 5786261 - DNA, 18 bp, Homo sapiens
tacacaaagatattattt

SEQ ID NO: 5786262 - DNA, 22 bp, Homo sapiens
tacacaaagctttcttttctaa

SEQ ID NO: 5786263 - DNA, 13 bp, Homo sapiens
tacacaaagggga

SEQ ID NO: 5786264 - DNA, 23 bp, Homo sapiens
tacacaaatgatagcataacata

SEQ ID NO: 5786265 - DNA, 20 bp, Homo sapiens
tacacaaatgtgatttttgt

SEQ ID NO: 5786266 - DNA, 22 bp, Homo sapiens
tacacaaatgtgatttttgtaa

SEQ ID NO: 5786267 - DNA, 16 bp, Homo sapiens
tacacaacatgtatgt

SEQ ID NO: 5786268 - DNA, 20 bp, Homo sapiens
tacacaacatttatttcaaa

SEQ ID NO: 5786269 - DNA, 20 bp, Homo sapiens
tacacaacgtaatcaaatat

SEQ ID NO: 5786270 - DNA, 13 bp, Homo sapiens
tacacaactcact

SEQ ID NO: 5786271 - DNA, 14 bp, Homo sapiens
tacacaactcactc

SEQ ID NO: 5786272 - DNA, 22 bp, Homo sapiens
tacacaactcactccttttaaa

SEQ ID NO: 5786273 - DNA, 17 bp, Homo sapiens
tacacaactttgcaaat

SEQ ID NO: 5786274 - DNA, 22 bp, Homo sapiens
tacacaagagggactgtatttc

SEQ ID NO: 5786275 - DNA, 17 bp, Homo sapiens
tacacaagcaatgcaag

SEQ ID NO: 5786276 - DNA, 20 bp, Homo sapiens
tacacaaggagctttcttgt

SEQ ID NO: 5786277 - DNA, 14 bp, Homo sapiens
tacacaataagcaa

SEQ ID NO: 5786278 - DNA, 14 bp, Homo sapiens
tacacaatacagta

SEQ ID NO: 5786279 - DNA, 16 bp, Homo sapiens
tacacaatacagtatt

SEQ ID NO: 5786280 - DNA, 18 bp, Homo sapiens
tacacaatagaattataa

SEQ ID NO: 5786281 - DNA, 21 bp, Homo sapiens
tacacaatggttttcttgtgt

SEQ ID NO: 5786282 - DNA, 20 bp, Homo sapiens
tacacaatggtttttaaatt

SEQ ID NO: 5786283 - DNA, 20 bp, Homo sapiens
tacacaattaattcatccct

SEQ ID NO: 5786284 - DNA, 21 bp, Homo sapiens
tacacaattaattcatccctt

SEQ ID NO: 5786285 - DNA, 13 bp, Homo sapiens
tacacaattctta

SEQ ID NO: 5786286 - DNA, 15 bp, Homo sapiens
tacacaattgtttta

SEQ ID NO: 5786287 - DNA, 13 bp, Homo sapiens
tacacacaaaaat

SEQ ID NO: 5786288 - DNA, 16 bp, Homo sapiens
tacacacacaaagaga

SEQ ID NO: 5786289 - DNA, 19 bp, Homo sapiens
tacacacacacacacagcc

SEQ ID NO: 5786290 - DNA, 14 bp, Homo sapiens
tacacacacagaca

SEQ ID NO: 5786291 - DNA, 10 bp, Homo sapiens
tacacacacg

SEQ ID NO: 5786292 - DNA, 12 bp, Homo sapiens
tacacacatata

SEQ ID NO: 5786293 - DNA, 14 bp, Homo sapiens
tacacacatataca

SEQ ID NO: 5786294 - DNA, 15 bp, Homo sapiens
tacacacatatacat

SEQ ID NO: 5786295 - DNA, 20 bp, Homo sapiens
tacacacatatacatatata

SEQ ID NO: 5786296 - DNA, 17 bp, Homo sapiens
tacacaccagaagatgt

SEQ ID NO: 5786297 - DNA, 18 bp, Homo sapiens
tacacaccagaagatgtg

SEQ ID NO: 5786298 - DNA, 17 bp, Homo sapiens
tacacacccccaagcca

SEQ ID NO: 5786299 - DNA, 15 bp, Homo sapiens
tacacacccgcctga

SEQ ID NO: 5786300 - DNA, 23 bp, Homo sapiens
tacacaccctgcccctgcaaaga

SEQ ID NO: 5786301 - DNA, 15 bp, Homo sapiens
tacacacctgagaat

SEQ ID NO: 5786302 - DNA, 18 bp, Homo sapiens
tacacacctgagaatgtg

SEQ ID NO: 5786303 - DNA, 15 bp, Homo sapiens
tacacacgctgcctt

SEQ ID NO: 5786304 - DNA, 16 bp, Homo sapiens
tacacacgctgccttc

SEQ ID NO: 5786305 - DNA, 17 bp, Homo sapiens
tacacacgctgccttcg

SEQ ID NO: 5786306 - DNA, 16 bp, Homo sapiens
tacacacggtgccttt

SEQ ID NO: 5786307 - DNA, 22 bp, Homo sapiens
tacacactcaggcctgtgccca

SEQ ID NO: 5786308 - DNA, 17 bp, Homo sapiens
tacacactgtacacata

SEQ ID NO: 5786309 - DNA, 19 bp, Homo sapiens
tacacagaaatgctgctgg

SEQ ID NO: 5786310 - DNA, 16 bp, Homo sapiens
tacacagaatctcctg

SEQ ID NO: 5786311 - DNA, 13 bp, Homo sapiens
tacacagacatta

SEQ ID NO: 5786312 - DNA, 16 bp, Homo sapiens
tacacagacccctccc

SEQ ID NO: 5786313 - DNA, 17 bp, Homo sapiens
tacacagactattgaca

SEQ ID NO: 5786314 - DNA, 12 bp, Homo sapiens
tacacagagaag

SEQ ID NO: 5786315 - DNA, 21 bp, Homo sapiens
tacacagagaaggctatgtaa

SEQ ID NO: 5786316 - DNA, 18 bp, Homo sapiens
tacacagaggagtgcagc

SEQ ID NO: 5786317 - DNA, 18 bp, Homo sapiens
tacacagcagtatgaatg

SEQ ID NO: 5786318 - DNA, 19 bp, Homo sapiens
tacacagcagtatgaatga

SEQ ID NO: 5786319 - DNA, 16 bp, Homo sapiens
tacacagcccaagagg

SEQ ID NO: 5786320 - DNA, 14 bp, Homo sapiens
tacacaggacaggg

SEQ ID NO: 5786321 - DNA, 21 bp, Homo sapiens
tacacaggacaggggttcctt

SEQ ID NO: 5786322 - DNA, 13 bp, Homo sapiens
tacacaggcagga

SEQ ID NO: 5786323 - DNA, 16 bp, Homo sapiens
tacacaggcagttttg

SEQ ID NO: 5786324 - DNA, 15 bp, Homo sapiens
tacacaggggccctg

SEQ ID NO: 5786325 - DNA, 21 bp, Homo sapiens
tacacaggggccctgtacagt

SEQ ID NO: 5786326 - DNA, 23 bp, Homo sapiens
tacacagtaaaaacttgtactat

SEQ ID NO: 5786327 - DNA, 22 bp, Homo sapiens
tacacagtacctcgtttctaca

SEQ ID NO: 5786328 - DNA, 20 bp, Homo sapiens
tacacagtactttattgtac

SEQ ID NO: 5786329 - DNA, 17 bp, Homo sapiens
tacacagtctgcaagat

SEQ ID NO: 5786330 - DNA, 17 bp, Homo sapiens
tacacagtgagactgta

SEQ ID NO: 5786331 - DNA, 21 bp, Homo sapiens
tacacagtgagactgtacata

SEQ ID NO: 5786332 - DNA, 22 bp, Homo sapiens
tacacagtgagactgtacataa

SEQ ID NO: 5786333 - DNA, 23 bp, Homo sapiens
tacacagtgggaactctgacaag

SEQ ID NO: 5786334 - DNA, 22 bp, Homo sapiens
tacacagtgtgaataaagtgct

SEQ ID NO: 5786335 - DNA, 17 bp, Homo sapiens
tacacagttaaataaat

SEQ ID NO: 5786336 - DNA, 20 bp, Homo sapiens
tacacagttctggtgttcct

SEQ ID NO: 5786337 - DNA, 22 bp, Homo sapiens
tacacataagaccgtgtcccaa

SEQ ID NO: 5786338 - DNA, 23 bp, Homo sapiens
tacacataagaccgtgtcccaag

SEQ ID NO: 5786339 - DNA, 19 bp, Homo sapiens
tacacataattaaagtgtc

SEQ ID NO: 5786340 - DNA, 16 bp, Homo sapiens
tacacatacagtttta

SEQ ID NO: 5786341 - DNA, 23 bp, Homo sapiens
tacacatacagttttatgctctt

SEQ ID NO: 5786342 - DNA, 18 bp, Homo sapiens
tacacatacatacacata

SEQ ID NO: 5786343 - DNA, 19 bp, Homo sapiens
tacacatacatacatacat

SEQ ID NO: 5786344 - DNA, 20 bp, Homo sapiens
tacagccctaagtggctgcc

SEQ ID NO: 5786345 - DNA, 23 bp, Homo sapiens
tacagccctggaggccgctgctg

SEQ ID NO: 5786346 - DNA, 19 bp, Homo sapiens
tacagcccttggcttgtgt

SEQ ID NO: 5786347 - DNA, 19 bp, Homo sapiens
tacagccgtgcacaccagt

SEQ ID NO: 5786348 - DNA, 21 bp, Homo sapiens
tacagcctcagaggcagcagg

SEQ ID NO: 5786349 - DNA, 15 bp, Homo sapiens
tacagcctgcacaca

SEQ ID NO: 5786350 - DNA, 16 bp, Homo sapiens
tacagcgcggaggagg

SEQ ID NO: 5786351 - DNA, 17 bp, Homo sapiens
tacagctatatttgatt

SEQ ID NO: 5786352 - DNA, 16 bp, Homo sapiens
tacagctatgaagaaa

SEQ ID NO: 5786353 - DNA, 14 bp, Homo sapiens
tacagctattaaaa

SEQ ID NO: 5786354 - DNA, 21 bp, Homo sapiens
tacagctcagaagtttcttct

SEQ ID NO: 5786355 - DNA, 13 bp, Homo sapiens
tacagctcagtaa

SEQ ID NO: 5786356 - DNA, 16 bp, Homo sapiens
tacagctcccttccct

SEQ ID NO: 5786357 - DNA, 22 bp, Homo sapiens
tacagctctcccctcccttgtc

SEQ ID NO: 5786358 - DNA, 18 bp, Homo sapiens
tacagctctcctccagcc

SEQ ID NO: 5786359 - DNA, 23 bp, Homo sapiens
tacagctctcctccagccctggg

SEQ ID NO: 5786360 - DNA, 20 bp, Homo sapiens
tacagctgaaagacagtaaa

SEQ ID NO: 5786361 - DNA, 10 bp, Homo sapiens
tacagctgag

SEQ ID NO: 5786362 - DNA, 19 bp, Homo sapiens
tacagctgagcacattctg

SEQ ID NO: 5786363 - DNA, 23 bp, Homo sapiens
tacagctgctttgagctacagga

SEQ ID NO: 5786364 - DNA, 10 bp, Homo sapiens
tacagctggc

SEQ ID NO: 5786365 - DNA, 17 bp, Homo sapiens
tacagctggggtgcagg

SEQ ID NO: 5786366 - DNA, 20 bp, Homo sapiens
tacagctgggtggcactgcc

SEQ ID NO: 5786367 - DNA, 16 bp, Homo sapiens
tacagctgtatataaa

SEQ ID NO: 5786368 - DNA, 14 bp, Homo sapiens
tacagctgtattgt

SEQ ID NO: 5786369 - DNA, 18 bp, Homo sapiens
tacagctgtattgtctga

SEQ ID NO: 5786370 - DNA, 19 bp, Homo sapiens
tacagctgtattgtctgaa

SEQ ID NO: 5786371 - DNA, 16 bp, Homo sapiens
tacagctgtgctccac

SEQ ID NO: 5786372 - DNA, 14 bp, Homo sapiens
tacagctgtttaag

SEQ ID NO: 5786373 - DNA, 16 bp, Homo sapiens
tacagctgtttaagat

SEQ ID NO: 5786374 - DNA, 14 bp, Homo sapiens
tacagcttcaccct

SEQ ID NO: 5786375 - DNA, 15 bp, Homo sapiens
tacagcttgtttaac

SEQ ID NO: 5786376 - DNA, 22 bp, Homo sapiens
tacagctttgtgactgtatata

SEQ ID NO: 5786377 - DNA, 14 bp, Homo sapiens
tacagcttttatgg

SEQ ID NO: 5786378 - DNA, 15 bp, Homo sapiens
tacagcttttatgga

SEQ ID NO: 5786379 - DNA, 13 bp, Homo sapiens
tacagcttttctc

SEQ ID NO: 5786380 - DNA, 15 bp, Homo sapiens
tacagcttttctctt

SEQ ID NO: 5786381 - DNA, 23 bp, Homo sapiens
tacaggaaaaaaaattctgttgt

SEQ ID NO: 5786382 - DNA, 17 bp, Homo sapiens
tacaggaaaaatgaaaa

SEQ ID NO: 5786383 - DNA, 20 bp, Homo sapiens
tacaggaaaatcccttctag

SEQ ID NO: 5786384 - DNA, 15 bp, Homo sapiens
tacaggaaacagttg

SEQ ID NO: 5786385 - DNA, 21 bp, Homo sapiens
tacaggaaacagttgcatgta

SEQ ID NO: 5786386 - DNA, 13 bp, Homo sapiens
tacaggaacacac

SEQ ID NO: 5786387 - DNA, 16 bp, Homo sapiens
tacaggaacccagcca

SEQ ID NO: 5786388 - DNA, 17 bp, Homo sapiens
tacaggaaggcaggagg

SEQ ID NO: 5786389 - DNA, 19 bp, Homo sapiens
tacaggaaggtgcctggcc

SEQ ID NO: 5786390 - DNA, 17 bp, Homo sapiens
tacaggaatgaagaact

SEQ ID NO: 5786391 - DNA, 19 bp, Homo sapiens
tacaggacaaagggaggga

SEQ ID NO: 5786392 - DNA, 14 bp, Homo sapiens
tacaggacatatat

SEQ ID NO: 5786393 - DNA, 22 bp, Homo sapiens
tacaggactgggccgggcccag

SEQ ID NO: 5786394 - DNA, 13 bp, Homo sapiens
tacaggactgtaa

SEQ ID NO: 5786395 - DNA, 15 bp, Homo sapiens
tacaggacttttaaa

SEQ ID NO: 5786396 - DNA, 20 bp, Homo sapiens
tacaggagacccaacaatga

SEQ ID NO: 5786397 - DNA, 14 bp, Homo sapiens
tacaggagaggcag

SEQ ID NO: 5786398 - DNA, 14 bp, Homo sapiens
tacaggagccagcc

SEQ ID NO: 5786399 - DNA, 16 bp, Homo sapiens
tacaggagccagcctg

SEQ ID NO: 5786400 - DNA, 17 bp, Homo sapiens
tacaggagccagcctgc

SEQ ID NO: 5786401 - DNA, 15 bp, Homo sapiens
tacaggagggaacat

SEQ ID NO: 5786402 - DNA, 20 bp, Homo sapiens
tacaggagggaacatttccg

SEQ ID NO: 5786403 - DNA, 16 bp, Homo sapiens
tacaggagggcccgga

SEQ ID NO: 5786404 - DNA, 18 bp, Homo sapiens
tacaggagtcagccatgt

SEQ ID NO: 5786405 - DNA, 18 bp, Homo sapiens
tacaggatatcacctgaa

SEQ ID NO: 5786406 - DNA, 21 bp, Homo sapiens
tacaggatatcacctgaatta

SEQ ID NO: 5786407 - DNA, 20 bp, Homo sapiens
tacaggatgatgactatgga

SEQ ID NO: 5786408 - DNA, 18 bp, Homo sapiens
tacaggatggtgggcagg

SEQ ID NO: 5786409 - DNA, 20 bp, Homo sapiens
tacaggatttgaactcagat

SEQ ID NO: 5786410 - DNA, 14 bp, Homo sapiens
tacaggcaattccg

SEQ ID NO: 5786411 - DNA, 16 bp, Homo sapiens
tacaggcacccaccat

SEQ ID NO: 5786412 - DNA, 19 bp, Homo sapiens
tacaggcaccgagaatgtt

SEQ ID NO: 5786413 - DNA, 20 bp, Homo sapiens
tacaggcaccgagaatgttg

SEQ ID NO: 5786414 - DNA, 15 bp, Homo sapiens
tacaggcagcacaga

SEQ ID NO: 5786415 - DNA, 14 bp, Homo sapiens
tacaggcagtctct

SEQ ID NO: 5786416 - DNA, 19 bp, Homo sapiens
tacaggcatgagccactgc

SEQ ID NO: 5786417 - DNA, 16 bp, Homo sapiens
tacaggcatgtgccac

SEQ ID NO: 5786418 - DNA, 22 bp, Homo sapiens
tacaggcatgtgccaccacgcc

SEQ ID NO: 5786419 - DNA, 20 bp, Homo sapiens
tacaggcccgtgcccagccc

SEQ ID NO: 5786420 - DNA, 14 bp, Homo sapiens
tacaggccctgctc

SEQ ID NO: 5786421 - DNA, 15 bp, Homo sapiens
tacaggccctgctcc

SEQ ID NO: 5786422 - DNA, 16 bp, Homo sapiens
tacaggccctgctcct

SEQ ID NO: 5786423 - DNA, 19 bp, Homo sapiens
tacaggccctgctcctgca

SEQ ID NO: 5786424 - DNA, 15 bp, Homo sapiens
tacaggcctcagggt

SEQ ID NO: 5786425 - DNA, 16 bp, Homo sapiens
tacaggcctttcagga

SEQ ID NO: 5786426 - DNA, 16 bp, Homo sapiens
tacaggcgcctgccac

SEQ ID NO: 5786427 - DNA, 15 bp, Homo sapiens
tacaggcgctccagg

SEQ ID NO: 5786428 - DNA, 17 bp, Homo sapiens
tacaggctaaaattagt

SEQ ID NO: 5786429 - DNA, 14 bp, Homo sapiens
tacaggctcctgcc

SEQ ID NO: 5786430 - DNA, 17 bp, Homo sapiens
tacaggctcctgccacc

SEQ ID NO: 5786431 - DNA, 15 bp, Homo sapiens
tacaggctgagacac

SEQ ID NO: 5786432 - DNA, 24 bp, Homo sapiens
tacagggaactgggaagatgctgg

SEQ ID NO: 5786433 - DNA, 14 bp, Homo sapiens
tacagggaagaaat

SEQ ID NO: 5786434 - DNA, 16 bp, Homo sapiens
tacagggaatgcctga

SEQ ID NO: 5786435 - DNA, 20 bp, Homo sapiens
tacagggaatgcctgagtgc

SEQ ID NO: 5786436 - DNA, 13 bp, Homo sapiens
tacagggagcctc

SEQ ID NO: 5786437 - DNA, 15 bp, Homo sapiens
tacagggagcctcct

SEQ ID NO: 5786438 - DNA, 16 bp, Homo sapiens
tacagggagcctcctg

SEQ ID NO: 5786439 - DNA, 20 bp, Homo sapiens
tacagggcacaggccatgga

SEQ ID NO: 5786440 - DNA, 19 bp, Homo sapiens
tacagggcaggagctgctg

SEQ ID NO: 5786441 - DNA, 22 bp, Homo sapiens
tacagggccaaacgctgagcca

SEQ ID NO: 5786442 - DNA, 15 bp, Homo sapiens
tacagggcccaggtg

SEQ ID NO: 5786443 - DNA, 22 bp, Homo sapiens
tacagggcgagactctgtctca

SEQ ID NO: 5786444 - DNA, 20 bp, Homo sapiens
tacaggggaggggcgcaccc

SEQ ID NO: 5786445 - DNA, 22 bp, Homo sapiens
tacaggggcagtcagtggaggg

SEQ ID NO: 5786446 - DNA, 12 bp, Homo sapiens
tacaggggccat

SEQ ID NO: 5786447 - DNA, 21 bp, Homo sapiens
tacaggggccatgccccaccc

SEQ ID NO: 5786448 - DNA, 17 bp, Homo sapiens
tacagggggtctggctg

SEQ ID NO: 5786449 - DNA, 19 bp, Homo sapiens
tacagggggtctggctggt

SEQ ID NO: 5786450 - DNA, 21 bp, Homo sapiens
tacagggggtctggctggtgt

SEQ ID NO: 5786451 - DNA, 20 bp, Homo sapiens
tacaggggtagtttgtttta

SEQ ID NO: 5786452 - DNA, 17 bp, Homo sapiens
tacaggggttgttttta

SEQ ID NO: 5786453 - DNA, 18 bp, Homo sapiens
tacagggtagcaggtacc

SEQ ID NO: 5786454 - DNA, 22 bp, Homo sapiens
tacagggtagcaggtaccactg

SEQ ID NO: 5786455 - DNA, 14 bp, Homo sapiens
tacagggtgactca

SEQ ID NO: 5786456 - DNA, 15 bp, Homo sapiens
tacagggtttttacc

SEQ ID NO: 5786457 - DNA, 23 bp, Homo sapiens
tacagggtttttacctgtcacat

SEQ ID NO: 5786458 - DNA, 21 bp, Homo sapiens
tacaggtaacattataaatga

SEQ ID NO: 5786459 - DNA, 16 bp, Homo sapiens
tacaggtaactaattg

SEQ ID NO: 5786460 - DNA, 17 bp, Homo sapiens
tacaggtatcaggcaca

SEQ ID NO: 5786461 - DNA, 20 bp, Homo sapiens
tacaggtcacccatcaggac

SEQ ID NO: 5786462 - DNA, 19 bp, Homo sapiens
tacaggtcatctgctggga

SEQ ID NO: 5786463 - DNA, 17 bp, Homo sapiens
tacaggtgcccaccacc

SEQ ID NO: 5786464 - DNA, 13 bp, Homo sapiens
tacaggtgtacta

SEQ ID NO: 5786465 - DNA, 19 bp, Homo sapiens
tacaggtgtcaccatcatt

SEQ ID NO: 5786466 - DNA, 23 bp, Homo sapiens
tacaggtgtgaaccactgtgccc

SEQ ID NO: 5786467 - DNA, 12 bp, Homo sapiens
tacaggtgtgag

SEQ ID NO: 5786468 - DNA, 16 bp, Homo sapiens
tacaggtgtgagcata

SEQ ID NO: 5786469 - DNA, 22 bp, Homo sapiens
tacaggtgtgagcatagtgaga

SEQ ID NO: 5786470 - DNA, 22 bp, Homo sapiens
tacaggtgtgagccaccacgcc

SEQ ID NO: 5786471 - DNA, 19 bp, Homo sapiens
tacaggttaacctgcagaa

SEQ ID NO: 5786472 - DNA, 17 bp, Homo sapiens
tacaggttactaccctc

SEQ ID NO: 5786473 - DNA, 12 bp, Homo sapiens
tacaggttcctt

SEQ ID NO: 5786474 - DNA, 16 bp, Homo sapiens
tacagtaaagtttaaa

SEQ ID NO: 5786475 - DNA, 17 bp, Homo sapiens
tacagtaaagtttaaaa

SEQ ID NO: 5786476 - DNA, 19 bp, Homo sapiens
tacagtaaagtttaaaaaa

SEQ ID NO: 5786477 - DNA, 13 bp, Homo sapiens
tacagtaaataaa

SEQ ID NO: 5786478 - DNA, 15 bp, Homo sapiens
tacagtaaataaatt

SEQ ID NO: 5786479 - DNA, 16 bp, Homo sapiens
tacagtaaataaattg

SEQ ID NO: 5786480 - DNA, 21 bp, Homo sapiens
tacagtaaataaattgtttga

SEQ ID NO: 5786481 - DNA, 12 bp, Homo sapiens
tacagtaaatgt

SEQ ID NO: 5786482 - DNA, 14 bp, Homo sapiens
tacagtaaatgtta

SEQ ID NO: 5786483 - DNA, 19 bp, Homo sapiens
tacagtaaccaaaacagca

SEQ ID NO: 5786484 - DNA, 16 bp, Homo sapiens
tacagtaactgtgact

SEQ ID NO: 5786485 - DNA, 13 bp, Homo sapiens
tacagtaacttta

SEQ ID NO: 5786486 - DNA, 16 bp, Homo sapiens
tacagtaactttatgt

SEQ ID NO: 5786487 - DNA, 23 bp, Homo sapiens
tacagtaagctggtttacagatg

SEQ ID NO: 5786488 - DNA, 13 bp, Homo sapiens
tacagtaataaat

SEQ ID NO: 5786489 - DNA, 17 bp, Homo sapiens
tacagtaatgaaatgtt

SEQ ID NO: 5786490 - DNA, 20 bp, Homo sapiens
tacagtacaatcagcagtct

SEQ ID NO: 5786491 - DNA, 21 bp, Homo sapiens
tacagtacatgtttattatgt

SEQ ID NO: 5786492 - DNA, 15 bp, Homo sapiens
tacagtactatgtaa

SEQ ID NO: 5786493 - DNA, 17 bp, Homo sapiens
tacagtactgttcccaa

SEQ ID NO: 5786494 - DNA, 16 bp, Homo sapiens
tacagtacttccagat

SEQ ID NO: 5786495 - DNA, 23 bp, Homo sapiens
tacagtagaaggagattgtgggg

SEQ ID NO: 5786496 - DNA, 17 bp, Homo sapiens
tacagtagattttccaa

SEQ ID NO: 5786497 - DNA, 14 bp, Homo sapiens
tacagtagccttat

SEQ ID NO: 5786498 - DNA, 22 bp, Homo sapiens
tacagtagctgtggggagctgg

SEQ ID NO: 5786499 - DNA, 16 bp, Homo sapiens
tacagtagcttaaata

SEQ ID NO: 5786500 - DNA, 17 bp, Homo sapiens
tacagtagcttaaataa

SEQ ID NO: 5786501 - DNA, 13 bp, Homo sapiens
tacagtagtataa

SEQ ID NO: 5786502 - DNA, 14 bp, Homo sapiens
tacagtagtataat

SEQ ID NO: 5786503 - DNA, 15 bp, Homo sapiens
tacagtagtataatg

SEQ ID NO: 5786504 - DNA, 16 bp, Homo sapiens
tacagtagtatctgct

SEQ ID NO: 5786505 - DNA, 16 bp, Homo sapiens
tacagtagtgtcatca

SEQ ID NO: 5786506 - DNA, 18 bp, Homo sapiens
tacagtataattaacatg

SEQ ID NO: 5786507 - DNA, 23 bp, Homo sapiens
tacagtataattaacatgttaaa

SEQ ID NO: 5786508 - DNA, 16 bp, Homo sapiens
tacagtatataagctt

SEQ ID NO: 5786509 - DNA, 18 bp, Homo sapiens
tacagtatatcttaagat

SEQ ID NO: 5786510 - DNA, 17 bp, Homo sapiens
tacagtatattcttgta

SEQ ID NO: 5786511 - DNA, 15 bp, Homo sapiens
tacagtatctcaggg

SEQ ID NO: 5786512 - DNA, 17 bp, Homo sapiens
tacagtatcttcaaaaa

SEQ ID NO: 5786513 - DNA, 18 bp, Homo sapiens
tacagtatcttcaaaaat

SEQ ID NO: 5786514 - DNA, 19 bp, Homo sapiens
tacagtatcttcaaaaata

SEQ ID NO: 5786515 - DNA, 20 bp, Homo sapiens
tacagtatcttcaaaaatac

SEQ ID NO: 5786516 - DNA, 21 bp, Homo sapiens
tacagtatgggggttgtaaat

SEQ ID NO: 5786517 - DNA, 15 bp, Homo sapiens
tacagtatgtgtcta

SEQ ID NO: 5786518 - DNA, 19 bp, Homo sapiens
tacagtattatagacaaaa

SEQ ID NO: 5786519 - DNA, 18 bp, Homo sapiens
tacagtattatttagtaa

SEQ ID NO: 5786520 - DNA, 20 bp, Homo sapiens
tacagtattatttagtaaaa

SEQ ID NO: 5786521 - DNA, 13 bp, Homo sapiens
tacagtattgaaa

SEQ ID NO: 5786522 - DNA, 22 bp, Homo sapiens
tacatttatcttctgtttttct

SEQ ID NO: 5786523 - DNA, 18 bp, Homo sapiens
tacatttatgatttaata

SEQ ID NO: 5786524 - DNA, 20 bp, Homo sapiens
tacatttatgtgtgaagcaa

SEQ ID NO: 5786525 - DNA, 17 bp, Homo sapiens
tacatttatttatccag

SEQ ID NO: 5786526 - DNA, 20 bp, Homo sapiens
tacatttatttattactgtc

SEQ ID NO: 5786527 - DNA, 21 bp, Homo sapiens
tacatttcacctactttgtaa

SEQ ID NO: 5786528 - DNA, 15 bp, Homo sapiens
tacatttcatacaac

SEQ ID NO: 5786529 - DNA, 11 bp, Homo sapiens
tacatttcatt

SEQ ID NO: 5786530 - DNA, 17 bp, Homo sapiens
tacatttcatttatact

SEQ ID NO: 5786531 - DNA, 18 bp, Homo sapiens
tacatttcatttatactg

SEQ ID NO: 5786532 - DNA, 21 bp, Homo sapiens
tacatttccaaattcacaagt

SEQ ID NO: 5786533 - DNA, 21 bp, Homo sapiens
tacatttccatttattgtttg

SEQ ID NO: 5786534 - DNA, 22 bp, Homo sapiens
tacatttccatttattgtttga

SEQ ID NO: 5786535 - DNA, 22 bp, Homo sapiens
tacatttccgccacatccctct

SEQ ID NO: 5786536 - DNA, 15 bp, Homo sapiens
tacatttctcaggct

SEQ ID NO: 5786537 - DNA, 22 bp, Homo sapiens
tacatttctcaggctaggccag

SEQ ID NO: 5786538 - DNA, 23 bp, Homo sapiens
tacatttctcctttgataaaata

SEQ ID NO: 5786539 - DNA, 16 bp, Homo sapiens
tacatttctgattctg

SEQ ID NO: 5786540 - DNA, 18 bp, Homo sapiens
tacatttcttttaaaata

SEQ ID NO: 5786541 - DNA, 18 bp, Homo sapiens
tacatttgaacagggcaa

SEQ ID NO: 5786542 - DNA, 16 bp, Homo sapiens
tacatttgaacttgat

SEQ ID NO: 5786543 - DNA, 12 bp, Homo sapiens
tacatttgaata

SEQ ID NO: 5786544 - DNA, 23 bp, Homo sapiens
tacatttgagggcccagccagga

SEQ ID NO: 5786545 - DNA, 23 bp, Homo sapiens
tacatttgatcttgtaaaaatag

SEQ ID NO: 5786546 - DNA, 19 bp, Homo sapiens
tacatttgatgcatgtctt

SEQ ID NO: 5786547 - DNA, 13 bp, Homo sapiens
tacatttgatttg

SEQ ID NO: 5786548 - DNA, 13 bp, Homo sapiens
tacatttgcaatt

SEQ ID NO: 5786549 - DNA, 16 bp, Homo sapiens
tacatttgcagatgtt

SEQ ID NO: 5786550 - DNA, 21 bp, Homo sapiens
tacatttgctccatcctcctg

SEQ ID NO: 5786551 - DNA, 12 bp, Homo sapiens
tacatttggaac

SEQ ID NO: 5786552 - DNA, 18 bp, Homo sapiens
tacatttggataaacaac

SEQ ID NO: 5786553 - DNA, 19 bp, Homo sapiens
tacatttgggagtttttat

SEQ ID NO: 5786554 - DNA, 17 bp, Homo sapiens
tacatttgtaatttaag

SEQ ID NO: 5786555 - DNA, 16 bp, Homo sapiens
tacatttgtactttat

SEQ ID NO: 5786556 - DNA, 14 bp, Homo sapiens
tacatttgtatttt

SEQ ID NO: 5786557 - DNA, 19 bp, Homo sapiens
tacatttgtattttgtgat

SEQ ID NO: 5786558 - DNA, 18 bp, Homo sapiens
tacatttgtatttttcca

SEQ ID NO: 5786559 - DNA, 23 bp, Homo sapiens
tacattttaaaggataatggtga

SEQ ID NO: 5786560 - DNA, 13 bp, Homo sapiens
tacattttagtta

SEQ ID NO: 5786561 - DNA, 11 bp, Homo sapiens
tacattttata

SEQ ID NO: 5786562 - DNA, 15 bp, Homo sapiens
tacattttataattt

SEQ ID NO: 5786563 - DNA, 19 bp, Homo sapiens
tacattttatatctggatt

SEQ ID NO: 5786564 - DNA, 21 bp, Homo sapiens
tacattttatatttttgtaca

SEQ ID NO: 5786565 - DNA, 22 bp, Homo sapiens
tacattttatatttttgtacat

SEQ ID NO: 5786566 - DNA, 12 bp, Homo sapiens
tacattttatgg

SEQ ID NO: 5786567 - DNA, 14 bp, Homo sapiens
tacattttattctg

SEQ ID NO: 5786568 - DNA, 20 bp, Homo sapiens
tacattttattgtcagaatt

SEQ ID NO: 5786569 - DNA, 22 bp, Homo sapiens
tacattttattgtcagaattta

SEQ ID NO: 5786570 - DNA, 14 bp, Homo sapiens
tacattttatttat

SEQ ID NO: 5786571 - DNA, 16 bp, Homo sapiens
tacattttatttatta

SEQ ID NO: 5786572 - DNA, 14 bp, Homo sapiens
tacattttcctgtg

SEQ ID NO: 5786573 - DNA, 20 bp, Homo sapiens
tacattttcgtcctgtagca

SEQ ID NO: 5786574 - DNA, 13 bp, Homo sapiens
tacattttctaaa

SEQ ID NO: 5786575 - DNA, 16 bp, Homo sapiens
tacattttctaaataa

SEQ ID NO: 5786576 - DNA, 21 bp, Homo sapiens
tacattttctaaataaaaata

SEQ ID NO: 5786577 - DNA, 20 bp, Homo sapiens
tacattttctaagaaacatt

SEQ ID NO: 5786578 - DNA, 16 bp, Homo sapiens
tacattttcttgtcca

SEQ ID NO: 5786579 - DNA, 15 bp, Homo sapiens
tacattttctttcat

SEQ ID NO: 5786580 - DNA, 23 bp, Homo sapiens
tacattttgaggttttgtaaaac

SEQ ID NO: 5786581 - DNA, 18 bp, Homo sapiens
tacattttgctctgtgaa

SEQ ID NO: 5786582 - DNA, 14 bp, Homo sapiens
tacattttgtaaaa

SEQ ID NO: 5786583 - DNA, 15 bp, Homo sapiens
tacattttgtaaaat

SEQ ID NO: 5786584 - DNA, 14 bp, Homo sapiens
tacattttgtacca

SEQ ID NO: 5786585 - DNA, 12 bp, Homo sapiens
tacattttgtat

SEQ ID NO: 5786586 - DNA, 16 bp, Homo sapiens
tacattttgtgcagtg

SEQ ID NO: 5786587 - DNA, 12 bp, Homo sapiens
tacattttgtta

SEQ ID NO: 5786588 - DNA, 16 bp, Homo sapiens
tacattttgttgtaaa

SEQ ID NO: 5786589 - DNA, 17 bp, Homo sapiens
tacattttgttgtaaaa

SEQ ID NO: 5786590 - DNA, 14 bp, Homo sapiens
tacatttttaaatg

SEQ ID NO: 5786591 - DNA, 23 bp, Homo sapiens
tacatttttaagtgctgcattta

SEQ ID NO: 5786592 - DNA, 21 bp, Homo sapiens
tacatttttacaataaataat

SEQ ID NO: 5786593 - DNA, 20 bp, Homo sapiens
tacatttttagcctgtgtca

SEQ ID NO: 5786594 - DNA, 14 bp, Homo sapiens
tacatttttattta

SEQ ID NO: 5786595 - DNA, 19 bp, Homo sapiens
tacatttttatttttggtt

SEQ ID NO: 5786596 - DNA, 20 bp, Homo sapiens
tacatttttgatcaaatgta

SEQ ID NO: 5786597 - DNA, 20 bp, Homo sapiens
tacatttttgtctttatctc

SEQ ID NO: 5786598 - DNA, 16 bp, Homo sapiens
tacattttttaaaact

SEQ ID NO: 5786599 - DNA, 19 bp, Homo sapiens
tacattttttaaaactgaa

SEQ ID NO: 5786600 - DNA, 23 bp, Homo sapiens
tacattttttctaataaagccat

SEQ ID NO: 5786601 - DNA, 15 bp, Homo sapiens
tacattttttgaaat

SEQ ID NO: 5786602 - DNA, 16 bp, Homo sapiens
tacattttttgaaatg

SEQ ID NO: 5786603 - DNA, 22 bp, Homo sapiens
tacattttttgaaatgctgaaa

SEQ ID NO: 5786604 - DNA, 16 bp, Homo sapiens
taccaaaaaaaggaag

SEQ ID NO: 5786605 - DNA, 17 bp, Homo sapiens
taccaaaaaaaggaagg

SEQ ID NO: 5786606 - DNA, 15 bp, Homo sapiens
taccaaaaaagaaag

SEQ ID NO: 5786607 - DNA, 22 bp, Homo sapiens
taccaaaaaccatgttgcgttc

SEQ ID NO: 5786608 - DNA, 21 bp, Homo sapiens
taccaaaaccatccatcccta

SEQ ID NO: 5786609 - DNA, 15 bp, Homo sapiens
taccaaaagacatta

SEQ ID NO: 5786610 - DNA, 22 bp, Homo sapiens
taccaaaagacattagagaaaa

SEQ ID NO: 5786611 - DNA, 13 bp, Homo sapiens
taccaaaatttta

SEQ ID NO: 5786612 - DNA, 17 bp, Homo sapiens
taccaaacaaggaagcc

SEQ ID NO: 5786613 - DNA, 21 bp, Homo sapiens
taccaaacaaggaagccaaag

SEQ ID NO: 5786614 - DNA, 23 bp, Homo sapiens
taccaaacaaggaagccaaagtt

SEQ ID NO: 5786615 - DNA, 13 bp, Homo sapiens
taccaaacactca

SEQ ID NO: 5786616 - DNA, 15 bp, Homo sapiens
taccaaacactcagt

SEQ ID NO: 5786617 - DNA, 17 bp, Homo sapiens
taccaaacattacaaaa

SEQ ID NO: 5786618 - DNA, 18 bp, Homo sapiens
taccaaaccgccagcgaa

SEQ ID NO: 5786619 - DNA, 19 bp, Homo sapiens
taccaaagaaacaccactt

SEQ ID NO: 5786620 - DNA, 15 bp, Homo sapiens
taccaaagaatgcat

SEQ ID NO: 5786621 - DNA, 23 bp, Homo sapiens
taccaaagactatttcaaaatgt

SEQ ID NO: 5786622 - DNA, 11 bp, Homo sapiens
taccaaagctg

SEQ ID NO: 5786623 - DNA, 14 bp, Homo sapiens
taccaaagctgttt

SEQ ID NO: 5786624 - DNA, 17 bp, Homo sapiens
taccaaagtgtcttttg

SEQ ID NO: 5786625 - DNA, 20 bp, Homo sapiens
taccaaagtgtcttttgaca

SEQ ID NO: 5786626 - DNA, 16 bp, Homo sapiens
taccaaatacacattt

SEQ ID NO: 5786627 - DNA, 21 bp, Homo sapiens
taccaaatacacatttcacat

SEQ ID NO: 5786628 - DNA, 22 bp, Homo sapiens
taccaaatacacatttcacatt

SEQ ID NO: 5786629 - DNA, 14 bp, Homo sapiens
taccaaatataaac

SEQ ID NO: 5786630 - DNA, 16 bp, Homo sapiens
taccaaatataaactt

SEQ ID NO: 5786631 - DNA, 18 bp, Homo sapiens
taccaaatataaacttgt

SEQ ID NO: 5786632 - DNA, 13 bp, Homo sapiens
taccaaatatttt

SEQ ID NO: 5786633 - DNA, 12 bp, Homo sapiens
taccaaatctca

SEQ ID NO: 5786634 - DNA, 20 bp, Homo sapiens
taccaaatctgacatattat

SEQ ID NO: 5786635 - DNA, 15 bp, Homo sapiens
taccaaatgaaatgc

SEQ ID NO: 5786636 - DNA, 17 bp, Homo sapiens
taccaacatgtatctgt

SEQ ID NO: 5786637 - DNA, 14 bp, Homo sapiens
taccaacctgaaag

SEQ ID NO: 5786638 - DNA, 14 bp, Homo sapiens
taccaactatttca

SEQ ID NO: 5786639 - DNA, 15 bp, Homo sapiens
taccaactatttcaa

SEQ ID NO: 5786640 - DNA, 14 bp, Homo sapiens
taccaactggaagc

SEQ ID NO: 5786641 - DNA, 14 bp, Homo sapiens
taccaactgggcct

SEQ ID NO: 5786642 - DNA, 14 bp, Homo sapiens
taccaactttactg

SEQ ID NO: 5786643 - DNA, 17 bp, Homo sapiens
taccaactttctgtaaa

SEQ ID NO: 5786644 - DNA, 21 bp, Homo sapiens
taccaagaaaggaacctgtca

SEQ ID NO: 5786645 - DNA, 14 bp, Homo sapiens
taccaagacataat

SEQ ID NO: 5786646 - DNA, 17 bp, Homo sapiens
taccaagacataatgca

SEQ ID NO: 5786647 - DNA, 13 bp, Homo sapiens
taccaagagaagg

SEQ ID NO: 5786648 - DNA, 23 bp, Homo sapiens
taccaagagtaactttactctgt

SEQ ID NO: 5786649 - DNA, 13 bp, Homo sapiens
taccaagccaccg

SEQ ID NO: 5786650 - DNA, 20 bp, Homo sapiens
taccaagcgcttctttctga

SEQ ID NO: 5786651 - DNA, 15 bp, Homo sapiens
taccaagctgctggg

SEQ ID NO: 5786652 - DNA, 13 bp, Homo sapiens
taccaagctgtca

SEQ ID NO: 5786653 - DNA, 21 bp, Homo sapiens
taccaagctgtcacaggtttt

SEQ ID NO: 5786654 - DNA, 12 bp, Homo sapiens
taccaaggattt

SEQ ID NO: 5786655 - DNA, 18 bp, Homo sapiens
taccaaggtcttcttaat

SEQ ID NO: 5786656 - DNA, 20 bp, Homo sapiens
taccaagtaagacatctcaa

SEQ ID NO: 5786657 - DNA, 21 bp, Homo sapiens
taccaagtaagacatctcaaa

SEQ ID NO: 5786658 - DNA, 15 bp, Homo sapiens
taccaagtatgaagt

SEQ ID NO: 5786659 - DNA, 16 bp, Homo sapiens
taccaagtatgaagta

SEQ ID NO: 5786660 - DNA, 17 bp, Homo sapiens
taccaagtatgaagtat

SEQ ID NO: 5786661 - DNA, 23 bp, Homo sapiens
taccaagtgcttcctacaaagac

SEQ ID NO: 5786662 - DNA, 16 bp, Homo sapiens
taccaagtttcaggta

SEQ ID NO: 5786663 - DNA, 13 bp, Homo sapiens
taccaataaactg

SEQ ID NO: 5786664 - DNA, 14 bp, Homo sapiens
taccaataaactga

SEQ ID NO: 5786665 - DNA, 12 bp, Homo sapiens
taccaataaagt

SEQ ID NO: 5786666 - DNA, 16 bp, Homo sapiens
taccaatagcctgaat

SEQ ID NO: 5786667 - DNA, 16 bp, Homo sapiens
taccaatatttaatct

SEQ ID NO: 5786668 - DNA, 13 bp, Homo sapiens
taccaatcatatt

SEQ ID NO: 5786669 - DNA, 15 bp, Homo sapiens
taccaatcattttaa

SEQ ID NO: 5786670 - DNA, 20 bp, Homo sapiens
taccaatcattttaattatt

SEQ ID NO: 5786671 - DNA, 13 bp, Homo sapiens
taccaatctggga

SEQ ID NO: 5786672 - DNA, 18 bp, Homo sapiens
taccaatgacttccatat

SEQ ID NO: 5786673 - DNA, 14 bp, Homo sapiens
taccaatgcatgca

SEQ ID NO: 5786674 - DNA, 14 bp, Homo sapiens
taccaatgccaaga

SEQ ID NO: 5786675 - DNA, 21 bp, Homo sapiens
taccaatgccaagataattca

SEQ ID NO: 5786676 - DNA, 17 bp, Homo sapiens
taccaatgtaacactgg

SEQ ID NO: 5786677 - DNA, 19 bp, Homo sapiens
taccaatgtgttttctgta

SEQ ID NO: 5786678 - DNA, 20 bp, Homo sapiens
taccaatgtgttttctgtag

SEQ ID NO: 5786679 - DNA, 20 bp, Homo sapiens
taccacaaaccctgctgaac

SEQ ID NO: 5786680 - DNA, 21 bp, Homo sapiens
taccacaaaccctgctgaaca

SEQ ID NO: 5786681 - DNA, 15 bp, Homo sapiens
taccacaagacattt

SEQ ID NO: 5786682 - DNA, 13 bp, Homo sapiens
taccacacaaact

SEQ ID NO: 5786683 - DNA, 15 bp, Homo sapiens
taccacacacagcct

SEQ ID NO: 5786684 - DNA, 13 bp, Homo sapiens
taccacactgagt

SEQ ID NO: 5786685 - DNA, 18 bp, Homo sapiens
taccacacttaaaagatg

SEQ ID NO: 5786686 - DNA, 23 bp, Homo sapiens
taccacagagttttttaaacaaa

SEQ ID NO: 5786687 - DNA, 20 bp, Homo sapiens
taccacagctgcctccgggc

SEQ ID NO: 5786688 - DNA, 20 bp, Homo sapiens
taccacaggatgcatattaa

SEQ ID NO: 5786689 - DNA, 13 bp, Homo sapiens
taccacagtttct

SEQ ID NO: 5786690 - DNA, 18 bp, Homo sapiens
taccacagtttcttctgt

SEQ ID NO: 5786691 - DNA, 16 bp, Homo sapiens
taccacatctgctcta

SEQ ID NO: 5786692 - DNA, 23 bp, Homo sapiens
taccacatggtccatttcatgtg

SEQ ID NO: 5786693 - DNA, 14 bp, Homo sapiens
taccacattctgtc

SEQ ID NO: 5786694 - DNA, 18 bp, Homo sapiens
taccaccagctgtgtcca

SEQ ID NO: 5786695 - DNA, 13 bp, Homo sapiens
taccaccagggcc

SEQ ID NO: 5786696 - DNA, 20 bp, Homo sapiens
taccaccatgcactgtaaat

SEQ ID NO: 5786697 - DNA, 15 bp, Homo sapiens
taccaccccactggc

SEQ ID NO: 5786698 - DNA, 15 bp, Homo sapiens
taccacccccacacc

SEQ ID NO: 5786699 - DNA, 14 bp, Homo sapiens
taccaccccttcct

SEQ ID NO: 5786700 - DNA, 15 bp, Homo sapiens
taccaccccttcctg

SEQ ID NO: 5786701 - DNA, 21 bp, Homo sapiens
taccccttcctgtcctgcctc

SEQ ID NO: 5786702 - DNA, 15 bp, Homo sapiens
taccccttctctgta

SEQ ID NO: 5786703 - DNA, 20 bp, Homo sapiens
taccccttctttgcagggct

SEQ ID NO: 5786704 - DNA, 15 bp, Homo sapiens
taccccttggaaatg

SEQ ID NO: 5786705 - DNA, 15 bp, Homo sapiens
tacccgaaagcatca

SEQ ID NO: 5786706 - DNA, 13 bp, Homo sapiens
tacccgagcccag

SEQ ID NO: 5786707 - DNA, 17 bp, Homo sapiens
tacccgatttgtttatt

SEQ ID NO: 5786708 - DNA, 15 bp, Homo sapiens
tacccgggcagggct

SEQ ID NO: 5786709 - DNA, 23 bp, Homo sapiens
tacccggtggcttctggcacctg

SEQ ID NO: 5786710 - DNA, 14 bp, Homo sapiens
tacccgtgcctggg

SEQ ID NO: 5786711 - DNA, 16 bp, Homo sapiens
tacccgtgcctgggcc

SEQ ID NO: 5786712 - DNA, 20 bp, Homo sapiens
tacccgtgcctgggcccctc

SEQ ID NO: 5786713 - DNA, 14 bp, Homo sapiens
taccctaaccaagt

SEQ ID NO: 5786714 - DNA, 17 bp, Homo sapiens
taccctaaccaagttcc

SEQ ID NO: 5786715 - DNA, 17 bp, Homo sapiens
taccctaatgtcttcat

SEQ ID NO: 5786716 - DNA, 22 bp, Homo sapiens
taccctaatgtcttcataaagt

SEQ ID NO: 5786717 - DNA, 13 bp, Homo sapiens
taccctactgtgg

SEQ ID NO: 5786718 - DNA, 18 bp, Homo sapiens
taccctagaagaaaaccc

SEQ ID NO: 5786719 - DNA, 18 bp, Homo sapiens
taccctaggtctccaccc

SEQ ID NO: 5786720 - DNA, 21 bp, Homo sapiens
taccctaggtctccacccctc

SEQ ID NO: 5786721 - DNA, 23 bp, Homo sapiens
taccctaggtctccacccctcaa

SEQ ID NO: 5786722 - DNA, 15 bp, Homo sapiens
taccctagttctctt

SEQ ID NO: 5786723 - DNA, 13 bp, Homo sapiens
taccctatatcta

SEQ ID NO: 5786724 - DNA, 16 bp, Homo sapiens
taccctattctctctt

SEQ ID NO: 5786725 - DNA, 15 bp, Homo sapiens
taccctcaaagtagg

SEQ ID NO: 5786726 - DNA, 20 bp, Homo sapiens
taccctcaaagtaggtatac

SEQ ID NO: 5786727 - DNA, 18 bp, Homo sapiens
taccctcagcctccaatg

SEQ ID NO: 5786728 - DNA, 22 bp, Homo sapiens
taccctcaggacaatgtctgaa

SEQ ID NO: 5786729 - DNA, 22 bp, Homo sapiens
taccctccacacacttcttcca

SEQ ID NO: 5786730 - DNA, 13 bp, Homo sapiens
taccctccagagt

SEQ ID NO: 5786731 - DNA, 12 bp, Homo sapiens
taccctcccacc

SEQ ID NO: 5786732 - DNA, 13 bp, Homo sapiens
taccctcccaccc

SEQ ID NO: 5786733 - DNA, 18 bp, Homo sapiens
taccctccctgctgtccc

SEQ ID NO: 5786734 - DNA, 22 bp, Homo sapiens
taccctccctgctgtcccctct

SEQ ID NO: 5786735 - DNA, 22 bp, Homo sapiens
taccctcctcccgactgaccac

SEQ ID NO: 5786736 - DNA, 13 bp, Homo sapiens
taccctcctctgc

SEQ ID NO: 5786737 - DNA, 16 bp, Homo sapiens
taccctcctctgctgg

SEQ ID NO: 5786738 - DNA, 17 bp, Homo sapiens
taccctcctctgctggg

SEQ ID NO: 5786739 - DNA, 19 bp, Homo sapiens
taccctcctctgctgggaa

SEQ ID NO: 5786740 - DNA, 18 bp, Homo sapiens
taccctcctgcactgttt

SEQ ID NO: 5786741 - DNA, 17 bp, Homo sapiens
taccctcctgctgagct

SEQ ID NO: 5786742 - DNA, 18 bp, Homo sapiens
taccctcctgctgagctg

SEQ ID NO: 5786743 - DNA, 20 bp, Homo sapiens
taccctcctgctgagctgcc

SEQ ID NO: 5786744 - DNA, 12 bp, Homo sapiens
taccctcctggc

SEQ ID NO: 5786745 - DNA, 19 bp, Homo sapiens
taccctcggctcccgggtc

SEQ ID NO: 5786746 - DNA, 22 bp, Homo sapiens
taccctcggtcattcctgtcaa

SEQ ID NO: 5786747 - DNA, 16 bp, Homo sapiens
taccctctaaaaaaga

SEQ ID NO: 5786748 - DNA, 16 bp, Homo sapiens
taccctctcaaatgga

SEQ ID NO: 5786749 - DNA, 21 bp, Homo sapiens
taccctctcactagtgccaat

SEQ ID NO: 5786750 - DNA, 20 bp, Homo sapiens
taccctctcagctccaggtg

SEQ ID NO: 5786751 - DNA, 14 bp, Homo sapiens
taccctctctttca

SEQ ID NO: 5786752 - DNA, 14 bp, Homo sapiens
taccctctgaaata

SEQ ID NO: 5786753 - DNA, 14 bp, Homo sapiens
taccctctggaggg

SEQ ID NO: 5786754 - DNA, 12 bp, Homo sapiens
taccctctgggt

SEQ ID NO: 5786755 - DNA, 22 bp, Homo sapiens
taccctcttcatggatggggga

SEQ ID NO: 5786756 - DNA, 19 bp, Homo sapiens
taccctcttctcagctcca

SEQ ID NO: 5786757 - DNA, 15 bp, Homo sapiens
taccctctttgctgc

SEQ ID NO: 5786758 - DNA, 16 bp, Homo sapiens
taccctctttgctgca

SEQ ID NO: 5786759 - DNA, 19 bp, Homo sapiens
taccctcttttaccaactt

SEQ ID NO: 5786760 - DNA, 20 bp, Homo sapiens
taccctgaagaaagggatgg

SEQ ID NO: 5786761 - DNA, 17 bp, Homo sapiens
taccctgaggtcactgc

SEQ ID NO: 5786762 - DNA, 17 bp, Homo sapiens
taccctgagttcatcca

SEQ ID NO: 5786763 - DNA, 16 bp, Homo sapiens
taccctgatctggacc

SEQ ID NO: 5786764 - DNA, 13 bp, Homo sapiens
taccctgcagctt

SEQ ID NO: 5786765 - DNA, 14 bp, Homo sapiens
taccctgcagcttg

SEQ ID NO: 5786766 - DNA, 14 bp, Homo sapiens
taccctgcaggcca

SEQ ID NO: 5786767 - DNA, 15 bp, Homo sapiens
taccctgcaggccag

SEQ ID NO: 5786768 - DNA, 17 bp, Homo sapiens
taccctgcaggccaggc

SEQ ID NO: 5786769 - DNA, 18 bp, Homo sapiens
taccctgcaggccaggcc

SEQ ID NO: 5786770 - DNA, 23 bp, Homo sapiens
taccctgcgcccagtccttccac

SEQ ID NO: 5786771 - DNA, 15 bp, Homo sapiens
taccctggcagagaa

SEQ ID NO: 5786772 - DNA, 14 bp, Homo sapiens
taccctggcaggga

SEQ ID NO: 5786773 - DNA, 20 bp, Homo sapiens
taccctggcagggacctgag

SEQ ID NO: 5786774 - DNA, 22 bp, Homo sapiens
taccctggcagggacctgagag

SEQ ID NO: 5786775 - DNA, 16 bp, Homo sapiens
taccctggcccctctc

SEQ ID NO: 5786776 - DNA, 21 bp, Homo sapiens
taccctggcccctctcccttg

SEQ ID NO: 5786777 - DNA, 18 bp, Homo sapiens
taccctgggaaggcctct

SEQ ID NO: 5786778 - DNA, 21 bp, Homo sapiens
taccctgggaaggcctcttgg

SEQ ID NO: 5786779 - DNA, 15 bp, Homo sapiens
taccctgggctctgg

SEQ ID NO: 5786780 - DNA, 14 bp, Homo sapiens
taccctgggctgga

SEQ ID NO: 5786781 - DNA, 20 bp, Homo sapiens
taccctgggtcctcgggccc

SEQ ID NO: 5786782 - DNA, 11 bp, Homo sapiens
taccctgggtg

SEQ ID NO: 5786783 - DNA, 12 bp, Homo sapiens
taccctgggtgt

SEQ ID NO: 5786784 - DNA, 22 bp, Homo sapiens
taccctggtccagtcgggagga

SEQ ID NO: 5786785 - DNA, 20 bp, Homo sapiens
taccctgtacatatctttga

SEQ ID NO: 5786786 - DNA, 17 bp, Homo sapiens
taccctgtctgtccctt

SEQ ID NO: 5786787 - DNA, 18 bp, Homo sapiens
taccctgtgctaagcacg

SEQ ID NO: 5786788 - DNA, 13 bp, Homo sapiens
taccctgtgtcag

SEQ ID NO: 5786789 - DNA, 15 bp, Homo sapiens
taccctgtgtcagag

SEQ ID NO: 5786790 - DNA, 17 bp, Homo sapiens
tacccttaattacttaa

SEQ ID NO: 5786791 - DNA, 13 bp, Homo sapiens
tacccttcctcat

SEQ ID NO: 5786792 - DNA, 21 bp, Homo sapiens
tacccttcctcatctgtgcct

SEQ ID NO: 5786793 - DNA, 15 bp, Homo sapiens
tacccttctacaaaa

SEQ ID NO: 5786794 - DNA, 13 bp, Homo sapiens
tacccttctcctt

SEQ ID NO: 5786795 - DNA, 14 bp, Homo sapiens
tacccttctccttt

SEQ ID NO: 5786796 - DNA, 15 bp, Homo sapiens
tacccttctcctttc

SEQ ID NO: 5786797 - DNA, 21 bp, Homo sapiens
tacccttctcctttccttccc

SEQ ID NO: 5786798 - DNA, 22 bp, Homo sapiens
tacccttctcctttccttccca

SEQ ID NO: 5786799 - DNA, 18 bp, Homo sapiens
tacccttctgtgcccagc

SEQ ID NO: 5786800 - DNA, 18 bp, Homo sapiens
tacccttctttaaatcaa

SEQ ID NO: 5786801 - DNA, 21 bp, Homo sapiens
tacccttctttccatttctct

SEQ ID NO: 5786802 - DNA, 14 bp, Homo sapiens
tacccttcttttat

SEQ ID NO: 5786803 - DNA, 16 bp, Homo sapiens
tacccttgagccctcc

SEQ ID NO: 5786804 - DNA, 14 bp, Homo sapiens
taccctttatagaa

SEQ ID NO: 5786805 - DNA, 12 bp, Homo sapiens
taccctttccca

SEQ ID NO: 5786806 - DNA, 22 bp, Homo sapiens
taccctttcctcctttatcaca

SEQ ID NO: 5786807 - DNA, 18 bp, Homo sapiens
taccctttgctggaagaa

SEQ ID NO: 5786808 - DNA, 16 bp, Homo sapiens
taccctttggggagca

SEQ ID NO: 5786809 - DNA, 13 bp, Homo sapiens
tacccttttcccc

SEQ ID NO: 5786810 - DNA, 13 bp, Homo sapiens
tacccttttcctt

SEQ ID NO: 5786811 - DNA, 15 bp, Homo sapiens
tacccttttcctttt

SEQ ID NO: 5786812 - DNA, 19 bp, Homo sapiens
taccctttttctccagctg

SEQ ID NO: 5786813 - DNA, 18 bp, Homo sapiens
taccgaaacaccccgctc

SEQ ID NO: 5786814 - DNA, 17 bp, Homo sapiens
taccgaaaccttgcctt

SEQ ID NO: 5786815 - DNA, 15 bp, Homo sapiens
taccgaatgtgtctt

SEQ ID NO: 5786816 - DNA, 17 bp, Homo sapiens
taccgaatgtgtcttta

SEQ ID NO: 5786817 - DNA, 19 bp, Homo sapiens
taccgaccatcgtccagcc

SEQ ID NO: 5786818 - DNA, 21 bp, Homo sapiens
taccgaccatcgtccagccct

SEQ ID NO: 5786819 - DNA, 16 bp, Homo sapiens
taccgagacccaccat

SEQ ID NO: 5786820 - DNA, 23 bp, Homo sapiens
taccgagacccaccatccttcca

SEQ ID NO: 5786821 - DNA, 17 bp, Homo sapiens
taccgagagccaaacag

SEQ ID NO: 5786822 - DNA, 19 bp, Homo sapiens
taccgaggacagcctgcct

SEQ ID NO: 5786823 - DNA, 17 bp, Homo sapiens
taccgagtctcttctcc

SEQ ID NO: 5786824 - DNA, 18 bp, Homo sapiens
taccgataaatgaacatt

SEQ ID NO: 5786825 - DNA, 13 bp, Homo sapiens
taccgatggtccc

SEQ ID NO: 5786826 - DNA, 16 bp, Homo sapiens
taccgatggtcccagg

SEQ ID NO: 5786827 - DNA, 15 bp, Homo sapiens
taccgatttctgcta

SEQ ID NO: 5786828 - DNA, 19 bp, Homo sapiens
taccgcaggcgggcgagcc

SEQ ID NO: 5786829 - DNA, 22 bp, Homo sapiens
taccgcatggcagctgggccca

SEQ ID NO: 5786830 - DNA, 18 bp, Homo sapiens
taccgctggccctgccgt

SEQ ID NO: 5786831 - DNA, 13 bp, Homo sapiens
taccgcttcctta

SEQ ID NO: 5786832 - DNA, 13 bp, Homo sapiens
taccggagctcca

SEQ ID NO: 5786833 - DNA, 19 bp, Homo sapiens
taccggttagcatggtttt

SEQ ID NO: 5786834 - DNA, 13 bp, Homo sapiens
taccgtctacatt

SEQ ID NO: 5786835 - DNA, 17 bp, Homo sapiens
taccgtctacatttcac

SEQ ID NO: 5786836 - DNA, 24 bp, Homo sapiens
taccgtgacagcccgcaggatcag

SEQ ID NO: 5786837 - DNA, 23 bp, Homo sapiens
taccgtgagtgacatagcctcat

SEQ ID NO: 5786838 - DNA, 18 bp, Homo sapiens
taccgtgccactttccac

SEQ ID NO: 5786839 - DNA, 19 bp, Homo sapiens
taccgtgccactttccacc

SEQ ID NO: 5786840 - DNA, 20 bp, Homo sapiens
taccgtgccactttccacca

SEQ ID NO: 5786841 - DNA, 13 bp, Homo sapiens
taccgtgccagca

SEQ ID NO: 5786842 - DNA, 14 bp, Homo sapiens
taccgtgccagcag

SEQ ID NO: 5786843 - DNA, 21 bp, Homo sapiens
taccgtggatctccttccctt

SEQ ID NO: 5786844 - DNA, 22 bp, Homo sapiens
taccgtggatctccttcccttc

SEQ ID NO: 5786845 - DNA, 18 bp, Homo sapiens
taccgtggatttgtactt

SEQ ID NO: 5786846 - DNA, 15 bp, Homo sapiens
taccgtttcttccct

SEQ ID NO: 5786847 - DNA, 18 bp, Homo sapiens
taccgtttggtgtctgat

SEQ ID NO: 5786848 - DNA, 23 bp, Homo sapiens
tacctaaaaggaaatctcacccc

SEQ ID NO: 5786849 - DNA, 19 bp, Homo sapiens
tacctaaacagatataaat

SEQ ID NO: 5786850 - DNA, 22 bp, Homo sapiens
tacctaaacagatataaatggc

SEQ ID NO: 5786851 - DNA, 23 bp, Homo sapiens
tacctaaactgagctgaatgttt

SEQ ID NO: 5786852 - DNA, 23 bp, Homo sapiens
tacctaaagacgtctctttttgg

SEQ ID NO: 5786853 - DNA, 22 bp, Homo sapiens
tacctaacgaagtatccttcag

SEQ ID NO: 5786854 - DNA, 17 bp, Homo sapiens
tacctaagaagtacatt

SEQ ID NO: 5786855 - DNA, 21 bp, Homo sapiens
tacctaagaatttcactgtct

SEQ ID NO: 5786856 - DNA, 23 bp, Homo sapiens
tacctaagaatttcactgtcttt

SEQ ID NO: 5786857 - DNA, 21 bp, Homo sapiens
tacctaagactaatgctttct

SEQ ID NO: 5786858 - DNA, 19 bp, Homo sapiens
tacctaagatttctgtctt

SEQ ID NO: 5786859 - DNA, 12 bp, Homo sapiens
tacctaagtaaa

SEQ ID NO: 5786860 - DNA, 20 bp, Homo sapiens
tacctaagtgacatttgtag

SEQ ID NO: 5786861 - DNA, 21 bp, Homo sapiens
tacctaatgtctcactgttct

SEQ ID NO: 5786862 - DNA, 22 bp, Homo sapiens
tacctaatgtctcactgttctg

SEQ ID NO: 5786863 - DNA, 17 bp, Homo sapiens
tacctaattagagcaga

SEQ ID NO: 5786864 - DNA, 20 bp, Homo sapiens
tacctaattagagcagatga

SEQ ID NO: 5786865 - DNA, 13 bp, Homo sapiens
tacctaattatta

SEQ ID NO: 5786866 - DNA, 18 bp, Homo sapiens
tacctacaaaatgagatt

SEQ ID NO: 5786867 - DNA, 23 bp, Homo sapiens
tacctacaaaatgagattcagtg

SEQ ID NO: 5786868 - DNA, 17 bp, Homo sapiens
tacctacaataaactgg

SEQ ID NO: 5786869 - DNA, 19 bp, Homo sapiens
tacctacaataaactggta

SEQ ID NO: 5786870 - DNA, 13 bp, Homo sapiens
tacctacatattt

SEQ ID NO: 5786871 - DNA, 14 bp, Homo sapiens
tacctacatatttg

SEQ ID NO: 5786872 - DNA, 17 bp, Homo sapiens
tacctaccaccttccct

SEQ ID NO: 5786873 - DNA, 14 bp, Homo sapiens
tacctacctgtgtg

SEQ ID NO: 5786874 - DNA, 15 bp, Homo sapiens
tacctactattggcc

SEQ ID NO: 5786875 - DNA, 16 bp, Homo sapiens
tacctactggtgtaat

SEQ ID NO: 5786876 - DNA, 23 bp, Homo sapiens
tacctactggtgtaatctcaatg

SEQ ID NO: 5786877 - DNA, 21 bp, Homo sapiens
tacctactgtgtgccaggggc

SEQ ID NO: 5786878 - DNA, 17 bp, Homo sapiens
tactaataaaatacata

SEQ ID NO: 5786879 - DNA, 15 bp, Homo sapiens
tactaataaaatgtg

SEQ ID NO: 5786880 - DNA, 13 bp, Homo sapiens
tactaataaatat

SEQ ID NO: 5786881 - DNA, 14 bp, Homo sapiens
tactaataaatata

SEQ ID NO: 5786882 - DNA, 23 bp, Homo sapiens
tactaatagaataaaggcagttt

SEQ ID NO: 5786883 - DNA, 15 bp, Homo sapiens
tactaatagacaatt

SEQ ID NO: 5786884 - DNA, 23 bp, Homo sapiens
tactaatagagtacttaatatac

SEQ ID NO: 5786885 - DNA, 13 bp, Homo sapiens
tactaatctgaga

SEQ ID NO: 5786886 - DNA, 23 bp, Homo sapiens
tactaatctgagattgtgtttgt

SEQ ID NO: 5786887 - DNA, 18 bp, Homo sapiens
tactaatgaaatttacag

SEQ ID NO: 5786888 - DNA, 15 bp, Homo sapiens
tactaatgaagtatt

SEQ ID NO: 5786889 - DNA, 17 bp, Homo sapiens
tactaatgatgctttta

SEQ ID NO: 5786890 - DNA, 13 bp, Homo sapiens
tactaatgatgtt

SEQ ID NO: 5786891 - DNA, 16 bp, Homo sapiens
tactaatgatgttttc

SEQ ID NO: 5786892 - DNA, 19 bp, Homo sapiens
tactaatgatttagtgttg

SEQ ID NO: 5786893 - DNA, 20 bp, Homo sapiens
tactaatgtaaaatgatttg

SEQ ID NO: 5786894 - DNA, 16 bp, Homo sapiens
tactaatgtctcttct

SEQ ID NO: 5786895 - DNA, 20 bp, Homo sapiens
tactaatgtctcttctaaca

SEQ ID NO: 5786896 - DNA, 15 bp, Homo sapiens
tactaatgttatttc

SEQ ID NO: 5786897 - DNA, 16 bp, Homo sapiens
tactaattctatttct

SEQ ID NO: 5786898 - DNA, 13 bp, Homo sapiens
tactaatttattg

SEQ ID NO: 5786899 - DNA, 14 bp, Homo sapiens
tactaatttattgc

SEQ ID NO: 5786900 - DNA, 18 bp, Homo sapiens
tactaattttacacatta

SEQ ID NO: 5786901 - DNA, 22 bp, Homo sapiens
tactacaaaaccgtttagtcat

SEQ ID NO: 5786902 - DNA, 17 bp, Homo sapiens
tactacaaatggatgac

SEQ ID NO: 5786903 - DNA, 16 bp, Homo sapiens
tactacaacttttgtt

SEQ ID NO: 5786904 - DNA, 17 bp, Homo sapiens
tactacaacttttgttt

SEQ ID NO: 5786905 - DNA, 18 bp, Homo sapiens
tactacacactgctcatt

SEQ ID NO: 5786906 - DNA, 22 bp, Homo sapiens
tactacacatttttaaattgtt

SEQ ID NO: 5786907 - DNA, 15 bp, Homo sapiens
tactacactgaggag

SEQ ID NO: 5786908 - DNA, 16 bp, Homo sapiens
tactacagaaattctg

SEQ ID NO: 5786909 - DNA, 19 bp, Homo sapiens
tactacagctatatttgat

SEQ ID NO: 5786910 - DNA, 15 bp, Homo sapiens
tactacagctatgaa

SEQ ID NO: 5786911 - DNA, 17 bp, Homo sapiens
tactacagtcaagatag

SEQ ID NO: 5786912 - DNA, 20 bp, Homo sapiens
tactacagtcctcccatctc

SEQ ID NO: 5786913 - DNA, 18 bp, Homo sapiens
tactacagttcttttgtt

SEQ ID NO: 5786914 - DNA, 19 bp, Homo sapiens
tactacataggttaatttt

SEQ ID NO: 5786915 - DNA, 22 bp, Homo sapiens
tactacatcagtgtggaaaaaa

SEQ ID NO: 5786916 - DNA, 17 bp, Homo sapiens
tactacatcgccctcca

SEQ ID NO: 5786917 - DNA, 11 bp, Homo sapiens
tactacatctg

SEQ ID NO: 5786918 - DNA, 21 bp, Homo sapiens
tactacatttgaacagggcaa

SEQ ID NO: 5786919 - DNA, 15 bp, Homo sapiens
tactacatttgcatg

SEQ ID NO: 5786920 - DNA, 16 bp, Homo sapiens
tactacatttgcatgc

SEQ ID NO: 5786921 - DNA, 16 bp, Homo sapiens
tactacccatagaaaa

SEQ ID NO: 5786922 - DNA, 15 bp, Homo sapiens
tactacccgagccca

SEQ ID NO: 5786923 - DNA, 15 bp, Homo sapiens
tactaccctttgctg

SEQ ID NO: 5786924 - DNA, 13 bp, Homo sapiens
tactacctagaag

SEQ ID NO: 5786925 - DNA, 22 bp, Homo sapiens
tactacctagaagtaagaagag

SEQ ID NO: 5786926 - DNA, 18 bp, Homo sapiens
tactacctcactactaca

SEQ ID NO: 5786927 - DNA, 14 bp, Homo sapiens
tactacctgtaatg

SEQ ID NO: 5786928 - DNA, 20 bp, Homo sapiens
tactacctgtcccctatgcc

SEQ ID NO: 5786929 - DNA, 22 bp, Homo sapiens
tactacctgtgtatatagtttt

SEQ ID NO: 5786930 - DNA, 13 bp, Homo sapiens
tactaccttgaaa

SEQ ID NO: 5786931 - DNA, 18 bp, Homo sapiens
tactacggagaaactcat

SEQ ID NO: 5786932 - DNA, 19 bp, Homo sapiens
tactacggagaaactcatc

SEQ ID NO: 5786933 - DNA, 15 bp, Homo sapiens
tactactactgttat

SEQ ID NO: 5786934 - DNA, 18 bp, Homo sapiens
tactactagatcacttgt

SEQ ID NO: 5786935 - DNA, 17 bp, Homo sapiens
tactactagatgtcttt

SEQ ID NO: 5786936 - DNA, 15 bp, Homo sapiens
tactactattctgtt

SEQ ID NO: 5786937 - DNA, 22 bp, Homo sapiens
tactactattctgttaaaatca

SEQ ID NO: 5786938 - DNA, 13 bp, Homo sapiens
tactactcctttg

SEQ ID NO: 5786939 - DNA, 17 bp, Homo sapiens
tactactcctttggaaa

SEQ ID NO: 5786940 - DNA, 20 bp, Homo sapiens
tactactgaaacagatttca

SEQ ID NO: 5786941 - DNA, 17 bp, Homo sapiens
tactactgagggaaata

SEQ ID NO: 5786942 - DNA, 13 bp, Homo sapiens
tactactgcagtc

SEQ ID NO: 5786943 - DNA, 16 bp, Homo sapiens
tactactgcagtcttt

SEQ ID NO: 5786944 - DNA, 18 bp, Homo sapiens
tactactgcagtctttat

SEQ ID NO: 5786945 - DNA, 22 bp, Homo sapiens
tactactgctgcaaagtgcaaa

SEQ ID NO: 5786946 - DNA, 12 bp, Homo sapiens
tactactgtaaa

SEQ ID NO: 5786947 - DNA, 12 bp, Homo sapiens
tactactgtaga

SEQ ID NO: 5786948 - DNA, 19 bp, Homo sapiens
tactactgtagaactgcaa

SEQ ID NO: 5786949 - DNA, 22 bp, Homo sapiens
tactacttaaaatgattctcta

SEQ ID NO: 5786950 - DNA, 20 bp, Homo sapiens
tactactttctctttttcgt

SEQ ID NO: 5786951 - DNA, 19 bp, Homo sapiens
tactactttgcctcttcag

SEQ ID NO: 5786952 - DNA, 13 bp, Homo sapiens
tactactttgtgt

SEQ ID NO: 5786953 - DNA, 18 bp, Homo sapiens
tactagaaatatattcat

SEQ ID NO: 5786954 - DNA, 21 bp, Homo sapiens
tactagaaatgggaatcatgg

SEQ ID NO: 5786955 - DNA, 12 bp, Homo sapiens
tactagaacaca

SEQ ID NO: 5786956 - DNA, 16 bp, Homo sapiens
tactagaaccttctaa

SEQ ID NO: 5786957 - DNA, 14 bp, Homo sapiens
tactagaagatgaa

SEQ ID NO: 5786958 - DNA, 17 bp, Homo sapiens
tactagaagatgaatac

SEQ ID NO: 5786959 - DNA, 15 bp, Homo sapiens
tactagaatttgtat

SEQ ID NO: 5786960 - DNA, 17 bp, Homo sapiens
tactagaatttgtattt

SEQ ID NO: 5786961 - DNA, 19 bp, Homo sapiens
tactagaatttgtattttg

SEQ ID NO: 5786962 - DNA, 13 bp, Homo sapiens
tactagactttga

SEQ ID NO: 5786963 - DNA, 16 bp, Homo sapiens
tactagactttgattt

SEQ ID NO: 5786964 - DNA, 23 bp, Homo sapiens
tactagagaaagacaaaatgtga

SEQ ID NO: 5786965 - DNA, 21 bp, Homo sapiens
tactagatgcatcactgggtg

SEQ ID NO: 5786966 - DNA, 14 bp, Homo sapiens
tactagatgtcttt

SEQ ID NO: 5786967 - DNA, 15 bp, Homo sapiens
tactagcaataagtt

SEQ ID NO: 5786968 - DNA, 21 bp, Homo sapiens
tactagcaataagttgaatga

SEQ ID NO: 5786969 - DNA, 20 bp, Homo sapiens
tactagctaactaattctgt

SEQ ID NO: 5786970 - DNA, 12 bp, Homo sapiens
tactagctgtgc

SEQ ID NO: 5786971 - DNA, 14 bp, Homo sapiens
tactagctgtgcaa

SEQ ID NO: 5786972 - DNA, 23 bp, Homo sapiens
tactaggaagaacgttttttcct

SEQ ID NO: 5786973 - DNA, 22 bp, Homo sapiens
tactaggatacagaaatgcaaa

SEQ ID NO: 5786974 - DNA, 23 bp, Homo sapiens
tactaggcttaatacctgggtga

SEQ ID NO: 5786975 - DNA, 18 bp, Homo sapiens
tactagggagaaggtttc

SEQ ID NO: 5786976 - DNA, 15 bp, Homo sapiens
tactagggaggctga

SEQ ID NO: 5786977 - DNA, 16 bp, Homo sapiens
tactaggtaacttcat

SEQ ID NO: 5786978 - DNA, 22 bp, Homo sapiens
tactaggtctgctcctgaacca

SEQ ID NO: 5786979 - DNA, 20 bp, Homo sapiens
tactaggttggacagccccc

SEQ ID NO: 5786980 - DNA, 13 bp, Homo sapiens
tactagtaataat

SEQ ID NO: 5786981 - DNA, 14 bp, Homo sapiens
tactagtactgtgt

SEQ ID NO: 5786982 - DNA, 21 bp, Homo sapiens
tactagtactgtgtactgtat

SEQ ID NO: 5786983 - DNA, 20 bp, Homo sapiens
tactagtcaccagagacttt

SEQ ID NO: 5786984 - DNA, 22 bp, Homo sapiens
tactagtcaccagagactttag

SEQ ID NO: 5786985 - DNA, 19 bp, Homo sapiens
tactagtctgtgtgggact

SEQ ID NO: 5786986 - DNA, 23 bp, Homo sapiens
tactagtctgtgtgggactgtac

SEQ ID NO: 5786987 - DNA, 19 bp, Homo sapiens
tactagtgggatcaacaat

SEQ ID NO: 5786988 - DNA, 15 bp, Homo sapiens
tactagtgtgactcc

SEQ ID NO: 5786989 - DNA, 16 bp, Homo sapiens
tactagtgtggtgtgt

SEQ ID NO: 5786990 - DNA, 14 bp, Homo sapiens
tactagtgttctgt

SEQ ID NO: 5786991 - DNA, 15 bp, Homo sapiens
tactagtgtttaagt

SEQ ID NO: 5786992 - DNA, 19 bp, Homo sapiens
tactagttacacatcttca

SEQ ID NO: 5786993 - DNA, 22 bp, Homo sapiens
tactataatcaaatgatttcat

SEQ ID NO: 5786994 - DNA, 23 bp, Homo sapiens
tactataattgtaaatattttga

SEQ ID NO: 5786995 - DNA, 15 bp, Homo sapiens
tactatacaacaatg

SEQ ID NO: 5786996 - DNA, 22 bp, Homo sapiens
tactatagaccaaaaggagaga

SEQ ID NO: 5786997 - DNA, 19 bp, Homo sapiens
tactatagatataactgta

SEQ ID NO: 5786998 - DNA, 13 bp, Homo sapiens
tactatagtacca

SEQ ID NO: 5786999 - DNA, 16 bp, Homo sapiens
tactatagtaccagta

SEQ ID NO: 5787000 - DNA, 18 bp, Homo sapiens
tactatagttatatagat

SEQ ID NO: 5787001 - DNA, 16 bp, Homo sapiens
tactatatctgtttta

SEQ ID NO: 5787002 - DNA, 14 bp, Homo sapiens
tactatatgaaaag

SEQ ID NO: 5787003 - DNA, 11 bp, Homo sapiens
tactatattaa

SEQ ID NO: 5787004 - DNA, 18 bp, Homo sapiens
tactatattaaattctga

SEQ ID NO: 5787005 - DNA, 14 bp, Homo sapiens
tactatatttgtga

SEQ ID NO: 5787006 - DNA, 17 bp, Homo sapiens
tactatcacacatgaat

SEQ ID NO: 5787007 - DNA, 21 bp, Homo sapiens
tactatcatactactgaaaca

SEQ ID NO: 5787008 - DNA, 15 bp, Homo sapiens
tactatcatctctta

SEQ ID NO: 5787009 - DNA, 18 bp, Homo sapiens
tactatcatctcttaaat

SEQ ID NO: 5787010 - DNA, 17 bp, Homo sapiens
tactatccagttactgc

SEQ ID NO: 5787011 - DNA, 15 bp, Homo sapiens
tactatccatttctt

SEQ ID NO: 5787012 - DNA, 21 bp, Homo sapiens
tactatccccaaactccttta

SEQ ID NO: 5787013 - DNA, 17 bp, Homo sapiens
tactatctactctcctc

SEQ ID NO: 5787014 - DNA, 17 bp, Homo sapiens
tactatcttatctcaga

SEQ ID NO: 5787015 - DNA, 22 bp, Homo sapiens
tactatcttatctcagatattt

SEQ ID NO: 5787016 - DNA, 20 bp, Homo sapiens
tactatctttgtctaaacaa

SEQ ID NO: 5787017 - DNA, 20 bp, Homo sapiens
tactatgaaatgaaagaact

SEQ ID NO: 5787018 - DNA, 18 bp, Homo sapiens
tactatgacaatcttatt

SEQ ID NO: 5787019 - DNA, 22 bp, Homo sapiens
tactatgatctcaggagcttgc

SEQ ID NO: 5787020 - DNA, 17 bp, Homo sapiens
tactatgatgggcttct

SEQ ID NO: 5787021 - DNA, 13 bp, Homo sapiens
tactatgcctgtg

SEQ ID NO: 5787022 - DNA, 21 bp, Homo sapiens
tactatggaaagcagccatat

SEQ ID NO: 5787023 - DNA, 19 bp, Homo sapiens
tactatggaagccacatca

SEQ ID NO: 5787024 - DNA, 21 bp, Homo sapiens
tactatggaagccacatcact

SEQ ID NO: 5787025 - DNA, 23 bp, Homo sapiens
tactatggccctggcctagcata

SEQ ID NO: 5787026 - DNA, 16 bp, Homo sapiens
tactatggctgattta

SEQ ID NO: 5787027 - DNA, 17 bp, Homo sapiens
tactatggtaacacttt

SEQ ID NO: 5787028 - DNA, 22 bp, Homo sapiens
tactatgtaagggctttaaata

SEQ ID NO: 5787029 - DNA, 20 bp, Homo sapiens
tactatgtattaccagcccc

SEQ ID NO: 5787030 - DNA, 21 bp, Homo sapiens
tactatgtattaccagccccc

SEQ ID NO: 5787031 - DNA, 20 bp, Homo sapiens
tactatgtgccagttcctgt

SEQ ID NO: 5787032 - DNA, 21 bp, Homo sapiens
tactatgtgccagttcctgta

SEQ ID NO: 5787033 - DNA, 15 bp, Homo sapiens
tactatgtgctgggt

SEQ ID NO: 5787034 - DNA, 13 bp, Homo sapiens
tactattaaacat

SEQ ID NO: 5787035 - DNA, 13 bp, Homo sapiens
tactattaacatg

SEQ ID NO: 5787036 - DNA, 15 bp, Homo sapiens
tactattaagcaaga

SEQ ID NO: 5787037 - DNA, 16 bp, Homo sapiens
tactattaatagaaca

SEQ ID NO: 5787038 - DNA, 20 bp, Homo sapiens
tactattatggaattactct

SEQ ID NO: 5787039 - DNA, 15 bp, Homo sapiens
tactattcaatgcaa

SEQ ID NO: 5787040 - DNA, 17 bp, Homo sapiens
tactattcaatgcaatg

SEQ ID NO: 5787041 - DNA, 19 bp, Homo sapiens
tactattcaggtaacacta

SEQ ID NO: 5787042 - DNA, 13 bp, Homo sapiens
tactattgcctca

SEQ ID NO: 5787043 - DNA, 13 bp, Homo sapiens
tactattgcttaa

SEQ ID NO: 5787044 - DNA, 19 bp, Homo sapiens
tactattggacagacacag

SEQ ID NO: 5787045 - DNA, 15 bp, Homo sapiens
tactattgttacatt

SEQ ID NO: 5787046 - DNA, 22 bp, Homo sapiens
tactattgttgctgaaacttgc

SEQ ID NO: 5787047 - DNA, 15 bp, Homo sapiens
tactattgtttaaaa

SEQ ID NO: 5787048 - DNA, 11 bp, Homo sapiens
tactatttaaa

SEQ ID NO: 5787049 - DNA, 19 bp, Homo sapiens
tactatttaactgactatt

SEQ ID NO: 5787050 - DNA, 21 bp, Homo sapiens
tactatttaagatgtgaaaat

SEQ ID NO: 5787051 - DNA, 13 bp, Homo sapiens
tactatttagatt

SEQ ID NO: 5787052 - DNA, 12 bp, Homo sapiens
tactatttcaca

SEQ ID NO: 5787053 - DNA, 13 bp, Homo sapiens
tactatttcacaa

SEQ ID NO: 5787054 - DNA, 22 bp, Homo sapiens
tactatttcttgtggttataac

SEQ ID NO: 5787055 - DNA, 19 bp, Homo sapiens
tactatttgaaaaaagaag

SEQ ID NO: 5787056 - DNA, 14 bp, Homo sapiens
tactgcaaattgat

SEQ ID NO: 5787057 - DNA, 19 bp, Homo sapiens
tactgcaaattgattgtct

SEQ ID NO: 5787058 - DNA, 22 bp, Homo sapiens
tactgcaaattgattgtctttc

SEQ ID NO: 5787059 - DNA, 23 bp, Homo sapiens
tactgcaacttaacttaaaattg

SEQ ID NO: 5787060 - DNA, 14 bp, Homo sapiens
tactgcaagaaaat

SEQ ID NO: 5787061 - DNA, 14 bp, Homo sapiens
tactgcaagagcca

SEQ ID NO: 5787062 - DNA, 13 bp, Homo sapiens
tactgcaataaat

SEQ ID NO: 5787063 - DNA, 15 bp, Homo sapiens
tactgcaatgtctgt

SEQ ID NO: 5787064 - DNA, 21 bp, Homo sapiens
tactgcaatgtctgtccctaa

SEQ ID NO: 5787065 - DNA, 19 bp, Homo sapiens
tactgcaattaaagtgata

SEQ ID NO: 5787066 - DNA, 22 bp, Homo sapiens
tactgcacactgcacatttgct

SEQ ID NO: 5787067 - DNA, 13 bp, Homo sapiens
tactgcactcaga

SEQ ID NO: 5787068 - DNA, 20 bp, Homo sapiens
tactgcactccagcctgggg

SEQ ID NO: 5787069 - DNA, 13 bp, Homo sapiens
tactgcactgagt

SEQ ID NO: 5787070 - DNA, 14 bp, Homo sapiens
tactgcactgagtt

SEQ ID NO: 5787071 - DNA, 22 bp, Homo sapiens
tactgcagaatacagtaagctg

SEQ ID NO: 5787072 - DNA, 20 bp, Homo sapiens
tactgcagcctttgcctccc

SEQ ID NO: 5787073 - DNA, 15 bp, Homo sapiens
tactgcagctttaca

SEQ ID NO: 5787074 - DNA, 19 bp, Homo sapiens
tactgcagctttacatgca

SEQ ID NO: 5787075 - DNA, 12 bp, Homo sapiens
tactgcagggcc

SEQ ID NO: 5787076 - DNA, 21 bp, Homo sapiens
tactgcagtaacactggcctt

SEQ ID NO: 5787077 - DNA, 13 bp, Homo sapiens
tactgcagtcttt

SEQ ID NO: 5787078 - DNA, 11 bp, Homo sapiens
tactgcagttg

SEQ ID NO: 5787079 - DNA, 13 bp, Homo sapiens
tactgcatacttt

SEQ ID NO: 5787080 - DNA, 18 bp, Homo sapiens
tactgcatactttttaaa

SEQ ID NO: 5787081 - DNA, 14 bp, Homo sapiens
tactgcatcttagt

SEQ ID NO: 5787082 - DNA, 21 bp, Homo sapiens
tactgcatcttagtttactgg

SEQ ID NO: 5787083 - DNA, 13 bp, Homo sapiens
tactgcatgcact

SEQ ID NO: 5787084 - DNA, 22 bp, Homo sapiens
tactgcatgtttgctgttccac

SEQ ID NO: 5787085 - DNA, 18 bp, Homo sapiens
tactgcattcttctgatc

SEQ ID NO: 5787086 - DNA, 22 bp, Homo sapiens
tactgcattgccgacagcacag

SEQ ID NO: 5787087 - DNA, 15 bp, Homo sapiens
tactgcatttaggga

SEQ ID NO: 5787088 - DNA, 13 bp, Homo sapiens
tactgcattttca

SEQ ID NO: 5787089 - DNA, 19 bp, Homo sapiens
tactgcattttcacaacat

SEQ ID NO: 5787090 - DNA, 11 bp, Homo sapiens
tactgccaaag

SEQ ID NO: 5787091 - DNA, 21 bp, Homo sapiens
tactgccacggtcctttgagt

SEQ ID NO: 5787092 - DNA, 15 bp, Homo sapiens
tactgccagatgctg

SEQ ID NO: 5787093 - DNA, 18 bp, Homo sapiens
tactgccatcctggccca

SEQ ID NO: 5787094 - DNA, 19 bp, Homo sapiens
tactgccatcctggcccag

SEQ ID NO: 5787095 - DNA, 21 bp, Homo sapiens
tactgccatgtactagtttta

SEQ ID NO: 5787096 - DNA, 18 bp, Homo sapiens
tactgcccagatgtttta

SEQ ID NO: 5787097 - DNA, 20 bp, Homo sapiens
tactgcccaggcctgcctgt

SEQ ID NO: 5787098 - DNA, 17 bp, Homo sapiens
tactgcccctgccctga

SEQ ID NO: 5787099 - DNA, 19 bp, Homo sapiens
tactgcccctgccctgagg

SEQ ID NO: 5787100 - DNA, 20 bp, Homo sapiens
tactgcccctgccctgagga

SEQ ID NO: 5787101 - DNA, 14 bp, Homo sapiens
tactgccctcccct

SEQ ID NO: 5787102 - DNA, 13 bp, Homo sapiens
tactgccctttca

SEQ ID NO: 5787103 - DNA, 21 bp, Homo sapiens
tactgccctttcaaagcactt

SEQ ID NO: 5787104 - DNA, 19 bp, Homo sapiens
tactgccgaagaattgtct

SEQ ID NO: 5787105 - DNA, 21 bp, Homo sapiens
tactgccgaagaattgtcttg

SEQ ID NO: 5787106 - DNA, 20 bp, Homo sapiens
tactgccggtcacccaggct

SEQ ID NO: 5787107 - DNA, 22 bp, Homo sapiens
tactgcctactgttactctaaa

SEQ ID NO: 5787108 - DNA, 20 bp, Homo sapiens
tactgcctgaataaagagcc

SEQ ID NO: 5787109 - DNA, 10 bp, Homo sapiens
tactgcctgc

SEQ ID NO: 5787110 - DNA, 13 bp, Homo sapiens
tactgcctgcaga

SEQ ID NO: 5787111 - DNA, 15 bp, Homo sapiens
tactgcctgcagaga

SEQ ID NO: 5787112 - DNA, 10 bp, Homo sapiens
tactgcctgt

SEQ ID NO: 5787113 - DNA, 12 bp, Homo sapiens
tactgccttgaa

SEQ ID NO: 5787114 - DNA, 16 bp, Homo sapiens
tactgccttgaaaaat

SEQ ID NO: 5787115 - DNA, 20 bp, Homo sapiens
tactgccttgaaaaatgaca

SEQ ID NO: 5787116 - DNA, 21 bp, Homo sapiens
tactgccttgtttaatgttaa

SEQ ID NO: 5787117 - DNA, 19 bp, Homo sapiens
tactgcctttagaaaatat

SEQ ID NO: 5787118 - DNA, 15 bp, Homo sapiens
tactgcctttcaaag

SEQ ID NO: 5787119 - DNA, 23 bp, Homo sapiens
tactgcctttcaaagtgcacaca

SEQ ID NO: 5787120 - DNA, 12 bp, Homo sapiens
tactgcgacttt

SEQ ID NO: 5787121 - DNA, 20 bp, Homo sapiens
tactgcgactttctgcctgg

SEQ ID NO: 5787122 - DNA, 21 bp, Homo sapiens
tactgcgactttctgcctgga

SEQ ID NO: 5787123 - DNA, 19 bp, Homo sapiens
tactgcggaccaagggact

SEQ ID NO: 5787124 - DNA, 20 bp, Homo sapiens
tactgcgtccaccctgagct

SEQ ID NO: 5787125 - DNA, 19 bp, Homo sapiens
tactgctaagtatttccca

SEQ ID NO: 5787126 - DNA, 20 bp, Homo sapiens
tactgctaagtatttcccag

SEQ ID NO: 5787127 - DNA, 15 bp, Homo sapiens
tactgctactgtaat

SEQ ID NO: 5787128 - DNA, 19 bp, Homo sapiens
tactgctcctgtggcagga

SEQ ID NO: 5787129 - DNA, 12 bp, Homo sapiens
tactgctctgag

SEQ ID NO: 5787130 - DNA, 13 bp, Homo sapiens
tactgctgacctt

SEQ ID NO: 5787131 - DNA, 10 bp, Homo sapiens
tactgctgag

SEQ ID NO: 5787132 - DNA, 19 bp, Homo sapiens
tactgctgatgctgaaata

SEQ ID NO: 5787133 - DNA, 23 bp, Homo sapiens
tactgctgatgctgaaataaact

SEQ ID NO: 5787134 - DNA, 16 bp, Homo sapiens
tactgctgattcttgt

SEQ ID NO: 5787135 - DNA, 14 bp, Homo sapiens
tactgctgcaaagt

SEQ ID NO: 5787136 - DNA, 19 bp, Homo sapiens
tactgctgcaaagtgcaaa

SEQ ID NO: 5787137 - DNA, 13 bp, Homo sapiens
tactgctggagtc

SEQ ID NO: 5787138 - DNA, 23 bp, Homo sapiens
tactgctgtcattgtccatgcct

SEQ ID NO: 5787139 - DNA, 19 bp, Homo sapiens
tactgcttaattcaaataa

SEQ ID NO: 5787140 - DNA, 22 bp, Homo sapiens
tactgcttctaccaactggaag

SEQ ID NO: 5787141 - DNA, 23 bp, Homo sapiens
tactgcttctaccaactggaagc

SEQ ID NO: 5787142 - DNA, 17 bp, Homo sapiens
tactgcttctctttgtg

SEQ ID NO: 5787143 - DNA, 18 bp, Homo sapiens
tactgcttctctttgtgc

SEQ ID NO: 5787144 - DNA, 22 bp, Homo sapiens
tactgcttgaccgtactctcac

SEQ ID NO: 5787145 - DNA, 24 bp, Homo sapiens
tactgcttggagctgagcaaatca

SEQ ID NO: 5787146 - DNA, 14 bp, Homo sapiens
tactgctttctgaa

SEQ ID NO: 5787147 - DNA, 17 bp, Homo sapiens
tactgctttctgaatgt

SEQ ID NO: 5787148 - DNA, 17 bp, Homo sapiens
tactgcttttcattagc

SEQ ID NO: 5787149 - DNA, 13 bp, Homo sapiens
tactgctttttct

SEQ ID NO: 5787150 - DNA, 23 bp, Homo sapiens
tactggaaacctagccagcttca

SEQ ID NO: 5787151 - DNA, 21 bp, Homo sapiens
tactggaacccttttaaagtt

SEQ ID NO: 5787152 - DNA, 15 bp, Homo sapiens
tactggaataaacag

SEQ ID NO: 5787153 - DNA, 20 bp, Homo sapiens
tactggaataatttgtaaat

SEQ ID NO: 5787154 - DNA, 21 bp, Homo sapiens
tactggaataatttgtaaatg

SEQ ID NO: 5787155 - DNA, 14 bp, Homo sapiens
tactggaattcaaa

SEQ ID NO: 5787156 - DNA, 17 bp, Homo sapiens
tactggaattcttctgc

SEQ ID NO: 5787157 - DNA, 14 bp, Homo sapiens
tactggaatttatt

SEQ ID NO: 5787158 - DNA, 17 bp, Homo sapiens
tactggacaaaatcaat

SEQ ID NO: 5787159 - DNA, 19 bp, Homo sapiens
tactggacaatcttatgtt

SEQ ID NO: 5787160 - DNA, 16 bp, Homo sapiens
tactggacacactaaa

SEQ ID NO: 5787161 - DNA, 15 bp, Homo sapiens
tactggacctgaaat

SEQ ID NO: 5787162 - DNA, 15 bp, Homo sapiens
tactggactaagtgg

SEQ ID NO: 5787163 - DNA, 14 bp, Homo sapiens
tactggactcagga

SEQ ID NO: 5787164 - DNA, 18 bp, Homo sapiens
tactggactcaggaactt

SEQ ID NO: 5787165 - DNA, 16 bp, Homo sapiens
tactggagaaaatgga

SEQ ID NO: 5787166 - DNA, 14 bp, Homo sapiens
tactggagaagtct

SEQ ID NO: 5787167 - DNA, 23 bp, Homo sapiens
tactggagtggaaggtctattgg

SEQ ID NO: 5787168 - DNA, 22 bp, Homo sapiens
tactggagttgggggcggcttg

SEQ ID NO: 5787169 - DNA, 19 bp, Homo sapiens
tactggataaattgtatga

SEQ ID NO: 5787170 - DNA, 14 bp, Homo sapiens
tactggataaattt

SEQ ID NO: 5787171 - DNA, 21 bp, Homo sapiens
tactggataaatttaaaacac

SEQ ID NO: 5787172 - DNA, 20 bp, Homo sapiens
tactggatagcatgaattct

SEQ ID NO: 5787173 - DNA, 15 bp, Homo sapiens
tactggatctcttaa

SEQ ID NO: 5787174 - DNA, 11 bp, Homo sapiens
tactggcactg

SEQ ID NO: 5787175 - DNA, 12 bp, Homo sapiens
tactggcagctc

SEQ ID NO: 5787176 - DNA, 14 bp, Homo sapiens
tactggcaggaggg

SEQ ID NO: 5787177 - DNA, 12 bp, Homo sapiens
tactggcattaa

SEQ ID NO: 5787178 - DNA, 15 bp, Homo sapiens
tactggccaattttt

SEQ ID NO: 5787179 - DNA, 12 bp, Homo sapiens
tactggcctctg

SEQ ID NO: 5787180 - DNA, 15 bp, Homo sapiens
tactggcctctgtga

SEQ ID NO: 5787181 - DNA, 15 bp, Homo sapiens
tactggccttttcac

SEQ ID NO: 5787182 - DNA, 18 bp, Homo sapiens
tactggcctttttcattt

SEQ ID NO: 5787183 - DNA, 12 bp, Homo sapiens
tactggcgtgga

SEQ ID NO: 5787184 - DNA, 15 bp, Homo sapiens
tactggcgtggatta

SEQ ID NO: 5787185 - DNA, 14 bp, Homo sapiens
tactggctggtgat

SEQ ID NO: 5787186 - DNA, 11 bp, Homo sapiens
tactgggaagc

SEQ ID NO: 5787187 - DNA, 17 bp, Homo sapiens
tactgggaaggctactt

SEQ ID NO: 5787188 - DNA, 15 bp, Homo sapiens
tactgggagaatcac

SEQ ID NO: 5787189 - DNA, 21 bp, Homo sapiens
tactgggagagaagaggactt

SEQ ID NO: 5787190 - DNA, 16 bp, Homo sapiens
tactgggagcctaccc

SEQ ID NO: 5787191 - DNA, 23 bp, Homo sapiens
tactgggccttagtgggccaggg

SEQ ID NO: 5787192 - DNA, 21 bp, Homo sapiens
tactggggaaactggccatgg

SEQ ID NO: 5787193 - DNA, 22 bp, Homo sapiens
tactggggaaactggccatggc

SEQ ID NO: 5787194 - DNA, 19 bp, Homo sapiens
tactggggaggctgaggca

SEQ ID NO: 5787195 - DNA, 13 bp, Homo sapiens
tactggggattct

SEQ ID NO: 5787196 - DNA, 14 bp, Homo sapiens
tactggggggcagg

SEQ ID NO: 5787197 - DNA, 18 bp, Homo sapiens
tactgggtacaagagcca

SEQ ID NO: 5787198 - DNA, 21 bp, Homo sapiens
tactgggtaggttctgaacag

SEQ ID NO: 5787199 - DNA, 23 bp, Homo sapiens
tactgggtgtcatttcattccat

SEQ ID NO: 5787200 - DNA, 16 bp, Homo sapiens
tactgggtttcaagaa

SEQ ID NO: 5787201 - DNA, 17 bp, Homo sapiens
tactgggtttcaagaaa

SEQ ID NO: 5787202 - DNA, 17 bp, Homo sapiens
tactggtaattgtacaa

SEQ ID NO: 5787203 - DNA, 18 bp, Homo sapiens
tactggtccaaaagattg

SEQ ID NO: 5787204 - DNA, 23 bp, Homo sapiens
tactggtccaaaagattgctgaa

SEQ ID NO: 5787205 - DNA, 19 bp, Homo sapiens
tactggtcccacttcacag

SEQ ID NO: 5787206 - DNA, 12 bp, Homo sapiens
tactggtctctc

SEQ ID NO: 5787207 - DNA, 13 bp, Homo sapiens
tactggtctctct

SEQ ID NO: 5787208 - DNA, 17 bp, Homo sapiens
tactggttactttcaaa

SEQ ID NO: 5787209 - DNA, 23 bp, Homo sapiens
tactggttatcctgtgctacaga

SEQ ID NO: 5787210 - DNA, 21 bp, Homo sapiens
tactggttggtgttcttccca

SEQ ID NO: 5787211 - DNA, 13 bp, Homo sapiens
tactgtaaaagtt

SEQ ID NO: 5787212 - DNA, 23 bp, Homo sapiens
tactgtaaaagttataataactg

SEQ ID NO: 5787213 - DNA, 20 bp, Homo sapiens
tactgtaaaatgcaaaaaat

SEQ ID NO: 5787214 - DNA, 14 bp, Homo sapiens
tactgtaaacagtt

SEQ ID NO: 5787215 - DNA, 15 bp, Homo sapiens
tactgtaaacagttc

SEQ ID NO: 5787216 - DNA, 19 bp, Homo sapiens
tactgtaaagaaaatgaat

SEQ ID NO: 5787217 - DNA, 16 bp, Homo sapiens
tactgtaaagaaagag

SEQ ID NO: 5787218 - DNA, 20 bp, Homo sapiens
tactgtaaagaaagagagaa

SEQ ID NO: 5787219 - DNA, 18 bp, Homo sapiens
tactgtaaatgccttgct

SEQ ID NO: 5787220 - DNA, 21 bp, Homo sapiens
tactgtaaatgccttgcttgt

SEQ ID NO: 5787221 - DNA, 23 bp, Homo sapiens
tactgtaaatgccttgcttgtat

SEQ ID NO: 5787222 - DNA, 11 bp, Homo sapiens
tactgtaaatt

SEQ ID NO: 5787223 - DNA, 13 bp, Homo sapiens
tactgtaactgct

SEQ ID NO: 5787224 - DNA, 11 bp, Homo sapiens
tactgtaactt

SEQ ID NO: 5787225 - DNA, 12 bp, Homo sapiens
tactgtaacttt

SEQ ID NO: 5787226 - DNA, 14 bp, Homo sapiens
tactgtaagaaaat

SEQ ID NO: 5787227 - DNA, 12 bp, Homo sapiens
tactgtaagaat

SEQ ID NO: 5787228 - DNA, 14 bp, Homo sapiens
tactgtaagaataa

SEQ ID NO: 5787229 - DNA, 18 bp, Homo sapiens
tactgtaagagacatgaa

SEQ ID NO: 5787230 - DNA, 19 bp, Homo sapiens
tactgtaaggcaatcatgg

SEQ ID NO: 5787231 - DNA, 18 bp, Homo sapiens
tactgtaataatacctca

SEQ ID NO: 5787232 - DNA, 23 bp, Homo sapiens
tactgtaataatacctcaatgtt

SEQ ID NO: 5787233 - DNA, 22 bp, Homo sapiens
tactgtaatagatcagcatcca

SEQ ID NO: 5787234 - DNA, 16 bp, Homo sapiens
tactgtaatgctgcct

SEQ ID NO: 5787235 - DNA, 23 bp, Homo sapiens
tactttggcaatttcctggccct

SEQ ID NO: 5787236 - DNA, 18 bp, Homo sapiens
tactttggtttctgagca

SEQ ID NO: 5787237 - DNA, 22 bp, Homo sapiens
tactttgtaaattctgatttct

SEQ ID NO: 5787238 - DNA, 22 bp, Homo sapiens
tactttgtaagtgagagagaca

SEQ ID NO: 5787239 - DNA, 16 bp, Homo sapiens
tactttgtatgatatt

SEQ ID NO: 5787240 - DNA, 20 bp, Homo sapiens
tactttgtatgatattccat

SEQ ID NO: 5787241 - DNA, 16 bp, Homo sapiens
tactttgtattttgat

SEQ ID NO: 5787242 - DNA, 21 bp, Homo sapiens
tactttgtattttgattattt

SEQ ID NO: 5787243 - DNA, 22 bp, Homo sapiens
tactttgtatttttcttttgaa

SEQ ID NO: 5787244 - DNA, 20 bp, Homo sapiens
tactttgtcctttttgttat

SEQ ID NO: 5787245 - DNA, 20 bp, Homo sapiens
tactttgtctaagaaacatt

SEQ ID NO: 5787246 - DNA, 14 bp, Homo sapiens
tactttgtctgaaa

SEQ ID NO: 5787247 - DNA, 19 bp, Homo sapiens
tactttgtcttgatcctca

SEQ ID NO: 5787248 - DNA, 13 bp, Homo sapiens
tactttgtgcaaa

SEQ ID NO: 5787249 - DNA, 17 bp, Homo sapiens
tactttgtgcaatatga

SEQ ID NO: 5787250 - DNA, 22 bp, Homo sapiens
tactttgtggaccaattattga

SEQ ID NO: 5787251 - DNA, 21 bp, Homo sapiens
tactttgtggatatatttaaa

SEQ ID NO: 5787252 - DNA, 13 bp, Homo sapiens
tactttgtgtctt

SEQ ID NO: 5787253 - DNA, 17 bp, Homo sapiens
tactttgttctgttgtc

SEQ ID NO: 5787254 - DNA, 15 bp, Homo sapiens
tactttgtttttcca

SEQ ID NO: 5787255 - DNA, 20 bp, Homo sapiens
tactttgtttttccatgtgt

SEQ ID NO: 5787256 - DNA, 21 bp, Homo sapiens
tacttttaaaaaatactctgc

SEQ ID NO: 5787257 - DNA, 14 bp, Homo sapiens
tacttttaaaaaca

SEQ ID NO: 5787258 - DNA, 15 bp, Homo sapiens
tacttttaaaaatgt

SEQ ID NO: 5787259 - DNA, 19 bp, Homo sapiens
tacttttaaaaatgtagaa

SEQ ID NO: 5787260 - DNA, 21 bp, Homo sapiens
tacttttaaacagtgagcctg

SEQ ID NO: 5787261 - DNA, 14 bp, Homo sapiens
tacttttaaactgt

SEQ ID NO: 5787262 - DNA, 21 bp, Homo sapiens
tacttttaaactgtgtacata

SEQ ID NO: 5787263 - DNA, 18 bp, Homo sapiens
tacttttaaatattaact

SEQ ID NO: 5787264 - DNA, 22 bp, Homo sapiens
tacttttaacgtatgtatttca

SEQ ID NO: 5787265 - DNA, 15 bp, Homo sapiens
tacttttaataaagt

SEQ ID NO: 5787266 - DNA, 20 bp, Homo sapiens
tacttttaattcctagaggg

SEQ ID NO: 5787267 - DNA, 20 bp, Homo sapiens
tacttttacaagtaacaaaa

SEQ ID NO: 5787268 - DNA, 23 bp, Homo sapiens
tacttttacaagtaacaaaaata

SEQ ID NO: 5787269 - DNA, 17 bp, Homo sapiens
tacttttaccactattt

SEQ ID NO: 5787270 - DNA, 18 bp, Homo sapiens
tacttttaccactattta

SEQ ID NO: 5787271 - DNA, 21 bp, Homo sapiens
tacttttacttgttcatttct

SEQ ID NO: 5787272 - DNA, 21 bp, Homo sapiens
tacttttagtagagacagtgt

SEQ ID NO: 5787273 - DNA, 23 bp, Homo sapiens
tacttttagtagagacagtgttt

SEQ ID NO: 5787274 - DNA, 22 bp, Homo sapiens
tacttttagttgactcacaggc

SEQ ID NO: 5787275 - DNA, 19 bp, Homo sapiens
tacttttatgatgtatatt

SEQ ID NO: 5787276 - DNA, 19 bp, Homo sapiens
tacttttattattttaatt

SEQ ID NO: 5787277 - DNA, 14 bp, Homo sapiens
tacttttattgatg

SEQ ID NO: 5787278 - DNA, 21 bp, Homo sapiens
tacttttatttgcaacattta

SEQ ID NO: 5787279 - DNA, 23 bp, Homo sapiens
tacttttattttacacagaaaca

SEQ ID NO: 5787280 - DNA, 15 bp, Homo sapiens
tacttttcacactgt

SEQ ID NO: 5787281 - DNA, 18 bp, Homo sapiens
tacttttcagtttttaac

SEQ ID NO: 5787282 - DNA, 16 bp, Homo sapiens
tacttttcattctctt

SEQ ID NO: 5787283 - DNA, 16 bp, Homo sapiens
tacttttccagtctgt

SEQ ID NO: 5787284 - DNA, 17 bp, Homo sapiens
tacttttcccctgttaa

SEQ ID NO: 5787285 - DNA, 21 bp, Homo sapiens
tacttttcctgggtttcctgc

SEQ ID NO: 5787286 - DNA, 21 bp, Homo sapiens
tacttttccttgcatacaaac

SEQ ID NO: 5787287 - DNA, 20 bp, Homo sapiens
tacttttctgcaatgttatt

SEQ ID NO: 5787288 - DNA, 14 bp, Homo sapiens
tacttttctgttta

SEQ ID NO: 5787289 - DNA, 19 bp, Homo sapiens
tacttttctttattagctt

SEQ ID NO: 5787290 - DNA, 17 bp, Homo sapiens
tacttttgaaaaaggat

SEQ ID NO: 5787291 - DNA, 14 bp, Homo sapiens
tacttttgataata

SEQ ID NO: 5787292 - DNA, 17 bp, Homo sapiens
tacttttgcatgaaaat

SEQ ID NO: 5787293 - DNA, 17 bp, Homo sapiens
tacttttgctgtttata

SEQ ID NO: 5787294 - DNA, 14 bp, Homo sapiens
tacttttggaatct

SEQ ID NO: 5787295 - DNA, 17 bp, Homo sapiens
tacttttgtcttcctca

SEQ ID NO: 5787296 - DNA, 13 bp, Homo sapiens
tacttttgtttca

SEQ ID NO: 5787297 - DNA, 20 bp, Homo sapiens
tactttttaaaaggtatttt

SEQ ID NO: 5787298 - DNA, 16 bp, Homo sapiens
tactttttatactcca

SEQ ID NO: 5787299 - DNA, 13 bp, Homo sapiens
tactttttatata

SEQ ID NO: 5787300 - DNA, 14 bp, Homo sapiens
tactttttattgca

SEQ ID NO: 5787301 - DNA, 17 bp, Homo sapiens
tactttttcagttgttt

SEQ ID NO: 5787302 - DNA, 16 bp, Homo sapiens
tactttttcattcttt

SEQ ID NO: 5787303 - DNA, 13 bp, Homo sapiens
tactttttccttc

SEQ ID NO: 5787304 - DNA, 15 bp, Homo sapiens
tactttttccttcct

SEQ ID NO: 5787305 - DNA, 19 bp, Homo sapiens
tactttttccttcctgccc

SEQ ID NO: 5787306 - DNA, 13 bp, Homo sapiens
tactttttctaat

SEQ ID NO: 5787307 - DNA, 16 bp, Homo sapiens
tactttttctaatgag

SEQ ID NO: 5787308 - DNA, 19 bp, Homo sapiens
tactttttgaacttttcat

SEQ ID NO: 5787309 - DNA, 20 bp, Homo sapiens
tactttttgaacttttcatt

SEQ ID NO: 5787310 - DNA, 19 bp, Homo sapiens
tactttttggcataacata

SEQ ID NO: 5787311 - DNA, 15 bp, Homo sapiens
tactttttggctgga

SEQ ID NO: 5787312 - DNA, 15 bp, Homo sapiens
tactttttgtaaaaa

SEQ ID NO: 5787313 - DNA, 18 bp, Homo sapiens
tactttttgtaaaaagct

SEQ ID NO: 5787314 - DNA, 13 bp, Homo sapiens
tactttttgtaga

SEQ ID NO: 5787315 - DNA, 14 bp, Homo sapiens
tactttttgtagag

SEQ ID NO: 5787316 - DNA, 19 bp, Homo sapiens
tactttttgttccagagct

SEQ ID NO: 5787317 - DNA, 16 bp, Homo sapiens
tacttttttaaaattg

SEQ ID NO: 5787318 - DNA, 20 bp, Homo sapiens
tacttttttaaatattttct

SEQ ID NO: 5787319 - DNA, 16 bp, Homo sapiens
tacttttttaacatgt

SEQ ID NO: 5787320 - DNA, 18 bp, Homo sapiens
tacttttttaacatgtgt

SEQ ID NO: 5787321 - DNA, 18 bp, Homo sapiens
tacttttttacactgagt

SEQ ID NO: 5787322 - DNA, 22 bp, Homo sapiens
tacttttttacactgagtttct

SEQ ID NO: 5787323 - DNA, 20 bp, Homo sapiens
tacttttttacactgataaa

SEQ ID NO: 5787324 - DNA, 13 bp, Homo sapiens
tacttttttcaaa

SEQ ID NO: 5787325 - DNA, 16 bp, Homo sapiens
tacttttttcaaatat

SEQ ID NO: 5787326 - DNA, 14 bp, Homo sapiens
tactttttttcaca

SEQ ID NO: 5787327 - DNA, 14 bp, Homo sapiens
tactttttttctgt

SEQ ID NO: 5787328 - DNA, 20 bp, Homo sapiens
tactttttttgtagatgaac

SEQ ID NO: 5787329 - DNA, 21 bp, Homo sapiens
tacttttttttagttcaatac

SEQ ID NO: 5787330 - DNA, 15 bp, Homo sapiens
tagaaaaaaaaataa

SEQ ID NO: 5787331 - DNA, 22 bp, Homo sapiens
tagaaaaaaactaaagttgaaa

SEQ ID NO: 5787332 - DNA, 13 bp, Homo sapiens
tagaaaaaacaat

SEQ ID NO: 5787333 - DNA, 15 bp, Homo sapiens
tagaaaaaagtagca

SEQ ID NO: 5787334 - DNA, 14 bp, Homo sapiens
tagaaaaacaaatc

SEQ ID NO: 5787335 - DNA, 14 bp, Homo sapiens
tagaaaaacaggca

SEQ ID NO: 5787336 - DNA, 18 bp, Homo sapiens
tagaaaaacatttaaact

SEQ ID NO: 5787337 - DNA, 22 bp, Homo sapiens
tagaaaaacatttaaacttttt

SEQ ID NO: 5787338 - DNA, 20 bp, Homo sapiens
tagaaaaacccaaactgaga

SEQ ID NO: 5787339 - DNA, 16 bp, Homo sapiens
tagaaaaaccctgccc

SEQ ID NO: 5787340 - DNA, 22 bp, Homo sapiens
tagaaaaaccctgcccccaaat

SEQ ID NO: 5787341 - DNA, 15 bp, Homo sapiens
tagaaaaagcacagc

SEQ ID NO: 5787342 - DNA, 17 bp, Homo sapiens
tagaaaaagcacagctc

SEQ ID NO: 5787343 - DNA, 16 bp, Homo sapiens
tagaaaaaggatggaa

SEQ ID NO: 5787344 - DNA, 20 bp, Homo sapiens
tagaaaaagtcaatgtactt

SEQ ID NO: 5787345 - DNA, 21 bp, Homo sapiens
tagaaaaagtcaatgtacttg

SEQ ID NO: 5787346 - DNA, 23 bp, Homo sapiens
tagaaaaagtcaatgtacttgtt

SEQ ID NO: 5787347 - DNA, 15 bp, Homo sapiens
tagaaaaataaaaat

SEQ ID NO: 5787348 - DNA, 15 bp, Homo sapiens
tagaaaaataaaatg

SEQ ID NO: 5787349 - DNA, 18 bp, Homo sapiens
tagaaaaataaaatgttt

SEQ ID NO: 5787350 - DNA, 19 bp, Homo sapiens
tagaaaaatgctgttcaga

SEQ ID NO: 5787351 - DNA, 16 bp, Homo sapiens
tagaaaaatgtataaa

SEQ ID NO: 5787352 - DNA, 18 bp, Homo sapiens
tagaaaaatgtataaaaa

SEQ ID NO: 5787353 - DNA, 17 bp, Homo sapiens
tagaaaaatttcacgat

SEQ ID NO: 5787354 - DNA, 23 bp, Homo sapiens
tagaaaacaggaaaaaaactttt

SEQ ID NO: 5787355 - DNA, 16 bp, Homo sapiens
tagaaaacataatctt

SEQ ID NO: 5787356 - DNA, 16 bp, Homo sapiens
tagaaaacctctcgct

SEQ ID NO: 5787357 - DNA, 14 bp, Homo sapiens
tagaaaactccagg

SEQ ID NO: 5787358 - DNA, 22 bp, Homo sapiens
tagaaaacttgacatgtagctt

SEQ ID NO: 5787359 - DNA, 15 bp, Homo sapiens
tagaaaactttaaag

SEQ ID NO: 5787360 - DNA, 18 bp, Homo sapiens
tagaaaagatgagaggca

SEQ ID NO: 5787361 - DNA, 17 bp, Homo sapiens
tagaaaagatttaagta

SEQ ID NO: 5787362 - DNA, 13 bp, Homo sapiens
tagaaaaggaaat

SEQ ID NO: 5787363 - DNA, 17 bp, Homo sapiens
tagaaaaggactataag

SEQ ID NO: 5787364 - DNA, 11 bp, Homo sapiens
tagaaaaggca

SEQ ID NO: 5787365 - DNA, 21 bp, Homo sapiens
tagaaaaggtgataaaatcat

SEQ ID NO: 5787366 - DNA, 22 bp, Homo sapiens
tagaaaaggtgataaaatcata

SEQ ID NO: 5787367 - DNA, 19 bp, Homo sapiens
tagaaaagtggtgtaaact

SEQ ID NO: 5787368 - DNA, 15 bp, Homo sapiens
tagaaaagttaacat

SEQ ID NO: 5787369 - DNA, 17 bp, Homo sapiens
tagaaaagttgcagatg

SEQ ID NO: 5787370 - DNA, 20 bp, Homo sapiens
tagaaaagttgcagatgtat

SEQ ID NO: 5787371 - DNA, 22 bp, Homo sapiens
tagaaaagttgcagatgtattg

SEQ ID NO: 5787372 - DNA, 14 bp, Homo sapiens
tagaaaagtttgtt

SEQ ID NO: 5787373 - DNA, 15 bp, Homo sapiens
tagaaaataaaataa

SEQ ID NO: 5787374 - DNA, 20 bp, Homo sapiens
tagaaaataaaataaattat

SEQ ID NO: 5787375 - DNA, 16 bp, Homo sapiens
tagaaaataaatacaa

SEQ ID NO: 5787376 - DNA, 16 bp, Homo sapiens
tagaaaatattctcta

SEQ ID NO: 5787377 - DNA, 18 bp, Homo sapiens
tagaaaatattctctatt

SEQ ID NO: 5787378 - DNA, 18 bp, Homo sapiens
tagaaaatccttcagcta

SEQ ID NO: 5787379 - DNA, 23 bp, Homo sapiens
tagaaaatgaactgtatattatt

SEQ ID NO: 5787380 - DNA, 20 bp, Homo sapiens
tagaaaatgacttatttctg

SEQ ID NO: 5787381 - DNA, 13 bp, Homo sapiens
tagaaaatggaaa

SEQ ID NO: 5787382 - DNA, 20 bp, Homo sapiens
tagaaaatggaaaatataca

SEQ ID NO: 5787383 - DNA, 12 bp, Homo sapiens
tagaaaatggtc

SEQ ID NO: 5787384 - DNA, 20 bp, Homo sapiens
tagaaaatgtgaccctccaa

SEQ ID NO: 5787385 - DNA, 15 bp, Homo sapiens
tagaaaattaaaata

SEQ ID NO: 5787386 - DNA, 16 bp, Homo sapiens
tagaaaattaaaataa

SEQ ID NO: 5787387 - DNA, 16 bp, Homo sapiens
tagaaaattagactgt

SEQ ID NO: 5787388 - DNA, 18 bp, Homo sapiens
tagaaaattagtgaccat

SEQ ID NO: 5787389 - DNA, 13 bp, Homo sapiens
tagaaaattattt

SEQ ID NO: 5787390 - DNA, 17 bp, Homo sapiens
tagaaaattcagctcct

SEQ ID NO: 5787391 - DNA, 23 bp, Homo sapiens
tagaaaattgtttttaatttgaa

SEQ ID NO: 5787392 - DNA, 21 bp, Homo sapiens
tagaaaatttagccctttaaa

SEQ ID NO: 5787393 - DNA, 13 bp, Homo sapiens
tagaaaatttgct

SEQ ID NO: 5787394 - DNA, 16 bp, Homo sapiens
tagaaaatttgcttta

SEQ ID NO: 5787395 - DNA, 23 bp, Homo sapiens
tagaaaatttgttattttgcaac

SEQ ID NO: 5787396 - DNA, 18 bp, Homo sapiens
tagaaacaacactgtagt

SEQ ID NO: 5787397 - DNA, 19 bp, Homo sapiens
tagaaacaacactgtagta

SEQ ID NO: 5787398 - DNA, 17 bp, Homo sapiens
tagaaacaagacaaggt

SEQ ID NO: 5787399 - DNA, 13 bp, Homo sapiens
tagaaacaatgtt

SEQ ID NO: 5787400 - DNA, 21 bp, Homo sapiens
tagaaacacacttttgcacat

SEQ ID NO: 5787401 - DNA, 20 bp, Homo sapiens
tagaaacacataattaacac

SEQ ID NO: 5787402 - DNA, 17 bp, Homo sapiens
tagaaacactttctcac

SEQ ID NO: 5787403 - DNA, 14 bp, Homo sapiens
tagaaacataaata

SEQ ID NO: 5787404 - DNA, 17 bp, Homo sapiens
tagaaacatgacactga

SEQ ID NO: 5787405 - DNA, 15 bp, Homo sapiens
tagaaacattgtaaa

SEQ ID NO: 5787406 - DNA, 17 bp, Homo sapiens
tagaaacccaaattggg

SEQ ID NO: 5787407 - DNA, 20 bp, Homo sapiens
tagaaacccaagctcctcct

SEQ ID NO: 5787408 - DNA, 21 bp, Homo sapiens
tagaaacccaagctcctcctc

SEQ ID NO: 5787409 - DNA, 16 bp, Homo sapiens
tagaaacgtaaactat

SEQ ID NO: 5787410 - DNA, 13 bp, Homo sapiens
tagaaactacaaa

SEQ ID NO: 5787411 - DNA, 15 bp, Homo sapiens
tagaaactcaggaaa

SEQ ID NO: 5787412 - DNA, 17 bp, Homo sapiens
tagaccttgttacttct

SEQ ID NO: 5787413 - DNA, 19 bp, Homo sapiens
tagaccttgttacttctga

SEQ ID NO: 5787414 - DNA, 13 bp, Homo sapiens
tagacgggttgaa

SEQ ID NO: 5787415 - DNA, 20 bp, Homo sapiens
tagacgggttgaaagacatc

SEQ ID NO: 5787416 - DNA, 14 bp, Homo sapiens
tagactaattgtgt

SEQ ID NO: 5787417 - DNA, 21 bp, Homo sapiens
tagactagcaatctcttcatt

SEQ ID NO: 5787418 - DNA, 19 bp, Homo sapiens
tagactagttgaacatctc

SEQ ID NO: 5787419 - DNA, 14 bp, Homo sapiens
tagactataaatgt

SEQ ID NO: 5787420 - DNA, 16 bp, Homo sapiens
tagactatagcccctg

SEQ ID NO: 5787421 - DNA, 21 bp, Homo sapiens
tagactatggaatgtcagtgt

SEQ ID NO: 5787422 - DNA, 22 bp, Homo sapiens
tagactattccttttctgtata

SEQ ID NO: 5787423 - DNA, 14 bp, Homo sapiens
tagactatttcttt

SEQ ID NO: 5787424 - DNA, 19 bp, Homo sapiens
tagactcaaagaagtactg

SEQ ID NO: 5787425 - DNA, 20 bp, Homo sapiens
tagactcaagggggtgacag

SEQ ID NO: 5787426 - DNA, 18 bp, Homo sapiens
tagactcacggctgcacc

SEQ ID NO: 5787427 - DNA, 18 bp, Homo sapiens
tagactcatcttactgta

SEQ ID NO: 5787428 - DNA, 17 bp, Homo sapiens
tagactcatcttttgaa

SEQ ID NO: 5787429 - DNA, 14 bp, Homo sapiens
tagactcctcagga

SEQ ID NO: 5787430 - DNA, 16 bp, Homo sapiens
tagactctagtattta

SEQ ID NO: 5787431 - DNA, 19 bp, Homo sapiens
tagactctgtaacatcact

SEQ ID NO: 5787432 - DNA, 22 bp, Homo sapiens
tagactctgtctacctggtctg

SEQ ID NO: 5787433 - DNA, 16 bp, Homo sapiens
tagactcttacttttt

SEQ ID NO: 5787434 - DNA, 20 bp, Homo sapiens
tagactcttactttttaaaa

SEQ ID NO: 5787435 - DNA, 17 bp, Homo sapiens
tagactcttcccctccc

SEQ ID NO: 5787436 - DNA, 18 bp, Homo sapiens
tagactcttcccctccct

SEQ ID NO: 5787437 - DNA, 22 bp, Homo sapiens
tagactcttcccctccctccca

SEQ ID NO: 5787438 - DNA, 21 bp, Homo sapiens
tagactcttttccttcccttt

SEQ ID NO: 5787439 - DNA, 22 bp, Homo sapiens
tagactgacttgtttgtcttcc

SEQ ID NO: 5787440 - DNA, 19 bp, Homo sapiens
tagactgaggtataaagac

SEQ ID NO: 5787441 - DNA, 22 bp, Homo sapiens
tagactgccagctcttcctagc

SEQ ID NO: 5787442 - DNA, 15 bp, Homo sapiens
tagactgctcctggg

SEQ ID NO: 5787443 - DNA, 18 bp, Homo sapiens
tagactgctcctgggcat

SEQ ID NO: 5787444 - DNA, 19 bp, Homo sapiens
tagactggaacttgaactg

SEQ ID NO: 5787445 - DNA, 18 bp, Homo sapiens
tagactggacagcttgtg

SEQ ID NO: 5787446 - DNA, 22 bp, Homo sapiens
tagactggagtgaggcttccag

SEQ ID NO: 5787447 - DNA, 20 bp, Homo sapiens
tagactggcctgaaccacag

SEQ ID NO: 5787448 - DNA, 12 bp, Homo sapiens
tagactgggctg

SEQ ID NO: 5787449 - DNA, 17 bp, Homo sapiens
tagactgggctggctgc

SEQ ID NO: 5787450 - DNA, 17 bp, Homo sapiens
tagactggtgactgatt

SEQ ID NO: 5787451 - DNA, 18 bp, Homo sapiens
tagactggtgactgattc

SEQ ID NO: 5787452 - DNA, 21 bp, Homo sapiens
tagactggtgactgattcttc

SEQ ID NO: 5787453 - DNA, 23 bp, Homo sapiens
tagactgtgtctgaatcatgtct

SEQ ID NO: 5787454 - DNA, 21 bp, Homo sapiens
tagactgtttcacattgcact

SEQ ID NO: 5787455 - DNA, 14 bp, Homo sapiens
tagacttaggcatt

SEQ ID NO: 5787456 - DNA, 15 bp, Homo sapiens
tagacttaggcatta

SEQ ID NO: 5787457 - DNA, 22 bp, Homo sapiens
tagacttcaagcatggctattt

SEQ ID NO: 5787458 - DNA, 21 bp, Homo sapiens
tagacttcagaacatgctgga

SEQ ID NO: 5787459 - DNA, 21 bp, Homo sapiens
tagacttcagggagtcagctg

SEQ ID NO: 5787460 - DNA, 22 bp, Homo sapiens
tagacttcccactgttctgaaa

SEQ ID NO: 5787461 - DNA, 16 bp, Homo sapiens
tagacttcctttataa

SEQ ID NO: 5787462 - DNA, 17 bp, Homo sapiens
tagacttcctttataat

SEQ ID NO: 5787463 - DNA, 20 bp, Homo sapiens
tagacttcctttataatatt

SEQ ID NO: 5787464 - DNA, 18 bp, Homo sapiens
tagacttcgaaaacagat

SEQ ID NO: 5787465 - DNA, 21 bp, Homo sapiens
tagacttcgaaaacagatgag

SEQ ID NO: 5787466 - DNA, 18 bp, Homo sapiens
tagacttcgactcaggat

SEQ ID NO: 5787467 - DNA, 22 bp, Homo sapiens
tagacttcgactcaggatccag

SEQ ID NO: 5787468 - DNA, 17 bp, Homo sapiens
tagacttctgttttcaa

SEQ ID NO: 5787469 - DNA, 12 bp, Homo sapiens
tagacttgaaaa

SEQ ID NO: 5787470 - DNA, 20 bp, Homo sapiens
tagacttgaaagttttccag

SEQ ID NO: 5787471 - DNA, 15 bp, Homo sapiens
tagacttgaaatact

SEQ ID NO: 5787472 - DNA, 12 bp, Homo sapiens
tagacttgctcc

SEQ ID NO: 5787473 - DNA, 21 bp, Homo sapiens
tagacttggagctgtcctcca

SEQ ID NO: 5787474 - DNA, 20 bp, Homo sapiens
tagacttggattctttccat

SEQ ID NO: 5787475 - DNA, 19 bp, Homo sapiens
tagacttggtgtgaagact

SEQ ID NO: 5787476 - DNA, 14 bp, Homo sapiens
tagactttaacata

SEQ ID NO: 5787477 - DNA, 21 bp, Homo sapiens
tagactttaacataagctatt

SEQ ID NO: 5787478 - DNA, 17 bp, Homo sapiens
tagactttagaaataaa

SEQ ID NO: 5787479 - DNA, 15 bp, Homo sapiens
tagactttaggcttt

SEQ ID NO: 5787480 - DNA, 16 bp, Homo sapiens
tagactttaggctttc

SEQ ID NO: 5787481 - DNA, 11 bp, Homo sapiens
tagactttctg

SEQ ID NO: 5787482 - DNA, 20 bp, Homo sapiens
tagactttgccttttacctg

SEQ ID NO: 5787483 - DNA, 14 bp, Homo sapiens
tagactttgtatga

SEQ ID NO: 5787484 - DNA, 14 bp, Homo sapiens
tagacttttccaat

SEQ ID NO: 5787485 - DNA, 18 bp, Homo sapiens
tagagaaaaaaaaatatg

SEQ ID NO: 5787486 - DNA, 20 bp, Homo sapiens
tagagaaaaaaaaatatgtg

SEQ ID NO: 5787487 - DNA, 23 bp, Homo sapiens
tagagaaaaaaaaatatgtgtac

SEQ ID NO: 5787488 - DNA, 19 bp, Homo sapiens
tagagaaaacatgcagaac

SEQ ID NO: 5787489 - DNA, 14 bp, Homo sapiens
tagagaaaacctta

SEQ ID NO: 5787490 - DNA, 14 bp, Homo sapiens
tagagaaaagtgta

SEQ ID NO: 5787491 - DNA, 15 bp, Homo sapiens
tagagaaaagtgtat

SEQ ID NO: 5787492 - DNA, 21 bp, Homo sapiens
tagagaaaatggaacattaac

SEQ ID NO: 5787493 - DNA, 14 bp, Homo sapiens
tagagaaacatttg

SEQ ID NO: 5787494 - DNA, 21 bp, Homo sapiens
tagagaaaccgtcctcttttt

SEQ ID NO: 5787495 - DNA, 22 bp, Homo sapiens
tagagaaactttgagtacagat

SEQ ID NO: 5787496 - DNA, 12 bp, Homo sapiens
tagagaacaaag

SEQ ID NO: 5787497 - DNA, 22 bp, Homo sapiens
tagagaacagtattgggcagga

SEQ ID NO: 5787498 - DNA, 13 bp, Homo sapiens
tagagaactgaaa

SEQ ID NO: 5787499 - DNA, 16 bp, Homo sapiens
tagagaactgaaaaga

SEQ ID NO: 5787500 - DNA, 21 bp, Homo sapiens
tagagaactggaggaaccaca

SEQ ID NO: 5787501 - DNA, 16 bp, Homo sapiens
tagagaactgtggccg

SEQ ID NO: 5787502 - DNA, 15 bp, Homo sapiens
tagagaagacaggct

SEQ ID NO: 5787503 - DNA, 18 bp, Homo sapiens
tagagaagacaggctgga

SEQ ID NO: 5787504 - DNA, 13 bp, Homo sapiens
tagagaagctgaa

SEQ ID NO: 5787505 - DNA, 20 bp, Homo sapiens
tagagaagtatccaattatg

SEQ ID NO: 5787506 - DNA, 18 bp, Homo sapiens
tagagaataatttttgtg

SEQ ID NO: 5787507 - DNA, 21 bp, Homo sapiens
tagagaatccgtattgaattt

SEQ ID NO: 5787508 - DNA, 14 bp, Homo sapiens
tagagaatgcacag

SEQ ID NO: 5787509 - DNA, 12 bp, Homo sapiens
tagagaatgttc

SEQ ID NO: 5787510 - DNA, 17 bp, Homo sapiens
tagagacaacaaaaatg

SEQ ID NO: 5787511 - DNA, 11 bp, Homo sapiens
tagagacacat

SEQ ID NO: 5787512 - DNA, 21 bp, Homo sapiens
tagagacagaagcaggctgga

SEQ ID NO: 5787513 - DNA, 19 bp, Homo sapiens
tagagacagggtctcactg

SEQ ID NO: 5787514 - DNA, 14 bp, Homo sapiens
tagagacagtatgt

SEQ ID NO: 5787515 - DNA, 12 bp, Homo sapiens
tagagacagtgt

SEQ ID NO: 5787516 - DNA, 20 bp, Homo sapiens
tagagacagtgtttcgtcat

SEQ ID NO: 5787517 - DNA, 19 bp, Homo sapiens
tagagaccaggagggagag

SEQ ID NO: 5787518 - DNA, 15 bp, Homo sapiens
tagagacccccaggc

SEQ ID NO: 5787519 - DNA, 18 bp, Homo sapiens
tagagactagacaaataa

SEQ ID NO: 5787520 - DNA, 17 bp, Homo sapiens
tagagactctgtgatct

SEQ ID NO: 5787521 - DNA, 22 bp, Homo sapiens
tagagactctgtgatctaagca

SEQ ID NO: 5787522 - DNA, 14 bp, Homo sapiens
tagagactgtagat

SEQ ID NO: 5787523 - DNA, 19 bp, Homo sapiens
tagagactgtagattgctt

SEQ ID NO: 5787524 - DNA, 23 bp, Homo sapiens
tagagactttgatactaccaggg

SEQ ID NO: 5787525 - DNA, 13 bp, Homo sapiens
tagagagaaaaag

SEQ ID NO: 5787526 - DNA, 14 bp, Homo sapiens
tagagagaacaggt

SEQ ID NO: 5787527 - DNA, 11 bp, Homo sapiens
tagagagaata

SEQ ID NO: 5787528 - DNA, 13 bp, Homo sapiens
tagagagaataaa

SEQ ID NO: 5787529 - DNA, 14 bp, Homo sapiens
tagagagagaggta

SEQ ID NO: 5787530 - DNA, 11 bp, Homo sapiens
tagagagcaga

SEQ ID NO: 5787531 - DNA, 14 bp, Homo sapiens
tagagagcagaaat

SEQ ID NO: 5787532 - DNA, 15 bp, Homo sapiens
tagagagcagaaata

SEQ ID NO: 5787533 - DNA, 19 bp, Homo sapiens
tagagagcagcattcccag

SEQ ID NO: 5787534 - DNA, 14 bp, Homo sapiens
tagagagcagtggc

SEQ ID NO: 5787535 - DNA, 23 bp, Homo sapiens
tagagagcatctgcaacaaaaag

SEQ ID NO: 5787536 - DNA, 21 bp, Homo sapiens
tagagaggacaatactggggt

SEQ ID NO: 5787537 - DNA, 12 bp, Homo sapiens
tagagaggcctg

SEQ ID NO: 5787538 - DNA, 14 bp, Homo sapiens
tagagaggctggca

SEQ ID NO: 5787539 - DNA, 20 bp, Homo sapiens
tagagaggggcctctggctg

SEQ ID NO: 5787540 - DNA, 13 bp, Homo sapiens
tagagagggggct

SEQ ID NO: 5787541 - DNA, 18 bp, Homo sapiens
tagagaggtagcgagctg

SEQ ID NO: 5787542 - DNA, 11 bp, Homo sapiens
tagagaggttt

SEQ ID NO: 5787543 - DNA, 14 bp, Homo sapiens
tagagagtgttgaa

SEQ ID NO: 5787544 - DNA, 20 bp, Homo sapiens
tagagataaaacagaatctt

SEQ ID NO: 5787545 - DNA, 14 bp, Homo sapiens
tagagataaatatt

SEQ ID NO: 5787546 - DNA, 19 bp, Homo sapiens
tagagataaatatttatgc

SEQ ID NO: 5787547 - DNA, 15 bp, Homo sapiens
tagagataattgctt

SEQ ID NO: 5787548 - DNA, 20 bp, Homo sapiens
tagagataccctctgagaca

SEQ ID NO: 5787549 - DNA, 23 bp, Homo sapiens
tagagatatgtatcataaaaata

SEQ ID NO: 5787550 - DNA, 16 bp, Homo sapiens
tagagatcatgaatta

SEQ ID NO: 5787551 - DNA, 15 bp, Homo sapiens
tagagatctattttt

SEQ ID NO: 5787552 - DNA, 18 bp, Homo sapiens
tagagatctggttttgct

SEQ ID NO: 5787553 - DNA, 20 bp, Homo sapiens
tagagatctggttttgctat

SEQ ID NO: 5787554 - DNA, 21 bp, Homo sapiens
tagagatctggttttgctatt

SEQ ID NO: 5787555 - DNA, 17 bp, Homo sapiens
tagagatgactgagtcc

SEQ ID NO: 5787556 - DNA, 13 bp, Homo sapiens
tagagatgagccc

SEQ ID NO: 5787557 - DNA, 14 bp, Homo sapiens
tagagatgagccca

SEQ ID NO: 5787558 - DNA, 16 bp, Homo sapiens
tagagatgagctttct

SEQ ID NO: 5787559 - DNA, 21 bp, Homo sapiens
tagagatgagctttcttttta

SEQ ID NO: 5787560 - DNA, 15 bp, Homo sapiens
tagagatgaggtttc

SEQ ID NO: 5787561 - DNA, 16 bp, Homo sapiens
tagagatgattcagag

SEQ ID NO: 5787562 - DNA, 14 bp, Homo sapiens
tagagatgcctccc

SEQ ID NO: 5787563 - DNA, 22 bp, Homo sapiens
tagagatgctactgtcagtgtc

SEQ ID NO: 5787564 - DNA, 23 bp, Homo sapiens
tagagatgctactgtcagtgtcc

SEQ ID NO: 5787565 - DNA, 14 bp, Homo sapiens
tagagatggaggag

SEQ ID NO: 5787566 - DNA, 17 bp, Homo sapiens
tagagatggagtttgct

SEQ ID NO: 5787567 - DNA, 22 bp, Homo sapiens
tagagatgtgcctgtgggaggg

SEQ ID NO: 5787568 - DNA, 12 bp, Homo sapiens
tagagatgtgtg

SEQ ID NO: 5787569 - DNA, 18 bp, Homo sapiens
tagagatgttgagtctta

SEQ ID NO: 5787570 - DNA, 12 bp, Homo sapiens
tagagatgtttt

SEQ ID NO: 5787571 - DNA, 23 bp, Homo sapiens
tagagatgtttttaaaagtttca

SEQ ID NO: 5787572 - DNA, 15 bp, Homo sapiens
tagagattaatttgt

SEQ ID NO: 5787573 - DNA, 14 bp, Homo sapiens
tagagattgacttc

SEQ ID NO: 5787574 - DNA, 20 bp, Homo sapiens
tagagattgccccagagccc

SEQ ID NO: 5787575 - DNA, 14 bp, Homo sapiens
tagagattgtacat

SEQ ID NO: 5787576 - DNA, 15 bp, Homo sapiens
tagagatttcatagc

SEQ ID NO: 5787577 - DNA, 13 bp, Homo sapiens
tagagatttccca

SEQ ID NO: 5787578 - DNA, 16 bp, Homo sapiens
tagagatttgtctaat

SEQ ID NO: 5787579 - DNA, 20 bp, Homo sapiens
tagagatttgtctaattgca

SEQ ID NO: 5787580 - DNA, 15 bp, Homo sapiens
tagagattttacaaa

SEQ ID NO: 5787581 - DNA, 19 bp, Homo sapiens
tagagattttacaaaatgc

SEQ ID NO: 5787582 - DNA, 14 bp, Homo sapiens
tagagattttctct

SEQ ID NO: 5787583 - DNA, 14 bp, Homo sapiens
tagagcaaaattga

SEQ ID NO: 5787584 - DNA, 13 bp, Homo sapiens
tagagcaatgttg

SEQ ID NO: 5787585 - DNA, 17 bp, Homo sapiens
tagagcacactgtagca

SEQ ID NO: 5787586 - DNA, 15 bp, Homo sapiens
tagagcacagcttct

SEQ ID NO: 5787587 - DNA, 20 bp, Homo sapiens
tagagcacagcttcttctgc

SEQ ID NO: 5787588 - DNA, 15 bp, Homo sapiens
tagagcacatttagt

SEQ ID NO: 5787589 - DNA, 17 bp, Homo sapiens
tagagcactgccaccag

SEQ ID NO: 5787590 - DNA, 15 bp, Homo sapiens
tagatgttactacct

SEQ ID NO: 5787591 - DNA, 17 bp, Homo sapiens
tagatgttactgtgtga

SEQ ID NO: 5787592 - DNA, 22 bp, Homo sapiens
tagatgttcagattgctttgat

SEQ ID NO: 5787593 - DNA, 15 bp, Homo sapiens
tagatgttctacttt

SEQ ID NO: 5787594 - DNA, 18 bp, Homo sapiens
tagatgttctctatcatt

SEQ ID NO: 5787595 - DNA, 19 bp, Homo sapiens
tagatgttctctatcattt

SEQ ID NO: 5787596 - DNA, 21 bp, Homo sapiens
tagatgttctctatcatttaa

SEQ ID NO: 5787597 - DNA, 21 bp, Homo sapiens
tagatgttcttttctatttat

SEQ ID NO: 5787598 - DNA, 14 bp, Homo sapiens
tagatgttgccatg

SEQ ID NO: 5787599 - DNA, 11 bp, Homo sapiens
tagatgttgct

SEQ ID NO: 5787600 - DNA, 13 bp, Homo sapiens
tagatgttgctaa

SEQ ID NO: 5787601 - DNA, 14 bp, Homo sapiens
tagatgttgctctt

SEQ ID NO: 5787602 - DNA, 17 bp, Homo sapiens
tagatgttgctctttca

SEQ ID NO: 5787603 - DNA, 19 bp, Homo sapiens
tagatgtttatatcaaatg

SEQ ID NO: 5787604 - DNA, 20 bp, Homo sapiens
tagatgtttattcttctaga

SEQ ID NO: 5787605 - DNA, 22 bp, Homo sapiens
tagatgtttcaactgtgctctt

SEQ ID NO: 5787606 - DNA, 15 bp, Homo sapiens
tagatgtttgacttt

SEQ ID NO: 5787607 - DNA, 14 bp, Homo sapiens
tagatgttttaact

SEQ ID NO: 5787608 - DNA, 20 bp, Homo sapiens
tagatgttttaacttattta

SEQ ID NO: 5787609 - DNA, 18 bp, Homo sapiens
tagatgttttgggatcag

SEQ ID NO: 5787610 - DNA, 22 bp, Homo sapiens
tagatgttttgggatcaggagc

SEQ ID NO: 5787611 - DNA, 20 bp, Homo sapiens
tagattaaatatagattaga

SEQ ID NO: 5787612 - DNA, 18 bp, Homo sapiens
tagattaagagatgggtt

SEQ ID NO: 5787613 - DNA, 22 bp, Homo sapiens
tagattaatgacgtatacatag

SEQ ID NO: 5787614 - DNA, 15 bp, Homo sapiens
tagattaatggcact

SEQ ID NO: 5787615 - DNA, 22 bp, Homo sapiens
tagattacagagggctcatttt

SEQ ID NO: 5787616 - DNA, 14 bp, Homo sapiens
tagattacatctgc

SEQ ID NO: 5787617 - DNA, 16 bp, Homo sapiens
tagattacatctgcct

SEQ ID NO: 5787618 - DNA, 19 bp, Homo sapiens
tagattacatctgccttaa

SEQ ID NO: 5787619 - DNA, 21 bp, Homo sapiens
tagattaccccctcattgttt

SEQ ID NO: 5787620 - DNA, 19 bp, Homo sapiens
tagattagaattctgtata

SEQ ID NO: 5787621 - DNA, 20 bp, Homo sapiens
tagattagatcttttaagcc

SEQ ID NO: 5787622 - DNA, 18 bp, Homo sapiens
tagattaggtcttgctgg

SEQ ID NO: 5787623 - DNA, 14 bp, Homo sapiens
tagattatgtcttt

SEQ ID NO: 5787624 - DNA, 13 bp, Homo sapiens
tagattatttcat

SEQ ID NO: 5787625 - DNA, 16 bp, Homo sapiens
tagattatttcatata

SEQ ID NO: 5787626 - DNA, 18 bp, Homo sapiens
tagattcaaaggttctag

SEQ ID NO: 5787627 - DNA, 24 bp, Homo sapiens
tagattcaagttgtgtctgaaaat

SEQ ID NO: 5787628 - DNA, 12 bp, Homo sapiens
tagattcacctg

SEQ ID NO: 5787629 - DNA, 22 bp, Homo sapiens
tagattcacctgtaaaacttta

SEQ ID NO: 5787630 - DNA, 12 bp, Homo sapiens
tagattcagaga

SEQ ID NO: 5787631 - DNA, 14 bp, Homo sapiens
tagattcagagaaa

SEQ ID NO: 5787632 - DNA, 18 bp, Homo sapiens
tagattcaggggaagggc

SEQ ID NO: 5787633 - DNA, 21 bp, Homo sapiens
tagattcaggggaagggcagg

SEQ ID NO: 5787634 - DNA, 20 bp, Homo sapiens
tagattccattggtccaaga

SEQ ID NO: 5787635 - DNA, 23 bp, Homo sapiens
tagattccccattgcctcctcct

SEQ ID NO: 5787636 - DNA, 16 bp, Homo sapiens
tagattcctacttaaa

SEQ ID NO: 5787637 - DNA, 17 bp, Homo sapiens
tagattcctacttaaac

SEQ ID NO: 5787638 - DNA, 23 bp, Homo sapiens
tagattcctacttaaacaaaaac

SEQ ID NO: 5787639 - DNA, 23 bp, Homo sapiens
tagattcctcttgcctctctcag

SEQ ID NO: 5787640 - DNA, 18 bp, Homo sapiens
tagattcgctgtcccctc

SEQ ID NO: 5787641 - DNA, 17 bp, Homo sapiens
tagattctaaagattct

SEQ ID NO: 5787642 - DNA, 20 bp, Homo sapiens
tagattctacatattcttta

SEQ ID NO: 5787643 - DNA, 15 bp, Homo sapiens
tagattctccaaatg

SEQ ID NO: 5787644 - DNA, 22 bp, Homo sapiens
tagattctctgtgtctaagatt

SEQ ID NO: 5787645 - DNA, 14 bp, Homo sapiens
tagattgaaaccat

SEQ ID NO: 5787646 - DNA, 15 bp, Homo sapiens
tagattgaaatttat

SEQ ID NO: 5787647 - DNA, 15 bp, Homo sapiens
tagattgagaaatgt

SEQ ID NO: 5787648 - DNA, 21 bp, Homo sapiens
tagattgatctaaggcatgct

SEQ ID NO: 5787649 - DNA, 23 bp, Homo sapiens
tagattgattgtattgttgaaaa

SEQ ID NO: 5787650 - DNA, 15 bp, Homo sapiens
tagattggttctgtt

SEQ ID NO: 5787651 - DNA, 18 bp, Homo sapiens
tagattgtaatacacata

SEQ ID NO: 5787652 - DNA, 18 bp, Homo sapiens
tagattgtccttttgcaa

SEQ ID NO: 5787653 - DNA, 23 bp, Homo sapiens
tagattgtgcccacccagggaag

SEQ ID NO: 5787654 - DNA, 18 bp, Homo sapiens
tagattgttttagagtta

SEQ ID NO: 5787655 - DNA, 23 bp, Homo sapiens
tagatttaatataaagttttata

SEQ ID NO: 5787656 - DNA, 20 bp, Homo sapiens
tagatttaccctttatagaa

SEQ ID NO: 5787657 - DNA, 20 bp, Homo sapiens
tagatttagttttgtaactt

SEQ ID NO: 5787658 - DNA, 13 bp, Homo sapiens
tagatttattgtc

SEQ ID NO: 5787659 - DNA, 14 bp, Homo sapiens
tagatttatttcat

SEQ ID NO: 5787660 - DNA, 15 bp, Homo sapiens
tagatttattttaca

SEQ ID NO: 5787661 - DNA, 17 bp, Homo sapiens
tagatttattttacatt

SEQ ID NO: 5787662 - DNA, 21 bp, Homo sapiens
tagatttatttttcagttcca

SEQ ID NO: 5787663 - DNA, 20 bp, Homo sapiens
tagatttcagctatgcagaa

SEQ ID NO: 5787664 - DNA, 20 bp, Homo sapiens
tagatttcagtagtttctaa

SEQ ID NO: 5787665 - DNA, 18 bp, Homo sapiens
tagatttcatagttcaga

SEQ ID NO: 5787666 - DNA, 20 bp, Homo sapiens
tagatttcatagttcagaat

SEQ ID NO: 5787667 - DNA, 13 bp, Homo sapiens
tagatttctagaa

SEQ ID NO: 5787668 - DNA, 13 bp, Homo sapiens
tagatttctagca

SEQ ID NO: 5787669 - DNA, 23 bp, Homo sapiens
tagatttctcacactctaactgt

SEQ ID NO: 5787670 - DNA, 12 bp, Homo sapiens
tagatttctctt

SEQ ID NO: 5787671 - DNA, 13 bp, Homo sapiens
tagatttctcttg

SEQ ID NO: 5787672 - DNA, 15 bp, Homo sapiens
tagatttctcttggg

SEQ ID NO: 5787673 - DNA, 17 bp, Homo sapiens
tagatttctgattttat

SEQ ID NO: 5787674 - DNA, 19 bp, Homo sapiens
tagatttctggcatatgtt

SEQ ID NO: 5787675 - DNA, 12 bp, Homo sapiens
tagatttgaaaa

SEQ ID NO: 5787676 - DNA, 13 bp, Homo sapiens
tagatttgaaaaa

SEQ ID NO: 5787677 - DNA, 21 bp, Homo sapiens
tagatttgaagatctgattta

SEQ ID NO: 5787678 - DNA, 13 bp, Homo sapiens
tagatttgaccta

SEQ ID NO: 5787679 - DNA, 14 bp, Homo sapiens
tagatttgacctcc

SEQ ID NO: 5787680 - DNA, 13 bp, Homo sapiens
tagatttggaata

SEQ ID NO: 5787681 - DNA, 17 bp, Homo sapiens
tagatttgtccttttat

SEQ ID NO: 5787682 - DNA, 20 bp, Homo sapiens
tagatttgtgtgcatcaggc

SEQ ID NO: 5787683 - DNA, 14 bp, Homo sapiens
tagatttgttttgt

SEQ ID NO: 5787684 - DNA, 15 bp, Homo sapiens
tagatttgttttgtg

SEQ ID NO: 5787685 - DNA, 13 bp, Homo sapiens
tagattttaagaa

SEQ ID NO: 5787686 - DNA, 18 bp, Homo sapiens
tagattttaatcaaattt

SEQ ID NO: 5787687 - DNA, 21 bp, Homo sapiens
tagattttacatgaagtattt

SEQ ID NO: 5787688 - DNA, 22 bp, Homo sapiens
tagattttacatgaagtatttt

SEQ ID NO: 5787689 - DNA, 21 bp, Homo sapiens
tagattttagaaaaacattta

SEQ ID NO: 5787690 - DNA, 18 bp, Homo sapiens
tagattttagcatgatga

SEQ ID NO: 5787691 - DNA, 13 bp, Homo sapiens
tagattttatagt

SEQ ID NO: 5787692 - DNA, 19 bp, Homo sapiens
tagattttatagtgtgttg

SEQ ID NO: 5787693 - DNA, 14 bp, Homo sapiens
tagattttattatg

SEQ ID NO: 5787694 - DNA, 12 bp, Homo sapiens
tagattttccaa

SEQ ID NO: 5787695 - DNA, 16 bp, Homo sapiens
tagattttctctggaa

SEQ ID NO: 5787696 - DNA, 14 bp, Homo sapiens
tagattttctggtt

SEQ ID NO: 5787697 - DNA, 15 bp, Homo sapiens
tagattttctgtaaa

SEQ ID NO: 5787698 - DNA, 16 bp, Homo sapiens
tagattttctttaaaa

SEQ ID NO: 5787699 - DNA, 19 bp, Homo sapiens
tagattttctttaaaagaa

SEQ ID NO: 5787700 - DNA, 15 bp, Homo sapiens
tagattttgaaaaat

SEQ ID NO: 5787701 - DNA, 15 bp, Homo sapiens
tagattttgtgcagt

SEQ ID NO: 5787702 - DNA, 21 bp, Homo sapiens
tagattttgtgtttattcttg

SEQ ID NO: 5787703 - DNA, 13 bp, Homo sapiens
tagattttgttat

SEQ ID NO: 5787704 - DNA, 15 bp, Homo sapiens
tagatttttaaaagg

SEQ ID NO: 5787705 - DNA, 23 bp, Homo sapiens
tagatttttaaaaggtaggtttt

SEQ ID NO: 5787706 - DNA, 21 bp, Homo sapiens
tagatttttaatggttaagaa

SEQ ID NO: 5787707 - DNA, 17 bp, Homo sapiens
tagatttttagattcct

SEQ ID NO: 5787708 - DNA, 18 bp, Homo sapiens
tagatttttgattcagct

SEQ ID NO: 5787709 - DNA, 12 bp, Homo sapiens
tagattttttca

SEQ ID NO: 5787710 - DNA, 13 bp, Homo sapiens
tagcaaaaaaagt

SEQ ID NO: 5787711 - DNA, 18 bp, Homo sapiens
tagcaaaaacatgtatgt

SEQ ID NO: 5787712 - DNA, 16 bp, Homo sapiens
tagcaaaacaaattca

SEQ ID NO: 5787713 - DNA, 21 bp, Homo sapiens
tagcaaaacaaattcaaataa

SEQ ID NO: 5787714 - DNA, 16 bp, Homo sapiens
tagcaaaacttttaaa

SEQ ID NO: 5787715 - DNA, 18 bp, Homo sapiens
tagcaaaacttttaaact

SEQ ID NO: 5787716 - DNA, 14 bp, Homo sapiens
tagcaaaagaagaa

SEQ ID NO: 5787717 - DNA, 14 bp, Homo sapiens
tagcaaaagaagta

SEQ ID NO: 5787718 - DNA, 23 bp, Homo sapiens
tagcaaaaggatgatttaacatt

SEQ ID NO: 5787719 - DNA, 15 bp, Homo sapiens
tagcaaaatattatc

SEQ ID NO: 5787720 - DNA, 20 bp, Homo sapiens
tagcaaaatattatctgaac

SEQ ID NO: 5787721 - DNA, 14 bp, Homo sapiens
tagcaaacaaaaat

SEQ ID NO: 5787722 - DNA, 23 bp, Homo sapiens
tagcaaacaaaaatagaatatat

SEQ ID NO: 5787723 - DNA, 12 bp, Homo sapiens
tagcaaacagag

SEQ ID NO: 5787724 - DNA, 15 bp, Homo sapiens
tagcaaacagaggaa

SEQ ID NO: 5787725 - DNA, 17 bp, Homo sapiens
tagcaaaccctgtcaaa

SEQ ID NO: 5787726 - DNA, 19 bp, Homo sapiens
tagcaaaccctgtcaaaca

SEQ ID NO: 5787727 - DNA, 17 bp, Homo sapiens
tagcaaactccaggttc

SEQ ID NO: 5787728 - DNA, 12 bp, Homo sapiens
tagcaaagaatt

SEQ ID NO: 5787729 - DNA, 14 bp, Homo sapiens
tagcaaagaattga

SEQ ID NO: 5787730 - DNA, 16 bp, Homo sapiens
tagcaaagatatatat

SEQ ID NO: 5787731 - DNA, 19 bp, Homo sapiens
tagcaaagatatctcatct

SEQ ID NO: 5787732 - DNA, 15 bp, Homo sapiens
tagcaaagcaaaagg

SEQ ID NO: 5787733 - DNA, 23 bp, Homo sapiens
tagcaaagcaaaaggctgagaag

SEQ ID NO: 5787734 - DNA, 19 bp, Homo sapiens
tagcaaagcttaaatgcct

SEQ ID NO: 5787735 - DNA, 12 bp, Homo sapiens
tagcaaatacat

SEQ ID NO: 5787736 - DNA, 19 bp, Homo sapiens
tagcaaatcgtacattgtg

SEQ ID NO: 5787737 - DNA, 21 bp, Homo sapiens
tagcaaatcgtacattgtgcc

SEQ ID NO: 5787738 - DNA, 17 bp, Homo sapiens
tagcaaatgaaggatga

SEQ ID NO: 5787739 - DNA, 23 bp, Homo sapiens
tagcaaatgacagatttctgtaa

SEQ ID NO: 5787740 - DNA, 12 bp, Homo sapiens
tagcaaatgcag

SEQ ID NO: 5787741 - DNA, 13 bp, Homo sapiens
tagcaaatgttta

SEQ ID NO: 5787742 - DNA, 20 bp, Homo sapiens
tagcaaattccaatacatta

SEQ ID NO: 5787743 - DNA, 22 bp, Homo sapiens
tagcaaatttgtttaatctaca

SEQ ID NO: 5787744 - DNA, 22 bp, Homo sapiens
tagcaacaaatccatggaccta

SEQ ID NO: 5787745 - DNA, 14 bp, Homo sapiens
tagcaacaacagaa

SEQ ID NO: 5787746 - DNA, 18 bp, Homo sapiens
tagcaacatatctctgcc

SEQ ID NO: 5787747 - DNA, 19 bp, Homo sapiens
tagcaacatatctctgccg

SEQ ID NO: 5787748 - DNA, 17 bp, Homo sapiens
tagcaaccatttgtaaa

SEQ ID NO: 5787749 - DNA, 21 bp, Homo sapiens
tagcaactacagtctaaagct

SEQ ID NO: 5787750 - DNA, 21 bp, Homo sapiens
tagcaactcttatttctttcc

SEQ ID NO: 5787751 - DNA, 13 bp, Homo sapiens
tagcaacttttgt

SEQ ID NO: 5787752 - DNA, 17 bp, Homo sapiens
tagcaacttttgtgtaa

SEQ ID NO: 5787753 - DNA, 17 bp, Homo sapiens
tagcaagacctgaaaat

SEQ ID NO: 5787754 - DNA, 16 bp, Homo sapiens
tagcaagacctgttgg

SEQ ID NO: 5787755 - DNA, 19 bp, Homo sapiens
tagcaagacctgttggtta

SEQ ID NO: 5787756 - DNA, 14 bp, Homo sapiens
tagcaagagagcag

SEQ ID NO: 5787757 - DNA, 21 bp, Homo sapiens
tagcaagagagcagcgcccag

SEQ ID NO: 5787758 - DNA, 24 bp, Homo sapiens
tagcaagattgcttaaaatagcaa

SEQ ID NO: 5787759 - DNA, 15 bp, Homo sapiens
tagcaagcaactaat

SEQ ID NO: 5787760 - DNA, 15 bp, Homo sapiens
tagcaagcttttgct

SEQ ID NO: 5787761 - DNA, 15 bp, Homo sapiens
tagcaaggaaggaca

SEQ ID NO: 5787762 - DNA, 16 bp, Homo sapiens
tagcaaggaaggacac

SEQ ID NO: 5787763 - DNA, 18 bp, Homo sapiens
tagcaaggcagagccttt

SEQ ID NO: 5787764 - DNA, 14 bp, Homo sapiens
tagcaaggccaggg

SEQ ID NO: 5787765 - DNA, 22 bp, Homo sapiens
tagcaaggccagggcacagctg

SEQ ID NO: 5787766 - DNA, 13 bp, Homo sapiens
tagcaaggctcat

SEQ ID NO: 5787767 - DNA, 14 bp, Homo sapiens
tagcaaggctgggt

SEQ ID NO: 5787768 - DNA, 20 bp, Homo sapiens
tagctactgtagaaaggaaa

SEQ ID NO: 5787769 - DNA, 21 bp, Homo sapiens
tagctactgtagaaaggaaat

SEQ ID NO: 5787770 - DNA, 15 bp, Homo sapiens
tagctacttttcaga

SEQ ID NO: 5787771 - DNA, 18 bp, Homo sapiens
tagctacttttgcaggat

SEQ ID NO: 5787772 - DNA, 14 bp, Homo sapiens
tagctagaagtggg

SEQ ID NO: 5787773 - DNA, 13 bp, Homo sapiens
tagctagaatatc

SEQ ID NO: 5787774 - DNA, 18 bp, Homo sapiens
tagctagactaggagacc

SEQ ID NO: 5787775 - DNA, 15 bp, Homo sapiens
tagctagccagccaa

SEQ ID NO: 5787776 - DNA, 20 bp, Homo sapiens
tagctagcgtgtgccaggca

SEQ ID NO: 5787777 - DNA, 15 bp, Homo sapiens
tagctagctatttct

SEQ ID NO: 5787778 - DNA, 17 bp, Homo sapiens
tagctaggagcaggctt

SEQ ID NO: 5787779 - DNA, 16 bp, Homo sapiens
tagctaggatttgaac

SEQ ID NO: 5787780 - DNA, 17 bp, Homo sapiens
tagctaggtgacatata

SEQ ID NO: 5787781 - DNA, 16 bp, Homo sapiens
tagctagtagcaatgt

SEQ ID NO: 5787782 - DNA, 20 bp, Homo sapiens
tagctagttatgtgagaaag

SEQ ID NO: 5787783 - DNA, 19 bp, Homo sapiens
tagctagtttaaaattatt

SEQ ID NO: 5787784 - DNA, 23 bp, Homo sapiens
tagctataattgggtcatagaaa

SEQ ID NO: 5787785 - DNA, 23 bp, Homo sapiens
tagctatatatttaggaaattca

SEQ ID NO: 5787786 - DNA, 16 bp, Homo sapiens
tagctatatccatgta

SEQ ID NO: 5787787 - DNA, 18 bp, Homo sapiens
tagctatatccatgtact

SEQ ID NO: 5787788 - DNA, 22 bp, Homo sapiens
tagctatatccatgtactgtag

SEQ ID NO: 5787789 - DNA, 23 bp, Homo sapiens
tagctatatgcattttatgtgac

SEQ ID NO: 5787790 - DNA, 17 bp, Homo sapiens
tagctatcaagaggctg

SEQ ID NO: 5787791 - DNA, 16 bp, Homo sapiens
tagctatcagaagacc

SEQ ID NO: 5787792 - DNA, 17 bp, Homo sapiens
tagctattaagatactt

SEQ ID NO: 5787793 - DNA, 13 bp, Homo sapiens
tagctattactgt

SEQ ID NO: 5787794 - DNA, 17 bp, Homo sapiens
tagctattgcatgtaaa

SEQ ID NO: 5787795 - DNA, 22 bp, Homo sapiens
tagctattgcatgtaaaatgca

SEQ ID NO: 5787796 - DNA, 22 bp, Homo sapiens
tagctatttaatactaattttc

SEQ ID NO: 5787797 - DNA, 18 bp, Homo sapiens
tagctatttatccctttc

SEQ ID NO: 5787798 - DNA, 11 bp, Homo sapiens
tagctattttc

SEQ ID NO: 5787799 - DNA, 16 bp, Homo sapiens
tagctattttccttgc

SEQ ID NO: 5787800 - DNA, 21 bp, Homo sapiens
tagctattttccttgcttttc

SEQ ID NO: 5787801 - DNA, 11 bp, Homo sapiens
tagctattttt

SEQ ID NO: 5787802 - DNA, 21 bp, Homo sapiens
tagctatttttatacactgta

SEQ ID NO: 5787803 - DNA, 22 bp, Homo sapiens
tagctatttttatacactgtaa

SEQ ID NO: 5787804 - DNA, 23 bp, Homo sapiens
tagctatttttatacactgtaag

SEQ ID NO: 5787805 - DNA, 23 bp, Homo sapiens
tagctcaagagaaaagttgacac

SEQ ID NO: 5787806 - DNA, 15 bp, Homo sapiens
tagctcaatgagcat

SEQ ID NO: 5787807 - DNA, 17 bp, Homo sapiens
tagctcaatgagcatgt

SEQ ID NO: 5787808 - DNA, 16 bp, Homo sapiens
tagctcacagcacatt

SEQ ID NO: 5787809 - DNA, 14 bp, Homo sapiens
tagctcaccaggcc

SEQ ID NO: 5787810 - DNA, 22 bp, Homo sapiens
tagctcaccttgagataacaat

SEQ ID NO: 5787811 - DNA, 20 bp, Homo sapiens
tagctcagataatgcccaga

SEQ ID NO: 5787812 - DNA, 15 bp, Homo sapiens
tagctcagctgagca

SEQ ID NO: 5787813 - DNA, 16 bp, Homo sapiens
tagctcaggtgcctta

SEQ ID NO: 5787814 - DNA, 16 bp, Homo sapiens
tagctcaggtgtccct

SEQ ID NO: 5787815 - DNA, 11 bp, Homo sapiens
tagctcagtca

SEQ ID NO: 5787816 - DNA, 11 bp, Homo sapiens
tagctcagttt

SEQ ID NO: 5787817 - DNA, 12 bp, Homo sapiens
tagctcagttta

SEQ ID NO: 5787818 - DNA, 15 bp, Homo sapiens
tagctcatgtatatt

SEQ ID NO: 5787819 - DNA, 12 bp, Homo sapiens
tagctcattctc

SEQ ID NO: 5787820 - DNA, 13 bp, Homo sapiens
tagctccaagctg

SEQ ID NO: 5787821 - DNA, 14 bp, Homo sapiens
tagctccaagctgt

SEQ ID NO: 5787822 - DNA, 15 bp, Homo sapiens
tagctccaagctgtt

SEQ ID NO: 5787823 - DNA, 20 bp, Homo sapiens
tagctccaagctgttaaaga

SEQ ID NO: 5787824 - DNA, 14 bp, Homo sapiens
tagctcccagctag

SEQ ID NO: 5787825 - DNA, 19 bp, Homo sapiens
tagctcccagctagggggc

SEQ ID NO: 5787826 - DNA, 21 bp, Homo sapiens
tagctccccgcttctgcctgc

SEQ ID NO: 5787827 - DNA, 15 bp, Homo sapiens
tagctcccctcctct

SEQ ID NO: 5787828 - DNA, 19 bp, Homo sapiens
tagctcccctgctgaggca

SEQ ID NO: 5787829 - DNA, 15 bp, Homo sapiens
tagctcccctggctg

SEQ ID NO: 5787830 - DNA, 16 bp, Homo sapiens
tagctcccctggctgg

SEQ ID NO: 5787831 - DNA, 14 bp, Homo sapiens
tagctccctcctcc

SEQ ID NO: 5787832 - DNA, 14 bp, Homo sapiens
tagctccctgttct

SEQ ID NO: 5787833 - DNA, 13 bp, Homo sapiens
tagctcccttgag

SEQ ID NO: 5787834 - DNA, 17 bp, Homo sapiens
tagctcccttgagctgg

SEQ ID NO: 5787835 - DNA, 15 bp, Homo sapiens
tagctccgcgtgtct

SEQ ID NO: 5787836 - DNA, 21 bp, Homo sapiens
tagctccgggggtacagccct

SEQ ID NO: 5787837 - DNA, 16 bp, Homo sapiens
tagctcctcactgtgg

SEQ ID NO: 5787838 - DNA, 16 bp, Homo sapiens
tagctcctccccttcc

SEQ ID NO: 5787839 - DNA, 16 bp, Homo sapiens
tagctcctcctcctgg

SEQ ID NO: 5787840 - DNA, 16 bp, Homo sapiens
tagctcctctgctgct

SEQ ID NO: 5787841 - DNA, 21 bp, Homo sapiens
tagctcctgccacatggagcc

SEQ ID NO: 5787842 - DNA, 12 bp, Homo sapiens
tagctcctgtgg

SEQ ID NO: 5787843 - DNA, 22 bp, Homo sapiens
tagctcctgtggccccaccctg

SEQ ID NO: 5787844 - DNA, 11 bp, Homo sapiens
tagctccttca

SEQ ID NO: 5787845 - DNA, 15 bp, Homo sapiens
tagctccttgaagac

SEQ ID NO: 5787846 - DNA, 16 bp, Homo sapiens
tagctccttgaagaca

SEQ ID NO: 5787847 - DNA, 14 bp, Homo sapiens
tagctcggcaccaa

SEQ ID NO: 5787848 - DNA, 14 bp, Homo sapiens
tagctctaaaatct

SEQ ID NO: 5787849 - DNA, 20 bp, Homo sapiens
tagctctaatgtttgcatat

SEQ ID NO: 5787850 - DNA, 14 bp, Homo sapiens
tagctctacacaac

SEQ ID NO: 5787851 - DNA, 17 bp, Homo sapiens
tagctctacacaacatg

SEQ ID NO: 5787852 - DNA, 21 bp, Homo sapiens
tagctctaggagggctggcaa

SEQ ID NO: 5787853 - DNA, 17 bp, Homo sapiens
tagctctatgtttacaa

SEQ ID NO: 5787854 - DNA, 15 bp, Homo sapiens
tagctctcacagaca

SEQ ID NO: 5787855 - DNA, 14 bp, Homo sapiens
tagctctccttccc

SEQ ID NO: 5787856 - DNA, 20 bp, Homo sapiens
tagctctcgcctcaggcttt

SEQ ID NO: 5787857 - DNA, 15 bp, Homo sapiens
tagctctctaggcct

SEQ ID NO: 5787858 - DNA, 16 bp, Homo sapiens
tagctctgaagcaaga

SEQ ID NO: 5787859 - DNA, 19 bp, Homo sapiens
tagctctgaagggagggga

SEQ ID NO: 5787860 - DNA, 12 bp, Homo sapiens
tagctctgagaa

SEQ ID NO: 5787861 - DNA, 13 bp, Homo sapiens
tagctctgccctg

SEQ ID NO: 5787862 - DNA, 14 bp, Homo sapiens
tagctctgcctccc

SEQ ID NO: 5787863 - DNA, 11 bp, Homo sapiens
tagctctgctg

SEQ ID NO: 5787864 - DNA, 13 bp, Homo sapiens
tagctctgctgct

SEQ ID NO: 5787865 - DNA, 21 bp, Homo sapiens
tagctctggaggtgctgctct

SEQ ID NO: 5787866 - DNA, 22 bp, Homo sapiens
tagctctggaggtgctgctcta

SEQ ID NO: 5787867 - DNA, 23 bp, Homo sapiens
tagctctggagtgagtctgtcat

SEQ ID NO: 5787868 - DNA, 16 bp, Homo sapiens
tagctctggggggcag

SEQ ID NO: 5787869 - DNA, 23 bp, Homo sapiens
tagctctggggtgggcagttttt

SEQ ID NO: 5787870 - DNA, 16 bp, Homo sapiens
tagctcttcacttcct

SEQ ID NO: 5787871 - DNA, 17 bp, Homo sapiens
tagctcttcacttcctc

SEQ ID NO: 5787872 - DNA, 17 bp, Homo sapiens
tagctcttccccatctc

SEQ ID NO: 5787873 - DNA, 14 bp, Homo sapiens
tagctcttgggcct

SEQ ID NO: 5787874 - DNA, 13 bp, Homo sapiens
tagctctttgtca

SEQ ID NO: 5787875 - DNA, 19 bp, Homo sapiens
tagctctttgtcagggagt

SEQ ID NO: 5787876 - DNA, 19 bp, Homo sapiens
tagctcttttttgtttgtt

SEQ ID NO: 5787877 - DNA, 13 bp, Homo sapiens
tagctgaaaaaac

SEQ ID NO: 5787878 - DNA, 16 bp, Homo sapiens
tagctgaaaaaactat

SEQ ID NO: 5787879 - DNA, 22 bp, Homo sapiens
tagctgaaaactaatgtactgt

SEQ ID NO: 5787880 - DNA, 23 bp, Homo sapiens
tagctgaaaactaatgtactgta

SEQ ID NO: 5787881 - DNA, 17 bp, Homo sapiens
tagctgaaacaaaaatg

SEQ ID NO: 5787882 - DNA, 22 bp, Homo sapiens
tagctgaagaattgaaaagttt

SEQ ID NO: 5787883 - DNA, 21 bp, Homo sapiens
tagctgaatgagtctgctttc

SEQ ID NO: 5787884 - DNA, 18 bp, Homo sapiens
tagctgacaaaatacttg

SEQ ID NO: 5787885 - DNA, 16 bp, Homo sapiens
tagctgacacagaaaa

SEQ ID NO: 5787886 - DNA, 15 bp, Homo sapiens
tagctgacagtcagc

SEQ ID NO: 5787887 - DNA, 17 bp, Homo sapiens
tagctgacatctcctct

SEQ ID NO: 5787888 - DNA, 18 bp, Homo sapiens
tagctgacatctcctcta

SEQ ID NO: 5787889 - DNA, 16 bp, Homo sapiens
tagctgactttcattt

SEQ ID NO: 5787890 - DNA, 17 bp, Homo sapiens
tagctgactttcatttg

SEQ ID NO: 5787891 - DNA, 16 bp, Homo sapiens
tagctgagaggaagat

SEQ ID NO: 5787892 - DNA, 18 bp, Homo sapiens
tagctgagaggaagatga

SEQ ID NO: 5787893 - DNA, 11 bp, Homo sapiens
tagctgagctc

SEQ ID NO: 5787894 - DNA, 15 bp, Homo sapiens
tagctgagctttaaa

SEQ ID NO: 5787895 - DNA, 20 bp, Homo sapiens
tagctgagctttaaatcatt

SEQ ID NO: 5787896 - DNA, 23 bp, Homo sapiens
tagctgaggctgagaaagctaaa

SEQ ID NO: 5787897 - DNA, 11 bp, Homo sapiens
tagctgaggga

SEQ ID NO: 5787898 - DNA, 12 bp, Homo sapiens
tagctgagggga

SEQ ID NO: 5787899 - DNA, 13 bp, Homo sapiens
tagctgaggggac

SEQ ID NO: 5787900 - DNA, 16 bp, Homo sapiens
tagctgaggggacggg

SEQ ID NO: 5787901 - DNA, 20 bp, Homo sapiens
tagctgataaagaaaccttt

SEQ ID NO: 5787902 - DNA, 16 bp, Homo sapiens
tagctgatcagaattt

SEQ ID NO: 5787903 - DNA, 21 bp, Homo sapiens
tagctgatgaacttattctgt

SEQ ID NO: 5787904 - DNA, 12 bp, Homo sapiens
tagctgcagaac

SEQ ID NO: 5787905 - DNA, 21 bp, Homo sapiens
tagctgcagataagtggcctt

SEQ ID NO: 5787906 - DNA, 20 bp, Homo sapiens
tagctgcagccttcatcaga

SEQ ID NO: 5787907 - DNA, 18 bp, Homo sapiens
tagctgccaaaaagaaca

SEQ ID NO: 5787908 - DNA, 15 bp, Homo sapiens
tagctgccacttgaa

SEQ ID NO: 5787909 - DNA, 21 bp, Homo sapiens
tagctgccacttgaacaaaat

SEQ ID NO: 5787910 - DNA, 16 bp, Homo sapiens
tagctgccactttcac

SEQ ID NO: 5787911 - DNA, 17 bp, Homo sapiens
tagctgccactttcacg

SEQ ID NO: 5787912 - DNA, 13 bp, Homo sapiens
tagctgccttttt

SEQ ID NO: 5787913 - DNA, 11 bp, Homo sapiens
tagctgctcac

SEQ ID NO: 5787914 - DNA, 18 bp, Homo sapiens
tagctgctcacttaaaca

SEQ ID NO: 5787915 - DNA, 17 bp, Homo sapiens
tagctgctgtcacattt

SEQ ID NO: 5787916 - DNA, 12 bp, Homo sapiens
tagctgctttaa

SEQ ID NO: 5787917 - DNA, 23 bp, Homo sapiens
tagctgcttttctgtcagtctga

SEQ ID NO: 5787918 - DNA, 17 bp, Homo sapiens
tagctggagaggagccc

SEQ ID NO: 5787919 - DNA, 19 bp, Homo sapiens
tagctggatataatgtatt

SEQ ID NO: 5787920 - DNA, 22 bp, Homo sapiens
tagctggctctgtgagggtgct

SEQ ID NO: 5787921 - DNA, 18 bp, Homo sapiens
tagctgggaaagcataaa

SEQ ID NO: 5787922 - DNA, 11 bp, Homo sapiens
tagctgggact

SEQ ID NO: 5787923 - DNA, 19 bp, Homo sapiens
tagctgggactacaggcac

SEQ ID NO: 5787924 - DNA, 17 bp, Homo sapiens
tagctgggatatgtagt

SEQ ID NO: 5787925 - DNA, 14 bp, Homo sapiens
tagctgggattaca

SEQ ID NO: 5787926 - DNA, 18 bp, Homo sapiens
tagctgggattacaggca

SEQ ID NO: 5787927 - DNA, 16 bp, Homo sapiens
tagctgggatttgaac

SEQ ID NO: 5787928 - DNA, 19 bp, Homo sapiens
tagctgggatttgaactga

SEQ ID NO: 5787929 - DNA, 23 bp, Homo sapiens
tagctgggattttaaactagatg

SEQ ID NO: 5787930 - DNA, 13 bp, Homo sapiens
tagctgggcctgt

SEQ ID NO: 5787931 - DNA, 15 bp, Homo sapiens
tagctgggcctgtgc

SEQ ID NO: 5787932 - DNA, 21 bp, Homo sapiens
tagctggggcttatgggtggc

SEQ ID NO: 5787933 - DNA, 14 bp, Homo sapiens
tagctggggcttca

SEQ ID NO: 5787934 - DNA, 21 bp, Homo sapiens
tagctgggttccgggaggcag

SEQ ID NO: 5787935 - DNA, 22 bp, Homo sapiens
tagctggtcttatttgtaaagc

SEQ ID NO: 5787936 - DNA, 20 bp, Homo sapiens
tagctggtggttgtgccttt

SEQ ID NO: 5787937 - DNA, 14 bp, Homo sapiens
tagctggtggtttc

SEQ ID NO: 5787938 - DNA, 20 bp, Homo sapiens
tagctggttggagagctaga

SEQ ID NO: 5787939 - DNA, 12 bp, Homo sapiens
tagctgtaaaac

SEQ ID NO: 5787940 - DNA, 19 bp, Homo sapiens
tagctgtaaatacatgtgt

SEQ ID NO: 5787941 - DNA, 21 bp, Homo sapiens
tagctgtaaatacatgtgtgg

SEQ ID NO: 5787942 - DNA, 12 bp, Homo sapiens
tagctgtaaggc

SEQ ID NO: 5787943 - DNA, 17 bp, Homo sapiens
tagctgtaagggcagtg

SEQ ID NO: 5787944 - DNA, 20 bp, Homo sapiens
tagctgtaagggcagtgccc

SEQ ID NO: 5787945 - DNA, 21 bp, Homo sapiens
tagctgtaagggcagtgccca

SEQ ID NO: 5787946 - DNA, 16 bp, Homo sapiens
tagctgtacaaatata

SEQ ID NO: 5787947 - DNA, 18 bp, Homo sapiens
taggatagctaactgtaa

SEQ ID NO: 5787948 - DNA, 19 bp, Homo sapiens
taggatagctaactgtaaa

SEQ ID NO: 5787949 - DNA, 15 bp, Homo sapiens
taggataggaactgg

SEQ ID NO: 5787950 - DNA, 19 bp, Homo sapiens
taggatagttgatgcatgt

SEQ ID NO: 5787951 - DNA, 17 bp, Homo sapiens
taggatatgcctgctct

SEQ ID NO: 5787952 - DNA, 21 bp, Homo sapiens
taggatatgcctgctctttgg

SEQ ID NO: 5787953 - DNA, 19 bp, Homo sapiens
taggatatgtatattttaa

SEQ ID NO: 5787954 - DNA, 17 bp, Homo sapiens
taggatattacaatggc

SEQ ID NO: 5787955 - DNA, 16 bp, Homo sapiens
taggatattgctaatt

SEQ ID NO: 5787956 - DNA, 17 bp, Homo sapiens
taggatattggcatttg

SEQ ID NO: 5787957 - DNA, 19 bp, Homo sapiens
taggatcagccctcatttt

SEQ ID NO: 5787958 - DNA, 22 bp, Homo sapiens
taggatcatatgaattgctgtc

SEQ ID NO: 5787959 - DNA, 15 bp, Homo sapiens
taggatcctggaggc

SEQ ID NO: 5787960 - DNA, 16 bp, Homo sapiens
taggatcgtaaaaaaa

SEQ ID NO: 5787961 - DNA, 16 bp, Homo sapiens
taggatctatgcaatt

SEQ ID NO: 5787962 - DNA, 18 bp, Homo sapiens
taggatctatgcaatttt

SEQ ID NO: 5787963 - DNA, 19 bp, Homo sapiens
taggatctatgcaattttt

SEQ ID NO: 5787964 - DNA, 20 bp, Homo sapiens
taggatctatgcaattttta

SEQ ID NO: 5787965 - DNA, 18 bp, Homo sapiens
taggatctgcaaacaatg

SEQ ID NO: 5787966 - DNA, 17 bp, Homo sapiens
taggatgacaggctctc

SEQ ID NO: 5787967 - DNA, 19 bp, Homo sapiens
taggatgcggctttctctg

SEQ ID NO: 5787968 - DNA, 14 bp, Homo sapiens
taggatgctgcagc

SEQ ID NO: 5787969 - DNA, 19 bp, Homo sapiens
taggatgggaacaaggaag

SEQ ID NO: 5787970 - DNA, 17 bp, Homo sapiens
taggatgggcttctgtg

SEQ ID NO: 5787971 - DNA, 17 bp, Homo sapiens
taggatggggctcccag

SEQ ID NO: 5787972 - DNA, 16 bp, Homo sapiens
taggatggtaaagtta

SEQ ID NO: 5787973 - DNA, 19 bp, Homo sapiens
taggatgtcatgtctgctt

SEQ ID NO: 5787974 - DNA, 19 bp, Homo sapiens
taggatgtctcttggaaat

SEQ ID NO: 5787975 - DNA, 20 bp, Homo sapiens
taggatgtctcttggaaatg

SEQ ID NO: 5787976 - DNA, 15 bp, Homo sapiens
taggatgtctgtaat

SEQ ID NO: 5787977 - DNA, 15 bp, Homo sapiens
taggatgttgcttct

SEQ ID NO: 5787978 - DNA, 21 bp, Homo sapiens
taggatgttgcttctgaatca

SEQ ID NO: 5787979 - DNA, 13 bp, Homo sapiens
taggatgtttttc

SEQ ID NO: 5787980 - DNA, 19 bp, Homo sapiens
taggatgtttttcatgaaa

SEQ ID NO: 5787981 - DNA, 13 bp, Homo sapiens
taggattaaacac

SEQ ID NO: 5787982 - DNA, 15 bp, Homo sapiens
taggattaatttatt

SEQ ID NO: 5787983 - DNA, 14 bp, Homo sapiens
taggattacaggca

SEQ ID NO: 5787984 - DNA, 19 bp, Homo sapiens
taggattacaggcatgagc

SEQ ID NO: 5787985 - DNA, 17 bp, Homo sapiens
taggattatagatactt

SEQ ID NO: 5787986 - DNA, 12 bp, Homo sapiens
taggattcaagt

SEQ ID NO: 5787987 - DNA, 22 bp, Homo sapiens
taggattcacaccccacctgcg

SEQ ID NO: 5787988 - DNA, 19 bp, Homo sapiens
taggattccccctgccctg

SEQ ID NO: 5787989 - DNA, 21 bp, Homo sapiens
taggattcccctcaatgcagt

SEQ ID NO: 5787990 - DNA, 14 bp, Homo sapiens
taggattctaaaat

SEQ ID NO: 5787991 - DNA, 14 bp, Homo sapiens
taggattgaagtgg

SEQ ID NO: 5787992 - DNA, 14 bp, Homo sapiens
taggattgctgggg

SEQ ID NO: 5787993 - DNA, 12 bp, Homo sapiens
taggatttaaca

SEQ ID NO: 5787994 - DNA, 21 bp, Homo sapiens
taggatttaacagtcatttaa

SEQ ID NO: 5787995 - DNA, 12 bp, Homo sapiens
taggatttattg

SEQ ID NO: 5787996 - DNA, 16 bp, Homo sapiens
taggatttatttaaaa

SEQ ID NO: 5787997 - DNA, 21 bp, Homo sapiens
taggatttatttaaaatagca

SEQ ID NO: 5787998 - DNA, 22 bp, Homo sapiens
taggatttatttaaaatagcaa

SEQ ID NO: 5787999 - DNA, 21 bp, Homo sapiens
taggatttgtgttttacagta

SEQ ID NO: 5788000 - DNA, 13 bp, Homo sapiens
taggattttcaca

SEQ ID NO: 5788001 - DNA, 15 bp, Homo sapiens
taggattttctcaag

SEQ ID NO: 5788002 - DNA, 22 bp, Homo sapiens
taggattttggatgttgagagg

SEQ ID NO: 5788003 - DNA, 15 bp, Homo sapiens
taggatttttttcct

SEQ ID NO: 5788004 - DNA, 22 bp, Homo sapiens
taggattttttttaatgtttaa

SEQ ID NO: 5788005 - DNA, 13 bp, Homo sapiens
taggcaaaaataa

SEQ ID NO: 5788006 - DNA, 18 bp, Homo sapiens
taggcaaaagtgtaacaa

SEQ ID NO: 5788007 - DNA, 16 bp, Homo sapiens
taggcaaataagcact

SEQ ID NO: 5788008 - DNA, 17 bp, Homo sapiens
taggcaagatggcacag

SEQ ID NO: 5788009 - DNA, 19 bp, Homo sapiens
taggcacccatcctagaga

SEQ ID NO: 5788010 - DNA, 21 bp, Homo sapiens
taggcacccctttccccagcc

SEQ ID NO: 5788011 - DNA, 21 bp, Homo sapiens
taggcacctccccgctctccc

SEQ ID NO: 5788012 - DNA, 17 bp, Homo sapiens
taggcaccttaactgga

SEQ ID NO: 5788013 - DNA, 18 bp, Homo sapiens
taggcaccttaactggag

SEQ ID NO: 5788014 - DNA, 16 bp, Homo sapiens
taggcacgaagcaatt

SEQ ID NO: 5788015 - DNA, 22 bp, Homo sapiens
taggcactttttaacattctca

SEQ ID NO: 5788016 - DNA, 23 bp, Homo sapiens
taggcactttttaacattctcaa

SEQ ID NO: 5788017 - DNA, 17 bp, Homo sapiens
taggcagacgtggggag

SEQ ID NO: 5788018 - DNA, 17 bp, Homo sapiens
taggcagactgggtttc

SEQ ID NO: 5788019 - DNA, 12 bp, Homo sapiens
taggcagagcct

SEQ ID NO: 5788020 - DNA, 13 bp, Homo sapiens
taggcagagcctt

SEQ ID NO: 5788021 - DNA, 12 bp, Homo sapiens
taggcagcctgc

SEQ ID NO: 5788022 - DNA, 15 bp, Homo sapiens
taggcagctgtcctg

SEQ ID NO: 5788023 - DNA, 17 bp, Homo sapiens
taggcagcttctaagag

SEQ ID NO: 5788024 - DNA, 17 bp, Homo sapiens
taggcaggaacatacag

SEQ ID NO: 5788025 - DNA, 18 bp, Homo sapiens
taggcaggaacatacaga

SEQ ID NO: 5788026 - DNA, 19 bp, Homo sapiens
taggcaggaacatacagac

SEQ ID NO: 5788027 - DNA, 17 bp, Homo sapiens
taggcaggaagtcagga

SEQ ID NO: 5788028 - DNA, 16 bp, Homo sapiens
taggcaggacatgctg

SEQ ID NO: 5788029 - DNA, 12 bp, Homo sapiens
taggcaggacca

SEQ ID NO: 5788030 - DNA, 18 bp, Homo sapiens
taggcagggagggggctg

SEQ ID NO: 5788031 - DNA, 17 bp, Homo sapiens
taggcagggggccctgc

SEQ ID NO: 5788032 - DNA, 17 bp, Homo sapiens
taggcagggtgtctgcc

SEQ ID NO: 5788033 - DNA, 20 bp, Homo sapiens
taggcagggtgtctgccccc

SEQ ID NO: 5788034 - DNA, 18 bp, Homo sapiens
taggcaggtggagagagt

SEQ ID NO: 5788035 - DNA, 20 bp, Homo sapiens
taggcagtaggccggtgtgc

SEQ ID NO: 5788036 - DNA, 19 bp, Homo sapiens
taggcagtataaagaatag

SEQ ID NO: 5788037 - DNA, 18 bp, Homo sapiens
taggcagttagagatgcc

SEQ ID NO: 5788038 - DNA, 24 bp, Homo sapiens
taggcagttagagatgcctccctg

SEQ ID NO: 5788039 - DNA, 18 bp, Homo sapiens
taggcatactctccagga

SEQ ID NO: 5788040 - DNA, 17 bp, Homo sapiens
taggcatacttttcaaa

SEQ ID NO: 5788041 - DNA, 18 bp, Homo sapiens
taggcatacttttcaaag

SEQ ID NO: 5788042 - DNA, 16 bp, Homo sapiens
taggcatatgcttctt

SEQ ID NO: 5788043 - DNA, 19 bp, Homo sapiens
taggcatcccaggggacca

SEQ ID NO: 5788044 - DNA, 18 bp, Homo sapiens
taggcatctcctctcccc

SEQ ID NO: 5788045 - DNA, 12 bp, Homo sapiens
taggcatgtgca

SEQ ID NO: 5788046 - DNA, 15 bp, Homo sapiens
taggcatgttatgtt

SEQ ID NO: 5788047 - DNA, 16 bp, Homo sapiens
taggcattaacacaaa

SEQ ID NO: 5788048 - DNA, 18 bp, Homo sapiens
taggcattaacacaaagg

SEQ ID NO: 5788049 - DNA, 17 bp, Homo sapiens
taggcattatttaatgt

SEQ ID NO: 5788050 - DNA, 17 bp, Homo sapiens
taggcattgcaggacct

SEQ ID NO: 5788051 - DNA, 20 bp, Homo sapiens
taggcatttcattatgcttt

SEQ ID NO: 5788052 - DNA, 12 bp, Homo sapiens
taggcatttcct

SEQ ID NO: 5788053 - DNA, 17 bp, Homo sapiens
taggcatttcctgctga

SEQ ID NO: 5788054 - DNA, 12 bp, Homo sapiens
taggcatttgta

SEQ ID NO: 5788055 - DNA, 19 bp, Homo sapiens
taggcatttttaccatcac

SEQ ID NO: 5788056 - DNA, 15 bp, Homo sapiens
taggccaaagacaaa

SEQ ID NO: 5788057 - DNA, 18 bp, Homo sapiens
taggccaaagacaaatag

SEQ ID NO: 5788058 - DNA, 23 bp, Homo sapiens
taggccaaggtgtcctacagaaa

SEQ ID NO: 5788059 - DNA, 21 bp, Homo sapiens
taggccacattgacagtggtg

SEQ ID NO: 5788060 - DNA, 22 bp, Homo sapiens
taggccaccattataatttata

SEQ ID NO: 5788061 - DNA, 23 bp, Homo sapiens
taggccagagccatgccaggctg

SEQ ID NO: 5788062 - DNA, 12 bp, Homo sapiens
taggccaggcct

SEQ ID NO: 5788063 - DNA, 14 bp, Homo sapiens
taggccaggcctta

SEQ ID NO: 5788064 - DNA, 23 bp, Homo sapiens
taggccaggccttatctgaaagg

SEQ ID NO: 5788065 - DNA, 15 bp, Homo sapiens
taggccatttgtatt

SEQ ID NO: 5788066 - DNA, 16 bp, Homo sapiens
taggccatttgtattt

SEQ ID NO: 5788067 - DNA, 14 bp, Homo sapiens
taggcccacacaca

SEQ ID NO: 5788068 - DNA, 23 bp, Homo sapiens
taggcccagacccagcccagcct

SEQ ID NO: 5788069 - DNA, 13 bp, Homo sapiens
taggcccaggcct

SEQ ID NO: 5788070 - DNA, 20 bp, Homo sapiens
taggcccattgtcctccttt

SEQ ID NO: 5788071 - DNA, 13 bp, Homo sapiens
taggccccagagg

SEQ ID NO: 5788072 - DNA, 16 bp, Homo sapiens
taggccccagaggccc

SEQ ID NO: 5788073 - DNA, 19 bp, Homo sapiens
taggccccagaggccctgg

SEQ ID NO: 5788074 - DNA, 23 bp, Homo sapiens
taggcccccaaattgccttcagc

SEQ ID NO: 5788075 - DNA, 14 bp, Homo sapiens
taggcccccacttg

SEQ ID NO: 5788076 - DNA, 21 bp, Homo sapiens
taggccccccagaaagctgcc

SEQ ID NO: 5788077 - DNA, 15 bp, Homo sapiens
taggcccctggggct

SEQ ID NO: 5788078 - DNA, 20 bp, Homo sapiens
taggcccgggcccctggcac

SEQ ID NO: 5788079 - DNA, 23 bp, Homo sapiens
taggccctggatgtgcccacagg

SEQ ID NO: 5788080 - DNA, 18 bp, Homo sapiens
taggccctggttcctgct

SEQ ID NO: 5788081 - DNA, 18 bp, Homo sapiens
taggcccttggggtggcg

SEQ ID NO: 5788082 - DNA, 13 bp, Homo sapiens
taggcccttgtcc

SEQ ID NO: 5788083 - DNA, 15 bp, Homo sapiens
taggcccttgtcctg

SEQ ID NO: 5788084 - DNA, 15 bp, Homo sapiens
taggccctttcagtg

SEQ ID NO: 5788085 - DNA, 17 bp, Homo sapiens
taggccgctgatgatat

SEQ ID NO: 5788086 - DNA, 14 bp, Homo sapiens
taggccgggcacag

SEQ ID NO: 5788087 - DNA, 23 bp, Homo sapiens
taggcctataaaattaaatgcct

SEQ ID NO: 5788088 - DNA, 12 bp, Homo sapiens
taggcctatcaa

SEQ ID NO: 5788089 - DNA, 20 bp, Homo sapiens
taggcctcaactcctcccat

SEQ ID NO: 5788090 - DNA, 16 bp, Homo sapiens
taggcctcagccagag

SEQ ID NO: 5788091 - DNA, 19 bp, Homo sapiens
taggcctcaggtgaaactc

SEQ ID NO: 5788092 - DNA, 15 bp, Homo sapiens
taggcctcatttctt

SEQ ID NO: 5788093 - DNA, 22 bp, Homo sapiens
taggcctctcacctctgtgcct

SEQ ID NO: 5788094 - DNA, 21 bp, Homo sapiens
taggcctgaaatgacatttca

SEQ ID NO: 5788095 - DNA, 20 bp, Homo sapiens
taggcctgagttagctgttt

SEQ ID NO: 5788096 - DNA, 11 bp, Homo sapiens
taggcctggag

SEQ ID NO: 5788097 - DNA, 17 bp, Homo sapiens
taggcctggcacagtgt

SEQ ID NO: 5788098 - DNA, 22 bp, Homo sapiens
taggcctggctcattctgcacc

SEQ ID NO: 5788099 - DNA, 16 bp, Homo sapiens
taggcctgggtgctgg

SEQ ID NO: 5788100 - DNA, 19 bp, Homo sapiens
taggcctgggtgctggctg

SEQ ID NO: 5788101 - DNA, 17 bp, Homo sapiens
taggcctgtcccttgcc

SEQ ID NO: 5788102 - DNA, 20 bp, Homo sapiens
taggccttaacacactggcc

SEQ ID NO: 5788103 - DNA, 16 bp, Homo sapiens
taggccttcttgtgat

SEQ ID NO: 5788104 - DNA, 24 bp, Homo sapiens
taggccttgcggctcctcagggac

SEQ ID NO: 5788105 - DNA, 14 bp, Homo sapiens
taggcctttcctct

SEQ ID NO: 5788106 - DNA, 22 bp, Homo sapiens
taggcctttcctctgcacgctc

SEQ ID NO: 5788107 - DNA, 14 bp, Homo sapiens
taggcgctcagagg

SEQ ID NO: 5788108 - DNA, 14 bp, Homo sapiens
taggcgggatgggc

SEQ ID NO: 5788109 - DNA, 19 bp, Homo sapiens
taggcggggcttgccttct

SEQ ID NO: 5788110 - DNA, 17 bp, Homo sapiens
taggcggtcatgtgtgc

SEQ ID NO: 5788111 - DNA, 15 bp, Homo sapiens
taggctaaaaacatt

SEQ ID NO: 5788112 - DNA, 15 bp, Homo sapiens
taggctaaaaggctt

SEQ ID NO: 5788113 - DNA, 19 bp, Homo sapiens
taggctaaaaggcttccag

SEQ ID NO: 5788114 - DNA, 21 bp, Homo sapiens
taggctaaaaggcttccaggc

SEQ ID NO: 5788115 - DNA, 13 bp, Homo sapiens
taggctaaatgtt

SEQ ID NO: 5788116 - DNA, 20 bp, Homo sapiens
taggctacaattttctccca

SEQ ID NO: 5788117 - DNA, 12 bp, Homo sapiens
taggctacagag

SEQ ID NO: 5788118 - DNA, 13 bp, Homo sapiens
taggctacagaga

SEQ ID NO: 5788119 - DNA, 16 bp, Homo sapiens
taggctacagagaagc

SEQ ID NO: 5788120 - DNA, 17 bp, Homo sapiens
taggctacagagaagcc

SEQ ID NO: 5788121 - DNA, 22 bp, Homo sapiens
taggctagacttagattcatta

SEQ ID NO: 5788122 - DNA, 15 bp, Homo sapiens
taggctagagacaga

SEQ ID NO: 5788123 - DNA, 18 bp, Homo sapiens
taggctagagacagatgc

SEQ ID NO: 5788124 - DNA, 24 bp, Homo sapiens
taggctagagacagatgctggtgg

SEQ ID NO: 5788125 - DNA, 21 bp, Homo sapiens
tagtatgatttttacaataat

SEQ ID NO: 5788126 - DNA, 22 bp, Homo sapiens
tagtatgctctgagtagcttta

SEQ ID NO: 5788127 - DNA, 24 bp, Homo sapiens
tagtatgctggcttgtacatagta

SEQ ID NO: 5788128 - DNA, 17 bp, Homo sapiens
tagtatgctgtatgaat

SEQ ID NO: 5788129 - DNA, 21 bp, Homo sapiens
tagtatggcctgacagctctg

SEQ ID NO: 5788130 - DNA, 20 bp, Homo sapiens
tagtatgggaaaaaaactga

SEQ ID NO: 5788131 - DNA, 15 bp, Homo sapiens
tagtatggttctcag

SEQ ID NO: 5788132 - DNA, 14 bp, Homo sapiens
tagtatgtctgttt

SEQ ID NO: 5788133 - DNA, 20 bp, Homo sapiens
tagtatgtctgtttttgtat

SEQ ID NO: 5788134 - DNA, 13 bp, Homo sapiens
tagtatgtgactt

SEQ ID NO: 5788135 - DNA, 15 bp, Homo sapiens
tagtatgtgactttt

SEQ ID NO: 5788136 - DNA, 23 bp, Homo sapiens
tagtatgtgcatttaattagaaa

SEQ ID NO: 5788137 - DNA, 13 bp, Homo sapiens
tagtattaaaatc

SEQ ID NO: 5788138 - DNA, 14 bp, Homo sapiens
tagtattaactatt

SEQ ID NO: 5788139 - DNA, 20 bp, Homo sapiens
tagtattaatactacccata

SEQ ID NO: 5788140 - DNA, 18 bp, Homo sapiens
tagtattaatggacaaat

SEQ ID NO: 5788141 - DNA, 22 bp, Homo sapiens
tagtattaccaccctttcacaa

SEQ ID NO: 5788142 - DNA, 14 bp, Homo sapiens
tagtattatgtcac

SEQ ID NO: 5788143 - DNA, 19 bp, Homo sapiens
tagtattcaggcactgaga

SEQ ID NO: 5788144 - DNA, 17 bp, Homo sapiens
tagtattcattctgcat

SEQ ID NO: 5788145 - DNA, 21 bp, Homo sapiens
tagtattcctaacctgtcaga

SEQ ID NO: 5788146 - DNA, 19 bp, Homo sapiens
tagtattctcttgtgcatt

SEQ ID NO: 5788147 - DNA, 21 bp, Homo sapiens
tagtattgacaaaatgttatt

SEQ ID NO: 5788148 - DNA, 22 bp, Homo sapiens
tagtattggagcacatgttact

SEQ ID NO: 5788149 - DNA, 17 bp, Homo sapiens
tagtattgtccaggtct

SEQ ID NO: 5788150 - DNA, 18 bp, Homo sapiens
tagtatttaactacatct

SEQ ID NO: 5788151 - DNA, 20 bp, Homo sapiens
tagtatttaactacatctgc

SEQ ID NO: 5788152 - DNA, 22 bp, Homo sapiens
tagtatttaactacatctgcct

SEQ ID NO: 5788153 - DNA, 19 bp, Homo sapiens
tagtatttagtatatgaaa

SEQ ID NO: 5788154 - DNA, 14 bp, Homo sapiens
tagtatttatattt

SEQ ID NO: 5788155 - DNA, 20 bp, Homo sapiens
tagtatttatgggtggattt

SEQ ID NO: 5788156 - DNA, 16 bp, Homo sapiens
tagtatttctatgaaa

SEQ ID NO: 5788157 - DNA, 18 bp, Homo sapiens
tagtatttctcctttgca

SEQ ID NO: 5788158 - DNA, 14 bp, Homo sapiens
tagtatttgaaaac

SEQ ID NO: 5788159 - DNA, 12 bp, Homo sapiens
tagtatttgatt

SEQ ID NO: 5788160 - DNA, 17 bp, Homo sapiens
tagtatttgattcaaaa

SEQ ID NO: 5788161 - DNA, 23 bp, Homo sapiens
tagtatttgattcaaaatattta

SEQ ID NO: 5788162 - DNA, 9 bp, Homo sapiens
tagtatttt

SEQ ID NO: 5788163 - DNA, 17 bp, Homo sapiens
tagtattttaatcctgt

SEQ ID NO: 5788164 - DNA, 12 bp, Homo sapiens
tagtattttgag

SEQ ID NO: 5788165 - DNA, 18 bp, Homo sapiens
tagtattttttgtataat

SEQ ID NO: 5788166 - DNA, 22 bp, Homo sapiens
tagtatttttttcttaccaaaa

SEQ ID NO: 5788167 - DNA, 19 bp, Homo sapiens
tagtcaaaaacaaagctga

SEQ ID NO: 5788168 - DNA, 16 bp, Homo sapiens
tagtcaaattatgtat

SEQ ID NO: 5788169 - DNA, 13 bp, Homo sapiens
tagtcaaattgtg

SEQ ID NO: 5788170 - DNA, 18 bp, Homo sapiens
tagtcaactgctgtttta

SEQ ID NO: 5788171 - DNA, 16 bp, Homo sapiens
tagtcaactggggaaa

SEQ ID NO: 5788172 - DNA, 20 bp, Homo sapiens
tagtcaactggggaaaagga

SEQ ID NO: 5788173 - DNA, 23 bp, Homo sapiens
tagtcaagaaaaattattgtata

SEQ ID NO: 5788174 - DNA, 19 bp, Homo sapiens
tagtcaagacgaacatgta

SEQ ID NO: 5788175 - DNA, 21 bp, Homo sapiens
tagtcaagaggtttttctccc

SEQ ID NO: 5788176 - DNA, 14 bp, Homo sapiens
tagtcaagctcctc

SEQ ID NO: 5788177 - DNA, 15 bp, Homo sapiens
tagtcaagctcctcc

SEQ ID NO: 5788178 - DNA, 16 bp, Homo sapiens
tagtcaaggactggta

SEQ ID NO: 5788179 - DNA, 15 bp, Homo sapiens
tagtcaataaaatga

SEQ ID NO: 5788180 - DNA, 19 bp, Homo sapiens
tagtcaataactctgattt

SEQ ID NO: 5788181 - DNA, 19 bp, Homo sapiens
tagtcaatcaagtctgttt

SEQ ID NO: 5788182 - DNA, 14 bp, Homo sapiens
tagtcaatcactgc

SEQ ID NO: 5788183 - DNA, 24 bp, Homo sapiens
tagtcaatcactgcactgcatgca

SEQ ID NO: 5788184 - DNA, 18 bp, Homo sapiens
tagtcaatggcttgttca

SEQ ID NO: 5788185 - DNA, 16 bp, Homo sapiens
tagtcaattagtacag

SEQ ID NO: 5788186 - DNA, 21 bp, Homo sapiens
tagtcacctaaccctctgtca

SEQ ID NO: 5788187 - DNA, 22 bp, Homo sapiens
tagtcaccttttaaatcctgtt

SEQ ID NO: 5788188 - DNA, 17 bp, Homo sapiens
tagtcactggaaattga

SEQ ID NO: 5788189 - DNA, 16 bp, Homo sapiens
tagtcacttaaaatgt

SEQ ID NO: 5788190 - DNA, 20 bp, Homo sapiens
tagtcactttttttttccaa

SEQ ID NO: 5788191 - DNA, 19 bp, Homo sapiens
tagtcagaagcaggttctt

SEQ ID NO: 5788192 - DNA, 22 bp, Homo sapiens
tagtcagaagcaggttcttgat

SEQ ID NO: 5788193 - DNA, 13 bp, Homo sapiens
tagtcagctgcct

SEQ ID NO: 5788194 - DNA, 16 bp, Homo sapiens
tagtcagctgcctttt

SEQ ID NO: 5788195 - DNA, 20 bp, Homo sapiens
tagtcaggagagtgcagatc

SEQ ID NO: 5788196 - DNA, 14 bp, Homo sapiens
tagtcaggtgctca

SEQ ID NO: 5788197 - DNA, 21 bp, Homo sapiens
tagtcagtaaacatttgtaaa

SEQ ID NO: 5788198 - DNA, 11 bp, Homo sapiens
tagtcataata

SEQ ID NO: 5788199 - DNA, 22 bp, Homo sapiens
tagtcatagaaatacctcattc

SEQ ID NO: 5788200 - DNA, 19 bp, Homo sapiens
tagtcatcagatatgctta

SEQ ID NO: 5788201 - DNA, 18 bp, Homo sapiens
tagtcatccaacaagaag

SEQ ID NO: 5788202 - DNA, 23 bp, Homo sapiens
tagtcatccaacaagaagaaata

SEQ ID NO: 5788203 - DNA, 17 bp, Homo sapiens
tagtcatgctgtgcatt

SEQ ID NO: 5788204 - DNA, 19 bp, Homo sapiens
tagtcatgctgtgcatttt

SEQ ID NO: 5788205 - DNA, 20 bp, Homo sapiens
tagtcatggggtccctgctg

SEQ ID NO: 5788206 - DNA, 18 bp, Homo sapiens
tagtcattccaaatatga

SEQ ID NO: 5788207 - DNA, 19 bp, Homo sapiens
tagtcattctgcctgccct

SEQ ID NO: 5788208 - DNA, 14 bp, Homo sapiens
tagtcattcttccc

SEQ ID NO: 5788209 - DNA, 18 bp, Homo sapiens
tagtcattgatagaacta

SEQ ID NO: 5788210 - DNA, 20 bp, Homo sapiens
tagtcatttaggatccatgc

SEQ ID NO: 5788211 - DNA, 15 bp, Homo sapiens
tagtcatttgttaat

SEQ ID NO: 5788212 - DNA, 14 bp, Homo sapiens
tagtcatttttagc

SEQ ID NO: 5788213 - DNA, 21 bp, Homo sapiens
tagtccaaaaagctcctgggg

SEQ ID NO: 5788214 - DNA, 22 bp, Homo sapiens
tagtccaaattatttttacgta

SEQ ID NO: 5788215 - DNA, 13 bp, Homo sapiens
tagtccaatattt

SEQ ID NO: 5788216 - DNA, 12 bp, Homo sapiens
tagtccaatgaa

SEQ ID NO: 5788217 - DNA, 22 bp, Homo sapiens
tagtccaatgtctttttaagct

SEQ ID NO: 5788218 - DNA, 18 bp, Homo sapiens
tagtccaatttttactca

SEQ ID NO: 5788219 - DNA, 11 bp, Homo sapiens
tagtccacaag

SEQ ID NO: 5788220 - DNA, 19 bp, Homo sapiens
tagtccacggacccccaga

SEQ ID NO: 5788221 - DNA, 23 bp, Homo sapiens
tagtccagctttgttcttcttaa

SEQ ID NO: 5788222 - DNA, 13 bp, Homo sapiens
tagtccaggctgt

SEQ ID NO: 5788223 - DNA, 19 bp, Homo sapiens
tagtccatcaccatttctt

SEQ ID NO: 5788224 - DNA, 22 bp, Homo sapiens
tagtcccaccctatggccactg

SEQ ID NO: 5788225 - DNA, 15 bp, Homo sapiens
tagtcccagcacttt

SEQ ID NO: 5788226 - DNA, 21 bp, Homo sapiens
tagtcccagctactcagaagc

SEQ ID NO: 5788227 - DNA, 20 bp, Homo sapiens
tagtcccagctactcaggag

SEQ ID NO: 5788228 - DNA, 16 bp, Homo sapiens
tagtccccaaggcctc

SEQ ID NO: 5788229 - DNA, 18 bp, Homo sapiens
tagtccccaaggcctctc

SEQ ID NO: 5788230 - DNA, 21 bp, Homo sapiens
tagtccccaaggcctctctct

SEQ ID NO: 5788231 - DNA, 18 bp, Homo sapiens
tagtccccagagctcccc

SEQ ID NO: 5788232 - DNA, 18 bp, Homo sapiens
tagtcccggaggccttcc

SEQ ID NO: 5788233 - DNA, 12 bp, Homo sapiens
tagtcccttcca

SEQ ID NO: 5788234 - DNA, 17 bp, Homo sapiens
tagtcccttccacaccc

SEQ ID NO: 5788235 - DNA, 15 bp, Homo sapiens
tagtcccttcccctc

SEQ ID NO: 5788236 - DNA, 14 bp, Homo sapiens
tagtccgctgaaga

SEQ ID NO: 5788237 - DNA, 23 bp, Homo sapiens
tagtccgggggacttggggctga

SEQ ID NO: 5788238 - DNA, 15 bp, Homo sapiens
tagtccgtcctggca

SEQ ID NO: 5788239 - DNA, 21 bp, Homo sapiens
tagtccgtgctgacagctgct

SEQ ID NO: 5788240 - DNA, 23 bp, Homo sapiens
tagtccgtgctgacagctgctcc

SEQ ID NO: 5788241 - DNA, 15 bp, Homo sapiens
tagtcctagtgaacc

SEQ ID NO: 5788242 - DNA, 16 bp, Homo sapiens
tagtcctagtgaacct

SEQ ID NO: 5788243 - DNA, 20 bp, Homo sapiens
tagtcctcccaagctgtgct

SEQ ID NO: 5788244 - DNA, 21 bp, Homo sapiens
tagtcctcccaagctgtgctg

SEQ ID NO: 5788245 - DNA, 15 bp, Homo sapiens
tagtcctccctgctc

SEQ ID NO: 5788246 - DNA, 16 bp, Homo sapiens
tagtcctccctgctca

SEQ ID NO: 5788247 - DNA, 19 bp, Homo sapiens
tagtcctgtctcccacttc

SEQ ID NO: 5788248 - DNA, 12 bp, Homo sapiens
tagtcctgtgaa

SEQ ID NO: 5788249 - DNA, 10 bp, Homo sapiens
tagtccttgg

SEQ ID NO: 5788250 - DNA, 14 bp, Homo sapiens
tagtccttggcata

SEQ ID NO: 5788251 - DNA, 15 bp, Homo sapiens
tagtcctttctgcct

SEQ ID NO: 5788252 - DNA, 16 bp, Homo sapiens
tagtcctttctgcctt

SEQ ID NO: 5788253 - DNA, 19 bp, Homo sapiens
tagtcctttctgtgaagct

SEQ ID NO: 5788254 - DNA, 18 bp, Homo sapiens
tagtccttttatctcctt

SEQ ID NO: 5788255 - DNA, 18 bp, Homo sapiens
tagtccttttgggaagaa

SEQ ID NO: 5788256 - DNA, 17 bp, Homo sapiens
tagtcgcccctcagagc

SEQ ID NO: 5788257 - DNA, 18 bp, Homo sapiens
tagtcgggcagggcccct

SEQ ID NO: 5788258 - DNA, 17 bp, Homo sapiens
tagtcgggcatgagtct

SEQ ID NO: 5788259 - DNA, 14 bp, Homo sapiens
tagtcgtgaatctt

SEQ ID NO: 5788260 - DNA, 21 bp, Homo sapiens
tagtcgtggagatgtcttcgt

SEQ ID NO: 5788261 - DNA, 13 bp, Homo sapiens
tagtctaacacag

SEQ ID NO: 5788262 - DNA, 20 bp, Homo sapiens
tagtctaagatgattcaaag

SEQ ID NO: 5788263 - DNA, 19 bp, Homo sapiens
tagtctacttcttaaaatt

SEQ ID NO: 5788264 - DNA, 17 bp, Homo sapiens
tagtctagcattctgca

SEQ ID NO: 5788265 - DNA, 13 bp, Homo sapiens
tagtctagtgtag

SEQ ID NO: 5788266 - DNA, 12 bp, Homo sapiens
tagtctagtttc

SEQ ID NO: 5788267 - DNA, 14 bp, Homo sapiens
tagtctattagcca

SEQ ID NO: 5788268 - DNA, 12 bp, Homo sapiens
tagtctcaggac

SEQ ID NO: 5788269 - DNA, 11 bp, Homo sapiens
tagtctcagtt

SEQ ID NO: 5788270 - DNA, 14 bp, Homo sapiens
tagtctcattgcca

SEQ ID NO: 5788271 - DNA, 16 bp, Homo sapiens
tagtctcattgccaag

SEQ ID NO: 5788272 - DNA, 17 bp, Homo sapiens
tagtctctgtgctttga

SEQ ID NO: 5788273 - DNA, 21 bp, Homo sapiens
tagtctcttgtattaaactct

SEQ ID NO: 5788274 - DNA, 18 bp, Homo sapiens
tagtctctttattcctag

SEQ ID NO: 5788275 - DNA, 15 bp, Homo sapiens
tagtctgaaactggc

SEQ ID NO: 5788276 - DNA, 14 bp, Homo sapiens
tagtctgaagtctg

SEQ ID NO: 5788277 - DNA, 20 bp, Homo sapiens
tagtctgaggccccttaact

SEQ ID NO: 5788278 - DNA, 19 bp, Homo sapiens
tagtctgattttaatgaaa

SEQ ID NO: 5788279 - DNA, 23 bp, Homo sapiens
tagtctgcaaaatgaggaatgta

SEQ ID NO: 5788280 - DNA, 12 bp, Homo sapiens
tagtctggaaag

SEQ ID NO: 5788281 - DNA, 12 bp, Homo sapiens
tagtctgggtca

SEQ ID NO: 5788282 - DNA, 22 bp, Homo sapiens
tagtctgtatccaaataatgaa

SEQ ID NO: 5788283 - DNA, 18 bp, Homo sapiens
tagtctgtcagggccttg

SEQ ID NO: 5788284 - DNA, 12 bp, Homo sapiens
tagtctgtcatc

SEQ ID NO: 5788285 - DNA, 13 bp, Homo sapiens
tagtctgtgtaac

SEQ ID NO: 5788286 - DNA, 18 bp, Homo sapiens
tagtctgtgtgaaggtga

SEQ ID NO: 5788287 - DNA, 17 bp, Homo sapiens
tagtctgtgtgcacaat

SEQ ID NO: 5788288 - DNA, 14 bp, Homo sapiens
tagtctgtttcatt

SEQ ID NO: 5788289 - DNA, 17 bp, Homo sapiens
tagtcttaagaactgct

SEQ ID NO: 5788290 - DNA, 13 bp, Homo sapiens
tagtcttacctaa

SEQ ID NO: 5788291 - DNA, 15 bp, Homo sapiens
tagtcttatgaatag

SEQ ID NO: 5788292 - DNA, 16 bp, Homo sapiens
tagtcttatgtaaagt

SEQ ID NO: 5788293 - DNA, 15 bp, Homo sapiens
tagtcttcaagcaga

SEQ ID NO: 5788294 - DNA, 14 bp, Homo sapiens
tagtcttcagtttc

SEQ ID NO: 5788295 - DNA, 22 bp, Homo sapiens
tagtcttctcaaattagaaagt

SEQ ID NO: 5788296 - DNA, 12 bp, Homo sapiens
tagtcttctcat

SEQ ID NO: 5788297 - DNA, 17 bp, Homo sapiens
tagtcttgacgaatatt

SEQ ID NO: 5788298 - DNA, 16 bp, Homo sapiens
tagtcttgctgtttct

SEQ ID NO: 5788299 - DNA, 17 bp, Homo sapiens
tagtcttgctgtttctt

SEQ ID NO: 5788300 - DNA, 22 bp, Homo sapiens
tagtcttgtctcagattttatt

SEQ ID NO: 5788301 - DNA, 18 bp, Homo sapiens
tagtctttagctattact

SEQ ID NO: 5788302 - DNA, 19 bp, Homo sapiens
tagtctttagctattactg

SEQ ID NO: 5788303 - DNA, 11 bp, Homo sapiens
tataaaaaaga

SEQ ID NO: 5788304 - DNA, 16 bp, Homo sapiens
tataaaaaagaaaact

SEQ ID NO: 5788305 - DNA, 22 bp, Homo sapiens
tataaaaaagaaaacttgtgtt

SEQ ID NO: 5788306 - DNA, 18 bp, Homo sapiens
tataaaaaaggtggtggt

SEQ ID NO: 5788307 - DNA, 13 bp, Homo sapiens
tataaaaaataag

SEQ ID NO: 5788308 - DNA, 21 bp, Homo sapiens
tataaaaaatatatgtaatat

SEQ ID NO: 5788309 - DNA, 22 bp, Homo sapiens
tataaaaaatcatgccagtatt

SEQ ID NO: 5788310 - DNA, 17 bp, Homo sapiens
tataaaaaatggtgcct

SEQ ID NO: 5788311 - DNA, 15 bp, Homo sapiens
tataaaaaatggttc

SEQ ID NO: 5788312 - DNA, 13 bp, Homo sapiens
tataaaaaatgta

SEQ ID NO: 5788313 - DNA, 21 bp, Homo sapiens
tataaaaaatgttattactga

SEQ ID NO: 5788314 - DNA, 13 bp, Homo sapiens
tataaaaacaaaa

SEQ ID NO: 5788315 - DNA, 15 bp, Homo sapiens
tataaaaacacttat

SEQ ID NO: 5788316 - DNA, 21 bp, Homo sapiens
tataaaaacatgagttattca

SEQ ID NO: 5788317 - DNA, 19 bp, Homo sapiens
tataaaaacattgaaatat

SEQ ID NO: 5788318 - DNA, 16 bp, Homo sapiens
tataaaaacatttgta

SEQ ID NO: 5788319 - DNA, 22 bp, Homo sapiens
tataaaaaccacccacaaagaa

SEQ ID NO: 5788320 - DNA, 22 bp, Homo sapiens
tataaaaacccctaaaaacaaa

SEQ ID NO: 5788321 - DNA, 23 bp, Homo sapiens
tataaaaacccctaaaaacaaaa

SEQ ID NO: 5788322 - DNA, 12 bp, Homo sapiens
tataaaaagcca

SEQ ID NO: 5788323 - DNA, 21 bp, Homo sapiens
tataaaaaggaaattagtctt

SEQ ID NO: 5788324 - DNA, 15 bp, Homo sapiens
tataaaaagtgaaat

SEQ ID NO: 5788325 - DNA, 11 bp, Homo sapiens
tataaaaataa

SEQ ID NO: 5788326 - DNA, 21 bp, Homo sapiens
tataaaaataaaaaacactgg

SEQ ID NO: 5788327 - DNA, 19 bp, Homo sapiens
tataaaaataaaaaagatc

SEQ ID NO: 5788328 - DNA, 13 bp, Homo sapiens
tataaaaatgtaa

SEQ ID NO: 5788329 - DNA, 21 bp, Homo sapiens
tataaaaattagccgggcttt

SEQ ID NO: 5788330 - DNA, 19 bp, Homo sapiens
tataaaaattatcaaaaag

SEQ ID NO: 5788331 - DNA, 21 bp, Homo sapiens
tataaaaattatcaaaaagct

SEQ ID NO: 5788332 - DNA, 10 bp, Homo sapiens
tataaaacaa

SEQ ID NO: 5788333 - DNA, 11 bp, Homo sapiens
tataaaacaaa

SEQ ID NO: 5788334 - DNA, 14 bp, Homo sapiens
tataaaactgaaat

SEQ ID NO: 5788335 - DNA, 19 bp, Homo sapiens
tataaaactgcgttaaagg

SEQ ID NO: 5788336 - DNA, 22 bp, Homo sapiens
tataaaactgcgttaaaggctc

SEQ ID NO: 5788337 - DNA, 14 bp, Homo sapiens
tataaaagaaacac

SEQ ID NO: 5788338 - DNA, 15 bp, Homo sapiens
tataaaagaaatata

SEQ ID NO: 5788339 - DNA, 14 bp, Homo sapiens
tataaaagactgac

SEQ ID NO: 5788340 - DNA, 18 bp, Homo sapiens
tataaaagactgtcttaa

SEQ ID NO: 5788341 - DNA, 15 bp, Homo sapiens
tataaaagatatata

SEQ ID NO: 5788342 - DNA, 20 bp, Homo sapiens
tataaaagcctgtttaagag

SEQ ID NO: 5788343 - DNA, 18 bp, Homo sapiens
tataaaagctatggtgag

SEQ ID NO: 5788344 - DNA, 18 bp, Homo sapiens
tataaaaggatgttacaa

SEQ ID NO: 5788345 - DNA, 22 bp, Homo sapiens
tataaaaggatgttacaagttt

SEQ ID NO: 5788346 - DNA, 19 bp, Homo sapiens
tataaaaggcaaatgtgta

SEQ ID NO: 5788347 - DNA, 22 bp, Homo sapiens
tataaaagggactgagaaattt

SEQ ID NO: 5788348 - DNA, 13 bp, Homo sapiens
tataaaagttgta

SEQ ID NO: 5788349 - DNA, 14 bp, Homo sapiens
tataaaagttgtac

SEQ ID NO: 5788350 - DNA, 15 bp, Homo sapiens
tataaaataaacttc

SEQ ID NO: 5788351 - DNA, 16 bp, Homo sapiens
tataaaataaacttct

SEQ ID NO: 5788352 - DNA, 13 bp, Homo sapiens
tataaaataaata

SEQ ID NO: 5788353 - DNA, 18 bp, Homo sapiens
tataaaataaatatacta

SEQ ID NO: 5788354 - DNA, 17 bp, Homo sapiens
tataaaataaatatata

SEQ ID NO: 5788355 - DNA, 21 bp, Homo sapiens
tataaaataaatatatataaa

SEQ ID NO: 5788356 - DNA, 22 bp, Homo sapiens
tataaaataaatatatataaac

SEQ ID NO: 5788357 - DNA, 15 bp, Homo sapiens
tataaaataactaaa

SEQ ID NO: 5788358 - DNA, 11 bp, Homo sapiens
tataaaataat

SEQ ID NO: 5788359 - DNA, 16 bp, Homo sapiens
tataaaataatgtact

SEQ ID NO: 5788360 - DNA, 21 bp, Homo sapiens
tataaaatacacgtgtatatg

SEQ ID NO: 5788361 - DNA, 18 bp, Homo sapiens
tataaaatacataaaaga

SEQ ID NO: 5788362 - DNA, 19 bp, Homo sapiens
tataaaatagttgtccata

SEQ ID NO: 5788363 - DNA, 18 bp, Homo sapiens
tataaaatataaacaaag

SEQ ID NO: 5788364 - DNA, 19 bp, Homo sapiens
tataaaatattcatatatt

SEQ ID NO: 5788365 - DNA, 16 bp, Homo sapiens
tataaaatcagccaat

SEQ ID NO: 5788366 - DNA, 19 bp, Homo sapiens
tataaaatcagccaattat

SEQ ID NO: 5788367 - DNA, 17 bp, Homo sapiens
tataaaatcctgtgcaa

SEQ ID NO: 5788368 - DNA, 17 bp, Homo sapiens
tataaaatctagatcaa

SEQ ID NO: 5788369 - DNA, 19 bp, Homo sapiens
tataaaatctagatcaatt

SEQ ID NO: 5788370 - DNA, 23 bp, Homo sapiens
tataaaatctgaattttgcaatg

SEQ ID NO: 5788371 - DNA, 14 bp, Homo sapiens
tataaaatctttcc

SEQ ID NO: 5788372 - DNA, 15 bp, Homo sapiens
tataaaatctttcca

SEQ ID NO: 5788373 - DNA, 13 bp, Homo sapiens
tataaaatgaggg

SEQ ID NO: 5788374 - DNA, 21 bp, Homo sapiens
tataaaatgcccatttcgaag

SEQ ID NO: 5788375 - DNA, 14 bp, Homo sapiens
tataaaatgggaag

SEQ ID NO: 5788376 - DNA, 15 bp, Homo sapiens
tataaaattaagcaa

SEQ ID NO: 5788377 - DNA, 20 bp, Homo sapiens
tataaaattatgagattggt

SEQ ID NO: 5788378 - DNA, 13 bp, Homo sapiens
tataaaattgaaa

SEQ ID NO: 5788379 - DNA, 14 bp, Homo sapiens
tataaaatttcagg

SEQ ID NO: 5788380 - DNA, 13 bp, Homo sapiens
tataaaatttctg

SEQ ID NO: 5788381 - DNA, 17 bp, Homo sapiens
tataaacaaacaaacaa

SEQ ID NO: 5788382 - DNA, 18 bp, Homo sapiens
tataaacaaacaaacaaa

SEQ ID NO: 5788383 - DNA, 19 bp, Homo sapiens
tataaacaaacaaacaaaa

SEQ ID NO: 5788384 - DNA, 21 bp, Homo sapiens
tataaacaaacaaacaaaaat

SEQ ID NO: 5788385 - DNA, 21 bp, Homo sapiens
tataaacaagaaaaataaaga

SEQ ID NO: 5788386 - DNA, 20 bp, Homo sapiens
tataaacagttttacttgtg

SEQ ID NO: 5788387 - DNA, 20 bp, Homo sapiens
tataaacataagttgcattt

SEQ ID NO: 5788388 - DNA, 21 bp, Homo sapiens
tataaacataagttgcattta

SEQ ID NO: 5788389 - DNA, 16 bp, Homo sapiens
tataaacatatgcaaa

SEQ ID NO: 5788390 - DNA, 20 bp, Homo sapiens
tataaacatatttttatact

SEQ ID NO: 5788391 - DNA, 21 bp, Homo sapiens
tataaacatatttttatactt

SEQ ID NO: 5788392 - DNA, 14 bp, Homo sapiens
tataaacatcacac

SEQ ID NO: 5788393 - DNA, 20 bp, Homo sapiens
tataaacatgaccctgggct

SEQ ID NO: 5788394 - DNA, 15 bp, Homo sapiens
tataaaccaatctta

SEQ ID NO: 5788395 - DNA, 19 bp, Homo sapiens
tataaaccacttgagccta

SEQ ID NO: 5788396 - DNA, 22 bp, Homo sapiens
tataaaccagcagcaggggaaa

SEQ ID NO: 5788397 - DNA, 15 bp, Homo sapiens
tataaaccataaaat

SEQ ID NO: 5788398 - DNA, 18 bp, Homo sapiens
tataaaccgaactgatgt

SEQ ID NO: 5788399 - DNA, 17 bp, Homo sapiens
tataaaccgtgtgtcat

SEQ ID NO: 5788400 - DNA, 15 bp, Homo sapiens
tataaacctaaaaaa

SEQ ID NO: 5788401 - DNA, 18 bp, Homo sapiens
tataaacctaaaaaagat

SEQ ID NO: 5788402 - DNA, 19 bp, Homo sapiens
tataaacctaaaaaagata

SEQ ID NO: 5788403 - DNA, 20 bp, Homo sapiens
tataaacctaaaaaagatat

SEQ ID NO: 5788404 - DNA, 19 bp, Homo sapiens
tataaacctctaatttatt

SEQ ID NO: 5788405 - DNA, 22 bp, Homo sapiens
tataaacctctaatttattttg

SEQ ID NO: 5788406 - DNA, 21 bp, Homo sapiens
tataaactaattttgtacgta

SEQ ID NO: 5788407 - DNA, 20 bp, Homo sapiens
tataaactaccaaattagtg

SEQ ID NO: 5788408 - DNA, 18 bp, Homo sapiens
tataaactgctgtcaata

SEQ ID NO: 5788409 - DNA, 17 bp, Homo sapiens
tataaactgggatgtaa

SEQ ID NO: 5788410 - DNA, 12 bp, Homo sapiens
tataaactgtag

SEQ ID NO: 5788411 - DNA, 18 bp, Homo sapiens
tataaactgtattttgaa

SEQ ID NO: 5788412 - DNA, 13 bp, Homo sapiens
tataaactgtgag

SEQ ID NO: 5788413 - DNA, 18 bp, Homo sapiens
tataaactgtgagataaa

SEQ ID NO: 5788414 - DNA, 17 bp, Homo sapiens
tataaacttaaaataaa

SEQ ID NO: 5788415 - DNA, 17 bp, Homo sapiens
tataaacttaaagctac

SEQ ID NO: 5788416 - DNA, 14 bp, Homo sapiens
tataaactttacct

SEQ ID NO: 5788417 - DNA, 17 bp, Homo sapiens
tataaactttacctttt

SEQ ID NO: 5788418 - DNA, 21 bp, Homo sapiens
tataaagaaactggtccatgt

SEQ ID NO: 5788419 - DNA, 18 bp, Homo sapiens
tataaagaaagattgtaa

SEQ ID NO: 5788420 - DNA, 20 bp, Homo sapiens
tataaagaaagattgtaaac

SEQ ID NO: 5788421 - DNA, 18 bp, Homo sapiens
tataaagaagaacttgca

SEQ ID NO: 5788422 - DNA, 19 bp, Homo sapiens
tataaagaaggataaattg

SEQ ID NO: 5788423 - DNA, 17 bp, Homo sapiens
tataaagaataggactt

SEQ ID NO: 5788424 - DNA, 12 bp, Homo sapiens
tataaagaatga

SEQ ID NO: 5788425 - DNA, 16 bp, Homo sapiens
tataaagaatgaaagt

SEQ ID NO: 5788426 - DNA, 23 bp, Homo sapiens
tataaagaatgaaagtagctgta

SEQ ID NO: 5788427 - DNA, 12 bp, Homo sapiens
tataaagaattc

SEQ ID NO: 5788428 - DNA, 21 bp, Homo sapiens
tataaagacgttttataagca

SEQ ID NO: 5788429 - DNA, 14 bp, Homo sapiens
tataaagagagata

SEQ ID NO: 5788430 - DNA, 15 bp, Homo sapiens
tataaagataaaata

SEQ ID NO: 5788431 - DNA, 14 bp, Homo sapiens
tataaagattgtac

SEQ ID NO: 5788432 - DNA, 24 bp, Homo sapiens
tataaagattgtacttagccagtt

SEQ ID NO: 5788433 - DNA, 19 bp, Homo sapiens
tataaagatttttgttaag

SEQ ID NO: 5788434 - DNA, 12 bp, Homo sapiens
tataaagcagta

SEQ ID NO: 5788435 - DNA, 15 bp, Homo sapiens
tataaagcagtagac

SEQ ID NO: 5788436 - DNA, 17 bp, Homo sapiens
tataaagcatctaaact

SEQ ID NO: 5788437 - DNA, 19 bp, Homo sapiens
tataaagcatctaaacttt

SEQ ID NO: 5788438 - DNA, 17 bp, Homo sapiens
tataaagctctcaaatg

SEQ ID NO: 5788439 - DNA, 12 bp, Homo sapiens
tataaagctgtt

SEQ ID NO: 5788440 - DNA, 16 bp, Homo sapiens
tataaagcttaaattt

SEQ ID NO: 5788441 - DNA, 17 bp, Homo sapiens
tataaagcttaaatttt

SEQ ID NO: 5788442 - DNA, 14 bp, Homo sapiens
tataaagcttaata

SEQ ID NO: 5788443 - DNA, 19 bp, Homo sapiens
tataaagggggagggaaat

SEQ ID NO: 5788444 - DNA, 12 bp, Homo sapiens
tataaagggtca

SEQ ID NO: 5788445 - DNA, 19 bp, Homo sapiens
tataaaggttatgaaacat

SEQ ID NO: 5788446 - DNA, 11 bp, Homo sapiens
tataaagtaac

SEQ ID NO: 5788447 - DNA, 18 bp, Homo sapiens
tataaagtagtcctgtga

SEQ ID NO: 5788448 - DNA, 19 bp, Homo sapiens
tataaagtatagagagaag

SEQ ID NO: 5788449 - DNA, 14 bp, Homo sapiens
tataaagtattctt

SEQ ID NO: 5788450 - DNA, 15 bp, Homo sapiens
tataaagtattcttt

SEQ ID NO: 5788451 - DNA, 15 bp, Homo sapiens
tataaagtcacttcc

SEQ ID NO: 5788452 - DNA, 20 bp, Homo sapiens
tataaagtctaagcaagatg

SEQ ID NO: 5788453 - DNA, 17 bp, Homo sapiens
tataaagtgcttgtgta

SEQ ID NO: 5788454 - DNA, 12 bp, Homo sapiens
tataaagtggac

SEQ ID NO: 5788455 - DNA, 20 bp, Homo sapiens
tataaagtgtttatgacaaa

SEQ ID NO: 5788456 - DNA, 13 bp, Homo sapiens
tataaagttatta

SEQ ID NO: 5788457 - DNA, 17 bp, Homo sapiens
tataaagttttatatat

SEQ ID NO: 5788458 - DNA, 14 bp, Homo sapiens
tataaataaaattg

SEQ ID NO: 5788459 - DNA, 15 bp, Homo sapiens
tataaataaatatat

SEQ ID NO: 5788460 - DNA, 14 bp, Homo sapiens
tataaataaatatt

SEQ ID NO: 5788461 - DNA, 12 bp, Homo sapiens
tataaataaatg

SEQ ID NO: 5788462 - DNA, 14 bp, Homo sapiens
tataaataaatgtt

SEQ ID NO: 5788463 - DNA, 21 bp, Homo sapiens
tataaataagagcatgatttg

SEQ ID NO: 5788464 - DNA, 18 bp, Homo sapiens
tataaatacaaatctgta

SEQ ID NO: 5788465 - DNA, 21 bp, Homo sapiens
tataaatacataaataaaaga

SEQ ID NO: 5788466 - DNA, 17 bp, Homo sapiens
tataaatacgtattaca

SEQ ID NO: 5788467 - DNA, 21 bp, Homo sapiens
tataaatactgacaatgtatt

SEQ ID NO: 5788468 - DNA, 13 bp, Homo sapiens
tataaatagcatt

SEQ ID NO: 5788469 - DNA, 18 bp, Homo sapiens
tataaatagctgaaaact

SEQ ID NO: 5788470 - DNA, 13 bp, Homo sapiens
tataaataggaga

SEQ ID NO: 5788471 - DNA, 21 bp, Homo sapiens
tataaatagtgtacacagact

SEQ ID NO: 5788472 - DNA, 15 bp, Homo sapiens
tataaatatacagta

SEQ ID NO: 5788473 - DNA, 19 bp, Homo sapiens
tataaatatatataaagaa

SEQ ID NO: 5788474 - DNA, 15 bp, Homo sapiens
tataaatatatattt

SEQ ID NO: 5788475 - DNA, 22 bp, Homo sapiens
tataaatatatgtatacatata

SEQ ID NO: 5788476 - DNA, 19 bp, Homo sapiens
tataaatatattattactt

SEQ ID NO: 5788477 - DNA, 18 bp, Homo sapiens
tataaatatatttaactt

SEQ ID NO: 5788478 - DNA, 17 bp, Homo sapiens
tataaatatattttctt

SEQ ID NO: 5788479 - DNA, 14 bp, Homo sapiens
tataaatatcacaa

SEQ ID NO: 5788480 - DNA, 15 bp, Homo sapiens
tataaatatcagtat

SEQ ID NO: 5788481 - DNA, 19 bp, Homo sapiens
tataaatatgtgaaaatga

SEQ ID NO: 5788482 - DNA, 18 bp, Homo sapiens
tataattacatatttgca

SEQ ID NO: 5788483 - DNA, 16 bp, Homo sapiens
tataattacttaatgt

SEQ ID NO: 5788484 - DNA, 20 bp, Homo sapiens
tataattagtcgggcatgag

SEQ ID NO: 5788485 - DNA, 19 bp, Homo sapiens
tataattatcggaagcagt

SEQ ID NO: 5788486 - DNA, 17 bp, Homo sapiens
tataattcagtctgctt

SEQ ID NO: 5788487 - DNA, 22 bp, Homo sapiens
tataattcctatatcctgtgac

SEQ ID NO: 5788488 - DNA, 17 bp, Homo sapiens
tataattctactttgag

SEQ ID NO: 5788489 - DNA, 16 bp, Homo sapiens
tataattctatactgt

SEQ ID NO: 5788490 - DNA, 17 bp, Homo sapiens
tataattctatactgtt

SEQ ID NO: 5788491 - DNA, 20 bp, Homo sapiens
tataattctatactgttgat

SEQ ID NO: 5788492 - DNA, 12 bp, Homo sapiens
tataattctgta

SEQ ID NO: 5788493 - DNA, 15 bp, Homo sapiens
tataattctgtaaat

SEQ ID NO: 5788494 - DNA, 14 bp, Homo sapiens
tataattctgtaca

SEQ ID NO: 5788495 - DNA, 20 bp, Homo sapiens
tataattctgtacatagcct

SEQ ID NO: 5788496 - DNA, 18 bp, Homo sapiens
tataattctgtactgatt

SEQ ID NO: 5788497 - DNA, 16 bp, Homo sapiens
tataattctttcaata

SEQ ID NO: 5788498 - DNA, 14 bp, Homo sapiens
tataattctttctt

SEQ ID NO: 5788499 - DNA, 17 bp, Homo sapiens
tataattgatgatgttg

SEQ ID NO: 5788500 - DNA, 17 bp, Homo sapiens
tataattgccaaaaagt

SEQ ID NO: 5788501 - DNA, 18 bp, Homo sapiens
tataattggatttcctaa

SEQ ID NO: 5788502 - DNA, 12 bp, Homo sapiens
tataattggctt

SEQ ID NO: 5788503 - DNA, 14 bp, Homo sapiens
tataattgggattt

SEQ ID NO: 5788504 - DNA, 12 bp, Homo sapiens
tataattgtatc

SEQ ID NO: 5788505 - DNA, 13 bp, Homo sapiens
tataattgtatcg

SEQ ID NO: 5788506 - DNA, 22 bp, Homo sapiens
tataattgtcatgactttcaga

SEQ ID NO: 5788507 - DNA, 20 bp, Homo sapiens
tataattgtgtgatatttca

SEQ ID NO: 5788508 - DNA, 22 bp, Homo sapiens
tataattgtgtgatatttcaga

SEQ ID NO: 5788509 - DNA, 12 bp, Homo sapiens
tataattgttat

SEQ ID NO: 5788510 - DNA, 20 bp, Homo sapiens
tataattgttccctatgaaa

SEQ ID NO: 5788511 - DNA, 21 bp, Homo sapiens
tataattgttctcagaatccc

SEQ ID NO: 5788512 - DNA, 16 bp, Homo sapiens
tataattgttttgcta

SEQ ID NO: 5788513 - DNA, 22 bp, Homo sapiens
tataattgttttttatcttttc

SEQ ID NO: 5788514 - DNA, 20 bp, Homo sapiens
tataatttaaacgtgatttt

SEQ ID NO: 5788515 - DNA, 22 bp, Homo sapiens
tataatttaacttcagagggaa

SEQ ID NO: 5788516 - DNA, 11 bp, Homo sapiens
tataatttaat

SEQ ID NO: 5788517 - DNA, 20 bp, Homo sapiens
tataatttaataaaaaggaa

SEQ ID NO: 5788518 - DNA, 16 bp, Homo sapiens
tataatttaatgcatg

SEQ ID NO: 5788519 - DNA, 19 bp, Homo sapiens
tataatttaatgtaaataa

SEQ ID NO: 5788520 - DNA, 20 bp, Homo sapiens
tataatttaatgtaaataaa

SEQ ID NO: 5788521 - DNA, 20 bp, Homo sapiens
tataatttacctaagattac

SEQ ID NO: 5788522 - DNA, 23 bp, Homo sapiens
tataatttacctctcattagaaa

SEQ ID NO: 5788523 - DNA, 18 bp, Homo sapiens
tataatttacctgaagtc

SEQ ID NO: 5788524 - DNA, 18 bp, Homo sapiens
tataatttactttgtaga

SEQ ID NO: 5788525 - DNA, 20 bp, Homo sapiens
tataatttactttgtagact

SEQ ID NO: 5788526 - DNA, 21 bp, Homo sapiens
tataatttagtcccttaaaaa

SEQ ID NO: 5788527 - DNA, 19 bp, Homo sapiens
tataatttatttccactaa

SEQ ID NO: 5788528 - DNA, 14 bp, Homo sapiens
tataatttcaattt

SEQ ID NO: 5788529 - DNA, 22 bp, Homo sapiens
tataatttcaatttttaaattt

SEQ ID NO: 5788530 - DNA, 18 bp, Homo sapiens
tataatttcacagataat

SEQ ID NO: 5788531 - DNA, 15 bp, Homo sapiens
tataatttccattta

SEQ ID NO: 5788532 - DNA, 16 bp, Homo sapiens
tataatttcgagattt

SEQ ID NO: 5788533 - DNA, 15 bp, Homo sapiens
tataatttctaccca

SEQ ID NO: 5788534 - DNA, 17 bp, Homo sapiens
tataatttgagtgtata

SEQ ID NO: 5788535 - DNA, 18 bp, Homo sapiens
tataattttaaaattgca

SEQ ID NO: 5788536 - DNA, 19 bp, Homo sapiens
tataattttaaagtaattt

SEQ ID NO: 5788537 - DNA, 14 bp, Homo sapiens
tataattttatctg

SEQ ID NO: 5788538 - DNA, 15 bp, Homo sapiens
tataattttatctgt

SEQ ID NO: 5788539 - DNA, 18 bp, Homo sapiens
tataattttatctgtata

SEQ ID NO: 5788540 - DNA, 22 bp, Homo sapiens
tataattttatgaatgtctttg

SEQ ID NO: 5788541 - DNA, 19 bp, Homo sapiens
tataattttattgctggaa

SEQ ID NO: 5788542 - DNA, 13 bp, Homo sapiens
tataattttctaa

SEQ ID NO: 5788543 - DNA, 22 bp, Homo sapiens
tataattttgaccataaattaa

SEQ ID NO: 5788544 - DNA, 13 bp, Homo sapiens
tataattttgcaa

SEQ ID NO: 5788545 - DNA, 17 bp, Homo sapiens
tataattttgcagcaga

SEQ ID NO: 5788546 - DNA, 20 bp, Homo sapiens
tataattttgcagcagaagc

SEQ ID NO: 5788547 - DNA, 19 bp, Homo sapiens
tataattttttgtaatgtg

SEQ ID NO: 5788548 - DNA, 21 bp, Homo sapiens
tataatttttttcaatattta

SEQ ID NO: 5788549 - DNA, 17 bp, Homo sapiens
tataatttttttcttgt

SEQ ID NO: 5788550 - DNA, 17 bp, Homo sapiens
tatacaaaactttatca

SEQ ID NO: 5788551 - DNA, 14 bp, Homo sapiens
tatacaaaagagca

SEQ ID NO: 5788552 - DNA, 15 bp, Homo sapiens
tatacaaaagagcat

SEQ ID NO: 5788553 - DNA, 21 bp, Homo sapiens
tatacaaaagagcatggatgc

SEQ ID NO: 5788554 - DNA, 18 bp, Homo sapiens
tatacaaaagcaagactt

SEQ ID NO: 5788555 - DNA, 16 bp, Homo sapiens
tatacaaacaggtgct

SEQ ID NO: 5788556 - DNA, 17 bp, Homo sapiens
tatacaaacaggtgcta

SEQ ID NO: 5788557 - DNA, 15 bp, Homo sapiens
tatacaaacatgtgg

SEQ ID NO: 5788558 - DNA, 22 bp, Homo sapiens
tatacaaacctaccaaaatgga

SEQ ID NO: 5788559 - DNA, 15 bp, Homo sapiens
tatacaaagaaactt

SEQ ID NO: 5788560 - DNA, 21 bp, Homo sapiens
tatacaaagctgtcactcaca

SEQ ID NO: 5788561 - DNA, 17 bp, Homo sapiens
tatacaaataaacttgt

SEQ ID NO: 5788562 - DNA, 16 bp, Homo sapiens
tatacaaatatattgt

SEQ ID NO: 5788563 - DNA, 20 bp, Homo sapiens
tatacaaatatattgttaat

SEQ ID NO: 5788564 - DNA, 17 bp, Homo sapiens
tatacaaattaaaaaga

SEQ ID NO: 5788565 - DNA, 18 bp, Homo sapiens
tatacaaattaaaaagat

SEQ ID NO: 5788566 - DNA, 17 bp, Homo sapiens
tatacaaattagaaaat

SEQ ID NO: 5788567 - DNA, 23 bp, Homo sapiens
tatacaaattttcagaaggttat

SEQ ID NO: 5788568 - DNA, 13 bp, Homo sapiens
tatacaacaatgt

SEQ ID NO: 5788569 - DNA, 13 bp, Homo sapiens
tatacaacaccaa

SEQ ID NO: 5788570 - DNA, 12 bp, Homo sapiens
tatacaacagtg

SEQ ID NO: 5788571 - DNA, 21 bp, Homo sapiens
tatacaaccctggcattatgt

SEQ ID NO: 5788572 - DNA, 22 bp, Homo sapiens
tatacaaccctggcattatgtc

SEQ ID NO: 5788573 - DNA, 17 bp, Homo sapiens
tatacaaccttcattta

SEQ ID NO: 5788574 - DNA, 15 bp, Homo sapiens
tatacaactgcctgg

SEQ ID NO: 5788575 - DNA, 13 bp, Homo sapiens
tatacaagataag

SEQ ID NO: 5788576 - DNA, 17 bp, Homo sapiens
tatacaagcaagcaaaa

SEQ ID NO: 5788577 - DNA, 15 bp, Homo sapiens
tatacaagtaaattc

SEQ ID NO: 5788578 - DNA, 16 bp, Homo sapiens
tatacaagtaaattct

SEQ ID NO: 5788579 - DNA, 15 bp, Homo sapiens
tatacaagtaatttc

SEQ ID NO: 5788580 - DNA, 13 bp, Homo sapiens
tatacaagtgttt

SEQ ID NO: 5788581 - DNA, 13 bp, Homo sapiens
tatacaatatata

SEQ ID NO: 5788582 - DNA, 14 bp, Homo sapiens
tatacaatatataa

SEQ ID NO: 5788583 - DNA, 15 bp, Homo sapiens
tatacaatatataaa

SEQ ID NO: 5788584 - DNA, 19 bp, Homo sapiens
tatacaatatataaaaata

SEQ ID NO: 5788585 - DNA, 19 bp, Homo sapiens
tatacaatatatattttgt

SEQ ID NO: 5788586 - DNA, 16 bp, Homo sapiens
tatacaatgttctgtt

SEQ ID NO: 5788587 - DNA, 18 bp, Homo sapiens
tatacaatttctattatt

SEQ ID NO: 5788588 - DNA, 23 bp, Homo sapiens
tatacaatttctattatttttca

SEQ ID NO: 5788589 - DNA, 15 bp, Homo sapiens
tatacacaaagatat

SEQ ID NO: 5788590 - DNA, 18 bp, Homo sapiens
tatacacaagcaatgcaa

SEQ ID NO: 5788591 - DNA, 20 bp, Homo sapiens
tatacacacacaaagagagt

SEQ ID NO: 5788592 - DNA, 13 bp, Homo sapiens
tatacacacacac

SEQ ID NO: 5788593 - DNA, 18 bp, Homo sapiens
tatacacacatatacata

SEQ ID NO: 5788594 - DNA, 21 bp, Homo sapiens
tatacacacatatacatatat

SEQ ID NO: 5788595 - DNA, 14 bp, Homo sapiens
tatacacaccctgc

SEQ ID NO: 5788596 - DNA, 17 bp, Homo sapiens
tatacacataagcataa

SEQ ID NO: 5788597 - DNA, 12 bp, Homo sapiens
tatacacataca

SEQ ID NO: 5788598 - DNA, 14 bp, Homo sapiens
tatacacatacata

SEQ ID NO: 5788599 - DNA, 16 bp, Homo sapiens
tatacacatacataca

SEQ ID NO: 5788600 - DNA, 21 bp, Homo sapiens
tatacacatacatacacatac

SEQ ID NO: 5788601 - DNA, 15 bp, Homo sapiens
tatacacatatacct

SEQ ID NO: 5788602 - DNA, 17 bp, Homo sapiens
tatacacatatacctat

SEQ ID NO: 5788603 - DNA, 16 bp, Homo sapiens
tatacacatcataaac

SEQ ID NO: 5788604 - DNA, 20 bp, Homo sapiens
tatacacatccatatacata

SEQ ID NO: 5788605 - DNA, 14 bp, Homo sapiens
tatacaccagcaat

SEQ ID NO: 5788606 - DNA, 19 bp, Homo sapiens
tatacacccagttctgaat

SEQ ID NO: 5788607 - DNA, 21 bp, Homo sapiens
tatacaccttattaatgatca

SEQ ID NO: 5788608 - DNA, 19 bp, Homo sapiens
tatacacgaatagacatca

SEQ ID NO: 5788609 - DNA, 19 bp, Homo sapiens
tatacacgggacagttgct

SEQ ID NO: 5788610 - DNA, 23 bp, Homo sapiens
tatacacttaaacttgcacattt

SEQ ID NO: 5788611 - DNA, 22 bp, Homo sapiens
tatacacttggagtttgcattc

SEQ ID NO: 5788612 - DNA, 19 bp, Homo sapiens
tatacacttggatttcatt

SEQ ID NO: 5788613 - DNA, 17 bp, Homo sapiens
tatacagacctaatatc

SEQ ID NO: 5788614 - DNA, 18 bp, Homo sapiens
tatacagacctccagatt

SEQ ID NO: 5788615 - DNA, 13 bp, Homo sapiens
tatacagaggaaa

SEQ ID NO: 5788616 - DNA, 13 bp, Homo sapiens
tatacagatgaaa

SEQ ID NO: 5788617 - DNA, 19 bp, Homo sapiens
tatacagatgaaaatttga

SEQ ID NO: 5788618 - DNA, 23 bp, Homo sapiens
tatacagattcctgttgtgtaat

SEQ ID NO: 5788619 - DNA, 15 bp, Homo sapiens
tatacaggtcatatt

SEQ ID NO: 5788620 - DNA, 16 bp, Homo sapiens
tatacagtaactttat

SEQ ID NO: 5788621 - DNA, 16 bp, Homo sapiens
tatacagtgccttgct

SEQ ID NO: 5788622 - DNA, 19 bp, Homo sapiens
tatacagtgtacatgtaca

SEQ ID NO: 5788623 - DNA, 16 bp, Homo sapiens
tatacagttataaaat

SEQ ID NO: 5788624 - DNA, 19 bp, Homo sapiens
tatacagttataaaattaa

SEQ ID NO: 5788625 - DNA, 23 bp, Homo sapiens
tatacagttataaaattaaaagt

SEQ ID NO: 5788626 - DNA, 16 bp, Homo sapiens
tatacagtttagaata

SEQ ID NO: 5788627 - DNA, 11 bp, Homo sapiens
tatacagtttg

SEQ ID NO: 5788628 - DNA, 16 bp, Homo sapiens
tatacagttttaaaga

SEQ ID NO: 5788629 - DNA, 21 bp, Homo sapiens
tatacagtttttgtaaccata

SEQ ID NO: 5788630 - DNA, 13 bp, Homo sapiens
tatacataaacaa

SEQ ID NO: 5788631 - DNA, 17 bp, Homo sapiens
tatacataaacagtttt

SEQ ID NO: 5788632 - DNA, 15 bp, Homo sapiens
tatacataaacttaa

SEQ ID NO: 5788633 - DNA, 18 bp, Homo sapiens
tatacataaatgcccagc

SEQ ID NO: 5788634 - DNA, 21 bp, Homo sapiens
tatacataacagggtaaatta

SEQ ID NO: 5788635 - DNA, 15 bp, Homo sapiens
tatacatacacttgt

SEQ ID NO: 5788636 - DNA, 21 bp, Homo sapiens
tatacatacgcaattgtatat

SEQ ID NO: 5788637 - DNA, 16 bp, Homo sapiens
tatacatactatgaaa

SEQ ID NO: 5788638 - DNA, 18 bp, Homo sapiens
tatacatagaaactttgt

SEQ ID NO: 5788639 - DNA, 16 bp, Homo sapiens
tatacatagtcacaaa

SEQ ID NO: 5788640 - DNA, 15 bp, Homo sapiens
tatacatatacacaa

SEQ ID NO: 5788641 - DNA, 13 bp, Homo sapiens
tatacatatatat

SEQ ID NO: 5788642 - DNA, 15 bp, Homo sapiens
tatacatatcagaaa

SEQ ID NO: 5788643 - DNA, 19 bp, Homo sapiens
tatacatatcagaaaagta

SEQ ID NO: 5788644 - DNA, 18 bp, Homo sapiens
tatacatatctttattaa

SEQ ID NO: 5788645 - DNA, 14 bp, Homo sapiens
tatacatatgagaa

SEQ ID NO: 5788646 - DNA, 14 bp, Homo sapiens
tatacatatgtatg

SEQ ID NO: 5788647 - DNA, 18 bp, Homo sapiens
tatacatatgtatgtgtg

SEQ ID NO: 5788648 - DNA, 17 bp, Homo sapiens
tatacatattataaata

SEQ ID NO: 5788649 - DNA, 16 bp, Homo sapiens
tatacatattcaaagt

SEQ ID NO: 5788650 - DNA, 18 bp, Homo sapiens
tatacatcaatatgtata

SEQ ID NO: 5788651 - DNA, 21 bp, Homo sapiens
tatacatcaatatgtatatat

SEQ ID NO: 5788652 - DNA, 12 bp, Homo sapiens
tatacatcactt

SEQ ID NO: 5788653 - DNA, 16 bp, Homo sapiens
tatacatcacttcctg

SEQ ID NO: 5788654 - DNA, 16 bp, Homo sapiens
tatacatctgtgtatt

SEQ ID NO: 5788655 - DNA, 14 bp, Homo sapiens
tatacatcttcatt

SEQ ID NO: 5788656 - DNA, 15 bp, Homo sapiens
tatacatgaaaattt

SEQ ID NO: 5788657 - DNA, 15 bp, Homo sapiens
tatacatgaaattca

SEQ ID NO: 5788658 - DNA, 15 bp, Homo sapiens
tatacatgccagtga

SEQ ID NO: 5788659 - DNA, 15 bp, Homo sapiens
tatacatgtgataca

SEQ ID NO: 5788660 - DNA, 20 bp, Homo sapiens
tatacatgtgatacattttt

SEQ ID NO: 5788661 - DNA, 23 bp, Homo sapiens
tatatatgatgtggacatatgta

SEQ ID NO: 5788662 - DNA, 18 bp, Homo sapiens
tatatatgcacacatata

SEQ ID NO: 5788663 - DNA, 20 bp, Homo sapiens
tatatatgcacacatatata

SEQ ID NO: 5788664 - DNA, 19 bp, Homo sapiens
tatatatggatcagaggag

SEQ ID NO: 5788665 - DNA, 18 bp, Homo sapiens
tatatatggtcatataca

SEQ ID NO: 5788666 - DNA, 11 bp, Homo sapiens
tatatatgtac

SEQ ID NO: 5788667 - DNA, 13 bp, Homo sapiens
tatatatgtacag

SEQ ID NO: 5788668 - DNA, 15 bp, Homo sapiens
tatatatgtacagtt

SEQ ID NO: 5788669 - DNA, 17 bp, Homo sapiens
tatatatgtacagttat

SEQ ID NO: 5788670 - DNA, 14 bp, Homo sapiens
tatatatgtacata

SEQ ID NO: 5788671 - DNA, 20 bp, Homo sapiens
tatatatgtatatctgtgta

SEQ ID NO: 5788672 - DNA, 20 bp, Homo sapiens
tatatatgtatatgtatata

SEQ ID NO: 5788673 - DNA, 21 bp, Homo sapiens
tatatatgtatctacaataca

SEQ ID NO: 5788674 - DNA, 13 bp, Homo sapiens
tatatatgtgaac

SEQ ID NO: 5788675 - DNA, 20 bp, Homo sapiens
tatatatgtgaactttctca

SEQ ID NO: 5788676 - DNA, 13 bp, Homo sapiens
tatatatgtgcag

SEQ ID NO: 5788677 - DNA, 16 bp, Homo sapiens
tatatatgtgtatata

SEQ ID NO: 5788678 - DNA, 19 bp, Homo sapiens
tatatatgtgtatatatac

SEQ ID NO: 5788679 - DNA, 20 bp, Homo sapiens
tatatatgtgtatatataca

SEQ ID NO: 5788680 - DNA, 22 bp, Homo sapiens
tatatatgtgtatatatacata

SEQ ID NO: 5788681 - DNA, 23 bp, Homo sapiens
tatatatgtgtatatatacatac

SEQ ID NO: 5788682 - DNA, 12 bp, Homo sapiens
tatatatgtgtg

SEQ ID NO: 5788683 - DNA, 19 bp, Homo sapiens
tatatatgtgtgccctgga

SEQ ID NO: 5788684 - DNA, 14 bp, Homo sapiens
tatatattaagtgt

SEQ ID NO: 5788685 - DNA, 14 bp, Homo sapiens
tatatattataaaa

SEQ ID NO: 5788686 - DNA, 15 bp, Homo sapiens
tatatattataagtt

SEQ ID NO: 5788687 - DNA, 13 bp, Homo sapiens
tatatattatact

SEQ ID NO: 5788688 - DNA, 14 bp, Homo sapiens
tatatattatactt

SEQ ID NO: 5788689 - DNA, 15 bp, Homo sapiens
tatatattatatgga

SEQ ID NO: 5788690 - DNA, 17 bp, Homo sapiens
tatatattatatggaaa

SEQ ID NO: 5788691 - DNA, 14 bp, Homo sapiens
tatatattatcttt

SEQ ID NO: 5788692 - DNA, 13 bp, Homo sapiens
tatatattattct

SEQ ID NO: 5788693 - DNA, 21 bp, Homo sapiens
tatatattctacacatatatg

SEQ ID NO: 5788694 - DNA, 14 bp, Homo sapiens
tatatattctatta

SEQ ID NO: 5788695 - DNA, 17 bp, Homo sapiens
tatatattctttcacaa

SEQ ID NO: 5788696 - DNA, 19 bp, Homo sapiens
tatatattgaaagttgctt

SEQ ID NO: 5788697 - DNA, 12 bp, Homo sapiens
tatatattgtct

SEQ ID NO: 5788698 - DNA, 17 bp, Homo sapiens
tatatattgtctgtaaa

SEQ ID NO: 5788699 - DNA, 18 bp, Homo sapiens
tatatattgtctgtaaaa

SEQ ID NO: 5788700 - DNA, 16 bp, Homo sapiens
tatatattgttgacaa

SEQ ID NO: 5788701 - DNA, 17 bp, Homo sapiens
tatatatttacaaggag

SEQ ID NO: 5788702 - DNA, 17 bp, Homo sapiens
tatatatttacagaaga

SEQ ID NO: 5788703 - DNA, 14 bp, Homo sapiens
tatatatttataac

SEQ ID NO: 5788704 - DNA, 15 bp, Homo sapiens
tatatatttataact

SEQ ID NO: 5788705 - DNA, 20 bp, Homo sapiens
tatatatttattattttcat

SEQ ID NO: 5788706 - DNA, 22 bp, Homo sapiens
tatatatttattattttcatat

SEQ ID NO: 5788707 - DNA, 20 bp, Homo sapiens
tatatatttccaaatattct

SEQ ID NO: 5788708 - DNA, 17 bp, Homo sapiens
tatatatttctattatt

SEQ ID NO: 5788709 - DNA, 16 bp, Homo sapiens
tatatatttcttaata

SEQ ID NO: 5788710 - DNA, 19 bp, Homo sapiens
tatatatttctttaaacct

SEQ ID NO: 5788711 - DNA, 17 bp, Homo sapiens
tatatatttgaaagaag

SEQ ID NO: 5788712 - DNA, 19 bp, Homo sapiens
tatatatttgatacatata

SEQ ID NO: 5788713 - DNA, 22 bp, Homo sapiens
tatatatttgattgtaaaaaca

SEQ ID NO: 5788714 - DNA, 14 bp, Homo sapiens
tatatatttgtaac

SEQ ID NO: 5788715 - DNA, 23 bp, Homo sapiens
tatatattttaagccttcatttg

SEQ ID NO: 5788716 - DNA, 17 bp, Homo sapiens
tatatattttatatgtt

SEQ ID NO: 5788717 - DNA, 15 bp, Homo sapiens
tatatattttatgat

SEQ ID NO: 5788718 - DNA, 17 bp, Homo sapiens
tatatattttgaaagga

SEQ ID NO: 5788719 - DNA, 23 bp, Homo sapiens
tatatattttgtgtgaaattgca

SEQ ID NO: 5788720 - DNA, 22 bp, Homo sapiens
tatatattttgttgttcctcta

SEQ ID NO: 5788721 - DNA, 20 bp, Homo sapiens
tatatatttttcaaccagca

SEQ ID NO: 5788722 - DNA, 15 bp, Homo sapiens
tatatatttttctga

SEQ ID NO: 5788723 - DNA, 20 bp, Homo sapiens
tatatatttttggttgtcaa

SEQ ID NO: 5788724 - DNA, 15 bp, Homo sapiens
tatatcaaagtattt

SEQ ID NO: 5788725 - DNA, 22 bp, Homo sapiens
tatatcaacagatagttgtgtt

SEQ ID NO: 5788726 - DNA, 14 bp, Homo sapiens
tatatcacacaata

SEQ ID NO: 5788727 - DNA, 17 bp, Homo sapiens
tatatcacacaatatag

SEQ ID NO: 5788728 - DNA, 20 bp, Homo sapiens
tatatcacagagccactctt

SEQ ID NO: 5788729 - DNA, 19 bp, Homo sapiens
tatatcacatgttttctct

SEQ ID NO: 5788730 - DNA, 13 bp, Homo sapiens
tatatcacccaga

SEQ ID NO: 5788731 - DNA, 22 bp, Homo sapiens
tatatcactaaaagcatgaatt

SEQ ID NO: 5788732 - DNA, 18 bp, Homo sapiens
tatatcagaaaagggaag

SEQ ID NO: 5788733 - DNA, 18 bp, Homo sapiens
tatatcagcagacactcc

SEQ ID NO: 5788734 - DNA, 23 bp, Homo sapiens
tatatcagcctgagtctcctgtg

SEQ ID NO: 5788735 - DNA, 13 bp, Homo sapiens
tatatcagctcta

SEQ ID NO: 5788736 - DNA, 16 bp, Homo sapiens
tatatcagctctaaag

SEQ ID NO: 5788737 - DNA, 13 bp, Homo sapiens
tatatcaggaggg

SEQ ID NO: 5788738 - DNA, 13 bp, Homo sapiens
tatatcagtttga

SEQ ID NO: 5788739 - DNA, 14 bp, Homo sapiens
tatatcagtttgat

SEQ ID NO: 5788740 - DNA, 22 bp, Homo sapiens
tatatcataacttaataaatat

SEQ ID NO: 5788741 - DNA, 22 bp, Homo sapiens
tatatcatacagttttcattga

SEQ ID NO: 5788742 - DNA, 14 bp, Homo sapiens
tatatcatatgtat

SEQ ID NO: 5788743 - DNA, 16 bp, Homo sapiens
tatatcatgaagcctt

SEQ ID NO: 5788744 - DNA, 13 bp, Homo sapiens
tatatcatgcaaa

SEQ ID NO: 5788745 - DNA, 20 bp, Homo sapiens
tatatcatgctttaaagtgt

SEQ ID NO: 5788746 - DNA, 18 bp, Homo sapiens
tatatcatgtaaagaaat

SEQ ID NO: 5788747 - DNA, 20 bp, Homo sapiens
tatatcattatctttgctgt

SEQ ID NO: 5788748 - DNA, 16 bp, Homo sapiens
tatatcattctaaaga

SEQ ID NO: 5788749 - DNA, 17 bp, Homo sapiens
tatatcattctaaagat

SEQ ID NO: 5788750 - DNA, 16 bp, Homo sapiens
tatatcattctacaga

SEQ ID NO: 5788751 - DNA, 18 bp, Homo sapiens
tatatcattctacagaat

SEQ ID NO: 5788752 - DNA, 21 bp, Homo sapiens
tatatcattttaaaatgtctt

SEQ ID NO: 5788753 - DNA, 18 bp, Homo sapiens
tatatccagttcctgctc

SEQ ID NO: 5788754 - DNA, 15 bp, Homo sapiens
tatatccatgtactg

SEQ ID NO: 5788755 - DNA, 14 bp, Homo sapiens
tatatcccctgcta

SEQ ID NO: 5788756 - DNA, 18 bp, Homo sapiens
tatatcctgtgactgtct

SEQ ID NO: 5788757 - DNA, 17 bp, Homo sapiens
tatatcctgtgtacctc

SEQ ID NO: 5788758 - DNA, 16 bp, Homo sapiens
tatatcgatgatggaa

SEQ ID NO: 5788759 - DNA, 17 bp, Homo sapiens
tatatcgttatcactgt

SEQ ID NO: 5788760 - DNA, 19 bp, Homo sapiens
tatatctaaatctgtccaa

SEQ ID NO: 5788761 - DNA, 18 bp, Homo sapiens
tatatctaattatttcca

SEQ ID NO: 5788762 - DNA, 12 bp, Homo sapiens
tatatctaattt

SEQ ID NO: 5788763 - DNA, 18 bp, Homo sapiens
tatatctaatttatacaa

SEQ ID NO: 5788764 - DNA, 14 bp, Homo sapiens
tatatctacaatat

SEQ ID NO: 5788765 - DNA, 16 bp, Homo sapiens
tatatctacaatatat

SEQ ID NO: 5788766 - DNA, 17 bp, Homo sapiens
tatatctacacatacag

SEQ ID NO: 5788767 - DNA, 18 bp, Homo sapiens
tatatctacacatacaga

SEQ ID NO: 5788768 - DNA, 22 bp, Homo sapiens
tatatctagaactatcattttt

SEQ ID NO: 5788769 - DNA, 18 bp, Homo sapiens
tatatctaggtttatgac

SEQ ID NO: 5788770 - DNA, 14 bp, Homo sapiens
tatatctatagtag

SEQ ID NO: 5788771 - DNA, 19 bp, Homo sapiens
tatatctatagtagtcaat

SEQ ID NO: 5788772 - DNA, 14 bp, Homo sapiens
tatatctatatcat

SEQ ID NO: 5788773 - DNA, 21 bp, Homo sapiens
tatatctatattttacataaa

SEQ ID NO: 5788774 - DNA, 14 bp, Homo sapiens
tatatctatctatt

SEQ ID NO: 5788775 - DNA, 15 bp, Homo sapiens
tatatctatcttata

SEQ ID NO: 5788776 - DNA, 23 bp, Homo sapiens
tatatctctagatgcaaatacat

SEQ ID NO: 5788777 - DNA, 16 bp, Homo sapiens
tatatctctcatgcat

SEQ ID NO: 5788778 - DNA, 19 bp, Homo sapiens
tatatctcttttggtccca

SEQ ID NO: 5788779 - DNA, 12 bp, Homo sapiens
tatatctgaaga

SEQ ID NO: 5788780 - DNA, 14 bp, Homo sapiens
tatatctgaagatt

SEQ ID NO: 5788781 - DNA, 20 bp, Homo sapiens
tatatctgaggaattctgta

SEQ ID NO: 5788782 - DNA, 13 bp, Homo sapiens
tatatctgataaa

SEQ ID NO: 5788783 - DNA, 16 bp, Homo sapiens
tatatctgcttcagtg

SEQ ID NO: 5788784 - DNA, 19 bp, Homo sapiens
tatatctgggttaagtgtt

SEQ ID NO: 5788785 - DNA, 13 bp, Homo sapiens
tatatctgtaaat

SEQ ID NO: 5788786 - DNA, 13 bp, Homo sapiens
tatatctgtaaca

SEQ ID NO: 5788787 - DNA, 14 bp, Homo sapiens
tatatctgtaatga

SEQ ID NO: 5788788 - DNA, 16 bp, Homo sapiens
tatatctgtaatgata

SEQ ID NO: 5788789 - DNA, 15 bp, Homo sapiens
tatatctgtatataa

SEQ ID NO: 5788790 - DNA, 18 bp, Homo sapiens
tatatctgtgattttaaa

SEQ ID NO: 5788791 - DNA, 19 bp, Homo sapiens
tatatctgtgattttaaaa

SEQ ID NO: 5788792 - DNA, 13 bp, Homo sapiens
tatatctgtttgt

SEQ ID NO: 5788793 - DNA, 15 bp, Homo sapiens
tatatctgtttgtat

SEQ ID NO: 5788794 - DNA, 21 bp, Homo sapiens
tatatctgttttgtttcttga

SEQ ID NO: 5788795 - DNA, 20 bp, Homo sapiens
tatatcttaagaatgtgcta

SEQ ID NO: 5788796 - DNA, 14 bp, Homo sapiens
tatatcttaagcag

SEQ ID NO: 5788797 - DNA, 16 bp, Homo sapiens
tatatcttataactgt

SEQ ID NO: 5788798 - DNA, 12 bp, Homo sapiens
tatatcttgttt

SEQ ID NO: 5788799 - DNA, 16 bp, Homo sapiens
tatatcttgtttacaa

SEQ ID NO: 5788800 - DNA, 18 bp, Homo sapiens
tatatctttaaataaatg

SEQ ID NO: 5788801 - DNA, 16 bp, Homo sapiens
tatatctttatactta

SEQ ID NO: 5788802 - DNA, 17 bp, Homo sapiens
tatatctttatgcaaaa

SEQ ID NO: 5788803 - DNA, 14 bp, Homo sapiens
tatatctttattca

SEQ ID NO: 5788804 - DNA, 14 bp, Homo sapiens
tatatctttgcact

SEQ ID NO: 5788805 - DNA, 15 bp, Homo sapiens
tatatctttgcactg

SEQ ID NO: 5788806 - DNA, 14 bp, Homo sapiens
tatatctttgtaaa

SEQ ID NO: 5788807 - DNA, 22 bp, Homo sapiens
tatatgaaaacaatactaaata

SEQ ID NO: 5788808 - DNA, 19 bp, Homo sapiens
tatatgaaaactatacaac

SEQ ID NO: 5788809 - DNA, 19 bp, Homo sapiens
tatatgaaatgtttcacta

SEQ ID NO: 5788810 - DNA, 16 bp, Homo sapiens
tatatgaagcaagctg

SEQ ID NO: 5788811 - DNA, 22 bp, Homo sapiens
tatatgaagcaagctgtgttac

SEQ ID NO: 5788812 - DNA, 24 bp, Homo sapiens
tatatgaagcaagctgtgttactt

SEQ ID NO: 5788813 - DNA, 16 bp, Homo sapiens
tatatgaataaagtgt

SEQ ID NO: 5788814 - DNA, 14 bp, Homo sapiens
tatatgaatattac

SEQ ID NO: 5788815 - DNA, 22 bp, Homo sapiens
tatatgaatttaaatataattc

SEQ ID NO: 5788816 - DNA, 15 bp, Homo sapiens
tatatgaccagaagc

SEQ ID NO: 5788817 - DNA, 12 bp, Homo sapiens
tatatgactgca

SEQ ID NO: 5788818 - DNA, 19 bp, Homo sapiens
tatatgactgcatttgtgt

SEQ ID NO: 5788819 - DNA, 19 bp, Homo sapiens
tatatgacttcttgttcat

SEQ ID NO: 5788820 - DNA, 18 bp, Homo sapiens
tatatgagactttatgtg

SEQ ID NO: 5788821 - DNA, 16 bp, Homo sapiens
tatatgagagaatcac

SEQ ID NO: 5788822 - DNA, 20 bp, Homo sapiens
tatatgatatatattatctt

SEQ ID NO: 5788823 - DNA, 13 bp, Homo sapiens
tatatgatatgca

SEQ ID NO: 5788824 - DNA, 21 bp, Homo sapiens
tatatgatattctttaaacaa

SEQ ID NO: 5788825 - DNA, 14 bp, Homo sapiens
tatatgatcctgaa

SEQ ID NO: 5788826 - DNA, 23 bp, Homo sapiens
tatatgatctaatacaaagatga

SEQ ID NO: 5788827 - DNA, 22 bp, Homo sapiens
tatatgatgagcagacttctcg

SEQ ID NO: 5788828 - DNA, 22 bp, Homo sapiens
tatatgatgtggacatatgtat

SEQ ID NO: 5788829 - DNA, 15 bp, Homo sapiens
tatatgatttatagt

SEQ ID NO: 5788830 - DNA, 21 bp, Homo sapiens
tatatgatttatagtttgtac

SEQ ID NO: 5788831 - DNA, 14 bp, Homo sapiens
tatatgatttatat

SEQ ID NO: 5788832 - DNA, 16 bp, Homo sapiens
tatatgatttgcatgt

SEQ ID NO: 5788833 - DNA, 15 bp, Homo sapiens
tatatgcaatgtcca

SEQ ID NO: 5788834 - DNA, 20 bp, Homo sapiens
tatatgcagtctctttattt

SEQ ID NO: 5788835 - DNA, 14 bp, Homo sapiens
tatatgcatttgcc

SEQ ID NO: 5788836 - DNA, 18 bp, Homo sapiens
tatatgcctatatttata

SEQ ID NO: 5788837 - DNA, 15 bp, Homo sapiens
tatatgccttactat

SEQ ID NO: 5788838 - DNA, 17 bp, Homo sapiens
tatatgccttactattg

SEQ ID NO: 5788839 - DNA, 17 bp, Homo sapiens
tatatgccttatgtaat

SEQ ID NO: 5788840 - DNA, 19 bp, Homo sapiens
tatattttgttgttcctct

SEQ ID NO: 5788841 - DNA, 21 bp, Homo sapiens
tatatttttaaaaaatgaaat

SEQ ID NO: 5788842 - DNA, 19 bp, Homo sapiens
tatatttttaagataataa

SEQ ID NO: 5788843 - DNA, 18 bp, Homo sapiens
tatatttttactgctttc

SEQ ID NO: 5788844 - DNA, 22 bp, Homo sapiens
tatatttttactgctttctgaa

SEQ ID NO: 5788845 - DNA, 22 bp, Homo sapiens
tatatttttatctatataaaat

SEQ ID NO: 5788846 - DNA, 15 bp, Homo sapiens
tatatttttcacagt

SEQ ID NO: 5788847 - DNA, 14 bp, Homo sapiens
tatatttttctatg

SEQ ID NO: 5788848 - DNA, 17 bp, Homo sapiens
tatatttttcttaaaaa

SEQ ID NO: 5788849 - DNA, 22 bp, Homo sapiens
tatatttttgatctttgagtgt

SEQ ID NO: 5788850 - DNA, 14 bp, Homo sapiens
tatatttttgtaaa

SEQ ID NO: 5788851 - DNA, 19 bp, Homo sapiens
tatatttttgtaaatagta

SEQ ID NO: 5788852 - DNA, 17 bp, Homo sapiens
tatatttttgtacatat

SEQ ID NO: 5788853 - DNA, 12 bp, Homo sapiens
tatatttttgtc

SEQ ID NO: 5788854 - DNA, 19 bp, Homo sapiens
tatatttttgtctgcagct

SEQ ID NO: 5788855 - DNA, 14 bp, Homo sapiens
tatatttttgtgaa

SEQ ID NO: 5788856 - DNA, 21 bp, Homo sapiens
tatatttttgtttgttttgtg

SEQ ID NO: 5788857 - DNA, 19 bp, Homo sapiens
tatattttttaaaataagt

SEQ ID NO: 5788858 - DNA, 19 bp, Homo sapiens
tatattttttaatgtattc

SEQ ID NO: 5788859 - DNA, 13 bp, Homo sapiens
tatattttttaca

SEQ ID NO: 5788860 - DNA, 16 bp, Homo sapiens
tatatttttttaactg

SEQ ID NO: 5788861 - DNA, 17 bp, Homo sapiens
tatatttttttaactgt

SEQ ID NO: 5788862 - DNA, 22 bp, Homo sapiens
tatatttttttcaactgccaat

SEQ ID NO: 5788863 - DNA, 16 bp, Homo sapiens
tatatttttttctgaa

SEQ ID NO: 5788864 - DNA, 19 bp, Homo sapiens
tatatttttttctgaaatt

SEQ ID NO: 5788865 - DNA, 20 bp, Homo sapiens
tatatttttttctgaaattt

SEQ ID NO: 5788866 - DNA, 19 bp, Homo sapiens
tatcaaaaaacaagtcttt

SEQ ID NO: 5788867 - DNA, 14 bp, Homo sapiens
tatcaaaacatatc

SEQ ID NO: 5788868 - DNA, 15 bp, Homo sapiens
tatcaaaacatatca

SEQ ID NO: 5788869 - DNA, 16 bp, Homo sapiens
tatcaaaacatatcaa

SEQ ID NO: 5788870 - DNA, 18 bp, Homo sapiens
tatcaaaacatatcaatt

SEQ ID NO: 5788871 - DNA, 19 bp, Homo sapiens
tatcaaaacatatcaattc

SEQ ID NO: 5788872 - DNA, 21 bp, Homo sapiens
tatcaaaacatatcaattcaa

SEQ ID NO: 5788873 - DNA, 21 bp, Homo sapiens
tatcaaaactctatcaaatgt

SEQ ID NO: 5788874 - DNA, 19 bp, Homo sapiens
tatcaaaactttcttttct

SEQ ID NO: 5788875 - DNA, 13 bp, Homo sapiens
tatcaaaagtgat

SEQ ID NO: 5788876 - DNA, 23 bp, Homo sapiens
tatcaaaagtgatcagcaatgaa

SEQ ID NO: 5788877 - DNA, 13 bp, Homo sapiens
tatcaaaattcta

SEQ ID NO: 5788878 - DNA, 22 bp, Homo sapiens
tatcaaaattgcctttttctct

SEQ ID NO: 5788879 - DNA, 19 bp, Homo sapiens
tatcaaacaccaacataaa

SEQ ID NO: 5788880 - DNA, 23 bp, Homo sapiens
tatcaaacaccaacataaaaatg

SEQ ID NO: 5788881 - DNA, 20 bp, Homo sapiens
tatcaaacagaattttaaag

SEQ ID NO: 5788882 - DNA, 15 bp, Homo sapiens
tatcaaacagctcag

SEQ ID NO: 5788883 - DNA, 21 bp, Homo sapiens
tatcaaaccctagccttgctt

SEQ ID NO: 5788884 - DNA, 23 bp, Homo sapiens
tatcaaaccctagccttgcttgt

SEQ ID NO: 5788885 - DNA, 16 bp, Homo sapiens
tatcaaactcgtctga

SEQ ID NO: 5788886 - DNA, 19 bp, Homo sapiens
tatcaaactcgtctgatgt

SEQ ID NO: 5788887 - DNA, 14 bp, Homo sapiens
tatcaaactgctgt

SEQ ID NO: 5788888 - DNA, 16 bp, Homo sapiens
tatcaaacttgtgctg

SEQ ID NO: 5788889 - DNA, 16 bp, Homo sapiens
tatcaaagagaagatg

SEQ ID NO: 5788890 - DNA, 12 bp, Homo sapiens
tatcaaagagca

SEQ ID NO: 5788891 - DNA, 14 bp, Homo sapiens
tatcaaagcttcaa

SEQ ID NO: 5788892 - DNA, 18 bp, Homo sapiens
tatcaaagggtgaaaatt

SEQ ID NO: 5788893 - DNA, 19 bp, Homo sapiens
tatcaaagggtgaaaatta

SEQ ID NO: 5788894 - DNA, 20 bp, Homo sapiens
tatcaaagtcattaaagaca

SEQ ID NO: 5788895 - DNA, 14 bp, Homo sapiens
tatcaaataactaa

SEQ ID NO: 5788896 - DNA, 23 bp, Homo sapiens
tatcaaataactaaggaatatat

SEQ ID NO: 5788897 - DNA, 13 bp, Homo sapiens
tatcaaataataa

SEQ ID NO: 5788898 - DNA, 23 bp, Homo sapiens
tatcaaatacatttaaaacatta

SEQ ID NO: 5788899 - DNA, 19 bp, Homo sapiens
tatcaaatattagatgtga

SEQ ID NO: 5788900 - DNA, 20 bp, Homo sapiens
tatcaaatattagatgtgat

SEQ ID NO: 5788901 - DNA, 21 bp, Homo sapiens
tatcaaatattagatgtgatt

SEQ ID NO: 5788902 - DNA, 12 bp, Homo sapiens
tatcaaatcatt

SEQ ID NO: 5788903 - DNA, 20 bp, Homo sapiens
tatcaaatcattcaaaactt

SEQ ID NO: 5788904 - DNA, 21 bp, Homo sapiens
tatcaaatcattcaaaacttt

SEQ ID NO: 5788905 - DNA, 22 bp, Homo sapiens
tatcaaatccaggactttgtta

SEQ ID NO: 5788906 - DNA, 16 bp, Homo sapiens
tatcaaatctgtatat

SEQ ID NO: 5788907 - DNA, 15 bp, Homo sapiens
tatcaaatgaaacag

SEQ ID NO: 5788908 - DNA, 19 bp, Homo sapiens
tatcaaatgcagtatattt

SEQ ID NO: 5788909 - DNA, 21 bp, Homo sapiens
tatcaaatgcagtatatttct

SEQ ID NO: 5788910 - DNA, 19 bp, Homo sapiens
tatcaaatgccttcatgaa

SEQ ID NO: 5788911 - DNA, 23 bp, Homo sapiens
tatcaaatgccttcatgaatctt

SEQ ID NO: 5788912 - DNA, 15 bp, Homo sapiens
tatcaaattaattgt

SEQ ID NO: 5788913 - DNA, 21 bp, Homo sapiens
tatcaaattaattgtgtgaac

SEQ ID NO: 5788914 - DNA, 12 bp, Homo sapiens
tatcaacactgc

SEQ ID NO: 5788915 - DNA, 14 bp, Homo sapiens
tatcaacagcttcc

SEQ ID NO: 5788916 - DNA, 16 bp, Homo sapiens
tatcaacccagaaaca

SEQ ID NO: 5788917 - DNA, 17 bp, Homo sapiens
tatcaaccccagacact

SEQ ID NO: 5788918 - DNA, 18 bp, Homo sapiens
tatcaaccccagacactg

SEQ ID NO: 5788919 - DNA, 21 bp, Homo sapiens
tatcaaccccagacactggtt

SEQ ID NO: 5788920 - DNA, 16 bp, Homo sapiens
tatcaactctgaagct

SEQ ID NO: 5788921 - DNA, 19 bp, Homo sapiens
tatcaacttagtcaataag

SEQ ID NO: 5788922 - DNA, 16 bp, Homo sapiens
tatcaacttatttttc

SEQ ID NO: 5788923 - DNA, 14 bp, Homo sapiens
tatcaacttcctaa

SEQ ID NO: 5788924 - DNA, 18 bp, Homo sapiens
tatcaacttcgctagaaa

SEQ ID NO: 5788925 - DNA, 19 bp, Homo sapiens
tatcaacttcgctagaaaa

SEQ ID NO: 5788926 - DNA, 14 bp, Homo sapiens
tatcaagacatagc

SEQ ID NO: 5788927 - DNA, 15 bp, Homo sapiens
tatcaagacatagca

SEQ ID NO: 5788928 - DNA, 17 bp, Homo sapiens
tatcaagacgtttaact

SEQ ID NO: 5788929 - DNA, 23 bp, Homo sapiens
tatcaagactgactggcaccaac

SEQ ID NO: 5788930 - DNA, 23 bp, Homo sapiens
tatcaagccagtacgtgctaaca

SEQ ID NO: 5788931 - DNA, 16 bp, Homo sapiens
tatcaagcccctgtct

SEQ ID NO: 5788932 - DNA, 22 bp, Homo sapiens
tatcaagcctagatgttttata

SEQ ID NO: 5788933 - DNA, 12 bp, Homo sapiens
tatcaagctaat

SEQ ID NO: 5788934 - DNA, 16 bp, Homo sapiens
tatcaaggaaaactgt

SEQ ID NO: 5788935 - DNA, 18 bp, Homo sapiens
tatcaaggaagtcttcaa

SEQ ID NO: 5788936 - DNA, 22 bp, Homo sapiens
tatcaaggactctggtttctca

SEQ ID NO: 5788937 - DNA, 19 bp, Homo sapiens
tatcaaggatgttctggct

SEQ ID NO: 5788938 - DNA, 22 bp, Homo sapiens
tatcaaggattttcatgttgat

SEQ ID NO: 5788939 - DNA, 17 bp, Homo sapiens
tatcaaggctgcctgga

SEQ ID NO: 5788940 - DNA, 19 bp, Homo sapiens
tatcaaggctgcctggaga

SEQ ID NO: 5788941 - DNA, 20 bp, Homo sapiens
tatcaaggctgcctggagaa

SEQ ID NO: 5788942 - DNA, 20 bp, Homo sapiens
tatcaagtcaatcatttctc

SEQ ID NO: 5788943 - DNA, 14 bp, Homo sapiens
tatcaagtgtcttc

SEQ ID NO: 5788944 - DNA, 14 bp, Homo sapiens
tatcaataaaattc

SEQ ID NO: 5788945 - DNA, 17 bp, Homo sapiens
tatcaataaaattctgt

SEQ ID NO: 5788946 - DNA, 13 bp, Homo sapiens
tatcaatagtcaa

SEQ ID NO: 5788947 - DNA, 18 bp, Homo sapiens
tatcaatatctaatatat

SEQ ID NO: 5788948 - DNA, 21 bp, Homo sapiens
tatcaatatctaatatatatg

SEQ ID NO: 5788949 - DNA, 22 bp, Homo sapiens
tatcaatatggtgtcttgatat

SEQ ID NO: 5788950 - DNA, 19 bp, Homo sapiens
tatcaatattttctgcaat

SEQ ID NO: 5788951 - DNA, 15 bp, Homo sapiens
tatcaatcagtaatt

SEQ ID NO: 5788952 - DNA, 16 bp, Homo sapiens
tatcaatcagtaatta

SEQ ID NO: 5788953 - DNA, 13 bp, Homo sapiens
tatcaatcatttt

SEQ ID NO: 5788954 - DNA, 14 bp, Homo sapiens
tatcaatcattttc

SEQ ID NO: 5788955 - DNA, 22 bp, Homo sapiens
tatcaatccaaattccctctgg

SEQ ID NO: 5788956 - DNA, 23 bp, Homo sapiens
tatcaatccaaattccctctgga

SEQ ID NO: 5788957 - DNA, 15 bp, Homo sapiens
tatcaatgagttctt

SEQ ID NO: 5788958 - DNA, 12 bp, Homo sapiens
tatcaatgtgtc

SEQ ID NO: 5788959 - DNA, 13 bp, Homo sapiens
tatcaattacagt

SEQ ID NO: 5788960 - DNA, 19 bp, Homo sapiens
tatcaattaccacaccatc

SEQ ID NO: 5788961 - DNA, 13 bp, Homo sapiens
tatcaattcacat

SEQ ID NO: 5788962 - DNA, 13 bp, Homo sapiens
tatcaatttctaa

SEQ ID NO: 5788963 - DNA, 14 bp, Homo sapiens
tatcaatttgtcat

SEQ ID NO: 5788964 - DNA, 21 bp, Homo sapiens
tatcaatttgtcattttgaag

SEQ ID NO: 5788965 - DNA, 13 bp, Homo sapiens
tatcaattttaag

SEQ ID NO: 5788966 - DNA, 16 bp, Homo sapiens
tatcaatttttcccag

SEQ ID NO: 5788967 - DNA, 18 bp, Homo sapiens
tatcaatttttcccagta

SEQ ID NO: 5788968 - DNA, 21 bp, Homo sapiens
tatcaatttttcccagtattt

SEQ ID NO: 5788969 - DNA, 20 bp, Homo sapiens
tatcacaaagttgtttaact

SEQ ID NO: 5788970 - DNA, 23 bp, Homo sapiens
tatcacaaccaccgttacaagta

SEQ ID NO: 5788971 - DNA, 23 bp, Homo sapiens
tatcacaagagtccccagactct

SEQ ID NO: 5788972 - DNA, 18 bp, Homo sapiens
tatcacaatgtactatat

SEQ ID NO: 5788973 - DNA, 12 bp, Homo sapiens
tatcacacaata

SEQ ID NO: 5788974 - DNA, 15 bp, Homo sapiens
tatcacacactttct

SEQ ID NO: 5788975 - DNA, 20 bp, Homo sapiens
tatcacacactttctcttca

SEQ ID NO: 5788976 - DNA, 18 bp, Homo sapiens
tatcacacactttctgac

SEQ ID NO: 5788977 - DNA, 16 bp, Homo sapiens
tatcacacctaatctt

SEQ ID NO: 5788978 - DNA, 16 bp, Homo sapiens
tatcacagagccactc

SEQ ID NO: 5788979 - DNA, 13 bp, Homo sapiens
tatcacagtatta

SEQ ID NO: 5788980 - DNA, 15 bp, Homo sapiens
tatcacagtctaatt

SEQ ID NO: 5788981 - DNA, 13 bp, Homo sapiens
tatcacagtgttt

SEQ ID NO: 5788982 - DNA, 19 bp, Homo sapiens
tatcacataagagagatga

SEQ ID NO: 5788983 - DNA, 21 bp, Homo sapiens
tatcacataagagagatgaga

SEQ ID NO: 5788984 - DNA, 23 bp, Homo sapiens
tatcacataagagagatgagaaa

SEQ ID NO: 5788985 - DNA, 12 bp, Homo sapiens
tatcacatacaa

SEQ ID NO: 5788986 - DNA, 17 bp, Homo sapiens
tatcacatacaatttgc

SEQ ID NO: 5788987 - DNA, 22 bp, Homo sapiens
tatcacatacaatttgcactgt

SEQ ID NO: 5788988 - DNA, 18 bp, Homo sapiens
tatcacatcaagcatgca

SEQ ID NO: 5788989 - DNA, 22 bp, Homo sapiens
tatcacatcaagcatgcaataa

SEQ ID NO: 5788990 - DNA, 17 bp, Homo sapiens
tatcacatgattataga

SEQ ID NO: 5788991 - DNA, 16 bp, Homo sapiens
tatcacatgtatgttt

SEQ ID NO: 5788992 - DNA, 17 bp, Homo sapiens
tatcacatgtatgtttt

SEQ ID NO: 5788993 - DNA, 15 bp, Homo sapiens
tatcacatgtgaaaa

SEQ ID NO: 5788994 - DNA, 21 bp, Homo sapiens
tatcacatgtgaaaagcttaa

SEQ ID NO: 5788995 - DNA, 22 bp, Homo sapiens
tatcacattaatctcaaagaga

SEQ ID NO: 5788996 - DNA, 14 bp, Homo sapiens
tatcacattaattt

SEQ ID NO: 5788997 - DNA, 15 bp, Homo sapiens
tatcacattttatta

SEQ ID NO: 5788998 - DNA, 16 bp, Homo sapiens
tatcacccaacgctcc

SEQ ID NO: 5788999 - DNA, 21 bp, Homo sapiens
tatcacccaacgctccaaagt

SEQ ID NO: 5789000 - DNA, 14 bp, Homo sapiens
tatcacccaggctg

SEQ ID NO: 5789001 - DNA, 20 bp, Homo sapiens
tatcaccctaattaatagaa

SEQ ID NO: 5789002 - DNA, 16 bp, Homo sapiens
tatcacctagctgaat

SEQ ID NO: 5789003 - DNA, 14 bp, Homo sapiens
tatcacctcatggc

SEQ ID NO: 5789004 - DNA, 19 bp, Homo sapiens
tatcacctcattctgaacc

SEQ ID NO: 5789005 - DNA, 15 bp, Homo sapiens
tatcacctcccctcc

SEQ ID NO: 5789006 - DNA, 16 bp, Homo sapiens
tatcacctcccctcct

SEQ ID NO: 5789007 - DNA, 14 bp, Homo sapiens
tatcacctcttcac

SEQ ID NO: 5789008 - DNA, 12 bp, Homo sapiens
tatcacctgtca

SEQ ID NO: 5789009 - DNA, 15 bp, Homo sapiens
tatcacctgtcatca

SEQ ID NO: 5789010 - DNA, 14 bp, Homo sapiens
tatcacctttccca

SEQ ID NO: 5789011 - DNA, 16 bp, Homo sapiens
tatcacgatttgcagg

SEQ ID NO: 5789012 - DNA, 15 bp, Homo sapiens
tatcacgttgaacca

SEQ ID NO: 5789013 - DNA, 13 bp, Homo sapiens
tatcactaaataa

SEQ ID NO: 5789014 - DNA, 16 bp, Homo sapiens
tatcactaagaaagaa

SEQ ID NO: 5789015 - DNA, 17 bp, Homo sapiens
tatcactaagaaagaaa

SEQ ID NO: 5789016 - DNA, 23 bp, Homo sapiens
tatcactaagaaagaaaggaaag

SEQ ID NO: 5789017 - DNA, 17 bp, Homo sapiens
tatctcaagtaaaacaa

SEQ ID NO: 5789018 - DNA, 22 bp, Homo sapiens
tatctcaagtaaaacaaatgaa

SEQ ID NO: 5789019 - DNA, 15 bp, Homo sapiens
tatctcaagtatata

SEQ ID NO: 5789020 - DNA, 22 bp, Homo sapiens
tatctcaatgaaccataaattc

SEQ ID NO: 5789021 - DNA, 14 bp, Homo sapiens
tatctcactgctgt

SEQ ID NO: 5789022 - DNA, 15 bp, Homo sapiens
tatctcactgtttta

SEQ ID NO: 5789023 - DNA, 15 bp, Homo sapiens
tatctcactttgtaa

SEQ ID NO: 5789024 - DNA, 13 bp, Homo sapiens
tatctcagaaagt

SEQ ID NO: 5789025 - DNA, 15 bp, Homo sapiens
tatctcagaggctat

SEQ ID NO: 5789026 - DNA, 19 bp, Homo sapiens
tatctcagatatttgcacc

SEQ ID NO: 5789027 - DNA, 12 bp, Homo sapiens
tatctcagccat

SEQ ID NO: 5789028 - DNA, 14 bp, Homo sapiens
tatctcagccatcc

SEQ ID NO: 5789029 - DNA, 16 bp, Homo sapiens
tatctcagccatccgc

SEQ ID NO: 5789030 - DNA, 14 bp, Homo sapiens
tatctcagggaggg

SEQ ID NO: 5789031 - DNA, 15 bp, Homo sapiens
tatctcagggcctgg

SEQ ID NO: 5789032 - DNA, 13 bp, Homo sapiens
tatctcaggtctg

SEQ ID NO: 5789033 - DNA, 22 bp, Homo sapiens
tatctcagtcatgcataaatat

SEQ ID NO: 5789034 - DNA, 16 bp, Homo sapiens
tatctcatactgtctg

SEQ ID NO: 5789035 - DNA, 22 bp, Homo sapiens
tatctcatagggatgctgtgag

SEQ ID NO: 5789036 - DNA, 14 bp, Homo sapiens
tatctcatcaacaa

SEQ ID NO: 5789037 - DNA, 20 bp, Homo sapiens
tatctcatttaatttgttat

SEQ ID NO: 5789038 - DNA, 18 bp, Homo sapiens
tatctccagcggccctgt

SEQ ID NO: 5789039 - DNA, 23 bp, Homo sapiens
tatctccaggattgaagagcatt

SEQ ID NO: 5789040 - DNA, 20 bp, Homo sapiens
tatctccatccttaactgtc

SEQ ID NO: 5789041 - DNA, 19 bp, Homo sapiens
tatctccatggccctgtcc

SEQ ID NO: 5789042 - DNA, 13 bp, Homo sapiens
tatctcccccagc

SEQ ID NO: 5789043 - DNA, 18 bp, Homo sapiens
tatctcccccagccccat

SEQ ID NO: 5789044 - DNA, 14 bp, Homo sapiens
tatctccctggaga

SEQ ID NO: 5789045 - DNA, 19 bp, Homo sapiens
tatctcctccaatgtcctg

SEQ ID NO: 5789046 - DNA, 21 bp, Homo sapiens
tatctcctgacagaaggtgcc

SEQ ID NO: 5789047 - DNA, 10 bp, Homo sapiens
tatctcctgg

SEQ ID NO: 5789048 - DNA, 15 bp, Homo sapiens
tatctcctgtctaca

SEQ ID NO: 5789049 - DNA, 20 bp, Homo sapiens
tatctcctgtgatcctttga

SEQ ID NO: 5789050 - DNA, 13 bp, Homo sapiens
tatctccttccca

SEQ ID NO: 5789051 - DNA, 17 bp, Homo sapiens
tatctccttcccacccc

SEQ ID NO: 5789052 - DNA, 23 bp, Homo sapiens
tatctccttcccacccctacaca

SEQ ID NO: 5789053 - DNA, 17 bp, Homo sapiens
tatctccttgtggccta

SEQ ID NO: 5789054 - DNA, 14 bp, Homo sapiens
tatctcctttgaag

SEQ ID NO: 5789055 - DNA, 14 bp, Homo sapiens
tatctcgaagtctt

SEQ ID NO: 5789056 - DNA, 16 bp, Homo sapiens
tatctcgtaatagctt

SEQ ID NO: 5789057 - DNA, 13 bp, Homo sapiens
tatctctaaaata

SEQ ID NO: 5789058 - DNA, 20 bp, Homo sapiens
tatctctaatgaaattgtga

SEQ ID NO: 5789059 - DNA, 18 bp, Homo sapiens
tatctctatttaatattt

SEQ ID NO: 5789060 - DNA, 20 bp, Homo sapiens
tatctctctctctttttgga

SEQ ID NO: 5789061 - DNA, 13 bp, Homo sapiens
tatctctctgcct

SEQ ID NO: 5789062 - DNA, 21 bp, Homo sapiens
tatctctctgtcttttttctc

SEQ ID NO: 5789063 - DNA, 15 bp, Homo sapiens
tatctctgaagcatg

SEQ ID NO: 5789064 - DNA, 14 bp, Homo sapiens
tatctctgaggcta

SEQ ID NO: 5789065 - DNA, 12 bp, Homo sapiens
tatctctggcct

SEQ ID NO: 5789066 - DNA, 14 bp, Homo sapiens
tatctctggcctcc

SEQ ID NO: 5789067 - DNA, 13 bp, Homo sapiens
tatctcttcagtc

SEQ ID NO: 5789068 - DNA, 14 bp, Homo sapiens
tatctcttcagtct

SEQ ID NO: 5789069 - DNA, 16 bp, Homo sapiens
tatctcttcagtctct

SEQ ID NO: 5789070 - DNA, 17 bp, Homo sapiens
tatctctttatatatgt

SEQ ID NO: 5789071 - DNA, 11 bp, Homo sapiens
tatctctttct

SEQ ID NO: 5789072 - DNA, 21 bp, Homo sapiens
tatctcttttatatttgtagg

SEQ ID NO: 5789073 - DNA, 22 bp, Homo sapiens
tatctcttttgaatccatgctt

SEQ ID NO: 5789074 - DNA, 12 bp, Homo sapiens
tatctgaaaact

SEQ ID NO: 5789075 - DNA, 13 bp, Homo sapiens
tatctgaaaactg

SEQ ID NO: 5789076 - DNA, 15 bp, Homo sapiens
tatctgaaaactgga

SEQ ID NO: 5789077 - DNA, 16 bp, Homo sapiens
tatctgaaaactggaa

SEQ ID NO: 5789078 - DNA, 17 bp, Homo sapiens
tatctgaaaggccagca

SEQ ID NO: 5789079 - DNA, 22 bp, Homo sapiens
tatctgaaaggccagcagctga

SEQ ID NO: 5789080 - DNA, 14 bp, Homo sapiens
tatctgaacattta

SEQ ID NO: 5789081 - DNA, 14 bp, Homo sapiens
tatctgaactaatt

SEQ ID NO: 5789082 - DNA, 19 bp, Homo sapiens
tatctgaagacctaccagg

SEQ ID NO: 5789083 - DNA, 19 bp, Homo sapiens
tatctgaagagtatccttc

SEQ ID NO: 5789084 - DNA, 16 bp, Homo sapiens
tatctgaagctagagg

SEQ ID NO: 5789085 - DNA, 20 bp, Homo sapiens
tatctgaaggaccccaggta

SEQ ID NO: 5789086 - DNA, 20 bp, Homo sapiens
tatctgaatagtgtcaccaa

SEQ ID NO: 5789087 - DNA, 16 bp, Homo sapiens
tatctgacacaagtgt

SEQ ID NO: 5789088 - DNA, 22 bp, Homo sapiens
tatctgacccactttgtaattt

SEQ ID NO: 5789089 - DNA, 12 bp, Homo sapiens
tatctgactgaa

SEQ ID NO: 5789090 - DNA, 16 bp, Homo sapiens
tatctgagaattgcaa

SEQ ID NO: 5789091 - DNA, 21 bp, Homo sapiens
tatctgagaccccaaactctc

SEQ ID NO: 5789092 - DNA, 23 bp, Homo sapiens
tatctgagcaataacttctatgt

SEQ ID NO: 5789093 - DNA, 20 bp, Homo sapiens
tatctgagctctttgcacta

SEQ ID NO: 5789094 - DNA, 16 bp, Homo sapiens
tatctgagctgagcca

SEQ ID NO: 5789095 - DNA, 17 bp, Homo sapiens
tatctgaggaattctgt

SEQ ID NO: 5789096 - DNA, 21 bp, Homo sapiens
tatctgaggaattctgtatag

SEQ ID NO: 5789097 - DNA, 17 bp, Homo sapiens
tatctgagggaggaggc

SEQ ID NO: 5789098 - DNA, 13 bp, Homo sapiens
tatctgaggtcac

SEQ ID NO: 5789099 - DNA, 14 bp, Homo sapiens
tatctgagttgtgc

SEQ ID NO: 5789100 - DNA, 23 bp, Homo sapiens
tatctgataaaattgtgatgttt

SEQ ID NO: 5789101 - DNA, 20 bp, Homo sapiens
tatctgatatgctgagaaat

SEQ ID NO: 5789102 - DNA, 22 bp, Homo sapiens
tatctgatatgctgagaaatta

SEQ ID NO: 5789103 - DNA, 16 bp, Homo sapiens
tatctgattttgtgca

SEQ ID NO: 5789104 - DNA, 19 bp, Homo sapiens
tatctgcaaatagtttcaa

SEQ ID NO: 5789105 - DNA, 16 bp, Homo sapiens
tatctgcacctagaac

SEQ ID NO: 5789106 - DNA, 11 bp, Homo sapiens
tatctgcagaa

SEQ ID NO: 5789107 - DNA, 12 bp, Homo sapiens
tatctgcagaac

SEQ ID NO: 5789108 - DNA, 10 bp, Homo sapiens
tatctgcagc

SEQ ID NO: 5789109 - DNA, 15 bp, Homo sapiens
tatctgcaggcagac

SEQ ID NO: 5789110 - DNA, 17 bp, Homo sapiens
tatctgcaggcagacac

SEQ ID NO: 5789111 - DNA, 21 bp, Homo sapiens
tatctgcaggcagacacggat

SEQ ID NO: 5789112 - DNA, 12 bp, Homo sapiens
tatctgcatgta

SEQ ID NO: 5789113 - DNA, 15 bp, Homo sapiens
tatctgcatgtgtca

SEQ ID NO: 5789114 - DNA, 22 bp, Homo sapiens
tatctgcatgtgtcatgaagaa

SEQ ID NO: 5789115 - DNA, 20 bp, Homo sapiens
tatctgcatttataaatgtg

SEQ ID NO: 5789116 - DNA, 22 bp, Homo sapiens
tatctgcatttataaatgtgtg

SEQ ID NO: 5789117 - DNA, 17 bp, Homo sapiens
tatctgccatgtccata

SEQ ID NO: 5789118 - DNA, 19 bp, Homo sapiens
tatctgcccacctcggcct

SEQ ID NO: 5789119 - DNA, 12 bp, Homo sapiens
tatctgccctcc

SEQ ID NO: 5789120 - DNA, 11 bp, Homo sapiens
tatctgcctgg

SEQ ID NO: 5789121 - DNA, 17 bp, Homo sapiens
tatctgccttatacatt

SEQ ID NO: 5789122 - DNA, 13 bp, Homo sapiens
tatctgcctttat

SEQ ID NO: 5789123 - DNA, 14 bp, Homo sapiens
tatctgcctttatt

SEQ ID NO: 5789124 - DNA, 23 bp, Homo sapiens
tatctgcggctttaaactgacag

SEQ ID NO: 5789125 - DNA, 16 bp, Homo sapiens
tatctgctataaactt

SEQ ID NO: 5789126 - DNA, 18 bp, Homo sapiens
tatctgctgcctctgaaa

SEQ ID NO: 5789127 - DNA, 19 bp, Homo sapiens
tatctgctgcctctgaaaa

SEQ ID NO: 5789128 - DNA, 22 bp, Homo sapiens
tatctgctgcctctgaaaatat

SEQ ID NO: 5789129 - DNA, 11 bp, Homo sapiens
tatctgctgtc

SEQ ID NO: 5789130 - DNA, 12 bp, Homo sapiens
tatctgctgtcc

SEQ ID NO: 5789131 - DNA, 12 bp, Homo sapiens
tatctgctgttc

SEQ ID NO: 5789132 - DNA, 20 bp, Homo sapiens
tatctgctgttccttcgagg

SEQ ID NO: 5789133 - DNA, 19 bp, Homo sapiens
tatctgctgttcttcagtc

SEQ ID NO: 5789134 - DNA, 20 bp, Homo sapiens
tatctgcttcagtggagaat

SEQ ID NO: 5789135 - DNA, 22 bp, Homo sapiens
tatctggaaaaaaaaaaatatg

SEQ ID NO: 5789136 - DNA, 19 bp, Homo sapiens
tatctggaagtaaccattt

SEQ ID NO: 5789137 - DNA, 20 bp, Homo sapiens
tatctggaagttgagactta

SEQ ID NO: 5789138 - DNA, 23 bp, Homo sapiens
tatctggaggccttccagctgct

SEQ ID NO: 5789139 - DNA, 16 bp, Homo sapiens
tatctggattcaaatt

SEQ ID NO: 5789140 - DNA, 19 bp, Homo sapiens
tatctggattcaaatttat

SEQ ID NO: 5789141 - DNA, 12 bp, Homo sapiens
tatctggcactg

SEQ ID NO: 5789142 - DNA, 13 bp, Homo sapiens
tatctggcactgt

SEQ ID NO: 5789143 - DNA, 19 bp, Homo sapiens
tatctggccacactgggct

SEQ ID NO: 5789144 - DNA, 16 bp, Homo sapiens
tatctggcgttctttg

SEQ ID NO: 5789145 - DNA, 16 bp, Homo sapiens
tatctggcttccctgg

SEQ ID NO: 5789146 - DNA, 23 bp, Homo sapiens
tatctgggaagctatttttttca

SEQ ID NO: 5789147 - DNA, 16 bp, Homo sapiens
tatctgggattattct

SEQ ID NO: 5789148 - DNA, 21 bp, Homo sapiens
tatctgggattattctttgaa

SEQ ID NO: 5789149 - DNA, 14 bp, Homo sapiens
tatctgggcctggg

SEQ ID NO: 5789150 - DNA, 16 bp, Homo sapiens
tatctgggcctgggct

SEQ ID NO: 5789151 - DNA, 17 bp, Homo sapiens
tatctgggtaagaagaa

SEQ ID NO: 5789152 - DNA, 21 bp, Homo sapiens
tatctgggtaagaagaaagca

SEQ ID NO: 5789153 - DNA, 19 bp, Homo sapiens
tatctgggtgcatgatctt

SEQ ID NO: 5789154 - DNA, 16 bp, Homo sapiens
tatctgggttttagaa

SEQ ID NO: 5789155 - DNA, 19 bp, Homo sapiens
tatctgggttttagaaatt

SEQ ID NO: 5789156 - DNA, 17 bp, Homo sapiens
tatctggtatatgtcat

SEQ ID NO: 5789157 - DNA, 15 bp, Homo sapiens
tatctggtatctgca

SEQ ID NO: 5789158 - DNA, 23 bp, Homo sapiens
tatctggtatggtgctaatattt

SEQ ID NO: 5789159 - DNA, 19 bp, Homo sapiens
tatctggtattaaatgcca

SEQ ID NO: 5789160 - DNA, 15 bp, Homo sapiens
tatctgtaaaaattg

SEQ ID NO: 5789161 - DNA, 15 bp, Homo sapiens
tatctgtaagagtgt

SEQ ID NO: 5789162 - DNA, 18 bp, Homo sapiens
tatctgtaagttttgaat

SEQ ID NO: 5789163 - DNA, 23 bp, Homo sapiens
tatctgtacatactttttcaaga

SEQ ID NO: 5789164 - DNA, 14 bp, Homo sapiens
tatctgtataagct

SEQ ID NO: 5789165 - DNA, 15 bp, Homo sapiens
tatctgtattggcag

SEQ ID NO: 5789166 - DNA, 23 bp, Homo sapiens
tatctgtattggcagcacagcta

SEQ ID NO: 5789167 - DNA, 12 bp, Homo sapiens
tatctgtattta

SEQ ID NO: 5789168 - DNA, 15 bp, Homo sapiens
tatctgtatttaatt

SEQ ID NO: 5789169 - DNA, 22 bp, Homo sapiens
tatctgtatttaattttgacac

SEQ ID NO: 5789170 - DNA, 16 bp, Homo sapiens
tatctgtattttcatt

SEQ ID NO: 5789171 - DNA, 17 bp, Homo sapiens
tatctgtccgtggaaaa

SEQ ID NO: 5789172 - DNA, 15 bp, Homo sapiens
tatctgtctgagccc

SEQ ID NO: 5789173 - DNA, 17 bp, Homo sapiens
tatctgtctgagccctg

SEQ ID NO: 5789174 - DNA, 21 bp, Homo sapiens
tatctgtctttatgatttcat

SEQ ID NO: 5789175 - DNA, 12 bp, Homo sapiens
tatctgtctttc

SEQ ID NO: 5789176 - DNA, 14 bp, Homo sapiens
tatctgtctttcca

SEQ ID NO: 5789177 - DNA, 14 bp, Homo sapiens
tatctgtgaacgtg

SEQ ID NO: 5789178 - DNA, 14 bp, Homo sapiens
tatctgtgatggat

SEQ ID NO: 5789179 - DNA, 20 bp, Homo sapiens
tatctgtgatggatggacac

SEQ ID NO: 5789180 - DNA, 22 bp, Homo sapiens
tatctgtgctcaggactcagaa

SEQ ID NO: 5789181 - DNA, 16 bp, Homo sapiens
tatctgtgcttctaat

SEQ ID NO: 5789182 - DNA, 19 bp, Homo sapiens
tatctgtgcttctaatatt

SEQ ID NO: 5789183 - DNA, 21 bp, Homo sapiens
tatctgtggagttcctgctcc

SEQ ID NO: 5789184 - DNA, 11 bp, Homo sapiens
tatctgtggga

SEQ ID NO: 5789185 - DNA, 13 bp, Homo sapiens
tatctgtggtctt

SEQ ID NO: 5789186 - DNA, 21 bp, Homo sapiens
tatctgtgtaagacacgtgca

SEQ ID NO: 5789187 - DNA, 20 bp, Homo sapiens
tatctgtgtgccctagggct

SEQ ID NO: 5789188 - DNA, 22 bp, Homo sapiens
tatctgtgtgccctagggctca

SEQ ID NO: 5789189 - DNA, 23 bp, Homo sapiens
tatctgtgtgccctagggctcag

SEQ ID NO: 5789190 - DNA, 17 bp, Homo sapiens
tatctgtgtttttgaaa

SEQ ID NO: 5789191 - DNA, 15 bp, Homo sapiens
tatctgttaaccaaa

SEQ ID NO: 5789192 - DNA, 21 bp, Homo sapiens
tatctgttactccaaaaagaa

SEQ ID NO: 5789193 - DNA, 12 bp, Homo sapiens
tatctgttctat

SEQ ID NO: 5789194 - DNA, 17 bp, Homo sapiens
tatctgtttacagtgtt

SEQ ID NO: 5789195 - DNA, 16 bp, Homo sapiens
tatctgtttattctgg

SEQ ID NO: 5789196 - DNA, 18 bp, Homo sapiens
tatgcagaaatagacaaa

SEQ ID NO: 5789197 - DNA, 21 bp, Homo sapiens
tatgcagaaatagacaaaaag

SEQ ID NO: 5789198 - DNA, 15 bp, Homo sapiens
tatgcagaacaggca

SEQ ID NO: 5789199 - DNA, 20 bp, Homo sapiens
tatgcagaacgtatttagcc

SEQ ID NO: 5789200 - DNA, 14 bp, Homo sapiens
tatgcagaatgttt

SEQ ID NO: 5789201 - DNA, 17 bp, Homo sapiens
tatgcagacagtctgtt

SEQ ID NO: 5789202 - DNA, 19 bp, Homo sapiens
tatgcagagacagctgttt

SEQ ID NO: 5789203 - DNA, 18 bp, Homo sapiens
tatgcagcatacaaaaat

SEQ ID NO: 5789204 - DNA, 20 bp, Homo sapiens
tatgcagcatacaaaaatat

SEQ ID NO: 5789205 - DNA, 21 bp, Homo sapiens
tatgcagcttggagacaggat

SEQ ID NO: 5789206 - DNA, 22 bp, Homo sapiens
tatgcagcttggagacaggatt

SEQ ID NO: 5789207 - DNA, 19 bp, Homo sapiens
tatgcaggcagattaataa

SEQ ID NO: 5789208 - DNA, 17 bp, Homo sapiens
tatgcaggcagcacagc

SEQ ID NO: 5789209 - DNA, 13 bp, Homo sapiens
tatgcagggagca

SEQ ID NO: 5789210 - DNA, 22 bp, Homo sapiens
tatgcaggggcaaacacctgct

SEQ ID NO: 5789211 - DNA, 20 bp, Homo sapiens
tatgcagtctctttatttta

SEQ ID NO: 5789212 - DNA, 22 bp, Homo sapiens
tatgcagtctctttattttact

SEQ ID NO: 5789213 - DNA, 12 bp, Homo sapiens
tatgcagtgaac

SEQ ID NO: 5789214 - DNA, 14 bp, Homo sapiens
tatgcagtgaacta

SEQ ID NO: 5789215 - DNA, 16 bp, Homo sapiens
tatgcagtgaactatt

SEQ ID NO: 5789216 - DNA, 18 bp, Homo sapiens
tatgcagtgtagatttta

SEQ ID NO: 5789217 - DNA, 13 bp, Homo sapiens
tatgcagtgtttc

SEQ ID NO: 5789218 - DNA, 22 bp, Homo sapiens
tatgcagttgataagaggaatt

SEQ ID NO: 5789219 - DNA, 17 bp, Homo sapiens
tatgcagtttttcagag

SEQ ID NO: 5789220 - DNA, 18 bp, Homo sapiens
tatgcataaaaaaatgat

SEQ ID NO: 5789221 - DNA, 22 bp, Homo sapiens
tatgcataatcagcgccctgga

SEQ ID NO: 5789222 - DNA, 23 bp, Homo sapiens
tatgcatacaaatctcactgtat

SEQ ID NO: 5789223 - DNA, 23 bp, Homo sapiens
tatgcatactaatttttgcttaa

SEQ ID NO: 5789224 - DNA, 13 bp, Homo sapiens
tatgcatatatat

SEQ ID NO: 5789225 - DNA, 17 bp, Homo sapiens
tatgcatatatatatgt

SEQ ID NO: 5789226 - DNA, 20 bp, Homo sapiens
tatgcatatatatatgtgtg

SEQ ID NO: 5789227 - DNA, 15 bp, Homo sapiens
tatgcatatatatgt

SEQ ID NO: 5789228 - DNA, 22 bp, Homo sapiens
tatgcatatattttagggctgt

SEQ ID NO: 5789229 - DNA, 22 bp, Homo sapiens
tatgcatatttatagagttatt

SEQ ID NO: 5789230 - DNA, 12 bp, Homo sapiens
tatgcatcagat

SEQ ID NO: 5789231 - DNA, 21 bp, Homo sapiens
tatgcatcagataacaactgt

SEQ ID NO: 5789232 - DNA, 17 bp, Homo sapiens
tatgcatctaataaaaa

SEQ ID NO: 5789233 - DNA, 19 bp, Homo sapiens
tatgcatctttgagaatat

SEQ ID NO: 5789234 - DNA, 14 bp, Homo sapiens
tatgcatgccaggc

SEQ ID NO: 5789235 - DNA, 18 bp, Homo sapiens
tatgcatggtgccccagg

SEQ ID NO: 5789236 - DNA, 21 bp, Homo sapiens
tatgcatggtgccccaggacc

SEQ ID NO: 5789237 - DNA, 17 bp, Homo sapiens
tatgcatggtttcagca

SEQ ID NO: 5789238 - DNA, 11 bp, Homo sapiens
tatgcatgtag

SEQ ID NO: 5789239 - DNA, 20 bp, Homo sapiens
tatgcatgtagcatataaat

SEQ ID NO: 5789240 - DNA, 15 bp, Homo sapiens
tatgcatgtgaagaa

SEQ ID NO: 5789241 - DNA, 17 bp, Homo sapiens
tatgcattattaaattg

SEQ ID NO: 5789242 - DNA, 15 bp, Homo sapiens
tatgcattcttataa

SEQ ID NO: 5789243 - DNA, 19 bp, Homo sapiens
tatgcattctttatagtga

SEQ ID NO: 5789244 - DNA, 15 bp, Homo sapiens
tatgcatttatgcat

SEQ ID NO: 5789245 - DNA, 18 bp, Homo sapiens
tatgcatttatgcatgag

SEQ ID NO: 5789246 - DNA, 22 bp, Homo sapiens
tatgcatttatgcatgagaact

SEQ ID NO: 5789247 - DNA, 20 bp, Homo sapiens
tatgcatttcaatttcaatg

SEQ ID NO: 5789248 - DNA, 23 bp, Homo sapiens
tatgcatttgaaaattttgatgt

SEQ ID NO: 5789249 - DNA, 14 bp, Homo sapiens
tatgcattttcttc

SEQ ID NO: 5789250 - DNA, 21 bp, Homo sapiens
tatgcattttcttcacagtgc

SEQ ID NO: 5789251 - DNA, 14 bp, Homo sapiens
tatgcatttttaat

SEQ ID NO: 5789252 - DNA, 15 bp, Homo sapiens
tatgcatttttaata

SEQ ID NO: 5789253 - DNA, 14 bp, Homo sapiens
tatgccaaagatca

SEQ ID NO: 5789254 - DNA, 19 bp, Homo sapiens
tatgccacccccgctggag

SEQ ID NO: 5789255 - DNA, 20 bp, Homo sapiens
tatgccacctgaataaagaa

SEQ ID NO: 5789256 - DNA, 20 bp, Homo sapiens
tatgccacttccttttaact

SEQ ID NO: 5789257 - DNA, 22 bp, Homo sapiens
tatgccagggcgcactttccac

SEQ ID NO: 5789258 - DNA, 16 bp, Homo sapiens
tatgccagtgactgct

SEQ ID NO: 5789259 - DNA, 23 bp, Homo sapiens
tatgccagtgactgctgcgctgt

SEQ ID NO: 5789260 - DNA, 13 bp, Homo sapiens
tatgccatagaaa

SEQ ID NO: 5789261 - DNA, 14 bp, Homo sapiens
tatgccatttgttt

SEQ ID NO: 5789262 - DNA, 15 bp, Homo sapiens
tatgcccacataccc

SEQ ID NO: 5789263 - DNA, 15 bp, Homo sapiens
tatgcccacatttag

SEQ ID NO: 5789264 - DNA, 18 bp, Homo sapiens
tatgcccacatttagtct

SEQ ID NO: 5789265 - DNA, 19 bp, Homo sapiens
tatgccccaccaaggctga

SEQ ID NO: 5789266 - DNA, 16 bp, Homo sapiens
tatgccctgcagagca

SEQ ID NO: 5789267 - DNA, 20 bp, Homo sapiens
tatgccctgcagagcaataa

SEQ ID NO: 5789268 - DNA, 12 bp, Homo sapiens
tatgccctgccc

SEQ ID NO: 5789269 - DNA, 17 bp, Homo sapiens
tatgccgtctcatattt

SEQ ID NO: 5789270 - DNA, 22 bp, Homo sapiens
tatgccgttacttttcatattt

SEQ ID NO: 5789271 - DNA, 20 bp, Homo sapiens
tatgcctacttgtaatttct

SEQ ID NO: 5789272 - DNA, 19 bp, Homo sapiens
tatgcctcacaaatgctgt

SEQ ID NO: 5789273 - DNA, 13 bp, Homo sapiens
tatgcctccattt

SEQ ID NO: 5789274 - DNA, 18 bp, Homo sapiens
tatgcctctcctttgtat

SEQ ID NO: 5789275 - DNA, 20 bp, Homo sapiens
tatgcctctcctttgtatat

SEQ ID NO: 5789276 - DNA, 21 bp, Homo sapiens
tatgcctctcctttgtatatt

SEQ ID NO: 5789277 - DNA, 13 bp, Homo sapiens
tatgcctgaatga

SEQ ID NO: 5789278 - DNA, 13 bp, Homo sapiens
tatgcctgacccc

SEQ ID NO: 5789279 - DNA, 21 bp, Homo sapiens
tatgcctgcactgggaaggaa

SEQ ID NO: 5789280 - DNA, 22 bp, Homo sapiens
tatgcctgcactgggaaggaaa

SEQ ID NO: 5789281 - DNA, 14 bp, Homo sapiens
tatgcctgctattt

SEQ ID NO: 5789282 - DNA, 18 bp, Homo sapiens
tatgcctgctatttgaag

SEQ ID NO: 5789283 - DNA, 16 bp, Homo sapiens
tatgcctgctctttgg

SEQ ID NO: 5789284 - DNA, 12 bp, Homo sapiens
tatgcctgtact

SEQ ID NO: 5789285 - DNA, 12 bp, Homo sapiens
tatgcctgtatt

SEQ ID NO: 5789286 - DNA, 10 bp, Homo sapiens
tatgcctgtg

SEQ ID NO: 5789287 - DNA, 12 bp, Homo sapiens
tatgcctgtggt

SEQ ID NO: 5789288 - DNA, 14 bp, Homo sapiens
tatgcctgtggtga

SEQ ID NO: 5789289 - DNA, 18 bp, Homo sapiens
tatgcctgttgcaggcaa

SEQ ID NO: 5789290 - DNA, 17 bp, Homo sapiens
tatgccttaagcagaac

SEQ ID NO: 5789291 - DNA, 16 bp, Homo sapiens
tatgccttaatttaga

SEQ ID NO: 5789292 - DNA, 14 bp, Homo sapiens
tatgccttctgtat

SEQ ID NO: 5789293 - DNA, 19 bp, Homo sapiens
tatgccttcttattgcttt

SEQ ID NO: 5789294 - DNA, 14 bp, Homo sapiens
tatgccttgtataa

SEQ ID NO: 5789295 - DNA, 16 bp, Homo sapiens
tatgcctttaaatctg

SEQ ID NO: 5789296 - DNA, 14 bp, Homo sapiens
tatgcctttctctc

SEQ ID NO: 5789297 - DNA, 20 bp, Homo sapiens
tatgcctttgatgtattttc

SEQ ID NO: 5789298 - DNA, 13 bp, Homo sapiens
tatgccttttgta

SEQ ID NO: 5789299 - DNA, 21 bp, Homo sapiens
tatgccttttgtagctgtcat

SEQ ID NO: 5789300 - DNA, 17 bp, Homo sapiens
tatgctaaaatacattt

SEQ ID NO: 5789301 - DNA, 20 bp, Homo sapiens
tatgctaaacctcctgcctc

SEQ ID NO: 5789302 - DNA, 17 bp, Homo sapiens
tatgctaaactgtgaaa

SEQ ID NO: 5789303 - DNA, 22 bp, Homo sapiens
tatgctaaattaattacaatta

SEQ ID NO: 5789304 - DNA, 16 bp, Homo sapiens
tatgctaagaattttt

SEQ ID NO: 5789305 - DNA, 19 bp, Homo sapiens
tatgctaatttttggagaa

SEQ ID NO: 5789306 - DNA, 15 bp, Homo sapiens
tatgctaccaccagc

SEQ ID NO: 5789307 - DNA, 21 bp, Homo sapiens
tatgctacccttaataacata

SEQ ID NO: 5789308 - DNA, 24 bp, Homo sapiens
tatgctagaggcttttattagaaa

SEQ ID NO: 5789309 - DNA, 20 bp, Homo sapiens
tatgctagtttattggaagt

SEQ ID NO: 5789310 - DNA, 15 bp, Homo sapiens
tatgctatttctata

SEQ ID NO: 5789311 - DNA, 18 bp, Homo sapiens
tatgctatttctatattt

SEQ ID NO: 5789312 - DNA, 22 bp, Homo sapiens
tatgctatttctatattttcat

SEQ ID NO: 5789313 - DNA, 23 bp, Homo sapiens
tatgctatttctatattttcatt

SEQ ID NO: 5789314 - DNA, 19 bp, Homo sapiens
tatgctatttctggcctca

SEQ ID NO: 5789315 - DNA, 14 bp, Homo sapiens
tatgctatttctgt

SEQ ID NO: 5789316 - DNA, 19 bp, Homo sapiens
tatgctctgcatgttacat

SEQ ID NO: 5789317 - DNA, 16 bp, Homo sapiens
tatgctcttaattgcc

SEQ ID NO: 5789318 - DNA, 21 bp, Homo sapiens
tatgctcttgaaatattcaga

SEQ ID NO: 5789319 - DNA, 22 bp, Homo sapiens
tatgctgagtatgttaagctct

SEQ ID NO: 5789320 - DNA, 20 bp, Homo sapiens
tatgctgatcttttaaaatc

SEQ ID NO: 5789321 - DNA, 21 bp, Homo sapiens
tatgctgatcttttaaaatca

SEQ ID NO: 5789322 - DNA, 19 bp, Homo sapiens
tatgctgcaacaaaatgta

SEQ ID NO: 5789323 - DNA, 22 bp, Homo sapiens
tatgctgcatttggctggagcc

SEQ ID NO: 5789324 - DNA, 19 bp, Homo sapiens
tatgctggccagcaccctc

SEQ ID NO: 5789325 - DNA, 17 bp, Homo sapiens
tatgctggcttgtacat

SEQ ID NO: 5789326 - DNA, 21 bp, Homo sapiens
tatgctggggtacacagtgag

SEQ ID NO: 5789327 - DNA, 21 bp, Homo sapiens
tatgctggtgaaaacaatttt

SEQ ID NO: 5789328 - DNA, 16 bp, Homo sapiens
tatgctgtaaaagcaa

SEQ ID NO: 5789329 - DNA, 14 bp, Homo sapiens
tatgctgtatgaat

SEQ ID NO: 5789330 - DNA, 17 bp, Homo sapiens
tatgctgtatttctttg

SEQ ID NO: 5789331 - DNA, 16 bp, Homo sapiens
tatgctgtattttctt

SEQ ID NO: 5789332 - DNA, 15 bp, Homo sapiens
tatgctgtgtttatg

SEQ ID NO: 5789333 - DNA, 18 bp, Homo sapiens
tatgctgttatgtccaga

SEQ ID NO: 5789334 - DNA, 15 bp, Homo sapiens
tatgctgttcattga

SEQ ID NO: 5789335 - DNA, 24 bp, Homo sapiens
tatgctgtttgtacaaactatttc

SEQ ID NO: 5789336 - DNA, 15 bp, Homo sapiens
tatgcttaaaatatg

SEQ ID NO: 5789337 - DNA, 20 bp, Homo sapiens
tatgcttaataaaagaacat

SEQ ID NO: 5789338 - DNA, 19 bp, Homo sapiens
tatgcttactaaatcttca

SEQ ID NO: 5789339 - DNA, 21 bp, Homo sapiens
tatgcttactgatatatttta

SEQ ID NO: 5789340 - DNA, 18 bp, Homo sapiens
tatgcttactgtgcacct

SEQ ID NO: 5789341 - DNA, 17 bp, Homo sapiens
tatgcttagtaatgcta

SEQ ID NO: 5789342 - DNA, 18 bp, Homo sapiens
tatgcttatacactgttg

SEQ ID NO: 5789343 - DNA, 20 bp, Homo sapiens
tatgcttatattgttcactt

SEQ ID NO: 5789344 - DNA, 13 bp, Homo sapiens
tatgcttcataca

SEQ ID NO: 5789345 - DNA, 17 bp, Homo sapiens
tatgcttcatacaggga

SEQ ID NO: 5789346 - DNA, 18 bp, Homo sapiens
tatgcttccacaggcaaa

SEQ ID NO: 5789347 - DNA, 13 bp, Homo sapiens
tatgcttctttca

SEQ ID NO: 5789348 - DNA, 18 bp, Homo sapiens
tatgcttgtaactaaaat

SEQ ID NO: 5789349 - DNA, 15 bp, Homo sapiens
tatgctttaaacatt

SEQ ID NO: 5789350 - DNA, 22 bp, Homo sapiens
tatgctttcacttcccacctct

SEQ ID NO: 5789351 - DNA, 18 bp, Homo sapiens
tatgctttccctgaggaa

SEQ ID NO: 5789352 - DNA, 21 bp, Homo sapiens
tatgctttccttctttgggat

SEQ ID NO: 5789353 - DNA, 15 bp, Homo sapiens
tatgctttcttcatg

SEQ ID NO: 5789354 - DNA, 19 bp, Homo sapiens
tatgcttttagagttgcaa

SEQ ID NO: 5789355 - DNA, 19 bp, Homo sapiens
tatggaaaaaagcccagca

SEQ ID NO: 5789356 - DNA, 21 bp, Homo sapiens
tatggaaaaaccatttgaagt

SEQ ID NO: 5789357 - DNA, 20 bp, Homo sapiens
tatggaaaaattgacaaaaa

SEQ ID NO: 5789358 - DNA, 15 bp, Homo sapiens
tatggaaaactgtgt

SEQ ID NO: 5789359 - DNA, 12 bp, Homo sapiens
tatggaaacaga

SEQ ID NO: 5789360 - DNA, 13 bp, Homo sapiens
tatggaaacattt

SEQ ID NO: 5789361 - DNA, 22 bp, Homo sapiens
tatggaaacattttatactgta

SEQ ID NO: 5789362 - DNA, 17 bp, Homo sapiens
tatggaaacccgagggt

SEQ ID NO: 5789363 - DNA, 16 bp, Homo sapiens
tatggaaagggtgtgg

SEQ ID NO: 5789364 - DNA, 15 bp, Homo sapiens
tatggaaatacattt

SEQ ID NO: 5789365 - DNA, 16 bp, Homo sapiens
tatggaaatacattta

SEQ ID NO: 5789366 - DNA, 13 bp, Homo sapiens
tatggaaatatat

SEQ ID NO: 5789367 - DNA, 16 bp, Homo sapiens
tatggaaatgcaaact

SEQ ID NO: 5789368 - DNA, 20 bp, Homo sapiens
tatggaaatgtgagaaatgt

SEQ ID NO: 5789369 - DNA, 14 bp, Homo sapiens
tatggaaatgttac

SEQ ID NO: 5789370 - DNA, 18 bp, Homo sapiens
tatggaacactctgagac

SEQ ID NO: 5789371 - DNA, 20 bp, Homo sapiens
tatggaacataaagttgtat

SEQ ID NO: 5789372 - DNA, 15 bp, Homo sapiens
tatggaacgcatttt

SEQ ID NO: 5789373 - DNA, 23 bp, Homo sapiens
tatgtatttaagatgtacattta

SEQ ID NO: 5789374 - DNA, 12 bp, Homo sapiens
tatgtatttata

SEQ ID NO: 5789375 - DNA, 21 bp, Homo sapiens
tatgtatttattgtcattact

SEQ ID NO: 5789376 - DNA, 14 bp, Homo sapiens
tatgtatttcattg

SEQ ID NO: 5789377 - DNA, 15 bp, Homo sapiens
tatgtatttcattgc

SEQ ID NO: 5789378 - DNA, 13 bp, Homo sapiens
tatgtatttgttg

SEQ ID NO: 5789379 - DNA, 14 bp, Homo sapiens
tatgtattttatgt

SEQ ID NO: 5789380 - DNA, 20 bp, Homo sapiens
tatgtattttgaaaaagaga

SEQ ID NO: 5789381 - DNA, 16 bp, Homo sapiens
tatgtattttttgaat

SEQ ID NO: 5789382 - DNA, 18 bp, Homo sapiens
tatgtattttttgaatct

SEQ ID NO: 5789383 - DNA, 23 bp, Homo sapiens
tatgtcaaaaatatttttatgtg

SEQ ID NO: 5789384 - DNA, 23 bp, Homo sapiens
tatgtcaaatggagctgaatttg

SEQ ID NO: 5789385 - DNA, 20 bp, Homo sapiens
tatgtcaaatggatgtaata

SEQ ID NO: 5789386 - DNA, 21 bp, Homo sapiens
tatgtcaaattgtgcaaaata

SEQ ID NO: 5789387 - DNA, 22 bp, Homo sapiens
tatgtcaaattgtgcaaaatat

SEQ ID NO: 5789388 - DNA, 23 bp, Homo sapiens
tatgtcaagggcagctttgctca

SEQ ID NO: 5789389 - DNA, 21 bp, Homo sapiens
tatgtcaattcattaataaaa

SEQ ID NO: 5789390 - DNA, 16 bp, Homo sapiens
tatgtcaatttgtata

SEQ ID NO: 5789391 - DNA, 20 bp, Homo sapiens
tatgtcaatttgtatatcat

SEQ ID NO: 5789392 - DNA, 23 bp, Homo sapiens
tatgtcaccataatgaacaattg

SEQ ID NO: 5789393 - DNA, 19 bp, Homo sapiens
tatgtcagaaaaaatatgt

SEQ ID NO: 5789394 - DNA, 20 bp, Homo sapiens
tatgtcagacatgaaaacta

SEQ ID NO: 5789395 - DNA, 17 bp, Homo sapiens
tatgtcagtccaataaa

SEQ ID NO: 5789396 - DNA, 21 bp, Homo sapiens
tatgtcagtgctataaatgcc

SEQ ID NO: 5789397 - DNA, 16 bp, Homo sapiens
tatgtcagtggtttct

SEQ ID NO: 5789398 - DNA, 22 bp, Homo sapiens
tatgtcatgtcttccattaaga

SEQ ID NO: 5789399 - DNA, 15 bp, Homo sapiens
tatgtcattatttat

SEQ ID NO: 5789400 - DNA, 18 bp, Homo sapiens
tatgtcattatttattgt

SEQ ID NO: 5789401 - DNA, 17 bp, Homo sapiens
tatgtcatttattttgt

SEQ ID NO: 5789402 - DNA, 16 bp, Homo sapiens
tatgtcatttcatgtc

SEQ ID NO: 5789403 - DNA, 23 bp, Homo sapiens
tatgtcatttccttcaaggcatc

SEQ ID NO: 5789404 - DNA, 14 bp, Homo sapiens
tatgtccagaaatt

SEQ ID NO: 5789405 - DNA, 23 bp, Homo sapiens
tatgtccagaaattgtgtgtgca

SEQ ID NO: 5789406 - DNA, 19 bp, Homo sapiens
tatgtccagaagagtcaaa

SEQ ID NO: 5789407 - DNA, 22 bp, Homo sapiens
tatgtccagatgtgcaggctcc

SEQ ID NO: 5789408 - DNA, 19 bp, Homo sapiens
tatgtccagctagccaact

SEQ ID NO: 5789409 - DNA, 13 bp, Homo sapiens
tatgtccaggtgt

SEQ ID NO: 5789410 - DNA, 15 bp, Homo sapiens
tatgtccatccatat

SEQ ID NO: 5789411 - DNA, 22 bp, Homo sapiens
tatgtccccccctaactttctt

SEQ ID NO: 5789412 - DNA, 13 bp, Homo sapiens
tatgtcctaagga

SEQ ID NO: 5789413 - DNA, 18 bp, Homo sapiens
tatgtcctattcattcac

SEQ ID NO: 5789414 - DNA, 23 bp, Homo sapiens
tatgtcctccaccacaagagctc

SEQ ID NO: 5789415 - DNA, 13 bp, Homo sapiens
tatgtcctgtcat

SEQ ID NO: 5789416 - DNA, 18 bp, Homo sapiens
tatgtcctgtgagatgtg

SEQ ID NO: 5789417 - DNA, 21 bp, Homo sapiens
tatgtccttgggttgctggtt

SEQ ID NO: 5789418 - DNA, 18 bp, Homo sapiens
tatgtcgagagctggcca

SEQ ID NO: 5789419 - DNA, 12 bp, Homo sapiens
tatgtctaaaga

SEQ ID NO: 5789420 - DNA, 15 bp, Homo sapiens
tatgtctataagtat

SEQ ID NO: 5789421 - DNA, 20 bp, Homo sapiens
tatgtctataagtatataaa

SEQ ID NO: 5789422 - DNA, 13 bp, Homo sapiens
tatgtctatgtgt

SEQ ID NO: 5789423 - DNA, 16 bp, Homo sapiens
tatgtctatgtgtata

SEQ ID NO: 5789424 - DNA, 22 bp, Homo sapiens
tatgtctcacagggacccacat

SEQ ID NO: 5789425 - DNA, 15 bp, Homo sapiens
tatgtctcatgtttt

SEQ ID NO: 5789426 - DNA, 14 bp, Homo sapiens
tatgtctcttctga

SEQ ID NO: 5789427 - DNA, 13 bp, Homo sapiens
tatgtctcttgtt

SEQ ID NO: 5789428 - DNA, 14 bp, Homo sapiens
tatgtctgccatgt

SEQ ID NO: 5789429 - DNA, 12 bp, Homo sapiens
tatgtctgcctt

SEQ ID NO: 5789430 - DNA, 20 bp, Homo sapiens
tatgtctgccttaggctgct

SEQ ID NO: 5789431 - DNA, 22 bp, Homo sapiens
tatgtctgctgagttggcctgg

SEQ ID NO: 5789432 - DNA, 17 bp, Homo sapiens
tatgtctggttctcaat

SEQ ID NO: 5789433 - DNA, 18 bp, Homo sapiens
tatgtctggttctcaatt

SEQ ID NO: 5789434 - DNA, 14 bp, Homo sapiens
tatgtctgtgccat

SEQ ID NO: 5789435 - DNA, 12 bp, Homo sapiens
tatgtctgtgta

SEQ ID NO: 5789436 - DNA, 15 bp, Homo sapiens
tatgtctgtgtgtgt

SEQ ID NO: 5789437 - DNA, 13 bp, Homo sapiens
tatgtctgtttaa

SEQ ID NO: 5789438 - DNA, 14 bp, Homo sapiens
tatgtctgtttaag

SEQ ID NO: 5789439 - DNA, 18 bp, Homo sapiens
tatgtctgtttaagaaaa

SEQ ID NO: 5789440 - DNA, 20 bp, Homo sapiens
tatgtctgtttaagaaaagt

SEQ ID NO: 5789441 - DNA, 16 bp, Homo sapiens
tatgtctgtttttgta

SEQ ID NO: 5789442 - DNA, 21 bp, Homo sapiens
tatgtcttgcaaagcctttaa

SEQ ID NO: 5789443 - DNA, 12 bp, Homo sapiens
tatgtctttaaa

SEQ ID NO: 5789444 - DNA, 21 bp, Homo sapiens
tatgtcttttaataaaaagga

SEQ ID NO: 5789445 - DNA, 20 bp, Homo sapiens
tatgtctttttttttctttt

SEQ ID NO: 5789446 - DNA, 13 bp, Homo sapiens
tatgtgaaaagat

SEQ ID NO: 5789447 - DNA, 14 bp, Homo sapiens
tatgtgaaacatgt

SEQ ID NO: 5789448 - DNA, 14 bp, Homo sapiens
tatgtgaaaggata

SEQ ID NO: 5789449 - DNA, 20 bp, Homo sapiens
tatgtgaacaaatcaaattg

SEQ ID NO: 5789450 - DNA, 22 bp, Homo sapiens
tatgtgaactttctcagcatat

SEQ ID NO: 5789451 - DNA, 12 bp, Homo sapiens
tatgtgaagaaa

SEQ ID NO: 5789452 - DNA, 18 bp, Homo sapiens
tatgtgaagaaaaagacc

SEQ ID NO: 5789453 - DNA, 23 bp, Homo sapiens
tatgtgaagaaaaagacctgcat

SEQ ID NO: 5789454 - DNA, 12 bp, Homo sapiens
tatgtgaagaat

SEQ ID NO: 5789455 - DNA, 17 bp, Homo sapiens
tatgtgaagaatttaga

SEQ ID NO: 5789456 - DNA, 17 bp, Homo sapiens
tatgtgaagatataagt

SEQ ID NO: 5789457 - DNA, 13 bp, Homo sapiens
tatgtgaagtttt

SEQ ID NO: 5789458 - DNA, 21 bp, Homo sapiens
tatgtgaatcctcttctttat

SEQ ID NO: 5789459 - DNA, 21 bp, Homo sapiens
tatgtgaattgaagtcatcat

SEQ ID NO: 5789460 - DNA, 18 bp, Homo sapiens
tatgtgaatttttaagct

SEQ ID NO: 5789461 - DNA, 14 bp, Homo sapiens
tatgtgacaacatt

SEQ ID NO: 5789462 - DNA, 15 bp, Homo sapiens
tatgtgacaaccttt

SEQ ID NO: 5789463 - DNA, 20 bp, Homo sapiens
tatgtgacatttctcttccc

SEQ ID NO: 5789464 - DNA, 21 bp, Homo sapiens
tatgtgacattttacattaaa

SEQ ID NO: 5789465 - DNA, 19 bp, Homo sapiens
tatgtgagaaatcagaatt

SEQ ID NO: 5789466 - DNA, 16 bp, Homo sapiens
tatgtgagatttcctt

SEQ ID NO: 5789467 - DNA, 19 bp, Homo sapiens
tatgtgagattttttattg

SEQ ID NO: 5789468 - DNA, 22 bp, Homo sapiens
tatgtgagattttttattgcta

SEQ ID NO: 5789469 - DNA, 23 bp, Homo sapiens
tatgtgagctgtaaaaatgttac

SEQ ID NO: 5789470 - DNA, 20 bp, Homo sapiens
tatgtgagtagtcttatgta

SEQ ID NO: 5789471 - DNA, 21 bp, Homo sapiens
tatgtgagtagtcttatgtaa

SEQ ID NO: 5789472 - DNA, 16 bp, Homo sapiens
tatgtgagtgcctttt

SEQ ID NO: 5789473 - DNA, 23 bp, Homo sapiens
tatgtgagtgccttttgcagaag

SEQ ID NO: 5789474 - DNA, 18 bp, Homo sapiens
tatgtgagtttcagaaat

SEQ ID NO: 5789475 - DNA, 13 bp, Homo sapiens
tatgtgatatgtt

SEQ ID NO: 5789476 - DNA, 19 bp, Homo sapiens
tatgtgatctgtcttgtaa

SEQ ID NO: 5789477 - DNA, 17 bp, Homo sapiens
tatgtgattatcattta

SEQ ID NO: 5789478 - DNA, 18 bp, Homo sapiens
tatgtgattttaactctg

SEQ ID NO: 5789479 - DNA, 19 bp, Homo sapiens
tatgtgattttaactctgt

SEQ ID NO: 5789480 - DNA, 21 bp, Homo sapiens
tatgtgattttaactctgtct

SEQ ID NO: 5789481 - DNA, 22 bp, Homo sapiens
tatgtgattttttttcccattt

SEQ ID NO: 5789482 - DNA, 19 bp, Homo sapiens
tatgtgcacatgtgtctgt

SEQ ID NO: 5789483 - DNA, 23 bp, Homo sapiens
tatgtgcactaccatagctacat

SEQ ID NO: 5789484 - DNA, 17 bp, Homo sapiens
tatgtgcactgcctgca

SEQ ID NO: 5789485 - DNA, 20 bp, Homo sapiens
tatgtgcactgtcactttgc

SEQ ID NO: 5789486 - DNA, 14 bp, Homo sapiens
tatgtgcagtattt

SEQ ID NO: 5789487 - DNA, 14 bp, Homo sapiens
tatgtgcatttaat

SEQ ID NO: 5789488 - DNA, 21 bp, Homo sapiens
tatgtgccaaagtccatttat

SEQ ID NO: 5789489 - DNA, 19 bp, Homo sapiens
tatgtgccaattttgtcac

SEQ ID NO: 5789490 - DNA, 19 bp, Homo sapiens
tatgtgccagatttatgca

SEQ ID NO: 5789491 - DNA, 23 bp, Homo sapiens
tatgtgccagatttatgcatatt

SEQ ID NO: 5789492 - DNA, 13 bp, Homo sapiens
tatgtgccaggct

SEQ ID NO: 5789493 - DNA, 17 bp, Homo sapiens
tatgtgccaggcttgcc

SEQ ID NO: 5789494 - DNA, 17 bp, Homo sapiens
tatgtgccagttcctgt

SEQ ID NO: 5789495 - DNA, 22 bp, Homo sapiens
tatgtgccttctagaatacata

SEQ ID NO: 5789496 - DNA, 18 bp, Homo sapiens
tatgtgcgtctctctttc

SEQ ID NO: 5789497 - DNA, 19 bp, Homo sapiens
tatgtgctagaacaatggg

SEQ ID NO: 5789498 - DNA, 17 bp, Homo sapiens
tatgtgctatggagagg

SEQ ID NO: 5789499 - DNA, 18 bp, Homo sapiens
tatgtgcttgtgtgtatg

SEQ ID NO: 5789500 - DNA, 14 bp, Homo sapiens
tatgtggaagtata

SEQ ID NO: 5789501 - DNA, 16 bp, Homo sapiens
tatgtggaataataca

SEQ ID NO: 5789502 - DNA, 17 bp, Homo sapiens
tatgtggatacagtcat

SEQ ID NO: 5789503 - DNA, 16 bp, Homo sapiens
tatgtggcaaaacata

SEQ ID NO: 5789504 - DNA, 19 bp, Homo sapiens
tatgtggcccaagtcattc

SEQ ID NO: 5789505 - DNA, 22 bp, Homo sapiens
tatgtggctgtaatgacaaaag

SEQ ID NO: 5789506 - DNA, 13 bp, Homo sapiens
tatgtggctttta

SEQ ID NO: 5789507 - DNA, 18 bp, Homo sapiens
tatgtgggatattgaatg

SEQ ID NO: 5789508 - DNA, 21 bp, Homo sapiens
tatgtgggggcttcatctctt

SEQ ID NO: 5789509 - DNA, 17 bp, Homo sapiens
tatgtggtggtttctat

SEQ ID NO: 5789510 - DNA, 15 bp, Homo sapiens
tatgtggttttgtaa

SEQ ID NO: 5789511 - DNA, 14 bp, Homo sapiens
tatgtgtaaaatgt

SEQ ID NO: 5789512 - DNA, 23 bp, Homo sapiens
tatgtgtaacaggatacaggtga

SEQ ID NO: 5789513 - DNA, 13 bp, Homo sapiens
tatgtgtaggcag

SEQ ID NO: 5789514 - DNA, 15 bp, Homo sapiens
tatgtgtagttataa

SEQ ID NO: 5789515 - DNA, 21 bp, Homo sapiens
tatgtgtatatatacatacac

SEQ ID NO: 5789516 - DNA, 13 bp, Homo sapiens
tatgtgtatatgt

SEQ ID NO: 5789517 - DNA, 17 bp, Homo sapiens
tatgtgtatatttgtag

SEQ ID NO: 5789518 - DNA, 12 bp, Homo sapiens
tatgtgtatgta

SEQ ID NO: 5789519 - DNA, 18 bp, Homo sapiens
tatgtgtatgtgccattt

SEQ ID NO: 5789520 - DNA, 12 bp, Homo sapiens
tatgtgtcatga

SEQ ID NO: 5789521 - DNA, 16 bp, Homo sapiens
tatgtgtcatgatttc

SEQ ID NO: 5789522 - DNA, 16 bp, Homo sapiens
tatgtgtccatttcct

SEQ ID NO: 5789523 - DNA, 21 bp, Homo sapiens
tatgtgtgaggagctgctggc

SEQ ID NO: 5789524 - DNA, 18 bp, Homo sapiens
tatgtgtgagtgtatgta

SEQ ID NO: 5789525 - DNA, 13 bp, Homo sapiens
tatgtgtgcatgt

SEQ ID NO: 5789526 - DNA, 18 bp, Homo sapiens
tatgtgtgcatgtgtgta

SEQ ID NO: 5789527 - DNA, 16 bp, Homo sapiens
tatgtgtgccctggac

SEQ ID NO: 5789528 - DNA, 20 bp, Homo sapiens
tatgtgtgggtgtgtgttac

SEQ ID NO: 5789529 - DNA, 23 bp, Homo sapiens
tatgtgtggtttcagttctgtgt

SEQ ID NO: 5789530 - DNA, 19 bp, Homo sapiens
tatgtgtgtatatgtatgt

SEQ ID NO: 5789531 - DNA, 11 bp, Homo sapiens
tatgtgtgtga

SEQ ID NO: 5789532 - DNA, 11 bp, Homo sapiens
tatgtgtgtgt

SEQ ID NO: 5789533 - DNA, 12 bp, Homo sapiens
tatgtgtgtgta

SEQ ID NO: 5789534 - DNA, 14 bp, Homo sapiens
tatgtgtgtgtgtt

SEQ ID NO: 5789535 - DNA, 17 bp, Homo sapiens
tatgtgtgttgtttcca

SEQ ID NO: 5789536 - DNA, 18 bp, Homo sapiens
tatgtgtgttgtttccat

SEQ ID NO: 5789537 - DNA, 19 bp, Homo sapiens
tatgtgtgttgtttccata

SEQ ID NO: 5789538 - DNA, 13 bp, Homo sapiens
tatgtgttacatt

SEQ ID NO: 5789539 - DNA, 17 bp, Homo sapiens
tatgtgttatgaacatc

SEQ ID NO: 5789540 - DNA, 18 bp, Homo sapiens
tatgtgttatgaacatcc

SEQ ID NO: 5789541 - DNA, 15 bp, Homo sapiens
tatgtgttgccaaag

SEQ ID NO: 5789542 - DNA, 16 bp, Homo sapiens
tatgtgtttagaattg

SEQ ID NO: 5789543 - DNA, 15 bp, Homo sapiens
tatgtgtttctgtaa

SEQ ID NO: 5789544 - DNA, 20 bp, Homo sapiens
tatgtgtttctgtaacaaat

SEQ ID NO: 5789545 - DNA, 21 bp, Homo sapiens
tatgtgtttctgtaacaaatt

SEQ ID NO: 5789546 - DNA, 16 bp, Homo sapiens
tatgtgttttaataaa

SEQ ID NO: 5789547 - DNA, 18 bp, Homo sapiens
tatgtgttttaataaacg

SEQ ID NO: 5789548 - DNA, 21 bp, Homo sapiens
tatgtgtttttctcatatttg

SEQ ID NO: 5789549 - DNA, 20 bp, Homo sapiens
tatgtgttttttgcaacata

SEQ ID NO: 5789550 - DNA, 13 bp, Homo sapiens
tattatatatata

SEQ ID NO: 5789551 - DNA, 14 bp, Homo sapiens
tattatatatatct

SEQ ID NO: 5789552 - DNA, 22 bp, Homo sapiens
tattatatctctgtatgccatt

SEQ ID NO: 5789553 - DNA, 14 bp, Homo sapiens
tattatatcttgta

SEQ ID NO: 5789554 - DNA, 17 bp, Homo sapiens
tattatatgttctagaa

SEQ ID NO: 5789555 - DNA, 15 bp, Homo sapiens
tattatattaatata

SEQ ID NO: 5789556 - DNA, 11 bp, Homo sapiens
tattatatttg

SEQ ID NO: 5789557 - DNA, 14 bp, Homo sapiens
tattatatttgaca

SEQ ID NO: 5789558 - DNA, 21 bp, Homo sapiens
tattatatttgacatgggtat

SEQ ID NO: 5789559 - DNA, 12 bp, Homo sapiens
tattatatttgg

SEQ ID NO: 5789560 - DNA, 17 bp, Homo sapiens
tattatatttggatgca

SEQ ID NO: 5789561 - DNA, 14 bp, Homo sapiens
tattatcaagtaga

SEQ ID NO: 5789562 - DNA, 14 bp, Homo sapiens
tattatcacatcaa

SEQ ID NO: 5789563 - DNA, 19 bp, Homo sapiens
tattatcagtgaatataaa

SEQ ID NO: 5789564 - DNA, 21 bp, Homo sapiens
tattatcatcctataaagaaa

SEQ ID NO: 5789565 - DNA, 16 bp, Homo sapiens
tattatcatgcaaatg

SEQ ID NO: 5789566 - DNA, 22 bp, Homo sapiens
tattatcatgcaaatgctgtat

SEQ ID NO: 5789567 - DNA, 15 bp, Homo sapiens
tattatcatgtctat

SEQ ID NO: 5789568 - DNA, 13 bp, Homo sapiens
tattatcctgtgt

SEQ ID NO: 5789569 - DNA, 15 bp, Homo sapiens
tattatcgctttatg

SEQ ID NO: 5789570 - DNA, 14 bp, Homo sapiens
tattatctaaatga

SEQ ID NO: 5789571 - DNA, 16 bp, Homo sapiens
tattatctactagtaa

SEQ ID NO: 5789572 - DNA, 15 bp, Homo sapiens
tattatctagtaggt

SEQ ID NO: 5789573 - DNA, 11 bp, Homo sapiens
tattatctgaa

SEQ ID NO: 5789574 - DNA, 18 bp, Homo sapiens
tattatctgtaaaaattg

SEQ ID NO: 5789575 - DNA, 18 bp, Homo sapiens
tattatcttcttaacagt

SEQ ID NO: 5789576 - DNA, 21 bp, Homo sapiens
tattatcttcttaacagttta

SEQ ID NO: 5789577 - DNA, 18 bp, Homo sapiens
tattatcttgttcaggaa

SEQ ID NO: 5789578 - DNA, 14 bp, Homo sapiens
tattatcttttcat

SEQ ID NO: 5789579 - DNA, 22 bp, Homo sapiens
tattatgaaacttgtgtaaata

SEQ ID NO: 5789580 - DNA, 13 bp, Homo sapiens
tattatgaatgtg

SEQ ID NO: 5789581 - DNA, 14 bp, Homo sapiens
tattatgaatgtga

SEQ ID NO: 5789582 - DNA, 21 bp, Homo sapiens
tattatgactcaataaaagaa

SEQ ID NO: 5789583 - DNA, 15 bp, Homo sapiens
tattatgagatgctg

SEQ ID NO: 5789584 - DNA, 17 bp, Homo sapiens
tattatgagatgctggc

SEQ ID NO: 5789585 - DNA, 18 bp, Homo sapiens
tattatgagctacaacaa

SEQ ID NO: 5789586 - DNA, 19 bp, Homo sapiens
tattatgagctttctttgc

SEQ ID NO: 5789587 - DNA, 14 bp, Homo sapiens
tattatgattagct

SEQ ID NO: 5789588 - DNA, 13 bp, Homo sapiens
tattatgcaaatt

SEQ ID NO: 5789589 - DNA, 12 bp, Homo sapiens
tattatgcataa

SEQ ID NO: 5789590 - DNA, 14 bp, Homo sapiens
tattatgcataact

SEQ ID NO: 5789591 - DNA, 22 bp, Homo sapiens
tattatgcctgagttataaata

SEQ ID NO: 5789592 - DNA, 17 bp, Homo sapiens
tattatgccttgagaat

SEQ ID NO: 5789593 - DNA, 16 bp, Homo sapiens
tattatggaaaactgt

SEQ ID NO: 5789594 - DNA, 20 bp, Homo sapiens
tattatggaaaactgtgttg

SEQ ID NO: 5789595 - DNA, 20 bp, Homo sapiens
tattatggaggcaggagttt

SEQ ID NO: 5789596 - DNA, 16 bp, Homo sapiens
tattatggcttgtgaa

SEQ ID NO: 5789597 - DNA, 17 bp, Homo sapiens
tattatggcttgtgaac

SEQ ID NO: 5789598 - DNA, 21 bp, Homo sapiens
tattatggttagctgtcacat

SEQ ID NO: 5789599 - DNA, 19 bp, Homo sapiens
tattatgtaacatccagaa

SEQ ID NO: 5789600 - DNA, 20 bp, Homo sapiens
tattatgtaacatccagaag

SEQ ID NO: 5789601 - DNA, 12 bp, Homo sapiens
tattatgtagct

SEQ ID NO: 5789602 - DNA, 15 bp, Homo sapiens
tattatgtagctgaa

SEQ ID NO: 5789603 - DNA, 15 bp, Homo sapiens
tattatgtataaaat

SEQ ID NO: 5789604 - DNA, 20 bp, Homo sapiens
tattatgtataaaatgtaac

SEQ ID NO: 5789605 - DNA, 21 bp, Homo sapiens
tattatgtataaaatgtaaca

SEQ ID NO: 5789606 - DNA, 12 bp, Homo sapiens
tattatgtatag

SEQ ID NO: 5789607 - DNA, 20 bp, Homo sapiens
tattatgtccattattcaag

SEQ ID NO: 5789608 - DNA, 22 bp, Homo sapiens
tattatgtcctgtgagatgtgt

SEQ ID NO: 5789609 - DNA, 19 bp, Homo sapiens
tattatgtcttattttatt

SEQ ID NO: 5789610 - DNA, 15 bp, Homo sapiens
tattatgtgaagaat

SEQ ID NO: 5789611 - DNA, 22 bp, Homo sapiens
tattatgtggcttttatttcag

SEQ ID NO: 5789612 - DNA, 13 bp, Homo sapiens
tattatgtgttca

SEQ ID NO: 5789613 - DNA, 15 bp, Homo sapiens
tattatgttatgaaa

SEQ ID NO: 5789614 - DNA, 14 bp, Homo sapiens
tattatgtttatta

SEQ ID NO: 5789615 - DNA, 16 bp, Homo sapiens
tattatgtttatttca

SEQ ID NO: 5789616 - DNA, 13 bp, Homo sapiens
tattatgtttcct

SEQ ID NO: 5789617 - DNA, 20 bp, Homo sapiens
tattatgtttgatttctcta

SEQ ID NO: 5789618 - DNA, 20 bp, Homo sapiens
tattattactctacactgaa

SEQ ID NO: 5789619 - DNA, 13 bp, Homo sapiens
tattattactgtt

SEQ ID NO: 5789620 - DNA, 17 bp, Homo sapiens
tattattactgttctta

SEQ ID NO: 5789621 - DNA, 14 bp, Homo sapiens
tattattacttgta

SEQ ID NO: 5789622 - DNA, 17 bp, Homo sapiens
tattattacttgtaaat

SEQ ID NO: 5789623 - DNA, 21 bp, Homo sapiens
tattattactttttaaaatgt

SEQ ID NO: 5789624 - DNA, 13 bp, Homo sapiens
tattattagaaat

SEQ ID NO: 5789625 - DNA, 18 bp, Homo sapiens
tattattagaaattagaa

SEQ ID NO: 5789626 - DNA, 12 bp, Homo sapiens
tattattagggc

SEQ ID NO: 5789627 - DNA, 14 bp, Homo sapiens
tattattatatata

SEQ ID NO: 5789628 - DNA, 16 bp, Homo sapiens
tattattatgttctta

SEQ ID NO: 5789629 - DNA, 13 bp, Homo sapiens
tattattattaaa

SEQ ID NO: 5789630 - DNA, 12 bp, Homo sapiens
tattattattat

SEQ ID NO: 5789631 - DNA, 12 bp, Homo sapiens
tattattattta

SEQ ID NO: 5789632 - DNA, 15 bp, Homo sapiens
tattattattttggg

SEQ ID NO: 5789633 - DNA, 13 bp, Homo sapiens
tattattcaaacc

SEQ ID NO: 5789634 - DNA, 22 bp, Homo sapiens
tattattcaaaccaatttcttc

SEQ ID NO: 5789635 - DNA, 16 bp, Homo sapiens
tattattcaagtgcct

SEQ ID NO: 5789636 - DNA, 19 bp, Homo sapiens
tattattcaccatgtaaaa

SEQ ID NO: 5789637 - DNA, 21 bp, Homo sapiens
tattattcagaattatacaga

SEQ ID NO: 5789638 - DNA, 17 bp, Homo sapiens
tattattcctagtcttt

SEQ ID NO: 5789639 - DNA, 12 bp, Homo sapiens
tattattctcat

SEQ ID NO: 5789640 - DNA, 17 bp, Homo sapiens
tattattctcatttagt

SEQ ID NO: 5789641 - DNA, 18 bp, Homo sapiens
tattattctcatttagtg

SEQ ID NO: 5789642 - DNA, 15 bp, Homo sapiens
tattattctgttttg

SEQ ID NO: 5789643 - DNA, 22 bp, Homo sapiens
tattattctgttttgcacagtt

SEQ ID NO: 5789644 - DNA, 14 bp, Homo sapiens
tattattcttgagt

SEQ ID NO: 5789645 - DNA, 14 bp, Homo sapiens
tattattgaaattg

SEQ ID NO: 5789646 - DNA, 15 bp, Homo sapiens
tattattgcttcatg

SEQ ID NO: 5789647 - DNA, 18 bp, Homo sapiens
tattattggcttgcactt

SEQ ID NO: 5789648 - DNA, 11 bp, Homo sapiens
tattattgggg

SEQ ID NO: 5789649 - DNA, 16 bp, Homo sapiens
tattattgtaagttgt

SEQ ID NO: 5789650 - DNA, 22 bp, Homo sapiens
tattattgtaagttgtacaaat

SEQ ID NO: 5789651 - DNA, 14 bp, Homo sapiens
tattatttaaatgt

SEQ ID NO: 5789652 - DNA, 14 bp, Homo sapiens
tattatttaactct

SEQ ID NO: 5789653 - DNA, 22 bp, Homo sapiens
tattatttagtaaaattatctg

SEQ ID NO: 5789654 - DNA, 15 bp, Homo sapiens
tattatttattgtat

SEQ ID NO: 5789655 - DNA, 19 bp, Homo sapiens
tattatttctaggaagaat

SEQ ID NO: 5789656 - DNA, 14 bp, Homo sapiens
tattatttctatta

SEQ ID NO: 5789657 - DNA, 13 bp, Homo sapiens
tattatttctgtt

SEQ ID NO: 5789658 - DNA, 17 bp, Homo sapiens
tattatttctgttctta

SEQ ID NO: 5789659 - DNA, 12 bp, Homo sapiens
tattatttcttc

SEQ ID NO: 5789660 - DNA, 15 bp, Homo sapiens
tattatttcttctct

SEQ ID NO: 5789661 - DNA, 17 bp, Homo sapiens
tattatttcttctctta

SEQ ID NO: 5789662 - DNA, 13 bp, Homo sapiens
tattatttgaagc

SEQ ID NO: 5789663 - DNA, 12 bp, Homo sapiens
tattatttgcag

SEQ ID NO: 5789664 - DNA, 12 bp, Homo sapiens
tattatttggca

SEQ ID NO: 5789665 - DNA, 14 bp, Homo sapiens
tattatttggcagt

SEQ ID NO: 5789666 - DNA, 23 bp, Homo sapiens
tattatttggcagtttggtattt

SEQ ID NO: 5789667 - DNA, 14 bp, Homo sapiens
tattatttgtctta

SEQ ID NO: 5789668 - DNA, 22 bp, Homo sapiens
tattattttaattttttctctt

SEQ ID NO: 5789669 - DNA, 14 bp, Homo sapiens
tattattttcaaag

SEQ ID NO: 5789670 - DNA, 14 bp, Homo sapiens
tattattttccaaa

SEQ ID NO: 5789671 - DNA, 20 bp, Homo sapiens
tattattttctatagctctt

SEQ ID NO: 5789672 - DNA, 18 bp, Homo sapiens
tattattttctgtaattc

SEQ ID NO: 5789673 - DNA, 20 bp, Homo sapiens
tattattttctgtaattctt

SEQ ID NO: 5789674 - DNA, 16 bp, Homo sapiens
tattatttttacctaa

SEQ ID NO: 5789675 - DNA, 23 bp, Homo sapiens
tattattttttaataagaacatt

SEQ ID NO: 5789676 - DNA, 17 bp, Homo sapiens
tattattttttccacat

SEQ ID NO: 5789677 - DNA, 14 bp, Homo sapiens
tattcaaacacaca

SEQ ID NO: 5789678 - DNA, 15 bp, Homo sapiens
tattcaaacagtctc

SEQ ID NO: 5789679 - DNA, 19 bp, Homo sapiens
tattcaaaccaatttcttc

SEQ ID NO: 5789680 - DNA, 21 bp, Homo sapiens
tattcaaaccaatttcttcct

SEQ ID NO: 5789681 - DNA, 15 bp, Homo sapiens
tattcaaactaccta

SEQ ID NO: 5789682 - DNA, 17 bp, Homo sapiens
tattcaaactacctata

SEQ ID NO: 5789683 - DNA, 20 bp, Homo sapiens
tattcaaactacctatattc

SEQ ID NO: 5789684 - DNA, 21 bp, Homo sapiens
tattcaaactacctatattcc

SEQ ID NO: 5789685 - DNA, 13 bp, Homo sapiens
tattcaaactttt

SEQ ID NO: 5789686 - DNA, 14 bp, Homo sapiens
tattcaaactttta

SEQ ID NO: 5789687 - DNA, 18 bp, Homo sapiens
tattcaaagatgataatt

SEQ ID NO: 5789688 - DNA, 18 bp, Homo sapiens
tattcaaagcagcagcca

SEQ ID NO: 5789689 - DNA, 15 bp, Homo sapiens
tattcaaagcagctg

SEQ ID NO: 5789690 - DNA, 19 bp, Homo sapiens
tattcaaagtatatacaga

SEQ ID NO: 5789691 - DNA, 20 bp, Homo sapiens
tattcaaagtatatacagag

SEQ ID NO: 5789692 - DNA, 18 bp, Homo sapiens
tattcaaagttgcctaaa

SEQ ID NO: 5789693 - DNA, 23 bp, Homo sapiens
tattcaaagttgcctaaatccat

SEQ ID NO: 5789694 - DNA, 13 bp, Homo sapiens
tattcaaattcct

SEQ ID NO: 5789695 - DNA, 14 bp, Homo sapiens
tattcaaatttgat

SEQ ID NO: 5789696 - DNA, 16 bp, Homo sapiens
tattcaaccatggact

SEQ ID NO: 5789697 - DNA, 20 bp, Homo sapiens
tattcaactaatacatggtt

SEQ ID NO: 5789698 - DNA, 18 bp, Homo sapiens
tattcaagaatgaaaaat

SEQ ID NO: 5789699 - DNA, 10 bp, Homo sapiens
tattcaaggt

SEQ ID NO: 5789700 - DNA, 16 bp, Homo sapiens
tattcaagttattgta

SEQ ID NO: 5789701 - DNA, 11 bp, Homo sapiens
tattcaataaa

SEQ ID NO: 5789702 - DNA, 13 bp, Homo sapiens
tattcaataaagc

SEQ ID NO: 5789703 - DNA, 14 bp, Homo sapiens
tattcaataaagta

SEQ ID NO: 5789704 - DNA, 20 bp, Homo sapiens
tattcaataaagtatttaat

SEQ ID NO: 5789705 - DNA, 20 bp, Homo sapiens
tattcaataccgctcagtat

SEQ ID NO: 5789706 - DNA, 16 bp, Homo sapiens
tattcaatatcctttg

SEQ ID NO: 5789707 - DNA, 16 bp, Homo sapiens
tattcaatcaaaattt

SEQ ID NO: 5789708 - DNA, 12 bp, Homo sapiens
tattcaatgcaa

SEQ ID NO: 5789709 - DNA, 15 bp, Homo sapiens
tattcaatgcattta

SEQ ID NO: 5789710 - DNA, 14 bp, Homo sapiens
tattcaatgtgaca

SEQ ID NO: 5789711 - DNA, 15 bp, Homo sapiens
tattcaattcctctg

SEQ ID NO: 5789712 - DNA, 16 bp, Homo sapiens
tattcaattcctctgg

SEQ ID NO: 5789713 - DNA, 17 bp, Homo sapiens
tattcaattcctctggg

SEQ ID NO: 5789714 - DNA, 23 bp, Homo sapiens
tattcacaaaacattaaatgtcc

SEQ ID NO: 5789715 - DNA, 21 bp, Homo sapiens
tattcacaatggaaactttag

SEQ ID NO: 5789716 - DNA, 13 bp, Homo sapiens
tattcacacacac

SEQ ID NO: 5789717 - DNA, 19 bp, Homo sapiens
tattcacatagtcctcagg

SEQ ID NO: 5789718 - DNA, 21 bp, Homo sapiens
tattcacatcgcttctgtgta

SEQ ID NO: 5789719 - DNA, 15 bp, Homo sapiens
tattcacatgttcta

SEQ ID NO: 5789720 - DNA, 19 bp, Homo sapiens
tattcaccaatgttgtaca

SEQ ID NO: 5789721 - DNA, 18 bp, Homo sapiens
tattcaccatgtaaaaca

SEQ ID NO: 5789722 - DNA, 16 bp, Homo sapiens
tattcaccccacaccc

SEQ ID NO: 5789723 - DNA, 16 bp, Homo sapiens
tattcacccctgcccc

SEQ ID NO: 5789724 - DNA, 19 bp, Homo sapiens
tattcacctcagtagaaaa

SEQ ID NO: 5789725 - DNA, 17 bp, Homo sapiens
tattcaccttcagtttt

SEQ ID NO: 5789726 - DNA, 17 bp, Homo sapiens
tattcaccttttcttca

SEQ ID NO: 5789727 - DNA, 21 bp, Homo sapiens
tattcactgaagttctcctga

SEQ ID NO: 5789728 - DNA, 14 bp, Homo sapiens
tattcactggcccc

SEQ ID NO: 5789729 - DNA, 20 bp, Homo sapiens
tattcactgtaagtttattt

SEQ ID NO: 5789730 - DNA, 15 bp, Homo sapiens
tattcacttgtgttt

SEQ ID NO: 5789731 - DNA, 20 bp, Homo sapiens
tattgacaataaaatattat

SEQ ID NO: 5789732 - DNA, 17 bp, Homo sapiens
tattgacaataagaaac

SEQ ID NO: 5789733 - DNA, 14 bp, Homo sapiens
tattgacacaccca

SEQ ID NO: 5789734 - DNA, 16 bp, Homo sapiens
tattgacacagaaaat

SEQ ID NO: 5789735 - DNA, 23 bp, Homo sapiens
tattgacacagaaaatgttgaga

SEQ ID NO: 5789736 - DNA, 14 bp, Homo sapiens
tattgacactgaac

SEQ ID NO: 5789737 - DNA, 19 bp, Homo sapiens
tattgacactgaacttaat

SEQ ID NO: 5789738 - DNA, 24 bp, Homo sapiens
tattgacactgaacttaataactg

SEQ ID NO: 5789739 - DNA, 17 bp, Homo sapiens
tattgacatcagcatca

SEQ ID NO: 5789740 - DNA, 15 bp, Homo sapiens
tattgaccatgtgat

SEQ ID NO: 5789741 - DNA, 14 bp, Homo sapiens
tattgaccattttt

SEQ ID NO: 5789742 - DNA, 17 bp, Homo sapiens
tattgacgaactggcta

SEQ ID NO: 5789743 - DNA, 14 bp, Homo sapiens
tattgactgtcttt

SEQ ID NO: 5789744 - DNA, 15 bp, Homo sapiens
tattgacttgtatat

SEQ ID NO: 5789745 - DNA, 17 bp, Homo sapiens
tattgacttgtatattt

SEQ ID NO: 5789746 - DNA, 22 bp, Homo sapiens
tattgacttgttacatgaagat

SEQ ID NO: 5789747 - DNA, 15 bp, Homo sapiens
tattgacttttcaat

SEQ ID NO: 5789748 - DNA, 15 bp, Homo sapiens
tattgagaaagagca

SEQ ID NO: 5789749 - DNA, 17 bp, Homo sapiens
tattgagacactgtcaa

SEQ ID NO: 5789750 - DNA, 16 bp, Homo sapiens
tattgagacattaatt

SEQ ID NO: 5789751 - DNA, 21 bp, Homo sapiens
tattgagatcagcattcaaaa

SEQ ID NO: 5789752 - DNA, 18 bp, Homo sapiens
tattgagatttcttaaat

SEQ ID NO: 5789753 - DNA, 18 bp, Homo sapiens
tattgagcagaattcatt

SEQ ID NO: 5789754 - DNA, 18 bp, Homo sapiens
tattgagcgtgattctgt

SEQ ID NO: 5789755 - DNA, 21 bp, Homo sapiens
tattgaggaaaaatatgtgaa

SEQ ID NO: 5789756 - DNA, 18 bp, Homo sapiens
tattgaggaaaattaata

SEQ ID NO: 5789757 - DNA, 19 bp, Homo sapiens
tattgaggccaagaatatt

SEQ ID NO: 5789758 - DNA, 22 bp, Homo sapiens
tattgaggccaagaatattgca

SEQ ID NO: 5789759 - DNA, 19 bp, Homo sapiens
tattgaggctttgtgttgt

SEQ ID NO: 5789760 - DNA, 19 bp, Homo sapiens
tattgagggataattggtt

SEQ ID NO: 5789761 - DNA, 20 bp, Homo sapiens
tattgagggccagtgatgat

SEQ ID NO: 5789762 - DNA, 19 bp, Homo sapiens
tattgagtaatattacatt

SEQ ID NO: 5789763 - DNA, 22 bp, Homo sapiens
tattgagtttgtaggtaaaatg

SEQ ID NO: 5789764 - DNA, 21 bp, Homo sapiens
tattgataaattttaaaattg

SEQ ID NO: 5789765 - DNA, 14 bp, Homo sapiens
tattgataacagca

SEQ ID NO: 5789766 - DNA, 18 bp, Homo sapiens
tattgataacagcactga

SEQ ID NO: 5789767 - DNA, 14 bp, Homo sapiens
tattgataataaaa

SEQ ID NO: 5789768 - DNA, 17 bp, Homo sapiens
tattgataataaaattc

SEQ ID NO: 5789769 - DNA, 15 bp, Homo sapiens
tattgatagtactct

SEQ ID NO: 5789770 - DNA, 14 bp, Homo sapiens
tattgatatatatt

SEQ ID NO: 5789771 - DNA, 20 bp, Homo sapiens
tattgatatgcttatacact

SEQ ID NO: 5789772 - DNA, 21 bp, Homo sapiens
tattgatatgcttatacactt

SEQ ID NO: 5789773 - DNA, 16 bp, Homo sapiens
tattgatcaaaatcaa

SEQ ID NO: 5789774 - DNA, 19 bp, Homo sapiens
tattgatcccacatttcca

SEQ ID NO: 5789775 - DNA, 14 bp, Homo sapiens
tattgatctgtatt

SEQ ID NO: 5789776 - DNA, 14 bp, Homo sapiens
tattgatctttgcc

SEQ ID NO: 5789777 - DNA, 13 bp, Homo sapiens
tattgatgaaaag

SEQ ID NO: 5789778 - DNA, 16 bp, Homo sapiens
tattgatgaaatcatt

SEQ ID NO: 5789779 - DNA, 17 bp, Homo sapiens
tattgatgattttgtaa

SEQ ID NO: 5789780 - DNA, 20 bp, Homo sapiens
tattgatgtacagtctgtca

SEQ ID NO: 5789781 - DNA, 21 bp, Homo sapiens
tattgatgtcagtatttcaac

SEQ ID NO: 5789782 - DNA, 15 bp, Homo sapiens
tattgatgttaacaa

SEQ ID NO: 5789783 - DNA, 16 bp, Homo sapiens
tattgatgttaacaag

SEQ ID NO: 5789784 - DNA, 23 bp, Homo sapiens
tattgatgttaacaagaggggaa

SEQ ID NO: 5789785 - DNA, 18 bp, Homo sapiens
tattgatgtttccagaaa

SEQ ID NO: 5789786 - DNA, 20 bp, Homo sapiens
tattgatgtttccagaaaat

SEQ ID NO: 5789787 - DNA, 17 bp, Homo sapiens
tattgattaaaaatgtg

SEQ ID NO: 5789788 - DNA, 12 bp, Homo sapiens
tattgattacaa

SEQ ID NO: 5789789 - DNA, 20 bp, Homo sapiens
tattgattacaaataaacag

SEQ ID NO: 5789790 - DNA, 23 bp, Homo sapiens
tattgattacaaataaacagttg

SEQ ID NO: 5789791 - DNA, 19 bp, Homo sapiens
tattgattctgcttgagaa

SEQ ID NO: 5789792 - DNA, 14 bp, Homo sapiens
tattgattgctttt

SEQ ID NO: 5789793 - DNA, 15 bp, Homo sapiens
tattgattgggaaaa

SEQ ID NO: 5789794 - DNA, 16 bp, Homo sapiens
tattgatttaaaattg

SEQ ID NO: 5789795 - DNA, 21 bp, Homo sapiens
tattgatttaacttcattttt

SEQ ID NO: 5789796 - DNA, 13 bp, Homo sapiens
tattgatttgaaa

SEQ ID NO: 5789797 - DNA, 19 bp, Homo sapiens
tattgcaaaatacatgaag

SEQ ID NO: 5789798 - DNA, 20 bp, Homo sapiens
tattgcaagtgaaataatat

SEQ ID NO: 5789799 - DNA, 17 bp, Homo sapiens
tattgcaatgaaggaaa

SEQ ID NO: 5789800 - DNA, 20 bp, Homo sapiens
tattgcacaactctactgtt

SEQ ID NO: 5789801 - DNA, 14 bp, Homo sapiens
tattgcacatgtct

SEQ ID NO: 5789802 - DNA, 16 bp, Homo sapiens
tattgcacatgtctta

SEQ ID NO: 5789803 - DNA, 17 bp, Homo sapiens
tattgcacatgtcttaa

SEQ ID NO: 5789804 - DNA, 22 bp, Homo sapiens
tattgcacatgtcttaatgaag

SEQ ID NO: 5789805 - DNA, 13 bp, Homo sapiens
tattgcacattgt

SEQ ID NO: 5789806 - DNA, 14 bp, Homo sapiens
tattgcacattgtt

SEQ ID NO: 5789807 - DNA, 10 bp, Homo sapiens
tattgcacta

SEQ ID NO: 5789808 - DNA, 20 bp, Homo sapiens
tattgcagacctgtcaccct

SEQ ID NO: 5789809 - DNA, 20 bp, Homo sapiens
tattgcagcaattaaaaatt

SEQ ID NO: 5789810 - DNA, 22 bp, Homo sapiens
tattgcagcgattaataacagg

SEQ ID NO: 5789811 - DNA, 23 bp, Homo sapiens
tattgcatactattaaacatgct

SEQ ID NO: 5789812 - DNA, 19 bp, Homo sapiens
tattgcatgcaatttgaag

SEQ ID NO: 5789813 - DNA, 21 bp, Homo sapiens
tattgcatgctgataatcatt

SEQ ID NO: 5789814 - DNA, 16 bp, Homo sapiens
tattgcatggtgtgaa

SEQ ID NO: 5789815 - DNA, 13 bp, Homo sapiens
tattgcatttctg

SEQ ID NO: 5789816 - DNA, 24 bp, Homo sapiens
tattgcatttgctgttgtttctat

SEQ ID NO: 5789817 - DNA, 22 bp, Homo sapiens
tattgcatttggattggggtcc

SEQ ID NO: 5789818 - DNA, 18 bp, Homo sapiens
tattgccaaaacccagct

SEQ ID NO: 5789819 - DNA, 17 bp, Homo sapiens
tattgccaaacattaat

SEQ ID NO: 5789820 - DNA, 20 bp, Homo sapiens
tattgccaaatattaagaag

SEQ ID NO: 5789821 - DNA, 22 bp, Homo sapiens
tattgccacaatgcctctccca

SEQ ID NO: 5789822 - DNA, 22 bp, Homo sapiens
tattgccaggaaaggagagtac

SEQ ID NO: 5789823 - DNA, 18 bp, Homo sapiens
tattgccaggaatgtttc

SEQ ID NO: 5789824 - DNA, 19 bp, Homo sapiens
tattgccagtatataagct

SEQ ID NO: 5789825 - DNA, 15 bp, Homo sapiens
tattgccatgaacca

SEQ ID NO: 5789826 - DNA, 14 bp, Homo sapiens
tattgcccacgctg

SEQ ID NO: 5789827 - DNA, 15 bp, Homo sapiens
tattgcccacgctgg

SEQ ID NO: 5789828 - DNA, 13 bp, Homo sapiens
tattgcccaggtt

SEQ ID NO: 5789829 - DNA, 22 bp, Homo sapiens
tattgcctaagaataaacattt

SEQ ID NO: 5789830 - DNA, 17 bp, Homo sapiens
tattgcctctgtcttaa

SEQ ID NO: 5789831 - DNA, 22 bp, Homo sapiens
tattgccttctcaccagctgca

SEQ ID NO: 5789832 - DNA, 19 bp, Homo sapiens
tattgccttctttgaagaa

SEQ ID NO: 5789833 - DNA, 21 bp, Homo sapiens
tattgccttgatgtttctata

SEQ ID NO: 5789834 - DNA, 17 bp, Homo sapiens
tattgccttttaatttt

SEQ ID NO: 5789835 - DNA, 14 bp, Homo sapiens
tattgcgctgctac

SEQ ID NO: 5789836 - DNA, 14 bp, Homo sapiens
tattgcgtcttagc

SEQ ID NO: 5789837 - DNA, 19 bp, Homo sapiens
tattgctaaaagcatgtat

SEQ ID NO: 5789838 - DNA, 14 bp, Homo sapiens
tattgctaaaagtg

SEQ ID NO: 5789839 - DNA, 15 bp, Homo sapiens
tattgctaaaagtgc

SEQ ID NO: 5789840 - DNA, 16 bp, Homo sapiens
tattgctaaaagtgca

SEQ ID NO: 5789841 - DNA, 17 bp, Homo sapiens
tattgctaaaagtgcat

SEQ ID NO: 5789842 - DNA, 19 bp, Homo sapiens
tattgctaaaatattttag

SEQ ID NO: 5789843 - DNA, 14 bp, Homo sapiens
tattgctagagctc

SEQ ID NO: 5789844 - DNA, 16 bp, Homo sapiens
tattgctagagctcct

SEQ ID NO: 5789845 - DNA, 17 bp, Homo sapiens
tattgctagtatttgaa

SEQ ID NO: 5789846 - DNA, 18 bp, Homo sapiens
tattgctatatttgctaa

SEQ ID NO: 5789847 - DNA, 13 bp, Homo sapiens
tattgctattaaa

SEQ ID NO: 5789848 - DNA, 13 bp, Homo sapiens
tattgctcctccc

SEQ ID NO: 5789849 - DNA, 19 bp, Homo sapiens
tattgctcgcccagacacc

SEQ ID NO: 5789850 - DNA, 22 bp, Homo sapiens
tattgctcgcccagacaccatg

SEQ ID NO: 5789851 - DNA, 16 bp, Homo sapiens
tattgctctaattctt

SEQ ID NO: 5789852 - DNA, 20 bp, Homo sapiens
tattgctctatatgtaatat

SEQ ID NO: 5789853 - DNA, 22 bp, Homo sapiens
tattgctcttaaaaatcttggt

SEQ ID NO: 5789854 - DNA, 13 bp, Homo sapiens
tattgctgaactc

SEQ ID NO: 5789855 - DNA, 15 bp, Homo sapiens
tattgctgagagaaa

SEQ ID NO: 5789856 - DNA, 16 bp, Homo sapiens
tattgctgagagaaat

SEQ ID NO: 5789857 - DNA, 15 bp, Homo sapiens
tattgctgcataaat

SEQ ID NO: 5789858 - DNA, 17 bp, Homo sapiens
tattgctgcataaattt

SEQ ID NO: 5789859 - DNA, 22 bp, Homo sapiens
tattgctgcataaatttgtaat

SEQ ID NO: 5789860 - DNA, 13 bp, Homo sapiens
tattgctgcattt

SEQ ID NO: 5789861 - DNA, 22 bp, Homo sapiens
tattgctgcattttaagcataa

SEQ ID NO: 5789862 - DNA, 14 bp, Homo sapiens
tattgctgccaaaa

SEQ ID NO: 5789863 - DNA, 17 bp, Homo sapiens
tattgctgccaaaacca

SEQ ID NO: 5789864 - DNA, 20 bp, Homo sapiens
tattgctgctgtgcgtggaa

SEQ ID NO: 5789865 - DNA, 14 bp, Homo sapiens
tattgctgtaaata

SEQ ID NO: 5789866 - DNA, 19 bp, Homo sapiens
tattgctgtaaataaaaat

SEQ ID NO: 5789867 - DNA, 19 bp, Homo sapiens
tattgctgtgagccttgca

SEQ ID NO: 5789868 - DNA, 19 bp, Homo sapiens
tattgctgtgtaacactgt

SEQ ID NO: 5789869 - DNA, 16 bp, Homo sapiens
tattgctgttgcttga

SEQ ID NO: 5789870 - DNA, 16 bp, Homo sapiens
tattgcttaaacaaaa

SEQ ID NO: 5789871 - DNA, 18 bp, Homo sapiens
tattgcttagtaaaattt

SEQ ID NO: 5789872 - DNA, 14 bp, Homo sapiens
tattgcttatttta

SEQ ID NO: 5789873 - DNA, 16 bp, Homo sapiens
tattgcttcaatttca

SEQ ID NO: 5789874 - DNA, 18 bp, Homo sapiens
tattgcttcaatttcaaa

SEQ ID NO: 5789875 - DNA, 20 bp, Homo sapiens
tattgcttcaatttcaaact

SEQ ID NO: 5789876 - DNA, 23 bp, Homo sapiens
tattgcttcaatttcaaactttt

SEQ ID NO: 5789877 - DNA, 13 bp, Homo sapiens
tattgcttcatgt

SEQ ID NO: 5789878 - DNA, 13 bp, Homo sapiens
tattgcttcttgt

SEQ ID NO: 5789879 - DNA, 14 bp, Homo sapiens
tattgcttcttgtg

SEQ ID NO: 5789880 - DNA, 15 bp, Homo sapiens
tattgcttgcacaaa

SEQ ID NO: 5789881 - DNA, 22 bp, Homo sapiens
tattgcttggactacctataaa

SEQ ID NO: 5789882 - DNA, 16 bp, Homo sapiens
tattggaaagtgattt

SEQ ID NO: 5789883 - DNA, 14 bp, Homo sapiens
tattggaaatgtga

SEQ ID NO: 5789884 - DNA, 21 bp, Homo sapiens
tattggaagctgctgaggccc

SEQ ID NO: 5789885 - DNA, 15 bp, Homo sapiens
tattggaattaacct

SEQ ID NO: 5789886 - DNA, 16 bp, Homo sapiens
tattggaattaacctg

SEQ ID NO: 5789887 - DNA, 15 bp, Homo sapiens
tattggaattttctt

SEQ ID NO: 5789888 - DNA, 18 bp, Homo sapiens
tattggacagacacagag

SEQ ID NO: 5789889 - DNA, 15 bp, Homo sapiens
tattggaccagaagt

SEQ ID NO: 5789890 - DNA, 21 bp, Homo sapiens
tattggacggtttctagcctc

SEQ ID NO: 5789891 - DNA, 19 bp, Homo sapiens
tattggacttccatttgga

SEQ ID NO: 5789892 - DNA, 16 bp, Homo sapiens
tattggagagaaaaaa

SEQ ID NO: 5789893 - DNA, 21 bp, Homo sapiens
tattggagagaaaaaattaac

SEQ ID NO: 5789894 - DNA, 23 bp, Homo sapiens
tattggaggaccaaaaaaataag

SEQ ID NO: 5789895 - DNA, 16 bp, Homo sapiens
tattggatcagtgaaa

SEQ ID NO: 5789896 - DNA, 23 bp, Homo sapiens
tattggatctattgatttgaaaa

SEQ ID NO: 5789897 - DNA, 14 bp, Homo sapiens
tattggatttgtcc

SEQ ID NO: 5789898 - DNA, 22 bp, Homo sapiens
tattggcagccaaggaatgtgt

SEQ ID NO: 5789899 - DNA, 13 bp, Homo sapiens
tattggcatttgt

SEQ ID NO: 5789900 - DNA, 19 bp, Homo sapiens
tattggccaaggaaaggca

SEQ ID NO: 5789901 - DNA, 19 bp, Homo sapiens
tattggccgatgagctggt

SEQ ID NO: 5789902 - DNA, 16 bp, Homo sapiens
tattggcttttctgat

SEQ ID NO: 5789903 - DNA, 17 bp, Homo sapiens
tattggcttttctgatc

SEQ ID NO: 5789904 - DNA, 21 bp, Homo sapiens
tattggctttttcagagtcat

SEQ ID NO: 5789905 - DNA, 20 bp, Homo sapiens
tattgggaaggaaatatatt

SEQ ID NO: 5789906 - DNA, 21 bp, Homo sapiens
tattgggagcaatctggaaaa

SEQ ID NO: 5789907 - DNA, 23 bp, Homo sapiens
tattgggagtaggagttgctcct

SEQ ID NO: 5789908 - DNA, 20 bp, Homo sapiens
tatttagatgcatattactg

SEQ ID NO: 5789909 - DNA, 20 bp, Homo sapiens
tatttagattcacttaacaa

SEQ ID NO: 5789910 - DNA, 22 bp, Homo sapiens
tatttagcatggggattgcaga

SEQ ID NO: 5789911 - DNA, 19 bp, Homo sapiens
tatttagccagcgtttatt

SEQ ID NO: 5789912 - DNA, 16 bp, Homo sapiens
tatttagccatagtat

SEQ ID NO: 5789913 - DNA, 15 bp, Homo sapiens
tatttagccattacc

SEQ ID NO: 5789914 - DNA, 14 bp, Homo sapiens
tatttagctctgaa

SEQ ID NO: 5789915 - DNA, 17 bp, Homo sapiens
tatttagctgttttgga

SEQ ID NO: 5789916 - DNA, 19 bp, Homo sapiens
tatttagcttgggaaaggt

SEQ ID NO: 5789917 - DNA, 16 bp, Homo sapiens
tatttaggaaacacca

SEQ ID NO: 5789918 - DNA, 15 bp, Homo sapiens
tatttaggaagtgtt

SEQ ID NO: 5789919 - DNA, 14 bp, Homo sapiens
tatttagggtacta

SEQ ID NO: 5789920 - DNA, 15 bp, Homo sapiens
tatttaggtttttgg

SEQ ID NO: 5789921 - DNA, 23 bp, Homo sapiens
tatttaggtttttggctgagtac

SEQ ID NO: 5789922 - DNA, 16 bp, Homo sapiens
tatttagtaaaaataa

SEQ ID NO: 5789923 - DNA, 18 bp, Homo sapiens
tatttagtaaaaataaat

SEQ ID NO: 5789924 - DNA, 21 bp, Homo sapiens
tatttagtaaaattatctgtt

SEQ ID NO: 5789925 - DNA, 17 bp, Homo sapiens
tatttagtaacttctgt

SEQ ID NO: 5789926 - DNA, 20 bp, Homo sapiens
tatttagtatatgaaatatt

SEQ ID NO: 5789927 - DNA, 17 bp, Homo sapiens
tatttagtcaacatata

SEQ ID NO: 5789928 - DNA, 13 bp, Homo sapiens
tatttagtgatat

SEQ ID NO: 5789929 - DNA, 14 bp, Homo sapiens
tatttagtgctgca

SEQ ID NO: 5789930 - DNA, 20 bp, Homo sapiens
tatttagtgctgcatcttat

SEQ ID NO: 5789931 - DNA, 19 bp, Homo sapiens
tatttagtgttagttataa

SEQ ID NO: 5789932 - DNA, 17 bp, Homo sapiens
tatttagttatagtttc

SEQ ID NO: 5789933 - DNA, 14 bp, Homo sapiens
tatttataaaactt

SEQ ID NO: 5789934 - DNA, 16 bp, Homo sapiens
tatttataaagaatgt

SEQ ID NO: 5789935 - DNA, 12 bp, Homo sapiens
tatttataaatg

SEQ ID NO: 5789936 - DNA, 14 bp, Homo sapiens
tatttataaatgaa

SEQ ID NO: 5789937 - DNA, 19 bp, Homo sapiens
tatttataacaacctaaat

SEQ ID NO: 5789938 - DNA, 13 bp, Homo sapiens
tatttataactca

SEQ ID NO: 5789939 - DNA, 22 bp, Homo sapiens
tatttataagtgactttaaact

SEQ ID NO: 5789940 - DNA, 16 bp, Homo sapiens
tatttataatacagaa

SEQ ID NO: 5789941 - DNA, 20 bp, Homo sapiens
tatttataatacagaatctt

SEQ ID NO: 5789942 - DNA, 15 bp, Homo sapiens
tatttataatataaa

SEQ ID NO: 5789943 - DNA, 16 bp, Homo sapiens
tatttataattaaaga

SEQ ID NO: 5789944 - DNA, 19 bp, Homo sapiens
tatttatacaagattgaaa

SEQ ID NO: 5789945 - DNA, 20 bp, Homo sapiens
tatttatacaagattgaaaa

SEQ ID NO: 5789946 - DNA, 12 bp, Homo sapiens
tatttatactct

SEQ ID NO: 5789947 - DNA, 23 bp, Homo sapiens
tatttatactctagaacatgcac

SEQ ID NO: 5789948 - DNA, 16 bp, Homo sapiens
tatttatagaaagctt

SEQ ID NO: 5789949 - DNA, 18 bp, Homo sapiens
tatttatagaacagttga

SEQ ID NO: 5789950 - DNA, 20 bp, Homo sapiens
tatttatagagttcatagaa

SEQ ID NO: 5789951 - DNA, 23 bp, Homo sapiens
tatttataggccagggcatgtgt

SEQ ID NO: 5789952 - DNA, 17 bp, Homo sapiens
tatttatagtaaccatt

SEQ ID NO: 5789953 - DNA, 16 bp, Homo sapiens
tatttatagtcattta

SEQ ID NO: 5789954 - DNA, 13 bp, Homo sapiens
tatttatataatt

SEQ ID NO: 5789955 - DNA, 17 bp, Homo sapiens
tatttatataattatgt

SEQ ID NO: 5789956 - DNA, 15 bp, Homo sapiens
tatttatatacaagt

SEQ ID NO: 5789957 - DNA, 20 bp, Homo sapiens
tatttatatactttttcatg

SEQ ID NO: 5789958 - DNA, 12 bp, Homo sapiens
tatttatatata

SEQ ID NO: 5789959 - DNA, 13 bp, Homo sapiens
tatttatatatat

SEQ ID NO: 5789960 - DNA, 14 bp, Homo sapiens
tatttatatatatg

SEQ ID NO: 5789961 - DNA, 24 bp, Homo sapiens
tatttatatatatgatgtggacat

SEQ ID NO: 5789962 - DNA, 23 bp, Homo sapiens
tatttatatatgtatttataaat

SEQ ID NO: 5789963 - DNA, 20 bp, Homo sapiens
tatttatatattggtaacat

SEQ ID NO: 5789964 - DNA, 13 bp, Homo sapiens
tatttatatattt

SEQ ID NO: 5789965 - DNA, 17 bp, Homo sapiens
tatttatatatttataa

SEQ ID NO: 5789966 - DNA, 14 bp, Homo sapiens
tatttatatatttg

SEQ ID NO: 5789967 - DNA, 17 bp, Homo sapiens
tatttatatatttgaat

SEQ ID NO: 5789968 - DNA, 22 bp, Homo sapiens
tatttatatcatccagaaaaga

SEQ ID NO: 5789969 - DNA, 13 bp, Homo sapiens
tatttatatgaag

SEQ ID NO: 5789970 - DNA, 19 bp, Homo sapiens
tatttatatgaagcaagct

SEQ ID NO: 5789971 - DNA, 15 bp, Homo sapiens
tatttatatgtacat

SEQ ID NO: 5789972 - DNA, 16 bp, Homo sapiens
tatttatatgtactgt

SEQ ID NO: 5789973 - DNA, 17 bp, Homo sapiens
tatttatatgtactgtt

SEQ ID NO: 5789974 - DNA, 14 bp, Homo sapiens
tatttatatgtatg

SEQ ID NO: 5789975 - DNA, 15 bp, Homo sapiens
tatttatatgtatgt

SEQ ID NO: 5789976 - DNA, 17 bp, Homo sapiens
tatttatatgtatgtgt

SEQ ID NO: 5789977 - DNA, 18 bp, Homo sapiens
tatttatatgtatgtgtt

SEQ ID NO: 5789978 - DNA, 19 bp, Homo sapiens
tatttatatgtatgtgttt

SEQ ID NO: 5789979 - DNA, 13 bp, Homo sapiens
tatttatatgtta

SEQ ID NO: 5789980 - DNA, 16 bp, Homo sapiens
tatttatatgttatta

SEQ ID NO: 5789981 - DNA, 15 bp, Homo sapiens
tatttatattagagt

SEQ ID NO: 5789982 - DNA, 16 bp, Homo sapiens
tatttatattccgtat

SEQ ID NO: 5789983 - DNA, 14 bp, Homo sapiens
tatttatatttcac

SEQ ID NO: 5789984 - DNA, 16 bp, Homo sapiens
tatttatatttcacta

SEQ ID NO: 5789985 - DNA, 13 bp, Homo sapiens
tatttatatttgg

SEQ ID NO: 5789986 - DNA, 16 bp, Homo sapiens
tatttatatttggaaa

SEQ ID NO: 5789987 - DNA, 21 bp, Homo sapiens
tatttatatttggaaagagac

SEQ ID NO: 5789988 - DNA, 20 bp, Homo sapiens
tatttatcaatttttcccag

SEQ ID NO: 5789989 - DNA, 13 bp, Homo sapiens
tatttatcacata

SEQ ID NO: 5789990 - DNA, 15 bp, Homo sapiens
tatttatcagtgaca

SEQ ID NO: 5789991 - DNA, 18 bp, Homo sapiens
tatttatcagtgacagag

SEQ ID NO: 5789992 - DNA, 16 bp, Homo sapiens
tatttatccctttcct

SEQ ID NO: 5789993 - DNA, 22 bp, Homo sapiens
tatttatctccgcaggctattt

SEQ ID NO: 5789994 - DNA, 16 bp, Homo sapiens
tatttatctgagcaat

SEQ ID NO: 5789995 - DNA, 15 bp, Homo sapiens
tatttatctgattaa

SEQ ID NO: 5789996 - DNA, 17 bp, Homo sapiens
tatttatctgtctgagc

SEQ ID NO: 5789997 - DNA, 22 bp, Homo sapiens
tatttatctgtgtttttgaaat

SEQ ID NO: 5789998 - DNA, 13 bp, Homo sapiens
tatttatgaaaaa

SEQ ID NO: 5789999 - DNA, 20 bp, Homo sapiens
tatttatgaaaaccatatga

SEQ ID NO: 5790000 - DNA, 13 bp, Homo sapiens
tatttatgaaagt

SEQ ID NO: 5790001 - DNA, 12 bp, Homo sapiens
tatttatgaagt

SEQ ID NO: 5790002 - DNA, 15 bp, Homo sapiens
tatttatgaatgtgc

SEQ ID NO: 5790003 - DNA, 14 bp, Homo sapiens
tatttatgaattgt

SEQ ID NO: 5790004 - DNA, 21 bp, Homo sapiens
tatttatgataactatttaca

SEQ ID NO: 5790005 - DNA, 17 bp, Homo sapiens
tatttatgatttcaaca

SEQ ID NO: 5790006 - DNA, 13 bp, Homo sapiens
tatttatgccttg

SEQ ID NO: 5790007 - DNA, 21 bp, Homo sapiens
tatttatgccttgatgattta

SEQ ID NO: 5790008 - DNA, 19 bp, Homo sapiens
tatttatgcgtaatttaat

SEQ ID NO: 5790009 - DNA, 17 bp, Homo sapiens
tatttatgctataaatt

SEQ ID NO: 5790010 - DNA, 18 bp, Homo sapiens
tatttatgcttaaaatat

SEQ ID NO: 5790011 - DNA, 16 bp, Homo sapiens
tatttatggtttctgt

SEQ ID NO: 5790012 - DNA, 13 bp, Homo sapiens
tatttatgtaaaa

SEQ ID NO: 5790013 - DNA, 20 bp, Homo sapiens
tatttatgtaaaatcaataa

SEQ ID NO: 5790014 - DNA, 13 bp, Homo sapiens
tatttatgtaaca

SEQ ID NO: 5790015 - DNA, 15 bp, Homo sapiens
tatttatgtaacaaa

SEQ ID NO: 5790016 - DNA, 18 bp, Homo sapiens
tatttatgtaatttgtac

SEQ ID NO: 5790017 - DNA, 20 bp, Homo sapiens
tatttatgtattgtgcaatg

SEQ ID NO: 5790018 - DNA, 21 bp, Homo sapiens
tatttatgtgtatatttgtag

SEQ ID NO: 5790019 - DNA, 14 bp, Homo sapiens
tatttatgtgtgag

SEQ ID NO: 5790020 - DNA, 14 bp, Homo sapiens
tatttatgtttaag

SEQ ID NO: 5790021 - DNA, 19 bp, Homo sapiens
tatttatgtttaagtgctt

SEQ ID NO: 5790022 - DNA, 13 bp, Homo sapiens
tatttatgtttgc

SEQ ID NO: 5790023 - DNA, 18 bp, Homo sapiens
tatttatgttttcacagt

SEQ ID NO: 5790024 - DNA, 18 bp, Homo sapiens
tatttattaaaaacatga

SEQ ID NO: 5790025 - DNA, 23 bp, Homo sapiens
tatttattaaacagatttttaca

SEQ ID NO: 5790026 - DNA, 16 bp, Homo sapiens
tatttattaaacttca

SEQ ID NO: 5790027 - DNA, 18 bp, Homo sapiens
tatttattaaacttcagc

SEQ ID NO: 5790028 - DNA, 24 bp, Homo sapiens
tatttattaaatttttttgtatga

SEQ ID NO: 5790029 - DNA, 17 bp, Homo sapiens
tatttattaatatttaa

SEQ ID NO: 5790030 - DNA, 13 bp, Homo sapiens
tatttattacata

SEQ ID NO: 5790031 - DNA, 20 bp, Homo sapiens
tatttattacataatttagt

SEQ ID NO: 5790032 - DNA, 12 bp, Homo sapiens
tatttattaccg

SEQ ID NO: 5790033 - DNA, 15 bp, Homo sapiens
tatttattacctctg

SEQ ID NO: 5790034 - DNA, 15 bp, Homo sapiens
tatttattattaatt

SEQ ID NO: 5790035 - DNA, 17 bp, Homo sapiens
tatttattattaattta

SEQ ID NO: 5790036 - DNA, 12 bp, Homo sapiens
tatttattcaat

SEQ ID NO: 5790037 - DNA, 13 bp, Homo sapiens
tatttattcaata

SEQ ID NO: 5790038 - DNA, 20 bp, Homo sapiens
tatttattcaataaagtatt

SEQ ID NO: 5790039 - DNA, 15 bp, Homo sapiens
tatttattcataatg

SEQ ID NO: 5790040 - DNA, 17 bp, Homo sapiens
tatttattcatgtgtac

SEQ ID NO: 5790041 - DNA, 22 bp, Homo sapiens
tatttattcatgtgtacagaaa

SEQ ID NO: 5790042 - DNA, 12 bp, Homo sapiens
tatttattcatt

SEQ ID NO: 5790043 - DNA, 19 bp, Homo sapiens
tatttattccccagtgact

SEQ ID NO: 5790044 - DNA, 22 bp, Homo sapiens
tatttattccccagtgactcca

SEQ ID NO: 5790045 - DNA, 19 bp, Homo sapiens
tatttattcctctgtccta

SEQ ID NO: 5790046 - DNA, 16 bp, Homo sapiens
tatttattgaaatgat

SEQ ID NO: 5790047 - DNA, 22 bp, Homo sapiens
tatttattgaaatgatttcaca

SEQ ID NO: 5790048 - DNA, 19 bp, Homo sapiens
tatttattgaattattttg

SEQ ID NO: 5790049 - DNA, 14 bp, Homo sapiens
tatttattgagcat

SEQ ID NO: 5790050 - DNA, 23 bp, Homo sapiens
tatttattgagtacctactgtgt

SEQ ID NO: 5790051 - DNA, 16 bp, Homo sapiens
tatttattgatgtttt

SEQ ID NO: 5790052 - DNA, 20 bp, Homo sapiens
tatttattgcattgctggta

SEQ ID NO: 5790053 - DNA, 22 bp, Homo sapiens
tatttattgcattgctggtaga

SEQ ID NO: 5790054 - DNA, 22 bp, Homo sapiens
tatttattgcttagtgaaaata

SEQ ID NO: 5790055 - DNA, 13 bp, Homo sapiens
tatttattggatg

SEQ ID NO: 5790056 - DNA, 14 bp, Homo sapiens
tatttattggggtg

SEQ ID NO: 5790057 - DNA, 10 bp, Homo sapiens
tatttattgt

SEQ ID NO: 5790058 - DNA, 21 bp, Homo sapiens
tatttattgtatatatggata

SEQ ID NO: 5790059 - DNA, 14 bp, Homo sapiens
tatttattgtatta

SEQ ID NO: 5790060 - DNA, 17 bp, Homo sapiens
tatttattgtcattact

SEQ ID NO: 5790061 - DNA, 23 bp, Homo sapiens
tatttattgtgctgggtcccagc

SEQ ID NO: 5790062 - DNA, 17 bp, Homo sapiens
tatttattgtgtgttct

SEQ ID NO: 5790063 - DNA, 14 bp, Homo sapiens
tatttattgttaaa

SEQ ID NO: 5790064 - DNA, 15 bp, Homo sapiens
tatttattgttagaa

SEQ ID NO: 5790065 - DNA, 24 bp, Homo sapiens
tatttattgttagaaaatgactta

SEQ ID NO: 5790066 - DNA, 22 bp, Homo sapiens
tatttattgtttatttatcagt

SEQ ID NO: 5790067 - DNA, 17 bp, Homo sapiens
tatttatttaaaactct

SEQ ID NO: 5790068 - DNA, 14 bp, Homo sapiens
tatttatttaaaca

SEQ ID NO: 5790069 - DNA, 16 bp, Homo sapiens
tatttatttaaatgtc

SEQ ID NO: 5790070 - DNA, 16 bp, Homo sapiens
tatttatttaagctta

SEQ ID NO: 5790071 - DNA, 15 bp, Homo sapiens
tatttatttatttgt

SEQ ID NO: 5790072 - DNA, 18 bp, Homo sapiens
tatttatttccaaaatgt

SEQ ID NO: 5790073 - DNA, 19 bp, Homo sapiens
tatttatttccagtggtca

SEQ ID NO: 5790074 - DNA, 14 bp, Homo sapiens
tatttatttcctgc

SEQ ID NO: 5790075 - DNA, 13 bp, Homo sapiens
tatttatttctgt

SEQ ID NO: 5790076 - DNA, 15 bp, Homo sapiens
tatttatttctttct

SEQ ID NO: 5790077 - DNA, 16 bp, Homo sapiens
tatttatttgaaagtc

SEQ ID NO: 5790078 - DNA, 20 bp, Homo sapiens
tatttatttgtttgttttag

SEQ ID NO: 5790079 - DNA, 21 bp, Homo sapiens
tatttatttgttttggaatcc

SEQ ID NO: 5790080 - DNA, 17 bp, Homo sapiens
tatttattttagcaaat

SEQ ID NO: 5790081 - DNA, 18 bp, Homo sapiens
tatttattttagcaaatc

SEQ ID NO: 5790082 - DNA, 18 bp, Homo sapiens
tatttattttcctcccca

SEQ ID NO: 5790083 - DNA, 13 bp, Homo sapiens
tatttattttgta

SEQ ID NO: 5790084 - DNA, 18 bp, Homo sapiens
tatttatttttgtactgt

SEQ ID NO: 5790085 - DNA, 20 bp, Homo sapiens
tatttattttttttaagtat

SEQ ID NO: 5790086 - DNA, 22 bp, Homo sapiens
tatttattttttttaattgtat

SEQ ID NO: 5790087 - DNA, 13 bp, Homo sapiens
tcaaggaaaataa

SEQ ID NO: 5790088 - DNA, 21 bp, Homo sapiens
tcaaggaaaataagtgaaatt

SEQ ID NO: 5790089 - DNA, 22 bp, Homo sapiens
tcaaggaaaataagtgaaattt

SEQ ID NO: 5790090 - DNA, 15 bp, Homo sapiens
tcaaggaacagccac

SEQ ID NO: 5790091 - DNA, 19 bp, Homo sapiens
tcaaggaacagccacaaaa

SEQ ID NO: 5790092 - DNA, 23 bp, Homo sapiens
tcaaggaagaataattttaacag

SEQ ID NO: 5790093 - DNA, 14 bp, Homo sapiens
tcaaggaagagcca

SEQ ID NO: 5790094 - DNA, 15 bp, Homo sapiens
tcaaggaagagccag

SEQ ID NO: 5790095 - DNA, 19 bp, Homo sapiens
tcaaggaagagccagccgt

SEQ ID NO: 5790096 - DNA, 19 bp, Homo sapiens
tcaaggaatccatcctgca

SEQ ID NO: 5790097 - DNA, 23 bp, Homo sapiens
tcaaggaatccatcctgcaaagg

SEQ ID NO: 5790098 - DNA, 15 bp, Homo sapiens
tcaaggaatgttatc

SEQ ID NO: 5790099 - DNA, 16 bp, Homo sapiens
tcaaggaatttcttaa

SEQ ID NO: 5790100 - DNA, 21 bp, Homo sapiens
tcaaggaatttcttaacttct

SEQ ID NO: 5790101 - DNA, 22 bp, Homo sapiens
tcaaggacaaagtctccagccc

SEQ ID NO: 5790102 - DNA, 12 bp, Homo sapiens
tcaaggacaggg

SEQ ID NO: 5790103 - DNA, 13 bp, Homo sapiens
tcaaggaccaaga

SEQ ID NO: 5790104 - DNA, 14 bp, Homo sapiens
tcaaggaccaagag

SEQ ID NO: 5790105 - DNA, 15 bp, Homo sapiens
tcaaggaccaagagc

SEQ ID NO: 5790106 - DNA, 22 bp, Homo sapiens
tcaaggaccaagagcaattgca

SEQ ID NO: 5790107 - DNA, 14 bp, Homo sapiens
tcaaggactcctgt

SEQ ID NO: 5790108 - DNA, 20 bp, Homo sapiens
tcaaggagaggcaaagaaag

SEQ ID NO: 5790109 - DNA, 23 bp, Homo sapiens
tcaaggagcccagaaaacctcca

SEQ ID NO: 5790110 - DNA, 20 bp, Homo sapiens
tcaaggaggtcagaagaaaa

SEQ ID NO: 5790111 - DNA, 20 bp, Homo sapiens
tcaaggaggtggtgaatttt

SEQ ID NO: 5790112 - DNA, 18 bp, Homo sapiens
tcaaggagtgaagtaatt

SEQ ID NO: 5790113 - DNA, 14 bp, Homo sapiens
tcaaggataaatat

SEQ ID NO: 5790114 - DNA, 19 bp, Homo sapiens
tcaaggataccttcttatt

SEQ ID NO: 5790115 - DNA, 14 bp, Homo sapiens
tcaaggatcctgag

SEQ ID NO: 5790116 - DNA, 16 bp, Homo sapiens
tcaaggatcctgagcc

SEQ ID NO: 5790117 - DNA, 23 bp, Homo sapiens
tcaaggatcctgagccagatttc

SEQ ID NO: 5790118 - DNA, 20 bp, Homo sapiens
tcaaggatcttttggacctg

SEQ ID NO: 5790119 - DNA, 22 bp, Homo sapiens
tcaaggatggttttgggactag

SEQ ID NO: 5790120 - DNA, 14 bp, Homo sapiens
tcaaggatgttttt

SEQ ID NO: 5790121 - DNA, 23 bp, Homo sapiens
tcaaggattcaatgcatttttaa

SEQ ID NO: 5790122 - DNA, 15 bp, Homo sapiens
tcaaggcaaaaatat

SEQ ID NO: 5790123 - DNA, 20 bp, Homo sapiens
tcaaggcacattgaaatact

SEQ ID NO: 5790124 - DNA, 15 bp, Homo sapiens
tcaaggcactctaga

SEQ ID NO: 5790125 - DNA, 17 bp, Homo sapiens
tcaaggcactctagatt

SEQ ID NO: 5790126 - DNA, 21 bp, Homo sapiens
tcaaggcactctagattccat

SEQ ID NO: 5790127 - DNA, 14 bp, Homo sapiens
tcaaggcactgcct

SEQ ID NO: 5790128 - DNA, 14 bp, Homo sapiens
tcaaggccaataat

SEQ ID NO: 5790129 - DNA, 21 bp, Homo sapiens
tcaaggccaataataaagaca

SEQ ID NO: 5790130 - DNA, 16 bp, Homo sapiens
tcaaggccacaaaaac

SEQ ID NO: 5790131 - DNA, 17 bp, Homo sapiens
tcaaggccacctctgcc

SEQ ID NO: 5790132 - DNA, 14 bp, Homo sapiens
tcaaggccgagggc

SEQ ID NO: 5790133 - DNA, 20 bp, Homo sapiens
tcaaggccgagggccaggca

SEQ ID NO: 5790134 - DNA, 21 bp, Homo sapiens
tcaaggccgagggccaggcag

SEQ ID NO: 5790135 - DNA, 16 bp, Homo sapiens
tcaaggcctcccacag

SEQ ID NO: 5790136 - DNA, 18 bp, Homo sapiens
tcaaggcctcccacagtg

SEQ ID NO: 5790137 - DNA, 19 bp, Homo sapiens
tcaaggcctcccacagtga

SEQ ID NO: 5790138 - DNA, 22 bp, Homo sapiens
tcaaggcctccccaatccaggc

SEQ ID NO: 5790139 - DNA, 13 bp, Homo sapiens
tcaaggcctgctc

SEQ ID NO: 5790140 - DNA, 14 bp, Homo sapiens
tcaaggccttcagt

SEQ ID NO: 5790141 - DNA, 14 bp, Homo sapiens
tcaaggcgggaggg

SEQ ID NO: 5790142 - DNA, 18 bp, Homo sapiens
tcaaggcgggagggcctg

SEQ ID NO: 5790143 - DNA, 23 bp, Homo sapiens
tcaaggcgggagggcctgcagtg

SEQ ID NO: 5790144 - DNA, 22 bp, Homo sapiens
tcaaggctaattggaaaagagt

SEQ ID NO: 5790145 - DNA, 20 bp, Homo sapiens
tcaaggctacagatgtgctg

SEQ ID NO: 5790146 - DNA, 12 bp, Homo sapiens
tcaaggctcaga

SEQ ID NO: 5790147 - DNA, 18 bp, Homo sapiens
tcaaggctcttcttcctc

SEQ ID NO: 5790148 - DNA, 15 bp, Homo sapiens
tcaaggctgcctgga

SEQ ID NO: 5790149 - DNA, 14 bp, Homo sapiens
tcaaggctggggca

SEQ ID NO: 5790150 - DNA, 16 bp, Homo sapiens
tcaaggctggggcatg

SEQ ID NO: 5790151 - DNA, 17 bp, Homo sapiens
tcaaggctggggcatgg

SEQ ID NO: 5790152 - DNA, 17 bp, Homo sapiens
tcaaggcttatattcaa

SEQ ID NO: 5790153 - DNA, 18 bp, Homo sapiens
tcaaggcttatattcaac

SEQ ID NO: 5790154 - DNA, 14 bp, Homo sapiens
tcaaggcttccact

SEQ ID NO: 5790155 - DNA, 21 bp, Homo sapiens
tcaagggaaaggcaagcttga

SEQ ID NO: 5790156 - DNA, 21 bp, Homo sapiens
tcaagggaattaaataaataa

SEQ ID NO: 5790157 - DNA, 17 bp, Homo sapiens
tcaagggaccctgggtg

SEQ ID NO: 5790158 - DNA, 20 bp, Homo sapiens
tcaagggactgggggtgcca

SEQ ID NO: 5790159 - DNA, 22 bp, Homo sapiens
tcaagggactgggggtgccaac

SEQ ID NO: 5790160 - DNA, 13 bp, Homo sapiens
tcaagggctgggg

SEQ ID NO: 5790161 - DNA, 14 bp, Homo sapiens
tcaagggctgtagg

SEQ ID NO: 5790162 - DNA, 18 bp, Homo sapiens
tcaagggcttactatttc

SEQ ID NO: 5790163 - DNA, 15 bp, Homo sapiens
tcaagggctttcctg

SEQ ID NO: 5790164 - DNA, 15 bp, Homo sapiens
tcaaggggcagggag

SEQ ID NO: 5790165 - DNA, 17 bp, Homo sapiens
tcaaggggccctaggaa

SEQ ID NO: 5790166 - DNA, 13 bp, Homo sapiens
tcaaggggtcact

SEQ ID NO: 5790167 - DNA, 16 bp, Homo sapiens
tcaagggtcaggcctt

SEQ ID NO: 5790168 - DNA, 16 bp, Homo sapiens
tcaagggtccagaagt

SEQ ID NO: 5790169 - DNA, 18 bp, Homo sapiens
tcaagggtcttcagggga

SEQ ID NO: 5790170 - DNA, 16 bp, Homo sapiens
tcaagggtggcaggtc

SEQ ID NO: 5790171 - DNA, 20 bp, Homo sapiens
tcaagggttctttcctccca

SEQ ID NO: 5790172 - DNA, 15 bp, Homo sapiens
tcaagggttttccag

SEQ ID NO: 5790173 - DNA, 16 bp, Homo sapiens
tcaagggttttccagg

SEQ ID NO: 5790174 - DNA, 15 bp, Homo sapiens
tcaaggtaaaattct

SEQ ID NO: 5790175 - DNA, 17 bp, Homo sapiens
tcaaggtaaaattctaa

SEQ ID NO: 5790176 - DNA, 18 bp, Homo sapiens
tcaaggtaaaattctaaa

SEQ ID NO: 5790177 - DNA, 14 bp, Homo sapiens
tcaaggtaagctca

SEQ ID NO: 5790178 - DNA, 19 bp, Homo sapiens
tcaaggtcactgtttcctg

SEQ ID NO: 5790179 - DNA, 20 bp, Homo sapiens
tcaaggtgaaggatctgtcc

SEQ ID NO: 5790180 - DNA, 12 bp, Homo sapiens
tcaaggtgctct

SEQ ID NO: 5790181 - DNA, 23 bp, Homo sapiens
tcaaggttactgggagtgtgggc

SEQ ID NO: 5790182 - DNA, 13 bp, Homo sapiens
tcaaggttttagg

SEQ ID NO: 5790183 - DNA, 18 bp, Homo sapiens
tcaaggttttaggttcta

SEQ ID NO: 5790184 - DNA, 20 bp, Homo sapiens
tcaagtaaaacaaatgaaat

SEQ ID NO: 5790185 - DNA, 12 bp, Homo sapiens
tcaagtaaaaga

SEQ ID NO: 5790186 - DNA, 14 bp, Homo sapiens
tcaagtaaaagaaa

SEQ ID NO: 5790187 - DNA, 13 bp, Homo sapiens
tcaagtaacactt

SEQ ID NO: 5790188 - DNA, 16 bp, Homo sapiens
tcaagtaagaagacat

SEQ ID NO: 5790189 - DNA, 22 bp, Homo sapiens
tcaagtaagaagacatgaacca

SEQ ID NO: 5790190 - DNA, 16 bp, Homo sapiens
tcaagtaataaaacaa

SEQ ID NO: 5790191 - DNA, 17 bp, Homo sapiens
tcaagtaataaaacaat

SEQ ID NO: 5790192 - DNA, 15 bp, Homo sapiens
tcaagtaatacaaac

SEQ ID NO: 5790193 - DNA, 14 bp, Homo sapiens
tcaagtaatattgg

SEQ ID NO: 5790194 - DNA, 19 bp, Homo sapiens
tcaagtaatccacctgcct

SEQ ID NO: 5790195 - DNA, 19 bp, Homo sapiens
tcaagtaatggaggtccca

SEQ ID NO: 5790196 - DNA, 19 bp, Homo sapiens
tcaagtacacaaagtaact

SEQ ID NO: 5790197 - DNA, 13 bp, Homo sapiens
tcaagtacactga

SEQ ID NO: 5790198 - DNA, 23 bp, Homo sapiens
tcaagtactgttttgaagctggg

SEQ ID NO: 5790199 - DNA, 18 bp, Homo sapiens
tcaagtagaacaaaaact

SEQ ID NO: 5790200 - DNA, 21 bp, Homo sapiens
tcaagtagctgggattttaaa

SEQ ID NO: 5790201 - DNA, 22 bp, Homo sapiens
tcaagtagtagtacttaatagt

SEQ ID NO: 5790202 - DNA, 20 bp, Homo sapiens
tcaagtatactaagagtaaa

SEQ ID NO: 5790203 - DNA, 13 bp, Homo sapiens
tcaagtatataaa

SEQ ID NO: 5790204 - DNA, 20 bp, Homo sapiens
tcaagtatatgtcatttact

SEQ ID NO: 5790205 - DNA, 20 bp, Homo sapiens
tcaagtattaagcagttcat

SEQ ID NO: 5790206 - DNA, 23 bp, Homo sapiens
tcaagtattaagcagttcattct

SEQ ID NO: 5790207 - DNA, 16 bp, Homo sapiens
tcaagtattataaaca

SEQ ID NO: 5790208 - DNA, 16 bp, Homo sapiens
tcaagtattatacctt

SEQ ID NO: 5790209 - DNA, 16 bp, Homo sapiens
tcaagtattggcaaag

SEQ ID NO: 5790210 - DNA, 16 bp, Homo sapiens
tcaagtatttaagcct

SEQ ID NO: 5790211 - DNA, 15 bp, Homo sapiens
tcaagtcaaattaat

SEQ ID NO: 5790212 - DNA, 14 bp, Homo sapiens
tcaagtcagctctt

SEQ ID NO: 5790213 - DNA, 20 bp, Homo sapiens
tcaagtcattccacacattt

SEQ ID NO: 5790214 - DNA, 12 bp, Homo sapiens
tcaagtccagag

SEQ ID NO: 5790215 - DNA, 19 bp, Homo sapiens
tcaagtccatctgacaaaa

SEQ ID NO: 5790216 - DNA, 21 bp, Homo sapiens
tcaagtcccgaggcagcaaca

SEQ ID NO: 5790217 - DNA, 22 bp, Homo sapiens
tcaagtccttacctcttccgga

SEQ ID NO: 5790218 - DNA, 19 bp, Homo sapiens
tcaagtcctttgtgaatat

SEQ ID NO: 5790219 - DNA, 20 bp, Homo sapiens
tcaagtcggatctagtccag

SEQ ID NO: 5790220 - DNA, 16 bp, Homo sapiens
tcaagtctacctgcct

SEQ ID NO: 5790221 - DNA, 14 bp, Homo sapiens
tcaagtctctgctg

SEQ ID NO: 5790222 - DNA, 12 bp, Homo sapiens
tcaagtctgtga

SEQ ID NO: 5790223 - DNA, 12 bp, Homo sapiens
tcaagtcttccc

SEQ ID NO: 5790224 - DNA, 15 bp, Homo sapiens
tcaagtctttctctt

SEQ ID NO: 5790225 - DNA, 18 bp, Homo sapiens
tcaagtctttctctttcc

SEQ ID NO: 5790226 - DNA, 13 bp, Homo sapiens
tcaagtgaaagac

SEQ ID NO: 5790227 - DNA, 14 bp, Homo sapiens
tcaagtgaacatta

SEQ ID NO: 5790228 - DNA, 21 bp, Homo sapiens
tcaagtgactctcctgcctca

SEQ ID NO: 5790229 - DNA, 17 bp, Homo sapiens
tcaagtgataggataaa

SEQ ID NO: 5790230 - DNA, 17 bp, Homo sapiens
tcaagtgatatatgtat

SEQ ID NO: 5790231 - DNA, 20 bp, Homo sapiens
tcaagtgatcctcctgtctt

SEQ ID NO: 5790232 - DNA, 21 bp, Homo sapiens
tcaagtgatctgccgcctcag

SEQ ID NO: 5790233 - DNA, 17 bp, Homo sapiens
tcaagtgattctcatgc

SEQ ID NO: 5790234 - DNA, 21 bp, Homo sapiens
tcaagtgattctcatgcctca

SEQ ID NO: 5790235 - DNA, 22 bp, Homo sapiens
tcaagtgattctcatgcctcag

SEQ ID NO: 5790236 - DNA, 21 bp, Homo sapiens
tcaagtgattctcctgcctca

SEQ ID NO: 5790237 - DNA, 22 bp, Homo sapiens
tcaagtgattctcctgcctcag

SEQ ID NO: 5790238 - DNA, 13 bp, Homo sapiens
tcaagtgcaagga

SEQ ID NO: 5790239 - DNA, 19 bp, Homo sapiens
tcaagtgcatgctctctgc

SEQ ID NO: 5790240 - DNA, 18 bp, Homo sapiens
tcaagtgcatttctgggc

SEQ ID NO: 5790241 - DNA, 18 bp, Homo sapiens
tcaagtgccaaacagagt

SEQ ID NO: 5790242 - DNA, 18 bp, Homo sapiens
tcaagtgccattcatcct

SEQ ID NO: 5790243 - DNA, 18 bp, Homo sapiens
tcaagtgcctagactgtt

SEQ ID NO: 5790244 - DNA, 21 bp, Homo sapiens
tcaagtgcctagactgttact

SEQ ID NO: 5790245 - DNA, 22 bp, Homo sapiens
tcaagtgcctcttgttgcagag

SEQ ID NO: 5790246 - DNA, 23 bp, Homo sapiens
tcaagtgccttttgctgcgcacc

SEQ ID NO: 5790247 - DNA, 19 bp, Homo sapiens
tcaagtgcttaaaaatact

SEQ ID NO: 5790248 - DNA, 16 bp, Homo sapiens
tcaagtggggctcgcc

SEQ ID NO: 5790249 - DNA, 18 bp, Homo sapiens
tcaagtggggctcgccat

SEQ ID NO: 5790250 - DNA, 15 bp, Homo sapiens
tcaagtgtcacctcc

SEQ ID NO: 5790251 - DNA, 16 bp, Homo sapiens
tcaagtgtcacctcct

SEQ ID NO: 5790252 - DNA, 22 bp, Homo sapiens
tcaagtgtcacctccttcccca

SEQ ID NO: 5790253 - DNA, 23 bp, Homo sapiens
tcaagtgtcacctccttccccag

SEQ ID NO: 5790254 - DNA, 15 bp, Homo sapiens
tcaagtgtcctgaaa

SEQ ID NO: 5790255 - DNA, 16 bp, Homo sapiens
tcaagtgtctcagtcc

SEQ ID NO: 5790256 - DNA, 21 bp, Homo sapiens
tcaagtgtctcagtccacctg

SEQ ID NO: 5790257 - DNA, 16 bp, Homo sapiens
tcaagtgttacagagg

SEQ ID NO: 5790258 - DNA, 20 bp, Homo sapiens
tcaagtgttaggtcaataac

SEQ ID NO: 5790259 - DNA, 20 bp, Homo sapiens
tcaagtgttctaaaatgaaa

SEQ ID NO: 5790260 - DNA, 22 bp, Homo sapiens
tcaagtgttctaaaatgaaata

SEQ ID NO: 5790261 - DNA, 19 bp, Homo sapiens
tcaagtgttttggagaaaa

SEQ ID NO: 5790262 - DNA, 18 bp, Homo sapiens
tcaagttattcagaaata

SEQ ID NO: 5790263 - DNA, 21 bp, Homo sapiens
tcaagttattgacaaactctc

SEQ ID NO: 5790264 - DNA, 19 bp, Homo sapiens
tcaattgggttttgatctc

SEQ ID NO: 5790265 - DNA, 18 bp, Homo sapiens
tcaattggtggaattcct

SEQ ID NO: 5790266 - DNA, 21 bp, Homo sapiens
tcaattgtagatgaacatctc

SEQ ID NO: 5790267 - DNA, 12 bp, Homo sapiens
tcaattgtgaaa

SEQ ID NO: 5790268 - DNA, 16 bp, Homo sapiens
tcaattgtgaaaaaat

SEQ ID NO: 5790269 - DNA, 22 bp, Homo sapiens
tcaattgtttaatgttggaaaa

SEQ ID NO: 5790270 - DNA, 14 bp, Homo sapiens
tcaattgtttatat

SEQ ID NO: 5790271 - DNA, 16 bp, Homo sapiens
tcaattgtttatatgg

SEQ ID NO: 5790272 - DNA, 17 bp, Homo sapiens
tcaatttaaaaagcaaa

SEQ ID NO: 5790273 - DNA, 20 bp, Homo sapiens
tcaatttaaaaagcaaaaaa

SEQ ID NO: 5790274 - DNA, 13 bp, Homo sapiens
tcaatttaaagga

SEQ ID NO: 5790275 - DNA, 14 bp, Homo sapiens
tcaatttaaatgtt

SEQ ID NO: 5790276 - DNA, 18 bp, Homo sapiens
tcaatttaaatgtttact

SEQ ID NO: 5790277 - DNA, 20 bp, Homo sapiens
tcaatttaaatgtttactat

SEQ ID NO: 5790278 - DNA, 21 bp, Homo sapiens
tcaatttaattcttatttctg

SEQ ID NO: 5790279 - DNA, 19 bp, Homo sapiens
tcaatttactttttaaaca

SEQ ID NO: 5790280 - DNA, 22 bp, Homo sapiens
tcaatttactttttaaacagtg

SEQ ID NO: 5790281 - DNA, 13 bp, Homo sapiens
tcaatttatgaat

SEQ ID NO: 5790282 - DNA, 23 bp, Homo sapiens
tcaatttattgcacaaaatataa

SEQ ID NO: 5790283 - DNA, 14 bp, Homo sapiens
tcaatttatttgaa

SEQ ID NO: 5790284 - DNA, 18 bp, Homo sapiens
tcaatttcaaacttttga

SEQ ID NO: 5790285 - DNA, 14 bp, Homo sapiens
tcaatttcagaaac

SEQ ID NO: 5790286 - DNA, 23 bp, Homo sapiens
tcaatttcagaaactaagaatca

SEQ ID NO: 5790287 - DNA, 18 bp, Homo sapiens
tcaatttccaagagctga

SEQ ID NO: 5790288 - DNA, 20 bp, Homo sapiens
tcaatttcccacccatctcc

SEQ ID NO: 5790289 - DNA, 13 bp, Homo sapiens
tcaatttcccaga

SEQ ID NO: 5790290 - DNA, 19 bp, Homo sapiens
tcaatttccctcaggttct

SEQ ID NO: 5790291 - DNA, 20 bp, Homo sapiens
tcaatttctaatgtttacta

SEQ ID NO: 5790292 - DNA, 22 bp, Homo sapiens
tcaatttctagtacctgtgact

SEQ ID NO: 5790293 - DNA, 12 bp, Homo sapiens
tcaatttctcac

SEQ ID NO: 5790294 - DNA, 16 bp, Homo sapiens
tcaatttctcacaata

SEQ ID NO: 5790295 - DNA, 11 bp, Homo sapiens
tcaatttctcc

SEQ ID NO: 5790296 - DNA, 14 bp, Homo sapiens
tcaatttctcccca

SEQ ID NO: 5790297 - DNA, 15 bp, Homo sapiens
tcaatttgaaacaca

SEQ ID NO: 5790298 - DNA, 14 bp, Homo sapiens
tcaatttgccattg

SEQ ID NO: 5790299 - DNA, 13 bp, Homo sapiens
tcaatttgctgaa

SEQ ID NO: 5790300 - DNA, 20 bp, Homo sapiens
tcaatttggagcattaacta

SEQ ID NO: 5790301 - DNA, 22 bp, Homo sapiens
tcaatttggatatttggaggag

SEQ ID NO: 5790302 - DNA, 21 bp, Homo sapiens
tcaatttggtttagaatgctg

SEQ ID NO: 5790303 - DNA, 20 bp, Homo sapiens
tcaatttgtaattgcttaca

SEQ ID NO: 5790304 - DNA, 20 bp, Homo sapiens
tcaatttgtaattttagtat

SEQ ID NO: 5790305 - DNA, 16 bp, Homo sapiens
tcaatttgtataaaat

SEQ ID NO: 5790306 - DNA, 13 bp, Homo sapiens
tcaatttgtcatt

SEQ ID NO: 5790307 - DNA, 17 bp, Homo sapiens
tcaatttgtcattttga

SEQ ID NO: 5790308 - DNA, 13 bp, Homo sapiens
tcaattttaaaga

SEQ ID NO: 5790309 - DNA, 17 bp, Homo sapiens
tcaattttagttgtcaa

SEQ ID NO: 5790310 - DNA, 16 bp, Homo sapiens
tcaattttatccctca

SEQ ID NO: 5790311 - DNA, 13 bp, Homo sapiens
tcaattttatgta

SEQ ID NO: 5790312 - DNA, 22 bp, Homo sapiens
tcaattttcttcacactatcaa

SEQ ID NO: 5790313 - DNA, 23 bp, Homo sapiens
tcaattttctttagcttttacca

SEQ ID NO: 5790314 - DNA, 13 bp, Homo sapiens
tcaattttgtatt

SEQ ID NO: 5790315 - DNA, 14 bp, Homo sapiens
tcaattttgtctat

SEQ ID NO: 5790316 - DNA, 17 bp, Homo sapiens
tcaatttttatacatat

SEQ ID NO: 5790317 - DNA, 19 bp, Homo sapiens
tcaatttttatacatatca

SEQ ID NO: 5790318 - DNA, 18 bp, Homo sapiens
tcaatttttcccagtatt

SEQ ID NO: 5790319 - DNA, 20 bp, Homo sapiens
tcaatttttcttatttcatt

SEQ ID NO: 5790320 - DNA, 20 bp, Homo sapiens
tcaatttttggttgaataaa

SEQ ID NO: 5790321 - DNA, 15 bp, Homo sapiens
tcaattttttaaacc

SEQ ID NO: 5790322 - DNA, 20 bp, Homo sapiens
tcacaaaaacaaaaaaacta

SEQ ID NO: 5790323 - DNA, 13 bp, Homo sapiens
tcacaaaaatggt

SEQ ID NO: 5790324 - DNA, 21 bp, Homo sapiens
tcacaaaaatttgaacactgg

SEQ ID NO: 5790325 - DNA, 20 bp, Homo sapiens
tcacaaaagtatattcaaaa

SEQ ID NO: 5790326 - DNA, 21 bp, Homo sapiens
tcacaaaataaagctgtgaca

SEQ ID NO: 5790327 - DNA, 14 bp, Homo sapiens
tcacaaaattttat

SEQ ID NO: 5790328 - DNA, 21 bp, Homo sapiens
tcacaaacatatgtatctttg

SEQ ID NO: 5790329 - DNA, 14 bp, Homo sapiens
tcacaaaccagcct

SEQ ID NO: 5790330 - DNA, 17 bp, Homo sapiens
tcacaaactacctctgg

SEQ ID NO: 5790331 - DNA, 13 bp, Homo sapiens
tcacaaactgtga

SEQ ID NO: 5790332 - DNA, 19 bp, Homo sapiens
tcacaaactgtgaaaatag

SEQ ID NO: 5790333 - DNA, 23 bp, Homo sapiens
tcacaaactgtgaaaatagtgta

SEQ ID NO: 5790334 - DNA, 21 bp, Homo sapiens
tcacaaacttttatactcttt

SEQ ID NO: 5790335 - DNA, 12 bp, Homo sapiens
tcacaaagccca

SEQ ID NO: 5790336 - DNA, 17 bp, Homo sapiens
tcacaaagctaaataca

SEQ ID NO: 5790337 - DNA, 18 bp, Homo sapiens
tcacaaagctatttaagt

SEQ ID NO: 5790338 - DNA, 12 bp, Homo sapiens
tcacaaaggaat

SEQ ID NO: 5790339 - DNA, 18 bp, Homo sapiens
tcacaaaggctgacattc

SEQ ID NO: 5790340 - DNA, 22 bp, Homo sapiens
tcacaaataagtaatatctttc

SEQ ID NO: 5790341 - DNA, 15 bp, Homo sapiens
tcacaaatgacttta

SEQ ID NO: 5790342 - DNA, 18 bp, Homo sapiens
tcacaaatgactttatta

SEQ ID NO: 5790343 - DNA, 23 bp, Homo sapiens
tcacaaattccgattagaccttt

SEQ ID NO: 5790344 - DNA, 22 bp, Homo sapiens
tcacaaatttcacttatacctg

SEQ ID NO: 5790345 - DNA, 16 bp, Homo sapiens
tcacaacaaaaggaag

SEQ ID NO: 5790346 - DNA, 23 bp, Homo sapiens
tcacaacaactcatttttacaga

SEQ ID NO: 5790347 - DNA, 21 bp, Homo sapiens
tcacaacagattattacctta

SEQ ID NO: 5790348 - DNA, 18 bp, Homo sapiens
tcacaacagatttctaag

SEQ ID NO: 5790349 - DNA, 19 bp, Homo sapiens
tcacaacagatttctaagt

SEQ ID NO: 5790350 - DNA, 22 bp, Homo sapiens
tcacaacagcctgacaacattt

SEQ ID NO: 5790351 - DNA, 15 bp, Homo sapiens
tcacaacaggcattc

SEQ ID NO: 5790352 - DNA, 17 bp, Homo sapiens
tcacaacaggcattcca

SEQ ID NO: 5790353 - DNA, 20 bp, Homo sapiens
tcacaacatatcagacttca

SEQ ID NO: 5790354 - DNA, 15 bp, Homo sapiens
tcacaaccagatttg

SEQ ID NO: 5790355 - DNA, 15 bp, Homo sapiens
tcacaaccagccaca

SEQ ID NO: 5790356 - DNA, 23 bp, Homo sapiens
tcacaaccagccacacagagcct

SEQ ID NO: 5790357 - DNA, 21 bp, Homo sapiens
tcacaacctcaccaaactagt

SEQ ID NO: 5790358 - DNA, 14 bp, Homo sapiens
tcacaacctgaacc

SEQ ID NO: 5790359 - DNA, 16 bp, Homo sapiens
tcacaacctgaaccta

SEQ ID NO: 5790360 - DNA, 17 bp, Homo sapiens
tcacaacgtgcattgtg

SEQ ID NO: 5790361 - DNA, 18 bp, Homo sapiens
tcacaacgtgcattgtgc

SEQ ID NO: 5790362 - DNA, 16 bp, Homo sapiens
tcacaactaggacctc

SEQ ID NO: 5790363 - DNA, 20 bp, Homo sapiens
tcacaactccttccatcctt

SEQ ID NO: 5790364 - DNA, 22 bp, Homo sapiens
tcacaactccttccatccttga

SEQ ID NO: 5790365 - DNA, 20 bp, Homo sapiens
tcacaactgtttttgaagaa

SEQ ID NO: 5790366 - DNA, 13 bp, Homo sapiens
tcacaagaagatt

SEQ ID NO: 5790367 - DNA, 19 bp, Homo sapiens
tcacaagcaataattagga

SEQ ID NO: 5790368 - DNA, 17 bp, Homo sapiens
tcacaagcacaaagctc

SEQ ID NO: 5790369 - DNA, 18 bp, Homo sapiens
tcacaagcacaaagctca

SEQ ID NO: 5790370 - DNA, 13 bp, Homo sapiens
tcacaagcctcct

SEQ ID NO: 5790371 - DNA, 15 bp, Homo sapiens
tcacaagcctcctgt

SEQ ID NO: 5790372 - DNA, 17 bp, Homo sapiens
tcacaagcctcttctga

SEQ ID NO: 5790373 - DNA, 22 bp, Homo sapiens
tcacaagctgcctccctgtcca

SEQ ID NO: 5790374 - DNA, 23 bp, Homo sapiens
tcacaaggcacaccagtgcaagc

SEQ ID NO: 5790375 - DNA, 12 bp, Homo sapiens
tcacaaggcagc

SEQ ID NO: 5790376 - DNA, 23 bp, Homo sapiens
tcacaaggcagcaaggcccgagc

SEQ ID NO: 5790377 - DNA, 23 bp, Homo sapiens
tcacaaggcaggaggagctgata

SEQ ID NO: 5790378 - DNA, 15 bp, Homo sapiens
tcacaaggcccagga

SEQ ID NO: 5790379 - DNA, 20 bp, Homo sapiens
tcacaaggcccaggagacct

SEQ ID NO: 5790380 - DNA, 17 bp, Homo sapiens
tcacaaggtataataag

SEQ ID NO: 5790381 - DNA, 14 bp, Homo sapiens
tcacaaggtcagga

SEQ ID NO: 5790382 - DNA, 18 bp, Homo sapiens
tcacaaggtctttactta

SEQ ID NO: 5790383 - DNA, 17 bp, Homo sapiens
tcacaagtctaaacaat

SEQ ID NO: 5790384 - DNA, 18 bp, Homo sapiens
tcacaagtctaaacaatg

SEQ ID NO: 5790385 - DNA, 20 bp, Homo sapiens
tcacaagtctaaacaatgaa

SEQ ID NO: 5790386 - DNA, 20 bp, Homo sapiens
tcacaagtctcctagacact

SEQ ID NO: 5790387 - DNA, 16 bp, Homo sapiens
tcacaagtgaaaaaca

SEQ ID NO: 5790388 - DNA, 21 bp, Homo sapiens
tcacaagtggtgtttattgca

SEQ ID NO: 5790389 - DNA, 21 bp, Homo sapiens
tcacaagttctatttcttgaa

SEQ ID NO: 5790390 - DNA, 20 bp, Homo sapiens
tcacaataaaaatggctcag

SEQ ID NO: 5790391 - DNA, 13 bp, Homo sapiens
tcacaataaagag

SEQ ID NO: 5790392 - DNA, 21 bp, Homo sapiens
tcacaataaagagaaccatgt

SEQ ID NO: 5790393 - DNA, 18 bp, Homo sapiens
tcacaataaatggccagt

SEQ ID NO: 5790394 - DNA, 13 bp, Homo sapiens
tcacaatacagat

SEQ ID NO: 5790395 - DNA, 16 bp, Homo sapiens
tcacaatagaaactca

SEQ ID NO: 5790396 - DNA, 22 bp, Homo sapiens
tcacaatagccgatatcagaat

SEQ ID NO: 5790397 - DNA, 13 bp, Homo sapiens
tcacaatataaag

SEQ ID NO: 5790398 - DNA, 18 bp, Homo sapiens
tcacaatattcagtggtg

SEQ ID NO: 5790399 - DNA, 16 bp, Homo sapiens
tcacaatcctgtccct

SEQ ID NO: 5790400 - DNA, 18 bp, Homo sapiens
tcacaatcctgtccctca

SEQ ID NO: 5790401 - DNA, 17 bp, Homo sapiens
tcacaatcttggggctg

SEQ ID NO: 5790402 - DNA, 20 bp, Homo sapiens
tcacaatcttggggctgatg

SEQ ID NO: 5790403 - DNA, 22 bp, Homo sapiens
tcacaatgaaatgctctccttt

SEQ ID NO: 5790404 - DNA, 17 bp, Homo sapiens
tcacaatgtactatatg

SEQ ID NO: 5790405 - DNA, 18 bp, Homo sapiens
tcacaatgtgaaactgaa

SEQ ID NO: 5790406 - DNA, 21 bp, Homo sapiens
tcacaatgttccttttttgta

SEQ ID NO: 5790407 - DNA, 16 bp, Homo sapiens
tcacaatgttctttat

SEQ ID NO: 5790408 - DNA, 17 bp, Homo sapiens
tcacaatgttctttata

SEQ ID NO: 5790409 - DNA, 21 bp, Homo sapiens
tcacaatgttggcctgtcaga

SEQ ID NO: 5790410 - DNA, 14 bp, Homo sapiens
tcacaattagggaa

SEQ ID NO: 5790411 - DNA, 18 bp, Homo sapiens
tcacaattatatttttgt

SEQ ID NO: 5790412 - DNA, 12 bp, Homo sapiens
tcacaattatta

SEQ ID NO: 5790413 - DNA, 17 bp, Homo sapiens
tcacaattccatttcca

SEQ ID NO: 5790414 - DNA, 12 bp, Homo sapiens
tcacaatttcaa

SEQ ID NO: 5790415 - DNA, 14 bp, Homo sapiens
tcacaatttcaatg

SEQ ID NO: 5790416 - DNA, 16 bp, Homo sapiens
tcacaatttgaaaagc

SEQ ID NO: 5790417 - DNA, 13 bp, Homo sapiens
tcacaatttttaa

SEQ ID NO: 5790418 - DNA, 20 bp, Homo sapiens
tcacacaaagactccttgtg

SEQ ID NO: 5790419 - DNA, 13 bp, Homo sapiens
tcacacaaagcag

SEQ ID NO: 5790420 - DNA, 14 bp, Homo sapiens
tcacacaaagcaga

SEQ ID NO: 5790421 - DNA, 18 bp, Homo sapiens
tcacacaaagtgaaatta

SEQ ID NO: 5790422 - DNA, 19 bp, Homo sapiens
tcacacaatacaataagtt

SEQ ID NO: 5790423 - DNA, 16 bp, Homo sapiens
tcacacaatcagacca

SEQ ID NO: 5790424 - DNA, 15 bp, Homo sapiens
tcacacacacacttg

SEQ ID NO: 5790425 - DNA, 19 bp, Homo sapiens
tcacacacagcctggcctc

SEQ ID NO: 5790426 - DNA, 20 bp, Homo sapiens
tcacacacagcctggcctcc

SEQ ID NO: 5790427 - DNA, 21 bp, Homo sapiens
tcacacacaggcaactgaggc

SEQ ID NO: 5790428 - DNA, 14 bp, Homo sapiens
tcacacacatggaa

SEQ ID NO: 5790429 - DNA, 21 bp, Homo sapiens
tcacacacccctcaaaaaaag

SEQ ID NO: 5790430 - DNA, 16 bp, Homo sapiens
tcacacaccctgaggt

SEQ ID NO: 5790431 - DNA, 12 bp, Homo sapiens
tcacacacctct

SEQ ID NO: 5790432 - DNA, 18 bp, Homo sapiens
tcacacacctctgcccct

SEQ ID NO: 5790433 - DNA, 12 bp, Homo sapiens
tcacacacctgt

SEQ ID NO: 5790434 - DNA, 21 bp, Homo sapiens
tcacacactcacaatttaaaa

SEQ ID NO: 5790435 - DNA, 11 bp, Homo sapiens
tcacacactgg

SEQ ID NO: 5790436 - DNA, 12 bp, Homo sapiens
tcacacactgga

SEQ ID NO: 5790437 - DNA, 20 bp, Homo sapiens
tcacacactggaccccactg

SEQ ID NO: 5790438 - DNA, 15 bp, Homo sapiens
tcacacactttctct

SEQ ID NO: 5790439 - DNA, 18 bp, Homo sapiens
tcacacactttctcttca

SEQ ID NO: 5790440 - DNA, 10 bp, Homo sapiens
tcacacagac

SEQ ID NO: 5790441 - DNA, 12 bp, Homo sapiens
tcacacagagat

SEQ ID NO: 5790442 - DNA, 15 bp, Homo sapiens
tcaccagccctgagc

SEQ ID NO: 5790443 - DNA, 16 bp, Homo sapiens
tcaccagccctgcagc

SEQ ID NO: 5790444 - DNA, 16 bp, Homo sapiens
tcaccagcctctgctc

SEQ ID NO: 5790445 - DNA, 17 bp, Homo sapiens
tcaccagctatctgtca

SEQ ID NO: 5790446 - DNA, 13 bp, Homo sapiens
tcaccagctgcaa

SEQ ID NO: 5790447 - DNA, 14 bp, Homo sapiens
tcaccagctgcaaa

SEQ ID NO: 5790448 - DNA, 17 bp, Homo sapiens
tcaccagctgcctcttc

SEQ ID NO: 5790449 - DNA, 12 bp, Homo sapiens
tcaccagctggg

SEQ ID NO: 5790450 - DNA, 22 bp, Homo sapiens
tcaccaggcagcctctgggggg

SEQ ID NO: 5790451 - DNA, 23 bp, Homo sapiens
tcaccaggcccacgaggagcagc

SEQ ID NO: 5790452 - DNA, 13 bp, Homo sapiens
tcaccaggcctgg

SEQ ID NO: 5790453 - DNA, 17 bp, Homo sapiens
tcaccaggcctggcctc

SEQ ID NO: 5790454 - DNA, 18 bp, Homo sapiens
tcaccaggcctggcctct

SEQ ID NO: 5790455 - DNA, 19 bp, Homo sapiens
tcaccaggcctggcctctg

SEQ ID NO: 5790456 - DNA, 14 bp, Homo sapiens
tcaccaggggagga

SEQ ID NO: 5790457 - DNA, 16 bp, Homo sapiens
tcaccaggggaggagc

SEQ ID NO: 5790458 - DNA, 22 bp, Homo sapiens
tcaccagggtccgcaccagctg

SEQ ID NO: 5790459 - DNA, 20 bp, Homo sapiens
tcaccaggtccaatgttgtt

SEQ ID NO: 5790460 - DNA, 19 bp, Homo sapiens
tcaccagtcccatgctggc

SEQ ID NO: 5790461 - DNA, 19 bp, Homo sapiens
tcaccagtgacctggaagg

SEQ ID NO: 5790462 - DNA, 18 bp, Homo sapiens
tcaccagtgccacgtcat

SEQ ID NO: 5790463 - DNA, 21 bp, Homo sapiens
tcaccagtgccacgtcatgag

SEQ ID NO: 5790464 - DNA, 13 bp, Homo sapiens
tcaccagtggcct

SEQ ID NO: 5790465 - DNA, 23 bp, Homo sapiens
tcaccagtggcctttcagtgtag

SEQ ID NO: 5790466 - DNA, 13 bp, Homo sapiens
tcaccagtgtccc

SEQ ID NO: 5790467 - DNA, 23 bp, Homo sapiens
tcaccagtgtgtggctttcagag

SEQ ID NO: 5790468 - DNA, 16 bp, Homo sapiens
tcaccagtgttcctga

SEQ ID NO: 5790469 - DNA, 20 bp, Homo sapiens
tcaccagtgttcctgaagct

SEQ ID NO: 5790470 - DNA, 21 bp, Homo sapiens
tcaccagtgttcctgaagctg

SEQ ID NO: 5790471 - DNA, 14 bp, Homo sapiens
tcaccagttaaaag

SEQ ID NO: 5790472 - DNA, 22 bp, Homo sapiens
tcaccataatgaacaattgcta

SEQ ID NO: 5790473 - DNA, 14 bp, Homo sapiens
tcaccatacccagc

SEQ ID NO: 5790474 - DNA, 11 bp, Homo sapiens
tcaccatcatt

SEQ ID NO: 5790475 - DNA, 12 bp, Homo sapiens
tcaccatcattt

SEQ ID NO: 5790476 - DNA, 14 bp, Homo sapiens
tcaccatccacctt

SEQ ID NO: 5790477 - DNA, 21 bp, Homo sapiens
tcaccatccagagaccaaata

SEQ ID NO: 5790478 - DNA, 17 bp, Homo sapiens
tcaccatctcaggccac

SEQ ID NO: 5790479 - DNA, 11 bp, Homo sapiens
tcaccatctct

SEQ ID NO: 5790480 - DNA, 15 bp, Homo sapiens
tcaccatcttggcca

SEQ ID NO: 5790481 - DNA, 20 bp, Homo sapiens
tcaccatctttctaatcttt

SEQ ID NO: 5790482 - DNA, 15 bp, Homo sapiens
tcaccatctttctga

SEQ ID NO: 5790483 - DNA, 16 bp, Homo sapiens
tcaccatgatcactta

SEQ ID NO: 5790484 - DNA, 19 bp, Homo sapiens
tcaccatgatggggcccta

SEQ ID NO: 5790485 - DNA, 15 bp, Homo sapiens
tcaccatgatgtgaa

SEQ ID NO: 5790486 - DNA, 15 bp, Homo sapiens
tcaccatgatttaat

SEQ ID NO: 5790487 - DNA, 13 bp, Homo sapiens
tcaccatgcaagg

SEQ ID NO: 5790488 - DNA, 23 bp, Homo sapiens
tcaccatgggaggtggggcctca

SEQ ID NO: 5790489 - DNA, 18 bp, Homo sapiens
tcaccatgttagccagga

SEQ ID NO: 5790490 - DNA, 15 bp, Homo sapiens
tcaccatgttggcca

SEQ ID NO: 5790491 - DNA, 19 bp, Homo sapiens
tcaccatgttggccaggct

SEQ ID NO: 5790492 - DNA, 20 bp, Homo sapiens
tcaccatgttggccaggctg

SEQ ID NO: 5790493 - DNA, 17 bp, Homo sapiens
tcaccattctgcattta

SEQ ID NO: 5790494 - DNA, 20 bp, Homo sapiens
tcaccattgacttcttggtg

SEQ ID NO: 5790495 - DNA, 20 bp, Homo sapiens
tcaccattggacagtctccc

SEQ ID NO: 5790496 - DNA, 23 bp, Homo sapiens
tcaccattggacagtctccctga

SEQ ID NO: 5790497 - DNA, 18 bp, Homo sapiens
tcaccattgtgtggtgta

SEQ ID NO: 5790498 - DNA, 20 bp, Homo sapiens
tcaccatttaatcatttcca

SEQ ID NO: 5790499 - DNA, 16 bp, Homo sapiens
tcaccatttccccagg

SEQ ID NO: 5790500 - DNA, 15 bp, Homo sapiens
tcaccatttcctcct

SEQ ID NO: 5790501 - DNA, 22 bp, Homo sapiens
tcaccatttgattatgtagcaa

SEQ ID NO: 5790502 - DNA, 20 bp, Homo sapiens
tcaccatttggatcctgtgt

SEQ ID NO: 5790503 - DNA, 18 bp, Homo sapiens
tcacccaaacacttctgc

SEQ ID NO: 5790504 - DNA, 13 bp, Homo sapiens
tcacccaacgctc

SEQ ID NO: 5790505 - DNA, 15 bp, Homo sapiens
tcacccaatcccagt

SEQ ID NO: 5790506 - DNA, 18 bp, Homo sapiens
tcacccaatcccagttct

SEQ ID NO: 5790507 - DNA, 23 bp, Homo sapiens
tcacccaatcccagttcttcctg

SEQ ID NO: 5790508 - DNA, 21 bp, Homo sapiens
tcacccacaaccctctggaag

SEQ ID NO: 5790509 - DNA, 22 bp, Homo sapiens
tcacccacaaccctctggaagt

SEQ ID NO: 5790510 - DNA, 15 bp, Homo sapiens
tcacccacagggcta

SEQ ID NO: 5790511 - DNA, 16 bp, Homo sapiens
tcacccaccagacttt

SEQ ID NO: 5790512 - DNA, 15 bp, Homo sapiens
tcacccaccagctcc

SEQ ID NO: 5790513 - DNA, 15 bp, Homo sapiens
tcacccaccaggcca

SEQ ID NO: 5790514 - DNA, 12 bp, Homo sapiens
tcacccaccata

SEQ ID NO: 5790515 - DNA, 13 bp, Homo sapiens
tcacccactccct

SEQ ID NO: 5790516 - DNA, 21 bp, Homo sapiens
tcacccactcctttacaacca

SEQ ID NO: 5790517 - DNA, 17 bp, Homo sapiens
tcacccactctgcactg

SEQ ID NO: 5790518 - DNA, 14 bp, Homo sapiens
tcacccagaaaaaa

SEQ ID NO: 5790519 - DNA, 13 bp, Homo sapiens
tcacccagaagga

SEQ ID NO: 5790520 - DNA, 17 bp, Homo sapiens
tcacccagacagctccc

SEQ ID NO: 5790521 - DNA, 11 bp, Homo sapiens
tcacccagact

SEQ ID NO: 5790522 - DNA, 19 bp, Homo sapiens
tcacccagactggaatgca

SEQ ID NO: 5790523 - DNA, 20 bp, Homo sapiens
tcacccagagcacaggagct

SEQ ID NO: 5790524 - DNA, 20 bp, Homo sapiens
tcacccagagctgcctatgc

SEQ ID NO: 5790525 - DNA, 18 bp, Homo sapiens
tcacccagatcaggaacc

SEQ ID NO: 5790526 - DNA, 23 bp, Homo sapiens
tcacccagatcaggaaccagggc

SEQ ID NO: 5790527 - DNA, 21 bp, Homo sapiens
tcacccagcacccatgcccca

SEQ ID NO: 5790528 - DNA, 13 bp, Homo sapiens
tcacccagcctgg

SEQ ID NO: 5790529 - DNA, 11 bp, Homo sapiens
tcacccaggac

SEQ ID NO: 5790530 - DNA, 13 bp, Homo sapiens
tcacccaggcctg

SEQ ID NO: 5790531 - DNA, 14 bp, Homo sapiens
tcacccaggcctga

SEQ ID NO: 5790532 - DNA, 12 bp, Homo sapiens
tcacccaggctg

SEQ ID NO: 5790533 - DNA, 19 bp, Homo sapiens
tcacccaggctggactgca

SEQ ID NO: 5790534 - DNA, 16 bp, Homo sapiens
tcacccaggctggagt

SEQ ID NO: 5790535 - DNA, 23 bp, Homo sapiens
tcacccagggacactccaactct

SEQ ID NO: 5790536 - DNA, 18 bp, Homo sapiens
tcacccagtcacctcccc

SEQ ID NO: 5790537 - DNA, 22 bp, Homo sapiens
tcacccagtcacctccccacat

SEQ ID NO: 5790538 - DNA, 23 bp, Homo sapiens
tcacccagtcacctccccacatc

SEQ ID NO: 5790539 - DNA, 18 bp, Homo sapiens
tcacccagtccccacccg

SEQ ID NO: 5790540 - DNA, 12 bp, Homo sapiens
tcacccataaac

SEQ ID NO: 5790541 - DNA, 20 bp, Homo sapiens
tcacccataataaaggttgt

SEQ ID NO: 5790542 - DNA, 19 bp, Homo sapiens
tcacccatctcactctccc

SEQ ID NO: 5790543 - DNA, 15 bp, Homo sapiens
tcacccatggcctca

SEQ ID NO: 5790544 - DNA, 20 bp, Homo sapiens
tcacccattccgggttcact

SEQ ID NO: 5790545 - DNA, 23 bp, Homo sapiens
tcacccattccgggttcactccc

SEQ ID NO: 5790546 - DNA, 13 bp, Homo sapiens
tcacccattgtct

SEQ ID NO: 5790547 - DNA, 14 bp, Homo sapiens
tcacccattgtctc

SEQ ID NO: 5790548 - DNA, 23 bp, Homo sapiens
tcaccccaatccctgccactggg

SEQ ID NO: 5790549 - DNA, 13 bp, Homo sapiens
tcaccccacactt

SEQ ID NO: 5790550 - DNA, 22 bp, Homo sapiens
tcaccccaccccaccccacctc

SEQ ID NO: 5790551 - DNA, 12 bp, Homo sapiens
tcaccccaccct

SEQ ID NO: 5790552 - DNA, 13 bp, Homo sapiens
tcaccccaccctt

SEQ ID NO: 5790553 - DNA, 14 bp, Homo sapiens
tcaccccactcctg

SEQ ID NO: 5790554 - DNA, 17 bp, Homo sapiens
tcaccccagagccacac

SEQ ID NO: 5790555 - DNA, 14 bp, Homo sapiens
tcaccccagaggcc

SEQ ID NO: 5790556 - DNA, 13 bp, Homo sapiens
tcaccccagcccc

SEQ ID NO: 5790557 - DNA, 19 bp, Homo sapiens
tcaccccagcccccacagc

SEQ ID NO: 5790558 - DNA, 15 bp, Homo sapiens
tcaccccagcctcat

SEQ ID NO: 5790559 - DNA, 16 bp, Homo sapiens
tcaccccagcctcatt

SEQ ID NO: 5790560 - DNA, 16 bp, Homo sapiens
tcaccccagtgcctgt

SEQ ID NO: 5790561 - DNA, 20 bp, Homo sapiens
tcaccccagttcccttggtg

SEQ ID NO: 5790562 - DNA, 23 bp, Homo sapiens
tcaccccagttcccttggtggca

SEQ ID NO: 5790563 - DNA, 13 bp, Homo sapiens
tcaccccatccca

SEQ ID NO: 5790564 - DNA, 15 bp, Homo sapiens
tcacccccacccctg

SEQ ID NO: 5790565 - DNA, 13 bp, Homo sapiens
tcacccccactcc

SEQ ID NO: 5790566 - DNA, 15 bp, Homo sapiens
tcacccccagcacag

SEQ ID NO: 5790567 - DNA, 16 bp, Homo sapiens
tcacccccaggacctc

SEQ ID NO: 5790568 - DNA, 17 bp, Homo sapiens
tcacccccaggacctct

SEQ ID NO: 5790569 - DNA, 15 bp, Homo sapiens
tcacccccatccaca

SEQ ID NO: 5790570 - DNA, 13 bp, Homo sapiens
tcacccccccagg

SEQ ID NO: 5790571 - DNA, 18 bp, Homo sapiens
tcaccccccgacctggct

SEQ ID NO: 5790572 - DNA, 18 bp, Homo sapiens
tcacccccctctgctgcc

SEQ ID NO: 5790573 - DNA, 21 bp, Homo sapiens
tcacccccctgtattctcagc

SEQ ID NO: 5790574 - DNA, 19 bp, Homo sapiens
tcaccccctcccaccccca

SEQ ID NO: 5790575 - DNA, 23 bp, Homo sapiens
tcaccccctcccacccccagccc

SEQ ID NO: 5790576 - DNA, 19 bp, Homo sapiens
tcaccccctcgggtctcct

SEQ ID NO: 5790577 - DNA, 16 bp, Homo sapiens
tcacccccttctccat

SEQ ID NO: 5790578 - DNA, 18 bp, Homo sapiens
tcacccccttctccatcc

SEQ ID NO: 5790579 - DNA, 20 bp, Homo sapiens
tcaccccctttgctgtgagg

SEQ ID NO: 5790580 - DNA, 20 bp, Homo sapiens
tcaccccgaggccctgcatg

SEQ ID NO: 5790581 - DNA, 16 bp, Homo sapiens
tcaccccggcaggccc

SEQ ID NO: 5790582 - DNA, 21 bp, Homo sapiens
tcaccccggcaggccctgcag

SEQ ID NO: 5790583 - DNA, 18 bp, Homo sapiens
tcaccccggccacctgcg

SEQ ID NO: 5790584 - DNA, 14 bp, Homo sapiens
tcaccccgtctggg

SEQ ID NO: 5790585 - DNA, 17 bp, Homo sapiens
tcaccccgttacagctc

SEQ ID NO: 5790586 - DNA, 23 bp, Homo sapiens
tcacccctaaaagaaaccctgca

SEQ ID NO: 5790587 - DNA, 13 bp, Homo sapiens
tcacccctcagca

SEQ ID NO: 5790588 - DNA, 17 bp, Homo sapiens
tcacccctccacccttg

SEQ ID NO: 5790589 - DNA, 13 bp, Homo sapiens
tcacccctccagg

SEQ ID NO: 5790590 - DNA, 18 bp, Homo sapiens
tcacccctccctccctct

SEQ ID NO: 5790591 - DNA, 17 bp, Homo sapiens
tcacccctccctttctc

SEQ ID NO: 5790592 - DNA, 20 bp, Homo sapiens
tcacccctcgccacctttca

SEQ ID NO: 5790593 - DNA, 14 bp, Homo sapiens
tcacccctctgccc

SEQ ID NO: 5790594 - DNA, 20 bp, Homo sapiens
tcacccctctgcccctgcag

SEQ ID NO: 5790595 - DNA, 21 bp, Homo sapiens
tcacccctctgcccctgcagc

SEQ ID NO: 5790596 - DNA, 18 bp, Homo sapiens
tcacccctcttcccacca

SEQ ID NO: 5790597 - DNA, 13 bp, Homo sapiens
tcacccctgcccc

SEQ ID NO: 5790598 - DNA, 15 bp, Homo sapiens
tcacccctgcccctg

SEQ ID NO: 5790599 - DNA, 18 bp, Homo sapiens
tcacccctgcccctgtgg

SEQ ID NO: 5790600 - DNA, 20 bp, Homo sapiens
tcacccctgcccctgtggga

SEQ ID NO: 5790601 - DNA, 13 bp, Homo sapiens
tcacccctgccct

SEQ ID NO: 5790602 - DNA, 17 bp, Homo sapiens
tcacccctgccctggga

SEQ ID NO: 5790603 - DNA, 13 bp, Homo sapiens
tcacccctgggca

SEQ ID NO: 5790604 - DNA, 20 bp, Homo sapiens
tcacccctggtggctgcagg

SEQ ID NO: 5790605 - DNA, 17 bp, Homo sapiens
tcacccctgtcctcact

SEQ ID NO: 5790606 - DNA, 20 bp, Homo sapiens
tcacccctgtcctcactgct

SEQ ID NO: 5790607 - DNA, 15 bp, Homo sapiens
tcacccctgtttctg

SEQ ID NO: 5790608 - DNA, 13 bp, Homo sapiens
tcaccccttcccc

SEQ ID NO: 5790609 - DNA, 16 bp, Homo sapiens
tcaccccttccccatt

SEQ ID NO: 5790610 - DNA, 19 bp, Homo sapiens
tcacccgagttcctctggg

SEQ ID NO: 5790611 - DNA, 13 bp, Homo sapiens
tcacccgctgccc

SEQ ID NO: 5790612 - DNA, 15 bp, Homo sapiens
tcacccgctgcccag

SEQ ID NO: 5790613 - DNA, 17 bp, Homo sapiens
tcacccgctgcccagcc

SEQ ID NO: 5790614 - DNA, 18 bp, Homo sapiens
tcacccgctgcccagccc

SEQ ID NO: 5790615 - DNA, 14 bp, Homo sapiens
tcacccggctgggc

SEQ ID NO: 5790616 - DNA, 15 bp, Homo sapiens
tcaccctagccctct

SEQ ID NO: 5790617 - DNA, 17 bp, Homo sapiens
tcaccctagccctctcc

SEQ ID NO: 5790618 - DNA, 13 bp, Homo sapiens
tcaccctattttc

SEQ ID NO: 5790619 - DNA, 13 bp, Homo sapiens
tcaccctcaccca

SEQ ID NO: 5790620 - DNA, 15 bp, Homo sapiens
tcaccctcagctggc

SEQ ID NO: 5790621 - DNA, 23 bp, Homo sapiens
tcactcggctttggctcgggact

SEQ ID NO: 5790622 - DNA, 21 bp, Homo sapiens
tcactcgtaggggatgtggag

SEQ ID NO: 5790623 - DNA, 16 bp, Homo sapiens
tcactcgtctccccca

SEQ ID NO: 5790624 - DNA, 16 bp, Homo sapiens
tcactctaaaaaacat

SEQ ID NO: 5790625 - DNA, 15 bp, Homo sapiens
tcactctaagatgtt

SEQ ID NO: 5790626 - DNA, 16 bp, Homo sapiens
tcactctaagatgtta

SEQ ID NO: 5790627 - DNA, 17 bp, Homo sapiens
tcactctaagatgttat

SEQ ID NO: 5790628 - DNA, 22 bp, Homo sapiens
tcactctaagatgttatatttt

SEQ ID NO: 5790629 - DNA, 21 bp, Homo sapiens
tcactctaattaattgtaatc

SEQ ID NO: 5790630 - DNA, 21 bp, Homo sapiens
tcactctaattggtcattcct

SEQ ID NO: 5790631 - DNA, 20 bp, Homo sapiens
tcactctacttagcatgtcc

SEQ ID NO: 5790632 - DNA, 20 bp, Homo sapiens
tcactctagtcaatgacatg

SEQ ID NO: 5790633 - DNA, 17 bp, Homo sapiens
tcactctcccagaggct

SEQ ID NO: 5790634 - DNA, 23 bp, Homo sapiens
tcactctccttggtgtcgggcat

SEQ ID NO: 5790635 - DNA, 15 bp, Homo sapiens
tcactctctccgtct

SEQ ID NO: 5790636 - DNA, 15 bp, Homo sapiens
tcactctctgaagat

SEQ ID NO: 5790637 - DNA, 18 bp, Homo sapiens
tcactctcttcctttcat

SEQ ID NO: 5790638 - DNA, 16 bp, Homo sapiens
tcactctgacagtatt

SEQ ID NO: 5790639 - DNA, 20 bp, Homo sapiens
tcactctgacagtattaaca

SEQ ID NO: 5790640 - DNA, 17 bp, Homo sapiens
tcactctgagtgtttta

SEQ ID NO: 5790641 - DNA, 11 bp, Homo sapiens
tcactctgcca

SEQ ID NO: 5790642 - DNA, 14 bp, Homo sapiens
tcactctgccaggg

SEQ ID NO: 5790643 - DNA, 13 bp, Homo sapiens
tcactctgccctc

SEQ ID NO: 5790644 - DNA, 14 bp, Homo sapiens
tcactctgccctct

SEQ ID NO: 5790645 - DNA, 18 bp, Homo sapiens
tcactctgccctctgctg

SEQ ID NO: 5790646 - DNA, 20 bp, Homo sapiens
tcactctgccctctgctgct

SEQ ID NO: 5790647 - DNA, 12 bp, Homo sapiens
tcactctggcag

SEQ ID NO: 5790648 - DNA, 13 bp, Homo sapiens
tcactctggcagc

SEQ ID NO: 5790649 - DNA, 17 bp, Homo sapiens
tcactctggcagcctca

SEQ ID NO: 5790650 - DNA, 20 bp, Homo sapiens
tcactctggcagcctcagag

SEQ ID NO: 5790651 - DNA, 19 bp, Homo sapiens
tcactctggcagctcagag

SEQ ID NO: 5790652 - DNA, 12 bp, Homo sapiens
tcactctggctt

SEQ ID NO: 5790653 - DNA, 21 bp, Homo sapiens
tcactctgggcacactctgcc

SEQ ID NO: 5790654 - DNA, 12 bp, Homo sapiens
tcactctgggct

SEQ ID NO: 5790655 - DNA, 13 bp, Homo sapiens
tcactctgggctg

SEQ ID NO: 5790656 - DNA, 15 bp, Homo sapiens
tcactctgtcagcca

SEQ ID NO: 5790657 - DNA, 23 bp, Homo sapiens
tcactctgtcagccagccgccct

SEQ ID NO: 5790658 - DNA, 18 bp, Homo sapiens
tcactctgtccctgtcct

SEQ ID NO: 5790659 - DNA, 21 bp, Homo sapiens
tcactctgtccctgtccttcc

SEQ ID NO: 5790660 - DNA, 19 bp, Homo sapiens
tcactctgtcgcccagtct

SEQ ID NO: 5790661 - DNA, 14 bp, Homo sapiens
tcactctgtcgctc

SEQ ID NO: 5790662 - DNA, 22 bp, Homo sapiens
tcactctgtcgctcaggctgga

SEQ ID NO: 5790663 - DNA, 22 bp, Homo sapiens
tcactctgttcattcctccagg

SEQ ID NO: 5790664 - DNA, 11 bp, Homo sapiens
tcactctgttg

SEQ ID NO: 5790665 - DNA, 17 bp, Homo sapiens
tcactcttatgaaatgg

SEQ ID NO: 5790666 - DNA, 15 bp, Homo sapiens
tcactcttatgctgt

SEQ ID NO: 5790667 - DNA, 14 bp, Homo sapiens
tcactcttcacttg

SEQ ID NO: 5790668 - DNA, 14 bp, Homo sapiens
tcactcttcctcat

SEQ ID NO: 5790669 - DNA, 17 bp, Homo sapiens
tcactcttcctcatcct

SEQ ID NO: 5790670 - DNA, 13 bp, Homo sapiens
tcactcttctcag

SEQ ID NO: 5790671 - DNA, 14 bp, Homo sapiens
tcactcttctcagc

SEQ ID NO: 5790672 - DNA, 17 bp, Homo sapiens
tcactcttctcagccac

SEQ ID NO: 5790673 - DNA, 18 bp, Homo sapiens
tcactcttctcagccact

SEQ ID NO: 5790674 - DNA, 18 bp, Homo sapiens
tcactcttgaagtccagg

SEQ ID NO: 5790675 - DNA, 21 bp, Homo sapiens
tcactcttgaagtccaggact

SEQ ID NO: 5790676 - DNA, 16 bp, Homo sapiens
tcactcttgccaacct

SEQ ID NO: 5790677 - DNA, 14 bp, Homo sapiens
tcactcttggagcc

SEQ ID NO: 5790678 - DNA, 18 bp, Homo sapiens
tcactcttggagcctgca

SEQ ID NO: 5790679 - DNA, 16 bp, Homo sapiens
tcactcttggtccctg

SEQ ID NO: 5790680 - DNA, 19 bp, Homo sapiens
tcactcttgtactgcctgc

SEQ ID NO: 5790681 - DNA, 22 bp, Homo sapiens
tcactcttgtcacccaggctgg

SEQ ID NO: 5790682 - DNA, 20 bp, Homo sapiens
tcactcttgtggatgtttta

SEQ ID NO: 5790683 - DNA, 21 bp, Homo sapiens
tcactcttgtggatgttttaa

SEQ ID NO: 5790684 - DNA, 14 bp, Homo sapiens
tcactctttagaaa

SEQ ID NO: 5790685 - DNA, 18 bp, Homo sapiens
tcactctttagatattta

SEQ ID NO: 5790686 - DNA, 11 bp, Homo sapiens
tcactctttat

SEQ ID NO: 5790687 - DNA, 19 bp, Homo sapiens
tcactctttatagtgcaca

SEQ ID NO: 5790688 - DNA, 23 bp, Homo sapiens
tcactctttcttctctctttgtc

SEQ ID NO: 5790689 - DNA, 23 bp, Homo sapiens
tcactcttttaagatcttgttaa

SEQ ID NO: 5790690 - DNA, 22 bp, Homo sapiens
tcactgaaaaaatgtagctttt

SEQ ID NO: 5790691 - DNA, 20 bp, Homo sapiens
tcactgaaaacatctggaag

SEQ ID NO: 5790692 - DNA, 14 bp, Homo sapiens
tcactgaaaactat

SEQ ID NO: 5790693 - DNA, 17 bp, Homo sapiens
tcactgaaacctctgcc

SEQ ID NO: 5790694 - DNA, 21 bp, Homo sapiens
tcactgaaacctttaagaaaa

SEQ ID NO: 5790695 - DNA, 14 bp, Homo sapiens
tcactgaacatgcc

SEQ ID NO: 5790696 - DNA, 14 bp, Homo sapiens
tcactgaaccactg

SEQ ID NO: 5790697 - DNA, 16 bp, Homo sapiens
tcactgaaccactgct

SEQ ID NO: 5790698 - DNA, 15 bp, Homo sapiens
tcactgaactccacc

SEQ ID NO: 5790699 - DNA, 19 bp, Homo sapiens
tcactgaagattgggtagc

SEQ ID NO: 5790700 - DNA, 11 bp, Homo sapiens
tcactgaagcc

SEQ ID NO: 5790701 - DNA, 17 bp, Homo sapiens
tcactgaagcccagacc

SEQ ID NO: 5790702 - DNA, 19 bp, Homo sapiens
tcactgaaggacctgagct

SEQ ID NO: 5790703 - DNA, 20 bp, Homo sapiens
tcactgaaggacctgagctg

SEQ ID NO: 5790704 - DNA, 16 bp, Homo sapiens
tcactgaagtgaatac

SEQ ID NO: 5790705 - DNA, 15 bp, Homo sapiens
tcactgaataaataa

SEQ ID NO: 5790706 - DNA, 22 bp, Homo sapiens
tcactgaataatggaattatgt

SEQ ID NO: 5790707 - DNA, 23 bp, Homo sapiens
tcactgaataatggaattatgta

SEQ ID NO: 5790708 - DNA, 18 bp, Homo sapiens
tcactgaatatcatatgt

SEQ ID NO: 5790709 - DNA, 20 bp, Homo sapiens
tcactgaatatcatatgtat

SEQ ID NO: 5790710 - DNA, 23 bp, Homo sapiens
tcactgaatgcttctgacttcat

SEQ ID NO: 5790711 - DNA, 14 bp, Homo sapiens
tcactgaatttata

SEQ ID NO: 5790712 - DNA, 15 bp, Homo sapiens
tcactgacacaaagg

SEQ ID NO: 5790713 - DNA, 17 bp, Homo sapiens
tcactgacacaaaggaa

SEQ ID NO: 5790714 - DNA, 16 bp, Homo sapiens
tcactgacacatcagc

SEQ ID NO: 5790715 - DNA, 23 bp, Homo sapiens
tcactgacacatcagcatgtttt

SEQ ID NO: 5790716 - DNA, 20 bp, Homo sapiens
tcactgacatcagcactgcc

SEQ ID NO: 5790717 - DNA, 14 bp, Homo sapiens
tcactgaccagcgg

SEQ ID NO: 5790718 - DNA, 16 bp, Homo sapiens
tcactgaccagcggct

SEQ ID NO: 5790719 - DNA, 17 bp, Homo sapiens
tcactgaccagcggctg

SEQ ID NO: 5790720 - DNA, 14 bp, Homo sapiens
tcactgactcaggc

SEQ ID NO: 5790721 - DNA, 15 bp, Homo sapiens
tcactgactctgact

SEQ ID NO: 5790722 - DNA, 22 bp, Homo sapiens
tcactgagaaggccccagggca

SEQ ID NO: 5790723 - DNA, 13 bp, Homo sapiens
tcactgagacagc

SEQ ID NO: 5790724 - DNA, 14 bp, Homo sapiens
tcactgagacagcc

SEQ ID NO: 5790725 - DNA, 15 bp, Homo sapiens
tcactgagacagccc

SEQ ID NO: 5790726 - DNA, 17 bp, Homo sapiens
tcactgagacagcccgg

SEQ ID NO: 5790727 - DNA, 21 bp, Homo sapiens
tcactgagacagcccgggctc

SEQ ID NO: 5790728 - DNA, 12 bp, Homo sapiens
tcactgagagct

SEQ ID NO: 5790729 - DNA, 17 bp, Homo sapiens
tcactgagaggcctgga

SEQ ID NO: 5790730 - DNA, 16 bp, Homo sapiens
tcactgagccatcatt

SEQ ID NO: 5790731 - DNA, 12 bp, Homo sapiens
tcactgagcctc

SEQ ID NO: 5790732 - DNA, 16 bp, Homo sapiens
tcactgagctccccag

SEQ ID NO: 5790733 - DNA, 13 bp, Homo sapiens
tcactgaggccat

SEQ ID NO: 5790734 - DNA, 21 bp, Homo sapiens
tcactgaggccatcagggccc

SEQ ID NO: 5790735 - DNA, 22 bp, Homo sapiens
tcactgaggccatcagggccct

SEQ ID NO: 5790736 - DNA, 21 bp, Homo sapiens
tcactgagggggagctgtctt

SEQ ID NO: 5790737 - DNA, 20 bp, Homo sapiens
tcactgagttttgtttcact

SEQ ID NO: 5790738 - DNA, 21 bp, Homo sapiens
tcactgagttttgtttcactt

SEQ ID NO: 5790739 - DNA, 22 bp, Homo sapiens
tcactgagttttgtttcacttt

SEQ ID NO: 5790740 - DNA, 20 bp, Homo sapiens
tcactgatattttttataca

SEQ ID NO: 5790741 - DNA, 14 bp, Homo sapiens
tcactgatgggaat

SEQ ID NO: 5790742 - DNA, 15 bp, Homo sapiens
tcactgatgggaata

SEQ ID NO: 5790743 - DNA, 14 bp, Homo sapiens
tcactgcaaacaca

SEQ ID NO: 5790744 - DNA, 18 bp, Homo sapiens
tcactgcaaacacacctt

SEQ ID NO: 5790745 - DNA, 20 bp, Homo sapiens
tcactgcaacatgatgaggt

SEQ ID NO: 5790746 - DNA, 18 bp, Homo sapiens
tcactgcaacctccgcct

SEQ ID NO: 5790747 - DNA, 18 bp, Homo sapiens
tcactgcaacctctacct

SEQ ID NO: 5790748 - DNA, 17 bp, Homo sapiens
tcactgcaacctctgcc

SEQ ID NO: 5790749 - DNA, 22 bp, Homo sapiens
tcactgcaacctcttcctcctg

SEQ ID NO: 5790750 - DNA, 15 bp, Homo sapiens
tcactgcaaccttca

SEQ ID NO: 5790751 - DNA, 21 bp, Homo sapiens
tcactgcaaccttcgccacct

SEQ ID NO: 5790752 - DNA, 21 bp, Homo sapiens
tcactgcaacttccgcctcct

SEQ ID NO: 5790753 - DNA, 18 bp, Homo sapiens
tcactgcaacttctgcct

SEQ ID NO: 5790754 - DNA, 16 bp, Homo sapiens
tcactgcaatctctgc

SEQ ID NO: 5790755 - DNA, 21 bp, Homo sapiens
tcactgcagcatgcccagtgc

SEQ ID NO: 5790756 - DNA, 13 bp, Homo sapiens
tcactgcagccca

SEQ ID NO: 5790757 - DNA, 18 bp, Homo sapiens
tcactgcagcccaggagg

SEQ ID NO: 5790758 - DNA, 12 bp, Homo sapiens
tcactgcagcct

SEQ ID NO: 5790759 - DNA, 14 bp, Homo sapiens
tcactgcagcctca

SEQ ID NO: 5790760 - DNA, 13 bp, Homo sapiens
tcactgcagcctt

SEQ ID NO: 5790761 - DNA, 14 bp, Homo sapiens
tcactgcagccttg

SEQ ID NO: 5790762 - DNA, 18 bp, Homo sapiens
tcactgcagccttgtcct

SEQ ID NO: 5790763 - DNA, 14 bp, Homo sapiens
tcactgcagccttt

SEQ ID NO: 5790764 - DNA, 15 bp, Homo sapiens
tcactgcagcctttc

SEQ ID NO: 5790765 - DNA, 19 bp, Homo sapiens
tcactgcagcgcgctcctg

SEQ ID NO: 5790766 - DNA, 17 bp, Homo sapiens
tcactgcagtcacctct

SEQ ID NO: 5790767 - DNA, 18 bp, Homo sapiens
tcactgcagtcacctctt

SEQ ID NO: 5790768 - DNA, 17 bp, Homo sapiens
tcactgcagtcttattt

SEQ ID NO: 5790769 - DNA, 13 bp, Homo sapiens
tcactgcatcctc

SEQ ID NO: 5790770 - DNA, 17 bp, Homo sapiens
tcactgcattattctct

SEQ ID NO: 5790771 - DNA, 18 bp, Homo sapiens
tcactgcattattctctt

SEQ ID NO: 5790772 - DNA, 21 bp, Homo sapiens
tcactgcattcattctgagcc

SEQ ID NO: 5790773 - DNA, 15 bp, Homo sapiens
tcactgccacactct

SEQ ID NO: 5790774 - DNA, 19 bp, Homo sapiens
tcactgccacactctccat

SEQ ID NO: 5790775 - DNA, 16 bp, Homo sapiens
tcactgccactttgca

SEQ ID NO: 5790776 - DNA, 17 bp, Homo sapiens
tcactgccactttgcac

SEQ ID NO: 5790777 - DNA, 19 bp, Homo sapiens
tcactgccactttgcacat

SEQ ID NO: 5790778 - DNA, 20 bp, Homo sapiens
tcactgccactttgcacatt

SEQ ID NO: 5790779 - DNA, 14 bp, Homo sapiens
tcactgccagagct

SEQ ID NO: 5790780 - DNA, 15 bp, Homo sapiens
tcactgccaggccag

SEQ ID NO: 5790781 - DNA, 20 bp, Homo sapiens
tcactgccaggccagcctcc

SEQ ID NO: 5790782 - DNA, 23 bp, Homo sapiens
tcactgccaggccagcctccgag

SEQ ID NO: 5790783 - DNA, 13 bp, Homo sapiens
tcactgccatgat

SEQ ID NO: 5790784 - DNA, 15 bp, Homo sapiens
tcactgccatgatag

SEQ ID NO: 5790785 - DNA, 20 bp, Homo sapiens
tcactgccatgatagctggg

SEQ ID NO: 5790786 - DNA, 18 bp, Homo sapiens
tcactgccatgccagctt

SEQ ID NO: 5790787 - DNA, 15 bp, Homo sapiens
tcactgcccaccaaa

SEQ ID NO: 5790788 - DNA, 20 bp, Homo sapiens
tcactgcccacctgccaggc

SEQ ID NO: 5790789 - DNA, 22 bp, Homo sapiens
tcactgcccacctgccaggctg

SEQ ID NO: 5790790 - DNA, 16 bp, Homo sapiens
tcactgcctcatggca

SEQ ID NO: 5790791 - DNA, 20 bp, Homo sapiens
tcactgcctctttgcagtag

SEQ ID NO: 5790792 - DNA, 15 bp, Homo sapiens
tcactgcctgcagct

SEQ ID NO: 5790793 - DNA, 17 bp, Homo sapiens
tcactgccttggcccct

SEQ ID NO: 5790794 - DNA, 14 bp, Homo sapiens
tcactgctacatgt

SEQ ID NO: 5790795 - DNA, 21 bp, Homo sapiens
tcactgctcacacgctgcctc

SEQ ID NO: 5790796 - DNA, 14 bp, Homo sapiens
tcactgctcacact

SEQ ID NO: 5790797 - DNA, 12 bp, Homo sapiens
tcactgctccag

SEQ ID NO: 5790798 - DNA, 13 bp, Homo sapiens
tcactgctccagg

SEQ ID NO: 5790799 - DNA, 16 bp, Homo sapiens
tcagaaagtaatttct

SEQ ID NO: 5790800 - DNA, 15 bp, Homo sapiens
tcagaaagtgcctga

SEQ ID NO: 5790801 - DNA, 18 bp, Homo sapiens
tcagaaagtgtaaatgtt

SEQ ID NO: 5790802 - DNA, 18 bp, Homo sapiens
tcagaaagtgtataataa

SEQ ID NO: 5790803 - DNA, 15 bp, Homo sapiens
tcagaaagtttgaag

SEQ ID NO: 5790804 - DNA, 17 bp, Homo sapiens
tcagaaataaatcacag

SEQ ID NO: 5790805 - DNA, 14 bp, Homo sapiens
tcagaaatagctcc

SEQ ID NO: 5790806 - DNA, 14 bp, Homo sapiens
tcagaaataggaag

SEQ ID NO: 5790807 - DNA, 16 bp, Homo sapiens
tcagaaataggaagat

SEQ ID NO: 5790808 - DNA, 19 bp, Homo sapiens
tcagaaataggaagattaa

SEQ ID NO: 5790809 - DNA, 13 bp, Homo sapiens
tcagaaatataac

SEQ ID NO: 5790810 - DNA, 20 bp, Homo sapiens
tcagaaatcctctgttaatg

SEQ ID NO: 5790811 - DNA, 21 bp, Homo sapiens
tcagaaatcctctgttaatgt

SEQ ID NO: 5790812 - DNA, 18 bp, Homo sapiens
tcagaaatccttgtattt

SEQ ID NO: 5790813 - DNA, 19 bp, Homo sapiens
tcagaaatccttgtattta

SEQ ID NO: 5790814 - DNA, 17 bp, Homo sapiens
tcagaaatgactttttg

SEQ ID NO: 5790815 - DNA, 17 bp, Homo sapiens
tcagaaatgattcaggg

SEQ ID NO: 5790816 - DNA, 15 bp, Homo sapiens
tcagaaatgtctgga

SEQ ID NO: 5790817 - DNA, 15 bp, Homo sapiens
tcagaaatgtgttat

SEQ ID NO: 5790818 - DNA, 21 bp, Homo sapiens
tcagaaattccaactcctgat

SEQ ID NO: 5790819 - DNA, 22 bp, Homo sapiens
tcagaaattcgccccattttct

SEQ ID NO: 5790820 - DNA, 23 bp, Homo sapiens
tcagaaattcgccccattttctt

SEQ ID NO: 5790821 - DNA, 13 bp, Homo sapiens
tcagaaattctca

SEQ ID NO: 5790822 - DNA, 19 bp, Homo sapiens
tcagaaatttttatcagtt

SEQ ID NO: 5790823 - DNA, 22 bp, Homo sapiens
tcagaaatttttatcagtttcc

SEQ ID NO: 5790824 - DNA, 15 bp, Homo sapiens
tcagaacaaaacttc

SEQ ID NO: 5790825 - DNA, 16 bp, Homo sapiens
tcagaacaaattcagg

SEQ ID NO: 5790826 - DNA, 19 bp, Homo sapiens
tcagaacaccaagacttga

SEQ ID NO: 5790827 - DNA, 16 bp, Homo sapiens
tcagaacagagccttt

SEQ ID NO: 5790828 - DNA, 21 bp, Homo sapiens
tcagaacagaggcatttaaaa

SEQ ID NO: 5790829 - DNA, 20 bp, Homo sapiens
tcagaacagatgctgagcca

SEQ ID NO: 5790830 - DNA, 14 bp, Homo sapiens
tcagaacagcagac

SEQ ID NO: 5790831 - DNA, 14 bp, Homo sapiens
tcagaacagctgtt

SEQ ID NO: 5790832 - DNA, 16 bp, Homo sapiens
tcagaacagctgttga

SEQ ID NO: 5790833 - DNA, 16 bp, Homo sapiens
tcagaacatactgatt

SEQ ID NO: 5790834 - DNA, 17 bp, Homo sapiens
tcagaacatcctccaat

SEQ ID NO: 5790835 - DNA, 16 bp, Homo sapiens
tcagaacatgttaaga

SEQ ID NO: 5790836 - DNA, 17 bp, Homo sapiens
tcagaacattcagctct

SEQ ID NO: 5790837 - DNA, 20 bp, Homo sapiens
tcagaacattcagctctgga

SEQ ID NO: 5790838 - DNA, 21 bp, Homo sapiens
tcagaaccaaatctttcccct

SEQ ID NO: 5790839 - DNA, 20 bp, Homo sapiens
tcagaaccagagggcatgct

SEQ ID NO: 5790840 - DNA, 21 bp, Homo sapiens
tcagaaccagagggcatgctg

SEQ ID NO: 5790841 - DNA, 23 bp, Homo sapiens
tcagaaccagagggcatgctgaa

SEQ ID NO: 5790842 - DNA, 13 bp, Homo sapiens
tcagaacccaggg

SEQ ID NO: 5790843 - DNA, 16 bp, Homo sapiens
tcagaaccctgccatg

SEQ ID NO: 5790844 - DNA, 17 bp, Homo sapiens
tcagaaccctgccatgg

SEQ ID NO: 5790845 - DNA, 20 bp, Homo sapiens
tcagaacccttggcttgccc

SEQ ID NO: 5790846 - DNA, 20 bp, Homo sapiens
tcagaacctcttccccagaa

SEQ ID NO: 5790847 - DNA, 21 bp, Homo sapiens
tcagaacctgttattttatgt

SEQ ID NO: 5790848 - DNA, 19 bp, Homo sapiens
tcagaaccttgtcccagcc

SEQ ID NO: 5790849 - DNA, 19 bp, Homo sapiens
tcagaacctttggacaaga

SEQ ID NO: 5790850 - DNA, 18 bp, Homo sapiens
tcagaactaaatttttca

SEQ ID NO: 5790851 - DNA, 16 bp, Homo sapiens
tcagaactataacatt

SEQ ID NO: 5790852 - DNA, 18 bp, Homo sapiens
tcagaactatttaaaata

SEQ ID NO: 5790853 - DNA, 22 bp, Homo sapiens
tcagaactcaaatggggccaga

SEQ ID NO: 5790854 - DNA, 17 bp, Homo sapiens
tcagaactcctttctaa

SEQ ID NO: 5790855 - DNA, 19 bp, Homo sapiens
tcagaactcgttaaagcaa

SEQ ID NO: 5790856 - DNA, 18 bp, Homo sapiens
tcagaactcttcctcctc

SEQ ID NO: 5790857 - DNA, 13 bp, Homo sapiens
tcagaactgccct

SEQ ID NO: 5790858 - DNA, 16 bp, Homo sapiens
tcagaactgcccttgc

SEQ ID NO: 5790859 - DNA, 15 bp, Homo sapiens
tcagaactgttggct

SEQ ID NO: 5790860 - DNA, 18 bp, Homo sapiens
tcagaactgttggctgct

SEQ ID NO: 5790861 - DNA, 15 bp, Homo sapiens
tcagaactgtttttg

SEQ ID NO: 5790862 - DNA, 17 bp, Homo sapiens
tcagaacttcatctgcc

SEQ ID NO: 5790863 - DNA, 19 bp, Homo sapiens
tcagaacttgtaactaaag

SEQ ID NO: 5790864 - DNA, 13 bp, Homo sapiens
tcagaagaaaaag

SEQ ID NO: 5790865 - DNA, 17 bp, Homo sapiens
tcagaagaaaaagaagc

SEQ ID NO: 5790866 - DNA, 14 bp, Homo sapiens
tcagaagaaaacaa

SEQ ID NO: 5790867 - DNA, 23 bp, Homo sapiens
tcagaagaaaacaaagttctatt

SEQ ID NO: 5790868 - DNA, 16 bp, Homo sapiens
tcagaagaaataaata

SEQ ID NO: 5790869 - DNA, 23 bp, Homo sapiens
tcagaagaacatgattttacaag

SEQ ID NO: 5790870 - DNA, 22 bp, Homo sapiens
tcagaagaatctctatgccctg

SEQ ID NO: 5790871 - DNA, 16 bp, Homo sapiens
tcagaagaatcttcct

SEQ ID NO: 5790872 - DNA, 22 bp, Homo sapiens
tcagaagaatcttcctggcaca

SEQ ID NO: 5790873 - DNA, 14 bp, Homo sapiens
tcagaagacactaa

SEQ ID NO: 5790874 - DNA, 13 bp, Homo sapiens
tcagaagacactg

SEQ ID NO: 5790875 - DNA, 19 bp, Homo sapiens
tcagaagacctccctgtga

SEQ ID NO: 5790876 - DNA, 13 bp, Homo sapiens
tcagaagacttga

SEQ ID NO: 5790877 - DNA, 22 bp, Homo sapiens
tcagaagagaaatacagctggc

SEQ ID NO: 5790878 - DNA, 13 bp, Homo sapiens
tcagaagagcagc

SEQ ID NO: 5790879 - DNA, 19 bp, Homo sapiens
tcagaagagggagaggagg

SEQ ID NO: 5790880 - DNA, 20 bp, Homo sapiens
tcagaagatagtcttggaag

SEQ ID NO: 5790881 - DNA, 22 bp, Homo sapiens
tcagaagatctttcttaataga

SEQ ID NO: 5790882 - DNA, 15 bp, Homo sapiens
tcagaagcaaggaag

SEQ ID NO: 5790883 - DNA, 17 bp, Homo sapiens
tcagaagcaaggaagta

SEQ ID NO: 5790884 - DNA, 18 bp, Homo sapiens
tcagaagcacagaatatt

SEQ ID NO: 5790885 - DNA, 13 bp, Homo sapiens
tcagaagcaggca

SEQ ID NO: 5790886 - DNA, 14 bp, Homo sapiens
tcagaagcaggcag

SEQ ID NO: 5790887 - DNA, 15 bp, Homo sapiens
tcagaagcaggcagg

SEQ ID NO: 5790888 - DNA, 13 bp, Homo sapiens
tcagaagccagtc

SEQ ID NO: 5790889 - DNA, 19 bp, Homo sapiens
tcagaagccagtctgcgtc

SEQ ID NO: 5790890 - DNA, 20 bp, Homo sapiens
tcagaagcctattgtaaata

SEQ ID NO: 5790891 - DNA, 15 bp, Homo sapiens
tcagaagcctccaag

SEQ ID NO: 5790892 - DNA, 20 bp, Homo sapiens
tcagaagcctgaggctggga

SEQ ID NO: 5790893 - DNA, 14 bp, Homo sapiens
tcagaagcctgggg

SEQ ID NO: 5790894 - DNA, 19 bp, Homo sapiens
tcagaagcctgggggcctg

SEQ ID NO: 5790895 - DNA, 22 bp, Homo sapiens
tcagaagcctgggggcctggct

SEQ ID NO: 5790896 - DNA, 21 bp, Homo sapiens
tcagaagccttcttgctgccc

SEQ ID NO: 5790897 - DNA, 19 bp, Homo sapiens
tcagaagctgatgaggaat

SEQ ID NO: 5790898 - DNA, 12 bp, Homo sapiens
tcagaaggaagc

SEQ ID NO: 5790899 - DNA, 18 bp, Homo sapiens
tcagaaggacggcaggag

SEQ ID NO: 5790900 - DNA, 13 bp, Homo sapiens
tcagaaggagaag

SEQ ID NO: 5790901 - DNA, 15 bp, Homo sapiens
tcagaaggagaagga

SEQ ID NO: 5790902 - DNA, 16 bp, Homo sapiens
tcagaaggagacagaa

SEQ ID NO: 5790903 - DNA, 17 bp, Homo sapiens
tcagaaggagacagaat

SEQ ID NO: 5790904 - DNA, 20 bp, Homo sapiens
tcagaaggagacagaatgag

SEQ ID NO: 5790905 - DNA, 15 bp, Homo sapiens
tcagaaggagctaca

SEQ ID NO: 5790906 - DNA, 19 bp, Homo sapiens
tcagaaggcaaatgacttt

SEQ ID NO: 5790907 - DNA, 20 bp, Homo sapiens
tcagaaggccccagagagac

SEQ ID NO: 5790908 - DNA, 21 bp, Homo sapiens
tcagaaggctctatctgctgg

SEQ ID NO: 5790909 - DNA, 23 bp, Homo sapiens
tcagaagggagctagccagagga

SEQ ID NO: 5790910 - DNA, 16 bp, Homo sapiens
tcagaagggaggctgg

SEQ ID NO: 5790911 - DNA, 15 bp, Homo sapiens
tcagaaggggagggg

SEQ ID NO: 5790912 - DNA, 20 bp, Homo sapiens
tcagaaggggatggtgttgt

SEQ ID NO: 5790913 - DNA, 14 bp, Homo sapiens
tcagaaggtagggg

SEQ ID NO: 5790914 - DNA, 16 bp, Homo sapiens
tcagaagtaactccca

SEQ ID NO: 5790915 - DNA, 23 bp, Homo sapiens
tcagaagtatggaattttctgcc

SEQ ID NO: 5790916 - DNA, 13 bp, Homo sapiens
tcagaagtgcaaa

SEQ ID NO: 5790917 - DNA, 15 bp, Homo sapiens
tcagaagttaacatc

SEQ ID NO: 5790918 - DNA, 16 bp, Homo sapiens
tcagaagttactttta

SEQ ID NO: 5790919 - DNA, 17 bp, Homo sapiens
tcagaagttgtgctaaa

SEQ ID NO: 5790920 - DNA, 17 bp, Homo sapiens
tcagaagtttaaatatt

SEQ ID NO: 5790921 - DNA, 23 bp, Homo sapiens
tcagaagtttaaatattaagcat

SEQ ID NO: 5790922 - DNA, 19 bp, Homo sapiens
tcagaagtttctcagctcc

SEQ ID NO: 5790923 - DNA, 22 bp, Homo sapiens
tcagaagtttctgccgcagccc

SEQ ID NO: 5790924 - DNA, 18 bp, Homo sapiens
tcagaataaaaatgtggt

SEQ ID NO: 5790925 - DNA, 13 bp, Homo sapiens
tcagaataaaatt

SEQ ID NO: 5790926 - DNA, 17 bp, Homo sapiens
tcagaataaagttgtat

SEQ ID NO: 5790927 - DNA, 20 bp, Homo sapiens
tcagaataaagttgtatttc

SEQ ID NO: 5790928 - DNA, 22 bp, Homo sapiens
tcagaataaagttgtatttcaa

SEQ ID NO: 5790929 - DNA, 17 bp, Homo sapiens
tcagaataactacctcc

SEQ ID NO: 5790930 - DNA, 23 bp, Homo sapiens
tcagaatagctgttttgtgtata

SEQ ID NO: 5790931 - DNA, 22 bp, Homo sapiens
tcagaatagcttccaataaagc

SEQ ID NO: 5790932 - DNA, 16 bp, Homo sapiens
tcagaataggaaaaca

SEQ ID NO: 5790933 - DNA, 17 bp, Homo sapiens
tcagaataggaaaacat

SEQ ID NO: 5790934 - DNA, 15 bp, Homo sapiens
tcagaataggaagat

SEQ ID NO: 5790935 - DNA, 20 bp, Homo sapiens
tcagaatataacatgtaaaa

SEQ ID NO: 5790936 - DNA, 13 bp, Homo sapiens
tcagaatatattc

SEQ ID NO: 5790937 - DNA, 15 bp, Homo sapiens
tcagaatatcatctt

SEQ ID NO: 5790938 - DNA, 15 bp, Homo sapiens
tcagaatatgtcagt

SEQ ID NO: 5790939 - DNA, 20 bp, Homo sapiens
tcagaatattaagcacatta

SEQ ID NO: 5790940 - DNA, 17 bp, Homo sapiens
tcagaatattaataaaa

SEQ ID NO: 5790941 - DNA, 14 bp, Homo sapiens
tcagaatattttca

SEQ ID NO: 5790942 - DNA, 19 bp, Homo sapiens
tcagaatcaaatctgagcc

SEQ ID NO: 5790943 - DNA, 19 bp, Homo sapiens
tcagaatcacttctgagaa

SEQ ID NO: 5790944 - DNA, 17 bp, Homo sapiens
tcagaatcatggagaaa

SEQ ID NO: 5790945 - DNA, 14 bp, Homo sapiens
tcagaatccaaaga

SEQ ID NO: 5790946 - DNA, 15 bp, Homo sapiens
tcagaatccaaagat

SEQ ID NO: 5790947 - DNA, 22 bp, Homo sapiens
tcagaatcctttacattcaact

SEQ ID NO: 5790948 - DNA, 18 bp, Homo sapiens
tcagaatctaaacgtggt

SEQ ID NO: 5790949 - DNA, 19 bp, Homo sapiens
tcagaatctaaacgtggtc

SEQ ID NO: 5790950 - DNA, 20 bp, Homo sapiens
tcagaatctacccaaaggat

SEQ ID NO: 5790951 - DNA, 21 bp, Homo sapiens
tcagaatctctctactcagat

SEQ ID NO: 5790952 - DNA, 22 bp, Homo sapiens
tcagaatctgaatgtaatttgt

SEQ ID NO: 5790953 - DNA, 21 bp, Homo sapiens
tcagaatctttccttcctctc

SEQ ID NO: 5790954 - DNA, 13 bp, Homo sapiens
tcagaatgaaaat

SEQ ID NO: 5790955 - DNA, 20 bp, Homo sapiens
tcagaatgaaccctcctcct

SEQ ID NO: 5790956 - DNA, 22 bp, Homo sapiens
tcagaatggaagagagaaagca

SEQ ID NO: 5790957 - DNA, 18 bp, Homo sapiens
tcagaatggaatccatct

SEQ ID NO: 5790958 - DNA, 18 bp, Homo sapiens
tcagaatggcagtcctgg

SEQ ID NO: 5790959 - DNA, 21 bp, Homo sapiens
tcagaatggcagtcctggagg

SEQ ID NO: 5790960 - DNA, 19 bp, Homo sapiens
tcagaatgggggctttcgg

SEQ ID NO: 5790961 - DNA, 14 bp, Homo sapiens
tcagaatgtaaaag

SEQ ID NO: 5790962 - DNA, 12 bp, Homo sapiens
tcagaatgttgt

SEQ ID NO: 5790963 - DNA, 18 bp, Homo sapiens
tcagaattaaacttttaa

SEQ ID NO: 5790964 - DNA, 23 bp, Homo sapiens
tcagaattaaacttttaattcat

SEQ ID NO: 5790965 - DNA, 16 bp, Homo sapiens
tcagaattaagcagaa

SEQ ID NO: 5790966 - DNA, 22 bp, Homo sapiens
tcagaattagagcatgggaggt

SEQ ID NO: 5790967 - DNA, 14 bp, Homo sapiens
tcagaattatgatg

SEQ ID NO: 5790968 - DNA, 16 bp, Homo sapiens
tcagaattatttttaa

SEQ ID NO: 5790969 - DNA, 19 bp, Homo sapiens
tcagaattcggtgtgctgc

SEQ ID NO: 5790970 - DNA, 23 bp, Homo sapiens
tcagaattctctagtttgattaa

SEQ ID NO: 5790971 - DNA, 18 bp, Homo sapiens
tcagaattgaaacacttt

SEQ ID NO: 5790972 - DNA, 18 bp, Homo sapiens
tcagaattgcacatctaa

SEQ ID NO: 5790973 - DNA, 19 bp, Homo sapiens
tcagaattggcataatttg

SEQ ID NO: 5790974 - DNA, 15 bp, Homo sapiens
tcagaatttccctct

SEQ ID NO: 5790975 - DNA, 22 bp, Homo sapiens
tcagacaaaatggatacataaa

SEQ ID NO: 5790976 - DNA, 15 bp, Homo sapiens
tcagatgactagaaa

SEQ ID NO: 5790977 - DNA, 18 bp, Homo sapiens
tcagatgactctctccaa

SEQ ID NO: 5790978 - DNA, 17 bp, Homo sapiens
tcagatgagaacaaagc

SEQ ID NO: 5790979 - DNA, 21 bp, Homo sapiens
tcagatgagaacaaagctgtt

SEQ ID NO: 5790980 - DNA, 18 bp, Homo sapiens
tcagatgagcaaggacat

SEQ ID NO: 5790981 - DNA, 10 bp, Homo sapiens
tcagatgagg

SEQ ID NO: 5790982 - DNA, 18 bp, Homo sapiens
tcagatgaggcaaacagc

SEQ ID NO: 5790983 - DNA, 15 bp, Homo sapiens
tcagatgaggccctg

SEQ ID NO: 5790984 - DNA, 16 bp, Homo sapiens
tcagatgaggccctgc

SEQ ID NO: 5790985 - DNA, 20 bp, Homo sapiens
tcagatgaggccctgcacct

SEQ ID NO: 5790986 - DNA, 22 bp, Homo sapiens
tcagatgatggggtcagcaggc

SEQ ID NO: 5790987 - DNA, 19 bp, Homo sapiens
tcagatgattcaaatatca

SEQ ID NO: 5790988 - DNA, 16 bp, Homo sapiens
tcagatgcagtttgga

SEQ ID NO: 5790989 - DNA, 16 bp, Homo sapiens
tcagatgccacttcta

SEQ ID NO: 5790990 - DNA, 20 bp, Homo sapiens
tcagatgccacttctaagaa

SEQ ID NO: 5790991 - DNA, 21 bp, Homo sapiens
tcagatgcgtgcccagctctt

SEQ ID NO: 5790992 - DNA, 20 bp, Homo sapiens
tcagatgctccaagattcta

SEQ ID NO: 5790993 - DNA, 22 bp, Homo sapiens
tcagatgctccaagattctaga

SEQ ID NO: 5790994 - DNA, 15 bp, Homo sapiens
tcagatgctcttggg

SEQ ID NO: 5790995 - DNA, 13 bp, Homo sapiens
tcagatgcttctg

SEQ ID NO: 5790996 - DNA, 18 bp, Homo sapiens
tcagatgcttctgggaga

SEQ ID NO: 5790997 - DNA, 19 bp, Homo sapiens
tcagatgcttgcggcaaaa

SEQ ID NO: 5790998 - DNA, 12 bp, Homo sapiens
tcagatggaaaa

SEQ ID NO: 5790999 - DNA, 19 bp, Homo sapiens
tcagatggaaaattcattt

SEQ ID NO: 5791000 - DNA, 19 bp, Homo sapiens
tcagatggaaatattttga

SEQ ID NO: 5791001 - DNA, 22 bp, Homo sapiens
tcagatggaaccgcaggaagct

SEQ ID NO: 5791002 - DNA, 23 bp, Homo sapiens
tcagatggaaccgcaggaagctg

SEQ ID NO: 5791003 - DNA, 22 bp, Homo sapiens
tcagatggaagcttactctctg

SEQ ID NO: 5791004 - DNA, 15 bp, Homo sapiens
tcagatggactggga

SEQ ID NO: 5791005 - DNA, 17 bp, Homo sapiens
tcagatggatgtagata

SEQ ID NO: 5791006 - DNA, 15 bp, Homo sapiens
tcagatggcagcttt

SEQ ID NO: 5791007 - DNA, 20 bp, Homo sapiens
tcagatgggaggaaagagag

SEQ ID NO: 5791008 - DNA, 14 bp, Homo sapiens
tcagatggggcctg

SEQ ID NO: 5791009 - DNA, 23 bp, Homo sapiens
tcagatggggcctgggctgttgt

SEQ ID NO: 5791010 - DNA, 16 bp, Homo sapiens
tcagatggtgtcattt

SEQ ID NO: 5791011 - DNA, 17 bp, Homo sapiens
tcagatggtgtcattta

SEQ ID NO: 5791012 - DNA, 13 bp, Homo sapiens
tcagatgtaatgt

SEQ ID NO: 5791013 - DNA, 17 bp, Homo sapiens
tcagatgtaatgttttc

SEQ ID NO: 5791014 - DNA, 13 bp, Homo sapiens
tcagatgtccctt

SEQ ID NO: 5791015 - DNA, 23 bp, Homo sapiens
tcagatgtcccttgatgcacaga

SEQ ID NO: 5791016 - DNA, 15 bp, Homo sapiens
tcagatgtcttctgc

SEQ ID NO: 5791017 - DNA, 16 bp, Homo sapiens
tcagatgtcttctgcc

SEQ ID NO: 5791018 - DNA, 20 bp, Homo sapiens
tcagatgtcttctgcctgtt

SEQ ID NO: 5791019 - DNA, 22 bp, Homo sapiens
tcagatgtcttctgcctgttat

SEQ ID NO: 5791020 - DNA, 12 bp, Homo sapiens
tcagatgtgcat

SEQ ID NO: 5791021 - DNA, 14 bp, Homo sapiens
tcagatgtggagcc

SEQ ID NO: 5791022 - DNA, 17 bp, Homo sapiens
tcagatgtgtgttctca

SEQ ID NO: 5791023 - DNA, 17 bp, Homo sapiens
tcagatgtgttcctcca

SEQ ID NO: 5791024 - DNA, 23 bp, Homo sapiens
tcagatgtgttcctccattttct

SEQ ID NO: 5791025 - DNA, 15 bp, Homo sapiens
tcagatgttaaaata

SEQ ID NO: 5791026 - DNA, 13 bp, Homo sapiens
tcagatgtttaaa

SEQ ID NO: 5791027 - DNA, 16 bp, Homo sapiens
tcagatgtttaaaaca

SEQ ID NO: 5791028 - DNA, 17 bp, Homo sapiens
tcagatgtttaaaacac

SEQ ID NO: 5791029 - DNA, 13 bp, Homo sapiens
tcagatgttttac

SEQ ID NO: 5791030 - DNA, 17 bp, Homo sapiens
tcagatgttttggtcaa

SEQ ID NO: 5791031 - DNA, 16 bp, Homo sapiens
tcagattaaattacag

SEQ ID NO: 5791032 - DNA, 16 bp, Homo sapiens
tcagattattaaaatt

SEQ ID NO: 5791033 - DNA, 22 bp, Homo sapiens
tcagattcaataatgagagctc

SEQ ID NO: 5791034 - DNA, 15 bp, Homo sapiens
tcagattcaggagct

SEQ ID NO: 5791035 - DNA, 13 bp, Homo sapiens
tcagattcaggca

SEQ ID NO: 5791036 - DNA, 16 bp, Homo sapiens
tcagattcaggcattt

SEQ ID NO: 5791037 - DNA, 21 bp, Homo sapiens
tcagattccacacaaaatgtc

SEQ ID NO: 5791038 - DNA, 21 bp, Homo sapiens
tcagattcccagagcaaaata

SEQ ID NO: 5791039 - DNA, 22 bp, Homo sapiens
tcagattcccagagcaaaataa

SEQ ID NO: 5791040 - DNA, 22 bp, Homo sapiens
tcagattccccactcagccttt

SEQ ID NO: 5791041 - DNA, 22 bp, Homo sapiens
tcagattccccccatctccatt

SEQ ID NO: 5791042 - DNA, 16 bp, Homo sapiens
tcagattccttcccat

SEQ ID NO: 5791043 - DNA, 19 bp, Homo sapiens
tcagattcctttcccttta

SEQ ID NO: 5791044 - DNA, 15 bp, Homo sapiens
tcagattcttgctgt

SEQ ID NO: 5791045 - DNA, 14 bp, Homo sapiens
tcagattgcatgtg

SEQ ID NO: 5791046 - DNA, 21 bp, Homo sapiens
tcagattgcatgtgactctga

SEQ ID NO: 5791047 - DNA, 22 bp, Homo sapiens
tcagattgcatgtgactctgaa

SEQ ID NO: 5791048 - DNA, 21 bp, Homo sapiens
tcagattgcttaaaagcattt

SEQ ID NO: 5791049 - DNA, 16 bp, Homo sapiens
tcagattgtaaaggta

SEQ ID NO: 5791050 - DNA, 15 bp, Homo sapiens
tcagattgtatctga

SEQ ID NO: 5791051 - DNA, 15 bp, Homo sapiens
tcagatttaaaacaa

SEQ ID NO: 5791052 - DNA, 18 bp, Homo sapiens
tcagatttatttgtttga

SEQ ID NO: 5791053 - DNA, 21 bp, Homo sapiens
tcagatttatttgtttgattt

SEQ ID NO: 5791054 - DNA, 22 bp, Homo sapiens
tcagatttatttgtttgatttt

SEQ ID NO: 5791055 - DNA, 14 bp, Homo sapiens
tcagatttcaaatt

SEQ ID NO: 5791056 - DNA, 15 bp, Homo sapiens
tcagatttccagtct

SEQ ID NO: 5791057 - DNA, 23 bp, Homo sapiens
tcagatttccattgtgtggcctg

SEQ ID NO: 5791058 - DNA, 23 bp, Homo sapiens
tcagatttctagttttttttcta

SEQ ID NO: 5791059 - DNA, 15 bp, Homo sapiens
tcagatttctctttg

SEQ ID NO: 5791060 - DNA, 18 bp, Homo sapiens
tcagatttctctttgaaa

SEQ ID NO: 5791061 - DNA, 19 bp, Homo sapiens
tcagatttctctttgaaac

SEQ ID NO: 5791062 - DNA, 16 bp, Homo sapiens
tcagatttcttaatgt

SEQ ID NO: 5791063 - DNA, 20 bp, Homo sapiens
tcagatttcttaatgtctgt

SEQ ID NO: 5791064 - DNA, 22 bp, Homo sapiens
tcagatttcttaatgtctgtca

SEQ ID NO: 5791065 - DNA, 14 bp, Homo sapiens
tcagatttgaaaag

SEQ ID NO: 5791066 - DNA, 12 bp, Homo sapiens
tcagatttgaac

SEQ ID NO: 5791067 - DNA, 16 bp, Homo sapiens
tcagatttgctgttca

SEQ ID NO: 5791068 - DNA, 13 bp, Homo sapiens
tcagattttaaaa

SEQ ID NO: 5791069 - DNA, 15 bp, Homo sapiens
tcagattttaaaaag

SEQ ID NO: 5791070 - DNA, 19 bp, Homo sapiens
tcagattttaaaaagtctt

SEQ ID NO: 5791071 - DNA, 20 bp, Homo sapiens
tcagattttattatgtaaat

SEQ ID NO: 5791072 - DNA, 21 bp, Homo sapiens
tcagattttctaagaaccaaa

SEQ ID NO: 5791073 - DNA, 12 bp, Homo sapiens
tcagattttgat

SEQ ID NO: 5791074 - DNA, 20 bp, Homo sapiens
tcagatttttaaagttttgt

SEQ ID NO: 5791075 - DNA, 14 bp, Homo sapiens
tcagattttttaaa

SEQ ID NO: 5791076 - DNA, 17 bp, Homo sapiens
tcagattttttaaaatt

SEQ ID NO: 5791077 - DNA, 20 bp, Homo sapiens
tcagattttttaaaattttg

SEQ ID NO: 5791078 - DNA, 13 bp, Homo sapiens
tcagcaaaaagca

SEQ ID NO: 5791079 - DNA, 14 bp, Homo sapiens
tcagcaaaaagcaa

SEQ ID NO: 5791080 - DNA, 16 bp, Homo sapiens
tcagcaaaaagcaaaa

SEQ ID NO: 5791081 - DNA, 18 bp, Homo sapiens
tcagcaaacacaataaga

SEQ ID NO: 5791082 - DNA, 21 bp, Homo sapiens
tcagcaaacaggatcagttaa

SEQ ID NO: 5791083 - DNA, 18 bp, Homo sapiens
tcagcaaacccaaagatg

SEQ ID NO: 5791084 - DNA, 22 bp, Homo sapiens
tcagcaaacccaaagatgttaa

SEQ ID NO: 5791085 - DNA, 15 bp, Homo sapiens
tcagcaaactctttt

SEQ ID NO: 5791086 - DNA, 20 bp, Homo sapiens
tcagcaaacttgttgaattt

SEQ ID NO: 5791087 - DNA, 13 bp, Homo sapiens
tcagcaaagaaaa

SEQ ID NO: 5791088 - DNA, 17 bp, Homo sapiens
tcagcaaagctacagga

SEQ ID NO: 5791089 - DNA, 14 bp, Homo sapiens
tcagcaaatcctct

SEQ ID NO: 5791090 - DNA, 17 bp, Homo sapiens
tcagcaaatgccttttc

SEQ ID NO: 5791091 - DNA, 19 bp, Homo sapiens
tcagcaaatgccttttcaa

SEQ ID NO: 5791092 - DNA, 23 bp, Homo sapiens
tcagcaacaaccatctcatccta

SEQ ID NO: 5791093 - DNA, 14 bp, Homo sapiens
tcagcaacaagact

SEQ ID NO: 5791094 - DNA, 23 bp, Homo sapiens
tcagcaacaagactgccaggtgg

SEQ ID NO: 5791095 - DNA, 14 bp, Homo sapiens
tcagcaacatcatt

SEQ ID NO: 5791096 - DNA, 19 bp, Homo sapiens
tcagcaacatgatacctgg

SEQ ID NO: 5791097 - DNA, 18 bp, Homo sapiens
tcagcaaccctacagtat

SEQ ID NO: 5791098 - DNA, 23 bp, Homo sapiens
tcagcaacccttcctgctgctgc

SEQ ID NO: 5791099 - DNA, 21 bp, Homo sapiens
tcagcaacctttcacctttgt

SEQ ID NO: 5791100 - DNA, 19 bp, Homo sapiens
tcagcaactgaggtaacct

SEQ ID NO: 5791101 - DNA, 18 bp, Homo sapiens
tcagcaagacaatgacac

SEQ ID NO: 5791102 - DNA, 14 bp, Homo sapiens
tcagcaagagagaa

SEQ ID NO: 5791103 - DNA, 21 bp, Homo sapiens
tcagcaagccctacagagctg

SEQ ID NO: 5791104 - DNA, 14 bp, Homo sapiens
tcagcaagctgccc

SEQ ID NO: 5791105 - DNA, 18 bp, Homo sapiens
tcagcaagctgcccagcc

SEQ ID NO: 5791106 - DNA, 21 bp, Homo sapiens
tcagcaagctgcccagccctg

SEQ ID NO: 5791107 - DNA, 23 bp, Homo sapiens
tcagcaagctgcccagccctggc

SEQ ID NO: 5791108 - DNA, 17 bp, Homo sapiens
tcagcaaggtgtgaatg

SEQ ID NO: 5791109 - DNA, 16 bp, Homo sapiens
tcagcaagtgcccagt

SEQ ID NO: 5791110 - DNA, 17 bp, Homo sapiens
tcagcaagtgcccagtg

SEQ ID NO: 5791111 - DNA, 22 bp, Homo sapiens
tcagcaagtgcccagtggagcc

SEQ ID NO: 5791112 - DNA, 13 bp, Homo sapiens
tcagcaagtgtac

SEQ ID NO: 5791113 - DNA, 15 bp, Homo sapiens
tcagcaagtgtacag

SEQ ID NO: 5791114 - DNA, 15 bp, Homo sapiens
tcagcaatattgcct

SEQ ID NO: 5791115 - DNA, 16 bp, Homo sapiens
tcagcaatattgcctg

SEQ ID NO: 5791116 - DNA, 13 bp, Homo sapiens
tcagcaatattta

SEQ ID NO: 5791117 - DNA, 19 bp, Homo sapiens
tcagcaatatttaaggaga

SEQ ID NO: 5791118 - DNA, 18 bp, Homo sapiens
tcagcaatgccccaaact

SEQ ID NO: 5791119 - DNA, 16 bp, Homo sapiens
tcagcaatgcttctct

SEQ ID NO: 5791120 - DNA, 13 bp, Homo sapiens
tcagcacaaggcc

SEQ ID NO: 5791121 - DNA, 22 bp, Homo sapiens
tcagcacaataaatatacttct

SEQ ID NO: 5791122 - DNA, 23 bp, Homo sapiens
tcagcacaatctgtaaattttta

SEQ ID NO: 5791123 - DNA, 23 bp, Homo sapiens
tcagcacaattatgtgtgaagct

SEQ ID NO: 5791124 - DNA, 18 bp, Homo sapiens
tcagcacaccccaaggga

SEQ ID NO: 5791125 - DNA, 12 bp, Homo sapiens
tcagcacagaga

SEQ ID NO: 5791126 - DNA, 22 bp, Homo sapiens
tcagcacagcctcacccctgca

SEQ ID NO: 5791127 - DNA, 13 bp, Homo sapiens
tcagcacagcctg

SEQ ID NO: 5791128 - DNA, 19 bp, Homo sapiens
tcagcacaggaattctcaa

SEQ ID NO: 5791129 - DNA, 18 bp, Homo sapiens
tcagcacatatttgcatg

SEQ ID NO: 5791130 - DNA, 21 bp, Homo sapiens
tcagcacattcgggaccaata

SEQ ID NO: 5791131 - DNA, 20 bp, Homo sapiens
tcagcaccacattgcctcat

SEQ ID NO: 5791132 - DNA, 12 bp, Homo sapiens
tcagcaccaccc

SEQ ID NO: 5791133 - DNA, 15 bp, Homo sapiens
tcagcaccaccctag

SEQ ID NO: 5791134 - DNA, 23 bp, Homo sapiens
tcagcaccaccctagtcccttcc

SEQ ID NO: 5791135 - DNA, 13 bp, Homo sapiens
tcagcaccactca

SEQ ID NO: 5791136 - DNA, 22 bp, Homo sapiens
tcagcaccagttatgtttgaat

SEQ ID NO: 5791137 - DNA, 13 bp, Homo sapiens
tcagcaccccact

SEQ ID NO: 5791138 - DNA, 14 bp, Homo sapiens
tcagcacccccacc

SEQ ID NO: 5791139 - DNA, 13 bp, Homo sapiens
tcagcaccccttc

SEQ ID NO: 5791140 - DNA, 13 bp, Homo sapiens
tcagcaccctggg

SEQ ID NO: 5791141 - DNA, 14 bp, Homo sapiens
tcagcaccctgggt

SEQ ID NO: 5791142 - DNA, 16 bp, Homo sapiens
tcagcaccctgggtgc

SEQ ID NO: 5791143 - DNA, 23 bp, Homo sapiens
tcagcaccctgggtgccattccc

SEQ ID NO: 5791144 - DNA, 18 bp, Homo sapiens
tcagcaccttggcccagg

SEQ ID NO: 5791145 - DNA, 19 bp, Homo sapiens
tcagcaccttggcccagga

SEQ ID NO: 5791146 - DNA, 19 bp, Homo sapiens
tcagcacgatttctgttta

SEQ ID NO: 5791147 - DNA, 22 bp, Homo sapiens
tcagcacgtagtttgcattcca

SEQ ID NO: 5791148 - DNA, 17 bp, Homo sapiens
tcagcactaattagtgt

SEQ ID NO: 5791149 - DNA, 17 bp, Homo sapiens
tcagcactctggactcc

SEQ ID NO: 5791150 - DNA, 18 bp, Homo sapiens
tcagcactctggactcca

SEQ ID NO: 5791151 - DNA, 15 bp, Homo sapiens
tcagcactgcctgct

SEQ ID NO: 5791152 - DNA, 12 bp, Homo sapiens
tcagcactgtcc

SEQ ID NO: 5791153 - DNA, 24 bp, Homo sapiens
tcagccttccccctcccagggcca

SEQ ID NO: 5791154 - DNA, 22 bp, Homo sapiens
tcagccttccccttgcccaggg

SEQ ID NO: 5791155 - DNA, 23 bp, Homo sapiens
tcagccttccccttgcccagggc

SEQ ID NO: 5791156 - DNA, 20 bp, Homo sapiens
tcagccttccgagtagctgg

SEQ ID NO: 5791157 - DNA, 14 bp, Homo sapiens
tcagccttcctcct

SEQ ID NO: 5791158 - DNA, 20 bp, Homo sapiens
tcagccttcgtgtggctcct

SEQ ID NO: 5791159 - DNA, 12 bp, Homo sapiens
tcagccttctga

SEQ ID NO: 5791160 - DNA, 18 bp, Homo sapiens
tcagccttctttttctgg

SEQ ID NO: 5791161 - DNA, 17 bp, Homo sapiens
tcagccttgaaaaacaa

SEQ ID NO: 5791162 - DNA, 20 bp, Homo sapiens
tcagccttgcacacccactg

SEQ ID NO: 5791163 - DNA, 16 bp, Homo sapiens
tcagccttgccagaga

SEQ ID NO: 5791164 - DNA, 14 bp, Homo sapiens
tcagccttgctgac

SEQ ID NO: 5791165 - DNA, 17 bp, Homo sapiens
tcagccttgctgctctg

SEQ ID NO: 5791166 - DNA, 13 bp, Homo sapiens
tcagccttggaag

SEQ ID NO: 5791167 - DNA, 15 bp, Homo sapiens
tcagcctttaagata

SEQ ID NO: 5791168 - DNA, 15 bp, Homo sapiens
tcagcctttgttaac

SEQ ID NO: 5791169 - DNA, 16 bp, Homo sapiens
tcagcctttgttaacc

SEQ ID NO: 5791170 - DNA, 19 bp, Homo sapiens
tcagccttttatgtatttt

SEQ ID NO: 5791171 - DNA, 17 bp, Homo sapiens
tcagcgaagtctcatgg

SEQ ID NO: 5791172 - DNA, 16 bp, Homo sapiens
tcagcgactggatgct

SEQ ID NO: 5791173 - DNA, 21 bp, Homo sapiens
tcagcgactggatgctcgcca

SEQ ID NO: 5791174 - DNA, 22 bp, Homo sapiens
tcagcgactggatgctcgccat

SEQ ID NO: 5791175 - DNA, 21 bp, Homo sapiens
tcagcgatgtatgcagctatc

SEQ ID NO: 5791176 - DNA, 16 bp, Homo sapiens
tcagcgattcctgcca

SEQ ID NO: 5791177 - DNA, 16 bp, Homo sapiens
tcagcgcaccaaaact

SEQ ID NO: 5791178 - DNA, 15 bp, Homo sapiens
tcagcgcaggctgca

SEQ ID NO: 5791179 - DNA, 17 bp, Homo sapiens
tcagcgcccccagagcc

SEQ ID NO: 5791180 - DNA, 15 bp, Homo sapiens
tcagcgcccccaggc

SEQ ID NO: 5791181 - DNA, 18 bp, Homo sapiens
tcagcgcccccaggcctg

SEQ ID NO: 5791182 - DNA, 16 bp, Homo sapiens
tcagcgctccctgtcg

SEQ ID NO: 5791183 - DNA, 17 bp, Homo sapiens
tcagcgctcctcctgtg

SEQ ID NO: 5791184 - DNA, 20 bp, Homo sapiens
tcagcgctcctcctgtgtga

SEQ ID NO: 5791185 - DNA, 13 bp, Homo sapiens
tcagcgctgccca

SEQ ID NO: 5791186 - DNA, 17 bp, Homo sapiens
tcagcgctgcccacacc

SEQ ID NO: 5791187 - DNA, 21 bp, Homo sapiens
tcagcgctgcccacaccaccg

SEQ ID NO: 5791188 - DNA, 13 bp, Homo sapiens
tcagcggcctggg

SEQ ID NO: 5791189 - DNA, 16 bp, Homo sapiens
tcagcgggagccagtg

SEQ ID NO: 5791190 - DNA, 17 bp, Homo sapiens
tcagcgggagccagtgg

SEQ ID NO: 5791191 - DNA, 19 bp, Homo sapiens
tcagcgggagtctcctcac

SEQ ID NO: 5791192 - DNA, 18 bp, Homo sapiens
tcagcgggcgctgctggg

SEQ ID NO: 5791193 - DNA, 16 bp, Homo sapiens
tcagcggggacagctc

SEQ ID NO: 5791194 - DNA, 17 bp, Homo sapiens
tcagcggggacagctcc

SEQ ID NO: 5791195 - DNA, 18 bp, Homo sapiens
tcagcggggacagctcct

SEQ ID NO: 5791196 - DNA, 19 bp, Homo sapiens
tcagcggggacagctcctt

SEQ ID NO: 5791197 - DNA, 21 bp, Homo sapiens
tcagcggggacagctccttct

SEQ ID NO: 5791198 - DNA, 23 bp, Homo sapiens
tcagcggggacagctccttctgt

SEQ ID NO: 5791199 - DNA, 22 bp, Homo sapiens
tcagcggggcagcggggctggc

SEQ ID NO: 5791200 - DNA, 21 bp, Homo sapiens
tcagcgggggccttgaagact

SEQ ID NO: 5791201 - DNA, 17 bp, Homo sapiens
tcagcggtatgtgcgtg

SEQ ID NO: 5791202 - DNA, 16 bp, Homo sapiens
tcagcgtaaaatggtg

SEQ ID NO: 5791203 - DNA, 15 bp, Homo sapiens
tcagcgtctccccat

SEQ ID NO: 5791204 - DNA, 17 bp, Homo sapiens
tcagcgtctccccatgc

SEQ ID NO: 5791205 - DNA, 21 bp, Homo sapiens
tcagcgtctccccatgctggg

SEQ ID NO: 5791206 - DNA, 23 bp, Homo sapiens
tcagcgtctccccatgctgggct

SEQ ID NO: 5791207 - DNA, 22 bp, Homo sapiens
tcagcgtggtttttatgtgtat

SEQ ID NO: 5791208 - DNA, 14 bp, Homo sapiens
tcagcgttttgcaa

SEQ ID NO: 5791209 - DNA, 15 bp, Homo sapiens
tcagctaaagaagtt

SEQ ID NO: 5791210 - DNA, 16 bp, Homo sapiens
tcagctaaatgcaggg

SEQ ID NO: 5791211 - DNA, 23 bp, Homo sapiens
tcagctaagccccctactgagaa

SEQ ID NO: 5791212 - DNA, 19 bp, Homo sapiens
tcagctacaattgtaaact

SEQ ID NO: 5791213 - DNA, 21 bp, Homo sapiens
tcagctactttccatttggta

SEQ ID NO: 5791214 - DNA, 22 bp, Homo sapiens
tcagctagaagatccacatcct

SEQ ID NO: 5791215 - DNA, 22 bp, Homo sapiens
tcagctagcaaaagaagtaaca

SEQ ID NO: 5791216 - DNA, 16 bp, Homo sapiens
tcagctaggaacaaat

SEQ ID NO: 5791217 - DNA, 19 bp, Homo sapiens
tcagctaggaacaaatctt

SEQ ID NO: 5791218 - DNA, 21 bp, Homo sapiens
tcagctagttaataattcttt

SEQ ID NO: 5791219 - DNA, 22 bp, Homo sapiens
tcagctagttggggagctaagg

SEQ ID NO: 5791220 - DNA, 20 bp, Homo sapiens
tcagctatcagtaggctaat

SEQ ID NO: 5791221 - DNA, 22 bp, Homo sapiens
tcagctatgcaaatcagtctca

SEQ ID NO: 5791222 - DNA, 20 bp, Homo sapiens
tcagctatttagtgatatat

SEQ ID NO: 5791223 - DNA, 12 bp, Homo sapiens
tcagctcacacc

SEQ ID NO: 5791224 - DNA, 21 bp, Homo sapiens
tcagctcacgcttcacagtga

SEQ ID NO: 5791225 - DNA, 16 bp, Homo sapiens
tcagctcactgcaacc

SEQ ID NO: 5791226 - DNA, 12 bp, Homo sapiens
tcagctcagcct

SEQ ID NO: 5791227 - DNA, 16 bp, Homo sapiens
tcagctcagcctcccc

SEQ ID NO: 5791228 - DNA, 18 bp, Homo sapiens
tcagctcagcgccagcct

SEQ ID NO: 5791229 - DNA, 15 bp, Homo sapiens
tcagctcagctgggc

SEQ ID NO: 5791230 - DNA, 16 bp, Homo sapiens
tcagctcattatgaaa

SEQ ID NO: 5791231 - DNA, 19 bp, Homo sapiens
tcagctcattatgaaaaac

SEQ ID NO: 5791232 - DNA, 13 bp, Homo sapiens
tcagctccactct

SEQ ID NO: 5791233 - DNA, 12 bp, Homo sapiens
tcagctccagcc

SEQ ID NO: 5791234 - DNA, 13 bp, Homo sapiens
tcagctccagccc

SEQ ID NO: 5791235 - DNA, 12 bp, Homo sapiens
tcagctccagct

SEQ ID NO: 5791236 - DNA, 13 bp, Homo sapiens
tcagctccagctg

SEQ ID NO: 5791237 - DNA, 22 bp, Homo sapiens
tcagctcccaacgagcctcctc

SEQ ID NO: 5791238 - DNA, 13 bp, Homo sapiens
tcagctcccacaa

SEQ ID NO: 5791239 - DNA, 18 bp, Homo sapiens
tcagctcccacaagcctc

SEQ ID NO: 5791240 - DNA, 13 bp, Homo sapiens
tcagctcccatag

SEQ ID NO: 5791241 - DNA, 20 bp, Homo sapiens
tcagctcccatagcgctggc

SEQ ID NO: 5791242 - DNA, 15 bp, Homo sapiens
tcagctcccatttct

SEQ ID NO: 5791243 - DNA, 18 bp, Homo sapiens
tcagctccccctgtcccc

SEQ ID NO: 5791244 - DNA, 20 bp, Homo sapiens
tcagctccccctgtcccctc

SEQ ID NO: 5791245 - DNA, 23 bp, Homo sapiens
tcagctccccctgtcccctcagc

SEQ ID NO: 5791246 - DNA, 20 bp, Homo sapiens
tcagctccccggcactgcag

SEQ ID NO: 5791247 - DNA, 17 bp, Homo sapiens
tcagctcccctcggaga

SEQ ID NO: 5791248 - DNA, 12 bp, Homo sapiens
tcagctccctgc

SEQ ID NO: 5791249 - DNA, 21 bp, Homo sapiens
tcagctcccttcccctgcctg

SEQ ID NO: 5791250 - DNA, 17 bp, Homo sapiens
tcagctcccttcccttg

SEQ ID NO: 5791251 - DNA, 9 bp, Homo sapiens
tcagctcct

SEQ ID NO: 5791252 - DNA, 11 bp, Homo sapiens
tcagctcctga

SEQ ID NO: 5791253 - DNA, 16 bp, Homo sapiens
tcagctccttcctgga

SEQ ID NO: 5791254 - DNA, 18 bp, Homo sapiens
tcagctcggggagcctta

SEQ ID NO: 5791255 - DNA, 15 bp, Homo sapiens
tcagctctaaagcag

SEQ ID NO: 5791256 - DNA, 15 bp, Homo sapiens
tcagctctcatctga

SEQ ID NO: 5791257 - DNA, 12 bp, Homo sapiens
tcagctctccac

SEQ ID NO: 5791258 - DNA, 14 bp, Homo sapiens
tcagctctctgccc

SEQ ID NO: 5791259 - DNA, 19 bp, Homo sapiens
tcagctctctgccctgtgt

SEQ ID NO: 5791260 - DNA, 20 bp, Homo sapiens
tcagctctctgtataaacat

SEQ ID NO: 5791261 - DNA, 17 bp, Homo sapiens
tcagctctgaaaggtaa

SEQ ID NO: 5791262 - DNA, 19 bp, Homo sapiens
tcagctctgatctgaggct

SEQ ID NO: 5791263 - DNA, 11 bp, Homo sapiens
tcagctctggc

SEQ ID NO: 5791264 - DNA, 13 bp, Homo sapiens
tcagctctggcca

SEQ ID NO: 5791265 - DNA, 12 bp, Homo sapiens
tcagctctggga

SEQ ID NO: 5791266 - DNA, 16 bp, Homo sapiens
tcagctctgggagagg

SEQ ID NO: 5791267 - DNA, 12 bp, Homo sapiens
tcagctctgtcc

SEQ ID NO: 5791268 - DNA, 14 bp, Homo sapiens
tcagctctgtcctg

SEQ ID NO: 5791269 - DNA, 20 bp, Homo sapiens
tcagctctgtcctgttaggc

SEQ ID NO: 5791270 - DNA, 23 bp, Homo sapiens
tcagctcttggtgggcccaggga

SEQ ID NO: 5791271 - DNA, 13 bp, Homo sapiens
tcagctctttttg

SEQ ID NO: 5791272 - DNA, 13 bp, Homo sapiens
tcagctgaacaca

SEQ ID NO: 5791273 - DNA, 22 bp, Homo sapiens
tcagctgaatgcctcctgtggg

SEQ ID NO: 5791274 - DNA, 13 bp, Homo sapiens
tcagctgaattca

SEQ ID NO: 5791275 - DNA, 17 bp, Homo sapiens
tcagctgacacataatt

SEQ ID NO: 5791276 - DNA, 18 bp, Homo sapiens
tcagctgacacataattt

SEQ ID NO: 5791277 - DNA, 19 bp, Homo sapiens
tcagctgaccccctccccc

SEQ ID NO: 5791278 - DNA, 20 bp, Homo sapiens
tcagctgaccccctcccccc

SEQ ID NO: 5791279 - DNA, 16 bp, Homo sapiens
tcagctgacccggcct

SEQ ID NO: 5791280 - DNA, 21 bp, Homo sapiens
tcagctgacccggcctctctg

SEQ ID NO: 5791281 - DNA, 13 bp, Homo sapiens
tcagctgagcatg

SEQ ID NO: 5791282 - DNA, 16 bp, Homo sapiens
tcagctgagcatggag

SEQ ID NO: 5791283 - DNA, 20 bp, Homo sapiens
tcagctgagcatggagacag

SEQ ID NO: 5791284 - DNA, 21 bp, Homo sapiens
tcagctgagcatggagacagc

SEQ ID NO: 5791285 - DNA, 22 bp, Homo sapiens
tcagctgagcatggagacagca

SEQ ID NO: 5791286 - DNA, 19 bp, Homo sapiens
tcagctgagcttgagctcc

SEQ ID NO: 5791287 - DNA, 18 bp, Homo sapiens
tcagctgattgtttattt

SEQ ID NO: 5791288 - DNA, 20 bp, Homo sapiens
tcagctgcaaggtactctgg

SEQ ID NO: 5791289 - DNA, 21 bp, Homo sapiens
tcagctgcaaggtactctggt

SEQ ID NO: 5791290 - DNA, 17 bp, Homo sapiens
tcagctgcagttgaaga

SEQ ID NO: 5791291 - DNA, 18 bp, Homo sapiens
tcagctgcatctgataaa

SEQ ID NO: 5791292 - DNA, 17 bp, Homo sapiens
tcagctgcatggagcct

SEQ ID NO: 5791293 - DNA, 12 bp, Homo sapiens
tcagctgccagt

SEQ ID NO: 5791294 - DNA, 16 bp, Homo sapiens
tcagctgcccatccca

SEQ ID NO: 5791295 - DNA, 23 bp, Homo sapiens
tcagctgcccatcccagtccctc

SEQ ID NO: 5791296 - DNA, 16 bp, Homo sapiens
tcagctgccccacagg

SEQ ID NO: 5791297 - DNA, 22 bp, Homo sapiens
tcagctgcctgaaacagccatg

SEQ ID NO: 5791298 - DNA, 17 bp, Homo sapiens
tcagctgctcagaattc

SEQ ID NO: 5791299 - DNA, 22 bp, Homo sapiens
tcagctgctcagcaacctttca

SEQ ID NO: 5791300 - DNA, 14 bp, Homo sapiens
tcagctgctcccac

SEQ ID NO: 5791301 - DNA, 19 bp, Homo sapiens
tcagctgctccctggcatt

SEQ ID NO: 5791302 - DNA, 21 bp, Homo sapiens
tcagctgctgactggcagggc

SEQ ID NO: 5791303 - DNA, 13 bp, Homo sapiens
tcagctgctggat

SEQ ID NO: 5791304 - DNA, 15 bp, Homo sapiens
tcagctgctgttgaa

SEQ ID NO: 5791305 - DNA, 18 bp, Homo sapiens
tcagctgctgttgaactt

SEQ ID NO: 5791306 - DNA, 20 bp, Homo sapiens
tcagctgcttctgctgccta

SEQ ID NO: 5791307 - DNA, 20 bp, Homo sapiens
tcagctggacatactgctgg

SEQ ID NO: 5791308 - DNA, 21 bp, Homo sapiens
tcagctggcactgtctctgct

SEQ ID NO: 5791309 - DNA, 21 bp, Homo sapiens
tcagctggctgagacactgaa

SEQ ID NO: 5791310 - DNA, 23 bp, Homo sapiens
tcagctgggcagtgccagccaat

SEQ ID NO: 5791311 - DNA, 23 bp, Homo sapiens
tcagctgggtcacatccatccct

SEQ ID NO: 5791312 - DNA, 23 bp, Homo sapiens
tcagctggtagctgggggcgcag

SEQ ID NO: 5791313 - DNA, 20 bp, Homo sapiens
tcagctggtcctgaccagga

SEQ ID NO: 5791314 - DNA, 23 bp, Homo sapiens
tcagctggtggatggtgactttt

SEQ ID NO: 5791315 - DNA, 16 bp, Homo sapiens
tcagctgtagaaaggt

SEQ ID NO: 5791316 - DNA, 19 bp, Homo sapiens
tcagctgtcacctgctcac

SEQ ID NO: 5791317 - DNA, 22 bp, Homo sapiens
tcagctgtcacctgctcacagg

SEQ ID NO: 5791318 - DNA, 17 bp, Homo sapiens
tcagctgtcctccctcc

SEQ ID NO: 5791319 - DNA, 19 bp, Homo sapiens
tcagctgtgaatctgttga

SEQ ID NO: 5791320 - DNA, 12 bp, Homo sapiens
tcagctgtggct

SEQ ID NO: 5791321 - DNA, 15 bp, Homo sapiens
tcagctgtggctgga

SEQ ID NO: 5791322 - DNA, 12 bp, Homo sapiens
tcagctgtgggg

SEQ ID NO: 5791323 - DNA, 14 bp, Homo sapiens
tcagctgtggggaa

SEQ ID NO: 5791324 - DNA, 22 bp, Homo sapiens
tcagctgtggtcccacccagga

SEQ ID NO: 5791325 - DNA, 18 bp, Homo sapiens
tcagctgttgcagatgaa

SEQ ID NO: 5791326 - DNA, 23 bp, Homo sapiens
tcagctgttgcaggcagtgtctt

SEQ ID NO: 5791327 - DNA, 17 bp, Homo sapiens
tcagcttaattctcctt

SEQ ID NO: 5791328 - DNA, 16 bp, Homo sapiens
tcagcttataatgaaa

SEQ ID NO: 5791329 - DNA, 16 bp, Homo sapiens
tcagcttatgggatcc

SEQ ID NO: 5791330 - DNA, 17 bp, Homo sapiens
tcagtataaacaaagtt

SEQ ID NO: 5791331 - DNA, 18 bp, Homo sapiens
tcagtataaattatctta

SEQ ID NO: 5791332 - DNA, 15 bp, Homo sapiens
tcagtatactgtgtg

SEQ ID NO: 5791333 - DNA, 19 bp, Homo sapiens
tcagtatattttctgtatt

SEQ ID NO: 5791334 - DNA, 21 bp, Homo sapiens
tcagtatattttctgtattta

SEQ ID NO: 5791335 - DNA, 13 bp, Homo sapiens
tcagtatcaggcc

SEQ ID NO: 5791336 - DNA, 19 bp, Homo sapiens
tcagtatcttagagtttac

SEQ ID NO: 5791337 - DNA, 23 bp, Homo sapiens
tcagtatgctgcccctgtcttgc

SEQ ID NO: 5791338 - DNA, 20 bp, Homo sapiens
tcagtatggtgctaatgtgt

SEQ ID NO: 5791339 - DNA, 22 bp, Homo sapiens
tcagtatgtccccataagacaa

SEQ ID NO: 5791340 - DNA, 14 bp, Homo sapiens
tcagtatgtggaag

SEQ ID NO: 5791341 - DNA, 21 bp, Homo sapiens
tcagtatgtgggggcttcatc

SEQ ID NO: 5791342 - DNA, 20 bp, Homo sapiens
tcagtatgttgtcaaagaga

SEQ ID NO: 5791343 - DNA, 16 bp, Homo sapiens
tcagtattaaactctc

SEQ ID NO: 5791344 - DNA, 23 bp, Homo sapiens
tcagtattaatactaaaatatgt

SEQ ID NO: 5791345 - DNA, 12 bp, Homo sapiens
tcagtattactt

SEQ ID NO: 5791346 - DNA, 12 bp, Homo sapiens
tcagtattctgc

SEQ ID NO: 5791347 - DNA, 18 bp, Homo sapiens
tcagtattgagacactgt

SEQ ID NO: 5791348 - DNA, 17 bp, Homo sapiens
tcagtattgttttggtt

SEQ ID NO: 5791349 - DNA, 14 bp, Homo sapiens
tcagtatttaacta

SEQ ID NO: 5791350 - DNA, 15 bp, Homo sapiens
tcagtatttcaactg

SEQ ID NO: 5791351 - DNA, 16 bp, Homo sapiens
tcagtatttcaactgc

SEQ ID NO: 5791352 - DNA, 17 bp, Homo sapiens
tcagtatttcaactgct

SEQ ID NO: 5791353 - DNA, 20 bp, Homo sapiens
tcagtatttcaactgctgta

SEQ ID NO: 5791354 - DNA, 15 bp, Homo sapiens
tcagtatttcagtgt

SEQ ID NO: 5791355 - DNA, 14 bp, Homo sapiens
tcagtatttccttc

SEQ ID NO: 5791356 - DNA, 20 bp, Homo sapiens
tcagtatttccttccactgt

SEQ ID NO: 5791357 - DNA, 13 bp, Homo sapiens
tcagtattttcca

SEQ ID NO: 5791358 - DNA, 15 bp, Homo sapiens
tcagtattttccagc

SEQ ID NO: 5791359 - DNA, 22 bp, Homo sapiens
tcagtattttccagccttatgt

SEQ ID NO: 5791360 - DNA, 14 bp, Homo sapiens
tcagtatttttcct

SEQ ID NO: 5791361 - DNA, 22 bp, Homo sapiens
tcagtattttttacttttcaca

SEQ ID NO: 5791362 - DNA, 14 bp, Homo sapiens
tcagtcaaaacttt

SEQ ID NO: 5791363 - DNA, 22 bp, Homo sapiens
tcagtcaagttccgtctcctct

SEQ ID NO: 5791364 - DNA, 21 bp, Homo sapiens
tcagtcacccccacttcccac

SEQ ID NO: 5791365 - DNA, 20 bp, Homo sapiens
tcagtcactttttcccctgc

SEQ ID NO: 5791366 - DNA, 20 bp, Homo sapiens
tcagtcagaaaactttaaaa

SEQ ID NO: 5791367 - DNA, 16 bp, Homo sapiens
tcagtcagtgctggag

SEQ ID NO: 5791368 - DNA, 15 bp, Homo sapiens
tcagtcagttcccgg

SEQ ID NO: 5791369 - DNA, 14 bp, Homo sapiens
tcagtcatcaaagc

SEQ ID NO: 5791370 - DNA, 14 bp, Homo sapiens
tcagtcatgaggaa

SEQ ID NO: 5791371 - DNA, 23 bp, Homo sapiens
tcagtcatgaggaaagacacaga

SEQ ID NO: 5791372 - DNA, 15 bp, Homo sapiens
tcagtcatgcataaa

SEQ ID NO: 5791373 - DNA, 14 bp, Homo sapiens
tcagtcatgtgtaa

SEQ ID NO: 5791374 - DNA, 18 bp, Homo sapiens
tcagtcattgctgttgta

SEQ ID NO: 5791375 - DNA, 19 bp, Homo sapiens
tcagtccagaagaattgac

SEQ ID NO: 5791376 - DNA, 19 bp, Homo sapiens
tcagtccagatgccttcct

SEQ ID NO: 5791377 - DNA, 20 bp, Homo sapiens
tcagtccagcagtttccagt

SEQ ID NO: 5791378 - DNA, 18 bp, Homo sapiens
tcagtccatgaagatgta

SEQ ID NO: 5791379 - DNA, 16 bp, Homo sapiens
tcagtccatttatata

SEQ ID NO: 5791380 - DNA, 23 bp, Homo sapiens
tcagtccatttatatatgaaaac

SEQ ID NO: 5791381 - DNA, 13 bp, Homo sapiens
tcagtcccacagc

SEQ ID NO: 5791382 - DNA, 16 bp, Homo sapiens
tcagtcccacagcccc

SEQ ID NO: 5791383 - DNA, 17 bp, Homo sapiens
tcagtcccacagcccct

SEQ ID NO: 5791384 - DNA, 15 bp, Homo sapiens
tcagtcccactgcac

SEQ ID NO: 5791385 - DNA, 17 bp, Homo sapiens
tcagtcccatcagagag

SEQ ID NO: 5791386 - DNA, 18 bp, Homo sapiens
tcagtccccacagataac

SEQ ID NO: 5791387 - DNA, 17 bp, Homo sapiens
tcagtccccctgtgcat

SEQ ID NO: 5791388 - DNA, 17 bp, Homo sapiens
tcagtcccctctctctg

SEQ ID NO: 5791389 - DNA, 19 bp, Homo sapiens
tcagtcccctctctctggg

SEQ ID NO: 5791390 - DNA, 17 bp, Homo sapiens
tcagtccctccctcctg

SEQ ID NO: 5791391 - DNA, 19 bp, Homo sapiens
tcagtccctccctcctggc

SEQ ID NO: 5791392 - DNA, 16 bp, Homo sapiens
tcagtccgcctggccg

SEQ ID NO: 5791393 - DNA, 13 bp, Homo sapiens
tcagtcctaatgt

SEQ ID NO: 5791394 - DNA, 17 bp, Homo sapiens
tcagtcctcccctcaca

SEQ ID NO: 5791395 - DNA, 19 bp, Homo sapiens
tcagtcctcccctcacagc

SEQ ID NO: 5791396 - DNA, 16 bp, Homo sapiens
tcagtcctgctccaga

SEQ ID NO: 5791397 - DNA, 20 bp, Homo sapiens
tcagtcctggtctgctcagg

SEQ ID NO: 5791398 - DNA, 20 bp, Homo sapiens
tcagtcctttgtctttcttt

SEQ ID NO: 5791399 - DNA, 15 bp, Homo sapiens
tcagtcgccctgttc

SEQ ID NO: 5791400 - DNA, 15 bp, Homo sapiens
tcagtcgtctgtccc

SEQ ID NO: 5791401 - DNA, 14 bp, Homo sapiens
tcagtcgttttagt

SEQ ID NO: 5791402 - DNA, 17 bp, Homo sapiens
tcagtctaaggtctcat

SEQ ID NO: 5791403 - DNA, 15 bp, Homo sapiens
tcagtctacaggcct

SEQ ID NO: 5791404 - DNA, 19 bp, Homo sapiens
tcagtctacaggcctttca

SEQ ID NO: 5791405 - DNA, 12 bp, Homo sapiens
tcagtctacccc

SEQ ID NO: 5791406 - DNA, 16 bp, Homo sapiens
tcagtctagaagaatt

SEQ ID NO: 5791407 - DNA, 15 bp, Homo sapiens
tcagtctagctttta

SEQ ID NO: 5791408 - DNA, 18 bp, Homo sapiens
tcagtctatccacagaga

SEQ ID NO: 5791409 - DNA, 16 bp, Homo sapiens
tcagtctatgctgtgt

SEQ ID NO: 5791410 - DNA, 17 bp, Homo sapiens
tcagtctcacagagaag

SEQ ID NO: 5791411 - DNA, 21 bp, Homo sapiens
tcagtctcacagagaagctcc

SEQ ID NO: 5791412 - DNA, 19 bp, Homo sapiens
tcagtctcacctgccggct

SEQ ID NO: 5791413 - DNA, 18 bp, Homo sapiens
tcagtctcagaatgtcat

SEQ ID NO: 5791414 - DNA, 19 bp, Homo sapiens
tcagtctcagaatgtcatt

SEQ ID NO: 5791415 - DNA, 14 bp, Homo sapiens
tcagtctcagctgc

SEQ ID NO: 5791416 - DNA, 15 bp, Homo sapiens
tcagtctcagctgct

SEQ ID NO: 5791417 - DNA, 16 bp, Homo sapiens
tcagtctcagctgctg

SEQ ID NO: 5791418 - DNA, 22 bp, Homo sapiens
tcagtctcccagctaattgaga

SEQ ID NO: 5791419 - DNA, 16 bp, Homo sapiens
tcagtctccctccctt

SEQ ID NO: 5791420 - DNA, 19 bp, Homo sapiens
tcagtctcccttctcccat

SEQ ID NO: 5791421 - DNA, 14 bp, Homo sapiens
tcagtctccctttc

SEQ ID NO: 5791422 - DNA, 23 bp, Homo sapiens
tcagtctccctttcccttcttgg

SEQ ID NO: 5791423 - DNA, 12 bp, Homo sapiens
tcagtctctctc

SEQ ID NO: 5791424 - DNA, 20 bp, Homo sapiens
tcagtctctgagcagtgaat

SEQ ID NO: 5791425 - DNA, 17 bp, Homo sapiens
tcagtctctgagggctt

SEQ ID NO: 5791426 - DNA, 12 bp, Homo sapiens
tcagtctctgca

SEQ ID NO: 5791427 - DNA, 14 bp, Homo sapiens
tcagtctgaatggc

SEQ ID NO: 5791428 - DNA, 17 bp, Homo sapiens
tcagtctgattcccaag

SEQ ID NO: 5791429 - DNA, 19 bp, Homo sapiens
tcagtctgattcccaagct

SEQ ID NO: 5791430 - DNA, 23 bp, Homo sapiens
tcagtctgattcccaagctctgc

SEQ ID NO: 5791431 - DNA, 17 bp, Homo sapiens
tcagtctgcacttaaat

SEQ ID NO: 5791432 - DNA, 23 bp, Homo sapiens
tcagtctgcacttaaatatcaat

SEQ ID NO: 5791433 - DNA, 21 bp, Homo sapiens
tcagtctgcttagaaataaca

SEQ ID NO: 5791434 - DNA, 15 bp, Homo sapiens
tcagtctggcccttc

SEQ ID NO: 5791435 - DNA, 14 bp, Homo sapiens
tcagtctgggtgtc

SEQ ID NO: 5791436 - DNA, 13 bp, Homo sapiens
tcagtctggtggg

SEQ ID NO: 5791437 - DNA, 21 bp, Homo sapiens
tcagtctgttcactgcattca

SEQ ID NO: 5791438 - DNA, 18 bp, Homo sapiens
tcagtcttccttgtggaa

SEQ ID NO: 5791439 - DNA, 20 bp, Homo sapiens
tcagtcttctctcactttga

SEQ ID NO: 5791440 - DNA, 22 bp, Homo sapiens
tcagtctttcttagtgcctgtg

SEQ ID NO: 5791441 - DNA, 12 bp, Homo sapiens
tcagtctttgct

SEQ ID NO: 5791442 - DNA, 14 bp, Homo sapiens
tcagtctttgctca

SEQ ID NO: 5791443 - DNA, 15 bp, Homo sapiens
tcagtctttgctcag

SEQ ID NO: 5791444 - DNA, 17 bp, Homo sapiens
tcagtctttgctcagtg

SEQ ID NO: 5791445 - DNA, 24 bp, Homo sapiens
tcagtctttgctcagtgtccagct

SEQ ID NO: 5791446 - DNA, 21 bp, Homo sapiens
tcagtgaagaaccctatttaa

SEQ ID NO: 5791447 - DNA, 13 bp, Homo sapiens
tcagtgaagacta

SEQ ID NO: 5791448 - DNA, 19 bp, Homo sapiens
tcagtgaagatgctgtaaa

SEQ ID NO: 5791449 - DNA, 18 bp, Homo sapiens
tcagtgaagcccaggagg

SEQ ID NO: 5791450 - DNA, 20 bp, Homo sapiens
tcagtgaagtacacctgtgt

SEQ ID NO: 5791451 - DNA, 18 bp, Homo sapiens
tcagtgaagttgctgctt

SEQ ID NO: 5791452 - DNA, 17 bp, Homo sapiens
tcagtgaatataaatgt

SEQ ID NO: 5791453 - DNA, 21 bp, Homo sapiens
tcagtgaatatttttgtattt

SEQ ID NO: 5791454 - DNA, 12 bp, Homo sapiens
tcagtgaatttg

SEQ ID NO: 5791455 - DNA, 16 bp, Homo sapiens
tcagtgaatttgtcca

SEQ ID NO: 5791456 - DNA, 17 bp, Homo sapiens
tcagtgaatttgtccat

SEQ ID NO: 5791457 - DNA, 21 bp, Homo sapiens
tcagtgaatttgtccattgta

SEQ ID NO: 5791458 - DNA, 21 bp, Homo sapiens
tcagtgacaaaatgggaggag

SEQ ID NO: 5791459 - DNA, 11 bp, Homo sapiens
tcagtgacaga

SEQ ID NO: 5791460 - DNA, 16 bp, Homo sapiens
tcagtgacagactgga

SEQ ID NO: 5791461 - DNA, 22 bp, Homo sapiens
tcagtgacatctgattggcaga

SEQ ID NO: 5791462 - DNA, 15 bp, Homo sapiens
tcagtgacccatgag

SEQ ID NO: 5791463 - DNA, 22 bp, Homo sapiens
tcagtgacctactacgcagagg

SEQ ID NO: 5791464 - DNA, 15 bp, Homo sapiens
tcagtgactcatgct

SEQ ID NO: 5791465 - DNA, 13 bp, Homo sapiens
tcagtgactcctg

SEQ ID NO: 5791466 - DNA, 14 bp, Homo sapiens
tcagtgactcctgc

SEQ ID NO: 5791467 - DNA, 15 bp, Homo sapiens
tcagtgactcctgct

SEQ ID NO: 5791468 - DNA, 16 bp, Homo sapiens
tcagtgactcctgctg

SEQ ID NO: 5791469 - DNA, 17 bp, Homo sapiens
tcagtgactcctgctgg

SEQ ID NO: 5791470 - DNA, 22 bp, Homo sapiens
tcagtgactcctgctggtacct

SEQ ID NO: 5791471 - DNA, 17 bp, Homo sapiens
tcagtgactgaaaccat

SEQ ID NO: 5791472 - DNA, 14 bp, Homo sapiens
tcagtgactgttgt

SEQ ID NO: 5791473 - DNA, 15 bp, Homo sapiens
tcagtgacttctggc

SEQ ID NO: 5791474 - DNA, 14 bp, Homo sapiens
tcagtgagacacag

SEQ ID NO: 5791475 - DNA, 12 bp, Homo sapiens
tcagtgagatat

SEQ ID NO: 5791476 - DNA, 18 bp, Homo sapiens
tcagtgagcccctcccca

SEQ ID NO: 5791477 - DNA, 17 bp, Homo sapiens
tcagtgaggagggatgt

SEQ ID NO: 5791478 - DNA, 15 bp, Homo sapiens
tcagtgagtcagagg

SEQ ID NO: 5791479 - DNA, 14 bp, Homo sapiens
tcagtgatggaata

SEQ ID NO: 5791480 - DNA, 21 bp, Homo sapiens
tcagtgatggaatatcatgaa

SEQ ID NO: 5791481 - DNA, 16 bp, Homo sapiens
tcagtgatgtgcctaa

SEQ ID NO: 5791482 - DNA, 12 bp, Homo sapiens
tcagtgatttcc

SEQ ID NO: 5791483 - DNA, 19 bp, Homo sapiens
tcagtgatttttcccccca

SEQ ID NO: 5791484 - DNA, 20 bp, Homo sapiens
tcagtgcaaaatgtcttgtg

SEQ ID NO: 5791485 - DNA, 21 bp, Homo sapiens
tcagtgcaaaatgtcttgtgt

SEQ ID NO: 5791486 - DNA, 14 bp, Homo sapiens
tcagtgcaaagatt

SEQ ID NO: 5791487 - DNA, 17 bp, Homo sapiens
tcagtgcaagagacttt

SEQ ID NO: 5791488 - DNA, 22 bp, Homo sapiens
tcagtgcaagagactttgtcac

SEQ ID NO: 5791489 - DNA, 24 bp, Homo sapiens
tcagtgcaagagactttgtcactt

SEQ ID NO: 5791490 - DNA, 18 bp, Homo sapiens
tcagtgcacctgcctcag

SEQ ID NO: 5791491 - DNA, 19 bp, Homo sapiens
tcagtgcacctgcctcagc

SEQ ID NO: 5791492 - DNA, 20 bp, Homo sapiens
tcagtgcagcatatacaata

SEQ ID NO: 5791493 - DNA, 12 bp, Homo sapiens
tcagtgcagccc

SEQ ID NO: 5791494 - DNA, 13 bp, Homo sapiens
tcagtgcagcccc

SEQ ID NO: 5791495 - DNA, 21 bp, Homo sapiens
tcagtgcagccccctcctgac

SEQ ID NO: 5791496 - DNA, 15 bp, Homo sapiens
tcagtgcagcccgtg

SEQ ID NO: 5791497 - DNA, 16 bp, Homo sapiens
tcagtgcatttgtgct

SEQ ID NO: 5791498 - DNA, 14 bp, Homo sapiens
tcagtgcattttca

SEQ ID NO: 5791499 - DNA, 20 bp, Homo sapiens
tcagtgccaactgtggctgg

SEQ ID NO: 5791500 - DNA, 22 bp, Homo sapiens
tcagtgccaataaaatttagga

SEQ ID NO: 5791501 - DNA, 15 bp, Homo sapiens
tcagtgccacaaagc

SEQ ID NO: 5791502 - DNA, 16 bp, Homo sapiens
tcagtgccacctatgc

SEQ ID NO: 5791503 - DNA, 20 bp, Homo sapiens
tcagtgccacctatgcctgt

SEQ ID NO: 5791504 - DNA, 17 bp, Homo sapiens
tcagtgccacttgacat

SEQ ID NO: 5791505 - DNA, 20 bp, Homo sapiens
tcagtgccacttgacattcc

SEQ ID NO: 5791506 - DNA, 22 bp, Homo sapiens
tcagtgccacttgacattcctt

SEQ ID NO: 5791507 - DNA, 15 bp, Homo sapiens
tcagtgccagcccct

SEQ ID NO: 5791508 - DNA, 16 bp, Homo sapiens
tcatatattatcaaaa

SEQ ID NO: 5791509 - DNA, 13 bp, Homo sapiens
tcatatattcatg

SEQ ID NO: 5791510 - DNA, 14 bp, Homo sapiens
tcatatattgcatt

SEQ ID NO: 5791511 - DNA, 21 bp, Homo sapiens
tcatatatttaacaatgacaa

SEQ ID NO: 5791512 - DNA, 23 bp, Homo sapiens
tcatatatttaagccttttgtgt

SEQ ID NO: 5791513 - DNA, 22 bp, Homo sapiens
tcatatattttatgaatcagaa

SEQ ID NO: 5791514 - DNA, 17 bp, Homo sapiens
tcatatcactaaataaa

SEQ ID NO: 5791515 - DNA, 13 bp, Homo sapiens
tcatatcatccac

SEQ ID NO: 5791516 - DNA, 14 bp, Homo sapiens
tcatatcatccaca

SEQ ID NO: 5791517 - DNA, 12 bp, Homo sapiens
tcatatcatttc

SEQ ID NO: 5791518 - DNA, 20 bp, Homo sapiens
tcatatcctctcgttcagtt

SEQ ID NO: 5791519 - DNA, 14 bp, Homo sapiens
tcatatccttttga

SEQ ID NO: 5791520 - DNA, 14 bp, Homo sapiens
tcatatctaacttt

SEQ ID NO: 5791521 - DNA, 20 bp, Homo sapiens
tcatatctctcccttcttta

SEQ ID NO: 5791522 - DNA, 24 bp, Homo sapiens
tcatatctctcccttctttacctt

SEQ ID NO: 5791523 - DNA, 19 bp, Homo sapiens
tcatatctcttgcccttcc

SEQ ID NO: 5791524 - DNA, 14 bp, Homo sapiens
tcatatctggagcc

SEQ ID NO: 5791525 - DNA, 19 bp, Homo sapiens
tcatatcttaatatatttc

SEQ ID NO: 5791526 - DNA, 15 bp, Homo sapiens
tcatatcttcctcat

SEQ ID NO: 5791527 - DNA, 20 bp, Homo sapiens
tcatatgaaaggtgccatgg

SEQ ID NO: 5791528 - DNA, 21 bp, Homo sapiens
tcatatgaaaggtgccatgga

SEQ ID NO: 5791529 - DNA, 20 bp, Homo sapiens
tcatatgacattcatgcctg

SEQ ID NO: 5791530 - DNA, 19 bp, Homo sapiens
tcatatgaccattgaaaaa

SEQ ID NO: 5791531 - DNA, 21 bp, Homo sapiens
tcatatgaggacctttatatc

SEQ ID NO: 5791532 - DNA, 18 bp, Homo sapiens
tcatatgaggggacccag

SEQ ID NO: 5791533 - DNA, 22 bp, Homo sapiens
tcatatgcagaacgtatttagc

SEQ ID NO: 5791534 - DNA, 13 bp, Homo sapiens
tcatatgcatatt

SEQ ID NO: 5791535 - DNA, 13 bp, Homo sapiens
tcatatgccaccc

SEQ ID NO: 5791536 - DNA, 20 bp, Homo sapiens
tcatatgccaccccatgtgc

SEQ ID NO: 5791537 - DNA, 12 bp, Homo sapiens
tcatatgctctg

SEQ ID NO: 5791538 - DNA, 15 bp, Homo sapiens
tcatatgctctgctt

SEQ ID NO: 5791539 - DNA, 20 bp, Homo sapiens
tcatatgggatactgctggt

SEQ ID NO: 5791540 - DNA, 15 bp, Homo sapiens
tcatatggtaggaac

SEQ ID NO: 5791541 - DNA, 22 bp, Homo sapiens
tcatatggtaggaccctcgaga

SEQ ID NO: 5791542 - DNA, 23 bp, Homo sapiens
tcatatggtaggaccctcgagag

SEQ ID NO: 5791543 - DNA, 22 bp, Homo sapiens
tcatatgtaatctctaggaagt

SEQ ID NO: 5791544 - DNA, 22 bp, Homo sapiens
tcatatgtaccatgtacatgaa

SEQ ID NO: 5791545 - DNA, 17 bp, Homo sapiens
tcatatgtatctaaatg

SEQ ID NO: 5791546 - DNA, 18 bp, Homo sapiens
tcatatgtcacctttgct

SEQ ID NO: 5791547 - DNA, 22 bp, Homo sapiens
tcatatgtgatctgtcttgtaa

SEQ ID NO: 5791548 - DNA, 20 bp, Homo sapiens
tcatatgttgctcagtctcc

SEQ ID NO: 5791549 - DNA, 23 bp, Homo sapiens
tcatatgttgtgtttggttcaat

SEQ ID NO: 5791550 - DNA, 19 bp, Homo sapiens
tcatatgtttattcaaaat

SEQ ID NO: 5791551 - DNA, 20 bp, Homo sapiens
tcatattaacatattctaaa

SEQ ID NO: 5791552 - DNA, 15 bp, Homo sapiens
tcatattaagaatga

SEQ ID NO: 5791553 - DNA, 18 bp, Homo sapiens
tcatattaagaatgatct

SEQ ID NO: 5791554 - DNA, 16 bp, Homo sapiens
tcatattaagacagtg

SEQ ID NO: 5791555 - DNA, 14 bp, Homo sapiens
tcatattaccagaa

SEQ ID NO: 5791556 - DNA, 23 bp, Homo sapiens
tcatattagtaaaagatgccata

SEQ ID NO: 5791557 - DNA, 15 bp, Homo sapiens
tcatattcagcttgc

SEQ ID NO: 5791558 - DNA, 13 bp, Homo sapiens
tcatattcctgcc

SEQ ID NO: 5791559 - DNA, 13 bp, Homo sapiens
tcatattctaaaa

SEQ ID NO: 5791560 - DNA, 21 bp, Homo sapiens
tcatattctaaaagtaataaa

SEQ ID NO: 5791561 - DNA, 20 bp, Homo sapiens
tcatattctaacttattaaa

SEQ ID NO: 5791562 - DNA, 18 bp, Homo sapiens
tcatattctattgtttac

SEQ ID NO: 5791563 - DNA, 17 bp, Homo sapiens
tcatattctcatggctt

SEQ ID NO: 5791564 - DNA, 16 bp, Homo sapiens
tcatattctgtctgga

SEQ ID NO: 5791565 - DNA, 16 bp, Homo sapiens
tcatattctttcaatt

SEQ ID NO: 5791566 - DNA, 16 bp, Homo sapiens
tcatattgatgaaaag

SEQ ID NO: 5791567 - DNA, 18 bp, Homo sapiens
tcatattgatgaaaagat

SEQ ID NO: 5791568 - DNA, 15 bp, Homo sapiens
tcatattgcatcata

SEQ ID NO: 5791569 - DNA, 21 bp, Homo sapiens
tcatattgctaccaaaaacta

SEQ ID NO: 5791570 - DNA, 14 bp, Homo sapiens
tcatattggtgctg

SEQ ID NO: 5791571 - DNA, 14 bp, Homo sapiens
tcatattgtaatct

SEQ ID NO: 5791572 - DNA, 14 bp, Homo sapiens
tcatattgtatgta

SEQ ID NO: 5791573 - DNA, 15 bp, Homo sapiens
tcatatttacctgtg

SEQ ID NO: 5791574 - DNA, 17 bp, Homo sapiens
tcatatttacctgtgaa

SEQ ID NO: 5791575 - DNA, 21 bp, Homo sapiens
tcatatttacttcttatacat

SEQ ID NO: 5791576 - DNA, 22 bp, Homo sapiens
tcatatttagtattgaatactt

SEQ ID NO: 5791577 - DNA, 18 bp, Homo sapiens
tcatatttcacagcacca

SEQ ID NO: 5791578 - DNA, 22 bp, Homo sapiens
tcatatttcacagcaccaaaat

SEQ ID NO: 5791579 - DNA, 13 bp, Homo sapiens
tcatatttcccat

SEQ ID NO: 5791580 - DNA, 20 bp, Homo sapiens
tcatatttcgctatagattt

SEQ ID NO: 5791581 - DNA, 13 bp, Homo sapiens
tcatatttctacc

SEQ ID NO: 5791582 - DNA, 13 bp, Homo sapiens
tcatatttctgtg

SEQ ID NO: 5791583 - DNA, 22 bp, Homo sapiens
tcatatttcttatcaccacagt

SEQ ID NO: 5791584 - DNA, 13 bp, Homo sapiens
tcatatttgcact

SEQ ID NO: 5791585 - DNA, 15 bp, Homo sapiens
tcatattttaaatct

SEQ ID NO: 5791586 - DNA, 21 bp, Homo sapiens
tcatattttaatttcaagctt

SEQ ID NO: 5791587 - DNA, 23 bp, Homo sapiens
tcatattttcagtgctttctcaa

SEQ ID NO: 5791588 - DNA, 15 bp, Homo sapiens
tcatattttcatgct

SEQ ID NO: 5791589 - DNA, 16 bp, Homo sapiens
tcatattttccatctt

SEQ ID NO: 5791590 - DNA, 22 bp, Homo sapiens
tcatattttcctttatgtgatg

SEQ ID NO: 5791591 - DNA, 13 bp, Homo sapiens
tcatattttgcca

SEQ ID NO: 5791592 - DNA, 23 bp, Homo sapiens
tcatattttgtatatatctgctt

SEQ ID NO: 5791593 - DNA, 15 bp, Homo sapiens
tcatattttgttgtg

SEQ ID NO: 5791594 - DNA, 15 bp, Homo sapiens
tcatatttttacaaa

SEQ ID NO: 5791595 - DNA, 21 bp, Homo sapiens
tcatatttttagatacagtga

SEQ ID NO: 5791596 - DNA, 13 bp, Homo sapiens
tcatcaaaaagaa

SEQ ID NO: 5791597 - DNA, 17 bp, Homo sapiens
tcatcaaaaagaaaaat

SEQ ID NO: 5791598 - DNA, 20 bp, Homo sapiens
tcatcaaaaagaaaaatcaa

SEQ ID NO: 5791599 - DNA, 19 bp, Homo sapiens
tcatcaaacatttgccaag

SEQ ID NO: 5791600 - DNA, 15 bp, Homo sapiens
tcatcaaatcatcat

SEQ ID NO: 5791601 - DNA, 18 bp, Homo sapiens
tcatcaacaaaagggaga

SEQ ID NO: 5791602 - DNA, 23 bp, Homo sapiens
tcatcaacaaaagggagaacatg

SEQ ID NO: 5791603 - DNA, 13 bp, Homo sapiens
tcatcaacaagat

SEQ ID NO: 5791604 - DNA, 17 bp, Homo sapiens
tcatcaaccctaaaaag

SEQ ID NO: 5791605 - DNA, 15 bp, Homo sapiens
tcatcaactgaatga

SEQ ID NO: 5791606 - DNA, 18 bp, Homo sapiens
tcatcaagaaataggtta

SEQ ID NO: 5791607 - DNA, 21 bp, Homo sapiens
tcatcaagaagggctgcatga

SEQ ID NO: 5791608 - DNA, 21 bp, Homo sapiens
tcatcaagagtttattattgt

SEQ ID NO: 5791609 - DNA, 21 bp, Homo sapiens
tcatcaagattaattaaaatt

SEQ ID NO: 5791610 - DNA, 15 bp, Homo sapiens
tcatcaaggcactgc

SEQ ID NO: 5791611 - DNA, 17 bp, Homo sapiens
tcatcaaggcactgcct

SEQ ID NO: 5791612 - DNA, 23 bp, Homo sapiens
tcatcaagtagtagtacttaata

SEQ ID NO: 5791613 - DNA, 13 bp, Homo sapiens
tcatcaataaaac

SEQ ID NO: 5791614 - DNA, 20 bp, Homo sapiens
tcatcaatatccctcttgta

SEQ ID NO: 5791615 - DNA, 22 bp, Homo sapiens
tcatcaatatccctcttgtaag

SEQ ID NO: 5791616 - DNA, 23 bp, Homo sapiens
tcatcaatcaaataagtatttat

SEQ ID NO: 5791617 - DNA, 22 bp, Homo sapiens
tcatcaatcaaatattttttga

SEQ ID NO: 5791618 - DNA, 21 bp, Homo sapiens
tcatcaatccaggatgttatt

SEQ ID NO: 5791619 - DNA, 22 bp, Homo sapiens
tcatcaatgaagattaacactg

SEQ ID NO: 5791620 - DNA, 17 bp, Homo sapiens
tcatcaatgaatgaatg

SEQ ID NO: 5791621 - DNA, 19 bp, Homo sapiens
tcatcaatggggccagtca

SEQ ID NO: 5791622 - DNA, 13 bp, Homo sapiens
tcatcaattaaag

SEQ ID NO: 5791623 - DNA, 12 bp, Homo sapiens
tcatcaattccc

SEQ ID NO: 5791624 - DNA, 15 bp, Homo sapiens
tcatcaattcccatt

SEQ ID NO: 5791625 - DNA, 17 bp, Homo sapiens
tcatcaattctctatca

SEQ ID NO: 5791626 - DNA, 23 bp, Homo sapiens
tcatcaattgaatggtcagcgtt

SEQ ID NO: 5791627 - DNA, 24 bp, Homo sapiens
tcatcaattgaatggtcagcgttg

SEQ ID NO: 5791628 - DNA, 18 bp, Homo sapiens
tcatcaattttgtctatt

SEQ ID NO: 5791629 - DNA, 17 bp, Homo sapiens
tcatcaatttttataca

SEQ ID NO: 5791630 - DNA, 19 bp, Homo sapiens
tcatcaatttttatacata

SEQ ID NO: 5791631 - DNA, 20 bp, Homo sapiens
tcatcaatttttatacatat

SEQ ID NO: 5791632 - DNA, 18 bp, Homo sapiens
tcatcacaacctaaatgg

SEQ ID NO: 5791633 - DNA, 15 bp, Homo sapiens
tcatcacacacatgg

SEQ ID NO: 5791634 - DNA, 20 bp, Homo sapiens
tcatcacacccttttaacat

SEQ ID NO: 5791635 - DNA, 18 bp, Homo sapiens
tcatcacagcatgtgcaa

SEQ ID NO: 5791636 - DNA, 23 bp, Homo sapiens
tcatcacatttctatgccaaaca

SEQ ID NO: 5791637 - DNA, 21 bp, Homo sapiens
tcatcaccaacgtctgtgcca

SEQ ID NO: 5791638 - DNA, 14 bp, Homo sapiens
tcatcaccaccctt

SEQ ID NO: 5791639 - DNA, 22 bp, Homo sapiens
tcatcaccatcgtgtttgcaaa

SEQ ID NO: 5791640 - DNA, 14 bp, Homo sapiens
tcatcaccatttcc

SEQ ID NO: 5791641 - DNA, 17 bp, Homo sapiens
tcatcacccagtcctgg

SEQ ID NO: 5791642 - DNA, 14 bp, Homo sapiens
tcatcaccccagag

SEQ ID NO: 5791643 - DNA, 18 bp, Homo sapiens
tcatcaccgattcttcct

SEQ ID NO: 5791644 - DNA, 22 bp, Homo sapiens
tcatcaccgattcttccttgcc

SEQ ID NO: 5791645 - DNA, 21 bp, Homo sapiens
tcatcacctgctagaacctct

SEQ ID NO: 5791646 - DNA, 18 bp, Homo sapiens
tcatcactacagtattac

SEQ ID NO: 5791647 - DNA, 18 bp, Homo sapiens
tcatcactccaaaaacag

SEQ ID NO: 5791648 - DNA, 14 bp, Homo sapiens
tcatcactcccctc

SEQ ID NO: 5791649 - DNA, 14 bp, Homo sapiens
tcatcactccctgg

SEQ ID NO: 5791650 - DNA, 19 bp, Homo sapiens
tcatcactccctggatgtg

SEQ ID NO: 5791651 - DNA, 20 bp, Homo sapiens
tcatcactccctggatgtgt

SEQ ID NO: 5791652 - DNA, 18 bp, Homo sapiens
tcatcactggactgcatg

SEQ ID NO: 5791653 - DNA, 19 bp, Homo sapiens
tcatcactggactgcatgg

SEQ ID NO: 5791654 - DNA, 11 bp, Homo sapiens
tcatcactgta

SEQ ID NO: 5791655 - DNA, 17 bp, Homo sapiens
tcatcactgtaaagaca

SEQ ID NO: 5791656 - DNA, 13 bp, Homo sapiens
tcatcactgtgcc

SEQ ID NO: 5791657 - DNA, 18 bp, Homo sapiens
tcatcacttcttccactg

SEQ ID NO: 5791658 - DNA, 17 bp, Homo sapiens
tcatcacttttcagtga

SEQ ID NO: 5791659 - DNA, 18 bp, Homo sapiens
tcatcagaacagctgttg

SEQ ID NO: 5791660 - DNA, 14 bp, Homo sapiens
tcatcagaactgaa

SEQ ID NO: 5791661 - DNA, 13 bp, Homo sapiens
tcatcagaagtgg

SEQ ID NO: 5791662 - DNA, 22 bp, Homo sapiens
tcatcagaagtggtaggaaagc

SEQ ID NO: 5791663 - DNA, 14 bp, Homo sapiens
tcatcagagcagct

SEQ ID NO: 5791664 - DNA, 15 bp, Homo sapiens
tcatcagatggaaat

SEQ ID NO: 5791665 - DNA, 17 bp, Homo sapiens
tcatcagccagcaagag

SEQ ID NO: 5791666 - DNA, 21 bp, Homo sapiens
tcatcagcccaggtcccagtg

SEQ ID NO: 5791667 - DNA, 13 bp, Homo sapiens
tcatcaggatgaa

SEQ ID NO: 5791668 - DNA, 23 bp, Homo sapiens
tcatcaggccgggtgcagtggct

SEQ ID NO: 5791669 - DNA, 20 bp, Homo sapiens
tcatcaggctctgttcctca

SEQ ID NO: 5791670 - DNA, 18 bp, Homo sapiens
tcatcagtaacagtattc

SEQ ID NO: 5791671 - DNA, 20 bp, Homo sapiens
tcatcagtaagcagcctttg

SEQ ID NO: 5791672 - DNA, 23 bp, Homo sapiens
tcatcagtattgaagcattttat

SEQ ID NO: 5791673 - DNA, 23 bp, Homo sapiens
tcatcagtcttaatattcagaga

SEQ ID NO: 5791674 - DNA, 19 bp, Homo sapiens
tcatcagtgtgtaaataat

SEQ ID NO: 5791675 - DNA, 14 bp, Homo sapiens
tcatcataaaataa

SEQ ID NO: 5791676 - DNA, 17 bp, Homo sapiens
tcatcataggtaaggtt

SEQ ID NO: 5791677 - DNA, 21 bp, Homo sapiens
tcatcatatacaaatgtttta

SEQ ID NO: 5791678 - DNA, 17 bp, Homo sapiens
tcatcatattgtatgta

SEQ ID NO: 5791679 - DNA, 20 bp, Homo sapiens
tcatcatattgtatgtaagt

SEQ ID NO: 5791680 - DNA, 16 bp, Homo sapiens
tcatcatcagacttgc

SEQ ID NO: 5791681 - DNA, 14 bp, Homo sapiens
tcatcatcagtctt

SEQ ID NO: 5791682 - DNA, 16 bp, Homo sapiens
tcatcatcatggccag

SEQ ID NO: 5791683 - DNA, 14 bp, Homo sapiens
tcatcatccacccg

SEQ ID NO: 5791684 - DNA, 21 bp, Homo sapiens
tcatgaacatggtcagaacct

SEQ ID NO: 5791685 - DNA, 22 bp, Homo sapiens
tcatgaacatggtcagaacctt

SEQ ID NO: 5791686 - DNA, 22 bp, Homo sapiens
tcatgaacttcgcatcaaaaga

SEQ ID NO: 5791687 - DNA, 16 bp, Homo sapiens
tcatgaacttggctgt

SEQ ID NO: 5791688 - DNA, 13 bp, Homo sapiens
tcatgaagaaaaa

SEQ ID NO: 5791689 - DNA, 16 bp, Homo sapiens
tcatgaagaaaaaatt

SEQ ID NO: 5791690 - DNA, 12 bp, Homo sapiens
tcatgaagccca

SEQ ID NO: 5791691 - DNA, 13 bp, Homo sapiens
tcatgaagccctt

SEQ ID NO: 5791692 - DNA, 20 bp, Homo sapiens
tcatgaagcccttagggaga

SEQ ID NO: 5791693 - DNA, 15 bp, Homo sapiens
tcatgaagcctgtgg

SEQ ID NO: 5791694 - DNA, 16 bp, Homo sapiens
tcatgaagcctgtgga

SEQ ID NO: 5791695 - DNA, 17 bp, Homo sapiens
tcatgaagcttactttt

SEQ ID NO: 5791696 - DNA, 18 bp, Homo sapiens
tcatgaagcttacttttt

SEQ ID NO: 5791697 - DNA, 14 bp, Homo sapiens
tcatgaaggagggg

SEQ ID NO: 5791698 - DNA, 11 bp, Homo sapiens
tcatgaagtga

SEQ ID NO: 5791699 - DNA, 19 bp, Homo sapiens
tcatgaagtgcacaggagc

SEQ ID NO: 5791700 - DNA, 14 bp, Homo sapiens
tcatgaatatgatg

SEQ ID NO: 5791701 - DNA, 21 bp, Homo sapiens
tcatgaatatttcaaaataaa

SEQ ID NO: 5791702 - DNA, 14 bp, Homo sapiens
tcatgaatgaaaat

SEQ ID NO: 5791703 - DNA, 11 bp, Homo sapiens
tcatgaatgtg

SEQ ID NO: 5791704 - DNA, 21 bp, Homo sapiens
tcatgaattagttttatatgc

SEQ ID NO: 5791705 - DNA, 19 bp, Homo sapiens
tcatgaattcatactctgt

SEQ ID NO: 5791706 - DNA, 19 bp, Homo sapiens
tcatgaattcccttttaat

SEQ ID NO: 5791707 - DNA, 22 bp, Homo sapiens
tcatgaatttattgcacattgt

SEQ ID NO: 5791708 - DNA, 12 bp, Homo sapiens
tcatgaatttta

SEQ ID NO: 5791709 - DNA, 15 bp, Homo sapiens
tcatgaattttaaag

SEQ ID NO: 5791710 - DNA, 16 bp, Homo sapiens
tcatgaattttaaagt

SEQ ID NO: 5791711 - DNA, 14 bp, Homo sapiens
tcatgaattttaca

SEQ ID NO: 5791712 - DNA, 19 bp, Homo sapiens
tcatgacaaagactgagta

SEQ ID NO: 5791713 - DNA, 20 bp, Homo sapiens
tcatgacaaccgacgaagaa

SEQ ID NO: 5791714 - DNA, 22 bp, Homo sapiens
tcatgacaagatgggacagcaa

SEQ ID NO: 5791715 - DNA, 18 bp, Homo sapiens
tcatgacagaatatacac

SEQ ID NO: 5791716 - DNA, 21 bp, Homo sapiens
tcatgacagaatatacacatt

SEQ ID NO: 5791717 - DNA, 22 bp, Homo sapiens
tcatgacagaatatacacattt

SEQ ID NO: 5791718 - DNA, 18 bp, Homo sapiens
tcatgacattatatttga

SEQ ID NO: 5791719 - DNA, 15 bp, Homo sapiens
tcatgacatttctca

SEQ ID NO: 5791720 - DNA, 16 bp, Homo sapiens
tcatgacatttctcaa

SEQ ID NO: 5791721 - DNA, 18 bp, Homo sapiens
tcatgacatttctcaaag

SEQ ID NO: 5791722 - DNA, 17 bp, Homo sapiens
tcatgaccattagaata

SEQ ID NO: 5791723 - DNA, 18 bp, Homo sapiens
tcatgacggcctgcctgc

SEQ ID NO: 5791724 - DNA, 20 bp, Homo sapiens
tcatgactagtgcctagaaa

SEQ ID NO: 5791725 - DNA, 24 bp, Homo sapiens
tcatgactagtgcctagaaagcaa

SEQ ID NO: 5791726 - DNA, 15 bp, Homo sapiens
tcatgactgaaggga

SEQ ID NO: 5791727 - DNA, 17 bp, Homo sapiens
tcatgactgaagggaaa

SEQ ID NO: 5791728 - DNA, 15 bp, Homo sapiens
tcatgagaagccaag

SEQ ID NO: 5791729 - DNA, 14 bp, Homo sapiens
tcatgagcccacca

SEQ ID NO: 5791730 - DNA, 14 bp, Homo sapiens
tcatgagcctgttt

SEQ ID NO: 5791731 - DNA, 18 bp, Homo sapiens
tcatgagcctgtttattg

SEQ ID NO: 5791732 - DNA, 20 bp, Homo sapiens
tcatgagcgtcaaagaaaat

SEQ ID NO: 5791733 - DNA, 21 bp, Homo sapiens
tcatgagctcctgatcagagg

SEQ ID NO: 5791734 - DNA, 13 bp, Homo sapiens
tcatgagctgagt

SEQ ID NO: 5791735 - DNA, 14 bp, Homo sapiens
tcatgagctgggta

SEQ ID NO: 5791736 - DNA, 17 bp, Homo sapiens
tcatgaggaaactactg

SEQ ID NO: 5791737 - DNA, 18 bp, Homo sapiens
tcatgaggaaagacacag

SEQ ID NO: 5791738 - DNA, 19 bp, Homo sapiens
tcatgaggaccagggtgga

SEQ ID NO: 5791739 - DNA, 21 bp, Homo sapiens
tcatgaggagattctgccttt

SEQ ID NO: 5791740 - DNA, 12 bp, Homo sapiens
tcatgaggctga

SEQ ID NO: 5791741 - DNA, 21 bp, Homo sapiens
tcatgaggggagaggcgccct

SEQ ID NO: 5791742 - DNA, 21 bp, Homo sapiens
tcatgataatgaacagaacat

SEQ ID NO: 5791743 - DNA, 17 bp, Homo sapiens
tcatgataattcagcag

SEQ ID NO: 5791744 - DNA, 22 bp, Homo sapiens
tcatgataccacctttactgtg

SEQ ID NO: 5791745 - DNA, 13 bp, Homo sapiens
tcatgatctccct

SEQ ID NO: 5791746 - DNA, 14 bp, Homo sapiens
tcatgatctccctg

SEQ ID NO: 5791747 - DNA, 17 bp, Homo sapiens
tcatgatctccctgccg

SEQ ID NO: 5791748 - DNA, 18 bp, Homo sapiens
tcatgatctccctgccgc

SEQ ID NO: 5791749 - DNA, 20 bp, Homo sapiens
tcatgatgatgatgatttta

SEQ ID NO: 5791750 - DNA, 15 bp, Homo sapiens
tcatgatgctagcca

SEQ ID NO: 5791751 - DNA, 13 bp, Homo sapiens
tcatgatgctcat

SEQ ID NO: 5791752 - DNA, 23 bp, Homo sapiens
tcatgatgctctttcccacccag

SEQ ID NO: 5791753 - DNA, 16 bp, Homo sapiens
tcatgatggagacttc

SEQ ID NO: 5791754 - DNA, 14 bp, Homo sapiens
tcatgatgtctgca

SEQ ID NO: 5791755 - DNA, 19 bp, Homo sapiens
tcatgatgtttttaaaatc

SEQ ID NO: 5791756 - DNA, 20 bp, Homo sapiens
tcatgatgtttttaaaatct

SEQ ID NO: 5791757 - DNA, 15 bp, Homo sapiens
tcatgattagacaat

SEQ ID NO: 5791758 - DNA, 13 bp, Homo sapiens
tcatgattagcaa

SEQ ID NO: 5791759 - DNA, 14 bp, Homo sapiens
tcatgattcacaac

SEQ ID NO: 5791760 - DNA, 15 bp, Homo sapiens
tcatgattccatgcc

SEQ ID NO: 5791761 - DNA, 22 bp, Homo sapiens
tcatgattggcttaaagtgaag

SEQ ID NO: 5791762 - DNA, 15 bp, Homo sapiens
tcatgatttctgtga

SEQ ID NO: 5791763 - DNA, 18 bp, Homo sapiens
tcatgcaaaaaaaaaaat

SEQ ID NO: 5791764 - DNA, 13 bp, Homo sapiens
tcatgcaaactct

SEQ ID NO: 5791765 - DNA, 14 bp, Homo sapiens
tcatgcaaactctt

SEQ ID NO: 5791766 - DNA, 23 bp, Homo sapiens
tcatgcaagacttcactgcagcc

SEQ ID NO: 5791767 - DNA, 19 bp, Homo sapiens
tcatgcaagtgagaaagac

SEQ ID NO: 5791768 - DNA, 21 bp, Homo sapiens
tcatgcaagtggagctgtctg

SEQ ID NO: 5791769 - DNA, 22 bp, Homo sapiens
tcatgcaagtggagctgtctgt

SEQ ID NO: 5791770 - DNA, 20 bp, Homo sapiens
tcatgcacagtatttgtaat

SEQ ID NO: 5791771 - DNA, 17 bp, Homo sapiens
tcatgcacccctgagcc

SEQ ID NO: 5791772 - DNA, 14 bp, Homo sapiens
tcatgcactgaggt

SEQ ID NO: 5791773 - DNA, 16 bp, Homo sapiens
tcatgcacttaaagaa

SEQ ID NO: 5791774 - DNA, 14 bp, Homo sapiens
tcatgcagccgtga

SEQ ID NO: 5791775 - DNA, 23 bp, Homo sapiens
tcatgcagccgtgatcaagggaa

SEQ ID NO: 5791776 - DNA, 16 bp, Homo sapiens
tcatgcaggttagaaa

SEQ ID NO: 5791777 - DNA, 20 bp, Homo sapiens
tcatgcataaatatgcagtg

SEQ ID NO: 5791778 - DNA, 15 bp, Homo sapiens
tcatgcatagacaag

SEQ ID NO: 5791779 - DNA, 17 bp, Homo sapiens
tcatgcatagtcccagc

SEQ ID NO: 5791780 - DNA, 18 bp, Homo sapiens
tcatgcatagtcccagct

SEQ ID NO: 5791781 - DNA, 20 bp, Homo sapiens
tcatgcatctccacctgctc

SEQ ID NO: 5791782 - DNA, 22 bp, Homo sapiens
tcatgcatctccacctgctccc

SEQ ID NO: 5791783 - DNA, 21 bp, Homo sapiens
tcatgcattctagtgcagaag

SEQ ID NO: 5791784 - DNA, 12 bp, Homo sapiens
tcatgcattggt

SEQ ID NO: 5791785 - DNA, 23 bp, Homo sapiens
tcatgcattttgctttggacaca

SEQ ID NO: 5791786 - DNA, 24 bp, Homo sapiens
tcatgccaaccctgggctattgct

SEQ ID NO: 5791787 - DNA, 23 bp, Homo sapiens
tcatgccacaccggtaccctcct

SEQ ID NO: 5791788 - DNA, 23 bp, Homo sapiens
tcatgccagctacttcctcctcc

SEQ ID NO: 5791789 - DNA, 17 bp, Homo sapiens
tcatgcccaagccctga

SEQ ID NO: 5791790 - DNA, 19 bp, Homo sapiens
tcatgcccaccccctgccc

SEQ ID NO: 5791791 - DNA, 22 bp, Homo sapiens
tcatgcccaccccctgccctgc

SEQ ID NO: 5791792 - DNA, 14 bp, Homo sapiens
tcatgcccactccc

SEQ ID NO: 5791793 - DNA, 20 bp, Homo sapiens
tcatgcccactcccccagga

SEQ ID NO: 5791794 - DNA, 22 bp, Homo sapiens
tcatgcccactcccccaggagc

SEQ ID NO: 5791795 - DNA, 23 bp, Homo sapiens
tcatgcccactcccccaggagca

SEQ ID NO: 5791796 - DNA, 13 bp, Homo sapiens
tcatgcccactgc

SEQ ID NO: 5791797 - DNA, 15 bp, Homo sapiens
tcatgcccactgccg

SEQ ID NO: 5791798 - DNA, 16 bp, Homo sapiens
tcatgcccagctctct

SEQ ID NO: 5791799 - DNA, 17 bp, Homo sapiens
tcatgcccggtcccacc

SEQ ID NO: 5791800 - DNA, 15 bp, Homo sapiens
tcatgccctgtgcaa

SEQ ID NO: 5791801 - DNA, 17 bp, Homo sapiens
tcatgccgctgtgtcta

SEQ ID NO: 5791802 - DNA, 20 bp, Homo sapiens
tcatgccgggcgtggtggca

SEQ ID NO: 5791803 - DNA, 14 bp, Homo sapiens
tcatgcctcagttt

SEQ ID NO: 5791804 - DNA, 17 bp, Homo sapiens
tcatgcctcagtttccc

SEQ ID NO: 5791805 - DNA, 18 bp, Homo sapiens
tcatgcctcagtttcccc

SEQ ID NO: 5791806 - DNA, 22 bp, Homo sapiens
tcatgcctcgctcagtcagtgc

SEQ ID NO: 5791807 - DNA, 22 bp, Homo sapiens
tcatgcctctgaggccagcctg

SEQ ID NO: 5791808 - DNA, 12 bp, Homo sapiens
tcatgcctgaga

SEQ ID NO: 5791809 - DNA, 13 bp, Homo sapiens
tcatgcctgagaa

SEQ ID NO: 5791810 - DNA, 22 bp, Homo sapiens
tcatgcctgagaatgcctaggc

SEQ ID NO: 5791811 - DNA, 13 bp, Homo sapiens
tcatgcctgcctg

SEQ ID NO: 5791812 - DNA, 14 bp, Homo sapiens
tcatgcctgcctga

SEQ ID NO: 5791813 - DNA, 13 bp, Homo sapiens
tcatgcctgctga

SEQ ID NO: 5791814 - DNA, 23 bp, Homo sapiens
tcatgcctggaagctttgtcccc

SEQ ID NO: 5791815 - DNA, 21 bp, Homo sapiens
tcatgcctggcccccctccag

SEQ ID NO: 5791816 - DNA, 22 bp, Homo sapiens
tcatgcctggcccccctccagg

SEQ ID NO: 5791817 - DNA, 20 bp, Homo sapiens
tcatgcctggggtggaggct

SEQ ID NO: 5791818 - DNA, 16 bp, Homo sapiens
tcatgcctgtaatccc

SEQ ID NO: 5791819 - DNA, 23 bp, Homo sapiens
tcatgcctttatttctgtatctg

SEQ ID NO: 5791820 - DNA, 16 bp, Homo sapiens
tcatgcctttcatagt

SEQ ID NO: 5791821 - DNA, 18 bp, Homo sapiens
tcatgcctttcatagttt

SEQ ID NO: 5791822 - DNA, 16 bp, Homo sapiens
tcatgcctttgtaagt

SEQ ID NO: 5791823 - DNA, 20 bp, Homo sapiens
tcatgcgaattcttgcttga

SEQ ID NO: 5791824 - DNA, 19 bp, Homo sapiens
tcatgcgatgacacttgta

SEQ ID NO: 5791825 - DNA, 20 bp, Homo sapiens
tcatgcgatgacacttgtac

SEQ ID NO: 5791826 - DNA, 22 bp, Homo sapiens
tcatgcgctgctttttcatcaa

SEQ ID NO: 5791827 - DNA, 13 bp, Homo sapiens
tcatgcggcccag

SEQ ID NO: 5791828 - DNA, 14 bp, Homo sapiens
tcatgcggcccagc

SEQ ID NO: 5791829 - DNA, 22 bp, Homo sapiens
tcatgcgtccactttcccttcc

SEQ ID NO: 5791830 - DNA, 17 bp, Homo sapiens
tcatgcgtctctggccc

SEQ ID NO: 5791831 - DNA, 17 bp, Homo sapiens
tcatgcgtgttttacct

SEQ ID NO: 5791832 - DNA, 22 bp, Homo sapiens
tcatgcgttttatatcttccta

SEQ ID NO: 5791833 - DNA, 19 bp, Homo sapiens
tcatgctcacttttgtgaa

SEQ ID NO: 5791834 - DNA, 18 bp, Homo sapiens
tcatgctcagccttgctg

SEQ ID NO: 5791835 - DNA, 23 bp, Homo sapiens
tcatgctcccaaatgcagcttca

SEQ ID NO: 5791836 - DNA, 21 bp, Homo sapiens
tcatgctctcatatatatttt

SEQ ID NO: 5791837 - DNA, 13 bp, Homo sapiens
tcatgctgaaagc

SEQ ID NO: 5791838 - DNA, 23 bp, Homo sapiens
tcatgctgaatccacctcggagc

SEQ ID NO: 5791839 - DNA, 13 bp, Homo sapiens
tcatgctgacttg

SEQ ID NO: 5791840 - DNA, 21 bp, Homo sapiens
tcatgctgccaatatcctaat

SEQ ID NO: 5791841 - DNA, 17 bp, Homo sapiens
tcatgctgcccctgcct

SEQ ID NO: 5791842 - DNA, 14 bp, Homo sapiens
tcatgctgcctgcc

SEQ ID NO: 5791843 - DNA, 18 bp, Homo sapiens
tcatgctgctagatcttt

SEQ ID NO: 5791844 - DNA, 19 bp, Homo sapiens
tcatgctgctagatcttta

SEQ ID NO: 5791845 - DNA, 19 bp, Homo sapiens
tcatgctggaacctgcaaa

SEQ ID NO: 5791846 - DNA, 17 bp, Homo sapiens
tcatgctggagggaggc

SEQ ID NO: 5791847 - DNA, 16 bp, Homo sapiens
tcatgctgtccgtgct

SEQ ID NO: 5791848 - DNA, 16 bp, Homo sapiens
tcatgctgttctcttt

SEQ ID NO: 5791849 - DNA, 19 bp, Homo sapiens
tcatgctgttctctttgct

SEQ ID NO: 5791850 - DNA, 20 bp, Homo sapiens
tcatgctgttctctttgctg

SEQ ID NO: 5791851 - DNA, 19 bp, Homo sapiens
tcatgctgttgctgctact

SEQ ID NO: 5791852 - DNA, 17 bp, Homo sapiens
tcatgcttaataaacat

SEQ ID NO: 5791853 - DNA, 15 bp, Homo sapiens
tcatgcttataagca

SEQ ID NO: 5791854 - DNA, 18 bp, Homo sapiens
tcatgcttatgttaaact

SEQ ID NO: 5791855 - DNA, 22 bp, Homo sapiens
tcatgcttatgttaaactctgt

SEQ ID NO: 5791856 - DNA, 19 bp, Homo sapiens
tcatgcttcagttgtactt

SEQ ID NO: 5791857 - DNA, 17 bp, Homo sapiens
tcatgcttcttccttac

SEQ ID NO: 5791858 - DNA, 23 bp, Homo sapiens
tcatgctttaaagtgtaataata

SEQ ID NO: 5791859 - DNA, 16 bp, Homo sapiens
tcatggaaaagcccag

SEQ ID NO: 5791860 - DNA, 23 bp, Homo sapiens
tcattggtggtagccatcaagca

SEQ ID NO: 5791861 - DNA, 18 bp, Homo sapiens
tcattggttaacaataaa

SEQ ID NO: 5791862 - DNA, 16 bp, Homo sapiens
tcattgtaaatgaaca

SEQ ID NO: 5791863 - DNA, 12 bp, Homo sapiens
tcattgtaaatt

SEQ ID NO: 5791864 - DNA, 19 bp, Homo sapiens
tcattgtaaccatttctca

SEQ ID NO: 5791865 - DNA, 14 bp, Homo sapiens
tcattgtaatctgc

SEQ ID NO: 5791866 - DNA, 17 bp, Homo sapiens
tcattgtaatgttactg

SEQ ID NO: 5791867 - DNA, 16 bp, Homo sapiens
tcattgtacaagtatt

SEQ ID NO: 5791868 - DNA, 14 bp, Homo sapiens
tcattgtacagttt

SEQ ID NO: 5791869 - DNA, 19 bp, Homo sapiens
tcattgtacagtttgttta

SEQ ID NO: 5791870 - DNA, 21 bp, Homo sapiens
tcattgtactacctgtgtata

SEQ ID NO: 5791871 - DNA, 18 bp, Homo sapiens
tcattgtactgtttttaa

SEQ ID NO: 5791872 - DNA, 14 bp, Homo sapiens
tcattgtagaaaag

SEQ ID NO: 5791873 - DNA, 14 bp, Homo sapiens
tcattgtagagctt

SEQ ID NO: 5791874 - DNA, 23 bp, Homo sapiens
tcattgtagagcttggtggctga

SEQ ID NO: 5791875 - DNA, 15 bp, Homo sapiens
tcattgtatgatgtg

SEQ ID NO: 5791876 - DNA, 14 bp, Homo sapiens
tcattgtatgtggt

SEQ ID NO: 5791877 - DNA, 12 bp, Homo sapiens
tcattgtattca

SEQ ID NO: 5791878 - DNA, 14 bp, Homo sapiens
tcattgtattcaga

SEQ ID NO: 5791879 - DNA, 15 bp, Homo sapiens
tcattgtcagccttg

SEQ ID NO: 5791880 - DNA, 22 bp, Homo sapiens
tcattgtccagagctgcttccc

SEQ ID NO: 5791881 - DNA, 20 bp, Homo sapiens
tcattgtccatgcctacaga

SEQ ID NO: 5791882 - DNA, 22 bp, Homo sapiens
tcattgtccatgcctacagata

SEQ ID NO: 5791883 - DNA, 16 bp, Homo sapiens
tcattgtccctcttca

SEQ ID NO: 5791884 - DNA, 16 bp, Homo sapiens
tcattgtcgctcagca

SEQ ID NO: 5791885 - DNA, 16 bp, Homo sapiens
tcattgtctcagtgct

SEQ ID NO: 5791886 - DNA, 18 bp, Homo sapiens
tcattgtctcagtgctgg

SEQ ID NO: 5791887 - DNA, 22 bp, Homo sapiens
tcattgtcttgttatgtacaaa

SEQ ID NO: 5791888 - DNA, 12 bp, Homo sapiens
tcattgtgaaat

SEQ ID NO: 5791889 - DNA, 15 bp, Homo sapiens
tcattgtgaaattat

SEQ ID NO: 5791890 - DNA, 18 bp, Homo sapiens
tcattgtgaaattattca

SEQ ID NO: 5791891 - DNA, 15 bp, Homo sapiens
tcattgtgccaagcc

SEQ ID NO: 5791892 - DNA, 19 bp, Homo sapiens
tcattgtgccaagccttct

SEQ ID NO: 5791893 - DNA, 18 bp, Homo sapiens
tcattgtgtaaggaaaaa

SEQ ID NO: 5791894 - DNA, 20 bp, Homo sapiens
tcattgtgtgtcttcaggag

SEQ ID NO: 5791895 - DNA, 16 bp, Homo sapiens
tcattgttaaaaaaca

SEQ ID NO: 5791896 - DNA, 18 bp, Homo sapiens
tcattgttaaaaaacaac

SEQ ID NO: 5791897 - DNA, 22 bp, Homo sapiens
tcattgttaaaaaacaaccaaa

SEQ ID NO: 5791898 - DNA, 15 bp, Homo sapiens
tcattgttaaagtaa

SEQ ID NO: 5791899 - DNA, 20 bp, Homo sapiens
tcattgttaaatacacatta

SEQ ID NO: 5791900 - DNA, 14 bp, Homo sapiens
tcattgttacatgt

SEQ ID NO: 5791901 - DNA, 22 bp, Homo sapiens
tcattgttctcctcgtccatca

SEQ ID NO: 5791902 - DNA, 12 bp, Homo sapiens
tcattgttctgt

SEQ ID NO: 5791903 - DNA, 16 bp, Homo sapiens
tcattgttgtgtataa

SEQ ID NO: 5791904 - DNA, 23 bp, Homo sapiens
tcattgttgttttaacctcccct

SEQ ID NO: 5791905 - DNA, 12 bp, Homo sapiens
tcattgtttaga

SEQ ID NO: 5791906 - DNA, 21 bp, Homo sapiens
tcattgtttagatgaggctca

SEQ ID NO: 5791907 - DNA, 23 bp, Homo sapiens
tcatttaaaaaaaaaatttgttt

SEQ ID NO: 5791908 - DNA, 14 bp, Homo sapiens
tcatttaaaaagct

SEQ ID NO: 5791909 - DNA, 20 bp, Homo sapiens
tcatttaaaaagctcactgc

SEQ ID NO: 5791910 - DNA, 22 bp, Homo sapiens
tcatttaaaaaggtttaaaact

SEQ ID NO: 5791911 - DNA, 14 bp, Homo sapiens
tcatttaaactaaa

SEQ ID NO: 5791912 - DNA, 15 bp, Homo sapiens
tcatttaaactaaat

SEQ ID NO: 5791913 - DNA, 21 bp, Homo sapiens
tcatttaacactgagtgaaat

SEQ ID NO: 5791914 - DNA, 15 bp, Homo sapiens
tcatttaactacaaa

SEQ ID NO: 5791915 - DNA, 12 bp, Homo sapiens
tcatttaactga

SEQ ID NO: 5791916 - DNA, 12 bp, Homo sapiens
tcatttaagatt

SEQ ID NO: 5791917 - DNA, 17 bp, Homo sapiens
tcatttaagggaaaaat

SEQ ID NO: 5791918 - DNA, 17 bp, Homo sapiens
tcatttaatatttttca

SEQ ID NO: 5791919 - DNA, 17 bp, Homo sapiens
tcatttacaacttccag

SEQ ID NO: 5791920 - DNA, 17 bp, Homo sapiens
tcatttacgtaaaaaga

SEQ ID NO: 5791921 - DNA, 22 bp, Homo sapiens
tcatttactcaaaatctgtcat

SEQ ID NO: 5791922 - DNA, 22 bp, Homo sapiens
tcatttacttgtacgagacaga

SEQ ID NO: 5791923 - DNA, 19 bp, Homo sapiens
tcatttagataatttgaaa

SEQ ID NO: 5791924 - DNA, 19 bp, Homo sapiens
tcatttagattgaaaactt

SEQ ID NO: 5791925 - DNA, 17 bp, Homo sapiens
tcatttagcatgttgtt

SEQ ID NO: 5791926 - DNA, 13 bp, Homo sapiens
tcatttaggactg

SEQ ID NO: 5791927 - DNA, 16 bp, Homo sapiens
tcatttagtaaggatt

SEQ ID NO: 5791928 - DNA, 21 bp, Homo sapiens
tcatttagtaaggattttatg

SEQ ID NO: 5791929 - DNA, 15 bp, Homo sapiens
tcatttagtgctaaa

SEQ ID NO: 5791930 - DNA, 17 bp, Homo sapiens
tcatttataatactgtt

SEQ ID NO: 5791931 - DNA, 18 bp, Homo sapiens
tcatttataatactgttt

SEQ ID NO: 5791932 - DNA, 22 bp, Homo sapiens
tcatttataatgtagcagctca

SEQ ID NO: 5791933 - DNA, 18 bp, Homo sapiens
tcatttatactgtagcaa

SEQ ID NO: 5791934 - DNA, 19 bp, Homo sapiens
tcatttatactgtagcaat

SEQ ID NO: 5791935 - DNA, 20 bp, Homo sapiens
tcatttatactgtagcaata

SEQ ID NO: 5791936 - DNA, 22 bp, Homo sapiens
tcatttatatagattataactt

SEQ ID NO: 5791937 - DNA, 19 bp, Homo sapiens
tcatttatatcgctggcca

SEQ ID NO: 5791938 - DNA, 16 bp, Homo sapiens
tcatttatctataatt

SEQ ID NO: 5791939 - DNA, 13 bp, Homo sapiens
tcatttatctgga

SEQ ID NO: 5791940 - DNA, 14 bp, Homo sapiens
tcatttatgaaaag

SEQ ID NO: 5791941 - DNA, 15 bp, Homo sapiens
tcatttatgttattt

SEQ ID NO: 5791942 - DNA, 18 bp, Homo sapiens
tcatttattaagtatatt

SEQ ID NO: 5791943 - DNA, 14 bp, Homo sapiens
tcatttatttcatg

SEQ ID NO: 5791944 - DNA, 14 bp, Homo sapiens
tcatttattttgac

SEQ ID NO: 5791945 - DNA, 21 bp, Homo sapiens
tcatttatttttaaaataatt

SEQ ID NO: 5791946 - DNA, 19 bp, Homo sapiens
tcatttatttttagccatt

SEQ ID NO: 5791947 - DNA, 19 bp, Homo sapiens
tcatttcaaaatatgtgta

SEQ ID NO: 5791948 - DNA, 15 bp, Homo sapiens
tcatttcacacagtg

SEQ ID NO: 5791949 - DNA, 19 bp, Homo sapiens
tcatttcacattaatggtc

SEQ ID NO: 5791950 - DNA, 15 bp, Homo sapiens
tcatttcacattttt

SEQ ID NO: 5791951 - DNA, 17 bp, Homo sapiens
tcatttcacatttttgt

SEQ ID NO: 5791952 - DNA, 23 bp, Homo sapiens
tcatttcacatttttgtaatgct

SEQ ID NO: 5791953 - DNA, 15 bp, Homo sapiens
tcatttcacccctcc

SEQ ID NO: 5791954 - DNA, 12 bp, Homo sapiens
tcatttcacctg

SEQ ID NO: 5791955 - DNA, 19 bp, Homo sapiens
tcatttcactaagctcctc

SEQ ID NO: 5791956 - DNA, 14 bp, Homo sapiens
tcatttcactttaa

SEQ ID NO: 5791957 - DNA, 15 bp, Homo sapiens
tcatttcagagccct

SEQ ID NO: 5791958 - DNA, 14 bp, Homo sapiens
tcatttcagatttt

SEQ ID NO: 5791959 - DNA, 15 bp, Homo sapiens
tcatttcagatttta

SEQ ID NO: 5791960 - DNA, 14 bp, Homo sapiens
tcatttcagccaaa

SEQ ID NO: 5791961 - DNA, 16 bp, Homo sapiens
tcatttcagccaaagt

SEQ ID NO: 5791962 - DNA, 12 bp, Homo sapiens
tcatttcataca

SEQ ID NO: 5791963 - DNA, 14 bp, Homo sapiens
tcatttcatacaaa

SEQ ID NO: 5791964 - DNA, 12 bp, Homo sapiens
tcatttcatata

SEQ ID NO: 5791965 - DNA, 14 bp, Homo sapiens
tcatttcatcctgt

SEQ ID NO: 5791966 - DNA, 15 bp, Homo sapiens
tcatttcatctcatt

SEQ ID NO: 5791967 - DNA, 16 bp, Homo sapiens
tcatttcatctcattt

SEQ ID NO: 5791968 - DNA, 20 bp, Homo sapiens
tcatttcatctcatttaagg

SEQ ID NO: 5791969 - DNA, 13 bp, Homo sapiens
tcatttcatgctt

SEQ ID NO: 5791970 - DNA, 16 bp, Homo sapiens
tcatttcatgctttga

SEQ ID NO: 5791971 - DNA, 15 bp, Homo sapiens
tcatttcattccatt

SEQ ID NO: 5791972 - DNA, 16 bp, Homo sapiens
tcatttcattccattg

SEQ ID NO: 5791973 - DNA, 16 bp, Homo sapiens
tcatttcattcctaac

SEQ ID NO: 5791974 - DNA, 14 bp, Homo sapiens
tcatttcattgtat

SEQ ID NO: 5791975 - DNA, 20 bp, Homo sapiens
tcatttccaaacttgaaaac

SEQ ID NO: 5791976 - DNA, 12 bp, Homo sapiens
tcatttccaaat

SEQ ID NO: 5791977 - DNA, 20 bp, Homo sapiens
tcatttccaaattcctagaa

SEQ ID NO: 5791978 - DNA, 19 bp, Homo sapiens
tcatttccaactcaggtta

SEQ ID NO: 5791979 - DNA, 15 bp, Homo sapiens
tcatttccagcaaaa

SEQ ID NO: 5791980 - DNA, 16 bp, Homo sapiens
tcatttccagcaaaat

SEQ ID NO: 5791981 - DNA, 14 bp, Homo sapiens
tcatttccagcttc

SEQ ID NO: 5791982 - DNA, 17 bp, Homo sapiens
tcatttccagcttctca

SEQ ID NO: 5791983 - DNA, 18 bp, Homo sapiens
tcatttccagcttctcag

SEQ ID NO: 5791984 - DNA, 12 bp, Homo sapiens
tcatttccatgt

SEQ ID NO: 5791985 - DNA, 18 bp, Homo sapiens
tcatttccccataactca

SEQ ID NO: 5791986 - DNA, 22 bp, Homo sapiens
tcatttccccataactcaatgg

SEQ ID NO: 5791987 - DNA, 13 bp, Homo sapiens
tcatttcctcaaa

SEQ ID NO: 5791988 - DNA, 21 bp, Homo sapiens
tcatttcctctgagctgttat

SEQ ID NO: 5791989 - DNA, 14 bp, Homo sapiens
tcatttcctgccct

SEQ ID NO: 5791990 - DNA, 18 bp, Homo sapiens
tcatttcctgggagaaag

SEQ ID NO: 5791991 - DNA, 16 bp, Homo sapiens
tcatttcctgtgtctt

SEQ ID NO: 5791992 - DNA, 21 bp, Homo sapiens
tcatttccttcaaggcatcat

SEQ ID NO: 5791993 - DNA, 21 bp, Homo sapiens
tcatttcctttgttgtctaca

SEQ ID NO: 5791994 - DNA, 18 bp, Homo sapiens
tcatttcgttccctgatt

SEQ ID NO: 5791995 - DNA, 13 bp, Homo sapiens
tcatttctaaaag

SEQ ID NO: 5791996 - DNA, 15 bp, Homo sapiens
tcatttctaaaagaa

SEQ ID NO: 5791997 - DNA, 17 bp, Homo sapiens
tcatttctaaaagaata

SEQ ID NO: 5791998 - DNA, 17 bp, Homo sapiens
tcatttctaaatttata

SEQ ID NO: 5791999 - DNA, 22 bp, Homo sapiens
tcatttctaggcaaaattgtga

SEQ ID NO: 5792000 - DNA, 23 bp, Homo sapiens
tcatttctaggcaaaattgtgaa

SEQ ID NO: 5792001 - DNA, 14 bp, Homo sapiens
tcatttctcaggtg

SEQ ID NO: 5792002 - DNA, 22 bp, Homo sapiens
tcatttctcataattttgcaaa

SEQ ID NO: 5792003 - DNA, 16 bp, Homo sapiens
tcatttctctgcatgg

SEQ ID NO: 5792004 - DNA, 14 bp, Homo sapiens
tcatttctctttca

SEQ ID NO: 5792005 - DNA, 19 bp, Homo sapiens
tcatttctctttttatctc

SEQ ID NO: 5792006 - DNA, 12 bp, Homo sapiens
tcatttctgatt

SEQ ID NO: 5792007 - DNA, 16 bp, Homo sapiens
tcatttctgtctcccc

SEQ ID NO: 5792008 - DNA, 20 bp, Homo sapiens
tcatttctgtctttaagaac

SEQ ID NO: 5792009 - DNA, 15 bp, Homo sapiens
tcatttcttatgaat

SEQ ID NO: 5792010 - DNA, 14 bp, Homo sapiens
tcatttcttcactt

SEQ ID NO: 5792011 - DNA, 16 bp, Homo sapiens
tcatttcttcctcagc

SEQ ID NO: 5792012 - DNA, 18 bp, Homo sapiens
tcatttcttcctcagctg

SEQ ID NO: 5792013 - DNA, 16 bp, Homo sapiens
tcatttcttcctctgc

SEQ ID NO: 5792014 - DNA, 17 bp, Homo sapiens
tcatttcttcctctgca

SEQ ID NO: 5792015 - DNA, 19 bp, Homo sapiens
tcatttcttttccaaaatt

SEQ ID NO: 5792016 - DNA, 13 bp, Homo sapiens
tcatttgaaagtg

SEQ ID NO: 5792017 - DNA, 16 bp, Homo sapiens
tcatttgaacaactag

SEQ ID NO: 5792018 - DNA, 14 bp, Homo sapiens
tcatttgaatgaga

SEQ ID NO: 5792019 - DNA, 16 bp, Homo sapiens
tcatttgacatttagt

SEQ ID NO: 5792020 - DNA, 18 bp, Homo sapiens
tcatttgactaagagtct

SEQ ID NO: 5792021 - DNA, 18 bp, Homo sapiens
tcatttgactgtctcact

SEQ ID NO: 5792022 - DNA, 19 bp, Homo sapiens
tcatttgagcagggctcag

SEQ ID NO: 5792023 - DNA, 16 bp, Homo sapiens
tcatttgatgctaaat

SEQ ID NO: 5792024 - DNA, 13 bp, Homo sapiens
tcatttgcacaca

SEQ ID NO: 5792025 - DNA, 18 bp, Homo sapiens
tcatttgcacacaaaaat

SEQ ID NO: 5792026 - DNA, 19 bp, Homo sapiens
tcatttgcagctgctggtt

SEQ ID NO: 5792027 - DNA, 19 bp, Homo sapiens
tcatttgcccttaaggaca

SEQ ID NO: 5792028 - DNA, 20 bp, Homo sapiens
tcatttgctaactagcttgg

SEQ ID NO: 5792029 - DNA, 21 bp, Homo sapiens
tcatttgctaagtgtatgatg

SEQ ID NO: 5792030 - DNA, 15 bp, Homo sapiens
tcatttgctttggaa

SEQ ID NO: 5792031 - DNA, 22 bp, Homo sapiens
tcatttggaggaaaaaaagcat

SEQ ID NO: 5792032 - DNA, 17 bp, Homo sapiens
tcatttggatataaatc

SEQ ID NO: 5792033 - DNA, 20 bp, Homo sapiens
tcatttggatataaatctta

SEQ ID NO: 5792034 - DNA, 16 bp, Homo sapiens
tcatttgggctagact

SEQ ID NO: 5792035 - DNA, 17 bp, Homo sapiens
tcatttggggcatttgt

SEQ ID NO: 5792036 - DNA, 15 bp, Homo sapiens
tcatttggtctgcca

SEQ ID NO: 5792037 - DNA, 16 bp, Homo sapiens
tcatttggtctgccag

SEQ ID NO: 5792038 - DNA, 17 bp, Homo sapiens
tcatttggtctgccaga

SEQ ID NO: 5792039 - DNA, 19 bp, Homo sapiens
tcatttggtctgccagaat

SEQ ID NO: 5792040 - DNA, 17 bp, Homo sapiens
tccaacgtggggcagca

SEQ ID NO: 5792041 - DNA, 18 bp, Homo sapiens
tccaacgtggggcagcac

SEQ ID NO: 5792042 - DNA, 13 bp, Homo sapiens
tccaacgtttgga

SEQ ID NO: 5792043 - DNA, 21 bp, Homo sapiens
tccaacgtttggaagatcctg

SEQ ID NO: 5792044 - DNA, 13 bp, Homo sapiens
tccaactactaaa

SEQ ID NO: 5792045 - DNA, 17 bp, Homo sapiens
tccaactcagagcacag

SEQ ID NO: 5792046 - DNA, 13 bp, Homo sapiens
tccaactcaggtt

SEQ ID NO: 5792047 - DNA, 12 bp, Homo sapiens
tccaactccagc

SEQ ID NO: 5792048 - DNA, 12 bp, Homo sapiens
tccaactccagt

SEQ ID NO: 5792049 - DNA, 19 bp, Homo sapiens
tccaactcctttcagccac

SEQ ID NO: 5792050 - DNA, 20 bp, Homo sapiens
tccaactcctttcagccaca

SEQ ID NO: 5792051 - DNA, 23 bp, Homo sapiens
tccaactgagaagtaccttatca

SEQ ID NO: 5792052 - DNA, 14 bp, Homo sapiens
tccaactgcaactc

SEQ ID NO: 5792053 - DNA, 17 bp, Homo sapiens
tccaactggaaattcca

SEQ ID NO: 5792054 - DNA, 23 bp, Homo sapiens
tccaactggccctatttagatga

SEQ ID NO: 5792055 - DNA, 18 bp, Homo sapiens
tccaactgtgttcattag

SEQ ID NO: 5792056 - DNA, 19 bp, Homo sapiens
tccaactgtgttcattaga

SEQ ID NO: 5792057 - DNA, 18 bp, Homo sapiens
tccaacttatgtttttaa

SEQ ID NO: 5792058 - DNA, 20 bp, Homo sapiens
tccaacttatgtttttaaat

SEQ ID NO: 5792059 - DNA, 14 bp, Homo sapiens
tccaacttcctgtg

SEQ ID NO: 5792060 - DNA, 17 bp, Homo sapiens
tccaacttcctgtggcc

SEQ ID NO: 5792061 - DNA, 19 bp, Homo sapiens
tccaacttcctgtggcctg

SEQ ID NO: 5792062 - DNA, 20 bp, Homo sapiens
tccaacttcctgtggcctga

SEQ ID NO: 5792063 - DNA, 14 bp, Homo sapiens
tccaacttgaagga

SEQ ID NO: 5792064 - DNA, 18 bp, Homo sapiens
tccaacttgatgtcaagc

SEQ ID NO: 5792065 - DNA, 16 bp, Homo sapiens
tccaacttgtctggga

SEQ ID NO: 5792066 - DNA, 15 bp, Homo sapiens
tccaacttttcatcc

SEQ ID NO: 5792067 - DNA, 11 bp, Homo sapiens
tccaagaaaat

SEQ ID NO: 5792068 - DNA, 17 bp, Homo sapiens
tccaagaaactgaatga

SEQ ID NO: 5792069 - DNA, 17 bp, Homo sapiens
tccaagaaagatccacc

SEQ ID NO: 5792070 - DNA, 16 bp, Homo sapiens
tccaagaaagatgaat

SEQ ID NO: 5792071 - DNA, 20 bp, Homo sapiens
tccaagaaagccaacaacca

SEQ ID NO: 5792072 - DNA, 18 bp, Homo sapiens
tccaagaactctaaccag

SEQ ID NO: 5792073 - DNA, 21 bp, Homo sapiens
tccaagaactctaaccagtgt

SEQ ID NO: 5792074 - DNA, 14 bp, Homo sapiens
tccaagaagcccag

SEQ ID NO: 5792075 - DNA, 14 bp, Homo sapiens
tccaagaagccctc

SEQ ID NO: 5792076 - DNA, 18 bp, Homo sapiens
tccaagaatagcatctgt

SEQ ID NO: 5792077 - DNA, 23 bp, Homo sapiens
tccaagaatccacatttctaaaa

SEQ ID NO: 5792078 - DNA, 19 bp, Homo sapiens
tccaagaatctatctgctt

SEQ ID NO: 5792079 - DNA, 15 bp, Homo sapiens
tccaagaatgctgaa

SEQ ID NO: 5792080 - DNA, 14 bp, Homo sapiens
tccaagaatgtttt

SEQ ID NO: 5792081 - DNA, 16 bp, Homo sapiens
tccaagacaaactaaa

SEQ ID NO: 5792082 - DNA, 17 bp, Homo sapiens
tccaagacaaactaaac

SEQ ID NO: 5792083 - DNA, 20 bp, Homo sapiens
tccaagacaaactaaacttt

SEQ ID NO: 5792084 - DNA, 15 bp, Homo sapiens
tccaagacagcagca

SEQ ID NO: 5792085 - DNA, 21 bp, Homo sapiens
tccaagacagcagcagcctgc

SEQ ID NO: 5792086 - DNA, 23 bp, Homo sapiens
tccaagacagcagcagcctgcac

SEQ ID NO: 5792087 - DNA, 19 bp, Homo sapiens
tccaagacagggctcattt

SEQ ID NO: 5792088 - DNA, 15 bp, Homo sapiens
tccaagacattgtca

SEQ ID NO: 5792089 - DNA, 16 bp, Homo sapiens
tccaagacattgtcaa

SEQ ID NO: 5792090 - DNA, 16 bp, Homo sapiens
tccaagacctggtgtg

SEQ ID NO: 5792091 - DNA, 19 bp, Homo sapiens
tccaagacctgttggttcc

SEQ ID NO: 5792092 - DNA, 13 bp, Homo sapiens
tccaagactctag

SEQ ID NO: 5792093 - DNA, 20 bp, Homo sapiens
tccaagactctagagtccaa

SEQ ID NO: 5792094 - DNA, 11 bp, Homo sapiens
tccaagactga

SEQ ID NO: 5792095 - DNA, 18 bp, Homo sapiens
tccaagagaactaaagct

SEQ ID NO: 5792096 - DNA, 22 bp, Homo sapiens
tccaagagaaggtggacctggc

SEQ ID NO: 5792097 - DNA, 23 bp, Homo sapiens
tccaagagaaggtggacctggca

SEQ ID NO: 5792098 - DNA, 22 bp, Homo sapiens
tccaagagacatggaagagaga

SEQ ID NO: 5792099 - DNA, 13 bp, Homo sapiens
tccaagagcctga

SEQ ID NO: 5792100 - DNA, 23 bp, Homo sapiens
tccaagaggggccgctgacttct

SEQ ID NO: 5792101 - DNA, 16 bp, Homo sapiens
tccaagagtctgatga

SEQ ID NO: 5792102 - DNA, 19 bp, Homo sapiens
tccaagatcaattccctct

SEQ ID NO: 5792103 - DNA, 20 bp, Homo sapiens
tccaagatcaattccctctc

SEQ ID NO: 5792104 - DNA, 23 bp, Homo sapiens
tccaagatcaattccctctctca

SEQ ID NO: 5792105 - DNA, 14 bp, Homo sapiens
tccaagatgtccca

SEQ ID NO: 5792106 - DNA, 16 bp, Homo sapiens
tccaagattaaaagtt

SEQ ID NO: 5792107 - DNA, 20 bp, Homo sapiens
tccaagattctagatgatta

SEQ ID NO: 5792108 - DNA, 11 bp, Homo sapiens
tccaagcaaag

SEQ ID NO: 5792109 - DNA, 15 bp, Homo sapiens
tccaagcaaatgtga

SEQ ID NO: 5792110 - DNA, 17 bp, Homo sapiens
tccaagcaaatgtgaat

SEQ ID NO: 5792111 - DNA, 19 bp, Homo sapiens
tccaagcaaatgttacata

SEQ ID NO: 5792112 - DNA, 17 bp, Homo sapiens
tccaagcaacagccttt

SEQ ID NO: 5792113 - DNA, 18 bp, Homo sapiens
tccaagcaacagcctttg

SEQ ID NO: 5792114 - DNA, 21 bp, Homo sapiens
tccaagcaacagcctttgaat

SEQ ID NO: 5792115 - DNA, 23 bp, Homo sapiens
tccaagcaagtagctttccacat

SEQ ID NO: 5792116 - DNA, 17 bp, Homo sapiens
tccaagcacagagcctg

SEQ ID NO: 5792117 - DNA, 18 bp, Homo sapiens
tccaagcacagagcctgg

SEQ ID NO: 5792118 - DNA, 14 bp, Homo sapiens
tccaagcacatctt

SEQ ID NO: 5792119 - DNA, 20 bp, Homo sapiens
tccaagcactagccttccca

SEQ ID NO: 5792120 - DNA, 21 bp, Homo sapiens
tccaagcagactccagcccct

SEQ ID NO: 5792121 - DNA, 14 bp, Homo sapiens
tccaagcatcagca

SEQ ID NO: 5792122 - DNA, 16 bp, Homo sapiens
tccaagcatcagcaag

SEQ ID NO: 5792123 - DNA, 12 bp, Homo sapiens
tccaagcatttc

SEQ ID NO: 5792124 - DNA, 13 bp, Homo sapiens
tccaagccagagt

SEQ ID NO: 5792125 - DNA, 19 bp, Homo sapiens
tccaagccccatcttctaa

SEQ ID NO: 5792126 - DNA, 15 bp, Homo sapiens
tccaagccccctggc

SEQ ID NO: 5792127 - DNA, 22 bp, Homo sapiens
tccaagccccctggcagctgcc

SEQ ID NO: 5792128 - DNA, 14 bp, Homo sapiens
tccaagccctcagc

SEQ ID NO: 5792129 - DNA, 12 bp, Homo sapiens
tccaagccctgg

SEQ ID NO: 5792130 - DNA, 16 bp, Homo sapiens
tccaagccctggggca

SEQ ID NO: 5792131 - DNA, 21 bp, Homo sapiens
tccaagccgtaggacccagtt

SEQ ID NO: 5792132 - DNA, 17 bp, Homo sapiens
tccaagcctaaaattaa

SEQ ID NO: 5792133 - DNA, 16 bp, Homo sapiens
tccaagcctctgtctt

SEQ ID NO: 5792134 - DNA, 19 bp, Homo sapiens
tccaagcctgcctcccaag

SEQ ID NO: 5792135 - DNA, 14 bp, Homo sapiens
tccaagcctggcac

SEQ ID NO: 5792136 - DNA, 19 bp, Homo sapiens
tccaagcctggcacccacc

SEQ ID NO: 5792137 - DNA, 16 bp, Homo sapiens
tccaagcctgggccac

SEQ ID NO: 5792138 - DNA, 20 bp, Homo sapiens
tccaagcctgggccactggc

SEQ ID NO: 5792139 - DNA, 14 bp, Homo sapiens
tccaagcgcctggc

SEQ ID NO: 5792140 - DNA, 18 bp, Homo sapiens
tccaagcggccctgtgtg

SEQ ID NO: 5792141 - DNA, 22 bp, Homo sapiens
tccaagctaagcactgccactg

SEQ ID NO: 5792142 - DNA, 15 bp, Homo sapiens
tccaagctccctgcc

SEQ ID NO: 5792143 - DNA, 14 bp, Homo sapiens
tccaagctccttat

SEQ ID NO: 5792144 - DNA, 19 bp, Homo sapiens
tccaagctgatgtttgtac

SEQ ID NO: 5792145 - DNA, 21 bp, Homo sapiens
tccaagctggtcccactcagt

SEQ ID NO: 5792146 - DNA, 14 bp, Homo sapiens
tccaagctgttaaa

SEQ ID NO: 5792147 - DNA, 18 bp, Homo sapiens
tccaagctgttagttgct

SEQ ID NO: 5792148 - DNA, 12 bp, Homo sapiens
tccaagcttttg

SEQ ID NO: 5792149 - DNA, 15 bp, Homo sapiens
tccaaggaaaattga

SEQ ID NO: 5792150 - DNA, 19 bp, Homo sapiens
tccaaggaaaattgaaagt

SEQ ID NO: 5792151 - DNA, 15 bp, Homo sapiens
tccaaggaaacatgc

SEQ ID NO: 5792152 - DNA, 23 bp, Homo sapiens
tccaaggaaatccccgggaagag

SEQ ID NO: 5792153 - DNA, 21 bp, Homo sapiens
tccaaggaacctaattgaaat

SEQ ID NO: 5792154 - DNA, 22 bp, Homo sapiens
tccaaggaacctaattgaaatt

SEQ ID NO: 5792155 - DNA, 23 bp, Homo sapiens
tccaaggaagggatgtatttgta

SEQ ID NO: 5792156 - DNA, 16 bp, Homo sapiens
tccaaggacaccctcc

SEQ ID NO: 5792157 - DNA, 17 bp, Homo sapiens
tccaaggacaccctccc

SEQ ID NO: 5792158 - DNA, 22 bp, Homo sapiens
tccaaggagaaacagagacagg

SEQ ID NO: 5792159 - DNA, 21 bp, Homo sapiens
tccaaggagttccatgaagac

SEQ ID NO: 5792160 - DNA, 20 bp, Homo sapiens
tccaaggcagttctgtgtcc

SEQ ID NO: 5792161 - DNA, 22 bp, Homo sapiens
tccaaggccagaaggaggggga

SEQ ID NO: 5792162 - DNA, 19 bp, Homo sapiens
tccaaggccgcggcccaga

SEQ ID NO: 5792163 - DNA, 21 bp, Homo sapiens
tccaaggctgtcttctcccag

SEQ ID NO: 5792164 - DNA, 22 bp, Homo sapiens
tccaaggctgtcttctcccaga

SEQ ID NO: 5792165 - DNA, 16 bp, Homo sapiens
tccaagggacagccca

SEQ ID NO: 5792166 - DNA, 20 bp, Homo sapiens
tccaagggacagcccacggt

SEQ ID NO: 5792167 - DNA, 13 bp, Homo sapiens
tccaagggacagg

SEQ ID NO: 5792168 - DNA, 21 bp, Homo sapiens
tccaagggacaggtgggcctg

SEQ ID NO: 5792169 - DNA, 19 bp, Homo sapiens
tccaagggaccctttgcct

SEQ ID NO: 5792170 - DNA, 16 bp, Homo sapiens
tccaagggcccagagg

SEQ ID NO: 5792171 - DNA, 19 bp, Homo sapiens
tccaagggccgtgcccttg

SEQ ID NO: 5792172 - DNA, 16 bp, Homo sapiens
tccaagggcttctgca

SEQ ID NO: 5792173 - DNA, 23 bp, Homo sapiens
tccaagggcttctgcaccctcca

SEQ ID NO: 5792174 - DNA, 14 bp, Homo sapiens
tccaaggggcaaat

SEQ ID NO: 5792175 - DNA, 18 bp, Homo sapiens
tccaagggtactaaggaa

SEQ ID NO: 5792176 - DNA, 20 bp, Homo sapiens
tccaagggtatgggaagcca

SEQ ID NO: 5792177 - DNA, 18 bp, Homo sapiens
tccaagggttgagagcca

SEQ ID NO: 5792178 - DNA, 21 bp, Homo sapiens
tccaagggttgagagccagtg

SEQ ID NO: 5792179 - DNA, 19 bp, Homo sapiens
tccaagggtttcgactggt

SEQ ID NO: 5792180 - DNA, 15 bp, Homo sapiens
tccaaggtcaaggca

SEQ ID NO: 5792181 - DNA, 23 bp, Homo sapiens
tccaaggtcccattttccccctg

SEQ ID NO: 5792182 - DNA, 18 bp, Homo sapiens
tccaaggtggcagatgtc

SEQ ID NO: 5792183 - DNA, 14 bp, Homo sapiens
tccaaggtgtttct

SEQ ID NO: 5792184 - DNA, 15 bp, Homo sapiens
tccaaggttcccttg

SEQ ID NO: 5792185 - DNA, 16 bp, Homo sapiens
tccaaggttcccttgt

SEQ ID NO: 5792186 - DNA, 22 bp, Homo sapiens
tccaaggtttaaagagtctaga

SEQ ID NO: 5792187 - DNA, 15 bp, Homo sapiens
tccaaggtttataaa

SEQ ID NO: 5792188 - DNA, 18 bp, Homo sapiens
tccaaggtttataaagca

SEQ ID NO: 5792189 - DNA, 14 bp, Homo sapiens
tccaagtaccaatg

SEQ ID NO: 5792190 - DNA, 17 bp, Homo sapiens
tccaagtaccaatgctg

SEQ ID NO: 5792191 - DNA, 19 bp, Homo sapiens
tccaagtaccaatgctgtt

SEQ ID NO: 5792192 - DNA, 17 bp, Homo sapiens
tccaagtattttatctg

SEQ ID NO: 5792193 - DNA, 21 bp, Homo sapiens
tccaagtattttatctgtgtt

SEQ ID NO: 5792194 - DNA, 17 bp, Homo sapiens
tccaagtcacaaagaga

SEQ ID NO: 5792195 - DNA, 23 bp, Homo sapiens
tccaagtcactgcaaaaccaggt

SEQ ID NO: 5792196 - DNA, 16 bp, Homo sapiens
tccaagtccaacctgc

SEQ ID NO: 5792197 - DNA, 15 bp, Homo sapiens
tccaagtctgtacct

SEQ ID NO: 5792198 - DNA, 18 bp, Homo sapiens
tccaagtctgtacctcaa

SEQ ID NO: 5792199 - DNA, 22 bp, Homo sapiens
tccaagtcttcagcgagaccct

SEQ ID NO: 5792200 - DNA, 19 bp, Homo sapiens
tccaagtctttgctattgt

SEQ ID NO: 5792201 - DNA, 21 bp, Homo sapiens
tccaagtctttgctattgtga

SEQ ID NO: 5792202 - DNA, 20 bp, Homo sapiens
tccaagtgaacactagccag

SEQ ID NO: 5792203 - DNA, 18 bp, Homo sapiens
tccaagtggacggcagac

SEQ ID NO: 5792204 - DNA, 19 bp, Homo sapiens
tccaagtggcagtttttaa

SEQ ID NO: 5792205 - DNA, 22 bp, Homo sapiens
tccaagtggtgggaatcagatc

SEQ ID NO: 5792206 - DNA, 13 bp, Homo sapiens
tccaagtgtataa

SEQ ID NO: 5792207 - DNA, 13 bp, Homo sapiens
tccaagtgtattt

SEQ ID NO: 5792208 - DNA, 16 bp, Homo sapiens
tccaagtgtattttaa

SEQ ID NO: 5792209 - DNA, 18 bp, Homo sapiens
tccaagtgtattttaaaa

SEQ ID NO: 5792210 - DNA, 15 bp, Homo sapiens
tccaagtgtgcatat

SEQ ID NO: 5792211 - DNA, 20 bp, Homo sapiens
tccaagtgtgcatattgtac

SEQ ID NO: 5792212 - DNA, 17 bp, Homo sapiens
tccaagtgtgtgtgcaa

SEQ ID NO: 5792213 - DNA, 13 bp, Homo sapiens
tccaagtgtttct

SEQ ID NO: 5792214 - DNA, 14 bp, Homo sapiens
tccaagttaaatgt

SEQ ID NO: 5792215 - DNA, 15 bp, Homo sapiens
tccaagttaaatgta

SEQ ID NO: 5792216 - DNA, 20 bp, Homo sapiens
tccaagttccccatccctgt

SEQ ID NO: 5792217 - DNA, 22 bp, Homo sapiens
tccactagtattttttttgctt

SEQ ID NO: 5792218 - DNA, 15 bp, Homo sapiens
tccactagtgcaaat

SEQ ID NO: 5792219 - DNA, 18 bp, Homo sapiens
tccactagtgcaaatcat

SEQ ID NO: 5792220 - DNA, 13 bp, Homo sapiens
tccactattttca

SEQ ID NO: 5792221 - DNA, 18 bp, Homo sapiens
tccactcaaaatatgtca

SEQ ID NO: 5792222 - DNA, 15 bp, Homo sapiens
tccactcaaatgtcc

SEQ ID NO: 5792223 - DNA, 20 bp, Homo sapiens
tccactcaatatgtgatttt

SEQ ID NO: 5792224 - DNA, 23 bp, Homo sapiens
tccactcaccacaagctgagcag

SEQ ID NO: 5792225 - DNA, 12 bp, Homo sapiens
tccactcactcc

SEQ ID NO: 5792226 - DNA, 13 bp, Homo sapiens
tccactcactcca

SEQ ID NO: 5792227 - DNA, 18 bp, Homo sapiens
tccactcagcactctgga

SEQ ID NO: 5792228 - DNA, 21 bp, Homo sapiens
tccactcagctgtcctgcagc

SEQ ID NO: 5792229 - DNA, 22 bp, Homo sapiens
tccactcagcttggttcctgcc

SEQ ID NO: 5792230 - DNA, 12 bp, Homo sapiens
tccactcagggc

SEQ ID NO: 5792231 - DNA, 19 bp, Homo sapiens
tccactcagggcttctcct

SEQ ID NO: 5792232 - DNA, 21 bp, Homo sapiens
tccactccatgtttgcaatgc

SEQ ID NO: 5792233 - DNA, 13 bp, Homo sapiens
tccactcccactt

SEQ ID NO: 5792234 - DNA, 14 bp, Homo sapiens
tccactcccaggat

SEQ ID NO: 5792235 - DNA, 14 bp, Homo sapiens
tccactcccaggca

SEQ ID NO: 5792236 - DNA, 19 bp, Homo sapiens
tccactcccccacctgaca

SEQ ID NO: 5792237 - DNA, 15 bp, Homo sapiens
tccactcccctcatc

SEQ ID NO: 5792238 - DNA, 15 bp, Homo sapiens
tccactccctgctcc

SEQ ID NO: 5792239 - DNA, 15 bp, Homo sapiens
tccactcctcctagc

SEQ ID NO: 5792240 - DNA, 22 bp, Homo sapiens
tccactccttccatctcttcct

SEQ ID NO: 5792241 - DNA, 23 bp, Homo sapiens
tccactccttccatctcttcctt

SEQ ID NO: 5792242 - DNA, 17 bp, Homo sapiens
tccactcgacccagaat

SEQ ID NO: 5792243 - DNA, 19 bp, Homo sapiens
tccactcgtccaagggaca

SEQ ID NO: 5792244 - DNA, 14 bp, Homo sapiens
tccactcgtgtgtt

SEQ ID NO: 5792245 - DNA, 14 bp, Homo sapiens
tccactctagttct

SEQ ID NO: 5792246 - DNA, 17 bp, Homo sapiens
tccactctagttctaga

SEQ ID NO: 5792247 - DNA, 13 bp, Homo sapiens
tccactctccccc

SEQ ID NO: 5792248 - DNA, 18 bp, Homo sapiens
tccactctcccccacccc

SEQ ID NO: 5792249 - DNA, 22 bp, Homo sapiens
tccactctctcttgttcttact

SEQ ID NO: 5792250 - DNA, 12 bp, Homo sapiens
tccactctgagg

SEQ ID NO: 5792251 - DNA, 13 bp, Homo sapiens
tccactctgaggt

SEQ ID NO: 5792252 - DNA, 16 bp, Homo sapiens
tccactctgaggtctc

SEQ ID NO: 5792253 - DNA, 21 bp, Homo sapiens
tccactctgaggtctcacctt

SEQ ID NO: 5792254 - DNA, 22 bp, Homo sapiens
tccactctgaggtctcaccttc

SEQ ID NO: 5792255 - DNA, 12 bp, Homo sapiens
tccactctgatt

SEQ ID NO: 5792256 - DNA, 14 bp, Homo sapiens
tccactctgattca

SEQ ID NO: 5792257 - DNA, 20 bp, Homo sapiens
tccactctgcttctctgact

SEQ ID NO: 5792258 - DNA, 19 bp, Homo sapiens
tccactctggattcagcct

SEQ ID NO: 5792259 - DNA, 16 bp, Homo sapiens
tccactcttctctcct

SEQ ID NO: 5792260 - DNA, 20 bp, Homo sapiens
tccactcttctctcctttct

SEQ ID NO: 5792261 - DNA, 21 bp, Homo sapiens
tccactcttctctcctttctc

SEQ ID NO: 5792262 - DNA, 20 bp, Homo sapiens
tccactcttgatctctcttg

SEQ ID NO: 5792263 - DNA, 16 bp, Homo sapiens
tccactctttctttca

SEQ ID NO: 5792264 - DNA, 14 bp, Homo sapiens
tccactgaaaattt

SEQ ID NO: 5792265 - DNA, 17 bp, Homo sapiens
tccactgaaacctctgt

SEQ ID NO: 5792266 - DNA, 18 bp, Homo sapiens
tccactgaaacctctgtt

SEQ ID NO: 5792267 - DNA, 19 bp, Homo sapiens
tccactgaaacctctgttc

SEQ ID NO: 5792268 - DNA, 21 bp, Homo sapiens
tccactgaaatagagtgaatt

SEQ ID NO: 5792269 - DNA, 22 bp, Homo sapiens
tccactgacaaacgtccccagc

SEQ ID NO: 5792270 - DNA, 12 bp, Homo sapiens
tccactgacctg

SEQ ID NO: 5792271 - DNA, 21 bp, Homo sapiens
tccactgagactttcccctct

SEQ ID NO: 5792272 - DNA, 11 bp, Homo sapiens
tccactgagca

SEQ ID NO: 5792273 - DNA, 15 bp, Homo sapiens
tccactgagggcagt

SEQ ID NO: 5792274 - DNA, 23 bp, Homo sapiens
tccactgaggtgggagcatctcc

SEQ ID NO: 5792275 - DNA, 18 bp, Homo sapiens
tccactgcaagagggggg

SEQ ID NO: 5792276 - DNA, 16 bp, Homo sapiens
tccactgccaaaacaa

SEQ ID NO: 5792277 - DNA, 15 bp, Homo sapiens
tccactgccctctgt

SEQ ID NO: 5792278 - DNA, 15 bp, Homo sapiens
tccactgccctggca

SEQ ID NO: 5792279 - DNA, 20 bp, Homo sapiens
tccactgccctggcagcagc

SEQ ID NO: 5792280 - DNA, 21 bp, Homo sapiens
tccactgccctggcagcagca

SEQ ID NO: 5792281 - DNA, 12 bp, Homo sapiens
tccactgcctcc

SEQ ID NO: 5792282 - DNA, 13 bp, Homo sapiens
tccactgcctcca

SEQ ID NO: 5792283 - DNA, 13 bp, Homo sapiens
tccactgcctctg

SEQ ID NO: 5792284 - DNA, 17 bp, Homo sapiens
tccactgcctctgcctt

SEQ ID NO: 5792285 - DNA, 15 bp, Homo sapiens
tccactgcgcttact

SEQ ID NO: 5792286 - DNA, 20 bp, Homo sapiens
tccactgctactgacccaga

SEQ ID NO: 5792287 - DNA, 14 bp, Homo sapiens
tccactgctctcag

SEQ ID NO: 5792288 - DNA, 12 bp, Homo sapiens
tccactggaaac

SEQ ID NO: 5792289 - DNA, 22 bp, Homo sapiens
tccactggaacgtttcactgca

SEQ ID NO: 5792290 - DNA, 15 bp, Homo sapiens
tccactggacactgt

SEQ ID NO: 5792291 - DNA, 14 bp, Homo sapiens
tccactggacagac

SEQ ID NO: 5792292 - DNA, 16 bp, Homo sapiens
tccactggacagaccc

SEQ ID NO: 5792293 - DNA, 18 bp, Homo sapiens
tccactggacagacccag

SEQ ID NO: 5792294 - DNA, 24 bp, Homo sapiens
tccactggacagacccaggtcttc

SEQ ID NO: 5792295 - DNA, 21 bp, Homo sapiens
tccactggacccttgattcat

SEQ ID NO: 5792296 - DNA, 17 bp, Homo sapiens
tccactggacttgagct

SEQ ID NO: 5792297 - DNA, 12 bp, Homo sapiens
tccactggagaa

SEQ ID NO: 5792298 - DNA, 14 bp, Homo sapiens
tccactggcctgcc

SEQ ID NO: 5792299 - DNA, 21 bp, Homo sapiens
tccactggcttttgcctgtaa

SEQ ID NO: 5792300 - DNA, 23 bp, Homo sapiens
tccactggggaatgctcccagct

SEQ ID NO: 5792301 - DNA, 18 bp, Homo sapiens
tccactggggattgggcc

SEQ ID NO: 5792302 - DNA, 17 bp, Homo sapiens
tccactggggtggcctg

SEQ ID NO: 5792303 - DNA, 17 bp, Homo sapiens
tccactgggtgtaaaca

SEQ ID NO: 5792304 - DNA, 17 bp, Homo sapiens
tccactgtaattaaaac

SEQ ID NO: 5792305 - DNA, 22 bp, Homo sapiens
tccactgtaattaaaactattt

SEQ ID NO: 5792306 - DNA, 12 bp, Homo sapiens
tccactgtagct

SEQ ID NO: 5792307 - DNA, 13 bp, Homo sapiens
tccactgtagcta

SEQ ID NO: 5792308 - DNA, 19 bp, Homo sapiens
tccactgtatattttttaa

SEQ ID NO: 5792309 - DNA, 19 bp, Homo sapiens
tccactgtcactgtttctc

SEQ ID NO: 5792310 - DNA, 22 bp, Homo sapiens
tccactgtcactgtttctctgc

SEQ ID NO: 5792311 - DNA, 17 bp, Homo sapiens
tccactgtcagccctca

SEQ ID NO: 5792312 - DNA, 18 bp, Homo sapiens
tccactgtcctccttggc

SEQ ID NO: 5792313 - DNA, 12 bp, Homo sapiens
tccactgtgcag

SEQ ID NO: 5792314 - DNA, 19 bp, Homo sapiens
tccactgtgcaggttccca

SEQ ID NO: 5792315 - DNA, 13 bp, Homo sapiens
tccactgtggcaa

SEQ ID NO: 5792316 - DNA, 20 bp, Homo sapiens
tccactgtgtatagaagtag

SEQ ID NO: 5792317 - DNA, 17 bp, Homo sapiens
tccactgtgtgttgaca

SEQ ID NO: 5792318 - DNA, 20 bp, Homo sapiens
tccactgtgtgttgacactg

SEQ ID NO: 5792319 - DNA, 23 bp, Homo sapiens
tccactgttctcctgaatatttt

SEQ ID NO: 5792320 - DNA, 22 bp, Homo sapiens
tccactgtttattcaacaacta

SEQ ID NO: 5792321 - DNA, 13 bp, Homo sapiens
tccactgtttcat

SEQ ID NO: 5792322 - DNA, 13 bp, Homo sapiens
tccacttaagttc

SEQ ID NO: 5792323 - DNA, 19 bp, Homo sapiens
tccacttactataatggtt

SEQ ID NO: 5792324 - DNA, 22 bp, Homo sapiens
tccacttatgtagacaaaactt

SEQ ID NO: 5792325 - DNA, 14 bp, Homo sapiens
tccacttcaatgca

SEQ ID NO: 5792326 - DNA, 17 bp, Homo sapiens
tccacttcattttgtat

SEQ ID NO: 5792327 - DNA, 16 bp, Homo sapiens
tccacttccagagggg

SEQ ID NO: 5792328 - DNA, 18 bp, Homo sapiens
tccacttccaggtctgcc

SEQ ID NO: 5792329 - DNA, 18 bp, Homo sapiens
tccacttctggtcccctg

SEQ ID NO: 5792330 - DNA, 20 bp, Homo sapiens
tccacttcttcctttctctt

SEQ ID NO: 5792331 - DNA, 13 bp, Homo sapiens
tccacttgccctg

SEQ ID NO: 5792332 - DNA, 18 bp, Homo sapiens
tccacttgccctgttctc

SEQ ID NO: 5792333 - DNA, 22 bp, Homo sapiens
tccacttgccctgttctcttca

SEQ ID NO: 5792334 - DNA, 15 bp, Homo sapiens
tccacttgcttaagt

SEQ ID NO: 5792335 - DNA, 13 bp, Homo sapiens
tccacttggtctg

SEQ ID NO: 5792336 - DNA, 15 bp, Homo sapiens
tccacttggtctgtg

SEQ ID NO: 5792337 - DNA, 23 bp, Homo sapiens
tccacttggtctgtgagatgcta

SEQ ID NO: 5792338 - DNA, 12 bp, Homo sapiens
tccacttgtaag

SEQ ID NO: 5792339 - DNA, 14 bp, Homo sapiens
tccacttgtgggct

SEQ ID NO: 5792340 - DNA, 17 bp, Homo sapiens
tccacttgtgggcttca

SEQ ID NO: 5792341 - DNA, 15 bp, Homo sapiens
tccacttgtgggtcc

SEQ ID NO: 5792342 - DNA, 16 bp, Homo sapiens
tccacttgtgggtcct

SEQ ID NO: 5792343 - DNA, 17 bp, Homo sapiens
tccacttgttcattctg

SEQ ID NO: 5792344 - DNA, 17 bp, Homo sapiens
tccacttgtttgcactg

SEQ ID NO: 5792345 - DNA, 20 bp, Homo sapiens
tccacttgtttgcactgtgt

SEQ ID NO: 5792346 - DNA, 12 bp, Homo sapiens
tccactttcagc

SEQ ID NO: 5792347 - DNA, 13 bp, Homo sapiens
tccactttcagct

SEQ ID NO: 5792348 - DNA, 17 bp, Homo sapiens
tccactttcagctgtct

SEQ ID NO: 5792349 - DNA, 18 bp, Homo sapiens
tccactttcagctgtctt

SEQ ID NO: 5792350 - DNA, 23 bp, Homo sapiens
tccactttcaggagggaaaaccc

SEQ ID NO: 5792351 - DNA, 14 bp, Homo sapiens
tccactttcatctg

SEQ ID NO: 5792352 - DNA, 17 bp, Homo sapiens
tccactttcccttcccc

SEQ ID NO: 5792353 - DNA, 14 bp, Homo sapiens
tccactttcctctc

SEQ ID NO: 5792354 - DNA, 22 bp, Homo sapiens
tccactttgctggttcagcctt

SEQ ID NO: 5792355 - DNA, 22 bp, Homo sapiens
tccactttgtataaatttttaa

SEQ ID NO: 5792356 - DNA, 22 bp, Homo sapiens
tccactttgttggcccttccag

SEQ ID NO: 5792357 - DNA, 15 bp, Homo sapiens
tccactttgtttcgt

SEQ ID NO: 5792358 - DNA, 19 bp, Homo sapiens
tccactttgtttcgtgggg

SEQ ID NO: 5792359 - DNA, 15 bp, Homo sapiens
tccacttttaaaact

SEQ ID NO: 5792360 - DNA, 18 bp, Homo sapiens
tccacttttccagtattt

SEQ ID NO: 5792361 - DNA, 15 bp, Homo sapiens
tccacttttcttctt

SEQ ID NO: 5792362 - DNA, 18 bp, Homo sapiens
tccacttttcttcttcct

SEQ ID NO: 5792363 - DNA, 24 bp, Homo sapiens
tccactttttaactcgtttgctga

SEQ ID NO: 5792364 - DNA, 19 bp, Homo sapiens
tccactttttccagaattt

SEQ ID NO: 5792365 - DNA, 14 bp, Homo sapiens
tccactttttgtta

SEQ ID NO: 5792366 - DNA, 15 bp, Homo sapiens
tccagaaaaatcaat

SEQ ID NO: 5792367 - DNA, 16 bp, Homo sapiens
tccagaaaaatcaatc

SEQ ID NO: 5792368 - DNA, 18 bp, Homo sapiens
tccagaaaaatcaatcat

SEQ ID NO: 5792369 - DNA, 18 bp, Homo sapiens
tccagaaaacctctcctg

SEQ ID NO: 5792370 - DNA, 23 bp, Homo sapiens
tccagaaaacctctcctgacccc

SEQ ID NO: 5792371 - DNA, 14 bp, Homo sapiens
tccagaaaactgtg

SEQ ID NO: 5792372 - DNA, 13 bp, Homo sapiens
tccagaaaatata

SEQ ID NO: 5792373 - DNA, 17 bp, Homo sapiens
tccagaaaatataaatg

SEQ ID NO: 5792374 - DNA, 19 bp, Homo sapiens
tccagaaaatataaatgca

SEQ ID NO: 5792375 - DNA, 13 bp, Homo sapiens
tccagaaacaaaa

SEQ ID NO: 5792376 - DNA, 17 bp, Homo sapiens
tccagaaacacccacag

SEQ ID NO: 5792377 - DNA, 11 bp, Homo sapiens
tccagaaagaa

SEQ ID NO: 5792378 - DNA, 23 bp, Homo sapiens
tccagaaagaaggacacttgtat

SEQ ID NO: 5792379 - DNA, 21 bp, Homo sapiens
tccagaaagcaggagcagctg

SEQ ID NO: 5792380 - DNA, 16 bp, Homo sapiens
tccagaaagccccacc

SEQ ID NO: 5792381 - DNA, 15 bp, Homo sapiens
tccagaaagctgagg

SEQ ID NO: 5792382 - DNA, 19 bp, Homo sapiens
tccagaaagctgaggaaca

SEQ ID NO: 5792383 - DNA, 23 bp, Homo sapiens
tccagaaagctgaggaacaggtt

SEQ ID NO: 5792384 - DNA, 17 bp, Homo sapiens
tccagaaaggatattta

SEQ ID NO: 5792385 - DNA, 14 bp, Homo sapiens
tccagaaataaaac

SEQ ID NO: 5792386 - DNA, 16 bp, Homo sapiens
tccagaaatacctgtc

SEQ ID NO: 5792387 - DNA, 18 bp, Homo sapiens
tccagaaatacctgtcta

SEQ ID NO: 5792388 - DNA, 16 bp, Homo sapiens
tccagaaattcttcaa

SEQ ID NO: 5792389 - DNA, 14 bp, Homo sapiens
tccagaaatttacc

SEQ ID NO: 5792390 - DNA, 16 bp, Homo sapiens
tccagaacaaaagata

SEQ ID NO: 5792391 - DNA, 20 bp, Homo sapiens
tccagaacaaacctctatat

SEQ ID NO: 5792392 - DNA, 13 bp, Homo sapiens
tccagaacactct

SEQ ID NO: 5792393 - DNA, 17 bp, Homo sapiens
tccagaacctaggagga

SEQ ID NO: 5792394 - DNA, 19 bp, Homo sapiens
tccagaacgccctgtgtcc

SEQ ID NO: 5792395 - DNA, 19 bp, Homo sapiens
tccagaactaccaaaatga

SEQ ID NO: 5792396 - DNA, 20 bp, Homo sapiens
tccagcctgggcaacagagc

SEQ ID NO: 5792397 - DNA, 22 bp, Homo sapiens
tccagcctgggcagccaggctg

SEQ ID NO: 5792398 - DNA, 13 bp, Homo sapiens
tccagcctgggcg

SEQ ID NO: 5792399 - DNA, 21 bp, Homo sapiens
tccagcctgggcgacaaaaac

SEQ ID NO: 5792400 - DNA, 20 bp, Homo sapiens
tccagcctgggcgacagagc

SEQ ID NO: 5792401 - DNA, 21 bp, Homo sapiens
tccagcctgggcgacagagca

SEQ ID NO: 5792402 - DNA, 19 bp, Homo sapiens
tccagcctggggctgaggc

SEQ ID NO: 5792403 - DNA, 14 bp, Homo sapiens
tccagcctgggtga

SEQ ID NO: 5792404 - DNA, 17 bp, Homo sapiens
tccagcctgtcggccac

SEQ ID NO: 5792405 - DNA, 14 bp, Homo sapiens
tccagcctgtgtgt

SEQ ID NO: 5792406 - DNA, 19 bp, Homo sapiens
tccagccttatgtgttaca

SEQ ID NO: 5792407 - DNA, 21 bp, Homo sapiens
tccagccttctctcaaggaga

SEQ ID NO: 5792408 - DNA, 15 bp, Homo sapiens
tccagcctttccaag

SEQ ID NO: 5792409 - DNA, 24 bp, Homo sapiens
tccagcctttccaagtcactagaa

SEQ ID NO: 5792410 - DNA, 21 bp, Homo sapiens
tccagcctttgctccctcccc

SEQ ID NO: 5792411 - DNA, 23 bp, Homo sapiens
tccagcgaggtgggagaggcctc

SEQ ID NO: 5792412 - DNA, 23 bp, Homo sapiens
tccagcgagtaccccagccactc

SEQ ID NO: 5792413 - DNA, 17 bp, Homo sapiens
tccagcgcctgccctcc

SEQ ID NO: 5792414 - DNA, 20 bp, Homo sapiens
tccagcgggacaccctggtt

SEQ ID NO: 5792415 - DNA, 18 bp, Homo sapiens
tccagcggggcttctggg

SEQ ID NO: 5792416 - DNA, 14 bp, Homo sapiens
tccagcgtcactcc

SEQ ID NO: 5792417 - DNA, 19 bp, Homo sapiens
tccagcgtcactccagtgc

SEQ ID NO: 5792418 - DNA, 12 bp, Homo sapiens
tccagcgtcctc

SEQ ID NO: 5792419 - DNA, 15 bp, Homo sapiens
tccagcgtcctcagc

SEQ ID NO: 5792420 - DNA, 19 bp, Homo sapiens
tccagcgtcctcagcaccc

SEQ ID NO: 5792421 - DNA, 23 bp, Homo sapiens
tccagctaaacaccaacccctga

SEQ ID NO: 5792422 - DNA, 20 bp, Homo sapiens
tccagctacttagctggcca

SEQ ID NO: 5792423 - DNA, 17 bp, Homo sapiens
tccagctagccaactcc

SEQ ID NO: 5792424 - DNA, 17 bp, Homo sapiens
tccagctatacaggaag

SEQ ID NO: 5792425 - DNA, 21 bp, Homo sapiens
tccagctatttttatttgttt

SEQ ID NO: 5792426 - DNA, 15 bp, Homo sapiens
tccagctcaccagcc

SEQ ID NO: 5792427 - DNA, 18 bp, Homo sapiens
tccagctcaccagcccca

SEQ ID NO: 5792428 - DNA, 20 bp, Homo sapiens
tccagctcaccccccacact

SEQ ID NO: 5792429 - DNA, 16 bp, Homo sapiens
tccagctcagaaccca

SEQ ID NO: 5792430 - DNA, 17 bp, Homo sapiens
tccagctcagaacccag

SEQ ID NO: 5792431 - DNA, 18 bp, Homo sapiens
tccagctcagaacccagg

SEQ ID NO: 5792432 - DNA, 21 bp, Homo sapiens
tccagctcagaacccagggct

SEQ ID NO: 5792433 - DNA, 13 bp, Homo sapiens
tccagctcagcag

SEQ ID NO: 5792434 - DNA, 13 bp, Homo sapiens
tccagctcagccc

SEQ ID NO: 5792435 - DNA, 19 bp, Homo sapiens
tccagctcagtcccacagc

SEQ ID NO: 5792436 - DNA, 21 bp, Homo sapiens
tccagctcagtcccacagccc

SEQ ID NO: 5792437 - DNA, 23 bp, Homo sapiens
tccagctcagtcccacagcccct

SEQ ID NO: 5792438 - DNA, 20 bp, Homo sapiens
tccagctcattcattttata

SEQ ID NO: 5792439 - DNA, 10 bp, Homo sapiens
tccagctccc

SEQ ID NO: 5792440 - DNA, 23 bp, Homo sapiens
tccagctcccactccctttccaa

SEQ ID NO: 5792441 - DNA, 22 bp, Homo sapiens
tccagctccccagcccacctgc

SEQ ID NO: 5792442 - DNA, 14 bp, Homo sapiens
tccagctccctccc

SEQ ID NO: 5792443 - DNA, 16 bp, Homo sapiens
tccagctccctcccct

SEQ ID NO: 5792444 - DNA, 18 bp, Homo sapiens
tccagctccctcccctgc

SEQ ID NO: 5792445 - DNA, 20 bp, Homo sapiens
tccagctccgtgtttctcta

SEQ ID NO: 5792446 - DNA, 13 bp, Homo sapiens
tccagctcctctc

SEQ ID NO: 5792447 - DNA, 14 bp, Homo sapiens
tccagctcctctcc

SEQ ID NO: 5792448 - DNA, 18 bp, Homo sapiens
tccagctccttaaactga

SEQ ID NO: 5792449 - DNA, 19 bp, Homo sapiens
tccagctcctttgggcttc

SEQ ID NO: 5792450 - DNA, 14 bp, Homo sapiens
tccagctcgtgtgt

SEQ ID NO: 5792451 - DNA, 22 bp, Homo sapiens
tccagctctaataaaacagctg

SEQ ID NO: 5792452 - DNA, 16 bp, Homo sapiens
tccagctctcccatgg

SEQ ID NO: 5792453 - DNA, 20 bp, Homo sapiens
tccagctctcccatggagcc

SEQ ID NO: 5792454 - DNA, 15 bp, Homo sapiens
tccagctctcccctg

SEQ ID NO: 5792455 - DNA, 18 bp, Homo sapiens
tccagctctgacatccct

SEQ ID NO: 5792456 - DNA, 20 bp, Homo sapiens
tccagctctgacatcccttc

SEQ ID NO: 5792457 - DNA, 14 bp, Homo sapiens
tccagctctggcac

SEQ ID NO: 5792458 - DNA, 15 bp, Homo sapiens
tccagctctggcatg

SEQ ID NO: 5792459 - DNA, 15 bp, Homo sapiens
tccagctcttggccc

SEQ ID NO: 5792460 - DNA, 21 bp, Homo sapiens
tccagctctttcctccttcca

SEQ ID NO: 5792461 - DNA, 12 bp, Homo sapiens
tccagctgacat

SEQ ID NO: 5792462 - DNA, 21 bp, Homo sapiens
tccagctgactaaactttttt

SEQ ID NO: 5792463 - DNA, 14 bp, Homo sapiens
tccagctgaggcag

SEQ ID NO: 5792464 - DNA, 15 bp, Homo sapiens
tccagctgagtcctg

SEQ ID NO: 5792465 - DNA, 16 bp, Homo sapiens
tccagctgcaccagag

SEQ ID NO: 5792466 - DNA, 17 bp, Homo sapiens
tccagctgcaccagagc

SEQ ID NO: 5792467 - DNA, 17 bp, Homo sapiens
tccagctgccaagtgct

SEQ ID NO: 5792468 - DNA, 15 bp, Homo sapiens
tccagctgcccctcc

SEQ ID NO: 5792469 - DNA, 18 bp, Homo sapiens
tccagctgcccctccctc

SEQ ID NO: 5792470 - DNA, 11 bp, Homo sapiens
tccagctgcct

SEQ ID NO: 5792471 - DNA, 12 bp, Homo sapiens
tccagctgcctg

SEQ ID NO: 5792472 - DNA, 15 bp, Homo sapiens
tccagctgcctgggc

SEQ ID NO: 5792473 - DNA, 21 bp, Homo sapiens
tccagctgctgagatcctgga

SEQ ID NO: 5792474 - DNA, 16 bp, Homo sapiens
tccagctgctgctctc

SEQ ID NO: 5792475 - DNA, 21 bp, Homo sapiens
tccagctggaattgctgctct

SEQ ID NO: 5792476 - DNA, 22 bp, Homo sapiens
tccagctggaattgctgctctc

SEQ ID NO: 5792477 - DNA, 15 bp, Homo sapiens
tccagctggccggga

SEQ ID NO: 5792478 - DNA, 22 bp, Homo sapiens
tccagctggccgggagcctgat

SEQ ID NO: 5792479 - DNA, 17 bp, Homo sapiens
tccagctgggaagccct

SEQ ID NO: 5792480 - DNA, 21 bp, Homo sapiens
tccagctgggaagcccttttt

SEQ ID NO: 5792481 - DNA, 23 bp, Homo sapiens
tccagctgggacctaatgctggc

SEQ ID NO: 5792482 - DNA, 14 bp, Homo sapiens
tccagctgggcctc

SEQ ID NO: 5792483 - DNA, 21 bp, Homo sapiens
tccagctgggctagaggctga

SEQ ID NO: 5792484 - DNA, 13 bp, Homo sapiens
tccagctggggcc

SEQ ID NO: 5792485 - DNA, 20 bp, Homo sapiens
tccagctggggccagaggct

SEQ ID NO: 5792486 - DNA, 19 bp, Homo sapiens
tccagctgggttggaaaac

SEQ ID NO: 5792487 - DNA, 17 bp, Homo sapiens
tccagctggtgccccca

SEQ ID NO: 5792488 - DNA, 16 bp, Homo sapiens
tccagctgtcccccca

SEQ ID NO: 5792489 - DNA, 21 bp, Homo sapiens
tccagctgtcgtctgactctg

SEQ ID NO: 5792490 - DNA, 16 bp, Homo sapiens
tccagctgtgcagcac

SEQ ID NO: 5792491 - DNA, 18 bp, Homo sapiens
tccagctgttacctgaga

SEQ ID NO: 5792492 - DNA, 15 bp, Homo sapiens
tccagctgttcttag

SEQ ID NO: 5792493 - DNA, 16 bp, Homo sapiens
tccagcttcaggcacc

SEQ ID NO: 5792494 - DNA, 18 bp, Homo sapiens
tccagcttcaggcaccag

SEQ ID NO: 5792495 - DNA, 20 bp, Homo sapiens
tccagcttcaggcaccagca

SEQ ID NO: 5792496 - DNA, 20 bp, Homo sapiens
tccagcttcccctcgctgtc

SEQ ID NO: 5792497 - DNA, 22 bp, Homo sapiens
tccagcttcccctcgctgtcct

SEQ ID NO: 5792498 - DNA, 20 bp, Homo sapiens
tccagcttcctctgagccgc

SEQ ID NO: 5792499 - DNA, 22 bp, Homo sapiens
tccagcttctcatgttaaatat

SEQ ID NO: 5792500 - DNA, 19 bp, Homo sapiens
tccagcttgctcttcagtg

SEQ ID NO: 5792501 - DNA, 18 bp, Homo sapiens
tccagcttgtggagcccc

SEQ ID NO: 5792502 - DNA, 23 bp, Homo sapiens
tccagcttgtggagccccacact

SEQ ID NO: 5792503 - DNA, 14 bp, Homo sapiens
tccagctttaaggg

SEQ ID NO: 5792504 - DNA, 22 bp, Homo sapiens
tccagctttactgtggctgtct

SEQ ID NO: 5792505 - DNA, 19 bp, Homo sapiens
tccagctttccctccccag

SEQ ID NO: 5792506 - DNA, 13 bp, Homo sapiens
tccagctttcctt

SEQ ID NO: 5792507 - DNA, 21 bp, Homo sapiens
tccagctttccttctgccctt

SEQ ID NO: 5792508 - DNA, 21 bp, Homo sapiens
tccagctttctctttgttctt

SEQ ID NO: 5792509 - DNA, 14 bp, Homo sapiens
tccagctttgggga

SEQ ID NO: 5792510 - DNA, 22 bp, Homo sapiens
tccagctttggggacttccgct

SEQ ID NO: 5792511 - DNA, 21 bp, Homo sapiens
tccagctttgttcttcttaaa

SEQ ID NO: 5792512 - DNA, 17 bp, Homo sapiens
tccagcttttgaacctt

SEQ ID NO: 5792513 - DNA, 14 bp, Homo sapiens
tccagcttttgtag

SEQ ID NO: 5792514 - DNA, 12 bp, Homo sapiens
tccaggaaaaaa

SEQ ID NO: 5792515 - DNA, 23 bp, Homo sapiens
tccaggaaaaaggacaggcagaa

SEQ ID NO: 5792516 - DNA, 21 bp, Homo sapiens
tccaggaaaatgtgaggggaa

SEQ ID NO: 5792517 - DNA, 21 bp, Homo sapiens
tccaggaaactccacatctgc

SEQ ID NO: 5792518 - DNA, 11 bp, Homo sapiens
tccaggaaaga

SEQ ID NO: 5792519 - DNA, 20 bp, Homo sapiens
tccaggaaagagcagtcaga

SEQ ID NO: 5792520 - DNA, 18 bp, Homo sapiens
tccaggaaagatgtccca

SEQ ID NO: 5792521 - DNA, 19 bp, Homo sapiens
tccaggaaagatgtcccac

SEQ ID NO: 5792522 - DNA, 14 bp, Homo sapiens
tccaggaaagtgtg

SEQ ID NO: 5792523 - DNA, 18 bp, Homo sapiens
tccaggaaagtgtgaaga

SEQ ID NO: 5792524 - DNA, 17 bp, Homo sapiens
tccaggaaatgtgcaca

SEQ ID NO: 5792525 - DNA, 19 bp, Homo sapiens
tccaggaacacatgcacac

SEQ ID NO: 5792526 - DNA, 14 bp, Homo sapiens
tccaggaaccaaaa

SEQ ID NO: 5792527 - DNA, 21 bp, Homo sapiens
tccaggaagaaagaatgttac

SEQ ID NO: 5792528 - DNA, 18 bp, Homo sapiens
tccaggaagcccagggca

SEQ ID NO: 5792529 - DNA, 17 bp, Homo sapiens
tccaggaaggcagctgc

SEQ ID NO: 5792530 - DNA, 19 bp, Homo sapiens
tccaggaaggcagctgctc

SEQ ID NO: 5792531 - DNA, 23 bp, Homo sapiens
tccaggaaggcagctgctcttag

SEQ ID NO: 5792532 - DNA, 20 bp, Homo sapiens
tccaggaaggcggggcttca

SEQ ID NO: 5792533 - DNA, 19 bp, Homo sapiens
tccaggaagggagtgaggg

SEQ ID NO: 5792534 - DNA, 17 bp, Homo sapiens
tccaggaaggggctgga

SEQ ID NO: 5792535 - DNA, 22 bp, Homo sapiens
tccaggaaggtagcccagcact

SEQ ID NO: 5792536 - DNA, 23 bp, Homo sapiens
tccaggaaggtagcccagcactg

SEQ ID NO: 5792537 - DNA, 22 bp, Homo sapiens
tccaggaatgctgggcccccag

SEQ ID NO: 5792538 - DNA, 23 bp, Homo sapiens
tccaggaatgctgggcccccagc

SEQ ID NO: 5792539 - DNA, 15 bp, Homo sapiens
tccaggaatggtgct

SEQ ID NO: 5792540 - DNA, 20 bp, Homo sapiens
tccaggaatggtgctttatg

SEQ ID NO: 5792541 - DNA, 20 bp, Homo sapiens
tccaggaattcctcttttgc

SEQ ID NO: 5792542 - DNA, 15 bp, Homo sapiens
tccaggacatgatac

SEQ ID NO: 5792543 - DNA, 14 bp, Homo sapiens
tccaggaccctgcc

SEQ ID NO: 5792544 - DNA, 17 bp, Homo sapiens
tccaggaccctgccagg

SEQ ID NO: 5792545 - DNA, 21 bp, Homo sapiens
tccaggaccctgccaggcaca

SEQ ID NO: 5792546 - DNA, 22 bp, Homo sapiens
tccaggaccctgccaggcacag

SEQ ID NO: 5792547 - DNA, 16 bp, Homo sapiens
tccaggactcagggac

SEQ ID NO: 5792548 - DNA, 13 bp, Homo sapiens
tccaggactccac

SEQ ID NO: 5792549 - DNA, 19 bp, Homo sapiens
tccaggactccactggaca

SEQ ID NO: 5792550 - DNA, 22 bp, Homo sapiens
tccaggactccactggacagac

SEQ ID NO: 5792551 - DNA, 16 bp, Homo sapiens
tccaggactgggtctg

SEQ ID NO: 5792552 - DNA, 23 bp, Homo sapiens
tccaggactgggtctgacctggt

SEQ ID NO: 5792553 - DNA, 20 bp, Homo sapiens
tccaggactgtttcaaacat

SEQ ID NO: 5792554 - DNA, 21 bp, Homo sapiens
tccaggactgtttcaaacatg

SEQ ID NO: 5792555 - DNA, 21 bp, Homo sapiens
tccaggagaaagccgggggag

SEQ ID NO: 5792556 - DNA, 19 bp, Homo sapiens
tccaggagaagtgctccct

SEQ ID NO: 5792557 - DNA, 15 bp, Homo sapiens
tccaggagacatata

SEQ ID NO: 5792558 - DNA, 13 bp, Homo sapiens
tccaggagaggag

SEQ ID NO: 5792559 - DNA, 10 bp, Homo sapiens
tccaggagat

SEQ ID NO: 5792560 - DNA, 22 bp, Homo sapiens
tccaggagcacacggccctgcc

SEQ ID NO: 5792561 - DNA, 12 bp, Homo sapiens
tccaggagcagc

SEQ ID NO: 5792562 - DNA, 15 bp, Homo sapiens
tccaggagcagccac

SEQ ID NO: 5792563 - DNA, 22 bp, Homo sapiens
tccaggagcagccacattcctg

SEQ ID NO: 5792564 - DNA, 21 bp, Homo sapiens
tccaggagccccagccagccc

SEQ ID NO: 5792565 - DNA, 16 bp, Homo sapiens
tccaggagcctcatcc

SEQ ID NO: 5792566 - DNA, 18 bp, Homo sapiens
tccaggagcctcatccag

SEQ ID NO: 5792567 - DNA, 22 bp, Homo sapiens
tccaggagcctcatccagcctc

SEQ ID NO: 5792568 - DNA, 24 bp, Homo sapiens
tccaggagcctcatccagcctcag

SEQ ID NO: 5792569 - DNA, 13 bp, Homo sapiens
tccaggagcctgg

SEQ ID NO: 5792570 - DNA, 18 bp, Homo sapiens
tccaggagctcaggaaga

SEQ ID NO: 5792571 - DNA, 22 bp, Homo sapiens
tccatcaccccaacctctcctt

SEQ ID NO: 5792572 - DNA, 21 bp, Homo sapiens
tccatcagaaaaccaaagggt

SEQ ID NO: 5792573 - DNA, 23 bp, Homo sapiens
tccatcagcaatgcttctctcat

SEQ ID NO: 5792574 - DNA, 17 bp, Homo sapiens
tccatcagcaccccagt

SEQ ID NO: 5792575 - DNA, 22 bp, Homo sapiens
tccatcagcttaggggctgctg

SEQ ID NO: 5792576 - DNA, 16 bp, Homo sapiens
tccatcagctttataa

SEQ ID NO: 5792577 - DNA, 21 bp, Homo sapiens
tccatcaggtgaggtgtgctc

SEQ ID NO: 5792578 - DNA, 21 bp, Homo sapiens
tccatcatatgcctgacccct

SEQ ID NO: 5792579 - DNA, 14 bp, Homo sapiens
tccatcatcactgt

SEQ ID NO: 5792580 - DNA, 19 bp, Homo sapiens
tccatcatcactgtaaaga

SEQ ID NO: 5792581 - DNA, 17 bp, Homo sapiens
tccatcatctcttttcc

SEQ ID NO: 5792582 - DNA, 13 bp, Homo sapiens
tccatcatgtccc

SEQ ID NO: 5792583 - DNA, 14 bp, Homo sapiens
tccatcatgtctgt

SEQ ID NO: 5792584 - DNA, 14 bp, Homo sapiens
tccatcatttggtt

SEQ ID NO: 5792585 - DNA, 18 bp, Homo sapiens
tccatcattttacagtga

SEQ ID NO: 5792586 - DNA, 22 bp, Homo sapiens
tccatccacacacagcagctcc

SEQ ID NO: 5792587 - DNA, 18 bp, Homo sapiens
tccatccagcttgccaga

SEQ ID NO: 5792588 - DNA, 16 bp, Homo sapiens
tccatccaggccattc

SEQ ID NO: 5792589 - DNA, 17 bp, Homo sapiens
tccatccatccttccaa

SEQ ID NO: 5792590 - DNA, 14 bp, Homo sapiens
tccatccatctcca

SEQ ID NO: 5792591 - DNA, 16 bp, Homo sapiens
tccatccatgtgttcc

SEQ ID NO: 5792592 - DNA, 17 bp, Homo sapiens
tccatcccaacagccat

SEQ ID NO: 5792593 - DNA, 14 bp, Homo sapiens
tccatcccaacctg

SEQ ID NO: 5792594 - DNA, 12 bp, Homo sapiens
tccatcccagag

SEQ ID NO: 5792595 - DNA, 13 bp, Homo sapiens
tccatcccagagg

SEQ ID NO: 5792596 - DNA, 15 bp, Homo sapiens
tccatcccaggacac

SEQ ID NO: 5792597 - DNA, 14 bp, Homo sapiens
tccatcccatcatc

SEQ ID NO: 5792598 - DNA, 14 bp, Homo sapiens
tccatccccaaact

SEQ ID NO: 5792599 - DNA, 22 bp, Homo sapiens
tccatccccaaactgtgccctg

SEQ ID NO: 5792600 - DNA, 22 bp, Homo sapiens
tccatccccagttggggctgcg

SEQ ID NO: 5792601 - DNA, 15 bp, Homo sapiens
tccatccccatcggc

SEQ ID NO: 5792602 - DNA, 16 bp, Homo sapiens
tccatccccctgcctc

SEQ ID NO: 5792603 - DNA, 23 bp, Homo sapiens
tccatcccccttcttcctcccct

SEQ ID NO: 5792604 - DNA, 13 bp, Homo sapiens
tccatcccctccc

SEQ ID NO: 5792605 - DNA, 12 bp, Homo sapiens
tccatcccctga

SEQ ID NO: 5792606 - DNA, 15 bp, Homo sapiens
tccatccccttcccc

SEQ ID NO: 5792607 - DNA, 14 bp, Homo sapiens
tccatccctacccc

SEQ ID NO: 5792608 - DNA, 22 bp, Homo sapiens
tccatccctaccccctaagagc

SEQ ID NO: 5792609 - DNA, 12 bp, Homo sapiens
tccatccctaga

SEQ ID NO: 5792610 - DNA, 13 bp, Homo sapiens
tccatccctccat

SEQ ID NO: 5792611 - DNA, 16 bp, Homo sapiens
tccatccctccattca

SEQ ID NO: 5792612 - DNA, 15 bp, Homo sapiens
tccatccctggcccc

SEQ ID NO: 5792613 - DNA, 22 bp, Homo sapiens
tccatccctggccccctccctg

SEQ ID NO: 5792614 - DNA, 24 bp, Homo sapiens
tccatccctggccccctccctgga

SEQ ID NO: 5792615 - DNA, 17 bp, Homo sapiens
tccatccctggtgaaag

SEQ ID NO: 5792616 - DNA, 12 bp, Homo sapiens
tccatccctttt

SEQ ID NO: 5792617 - DNA, 16 bp, Homo sapiens
tccatcccttttcctg

SEQ ID NO: 5792618 - DNA, 18 bp, Homo sapiens
tccatcccttttcctgtc

SEQ ID NO: 5792619 - DNA, 15 bp, Homo sapiens
tccatccgactgccc

SEQ ID NO: 5792620 - DNA, 17 bp, Homo sapiens
tccatccgactgcccct

SEQ ID NO: 5792621 - DNA, 16 bp, Homo sapiens
tccatcctaccccctg

SEQ ID NO: 5792622 - DNA, 23 bp, Homo sapiens
tccatcctcatctctcttgggcc

SEQ ID NO: 5792623 - DNA, 17 bp, Homo sapiens
tccatcctcctccttcc

SEQ ID NO: 5792624 - DNA, 18 bp, Homo sapiens
tccatcctcctccttcct

SEQ ID NO: 5792625 - DNA, 20 bp, Homo sapiens
tccatcctcctctccatgca

SEQ ID NO: 5792626 - DNA, 13 bp, Homo sapiens
tccatcctgacct

SEQ ID NO: 5792627 - DNA, 11 bp, Homo sapiens
tccatcctgag

SEQ ID NO: 5792628 - DNA, 14 bp, Homo sapiens
tccatcctgaggac

SEQ ID NO: 5792629 - DNA, 20 bp, Homo sapiens
tccatcctgaggaccgcccc

SEQ ID NO: 5792630 - DNA, 21 bp, Homo sapiens
tccatcctgaggctccacttg

SEQ ID NO: 5792631 - DNA, 17 bp, Homo sapiens
tccatcctgcaaaggcc

SEQ ID NO: 5792632 - DNA, 13 bp, Homo sapiens
tccatcctgcaga

SEQ ID NO: 5792633 - DNA, 14 bp, Homo sapiens
tccatcctgcagat

SEQ ID NO: 5792634 - DNA, 12 bp, Homo sapiens
tccatcctgcca

SEQ ID NO: 5792635 - DNA, 16 bp, Homo sapiens
tccatcctgctagcac

SEQ ID NO: 5792636 - DNA, 19 bp, Homo sapiens
tccatcctgctagcacctc

SEQ ID NO: 5792637 - DNA, 17 bp, Homo sapiens
tccatccttaactgtcc

SEQ ID NO: 5792638 - DNA, 15 bp, Homo sapiens
tccatccttctcccc

SEQ ID NO: 5792639 - DNA, 15 bp, Homo sapiens
tccatccttgagatt

SEQ ID NO: 5792640 - DNA, 15 bp, Homo sapiens
tccatcctttctcct

SEQ ID NO: 5792641 - DNA, 22 bp, Homo sapiens
tccatcgccatcttcttccctt

SEQ ID NO: 5792642 - DNA, 16 bp, Homo sapiens
tccatcgtattaaaaa

SEQ ID NO: 5792643 - DNA, 22 bp, Homo sapiens
tccatcgtattaaaaaacaatt

SEQ ID NO: 5792644 - DNA, 19 bp, Homo sapiens
tccatcgtctcatcctcct

SEQ ID NO: 5792645 - DNA, 20 bp, Homo sapiens
tccatcgtctcatcctcctt

SEQ ID NO: 5792646 - DNA, 15 bp, Homo sapiens
tccatctaaaaatat

SEQ ID NO: 5792647 - DNA, 16 bp, Homo sapiens
tccatctaaaaatata

SEQ ID NO: 5792648 - DNA, 21 bp, Homo sapiens
tccatctaaaaatatacatgt

SEQ ID NO: 5792649 - DNA, 16 bp, Homo sapiens
tccatctaaactgccc

SEQ ID NO: 5792650 - DNA, 22 bp, Homo sapiens
tccatctacttttttatccacc

SEQ ID NO: 5792651 - DNA, 23 bp, Homo sapiens
tccatctagagattttcttggca

SEQ ID NO: 5792652 - DNA, 20 bp, Homo sapiens
tccatctagcagctggccta

SEQ ID NO: 5792653 - DNA, 21 bp, Homo sapiens
tccatctatcactgcattatc

SEQ ID NO: 5792654 - DNA, 22 bp, Homo sapiens
tccatctcaaaaaaaaaaaaga

SEQ ID NO: 5792655 - DNA, 19 bp, Homo sapiens
tccatctcaaaacaaaaca

SEQ ID NO: 5792656 - DNA, 18 bp, Homo sapiens
tccatctcaacctacctc

SEQ ID NO: 5792657 - DNA, 11 bp, Homo sapiens
tccatctcagt

SEQ ID NO: 5792658 - DNA, 23 bp, Homo sapiens
tccatctcagtcactttttcccc

SEQ ID NO: 5792659 - DNA, 13 bp, Homo sapiens
tccatctcccaag

SEQ ID NO: 5792660 - DNA, 23 bp, Homo sapiens
tccatctcccgaattcgctgtta

SEQ ID NO: 5792661 - DNA, 19 bp, Homo sapiens
tccatctcctgctcaccac

SEQ ID NO: 5792662 - DNA, 12 bp, Homo sapiens
tccatctccttg

SEQ ID NO: 5792663 - DNA, 16 bp, Homo sapiens
tccatctcgccacccc

SEQ ID NO: 5792664 - DNA, 23 bp, Homo sapiens
tccatctcgccacccctccttcc

SEQ ID NO: 5792665 - DNA, 18 bp, Homo sapiens
tccatctctctcttgcct

SEQ ID NO: 5792666 - DNA, 14 bp, Homo sapiens
tccatctctgcctg

SEQ ID NO: 5792667 - DNA, 17 bp, Homo sapiens
tccatctctgcctgtca

SEQ ID NO: 5792668 - DNA, 18 bp, Homo sapiens
tccatctctgcctgtcaa

SEQ ID NO: 5792669 - DNA, 14 bp, Homo sapiens
tccatctcttcctt

SEQ ID NO: 5792670 - DNA, 19 bp, Homo sapiens
tccatctcttcctttcctt

SEQ ID NO: 5792671 - DNA, 19 bp, Homo sapiens
tccatctcttgtaccagcc

SEQ ID NO: 5792672 - DNA, 20 bp, Homo sapiens
tccatctcttgtaccagccc

SEQ ID NO: 5792673 - DNA, 16 bp, Homo sapiens
tccatctgattccagc

SEQ ID NO: 5792674 - DNA, 18 bp, Homo sapiens
tccatctgcccgcctgcc

SEQ ID NO: 5792675 - DNA, 22 bp, Homo sapiens
tccatctgcccgcctgcccacc

SEQ ID NO: 5792676 - DNA, 13 bp, Homo sapiens
tccatctggggat

SEQ ID NO: 5792677 - DNA, 21 bp, Homo sapiens
tccatctggtagaagggaaag

SEQ ID NO: 5792678 - DNA, 19 bp, Homo sapiens
tccatctgtacttggtcca

SEQ ID NO: 5792679 - DNA, 13 bp, Homo sapiens
tccatctgtccac

SEQ ID NO: 5792680 - DNA, 23 bp, Homo sapiens
tccatctgtccacatccccagag

SEQ ID NO: 5792681 - DNA, 13 bp, Homo sapiens
tccatctgtccgt

SEQ ID NO: 5792682 - DNA, 13 bp, Homo sapiens
tccatctgtctgt

SEQ ID NO: 5792683 - DNA, 16 bp, Homo sapiens
tccatcttacttgccc

SEQ ID NO: 5792684 - DNA, 17 bp, Homo sapiens
tccatcttacttgccct

SEQ ID NO: 5792685 - DNA, 15 bp, Homo sapiens
tccatcttcacactg

SEQ ID NO: 5792686 - DNA, 16 bp, Homo sapiens
tccatcttcagcttct

SEQ ID NO: 5792687 - DNA, 19 bp, Homo sapiens
tccatcttcagtttctgaa

SEQ ID NO: 5792688 - DNA, 24 bp, Homo sapiens
tccatcttctccccacagcctctg

SEQ ID NO: 5792689 - DNA, 15 bp, Homo sapiens
tccatcttctttgca

SEQ ID NO: 5792690 - DNA, 17 bp, Homo sapiens
tccatcttgctaataaa

SEQ ID NO: 5792691 - DNA, 18 bp, Homo sapiens
tccatcttggtagttctg

SEQ ID NO: 5792692 - DNA, 17 bp, Homo sapiens
tccatcttgtttcattt

SEQ ID NO: 5792693 - DNA, 13 bp, Homo sapiens
tccatctttacaa

SEQ ID NO: 5792694 - DNA, 18 bp, Homo sapiens
tccatctttctacagaga

SEQ ID NO: 5792695 - DNA, 16 bp, Homo sapiens
tccatctttttcttgg

SEQ ID NO: 5792696 - DNA, 18 bp, Homo sapiens
tccatctttttcttgggt

SEQ ID NO: 5792697 - DNA, 19 bp, Homo sapiens
tccatgaaaacgttttatt

SEQ ID NO: 5792698 - DNA, 21 bp, Homo sapiens
tccatgaaaacgttttattgt

SEQ ID NO: 5792699 - DNA, 12 bp, Homo sapiens
tccatgaaaata

SEQ ID NO: 5792700 - DNA, 13 bp, Homo sapiens
tccatgaaaatac

SEQ ID NO: 5792701 - DNA, 16 bp, Homo sapiens
tccatgaaaataccat

SEQ ID NO: 5792702 - DNA, 15 bp, Homo sapiens
tccatgaaaatgcaa

SEQ ID NO: 5792703 - DNA, 16 bp, Homo sapiens
tccatgaaaatgcaac

SEQ ID NO: 5792704 - DNA, 17 bp, Homo sapiens
tccatgaaagaacttaa

SEQ ID NO: 5792705 - DNA, 21 bp, Homo sapiens
tccatgaagagcttgtgtcct

SEQ ID NO: 5792706 - DNA, 22 bp, Homo sapiens
tccatgaagagcttgtgtcctg

SEQ ID NO: 5792707 - DNA, 20 bp, Homo sapiens
tccatgaatcgcttctcttt

SEQ ID NO: 5792708 - DNA, 14 bp, Homo sapiens
tccatgaatgtatc

SEQ ID NO: 5792709 - DNA, 15 bp, Homo sapiens
tccatgaatgttcat

SEQ ID NO: 5792710 - DNA, 17 bp, Homo sapiens
tccatgaattttaaaat

SEQ ID NO: 5792711 - DNA, 16 bp, Homo sapiens
tccatgacacccaagg

SEQ ID NO: 5792712 - DNA, 15 bp, Homo sapiens
tccatgacaggcctg

SEQ ID NO: 5792713 - DNA, 14 bp, Homo sapiens
tccatgacattttt

SEQ ID NO: 5792714 - DNA, 16 bp, Homo sapiens
tccatgaccagaaaca

SEQ ID NO: 5792715 - DNA, 17 bp, Homo sapiens
tccatgacctcccctcc

SEQ ID NO: 5792716 - DNA, 16 bp, Homo sapiens
tccatgacgcaggagc

SEQ ID NO: 5792717 - DNA, 14 bp, Homo sapiens
tccatgactctgcc

SEQ ID NO: 5792718 - DNA, 14 bp, Homo sapiens
tccatgactggctg

SEQ ID NO: 5792719 - DNA, 16 bp, Homo sapiens
tccatgagctgctcat

SEQ ID NO: 5792720 - DNA, 20 bp, Homo sapiens
tccatgagggtttcattgtg

SEQ ID NO: 5792721 - DNA, 15 bp, Homo sapiens
tccatgaggtactgg

SEQ ID NO: 5792722 - DNA, 18 bp, Homo sapiens
tccatgaggtactggtcc

SEQ ID NO: 5792723 - DNA, 15 bp, Homo sapiens
tccatgagtcccctg

SEQ ID NO: 5792724 - DNA, 16 bp, Homo sapiens
tccatgagtcccctgt

SEQ ID NO: 5792725 - DNA, 18 bp, Homo sapiens
tccatgagtttgccctgg

SEQ ID NO: 5792726 - DNA, 16 bp, Homo sapiens
tccatgatactttaat

SEQ ID NO: 5792727 - DNA, 19 bp, Homo sapiens
tccatgatgcacagtatct

SEQ ID NO: 5792728 - DNA, 15 bp, Homo sapiens
tccatgatgctggga

SEQ ID NO: 5792729 - DNA, 15 bp, Homo sapiens
tccatgatgttacat

SEQ ID NO: 5792730 - DNA, 21 bp, Homo sapiens
tccatgattccaagggcccag

SEQ ID NO: 5792731 - DNA, 12 bp, Homo sapiens
tccatgattcta

SEQ ID NO: 5792732 - DNA, 16 bp, Homo sapiens
tccatgattctctgag

SEQ ID NO: 5792733 - DNA, 18 bp, Homo sapiens
tccatgattctctgagtg

SEQ ID NO: 5792734 - DNA, 16 bp, Homo sapiens
tccatgatttagcaag

SEQ ID NO: 5792735 - DNA, 17 bp, Homo sapiens
tccatgatttagcaagc

SEQ ID NO: 5792736 - DNA, 22 bp, Homo sapiens
tccatgatttagcaagcaacta

SEQ ID NO: 5792737 - DNA, 16 bp, Homo sapiens
tccatgattttacaga

SEQ ID NO: 5792738 - DNA, 14 bp, Homo sapiens
tccatgcaagtgct

SEQ ID NO: 5792739 - DNA, 13 bp, Homo sapiens
tccatgcacagga

SEQ ID NO: 5792740 - DNA, 19 bp, Homo sapiens
tccatgcacctcccttccc

SEQ ID NO: 5792741 - DNA, 21 bp, Homo sapiens
tccatgcagactcctcagatc

SEQ ID NO: 5792742 - DNA, 21 bp, Homo sapiens
tccatgcagactgttagcttt

SEQ ID NO: 5792743 - DNA, 20 bp, Homo sapiens
tccatgcagatctagccagg

SEQ ID NO: 5792744 - DNA, 23 bp, Homo sapiens
tccatgcagatctagccaggcct

SEQ ID NO: 5792745 - DNA, 16 bp, Homo sapiens
tccatgcagccttggg

SEQ ID NO: 5792746 - DNA, 21 bp, Homo sapiens
tccatgcagggggctcctggg

SEQ ID NO: 5792747 - DNA, 20 bp, Homo sapiens
tccatgcagttattagaact

SEQ ID NO: 5792748 - DNA, 13 bp, Homo sapiens
tccatgcatgtgc

SEQ ID NO: 5792749 - DNA, 16 bp, Homo sapiens
tccatgccatgaatga

SEQ ID NO: 5792750 - DNA, 18 bp, Homo sapiens
tcccaagatctgtgcagc

SEQ ID NO: 5792751 - DNA, 19 bp, Homo sapiens
tcccaagatggagaggaag

SEQ ID NO: 5792752 - DNA, 22 bp, Homo sapiens
tcccaagatggagaggaagaaa

SEQ ID NO: 5792753 - DNA, 12 bp, Homo sapiens
tcccaagcagct

SEQ ID NO: 5792754 - DNA, 13 bp, Homo sapiens
tcccaagccatgg

SEQ ID NO: 5792755 - DNA, 14 bp, Homo sapiens
tcccaagcccagtg

SEQ ID NO: 5792756 - DNA, 18 bp, Homo sapiens
tcccaagcccctgacccg

SEQ ID NO: 5792757 - DNA, 14 bp, Homo sapiens
tcccaagccttcgg

SEQ ID NO: 5792758 - DNA, 13 bp, Homo sapiens
tcccaagctaggc

SEQ ID NO: 5792759 - DNA, 18 bp, Homo sapiens
tcccaagctagtgagcaa

SEQ ID NO: 5792760 - DNA, 20 bp, Homo sapiens
tcccaagctatctaaagttt

SEQ ID NO: 5792761 - DNA, 14 bp, Homo sapiens
tcccaagctcagag

SEQ ID NO: 5792762 - DNA, 17 bp, Homo sapiens
tcccaagctcagagcag

SEQ ID NO: 5792763 - DNA, 21 bp, Homo sapiens
tcccaagctcccaagagcttc

SEQ ID NO: 5792764 - DNA, 16 bp, Homo sapiens
tcccaagctcccttcc

SEQ ID NO: 5792765 - DNA, 12 bp, Homo sapiens
tcccaagctctg

SEQ ID NO: 5792766 - DNA, 13 bp, Homo sapiens
tcccaagctggct

SEQ ID NO: 5792767 - DNA, 15 bp, Homo sapiens
tcccaagctgggccc

SEQ ID NO: 5792768 - DNA, 16 bp, Homo sapiens
tcccaagctgggcccc

SEQ ID NO: 5792769 - DNA, 21 bp, Homo sapiens
tcccaagctgggccccagccc

SEQ ID NO: 5792770 - DNA, 12 bp, Homo sapiens
tcccaagctttg

SEQ ID NO: 5792771 - DNA, 18 bp, Homo sapiens
tcccaaggaaagccccag

SEQ ID NO: 5792772 - DNA, 22 bp, Homo sapiens
tcccaaggaaagccccagcact

SEQ ID NO: 5792773 - DNA, 19 bp, Homo sapiens
tcccaaggaagctccttcc

SEQ ID NO: 5792774 - DNA, 22 bp, Homo sapiens
tcccaaggaagctccttcctgt

SEQ ID NO: 5792775 - DNA, 13 bp, Homo sapiens
tcccaaggacttc

SEQ ID NO: 5792776 - DNA, 18 bp, Homo sapiens
tcccaaggacttccacat

SEQ ID NO: 5792777 - DNA, 17 bp, Homo sapiens
tcccaaggagaacaaat

SEQ ID NO: 5792778 - DNA, 19 bp, Homo sapiens
tcccaaggagaacaaatat

SEQ ID NO: 5792779 - DNA, 16 bp, Homo sapiens
tcccaaggagccattc

SEQ ID NO: 5792780 - DNA, 21 bp, Homo sapiens
tcccaaggagccattctgtgt

SEQ ID NO: 5792781 - DNA, 20 bp, Homo sapiens
tcccaaggcaagcatgaata

SEQ ID NO: 5792782 - DNA, 22 bp, Homo sapiens
tcccaaggcaagcatgaataaa

SEQ ID NO: 5792783 - DNA, 23 bp, Homo sapiens
tcccaaggcaaggggtgcctggg

SEQ ID NO: 5792784 - DNA, 13 bp, Homo sapiens
tcccaaggcagct

SEQ ID NO: 5792785 - DNA, 14 bp, Homo sapiens
tcccaaggcagctg

SEQ ID NO: 5792786 - DNA, 19 bp, Homo sapiens
tcccaaggcgtgcaggggc

SEQ ID NO: 5792787 - DNA, 20 bp, Homo sapiens
tcccaaggctcctgacctac

SEQ ID NO: 5792788 - DNA, 18 bp, Homo sapiens
tcccaaggctctgagcaa

SEQ ID NO: 5792789 - DNA, 21 bp, Homo sapiens
tcccaaggctgccagacatgg

SEQ ID NO: 5792790 - DNA, 21 bp, Homo sapiens
tcccaagggacagcaagtgag

SEQ ID NO: 5792791 - DNA, 21 bp, Homo sapiens
tcccaagggatggtgccctgt

SEQ ID NO: 5792792 - DNA, 16 bp, Homo sapiens
tcccaaggggcctgag

SEQ ID NO: 5792793 - DNA, 19 bp, Homo sapiens
tcccaaggggcctgagcag

SEQ ID NO: 5792794 - DNA, 20 bp, Homo sapiens
tcccaagggtgccctttggg

SEQ ID NO: 5792795 - DNA, 16 bp, Homo sapiens
tcccaaggttctgggt

SEQ ID NO: 5792796 - DNA, 21 bp, Homo sapiens
tcccaagtaactgggattaca

SEQ ID NO: 5792797 - DNA, 16 bp, Homo sapiens
tcccaagtagaatctc

SEQ ID NO: 5792798 - DNA, 20 bp, Homo sapiens
tcccaagtagctgagattac

SEQ ID NO: 5792799 - DNA, 15 bp, Homo sapiens
tcccaagtagctggg

SEQ ID NO: 5792800 - DNA, 16 bp, Homo sapiens
tcccaagtagctggga

SEQ ID NO: 5792801 - DNA, 21 bp, Homo sapiens
tcccaagtagctgggattaca

SEQ ID NO: 5792802 - DNA, 13 bp, Homo sapiens
tcccaagtatgcc

SEQ ID NO: 5792803 - DNA, 22 bp, Homo sapiens
tcccaagtatgccttaagcaga

SEQ ID NO: 5792804 - DNA, 22 bp, Homo sapiens
tcccaagtcaaacagtgtggct

SEQ ID NO: 5792805 - DNA, 17 bp, Homo sapiens
tcccaagtcacacccac

SEQ ID NO: 5792806 - DNA, 13 bp, Homo sapiens
tcccaagtccaca

SEQ ID NO: 5792807 - DNA, 16 bp, Homo sapiens
tcccaagtcccaccct

SEQ ID NO: 5792808 - DNA, 23 bp, Homo sapiens
tcccaagtcctcgccccccgccc

SEQ ID NO: 5792809 - DNA, 14 bp, Homo sapiens
tcccaagtctacag

SEQ ID NO: 5792810 - DNA, 15 bp, Homo sapiens
tcccaagtctacaga

SEQ ID NO: 5792811 - DNA, 13 bp, Homo sapiens
tcccaagtctcca

SEQ ID NO: 5792812 - DNA, 12 bp, Homo sapiens
tcccaagtgcca

SEQ ID NO: 5792813 - DNA, 15 bp, Homo sapiens
tcccaagtgccaaag

SEQ ID NO: 5792814 - DNA, 15 bp, Homo sapiens
tcccaagtgtactat

SEQ ID NO: 5792815 - DNA, 23 bp, Homo sapiens
tcccaagtttccatagcaacagg

SEQ ID NO: 5792816 - DNA, 18 bp, Homo sapiens
tcccaagttttaggacaa

SEQ ID NO: 5792817 - DNA, 11 bp, Homo sapiens
tcccaataaaa

SEQ ID NO: 5792818 - DNA, 15 bp, Homo sapiens
tcccaataaaagtga

SEQ ID NO: 5792819 - DNA, 15 bp, Homo sapiens
tcccaataaagctgg

SEQ ID NO: 5792820 - DNA, 20 bp, Homo sapiens
tcccaataaagtcctcttcc

SEQ ID NO: 5792821 - DNA, 22 bp, Homo sapiens
tcccaataaagtcctcttccct

SEQ ID NO: 5792822 - DNA, 17 bp, Homo sapiens
tcccaatagaatacctc

SEQ ID NO: 5792823 - DNA, 22 bp, Homo sapiens
tcccaatagcaacgtagcttct

SEQ ID NO: 5792824 - DNA, 20 bp, Homo sapiens
tcccaatagcactttcattg

SEQ ID NO: 5792825 - DNA, 20 bp, Homo sapiens
tcccaatcaaagaattacag

SEQ ID NO: 5792826 - DNA, 14 bp, Homo sapiens
tcccaatcagcact

SEQ ID NO: 5792827 - DNA, 15 bp, Homo sapiens
tcccaatcagcactg

SEQ ID NO: 5792828 - DNA, 16 bp, Homo sapiens
tcccaatcagcactga

SEQ ID NO: 5792829 - DNA, 17 bp, Homo sapiens
tcccaatcagcactgaa

SEQ ID NO: 5792830 - DNA, 18 bp, Homo sapiens
tcccaatcagcactgaaa

SEQ ID NO: 5792831 - DNA, 16 bp, Homo sapiens
tcccaatcctctctcc

SEQ ID NO: 5792832 - DNA, 17 bp, Homo sapiens
tcccaatcctctctccc

SEQ ID NO: 5792833 - DNA, 22 bp, Homo sapiens
tcccaatctctacccctttctt

SEQ ID NO: 5792834 - DNA, 21 bp, Homo sapiens
tcccaatctgaaattcaaaat

SEQ ID NO: 5792835 - DNA, 15 bp, Homo sapiens
tcccaatcttaccag

SEQ ID NO: 5792836 - DNA, 21 bp, Homo sapiens
tcccaatcttaccagatgcta

SEQ ID NO: 5792837 - DNA, 14 bp, Homo sapiens
tcccaatctttcta

SEQ ID NO: 5792838 - DNA, 14 bp, Homo sapiens
tcccaatgcacatc

SEQ ID NO: 5792839 - DNA, 20 bp, Homo sapiens
tcccaatgcacatccattcc

SEQ ID NO: 5792840 - DNA, 18 bp, Homo sapiens
tcccaatggtgcttggag

SEQ ID NO: 5792841 - DNA, 13 bp, Homo sapiens
tcccaatggtgtt

SEQ ID NO: 5792842 - DNA, 16 bp, Homo sapiens
tcccaatggtgttttt

SEQ ID NO: 5792843 - DNA, 21 bp, Homo sapiens
tcccaatggtgtttttcttgt

SEQ ID NO: 5792844 - DNA, 13 bp, Homo sapiens
tcccaattaaaat

SEQ ID NO: 5792845 - DNA, 15 bp, Homo sapiens
tcccaattcacatct

SEQ ID NO: 5792846 - DNA, 20 bp, Homo sapiens
tcccaattcatcctcactca

SEQ ID NO: 5792847 - DNA, 22 bp, Homo sapiens
tcccaattcggggcctgctgga

SEQ ID NO: 5792848 - DNA, 16 bp, Homo sapiens
tcccaattgagaaaaa

SEQ ID NO: 5792849 - DNA, 23 bp, Homo sapiens
tcccaatttaagagtcctgaggc

SEQ ID NO: 5792850 - DNA, 18 bp, Homo sapiens
tcccaatttcagactccc

SEQ ID NO: 5792851 - DNA, 20 bp, Homo sapiens
tcccacaaaagacagaccca

SEQ ID NO: 5792852 - DNA, 18 bp, Homo sapiens
tcccacaaaatatttcta

SEQ ID NO: 5792853 - DNA, 22 bp, Homo sapiens
tcccacaaatgcaggtgtcctg

SEQ ID NO: 5792854 - DNA, 21 bp, Homo sapiens
tcccacaagcctgagggaaag

SEQ ID NO: 5792855 - DNA, 21 bp, Homo sapiens
tcccacaagtatatactttta

SEQ ID NO: 5792856 - DNA, 14 bp, Homo sapiens
tcccacaagtggtg

SEQ ID NO: 5792857 - DNA, 16 bp, Homo sapiens
tcccacaattcttttg

SEQ ID NO: 5792858 - DNA, 17 bp, Homo sapiens
tcccacacatattcaaa

SEQ ID NO: 5792859 - DNA, 18 bp, Homo sapiens
tcccacacatattcaaat

SEQ ID NO: 5792860 - DNA, 12 bp, Homo sapiens
tcccacacccaa

SEQ ID NO: 5792861 - DNA, 14 bp, Homo sapiens
tcccacacccaccc

SEQ ID NO: 5792862 - DNA, 18 bp, Homo sapiens
tcccacacccacctctgc

SEQ ID NO: 5792863 - DNA, 19 bp, Homo sapiens
tcccacaccgcgtcccagc

SEQ ID NO: 5792864 - DNA, 23 bp, Homo sapiens
tcccacaccgcgtcccagctccc

SEQ ID NO: 5792865 - DNA, 18 bp, Homo sapiens
tcccacaccgtgtaaacc

SEQ ID NO: 5792866 - DNA, 16 bp, Homo sapiens
tcccacacctccacag

SEQ ID NO: 5792867 - DNA, 17 bp, Homo sapiens
tcccacacctccacagt

SEQ ID NO: 5792868 - DNA, 13 bp, Homo sapiens
tcccacacctgcc

SEQ ID NO: 5792869 - DNA, 23 bp, Homo sapiens
tcccacacggcagcccccccctc

SEQ ID NO: 5792870 - DNA, 20 bp, Homo sapiens
tcccacactcctatggtcac

SEQ ID NO: 5792871 - DNA, 18 bp, Homo sapiens
tcccacactcgccatctc

SEQ ID NO: 5792872 - DNA, 17 bp, Homo sapiens
tcccacactgaaattct

SEQ ID NO: 5792873 - DNA, 18 bp, Homo sapiens
tcccacactggtgactgc

SEQ ID NO: 5792874 - DNA, 21 bp, Homo sapiens
tcccacactgtgcagacccag

SEQ ID NO: 5792875 - DNA, 19 bp, Homo sapiens
tcccacactgtggccaggc

SEQ ID NO: 5792876 - DNA, 13 bp, Homo sapiens
tcccacacttgct

SEQ ID NO: 5792877 - DNA, 14 bp, Homo sapiens
tcccacacttgctg

SEQ ID NO: 5792878 - DNA, 18 bp, Homo sapiens
tcccacacttgtgccagc

SEQ ID NO: 5792879 - DNA, 20 bp, Homo sapiens
tcccacacttgtgccagccc

SEQ ID NO: 5792880 - DNA, 21 bp, Homo sapiens
tcccacacttgtgccagcccg

SEQ ID NO: 5792881 - DNA, 13 bp, Homo sapiens
tcccacactttga

SEQ ID NO: 5792882 - DNA, 19 bp, Homo sapiens
tcccacactttgaagcaaa

SEQ ID NO: 5792883 - DNA, 21 bp, Homo sapiens
tcccacactttgaagcaaata

SEQ ID NO: 5792884 - DNA, 16 bp, Homo sapiens
tcccacagacctgcag

SEQ ID NO: 5792885 - DNA, 18 bp, Homo sapiens
tcccacagacctgcagtg

SEQ ID NO: 5792886 - DNA, 15 bp, Homo sapiens
tcccacagagtgctg

SEQ ID NO: 5792887 - DNA, 17 bp, Homo sapiens
tcccacagagtgctgga

SEQ ID NO: 5792888 - DNA, 23 bp, Homo sapiens
tcccacagcagccccaggagaag

SEQ ID NO: 5792889 - DNA, 14 bp, Homo sapiens
tcccacagcctcct

SEQ ID NO: 5792890 - DNA, 17 bp, Homo sapiens
tcccacagcctccttct

SEQ ID NO: 5792891 - DNA, 17 bp, Homo sapiens
tcccacagcctcttcct

SEQ ID NO: 5792892 - DNA, 13 bp, Homo sapiens
tcccacagcgctg

SEQ ID NO: 5792893 - DNA, 13 bp, Homo sapiens
tcccacaggaggg

SEQ ID NO: 5792894 - DNA, 15 bp, Homo sapiens
tcccacaggcagctt

SEQ ID NO: 5792895 - DNA, 15 bp, Homo sapiens
tcccacaggcccttc

SEQ ID NO: 5792896 - DNA, 19 bp, Homo sapiens
tcccacaggtggtacagcc

SEQ ID NO: 5792897 - DNA, 18 bp, Homo sapiens
tcccacaggttcaggcga

SEQ ID NO: 5792898 - DNA, 11 bp, Homo sapiens
tcccacagtgg

SEQ ID NO: 5792899 - DNA, 23 bp, Homo sapiens
tcccacatccaactccagcaact

SEQ ID NO: 5792900 - DNA, 15 bp, Homo sapiens
tcccacatcccccgt

SEQ ID NO: 5792901 - DNA, 17 bp, Homo sapiens
tcccacatcccccgtgt

SEQ ID NO: 5792902 - DNA, 13 bp, Homo sapiens
tcccacatccctg

SEQ ID NO: 5792903 - DNA, 14 bp, Homo sapiens
tcccacatccctgg

SEQ ID NO: 5792904 - DNA, 16 bp, Homo sapiens
tcccacatccctgggc

SEQ ID NO: 5792905 - DNA, 22 bp, Homo sapiens
tcccacatccctgggcctgctg

SEQ ID NO: 5792906 - DNA, 23 bp, Homo sapiens
tcccacatccctgggcctgctgc

SEQ ID NO: 5792907 - DNA, 19 bp, Homo sapiens
tcccacatgaggccatctc

SEQ ID NO: 5792908 - DNA, 15 bp, Homo sapiens
tcccacatgcctgcg

SEQ ID NO: 5792909 - DNA, 22 bp, Homo sapiens
tcccacatgcctgcgcctgctg

SEQ ID NO: 5792910 - DNA, 21 bp, Homo sapiens
tcccaccaacaaaatccatgt

SEQ ID NO: 5792911 - DNA, 22 bp, Homo sapiens
tcccaccaactctctctgcccc

SEQ ID NO: 5792912 - DNA, 16 bp, Homo sapiens
tcccaccaactctgca

SEQ ID NO: 5792913 - DNA, 18 bp, Homo sapiens
tcccaccaactctgcact

SEQ ID NO: 5792914 - DNA, 15 bp, Homo sapiens
tcccaccacagcagg

SEQ ID NO: 5792915 - DNA, 14 bp, Homo sapiens
tcccaccacaggca

SEQ ID NO: 5792916 - DNA, 10 bp, Homo sapiens
tcccaccacc

SEQ ID NO: 5792917 - DNA, 13 bp, Homo sapiens
tcccaccacccca

SEQ ID NO: 5792918 - DNA, 15 bp, Homo sapiens
tcccaccaccctgag

SEQ ID NO: 5792919 - DNA, 23 bp, Homo sapiens
tcccaccaccctttgctgactct

SEQ ID NO: 5792920 - DNA, 19 bp, Homo sapiens
tcccaccagagccgggagg

SEQ ID NO: 5792921 - DNA, 20 bp, Homo sapiens
tcccaccagcatgtcactcc

SEQ ID NO: 5792922 - DNA, 23 bp, Homo sapiens
tcccaccagcatgtcactcccag

SEQ ID NO: 5792923 - DNA, 14 bp, Homo sapiens
tcccaccagccccg

SEQ ID NO: 5792924 - DNA, 16 bp, Homo sapiens
tcccaccagccccggc

SEQ ID NO: 5792925 - DNA, 16 bp, Homo sapiens
tcccaccagcctgagc

SEQ ID NO: 5792926 - DNA, 21 bp, Homo sapiens
tcccaccaggcagctccagct

SEQ ID NO: 5792927 - DNA, 14 bp, Homo sapiens
tcccatccaggcag

SEQ ID NO: 5792928 - DNA, 15 bp, Homo sapiens
tcccatccaggcagt

SEQ ID NO: 5792929 - DNA, 14 bp, Homo sapiens
tcccatccagggcc

SEQ ID NO: 5792930 - DNA, 18 bp, Homo sapiens
tcccatccagtgtctcac

SEQ ID NO: 5792931 - DNA, 22 bp, Homo sapiens
tcccatcccagctgaaatactg

SEQ ID NO: 5792932 - DNA, 14 bp, Homo sapiens
tcccatcccatccc

SEQ ID NO: 5792933 - DNA, 15 bp, Homo sapiens
tcccatcccatccca

SEQ ID NO: 5792934 - DNA, 17 bp, Homo sapiens
tcccatcccatcccatc

SEQ ID NO: 5792935 - DNA, 19 bp, Homo sapiens
tcccatcccatcccatccc

SEQ ID NO: 5792936 - DNA, 13 bp, Homo sapiens
tcccatcccctgg

SEQ ID NO: 5792937 - DNA, 15 bp, Homo sapiens
tcccatcccctggac

SEQ ID NO: 5792938 - DNA, 15 bp, Homo sapiens
tcccatcccctgtgg

SEQ ID NO: 5792939 - DNA, 23 bp, Homo sapiens
tcccatcccgtaagaccaccttc

SEQ ID NO: 5792940 - DNA, 16 bp, Homo sapiens
tcccatcctcacccag

SEQ ID NO: 5792941 - DNA, 21 bp, Homo sapiens
tcccatcctcacccagatcag

SEQ ID NO: 5792942 - DNA, 22 bp, Homo sapiens
tcccatcctgatcccagaccca

SEQ ID NO: 5792943 - DNA, 13 bp, Homo sapiens
tcccatcctgggg

SEQ ID NO: 5792944 - DNA, 17 bp, Homo sapiens
tcccatcctggggcagc

SEQ ID NO: 5792945 - DNA, 16 bp, Homo sapiens
tcccatcctgtgtgtt

SEQ ID NO: 5792946 - DNA, 17 bp, Homo sapiens
tcccatcgctggaaaac

SEQ ID NO: 5792947 - DNA, 13 bp, Homo sapiens
tcccatcgctgtc

SEQ ID NO: 5792948 - DNA, 22 bp, Homo sapiens
tcccatcgtctcggccttcaca

SEQ ID NO: 5792949 - DNA, 22 bp, Homo sapiens
tcccatctaagctgcagcttcc

SEQ ID NO: 5792950 - DNA, 23 bp, Homo sapiens
tcccatctaagctgcagcttcct

SEQ ID NO: 5792951 - DNA, 19 bp, Homo sapiens
tcccatctcacacatgagc

SEQ ID NO: 5792952 - DNA, 16 bp, Homo sapiens
tcccatctcagaagat

SEQ ID NO: 5792953 - DNA, 16 bp, Homo sapiens
tcccatctccagggaa

SEQ ID NO: 5792954 - DNA, 17 bp, Homo sapiens
tcccatctccagggaag

SEQ ID NO: 5792955 - DNA, 12 bp, Homo sapiens
tcccatctcctt

SEQ ID NO: 5792956 - DNA, 13 bp, Homo sapiens
tcccatctcctta

SEQ ID NO: 5792957 - DNA, 21 bp, Homo sapiens
tcccatctccttacctctgga

SEQ ID NO: 5792958 - DNA, 16 bp, Homo sapiens
tcccatctccttcccc

SEQ ID NO: 5792959 - DNA, 14 bp, Homo sapiens
tcccatctctacaa

SEQ ID NO: 5792960 - DNA, 14 bp, Homo sapiens
tcccatctctccca

SEQ ID NO: 5792961 - DNA, 16 bp, Homo sapiens
tcccatctctcccact

SEQ ID NO: 5792962 - DNA, 20 bp, Homo sapiens
tcccatctctcccacttcct

SEQ ID NO: 5792963 - DNA, 21 bp, Homo sapiens
tcccatctctcccacttcctc

SEQ ID NO: 5792964 - DNA, 23 bp, Homo sapiens
tcccatctctcccacttcctcct

SEQ ID NO: 5792965 - DNA, 13 bp, Homo sapiens
tcccatctgaaga

SEQ ID NO: 5792966 - DNA, 17 bp, Homo sapiens
tcccatctgaagagtgg

SEQ ID NO: 5792967 - DNA, 13 bp, Homo sapiens
tcccatctgcacc

SEQ ID NO: 5792968 - DNA, 13 bp, Homo sapiens
tcccatctgctcc

SEQ ID NO: 5792969 - DNA, 22 bp, Homo sapiens
tcccatctggctttttctgcca

SEQ ID NO: 5792970 - DNA, 17 bp, Homo sapiens
tcccatctgggagtccc

SEQ ID NO: 5792971 - DNA, 23 bp, Homo sapiens
tcccatctgggagtccccttttc

SEQ ID NO: 5792972 - DNA, 19 bp, Homo sapiens
tcccatcttaactctttgc

SEQ ID NO: 5792973 - DNA, 14 bp, Homo sapiens
tcccatcttggcct

SEQ ID NO: 5792974 - DNA, 14 bp, Homo sapiens
tcccatgaacacac

SEQ ID NO: 5792975 - DNA, 16 bp, Homo sapiens
tcccatgaacacactg

SEQ ID NO: 5792976 - DNA, 17 bp, Homo sapiens
tcccatgaacacactgt

SEQ ID NO: 5792977 - DNA, 19 bp, Homo sapiens
tcccatgaacacactgtgt

SEQ ID NO: 5792978 - DNA, 14 bp, Homo sapiens
tcccatgaagcctt

SEQ ID NO: 5792979 - DNA, 19 bp, Homo sapiens
tcccatgaagccttttgaa

SEQ ID NO: 5792980 - DNA, 15 bp, Homo sapiens
tcccatgaatatcaa

SEQ ID NO: 5792981 - DNA, 14 bp, Homo sapiens
tcccatgacccacc

SEQ ID NO: 5792982 - DNA, 16 bp, Homo sapiens
tcccatgactcttgga

SEQ ID NO: 5792983 - DNA, 15 bp, Homo sapiens
tcccatgactgcacc

SEQ ID NO: 5792984 - DNA, 21 bp, Homo sapiens
tcccatgactgcacccagctc

SEQ ID NO: 5792985 - DNA, 20 bp, Homo sapiens
tcccatgagactgccctgcc

SEQ ID NO: 5792986 - DNA, 20 bp, Homo sapiens
tcccatgagcctcagcatcc

SEQ ID NO: 5792987 - DNA, 16 bp, Homo sapiens
tcccatgatccagaac

SEQ ID NO: 5792988 - DNA, 12 bp, Homo sapiens
tcccatgatgta

SEQ ID NO: 5792989 - DNA, 19 bp, Homo sapiens
tcccatgatttcatgtact

SEQ ID NO: 5792990 - DNA, 17 bp, Homo sapiens
tcccatgcaagtagctg

SEQ ID NO: 5792991 - DNA, 19 bp, Homo sapiens
tcccatgcacaactctcca

SEQ ID NO: 5792992 - DNA, 21 bp, Homo sapiens
tcccatgcacacaaacacctc

SEQ ID NO: 5792993 - DNA, 12 bp, Homo sapiens
tcccatgccctg

SEQ ID NO: 5792994 - DNA, 23 bp, Homo sapiens
tcccatgccggtacacagccagt

SEQ ID NO: 5792995 - DNA, 16 bp, Homo sapiens
tcccatgcctgcaacc

SEQ ID NO: 5792996 - DNA, 12 bp, Homo sapiens
tcccatgcctgt

SEQ ID NO: 5792997 - DNA, 17 bp, Homo sapiens
tcccatgcctgtctctg

SEQ ID NO: 5792998 - DNA, 15 bp, Homo sapiens
tcccatgctgaatta

SEQ ID NO: 5792999 - DNA, 19 bp, Homo sapiens
tcccatgctgaattatttt

SEQ ID NO: 5793000 - DNA, 22 bp, Homo sapiens
tcccatggacactccagtgcca

SEQ ID NO: 5793001 - DNA, 13 bp, Homo sapiens
tcccatggagccc

SEQ ID NO: 5793002 - DNA, 15 bp, Homo sapiens
tcccatggagcccca

SEQ ID NO: 5793003 - DNA, 16 bp, Homo sapiens
tcccatggagccccag

SEQ ID NO: 5793004 - DNA, 21 bp, Homo sapiens
tcccatggagccccagccccc

SEQ ID NO: 5793005 - DNA, 21 bp, Homo sapiens
tcccatggagttgccaactat

SEQ ID NO: 5793006 - DNA, 13 bp, Homo sapiens
tcccatggcctgc

SEQ ID NO: 5793007 - DNA, 16 bp, Homo sapiens
tcccatggccttccct

SEQ ID NO: 5793008 - DNA, 24 bp, Homo sapiens
tcccatggctgaagctggagcagc

SEQ ID NO: 5793009 - DNA, 20 bp, Homo sapiens
tcccatggctttgtgctgct

SEQ ID NO: 5793010 - DNA, 14 bp, Homo sapiens
tcccatgggctagg

SEQ ID NO: 5793011 - DNA, 18 bp, Homo sapiens
tcccatgggggtgctgca

SEQ ID NO: 5793012 - DNA, 23 bp, Homo sapiens
tcccatggtagactgtgacacag

SEQ ID NO: 5793013 - DNA, 11 bp, Homo sapiens
tcccatggtgc

SEQ ID NO: 5793014 - DNA, 23 bp, Homo sapiens
tcccatggtgcccgtgcctctgt

SEQ ID NO: 5793015 - DNA, 16 bp, Homo sapiens
tcccatggtgtatgtg

SEQ ID NO: 5793016 - DNA, 18 bp, Homo sapiens
tcccatgtaacagaaagg

SEQ ID NO: 5793017 - DNA, 13 bp, Homo sapiens
tcccatgtagccc

SEQ ID NO: 5793018 - DNA, 15 bp, Homo sapiens
tcccatgtagccccc

SEQ ID NO: 5793019 - DNA, 22 bp, Homo sapiens
tcccatgtagccccctggcctc

SEQ ID NO: 5793020 - DNA, 13 bp, Homo sapiens
tcccatgtatgga

SEQ ID NO: 5793021 - DNA, 13 bp, Homo sapiens
tcccatgtatttg

SEQ ID NO: 5793022 - DNA, 18 bp, Homo sapiens
tcccatgtcacctcagct

SEQ ID NO: 5793023 - DNA, 22 bp, Homo sapiens
tcccatgtgggatgagttttta

SEQ ID NO: 5793024 - DNA, 21 bp, Homo sapiens
tcccatgtgtgactccagcct

SEQ ID NO: 5793025 - DNA, 23 bp, Homo sapiens
tcccatgtgtgatgctgacacca

SEQ ID NO: 5793026 - DNA, 18 bp, Homo sapiens
tcccatgttgaagtaatt

SEQ ID NO: 5793027 - DNA, 16 bp, Homo sapiens
tcccatgttgcatgcc

SEQ ID NO: 5793028 - DNA, 23 bp, Homo sapiens
tcccatgttgggtttgagacaga

SEQ ID NO: 5793029 - DNA, 16 bp, Homo sapiens
tcccattagcaaaaat

SEQ ID NO: 5793030 - DNA, 21 bp, Homo sapiens
tcccattaggacaatcagtcc

SEQ ID NO: 5793031 - DNA, 15 bp, Homo sapiens
tcccattatatttat

SEQ ID NO: 5793032 - DNA, 18 bp, Homo sapiens
tcccattatatttattgt

SEQ ID NO: 5793033 - DNA, 15 bp, Homo sapiens
tcccattattatttc

SEQ ID NO: 5793034 - DNA, 17 bp, Homo sapiens
tcccattattatttctg

SEQ ID NO: 5793035 - DNA, 19 bp, Homo sapiens
tcccattattatttctgtt

SEQ ID NO: 5793036 - DNA, 19 bp, Homo sapiens
tcccattcaccctgtgtaa

SEQ ID NO: 5793037 - DNA, 14 bp, Homo sapiens
tcccattccaggca

SEQ ID NO: 5793038 - DNA, 12 bp, Homo sapiens
tcccattcccct

SEQ ID NO: 5793039 - DNA, 13 bp, Homo sapiens
tcccattccctgg

SEQ ID NO: 5793040 - DNA, 14 bp, Homo sapiens
tcccattcctccct

SEQ ID NO: 5793041 - DNA, 15 bp, Homo sapiens
tcccattcctgaaga

SEQ ID NO: 5793042 - DNA, 17 bp, Homo sapiens
tcccattcctgaagaac

SEQ ID NO: 5793043 - DNA, 12 bp, Homo sapiens
tcccattctaga

SEQ ID NO: 5793044 - DNA, 14 bp, Homo sapiens
tcccattctagatc

SEQ ID NO: 5793045 - DNA, 18 bp, Homo sapiens
tcccattctatgtgtcat

SEQ ID NO: 5793046 - DNA, 19 bp, Homo sapiens
tcccattctccactcactg

SEQ ID NO: 5793047 - DNA, 16 bp, Homo sapiens
tcccattctccatttg

SEQ ID NO: 5793048 - DNA, 19 bp, Homo sapiens
tcccattctccatttgtta

SEQ ID NO: 5793049 - DNA, 13 bp, Homo sapiens
tcccattctgcac

SEQ ID NO: 5793050 - DNA, 14 bp, Homo sapiens
tcccattctgcccc

SEQ ID NO: 5793051 - DNA, 14 bp, Homo sapiens
tcccattgaaaatg

SEQ ID NO: 5793052 - DNA, 15 bp, Homo sapiens
tcccattgcccagtg

SEQ ID NO: 5793053 - DNA, 14 bp, Homo sapiens
tcccattgccctgg

SEQ ID NO: 5793054 - DNA, 15 bp, Homo sapiens
tcccattgtcttctg

SEQ ID NO: 5793055 - DNA, 22 bp, Homo sapiens
tcccattgtcttctgacctcta

SEQ ID NO: 5793056 - DNA, 15 bp, Homo sapiens
tcccattgtgacagc

SEQ ID NO: 5793057 - DNA, 16 bp, Homo sapiens
tcccattgtggctcct

SEQ ID NO: 5793058 - DNA, 13 bp, Homo sapiens
tcccatttcagga

SEQ ID NO: 5793059 - DNA, 16 bp, Homo sapiens
tcccatttcaggaatt

SEQ ID NO: 5793060 - DNA, 16 bp, Homo sapiens
tcccatttcctgatct

SEQ ID NO: 5793061 - DNA, 17 bp, Homo sapiens
tcccatttcctgatcta

SEQ ID NO: 5793062 - DNA, 13 bp, Homo sapiens
tcccatttcctgt

SEQ ID NO: 5793063 - DNA, 20 bp, Homo sapiens
tcccatttcctgtcattttt

SEQ ID NO: 5793064 - DNA, 12 bp, Homo sapiens
tcccatttcctt

SEQ ID NO: 5793065 - DNA, 14 bp, Homo sapiens
tcccatttccttgg

SEQ ID NO: 5793066 - DNA, 20 bp, Homo sapiens
tcccatttccttggaggcca

SEQ ID NO: 5793067 - DNA, 23 bp, Homo sapiens
tcccatttctaaagctgaatgtc

SEQ ID NO: 5793068 - DNA, 21 bp, Homo sapiens
tcccatttctaaaggcctctt

SEQ ID NO: 5793069 - DNA, 16 bp, Homo sapiens
tcccatttctcactga

SEQ ID NO: 5793070 - DNA, 14 bp, Homo sapiens
tcccatttcttaat

SEQ ID NO: 5793071 - DNA, 15 bp, Homo sapiens
tcccatttcttccca

SEQ ID NO: 5793072 - DNA, 22 bp, Homo sapiens
tcccatttgcagaccaggaagg

SEQ ID NO: 5793073 - DNA, 20 bp, Homo sapiens
tcccatttgcaggatctgtc

SEQ ID NO: 5793074 - DNA, 22 bp, Homo sapiens
tcccatttgcatatcacccttc

SEQ ID NO: 5793075 - DNA, 14 bp, Homo sapiens
tcccatttgtaatt

SEQ ID NO: 5793076 - DNA, 16 bp, Homo sapiens
tcccatttgtgccaga

SEQ ID NO: 5793077 - DNA, 16 bp, Homo sapiens
tcccatttgttgctgc

SEQ ID NO: 5793078 - DNA, 18 bp, Homo sapiens
tcccatttgttgctgctg

SEQ ID NO: 5793079 - DNA, 19 bp, Homo sapiens
tcccatttgttgctgctgc

SEQ ID NO: 5793080 - DNA, 20 bp, Homo sapiens
tcccattttcatcctgagcc

SEQ ID NO: 5793081 - DNA, 13 bp, Homo sapiens
tcccattttcccc

SEQ ID NO: 5793082 - DNA, 18 bp, Homo sapiens
tcccattttccccctgtg

SEQ ID NO: 5793083 - DNA, 22 bp, Homo sapiens
tcccattttccccttcctcatt

SEQ ID NO: 5793084 - DNA, 22 bp, Homo sapiens
tcccattttggtgtgcatctgt

SEQ ID NO: 5793085 - DNA, 14 bp, Homo sapiens
tcccatttttactt

SEQ ID NO: 5793086 - DNA, 22 bp, Homo sapiens
tccccaaaaacctcacccgagg

SEQ ID NO: 5793087 - DNA, 14 bp, Homo sapiens
tccccaaaacaaag

SEQ ID NO: 5793088 - DNA, 19 bp, Homo sapiens
tccccaaaagcgtgagctt

SEQ ID NO: 5793089 - DNA, 18 bp, Homo sapiens
tccccaaaccataaaacc

SEQ ID NO: 5793090 - DNA, 20 bp, Homo sapiens
tccccaaactgtgccctgcc

SEQ ID NO: 5793091 - DNA, 17 bp, Homo sapiens
tccccaaagccactgga

SEQ ID NO: 5793092 - DNA, 20 bp, Homo sapiens
tccccaaagccactggaagg

SEQ ID NO: 5793093 - DNA, 21 bp, Homo sapiens
tccccaaaggccaacagcatt

SEQ ID NO: 5793094 - DNA, 22 bp, Homo sapiens
tccccaaaggctttgccctgct

SEQ ID NO: 5793095 - DNA, 16 bp, Homo sapiens
tccccaaaggtccgca

SEQ ID NO: 5793096 - DNA, 20 bp, Homo sapiens
tccccaaagtaccacactga

SEQ ID NO: 5793097 - DNA, 14 bp, Homo sapiens
tccccaaatccgaa

SEQ ID NO: 5793098 - DNA, 15 bp, Homo sapiens
tccccaaatggctgc

SEQ ID NO: 5793099 - DNA, 18 bp, Homo sapiens
tccccaacacctgcctct

SEQ ID NO: 5793100 - DNA, 20 bp, Homo sapiens
tccccaacacctgcctctga

SEQ ID NO: 5793101 - DNA, 14 bp, Homo sapiens
tccccaacagtgtg

SEQ ID NO: 5793102 - DNA, 23 bp, Homo sapiens
tccccaacagtgtgaagttagaa

SEQ ID NO: 5793103 - DNA, 14 bp, Homo sapiens
tccccaaccccaga

SEQ ID NO: 5793104 - DNA, 16 bp, Homo sapiens
tccccaacccccaact

SEQ ID NO: 5793105 - DNA, 15 bp, Homo sapiens
tccccaacccctctc

SEQ ID NO: 5793106 - DNA, 20 bp, Homo sapiens
tccccgaggttgtggggagg

SEQ ID NO: 5793107 - DNA, 15 bp, Homo sapiens
tccccgagtcctcag

SEQ ID NO: 5793108 - DNA, 14 bp, Homo sapiens
tccccgagtgccta

SEQ ID NO: 5793109 - DNA, 15 bp, Homo sapiens
tccccgatccccgac

SEQ ID NO: 5793110 - DNA, 14 bp, Homo sapiens
tccccgatgctgac

SEQ ID NO: 5793111 - DNA, 16 bp, Homo sapiens
tccccgatgctgacct

SEQ ID NO: 5793112 - DNA, 20 bp, Homo sapiens
tccccgcactgggcttgggg

SEQ ID NO: 5793113 - DNA, 14 bp, Homo sapiens
tccccgcagagctc

SEQ ID NO: 5793114 - DNA, 18 bp, Homo sapiens
tccccgcagagctccctt

SEQ ID NO: 5793115 - DNA, 18 bp, Homo sapiens
tccccgcagccctctcca

SEQ ID NO: 5793116 - DNA, 20 bp, Homo sapiens
tccccgcagtgtgcactaag

SEQ ID NO: 5793117 - DNA, 21 bp, Homo sapiens
tccccgcagtgtgcactaagg

SEQ ID NO: 5793118 - DNA, 22 bp, Homo sapiens
tccccgcagtgtgcactaaggg

SEQ ID NO: 5793119 - DNA, 19 bp, Homo sapiens
tccccgcattccaggctcc

SEQ ID NO: 5793120 - DNA, 15 bp, Homo sapiens
tccccgccccctgaa

SEQ ID NO: 5793121 - DNA, 12 bp, Homo sapiens
tccccgcccctg

SEQ ID NO: 5793122 - DNA, 18 bp, Homo sapiens
tccccgcccctgtggccc

SEQ ID NO: 5793123 - DNA, 20 bp, Homo sapiens
tccccgcccgccctcctctg

SEQ ID NO: 5793124 - DNA, 16 bp, Homo sapiens
tccccgccctctctca

SEQ ID NO: 5793125 - DNA, 13 bp, Homo sapiens
tccccgccctttt

SEQ ID NO: 5793126 - DNA, 13 bp, Homo sapiens
tccccgcctccac

SEQ ID NO: 5793127 - DNA, 14 bp, Homo sapiens
tccccgcctccact

SEQ ID NO: 5793128 - DNA, 16 bp, Homo sapiens
tccccgcctccactct

SEQ ID NO: 5793129 - DNA, 17 bp, Homo sapiens
tccccgcctccactcta

SEQ ID NO: 5793130 - DNA, 17 bp, Homo sapiens
tccccgcctcctcccac

SEQ ID NO: 5793131 - DNA, 18 bp, Homo sapiens
tccccgcctcctccctgc

SEQ ID NO: 5793132 - DNA, 19 bp, Homo sapiens
tccccgcctggccaggagc

SEQ ID NO: 5793133 - DNA, 20 bp, Homo sapiens
tccccgcctggccagggcag

SEQ ID NO: 5793134 - DNA, 11 bp, Homo sapiens
tccccgcctgt

SEQ ID NO: 5793135 - DNA, 18 bp, Homo sapiens
tccccgcctgtcctgcct

SEQ ID NO: 5793136 - DNA, 12 bp, Homo sapiens
tccccgccttcc

SEQ ID NO: 5793137 - DNA, 18 bp, Homo sapiens
tccccgcgcgttccttcg

SEQ ID NO: 5793138 - DNA, 17 bp, Homo sapiens
tccccgctctccctgtc

SEQ ID NO: 5793139 - DNA, 18 bp, Homo sapiens
tccccgctctccctgtca

SEQ ID NO: 5793140 - DNA, 13 bp, Homo sapiens
tccccgctctgcc

SEQ ID NO: 5793141 - DNA, 15 bp, Homo sapiens
tccccgctctgccgc

SEQ ID NO: 5793142 - DNA, 14 bp, Homo sapiens
tccccgctctggat

SEQ ID NO: 5793143 - DNA, 21 bp, Homo sapiens
tccccgctgccctttggccaa

SEQ ID NO: 5793144 - DNA, 15 bp, Homo sapiens
tccccgctgctgtgc

SEQ ID NO: 5793145 - DNA, 16 bp, Homo sapiens
tccccgctgctgtgca

SEQ ID NO: 5793146 - DNA, 16 bp, Homo sapiens
tccccgctggctgggg

SEQ ID NO: 5793147 - DNA, 17 bp, Homo sapiens
tccccgctggctggggg

SEQ ID NO: 5793148 - DNA, 12 bp, Homo sapiens
tccccgcttccc

SEQ ID NO: 5793149 - DNA, 21 bp, Homo sapiens
tccccggacaagcccaggaca

SEQ ID NO: 5793150 - DNA, 20 bp, Homo sapiens
tccccggacatactctctgc

SEQ ID NO: 5793151 - DNA, 20 bp, Homo sapiens
tccccggacgcatgcagggc

SEQ ID NO: 5793152 - DNA, 15 bp, Homo sapiens
tccccggagctggga

SEQ ID NO: 5793153 - DNA, 15 bp, Homo sapiens
tccccggagggctgc

SEQ ID NO: 5793154 - DNA, 20 bp, Homo sapiens
tccccggcaccctctggccg

SEQ ID NO: 5793155 - DNA, 16 bp, Homo sapiens
tccccggcaggcctga

SEQ ID NO: 5793156 - DNA, 16 bp, Homo sapiens
tccccggccacatgcc

SEQ ID NO: 5793157 - DNA, 19 bp, Homo sapiens
tccccggccacgtctgtgc

SEQ ID NO: 5793158 - DNA, 15 bp, Homo sapiens
tccccggccctacca

SEQ ID NO: 5793159 - DNA, 17 bp, Homo sapiens
tccccggccctaccagc

SEQ ID NO: 5793160 - DNA, 21 bp, Homo sapiens
tccccggcggggtgcctgctg

SEQ ID NO: 5793161 - DNA, 14 bp, Homo sapiens
tccccgggcagcag

SEQ ID NO: 5793162 - DNA, 11 bp, Homo sapiens
tccccggggcc

SEQ ID NO: 5793163 - DNA, 21 bp, Homo sapiens
tccccggggttccccacacag

SEQ ID NO: 5793164 - DNA, 22 bp, Homo sapiens
tccccggtaatgtcactgtttt

SEQ ID NO: 5793165 - DNA, 23 bp, Homo sapiens
tccccggtaatgtcactgttttt

SEQ ID NO: 5793166 - DNA, 23 bp, Homo sapiens
tccccggttgctggtcaggtccc

SEQ ID NO: 5793167 - DNA, 17 bp, Homo sapiens
tccccgtcccctgcagc

SEQ ID NO: 5793168 - DNA, 15 bp, Homo sapiens
tccccgtctctgccc

SEQ ID NO: 5793169 - DNA, 17 bp, Homo sapiens
tccccgtctctgccctg

SEQ ID NO: 5793170 - DNA, 18 bp, Homo sapiens
tccccgtctctgccctgg

SEQ ID NO: 5793171 - DNA, 19 bp, Homo sapiens
tccccgtctctgccctggg

SEQ ID NO: 5793172 - DNA, 20 bp, Homo sapiens
tccccgtgagcactgcgtac

SEQ ID NO: 5793173 - DNA, 16 bp, Homo sapiens
tccccgtgctcacagt

SEQ ID NO: 5793174 - DNA, 19 bp, Homo sapiens
tccccgtgctcacagtagc

SEQ ID NO: 5793175 - DNA, 18 bp, Homo sapiens
tccccgtggatggtctcc

SEQ ID NO: 5793176 - DNA, 17 bp, Homo sapiens
tccccgtgggccatggc

SEQ ID NO: 5793177 - DNA, 13 bp, Homo sapiens
tccccgtggtctc

SEQ ID NO: 5793178 - DNA, 19 bp, Homo sapiens
tccccgtgtcctctccctg

SEQ ID NO: 5793179 - DNA, 19 bp, Homo sapiens
tccccgtgtgccccaagag

SEQ ID NO: 5793180 - DNA, 20 bp, Homo sapiens
tccccgttcctgacatcaca

SEQ ID NO: 5793181 - DNA, 23 bp, Homo sapiens
tcccctaaagccaggctcaggag

SEQ ID NO: 5793182 - DNA, 22 bp, Homo sapiens
tcccctaaagcctcaaaacaaa

SEQ ID NO: 5793183 - DNA, 17 bp, Homo sapiens
tcccctaacccccagtc

SEQ ID NO: 5793184 - DNA, 19 bp, Homo sapiens
tcccctaacccccagtcct

SEQ ID NO: 5793185 - DNA, 14 bp, Homo sapiens
tcccctaacctcat

SEQ ID NO: 5793186 - DNA, 16 bp, Homo sapiens
tcccctacccaaccct

SEQ ID NO: 5793187 - DNA, 16 bp, Homo sapiens
tcccctagatccagaa

SEQ ID NO: 5793188 - DNA, 15 bp, Homo sapiens
tcccctagctcacca

SEQ ID NO: 5793189 - DNA, 17 bp, Homo sapiens
tcccctagctcaccagg

SEQ ID NO: 5793190 - DNA, 20 bp, Homo sapiens
tcccctagtaagtgccttcc

SEQ ID NO: 5793191 - DNA, 21 bp, Homo sapiens
tcccctatccacccagcccat

SEQ ID NO: 5793192 - DNA, 11 bp, Homo sapiens
tcccctatgat

SEQ ID NO: 5793193 - DNA, 15 bp, Homo sapiens
tcccctatgccacta

SEQ ID NO: 5793194 - DNA, 14 bp, Homo sapiens
tcccctatgctggt

SEQ ID NO: 5793195 - DNA, 24 bp, Homo sapiens
tcccctatgctggtagatgctgag

SEQ ID NO: 5793196 - DNA, 21 bp, Homo sapiens
tcccctatggaatttataatt

SEQ ID NO: 5793197 - DNA, 23 bp, Homo sapiens
tcccctatgtggaagtggggcgg

SEQ ID NO: 5793198 - DNA, 21 bp, Homo sapiens
tcccctattgcgctctcaaga

SEQ ID NO: 5793199 - DNA, 18 bp, Homo sapiens
tcccctcaacaccctgct

SEQ ID NO: 5793200 - DNA, 23 bp, Homo sapiens
tcccctcaaggacaaagtctcca

SEQ ID NO: 5793201 - DNA, 20 bp, Homo sapiens
tcccctcacacacacccccc

SEQ ID NO: 5793202 - DNA, 13 bp, Homo sapiens
tcccctcacagac

SEQ ID NO: 5793203 - DNA, 16 bp, Homo sapiens
tcccctcacagcctct

SEQ ID NO: 5793204 - DNA, 18 bp, Homo sapiens
tcccctcacagcctctga

SEQ ID NO: 5793205 - DNA, 21 bp, Homo sapiens
tcccctcacagcctctgaccc

SEQ ID NO: 5793206 - DNA, 18 bp, Homo sapiens
tcccctcacatcctcctg

SEQ ID NO: 5793207 - DNA, 19 bp, Homo sapiens
tcccctcacccgctgccca

SEQ ID NO: 5793208 - DNA, 22 bp, Homo sapiens
tcccctcacccgctgcccagcc

SEQ ID NO: 5793209 - DNA, 17 bp, Homo sapiens
tcccctcactctgtcag

SEQ ID NO: 5793210 - DNA, 20 bp, Homo sapiens
tcccctcacttaaccacccc

SEQ ID NO: 5793211 - DNA, 13 bp, Homo sapiens
tcccctcagagcc

SEQ ID NO: 5793212 - DNA, 15 bp, Homo sapiens
tcccctcagagccca

SEQ ID NO: 5793213 - DNA, 15 bp, Homo sapiens
tcccctcagagctct

SEQ ID NO: 5793214 - DNA, 13 bp, Homo sapiens
tcccctcagccaa

SEQ ID NO: 5793215 - DNA, 12 bp, Homo sapiens
tcccctcagcct

SEQ ID NO: 5793216 - DNA, 13 bp, Homo sapiens
tcccctcagcctg

SEQ ID NO: 5793217 - DNA, 16 bp, Homo sapiens
tcccctcagcctgccc

SEQ ID NO: 5793218 - DNA, 21 bp, Homo sapiens
tcccctcagcctgcccacctc

SEQ ID NO: 5793219 - DNA, 12 bp, Homo sapiens
tcccctcagctc

SEQ ID NO: 5793220 - DNA, 15 bp, Homo sapiens
tcccctcagctccag

SEQ ID NO: 5793221 - DNA, 19 bp, Homo sapiens
tcccctccaaaatgtgcct

SEQ ID NO: 5793222 - DNA, 13 bp, Homo sapiens
tcccctccaacct

SEQ ID NO: 5793223 - DNA, 14 bp, Homo sapiens
tcccctccacagct

SEQ ID NO: 5793224 - DNA, 17 bp, Homo sapiens
tcccctccacagctgca

SEQ ID NO: 5793225 - DNA, 19 bp, Homo sapiens
tcccctccacagctgcagc

SEQ ID NO: 5793226 - DNA, 12 bp, Homo sapiens
tcccctccactg

SEQ ID NO: 5793227 - DNA, 12 bp, Homo sapiens
tcccctccagac

SEQ ID NO: 5793228 - DNA, 14 bp, Homo sapiens
tcccctccagaccc

SEQ ID NO: 5793229 - DNA, 21 bp, Homo sapiens
tcccctccagacccctaccct

SEQ ID NO: 5793230 - DNA, 15 bp, Homo sapiens
tcccctccaggaaga

SEQ ID NO: 5793231 - DNA, 13 bp, Homo sapiens
tcccctccaggag

SEQ ID NO: 5793232 - DNA, 19 bp, Homo sapiens
tcccctccaggagggacca

SEQ ID NO: 5793233 - DNA, 14 bp, Homo sapiens
tcccctccatccct

SEQ ID NO: 5793234 - DNA, 19 bp, Homo sapiens
tcccctcccacccacagcc

SEQ ID NO: 5793235 - DNA, 15 bp, Homo sapiens
tcccctcccagccct

SEQ ID NO: 5793236 - DNA, 21 bp, Homo sapiens
tcccctcccaggggagccagc

SEQ ID NO: 5793237 - DNA, 12 bp, Homo sapiens
tcccctcccagt

SEQ ID NO: 5793238 - DNA, 13 bp, Homo sapiens
tcccctcccagtc

SEQ ID NO: 5793239 - DNA, 12 bp, Homo sapiens
tcccctccccag

SEQ ID NO: 5793240 - DNA, 19 bp, Homo sapiens
tcccctccccatctgtgtt

SEQ ID NO: 5793241 - DNA, 21 bp, Homo sapiens
tcccctccccatctgtgttct

SEQ ID NO: 5793242 - DNA, 22 bp, Homo sapiens
tcccctccccatctgtgttcta

SEQ ID NO: 5793243 - DNA, 19 bp, Homo sapiens
tcccctcccccacccctgc

SEQ ID NO: 5793244 - DNA, 20 bp, Homo sapiens
tcccctcccccacccctgct

SEQ ID NO: 5793245 - DNA, 21 bp, Homo sapiens
tcccctcccccacccctgctg

SEQ ID NO: 5793246 - DNA, 18 bp, Homo sapiens
tcccctcccccactcctc

SEQ ID NO: 5793247 - DNA, 16 bp, Homo sapiens
tcccctcccccagaaa

SEQ ID NO: 5793248 - DNA, 15 bp, Homo sapiens
tcccctcccccatcc

SEQ ID NO: 5793249 - DNA, 13 bp, Homo sapiens
tcccctcccccct

SEQ ID NO: 5793250 - DNA, 12 bp, Homo sapiens
tcccctccccct

SEQ ID NO: 5793251 - DNA, 20 bp, Homo sapiens
tcccctccccgccccctgaa

SEQ ID NO: 5793252 - DNA, 20 bp, Homo sapiens
tcccctccccgcctggccag

SEQ ID NO: 5793253 - DNA, 18 bp, Homo sapiens
tcccctccccggccctac

SEQ ID NO: 5793254 - DNA, 12 bp, Homo sapiens
tcccctcccctc

SEQ ID NO: 5793255 - DNA, 14 bp, Homo sapiens
tcccctcccctgct

SEQ ID NO: 5793256 - DNA, 16 bp, Homo sapiens
tcccctcccctgctgc

SEQ ID NO: 5793257 - DNA, 23 bp, Homo sapiens
tcccctcccgcttcctccggctg

SEQ ID NO: 5793258 - DNA, 15 bp, Homo sapiens
tcccctccctgcctg

SEQ ID NO: 5793259 - DNA, 16 bp, Homo sapiens
tcccctccctgcctgc

SEQ ID NO: 5793260 - DNA, 19 bp, Homo sapiens
tcccctccctgcctgctcc

SEQ ID NO: 5793261 - DNA, 19 bp, Homo sapiens
tcccctccctggctcccat

SEQ ID NO: 5793262 - DNA, 13 bp, Homo sapiens
tcccctccctggg

SEQ ID NO: 5793263 - DNA, 16 bp, Homo sapiens
tcccctccctgggttc

SEQ ID NO: 5793264 - DNA, 17 bp, Homo sapiens
tcccctccgccaggcga

SEQ ID NO: 5793265 - DNA, 18 bp, Homo sapiens
tcccctccggactggtgc

SEQ ID NO: 5793266 - DNA, 13 bp, Homo sapiens
tcccctcctaccc

SEQ ID NO: 5793267 - DNA, 17 bp, Homo sapiens
tcccctcctacccctcc

SEQ ID NO: 5793268 - DNA, 19 bp, Homo sapiens
tcccctcctacccctccca

SEQ ID NO: 5793269 - DNA, 22 bp, Homo sapiens
tcccctcctacccctcccagct

SEQ ID NO: 5793270 - DNA, 15 bp, Homo sapiens
tcccctcctagcaca

SEQ ID NO: 5793271 - DNA, 16 bp, Homo sapiens
tcccctcctccactct

SEQ ID NO: 5793272 - DNA, 15 bp, Homo sapiens
tcccctcctccctgg

SEQ ID NO: 5793273 - DNA, 12 bp, Homo sapiens
tcccctcctctg

SEQ ID NO: 5793274 - DNA, 16 bp, Homo sapiens
tcccctcctgcacaca

SEQ ID NO: 5793275 - DNA, 12 bp, Homo sapiens
tcccctcctgta

SEQ ID NO: 5793276 - DNA, 16 bp, Homo sapiens
tcccctccttccctca

SEQ ID NO: 5793277 - DNA, 20 bp, Homo sapiens
tcccctccttgcctcctgtg

SEQ ID NO: 5793278 - DNA, 22 bp, Homo sapiens
tcccctccttgcctcctgtgta

SEQ ID NO: 5793279 - DNA, 18 bp, Homo sapiens
tcccctccttggctttat

SEQ ID NO: 5793280 - DNA, 18 bp, Homo sapiens
tcccctccttgggcactt

SEQ ID NO: 5793281 - DNA, 18 bp, Homo sapiens
tcccctcctttgtctttt

SEQ ID NO: 5793282 - DNA, 21 bp, Homo sapiens
tcccctcgacagctctctggg

SEQ ID NO: 5793283 - DNA, 19 bp, Homo sapiens
tcccctcgcccatcagtgc

SEQ ID NO: 5793284 - DNA, 15 bp, Homo sapiens
tcccctcgctgtcct

SEQ ID NO: 5793285 - DNA, 15 bp, Homo sapiens
tcccgggctgtccac

SEQ ID NO: 5793286 - DNA, 16 bp, Homo sapiens
tcccggggccagcact

SEQ ID NO: 5793287 - DNA, 13 bp, Homo sapiens
tcccggggccatg

SEQ ID NO: 5793288 - DNA, 17 bp, Homo sapiens
tcccggggcctggacag

SEQ ID NO: 5793289 - DNA, 18 bp, Homo sapiens
tcccggggcctggacagg

SEQ ID NO: 5793290 - DNA, 17 bp, Homo sapiens
tcccgggggcactgcct

SEQ ID NO: 5793291 - DNA, 23 bp, Homo sapiens
tcccggggtgcccgtgtggcctg

SEQ ID NO: 5793292 - DNA, 15 bp, Homo sapiens
tcccgggttagcctg

SEQ ID NO: 5793293 - DNA, 21 bp, Homo sapiens
tcccggtgcagaacaggggca

SEQ ID NO: 5793294 - DNA, 14 bp, Homo sapiens
tcccggtgtgcagc

SEQ ID NO: 5793295 - DNA, 15 bp, Homo sapiens
tcccggttcaccttg

SEQ ID NO: 5793296 - DNA, 16 bp, Homo sapiens
tcccggttcaggacca

SEQ ID NO: 5793297 - DNA, 14 bp, Homo sapiens
tcccgtacctcttc

SEQ ID NO: 5793298 - DNA, 20 bp, Homo sapiens
tcccgtacctcttcccatga

SEQ ID NO: 5793299 - DNA, 21 bp, Homo sapiens
tcccgtacgtgttcattttat

SEQ ID NO: 5793300 - DNA, 15 bp, Homo sapiens
tcccgtagctgccag

SEQ ID NO: 5793301 - DNA, 16 bp, Homo sapiens
tcccgtagctgccagt

SEQ ID NO: 5793302 - DNA, 16 bp, Homo sapiens
tcccgtagtctcctgg

SEQ ID NO: 5793303 - DNA, 17 bp, Homo sapiens
tcccgtagtctcctggg

SEQ ID NO: 5793304 - DNA, 15 bp, Homo sapiens
tcccgtataataaaa

SEQ ID NO: 5793305 - DNA, 17 bp, Homo sapiens
tcccgtatcacagtgtt

SEQ ID NO: 5793306 - DNA, 21 bp, Homo sapiens
tcccgtatcacagtgttttta

SEQ ID NO: 5793307 - DNA, 17 bp, Homo sapiens
tcccgtatgctttcttc

SEQ ID NO: 5793308 - DNA, 20 bp, Homo sapiens
tcccgtcacccctgtttctg

SEQ ID NO: 5793309 - DNA, 20 bp, Homo sapiens
tcccgtcccatatcctgcct

SEQ ID NO: 5793310 - DNA, 23 bp, Homo sapiens
tcccgtccgtccgcccgcccacc

SEQ ID NO: 5793311 - DNA, 17 bp, Homo sapiens
tcccgtctggacctggg

SEQ ID NO: 5793312 - DNA, 20 bp, Homo sapiens
tcccgtgaaaacactcgtgt

SEQ ID NO: 5793313 - DNA, 20 bp, Homo sapiens
tcccgtgaaagtttttaatt

SEQ ID NO: 5793314 - DNA, 14 bp, Homo sapiens
tcccgtgcacctac

SEQ ID NO: 5793315 - DNA, 13 bp, Homo sapiens
tcccgtgcagctt

SEQ ID NO: 5793316 - DNA, 20 bp, Homo sapiens
tcccgtgcatcccccctgct

SEQ ID NO: 5793317 - DNA, 22 bp, Homo sapiens
tcccgtgcatcccccctgctca

SEQ ID NO: 5793318 - DNA, 22 bp, Homo sapiens
tcccgtgcccctttccttcact

SEQ ID NO: 5793319 - DNA, 13 bp, Homo sapiens
tcccgtgcctggg

SEQ ID NO: 5793320 - DNA, 14 bp, Homo sapiens
tcccgtgctggaag

SEQ ID NO: 5793321 - DNA, 19 bp, Homo sapiens
tcccgtggatgctctttca

SEQ ID NO: 5793322 - DNA, 21 bp, Homo sapiens
tcccgtggatgctctttcaat

SEQ ID NO: 5793323 - DNA, 14 bp, Homo sapiens
tcccgtggccccag

SEQ ID NO: 5793324 - DNA, 15 bp, Homo sapiens
tcccgtggccccagc

SEQ ID NO: 5793325 - DNA, 19 bp, Homo sapiens
tcccgtggccccagcctgg

SEQ ID NO: 5793326 - DNA, 22 bp, Homo sapiens
tcccgtggccccagcctggccc

SEQ ID NO: 5793327 - DNA, 19 bp, Homo sapiens
tcccgtggggccccggctc

SEQ ID NO: 5793328 - DNA, 17 bp, Homo sapiens
tcccgtgtgtatttcta

SEQ ID NO: 5793329 - DNA, 18 bp, Homo sapiens
tcccgtgtgtatttctaa

SEQ ID NO: 5793330 - DNA, 20 bp, Homo sapiens
tcccgtgtgtggttggaaaa

SEQ ID NO: 5793331 - DNA, 22 bp, Homo sapiens
tcccgtgttgcttcaaactgag

SEQ ID NO: 5793332 - DNA, 15 bp, Homo sapiens
tcccgttccgtggga

SEQ ID NO: 5793333 - DNA, 17 bp, Homo sapiens
tcccgtttccctccagg

SEQ ID NO: 5793334 - DNA, 12 bp, Homo sapiens
tcccgtttcctc

SEQ ID NO: 5793335 - DNA, 20 bp, Homo sapiens
tcccgtttctccacctagac

SEQ ID NO: 5793336 - DNA, 14 bp, Homo sapiens
tcccgttttacaga

SEQ ID NO: 5793337 - DNA, 16 bp, Homo sapiens
tcccgttttccccatg

SEQ ID NO: 5793338 - DNA, 18 bp, Homo sapiens
tccctaaaaacacagaca

SEQ ID NO: 5793339 - DNA, 20 bp, Homo sapiens
tccctaaactgcagcctctc

SEQ ID NO: 5793340 - DNA, 18 bp, Homo sapiens
tccctaaactttggcctt

SEQ ID NO: 5793341 - DNA, 19 bp, Homo sapiens
tccctaaactttggccttt

SEQ ID NO: 5793342 - DNA, 18 bp, Homo sapiens
tccctaaatatacatctg

SEQ ID NO: 5793343 - DNA, 16 bp, Homo sapiens
tccctaacaggctgta

SEQ ID NO: 5793344 - DNA, 16 bp, Homo sapiens
tccctaactctcggga

SEQ ID NO: 5793345 - DNA, 21 bp, Homo sapiens
tccctaacttgtgaagacaat

SEQ ID NO: 5793346 - DNA, 19 bp, Homo sapiens
tccctaagtaagtttcttc

SEQ ID NO: 5793347 - DNA, 22 bp, Homo sapiens
tccctaagtaagtttcttcctg

SEQ ID NO: 5793348 - DNA, 22 bp, Homo sapiens
tccctaagttgctgggattaca

SEQ ID NO: 5793349 - DNA, 14 bp, Homo sapiens
tccctaatgctgca

SEQ ID NO: 5793350 - DNA, 14 bp, Homo sapiens
tccctaatgtgttt

SEQ ID NO: 5793351 - DNA, 21 bp, Homo sapiens
tccctaattctcttcgctgtg

SEQ ID NO: 5793352 - DNA, 23 bp, Homo sapiens
tccctaattctcttcgctgtgat

SEQ ID NO: 5793353 - DNA, 19 bp, Homo sapiens
tccctaattctgccttaaa

SEQ ID NO: 5793354 - DNA, 20 bp, Homo sapiens
tccctaatttaacccagctc

SEQ ID NO: 5793355 - DNA, 13 bp, Homo sapiens
tccctacacacac

SEQ ID NO: 5793356 - DNA, 14 bp, Homo sapiens
tccctacacacaca

SEQ ID NO: 5793357 - DNA, 14 bp, Homo sapiens
tccctacacagggc

SEQ ID NO: 5793358 - DNA, 16 bp, Homo sapiens
tccctacactgatgca

SEQ ID NO: 5793359 - DNA, 18 bp, Homo sapiens
tccctacagaaaagaaat

SEQ ID NO: 5793360 - DNA, 21 bp, Homo sapiens
tccctacaggaggaacagtgg

SEQ ID NO: 5793361 - DNA, 13 bp, Homo sapiens
tccctacatgtat

SEQ ID NO: 5793362 - DNA, 18 bp, Homo sapiens
tccctaccaaaaattgcc

SEQ ID NO: 5793363 - DNA, 18 bp, Homo sapiens
tccctaccacctccccag

SEQ ID NO: 5793364 - DNA, 21 bp, Homo sapiens
tccctaccactgagcccttgc

SEQ ID NO: 5793365 - DNA, 22 bp, Homo sapiens
tccctaccactgagcccttgca

SEQ ID NO: 5793366 - DNA, 19 bp, Homo sapiens
tccctacccaatgtctccc

SEQ ID NO: 5793367 - DNA, 23 bp, Homo sapiens
tccctacccaatgtctcccacac

SEQ ID NO: 5793368 - DNA, 13 bp, Homo sapiens
tccctacccacag

SEQ ID NO: 5793369 - DNA, 13 bp, Homo sapiens
tccctacccactc

SEQ ID NO: 5793370 - DNA, 23 bp, Homo sapiens
tccctaccccagggccctggcca

SEQ ID NO: 5793371 - DNA, 20 bp, Homo sapiens
tccctaccccctaagagcca

SEQ ID NO: 5793372 - DNA, 12 bp, Homo sapiens
tccctacccctc

SEQ ID NO: 5793373 - DNA, 14 bp, Homo sapiens
tccctaccctcgga

SEQ ID NO: 5793374 - DNA, 18 bp, Homo sapiens
tccctaccctcttctcag

SEQ ID NO: 5793375 - DNA, 18 bp, Homo sapiens
tccctaccgacccagggt

SEQ ID NO: 5793376 - DNA, 19 bp, Homo sapiens
tccctaccgagtctcttct

SEQ ID NO: 5793377 - DNA, 21 bp, Homo sapiens
tccctaccgagtctcttctcc

SEQ ID NO: 5793378 - DNA, 22 bp, Homo sapiens
tccctaccgagtctcttctcca

SEQ ID NO: 5793379 - DNA, 21 bp, Homo sapiens
tccctacctcaacctgtaaat

SEQ ID NO: 5793380 - DNA, 13 bp, Homo sapiens
tccctacctcagg

SEQ ID NO: 5793381 - DNA, 15 bp, Homo sapiens
tccctacctccctcc

SEQ ID NO: 5793382 - DNA, 16 bp, Homo sapiens
tccctacctccctcct

SEQ ID NO: 5793383 - DNA, 16 bp, Homo sapiens
tccctaccttgcctcc

SEQ ID NO: 5793384 - DNA, 21 bp, Homo sapiens
tccctactgaagcccttgtga

SEQ ID NO: 5793385 - DNA, 15 bp, Homo sapiens
tccctacttgcagcg

SEQ ID NO: 5793386 - DNA, 13 bp, Homo sapiens
tccctactttctc

SEQ ID NO: 5793387 - DNA, 18 bp, Homo sapiens
tccctagaaacttccaaa

SEQ ID NO: 5793388 - DNA, 20 bp, Homo sapiens
tccctagaaagccatattcc

SEQ ID NO: 5793389 - DNA, 23 bp, Homo sapiens
tccctagaaagccatattccagc

SEQ ID NO: 5793390 - DNA, 12 bp, Homo sapiens
tccctagacttt

SEQ ID NO: 5793391 - DNA, 20 bp, Homo sapiens
tccctagactttaggctttc

SEQ ID NO: 5793392 - DNA, 22 bp, Homo sapiens
tccctagactttaggctttcag

SEQ ID NO: 5793393 - DNA, 13 bp, Homo sapiens
tccctagagagaa

SEQ ID NO: 5793394 - DNA, 14 bp, Homo sapiens
tccctagagagaat

SEQ ID NO: 5793395 - DNA, 19 bp, Homo sapiens
tccctagagagaataaatt

SEQ ID NO: 5793396 - DNA, 22 bp, Homo sapiens
tccctagaggggcaccttttca

SEQ ID NO: 5793397 - DNA, 18 bp, Homo sapiens
tccctagagggttcctgt

SEQ ID NO: 5793398 - DNA, 19 bp, Homo sapiens
tccctagagggttcctgta

SEQ ID NO: 5793399 - DNA, 16 bp, Homo sapiens
tccctagatccaggct

SEQ ID NO: 5793400 - DNA, 17 bp, Homo sapiens
tccctagatccaggctt

SEQ ID NO: 5793401 - DNA, 21 bp, Homo sapiens
tccctagatccaggcttctcc

SEQ ID NO: 5793402 - DNA, 23 bp, Homo sapiens
tccctagatctttctattccaaa

SEQ ID NO: 5793403 - DNA, 16 bp, Homo sapiens
tccctagcaaaatgct

SEQ ID NO: 5793404 - DNA, 14 bp, Homo sapiens
tccctagctcacac

SEQ ID NO: 5793405 - DNA, 14 bp, Homo sapiens
tccctagctctgaa

SEQ ID NO: 5793406 - DNA, 22 bp, Homo sapiens
tccctaggagagtttactgatg

SEQ ID NO: 5793407 - DNA, 16 bp, Homo sapiens
tccctaggcacctctg

SEQ ID NO: 5793408 - DNA, 14 bp, Homo sapiens
tccctaggcctgag

SEQ ID NO: 5793409 - DNA, 16 bp, Homo sapiens
tccctaggtaggcacc

SEQ ID NO: 5793410 - DNA, 16 bp, Homo sapiens
tccctaggtgggtcaa

SEQ ID NO: 5793411 - DNA, 14 bp, Homo sapiens
tccctagttaccca

SEQ ID NO: 5793412 - DNA, 13 bp, Homo sapiens
tccctagttcttt

SEQ ID NO: 5793413 - DNA, 18 bp, Homo sapiens
tccctataataaaggctg

SEQ ID NO: 5793414 - DNA, 16 bp, Homo sapiens
tccctataatgctgga

SEQ ID NO: 5793415 - DNA, 18 bp, Homo sapiens
tccctataccgagaccca

SEQ ID NO: 5793416 - DNA, 14 bp, Homo sapiens
tccctatactgctt

SEQ ID NO: 5793417 - DNA, 15 bp, Homo sapiens
tccctataggaacag

SEQ ID NO: 5793418 - DNA, 16 bp, Homo sapiens
tccctataggaacagc

SEQ ID NO: 5793419 - DNA, 19 bp, Homo sapiens
tccctataggaacagccca

SEQ ID NO: 5793420 - DNA, 17 bp, Homo sapiens
tccctatagtttcacca

SEQ ID NO: 5793421 - DNA, 23 bp, Homo sapiens
tccctatagtttcaccactcctc

SEQ ID NO: 5793422 - DNA, 13 bp, Homo sapiens
tccctatcaaaac

SEQ ID NO: 5793423 - DNA, 22 bp, Homo sapiens
tccctatcaaaacatatcaatt

SEQ ID NO: 5793424 - DNA, 16 bp, Homo sapiens
tccctatccaatcaat

SEQ ID NO: 5793425 - DNA, 23 bp, Homo sapiens
tccctatctattaaagtgacttt

SEQ ID NO: 5793426 - DNA, 20 bp, Homo sapiens
tccctatggagaggcttccc

SEQ ID NO: 5793427 - DNA, 14 bp, Homo sapiens
tccctatgttgcta

SEQ ID NO: 5793428 - DNA, 16 bp, Homo sapiens
tccctatgtttatttt

SEQ ID NO: 5793429 - DNA, 16 bp, Homo sapiens
tccctattagagaaga

SEQ ID NO: 5793430 - DNA, 21 bp, Homo sapiens
tccctattcgtagccatctcc

SEQ ID NO: 5793431 - DNA, 17 bp, Homo sapiens
tccctattctgccatgg

SEQ ID NO: 5793432 - DNA, 22 bp, Homo sapiens
tccctatttttctctcctgtcc

SEQ ID NO: 5793433 - DNA, 21 bp, Homo sapiens
tccctattttttttctgttat

SEQ ID NO: 5793434 - DNA, 20 bp, Homo sapiens
tccctcaaagaaatcctcca

SEQ ID NO: 5793435 - DNA, 21 bp, Homo sapiens
tccctcaaatgcgcgtgtgca

SEQ ID NO: 5793436 - DNA, 18 bp, Homo sapiens
tccctcaacaagggagag

SEQ ID NO: 5793437 - DNA, 23 bp, Homo sapiens
tccctcaacaagggagagacctc

SEQ ID NO: 5793438 - DNA, 18 bp, Homo sapiens
tccctcaacctcatcctc

SEQ ID NO: 5793439 - DNA, 19 bp, Homo sapiens
tccctcaaggctgggagga

SEQ ID NO: 5793440 - DNA, 16 bp, Homo sapiens
tccctcaattacagag

SEQ ID NO: 5793441 - DNA, 23 bp, Homo sapiens
tccctcacaagcgctcccagcct

SEQ ID NO: 5793442 - DNA, 14 bp, Homo sapiens
tccctcacaagtgg

SEQ ID NO: 5793443 - DNA, 10 bp, Homo sapiens
tccctcaccc

SEQ ID NO: 5793444 - DNA, 12 bp, Homo sapiens
tccctcacccat

SEQ ID NO: 5793445 - DNA, 18 bp, Homo sapiens
tccctcacccccaggtgt

SEQ ID NO: 5793446 - DNA, 19 bp, Homo sapiens
tccctcaccctgagcccct

SEQ ID NO: 5793447 - DNA, 14 bp, Homo sapiens
tccctcaccttctg

SEQ ID NO: 5793448 - DNA, 15 bp, Homo sapiens
tccctcaccttggca

SEQ ID NO: 5793449 - DNA, 20 bp, Homo sapiens
tccctcaccttggcaccaga

SEQ ID NO: 5793450 - DNA, 17 bp, Homo sapiens
tccctcactgccttcca

SEQ ID NO: 5793451 - DNA, 9 bp, Homo sapiens
tccctcaga

SEQ ID NO: 5793452 - DNA, 15 bp, Homo sapiens
tccctcagaaaatga

SEQ ID NO: 5793453 - DNA, 13 bp, Homo sapiens
tccctcagaccca

SEQ ID NO: 5793454 - DNA, 23 bp, Homo sapiens
tccctcagacccaggagtccagc

SEQ ID NO: 5793455 - DNA, 14 bp, Homo sapiens
tccctcagactcag

SEQ ID NO: 5793456 - DNA, 15 bp, Homo sapiens
tccctcagactcaga

SEQ ID NO: 5793457 - DNA, 21 bp, Homo sapiens
tccctcagactcagaggtcca

SEQ ID NO: 5793458 - DNA, 19 bp, Homo sapiens
tccctcagccacgcctctc

SEQ ID NO: 5793459 - DNA, 16 bp, Homo sapiens
tccctcagcccccagg

SEQ ID NO: 5793460 - DNA, 17 bp, Homo sapiens
tccctcagcccccagga

SEQ ID NO: 5793461 - DNA, 14 bp, Homo sapiens
tccctcagcccctc

SEQ ID NO: 5793462 - DNA, 17 bp, Homo sapiens
tccctggggagccctca

SEQ ID NO: 5793463 - DNA, 20 bp, Homo sapiens
tccctggggagccctcaggc

SEQ ID NO: 5793464 - DNA, 21 bp, Homo sapiens
tccctggggaggacccctgcc

SEQ ID NO: 5793465 - DNA, 13 bp, Homo sapiens
tccctggggcact

SEQ ID NO: 5793466 - DNA, 17 bp, Homo sapiens
tccctggggcactcccc

SEQ ID NO: 5793467 - DNA, 21 bp, Homo sapiens
tccctggggcactcccccagg

SEQ ID NO: 5793468 - DNA, 14 bp, Homo sapiens
tccctggggcccca

SEQ ID NO: 5793469 - DNA, 20 bp, Homo sapiens
tccctgggggaagccctgga

SEQ ID NO: 5793470 - DNA, 17 bp, Homo sapiens
tccctgggggcatcctg

SEQ ID NO: 5793471 - DNA, 23 bp, Homo sapiens
tccctgggggcatcctgcttcct

SEQ ID NO: 5793472 - DNA, 17 bp, Homo sapiens
tccctgggggccttggg

SEQ ID NO: 5793473 - DNA, 14 bp, Homo sapiens
tccctgggggcggg

SEQ ID NO: 5793474 - DNA, 20 bp, Homo sapiens
tccctgggggtggggctcct

SEQ ID NO: 5793475 - DNA, 21 bp, Homo sapiens
tccctggggtactactctcca

SEQ ID NO: 5793476 - DNA, 16 bp, Homo sapiens
tccctggggtccttgc

SEQ ID NO: 5793477 - DNA, 20 bp, Homo sapiens
tccctgggtagcgggggagg

SEQ ID NO: 5793478 - DNA, 14 bp, Homo sapiens
tccctgggtctggg

SEQ ID NO: 5793479 - DNA, 15 bp, Homo sapiens
tccctgggtggagca

SEQ ID NO: 5793480 - DNA, 20 bp, Homo sapiens
tccctgggtggagcaggact

SEQ ID NO: 5793481 - DNA, 20 bp, Homo sapiens
tccctgggttagactgccag

SEQ ID NO: 5793482 - DNA, 21 bp, Homo sapiens
tccctgggtttgggagccagg

SEQ ID NO: 5793483 - DNA, 20 bp, Homo sapiens
tccctggtcaccaaggcagt

SEQ ID NO: 5793484 - DNA, 21 bp, Homo sapiens
tccctggtcaccaaggcagtg

SEQ ID NO: 5793485 - DNA, 22 bp, Homo sapiens
tccctggtcaccaaggcagtgc

SEQ ID NO: 5793486 - DNA, 16 bp, Homo sapiens
tccctggtccagattg

SEQ ID NO: 5793487 - DNA, 17 bp, Homo sapiens
tccctggtccctcgtcc

SEQ ID NO: 5793488 - DNA, 11 bp, Homo sapiens
tccctggtcct

SEQ ID NO: 5793489 - DNA, 17 bp, Homo sapiens
tccctggtccttcactg

SEQ ID NO: 5793490 - DNA, 18 bp, Homo sapiens
tccctggtccttcactgg

SEQ ID NO: 5793491 - DNA, 23 bp, Homo sapiens
tccctggtccttcactggcgcct

SEQ ID NO: 5793492 - DNA, 16 bp, Homo sapiens
tccctggtcggagagg

SEQ ID NO: 5793493 - DNA, 19 bp, Homo sapiens
tccctggtgaaagagtaaa

SEQ ID NO: 5793494 - DNA, 23 bp, Homo sapiens
tccctggtgagagggccgggcag

SEQ ID NO: 5793495 - DNA, 13 bp, Homo sapiens
tccctggtgcaga

SEQ ID NO: 5793496 - DNA, 15 bp, Homo sapiens
tccctggtggcagct

SEQ ID NO: 5793497 - DNA, 20 bp, Homo sapiens
tccctggtggcagctcacct

SEQ ID NO: 5793498 - DNA, 21 bp, Homo sapiens
tccctggtggcagctcacctc

SEQ ID NO: 5793499 - DNA, 22 bp, Homo sapiens
tccctggtggcagctcacctct

SEQ ID NO: 5793500 - DNA, 18 bp, Homo sapiens
tccctggttcaagcgatt

SEQ ID NO: 5793501 - DNA, 12 bp, Homo sapiens
tccctggttctg

SEQ ID NO: 5793502 - DNA, 16 bp, Homo sapiens
tccctggttgcctcat

SEQ ID NO: 5793503 - DNA, 17 bp, Homo sapiens
tccctggttgcctctct

SEQ ID NO: 5793504 - DNA, 22 bp, Homo sapiens
tccctggttgcctctcttgccc

SEQ ID NO: 5793505 - DNA, 19 bp, Homo sapiens
tccctggtttgcagctgtt

SEQ ID NO: 5793506 - DNA, 21 bp, Homo sapiens
tccctggttttaccccagctc

SEQ ID NO: 5793507 - DNA, 23 bp, Homo sapiens
tccctggttttaccccagctcca

SEQ ID NO: 5793508 - DNA, 18 bp, Homo sapiens
tccctgtaacctcttcag

SEQ ID NO: 5793509 - DNA, 19 bp, Homo sapiens
tccctgtaacctcttcaga

SEQ ID NO: 5793510 - DNA, 23 bp, Homo sapiens
tccctgtaacctcttcagaggcc

SEQ ID NO: 5793511 - DNA, 12 bp, Homo sapiens
tccctgtaactt

SEQ ID NO: 5793512 - DNA, 20 bp, Homo sapiens
tccctgtaattgttgtttgt

SEQ ID NO: 5793513 - DNA, 21 bp, Homo sapiens
tccctgtaattgttgtttgta

SEQ ID NO: 5793514 - DNA, 18 bp, Homo sapiens
tccctgtaggagtaaaga

SEQ ID NO: 5793515 - DNA, 23 bp, Homo sapiens
tccctgtaggagtaaagataaaa

SEQ ID NO: 5793516 - DNA, 20 bp, Homo sapiens
tccctgtattttctttctct

SEQ ID NO: 5793517 - DNA, 13 bp, Homo sapiens
tccctgtcacaca

SEQ ID NO: 5793518 - DNA, 17 bp, Homo sapiens
tccctgtcacacactgg

SEQ ID NO: 5793519 - DNA, 19 bp, Homo sapiens
tccctgtcacacactggac

SEQ ID NO: 5793520 - DNA, 15 bp, Homo sapiens
tccctgtcacctctt

SEQ ID NO: 5793521 - DNA, 13 bp, Homo sapiens
tccctgtcacgct

SEQ ID NO: 5793522 - DNA, 14 bp, Homo sapiens
tccctgtcacgctc

SEQ ID NO: 5793523 - DNA, 13 bp, Homo sapiens
tccctgtcatagt

SEQ ID NO: 5793524 - DNA, 14 bp, Homo sapiens
tccctgtccacccc

SEQ ID NO: 5793525 - DNA, 13 bp, Homo sapiens
tccctgtcccagt

SEQ ID NO: 5793526 - DNA, 16 bp, Homo sapiens
tccctgtccccaggcc

SEQ ID NO: 5793527 - DNA, 17 bp, Homo sapiens
tccctgtccccaggccc

SEQ ID NO: 5793528 - DNA, 18 bp, Homo sapiens
tccctgtccccaggccca

SEQ ID NO: 5793529 - DNA, 19 bp, Homo sapiens
tccctgtccccaggcccag

SEQ ID NO: 5793530 - DNA, 14 bp, Homo sapiens
tccctgtccccctc

SEQ ID NO: 5793531 - DNA, 11 bp, Homo sapiens
tccctgtccct

SEQ ID NO: 5793532 - DNA, 18 bp, Homo sapiens
tccctgtcccttcctttc

SEQ ID NO: 5793533 - DNA, 21 bp, Homo sapiens
tccctgtccttccctgttctc

SEQ ID NO: 5793534 - DNA, 14 bp, Homo sapiens
tccctgtccttcta

SEQ ID NO: 5793535 - DNA, 23 bp, Homo sapiens
tccctgtcgcctgcggactccat

SEQ ID NO: 5793536 - DNA, 18 bp, Homo sapiens
tccctgtcgcgtctcatt

SEQ ID NO: 5793537 - DNA, 15 bp, Homo sapiens
tccctgtctccagct

SEQ ID NO: 5793538 - DNA, 20 bp, Homo sapiens
tccctgtctccagctgcctg

SEQ ID NO: 5793539 - DNA, 21 bp, Homo sapiens
tccctgtctccagctgcctgg

SEQ ID NO: 5793540 - DNA, 22 bp, Homo sapiens
tccctgtctccagctgcctggg

SEQ ID NO: 5793541 - DNA, 16 bp, Homo sapiens
tccctgtctccagggc

SEQ ID NO: 5793542 - DNA, 21 bp, Homo sapiens
tccctgtctccagggccccca

SEQ ID NO: 5793543 - DNA, 13 bp, Homo sapiens
tccctgtctctgc

SEQ ID NO: 5793544 - DNA, 20 bp, Homo sapiens
tccctgtctgtctgtctctc

SEQ ID NO: 5793545 - DNA, 14 bp, Homo sapiens
tccctgtctgtgtc

SEQ ID NO: 5793546 - DNA, 21 bp, Homo sapiens
tccctgtctgtgtcccagcca

SEQ ID NO: 5793547 - DNA, 14 bp, Homo sapiens
tccctgtctttcct

SEQ ID NO: 5793548 - DNA, 17 bp, Homo sapiens
tccctgtctttcctaag

SEQ ID NO: 5793549 - DNA, 19 bp, Homo sapiens
tccctgtgacccgttccat

SEQ ID NO: 5793550 - DNA, 12 bp, Homo sapiens
tccctgtgaggg

SEQ ID NO: 5793551 - DNA, 22 bp, Homo sapiens
tccctgtgccactttgactcag

SEQ ID NO: 5793552 - DNA, 17 bp, Homo sapiens
tccctgtgcccccagcc

SEQ ID NO: 5793553 - DNA, 23 bp, Homo sapiens
tccctgtgcccccagcctcagcc

SEQ ID NO: 5793554 - DNA, 24 bp, Homo sapiens
tccctgtgcccccagcctcagccc

SEQ ID NO: 5793555 - DNA, 20 bp, Homo sapiens
tccctgtgcctaacaccagc

SEQ ID NO: 5793556 - DNA, 16 bp, Homo sapiens
tccctgtgcctcctcc

SEQ ID NO: 5793557 - DNA, 17 bp, Homo sapiens
tccctgtgggctcacac

SEQ ID NO: 5793558 - DNA, 11 bp, Homo sapiens
tccctgtgggg

SEQ ID NO: 5793559 - DNA, 23 bp, Homo sapiens
tccctgtggggcaggagtgccag

SEQ ID NO: 5793560 - DNA, 16 bp, Homo sapiens
tccctgtgggggtggc

SEQ ID NO: 5793561 - DNA, 14 bp, Homo sapiens
tccctgtggtaccc

SEQ ID NO: 5793562 - DNA, 21 bp, Homo sapiens
tccctgtggtctacccgtgtc

SEQ ID NO: 5793563 - DNA, 16 bp, Homo sapiens
tccctgtgtcatttca

SEQ ID NO: 5793564 - DNA, 17 bp, Homo sapiens
tccctgtgtcatttcaa

SEQ ID NO: 5793565 - DNA, 18 bp, Homo sapiens
tccctgtgtgtaggctgg

SEQ ID NO: 5793566 - DNA, 22 bp, Homo sapiens
tccctgtgtgtcgttcccttgt

SEQ ID NO: 5793567 - DNA, 20 bp, Homo sapiens
tccctgtgttaatttaagtt

SEQ ID NO: 5793568 - DNA, 17 bp, Homo sapiens
tccctgtgttacccagg

SEQ ID NO: 5793569 - DNA, 16 bp, Homo sapiens
tccctgtgttctgggc

SEQ ID NO: 5793570 - DNA, 17 bp, Homo sapiens
tccctgtgttctgggct

SEQ ID NO: 5793571 - DNA, 17 bp, Homo sapiens
tccctgtgttgtctcta

SEQ ID NO: 5793572 - DNA, 17 bp, Homo sapiens
tccctgttagaaatgtt

SEQ ID NO: 5793573 - DNA, 17 bp, Homo sapiens
tccctgttattttcaag

SEQ ID NO: 5793574 - DNA, 23 bp, Homo sapiens
tccctgttattttcaagtagctg

SEQ ID NO: 5793575 - DNA, 13 bp, Homo sapiens
tccctgttcccca

SEQ ID NO: 5793576 - DNA, 14 bp, Homo sapiens
tccctgttccccac

SEQ ID NO: 5793577 - DNA, 18 bp, Homo sapiens
tccctgttccccacaggt

SEQ ID NO: 5793578 - DNA, 16 bp, Homo sapiens
tccctgttccccagag

SEQ ID NO: 5793579 - DNA, 17 bp, Homo sapiens
tccctgttccccagaga

SEQ ID NO: 5793580 - DNA, 19 bp, Homo sapiens
tccctgttctcagctccgt

SEQ ID NO: 5793581 - DNA, 23 bp, Homo sapiens
tccctgttctccctttctctctc

SEQ ID NO: 5793582 - DNA, 14 bp, Homo sapiens
tccctgttcttcct

SEQ ID NO: 5793583 - DNA, 21 bp, Homo sapiens
tccctgttcttcctccagctg

SEQ ID NO: 5793584 - DNA, 18 bp, Homo sapiens
tccctgttggtcggtggg

SEQ ID NO: 5793585 - DNA, 14 bp, Homo sapiens
tccctgtttaatat

SEQ ID NO: 5793586 - DNA, 21 bp, Homo sapiens
tccctgtttaatatttaaaca

SEQ ID NO: 5793587 - DNA, 17 bp, Homo sapiens
tccctgtttcaaactga

SEQ ID NO: 5793588 - DNA, 20 bp, Homo sapiens
tccctgtttgcctatagttg

SEQ ID NO: 5793589 - DNA, 21 bp, Homo sapiens
tccctgttttagtttctgaac

SEQ ID NO: 5793590 - DNA, 22 bp, Homo sapiens
tccctgttttagtttctgaact

SEQ ID NO: 5793591 - DNA, 19 bp, Homo sapiens
tccctgttttctgagcccg

SEQ ID NO: 5793592 - DNA, 21 bp, Homo sapiens
tccctgttttctgagcccggg

SEQ ID NO: 5793593 - DNA, 23 bp, Homo sapiens
tccctgttttctgagcccgggct

SEQ ID NO: 5793594 - DNA, 18 bp, Homo sapiens
tccctgtttttgcagtac

SEQ ID NO: 5793595 - DNA, 22 bp, Homo sapiens
tcccttaaaattaccagacaaa

SEQ ID NO: 5793596 - DNA, 20 bp, Homo sapiens
tcccttaactctaaccctgt

SEQ ID NO: 5793597 - DNA, 21 bp, Homo sapiens
tcccttaactctaaccctgtg

SEQ ID NO: 5793598 - DNA, 15 bp, Homo sapiens
tcccttaacttttcc

SEQ ID NO: 5793599 - DNA, 16 bp, Homo sapiens
tcccttaacttttcct

SEQ ID NO: 5793600 - DNA, 18 bp, Homo sapiens
tcccttaaggtctccaaa

SEQ ID NO: 5793601 - DNA, 21 bp, Homo sapiens
tcccttaatattgaggctgca

SEQ ID NO: 5793602 - DNA, 10 bp, Homo sapiens
tcccttaccc

SEQ ID NO: 5793603 - DNA, 19 bp, Homo sapiens
tcccttagactttagtagt

SEQ ID NO: 5793604 - DNA, 14 bp, Homo sapiens
tcccttagcctctc

SEQ ID NO: 5793605 - DNA, 18 bp, Homo sapiens
tcccttagtactcttcta

SEQ ID NO: 5793606 - DNA, 15 bp, Homo sapiens
tcccttatccctgct

SEQ ID NO: 5793607 - DNA, 16 bp, Homo sapiens
tcccttattagttaca

SEQ ID NO: 5793608 - DNA, 22 bp, Homo sapiens
tcccttcaaccattccccatgg

SEQ ID NO: 5793609 - DNA, 20 bp, Homo sapiens
tcccttcaagacgaggggca

SEQ ID NO: 5793610 - DNA, 12 bp, Homo sapiens
tcccttcagccc

SEQ ID NO: 5793611 - DNA, 14 bp, Homo sapiens
tcccttcagccccc

SEQ ID NO: 5793612 - DNA, 17 bp, Homo sapiens
tcccttcagcccccagc

SEQ ID NO: 5793613 - DNA, 17 bp, Homo sapiens
tcccttcagtactgcag

SEQ ID NO: 5793614 - DNA, 10 bp, Homo sapiens
tcccttcata

SEQ ID NO: 5793615 - DNA, 14 bp, Homo sapiens
tcccttcatacttg

SEQ ID NO: 5793616 - DNA, 15 bp, Homo sapiens
tcccttcatgtttta

SEQ ID NO: 5793617 - DNA, 14 bp, Homo sapiens
tcccttcatttaaa

SEQ ID NO: 5793618 - DNA, 12 bp, Homo sapiens
tcccttccaaag

SEQ ID NO: 5793619 - DNA, 17 bp, Homo sapiens
tcccttccacctgctct

SEQ ID NO: 5793620 - DNA, 21 bp, Homo sapiens
tcccttccacctgctctgctg

SEQ ID NO: 5793621 - DNA, 17 bp, Homo sapiens
tcccttccactgcctct

SEQ ID NO: 5793622 - DNA, 12 bp, Homo sapiens
tcccttccagtt

SEQ ID NO: 5793623 - DNA, 15 bp, Homo sapiens
tcccttccatctctt

SEQ ID NO: 5793624 - DNA, 19 bp, Homo sapiens
tcccttccatctcttcctt

SEQ ID NO: 5793625 - DNA, 19 bp, Homo sapiens
tcccttccatgccccagga

SEQ ID NO: 5793626 - DNA, 20 bp, Homo sapiens
tcccttccatgccccaggat

SEQ ID NO: 5793627 - DNA, 18 bp, Homo sapiens
tcccttccatgccctggg

SEQ ID NO: 5793628 - DNA, 13 bp, Homo sapiens
tcccttcccacct

SEQ ID NO: 5793629 - DNA, 17 bp, Homo sapiens
tcccttcccacctctct

SEQ ID NO: 5793630 - DNA, 14 bp, Homo sapiens
tcccttcccagacc

SEQ ID NO: 5793631 - DNA, 17 bp, Homo sapiens
tcccttcccagaccagg

SEQ ID NO: 5793632 - DNA, 19 bp, Homo sapiens
tcccttcccagtgggctgt

SEQ ID NO: 5793633 - DNA, 22 bp, Homo sapiens
tcccttcccatgacccaggctg

SEQ ID NO: 5793634 - DNA, 18 bp, Homo sapiens
tcccttccccctgctgat

SEQ ID NO: 5793635 - DNA, 20 bp, Homo sapiens
tcccttcccctccctggctc

SEQ ID NO: 5793636 - DNA, 14 bp, Homo sapiens
tcccttcccctgtg

SEQ ID NO: 5793637 - DNA, 16 bp, Homo sapiens
tcccttcccgacccag

SEQ ID NO: 5793638 - DNA, 22 bp, Homo sapiens
tcccttcccgacccagccagct

SEQ ID NO: 5793639 - DNA, 20 bp, Homo sapiens
tccgtgagtgaaccatcatt

SEQ ID NO: 5793640 - DNA, 19 bp, Homo sapiens
tccgtgatccatccatctc

SEQ ID NO: 5793641 - DNA, 13 bp, Homo sapiens
tccgtgcccaggc

SEQ ID NO: 5793642 - DNA, 14 bp, Homo sapiens
tccgtgcccaggcc

SEQ ID NO: 5793643 - DNA, 16 bp, Homo sapiens
tccgtgcccaggccct

SEQ ID NO: 5793644 - DNA, 17 bp, Homo sapiens
tccgtgccccttccctg

SEQ ID NO: 5793645 - DNA, 19 bp, Homo sapiens
tccgtgccccttccctggg

SEQ ID NO: 5793646 - DNA, 17 bp, Homo sapiens
tccgtgcctccaccacc

SEQ ID NO: 5793647 - DNA, 14 bp, Homo sapiens
tccgtgctaaggac

SEQ ID NO: 5793648 - DNA, 15 bp, Homo sapiens
tccgtgctaaggact

SEQ ID NO: 5793649 - DNA, 16 bp, Homo sapiens
tccgtgctaaggactt

SEQ ID NO: 5793650 - DNA, 17 bp, Homo sapiens
tccgtgctaaggacttg

SEQ ID NO: 5793651 - DNA, 21 bp, Homo sapiens
tccgtgcttaaccaaagaagc

SEQ ID NO: 5793652 - DNA, 17 bp, Homo sapiens
tccgtggcaaccctcag

SEQ ID NO: 5793653 - DNA, 23 bp, Homo sapiens
tccgtggcaaccctcagctgcct

SEQ ID NO: 5793654 - DNA, 16 bp, Homo sapiens
tccgtggcacttgtaa

SEQ ID NO: 5793655 - DNA, 21 bp, Homo sapiens
tccgtgggaccctcagcagct

SEQ ID NO: 5793656 - DNA, 23 bp, Homo sapiens
tccgtgggacggtgcccaagcca

SEQ ID NO: 5793657 - DNA, 21 bp, Homo sapiens
tccgtgggtcatcccagcacc

SEQ ID NO: 5793658 - DNA, 15 bp, Homo sapiens
tccgtggtagaggcc

SEQ ID NO: 5793659 - DNA, 22 bp, Homo sapiens
tccgtggtagaggcctggggcc

SEQ ID NO: 5793660 - DNA, 19 bp, Homo sapiens
tccgtggtcagagtgccac

SEQ ID NO: 5793661 - DNA, 18 bp, Homo sapiens
tccgtggtttctcatgag

SEQ ID NO: 5793662 - DNA, 15 bp, Homo sapiens
tccgtgtgcctcctg

SEQ ID NO: 5793663 - DNA, 16 bp, Homo sapiens
tccgtgtggatccaat

SEQ ID NO: 5793664 - DNA, 14 bp, Homo sapiens
tccgtgtgtatgtg

SEQ ID NO: 5793665 - DNA, 17 bp, Homo sapiens
tccgtgtgtcccagatg

SEQ ID NO: 5793666 - DNA, 13 bp, Homo sapiens
tccgttaaaatac

SEQ ID NO: 5793667 - DNA, 15 bp, Homo sapiens
tccgttaaaatacca

SEQ ID NO: 5793668 - DNA, 16 bp, Homo sapiens
tccgttagctcctgtg

SEQ ID NO: 5793669 - DNA, 16 bp, Homo sapiens
tccgttcatctgagga

SEQ ID NO: 5793670 - DNA, 19 bp, Homo sapiens
tccgttcccacctctgagg

SEQ ID NO: 5793671 - DNA, 13 bp, Homo sapiens
tccgttcctcctc

SEQ ID NO: 5793672 - DNA, 18 bp, Homo sapiens
tccgttctgttctgctgg

SEQ ID NO: 5793673 - DNA, 22 bp, Homo sapiens
tccgttgaatgagtgtgttttg

SEQ ID NO: 5793674 - DNA, 17 bp, Homo sapiens
tccgttgcaaacccaaa

SEQ ID NO: 5793675 - DNA, 19 bp, Homo sapiens
tccgttgctgaaaatgatt

SEQ ID NO: 5793676 - DNA, 20 bp, Homo sapiens
tccgttggaaagaacattta

SEQ ID NO: 5793677 - DNA, 15 bp, Homo sapiens
tccgttggccactcc

SEQ ID NO: 5793678 - DNA, 15 bp, Homo sapiens
tccgtttattaaaga

SEQ ID NO: 5793679 - DNA, 21 bp, Homo sapiens
tccgtttattataaactgtat

SEQ ID NO: 5793680 - DNA, 20 bp, Homo sapiens
tccgtttcagctgacagctg

SEQ ID NO: 5793681 - DNA, 19 bp, Homo sapiens
tccgtttgaccaatttgca

SEQ ID NO: 5793682 - DNA, 22 bp, Homo sapiens
tccgtttgaccaatttgcacca

SEQ ID NO: 5793683 - DNA, 20 bp, Homo sapiens
tccgtttgagtgtctgcgcc

SEQ ID NO: 5793684 - DNA, 14 bp, Homo sapiens
tcctaaaaatctgg

SEQ ID NO: 5793685 - DNA, 16 bp, Homo sapiens
tcctaaaaatctgtgg

SEQ ID NO: 5793686 - DNA, 13 bp, Homo sapiens
tcctaaaacaaca

SEQ ID NO: 5793687 - DNA, 18 bp, Homo sapiens
tcctaaaactctgccagc

SEQ ID NO: 5793688 - DNA, 13 bp, Homo sapiens
tcctaaaactggg

SEQ ID NO: 5793689 - DNA, 18 bp, Homo sapiens
tcctaaaacttggatgga

SEQ ID NO: 5793690 - DNA, 21 bp, Homo sapiens
tcctaaaaggcccagagagaa

SEQ ID NO: 5793691 - DNA, 17 bp, Homo sapiens
tcctaaaagtggttttt

SEQ ID NO: 5793692 - DNA, 19 bp, Homo sapiens
tcctaaaagttctcaatgt

SEQ ID NO: 5793693 - DNA, 21 bp, Homo sapiens
tcctaaacatcattcattttt

SEQ ID NO: 5793694 - DNA, 23 bp, Homo sapiens
tcctaaacccccgctccagatct

SEQ ID NO: 5793695 - DNA, 15 bp, Homo sapiens
tcctaaactctctag

SEQ ID NO: 5793696 - DNA, 17 bp, Homo sapiens
tcctaaagaaaaagata

SEQ ID NO: 5793697 - DNA, 23 bp, Homo sapiens
tcctaaagaaaaatatcttggcc

SEQ ID NO: 5793698 - DNA, 16 bp, Homo sapiens
tcctaaagaagacatt

SEQ ID NO: 5793699 - DNA, 22 bp, Homo sapiens
tcctaaagaagacattttctct

SEQ ID NO: 5793700 - DNA, 22 bp, Homo sapiens
tcctaaagccaaagtttctgtt

SEQ ID NO: 5793701 - DNA, 21 bp, Homo sapiens
tcctaaagccatcatgccttg

SEQ ID NO: 5793702 - DNA, 20 bp, Homo sapiens
tcctaaagctgaatcccggc

SEQ ID NO: 5793703 - DNA, 19 bp, Homo sapiens
tcctaaagtgaagaagcca

SEQ ID NO: 5793704 - DNA, 13 bp, Homo sapiens
tcctaaatatcca

SEQ ID NO: 5793705 - DNA, 19 bp, Homo sapiens
tcctaaatatccaaagact

SEQ ID NO: 5793706 - DNA, 14 bp, Homo sapiens
tcctaaatattatg

SEQ ID NO: 5793707 - DNA, 22 bp, Homo sapiens
tcctaaatattttcaagaaaag

SEQ ID NO: 5793708 - DNA, 23 bp, Homo sapiens
tcctaaatattttcaagaaaaga

SEQ ID NO: 5793709 - DNA, 15 bp, Homo sapiens
tcctaaatgcagtga

SEQ ID NO: 5793710 - DNA, 12 bp, Homo sapiens
tcctaaatgtat

SEQ ID NO: 5793711 - DNA, 17 bp, Homo sapiens
tcctaaatgtcagctgt

SEQ ID NO: 5793712 - DNA, 15 bp, Homo sapiens
tcctaaatttcagta

SEQ ID NO: 5793713 - DNA, 18 bp, Homo sapiens
tcctaacatgacagtatt

SEQ ID NO: 5793714 - DNA, 12 bp, Homo sapiens
tcctaactagaa

SEQ ID NO: 5793715 - DNA, 16 bp, Homo sapiens
tcctaactccaccgcc

SEQ ID NO: 5793716 - DNA, 13 bp, Homo sapiens
tcctaactgagaa

SEQ ID NO: 5793717 - DNA, 14 bp, Homo sapiens
tcctaacttttcaa

SEQ ID NO: 5793718 - DNA, 20 bp, Homo sapiens
tcctaagaaagaggagtgct

SEQ ID NO: 5793719 - DNA, 18 bp, Homo sapiens
tcctaagaaatatgtgag

SEQ ID NO: 5793720 - DNA, 13 bp, Homo sapiens
tcctaagaagctt

SEQ ID NO: 5793721 - DNA, 15 bp, Homo sapiens
tcctaagaagcttct

SEQ ID NO: 5793722 - DNA, 18 bp, Homo sapiens
tcctaagacatttttcat

SEQ ID NO: 5793723 - DNA, 20 bp, Homo sapiens
tcctaagacatttttcattc

SEQ ID NO: 5793724 - DNA, 16 bp, Homo sapiens
tcctaagacctggggt

SEQ ID NO: 5793725 - DNA, 18 bp, Homo sapiens
tcctaagacctggggttg

SEQ ID NO: 5793726 - DNA, 22 bp, Homo sapiens
tcctaagactaacaaaggcagc

SEQ ID NO: 5793727 - DNA, 20 bp, Homo sapiens
tcctaagatgtgttcttatt

SEQ ID NO: 5793728 - DNA, 15 bp, Homo sapiens
tcctaagcagctggg

SEQ ID NO: 5793729 - DNA, 17 bp, Homo sapiens
tcctaagcagctgggac

SEQ ID NO: 5793730 - DNA, 14 bp, Homo sapiens
tcctaagcctgtgg

SEQ ID NO: 5793731 - DNA, 17 bp, Homo sapiens
tcctaagcctgtggctg

SEQ ID NO: 5793732 - DNA, 13 bp, Homo sapiens
tcctaagcctgtt

SEQ ID NO: 5793733 - DNA, 16 bp, Homo sapiens
tcctaagctattcagt

SEQ ID NO: 5793734 - DNA, 12 bp, Homo sapiens
tcctaagctgcc

SEQ ID NO: 5793735 - DNA, 15 bp, Homo sapiens
tcctaagctgccagc

SEQ ID NO: 5793736 - DNA, 18 bp, Homo sapiens
tcctaaggaaactgcttt

SEQ ID NO: 5793737 - DNA, 19 bp, Homo sapiens
tcctaaggaaactgcttta

SEQ ID NO: 5793738 - DNA, 22 bp, Homo sapiens
tcctaaggaaactgctttattt

SEQ ID NO: 5793739 - DNA, 12 bp, Homo sapiens
tcctaaggcatg

SEQ ID NO: 5793740 - DNA, 21 bp, Homo sapiens
tcctaaggcccagctgccagg

SEQ ID NO: 5793741 - DNA, 16 bp, Homo sapiens
tcctaaggctccccac

SEQ ID NO: 5793742 - DNA, 17 bp, Homo sapiens
tcctaaggctccccacc

SEQ ID NO: 5793743 - DNA, 20 bp, Homo sapiens
tcctaagggtcgaaagctct

SEQ ID NO: 5793744 - DNA, 23 bp, Homo sapiens
tcctaagggtcgaaagctctaga

SEQ ID NO: 5793745 - DNA, 19 bp, Homo sapiens
tcctaagtcccttcctatt

SEQ ID NO: 5793746 - DNA, 14 bp, Homo sapiens
tcctaagttccctt

SEQ ID NO: 5793747 - DNA, 17 bp, Homo sapiens
tcctaagttcccttcta

SEQ ID NO: 5793748 - DNA, 12 bp, Homo sapiens
tcctaagtttct

SEQ ID NO: 5793749 - DNA, 15 bp, Homo sapiens
tcctaataaaaaggt

SEQ ID NO: 5793750 - DNA, 16 bp, Homo sapiens
tcctaataaaaaggtg

SEQ ID NO: 5793751 - DNA, 14 bp, Homo sapiens
tcctaatactgtca

SEQ ID NO: 5793752 - DNA, 17 bp, Homo sapiens
tcctaatagaaagaaat

SEQ ID NO: 5793753 - DNA, 14 bp, Homo sapiens
tcctaatagctttt

SEQ ID NO: 5793754 - DNA, 17 bp, Homo sapiens
tcctaatatatatgtag

SEQ ID NO: 5793755 - DNA, 19 bp, Homo sapiens
tcctaatcaaattctgtct

SEQ ID NO: 5793756 - DNA, 14 bp, Homo sapiens
tcctaatcatacac

SEQ ID NO: 5793757 - DNA, 14 bp, Homo sapiens
tcctaatcatccaa

SEQ ID NO: 5793758 - DNA, 22 bp, Homo sapiens
tcctaatggcatggagactctg

SEQ ID NO: 5793759 - DNA, 24 bp, Homo sapiens
tcctaatggtgatgcagtcttaga

SEQ ID NO: 5793760 - DNA, 15 bp, Homo sapiens
tcctaatgtgatcat

SEQ ID NO: 5793761 - DNA, 16 bp, Homo sapiens
tcctaattccacagct

SEQ ID NO: 5793762 - DNA, 19 bp, Homo sapiens
tcctaatttcccttcttgc

SEQ ID NO: 5793763 - DNA, 14 bp, Homo sapiens
tcctaatttgaaca

SEQ ID NO: 5793764 - DNA, 15 bp, Homo sapiens
tcctacaaagatgtt

SEQ ID NO: 5793765 - DNA, 17 bp, Homo sapiens
tcctacaaccaggtctt

SEQ ID NO: 5793766 - DNA, 18 bp, Homo sapiens
tcctacaagagcagcctg

SEQ ID NO: 5793767 - DNA, 20 bp, Homo sapiens
tcctacaagatttagaaaaa

SEQ ID NO: 5793768 - DNA, 21 bp, Homo sapiens
tcctacaagatttagaaaaaa

SEQ ID NO: 5793769 - DNA, 12 bp, Homo sapiens
tcctacacagga

SEQ ID NO: 5793770 - DNA, 15 bp, Homo sapiens
tcctacacaggacag

SEQ ID NO: 5793771 - DNA, 16 bp, Homo sapiens
tcctacacaggacagg

SEQ ID NO: 5793772 - DNA, 20 bp, Homo sapiens
tcctacacccttggacttga

SEQ ID NO: 5793773 - DNA, 15 bp, Homo sapiens
tcctacacctaactc

SEQ ID NO: 5793774 - DNA, 14 bp, Homo sapiens
tcctacagaaaaac

SEQ ID NO: 5793775 - DNA, 15 bp, Homo sapiens
tcctacagaaaaacc

SEQ ID NO: 5793776 - DNA, 17 bp, Homo sapiens
tcctacagaaaaacctt

SEQ ID NO: 5793777 - DNA, 20 bp, Homo sapiens
tcctacagaaatactgctct

SEQ ID NO: 5793778 - DNA, 16 bp, Homo sapiens
tcctacagtacaatca

SEQ ID NO: 5793779 - DNA, 21 bp, Homo sapiens
tcctacagtgaaatgagcagc

SEQ ID NO: 5793780 - DNA, 22 bp, Homo sapiens
tcctacagtgactccctgggag

SEQ ID NO: 5793781 - DNA, 18 bp, Homo sapiens
tcctacatacttctttca

SEQ ID NO: 5793782 - DNA, 18 bp, Homo sapiens
tcctacatatcccttcca

SEQ ID NO: 5793783 - DNA, 20 bp, Homo sapiens
tcctacatatcccttccaga

SEQ ID NO: 5793784 - DNA, 19 bp, Homo sapiens
tcctacatcttcttcccag

SEQ ID NO: 5793785 - DNA, 12 bp, Homo sapiens
tcctacattttc

SEQ ID NO: 5793786 - DNA, 14 bp, Homo sapiens
tcctaccaacctct

SEQ ID NO: 5793787 - DNA, 14 bp, Homo sapiens
tcctaccaatgcat

SEQ ID NO: 5793788 - DNA, 16 bp, Homo sapiens
tcctaccaatgcatgc

SEQ ID NO: 5793789 - DNA, 14 bp, Homo sapiens
tcctaccactctaa

SEQ ID NO: 5793790 - DNA, 20 bp, Homo sapiens
tcctaccactggacagtcat

SEQ ID NO: 5793791 - DNA, 22 bp, Homo sapiens
tcctaccagttgccctagccca

SEQ ID NO: 5793792 - DNA, 14 bp, Homo sapiens
tcctaccatcagct

SEQ ID NO: 5793793 - DNA, 18 bp, Homo sapiens
tcctaccatcagctctgc

SEQ ID NO: 5793794 - DNA, 15 bp, Homo sapiens
tcctacccaaccact

SEQ ID NO: 5793795 - DNA, 20 bp, Homo sapiens
tcctacccacacctctgcca

SEQ ID NO: 5793796 - DNA, 21 bp, Homo sapiens
tcctacccacacctctgccag

SEQ ID NO: 5793797 - DNA, 22 bp, Homo sapiens
tcctacccacacctctgccaga

SEQ ID NO: 5793798 - DNA, 18 bp, Homo sapiens
tcctacccaccctccttt

SEQ ID NO: 5793799 - DNA, 19 bp, Homo sapiens
tcctaccccaattccttgt

SEQ ID NO: 5793800 - DNA, 22 bp, Homo sapiens
tcctaccccctcttcaaagcag

SEQ ID NO: 5793801 - DNA, 16 bp, Homo sapiens
tcctaccccctgtgcc

SEQ ID NO: 5793802 - DNA, 23 bp, Homo sapiens
tcctaccccggctgcttggcagt

SEQ ID NO: 5793803 - DNA, 16 bp, Homo sapiens
tcctacccctgtcctg

SEQ ID NO: 5793804 - DNA, 20 bp, Homo sapiens
tcctacccctgtcctggggc

SEQ ID NO: 5793805 - DNA, 23 bp, Homo sapiens
tcctaccccttcctgtcctgcct

SEQ ID NO: 5793806 - DNA, 18 bp, Homo sapiens
tcctacccgcccgcgtcc

SEQ ID NO: 5793807 - DNA, 16 bp, Homo sapiens
tcctacccgcttccca

SEQ ID NO: 5793808 - DNA, 14 bp, Homo sapiens
tcctaccctcccac

SEQ ID NO: 5793809 - DNA, 17 bp, Homo sapiens
tcctaccctcccaccag

SEQ ID NO: 5793810 - DNA, 15 bp, Homo sapiens
tcctaccctgcctcc

SEQ ID NO: 5793811 - DNA, 14 bp, Homo sapiens
tcctaccctggtga

SEQ ID NO: 5793812 - DNA, 20 bp, Homo sapiens
tcctaccgaaaccttgcctt

SEQ ID NO: 5793813 - DNA, 21 bp, Homo sapiens
tcctaccgtactccctgcacc

SEQ ID NO: 5793814 - DNA, 13 bp, Homo sapiens
tcctaccgtcttt

SEQ ID NO: 5793815 - DNA, 13 bp, Homo sapiens
tcctacctcagcc

SEQ ID NO: 5793816 - DNA, 14 bp, Homo sapiens
tcctacctcagcct

SEQ ID NO: 5793817 - DNA, 13 bp, Homo sapiens
tcctcagcctggg

SEQ ID NO: 5793818 - DNA, 20 bp, Homo sapiens
tcctcagccttgccagagat

SEQ ID NO: 5793819 - DNA, 19 bp, Homo sapiens
tcctcagctcagctgggcc

SEQ ID NO: 5793820 - DNA, 14 bp, Homo sapiens
tcctcagctccctg

SEQ ID NO: 5793821 - DNA, 19 bp, Homo sapiens
tcctcagctccctgcctgt

SEQ ID NO: 5793822 - DNA, 16 bp, Homo sapiens
tcctcagctgctccca

SEQ ID NO: 5793823 - DNA, 15 bp, Homo sapiens
tcctcagctggttac

SEQ ID NO: 5793824 - DNA, 14 bp, Homo sapiens
tcctcagcttatct

SEQ ID NO: 5793825 - DNA, 13 bp, Homo sapiens
tcctcagcttggg

SEQ ID NO: 5793826 - DNA, 20 bp, Homo sapiens
tcctcagcttgggcttcttc

SEQ ID NO: 5793827 - DNA, 15 bp, Homo sapiens
tcctcaggaacagaa

SEQ ID NO: 5793828 - DNA, 15 bp, Homo sapiens
tcctcaggaaggaca

SEQ ID NO: 5793829 - DNA, 20 bp, Homo sapiens
tcctcaggaccctcagccct

SEQ ID NO: 5793830 - DNA, 16 bp, Homo sapiens
tcctcaggatttcatt

SEQ ID NO: 5793831 - DNA, 17 bp, Homo sapiens
tcctcaggcacacagct

SEQ ID NO: 5793832 - DNA, 20 bp, Homo sapiens
tcctcaggcagtggcccagg

SEQ ID NO: 5793833 - DNA, 21 bp, Homo sapiens
tcctcaggcagtggcccaggg

SEQ ID NO: 5793834 - DNA, 20 bp, Homo sapiens
tcctcaggcccagctgctcc

SEQ ID NO: 5793835 - DNA, 16 bp, Homo sapiens
tcctcagggacagaga

SEQ ID NO: 5793836 - DNA, 24 bp, Homo sapiens
tcctcagggacagagacacctgca

SEQ ID NO: 5793837 - DNA, 17 bp, Homo sapiens
tcctcaggggtggagaa

SEQ ID NO: 5793838 - DNA, 17 bp, Homo sapiens
tcctcagggtggggggt

SEQ ID NO: 5793839 - DNA, 23 bp, Homo sapiens
tcctcaggtacagcgggctgtgc

SEQ ID NO: 5793840 - DNA, 12 bp, Homo sapiens
tcctcaggtcag

SEQ ID NO: 5793841 - DNA, 15 bp, Homo sapiens
tcctcaggtcagctg

SEQ ID NO: 5793842 - DNA, 16 bp, Homo sapiens
tcctcaggtggccatg

SEQ ID NO: 5793843 - DNA, 23 bp, Homo sapiens
tcctcaggtggccatgcctcagc

SEQ ID NO: 5793844 - DNA, 21 bp, Homo sapiens
tcctcagtaaaagtcttctcc

SEQ ID NO: 5793845 - DNA, 16 bp, Homo sapiens
tcctcagtatgtgggg

SEQ ID NO: 5793846 - DNA, 18 bp, Homo sapiens
tcctcagtatgtgggggc

SEQ ID NO: 5793847 - DNA, 22 bp, Homo sapiens
tcctcagtatgtgggggcttca

SEQ ID NO: 5793848 - DNA, 19 bp, Homo sapiens
tcctcagtccatttatata

SEQ ID NO: 5793849 - DNA, 21 bp, Homo sapiens
tcctcagtccatttatatatg

SEQ ID NO: 5793850 - DNA, 17 bp, Homo sapiens
tcctcagtccctcttct

SEQ ID NO: 5793851 - DNA, 12 bp, Homo sapiens
tcctcagtgatg

SEQ ID NO: 5793852 - DNA, 10 bp, Homo sapiens
tcctcagtgc

SEQ ID NO: 5793853 - DNA, 14 bp, Homo sapiens
tcctcagtgcaaaa

SEQ ID NO: 5793854 - DNA, 21 bp, Homo sapiens
tcctcagtgcaaaatgtcttg

SEQ ID NO: 5793855 - DNA, 19 bp, Homo sapiens
tcctcagtgcatttgtgct

SEQ ID NO: 5793856 - DNA, 15 bp, Homo sapiens
tcctcagtggcttct

SEQ ID NO: 5793857 - DNA, 22 bp, Homo sapiens
tcctcagtggcttctccaggga

SEQ ID NO: 5793858 - DNA, 19 bp, Homo sapiens
tcctcagttcctcaccatc

SEQ ID NO: 5793859 - DNA, 23 bp, Homo sapiens
tcctcataaaaagcaaaacaaaa

SEQ ID NO: 5793860 - DNA, 14 bp, Homo sapiens
tcctcatacccacc

SEQ ID NO: 5793861 - DNA, 22 bp, Homo sapiens
tcctcatagtatggtggctggg

SEQ ID NO: 5793862 - DNA, 14 bp, Homo sapiens
tcctcatcagtaga

SEQ ID NO: 5793863 - DNA, 22 bp, Homo sapiens
tcctcatcagtgtcattttctg

SEQ ID NO: 5793864 - DNA, 17 bp, Homo sapiens
tcctcatcatgaaaact

SEQ ID NO: 5793865 - DNA, 14 bp, Homo sapiens
tcctcatccacccc

SEQ ID NO: 5793866 - DNA, 18 bp, Homo sapiens
tcctcatccaccccatcc

SEQ ID NO: 5793867 - DNA, 18 bp, Homo sapiens
tcctcatccagggctctg

SEQ ID NO: 5793868 - DNA, 22 bp, Homo sapiens
tcctcatcccgtgttctccttt

SEQ ID NO: 5793869 - DNA, 13 bp, Homo sapiens
tcctcatccctga

SEQ ID NO: 5793870 - DNA, 16 bp, Homo sapiens
tcctcatcctccctga

SEQ ID NO: 5793871 - DNA, 14 bp, Homo sapiens
tcctcatcctgctt

SEQ ID NO: 5793872 - DNA, 18 bp, Homo sapiens
tcctcatctccaaggcag

SEQ ID NO: 5793873 - DNA, 14 bp, Homo sapiens
tcctcatctccatg

SEQ ID NO: 5793874 - DNA, 12 bp, Homo sapiens
tcctcatctgca

SEQ ID NO: 5793875 - DNA, 14 bp, Homo sapiens
tcctcatctgcaga

SEQ ID NO: 5793876 - DNA, 15 bp, Homo sapiens
tcctcatctgtgcct

SEQ ID NO: 5793877 - DNA, 14 bp, Homo sapiens
tcctcatgaaagca

SEQ ID NO: 5793878 - DNA, 21 bp, Homo sapiens
tcctcatgaatgtaaatttgt

SEQ ID NO: 5793879 - DNA, 20 bp, Homo sapiens
tcctcatgacccctcgtcca

SEQ ID NO: 5793880 - DNA, 20 bp, Homo sapiens
tcctcatgcccaagagatct

SEQ ID NO: 5793881 - DNA, 22 bp, Homo sapiens
tcctcatggctgttatctgtct

SEQ ID NO: 5793882 - DNA, 13 bp, Homo sapiens
tcctcatgtaaca

SEQ ID NO: 5793883 - DNA, 14 bp, Homo sapiens
tcctcatgtaacat

SEQ ID NO: 5793884 - DNA, 15 bp, Homo sapiens
tcctcatgtaacatt

SEQ ID NO: 5793885 - DNA, 17 bp, Homo sapiens
tcctcatgttctgcttt

SEQ ID NO: 5793886 - DNA, 17 bp, Homo sapiens
tcctcattaaattacct

SEQ ID NO: 5793887 - DNA, 20 bp, Homo sapiens
tcctcattaatagctgcctt

SEQ ID NO: 5793888 - DNA, 20 bp, Homo sapiens
tcctcattataaaatgggaa

SEQ ID NO: 5793889 - DNA, 15 bp, Homo sapiens
tcctcattcagacca

SEQ ID NO: 5793890 - DNA, 22 bp, Homo sapiens
tcctcattccctcgtctttccc

SEQ ID NO: 5793891 - DNA, 15 bp, Homo sapiens
tcctcattgcctcct

SEQ ID NO: 5793892 - DNA, 17 bp, Homo sapiens
tcctcattgcctcctgt

SEQ ID NO: 5793893 - DNA, 20 bp, Homo sapiens
tcctcattgcctcctgttct

SEQ ID NO: 5793894 - DNA, 19 bp, Homo sapiens
tcctcattgtaaacaaact

SEQ ID NO: 5793895 - DNA, 19 bp, Homo sapiens
tcctcatttggggtagcta

SEQ ID NO: 5793896 - DNA, 12 bp, Homo sapiens
tcctcatttgtt

SEQ ID NO: 5793897 - DNA, 22 bp, Homo sapiens
tcctcatttgttcattaaacgt

SEQ ID NO: 5793898 - DNA, 17 bp, Homo sapiens
tcctcattttactaaaa

SEQ ID NO: 5793899 - DNA, 22 bp, Homo sapiens
tcctcattttgaattatgtgca

SEQ ID NO: 5793900 - DNA, 17 bp, Homo sapiens
tcctccaaaacacaagg

SEQ ID NO: 5793901 - DNA, 17 bp, Homo sapiens
tcctccaaactcctgcc

SEQ ID NO: 5793902 - DNA, 20 bp, Homo sapiens
tcctccaaactcctgcctgt

SEQ ID NO: 5793903 - DNA, 17 bp, Homo sapiens
tcctccaaatctcttgc

SEQ ID NO: 5793904 - DNA, 14 bp, Homo sapiens
tcctccaaatgctg

SEQ ID NO: 5793905 - DNA, 19 bp, Homo sapiens
tcctccaacgttaaaagac

SEQ ID NO: 5793906 - DNA, 22 bp, Homo sapiens
tcctccaacgttaaaagacagt

SEQ ID NO: 5793907 - DNA, 17 bp, Homo sapiens
tcctccaagaagccctc

SEQ ID NO: 5793908 - DNA, 15 bp, Homo sapiens
tcctccaagtcttca

SEQ ID NO: 5793909 - DNA, 23 bp, Homo sapiens
tcctccaatcaaaatcacctccc

SEQ ID NO: 5793910 - DNA, 15 bp, Homo sapiens
tcctccaatccccac

SEQ ID NO: 5793911 - DNA, 19 bp, Homo sapiens
tcctccaatgtcctgaaac

SEQ ID NO: 5793912 - DNA, 21 bp, Homo sapiens
tcctccaattccacagtctct

SEQ ID NO: 5793913 - DNA, 13 bp, Homo sapiens
tcctccacagaga

SEQ ID NO: 5793914 - DNA, 15 bp, Homo sapiens
tcctccacagcccca

SEQ ID NO: 5793915 - DNA, 21 bp, Homo sapiens
tcctccacagctgcagcccat

SEQ ID NO: 5793916 - DNA, 22 bp, Homo sapiens
tcctccacagtcccccacccac

SEQ ID NO: 5793917 - DNA, 15 bp, Homo sapiens
tcctccacagtgctg

SEQ ID NO: 5793918 - DNA, 18 bp, Homo sapiens
tcctccacatcctgtgtc

SEQ ID NO: 5793919 - DNA, 23 bp, Homo sapiens
tcctccacatcctttctaaacaa

SEQ ID NO: 5793920 - DNA, 15 bp, Homo sapiens
tcctccaccaccgcc

SEQ ID NO: 5793921 - DNA, 15 bp, Homo sapiens
tcctccacccacccc

SEQ ID NO: 5793922 - DNA, 21 bp, Homo sapiens
tcctccacccaccccctttgg

SEQ ID NO: 5793923 - DNA, 21 bp, Homo sapiens
tcctccaccgccatggcttcc

SEQ ID NO: 5793924 - DNA, 17 bp, Homo sapiens
tcctccacctcaactcc

SEQ ID NO: 5793925 - DNA, 15 bp, Homo sapiens
tcctccacctcccac

SEQ ID NO: 5793926 - DNA, 17 bp, Homo sapiens
tcctccactccacctcc

SEQ ID NO: 5793927 - DNA, 16 bp, Homo sapiens
tcctccactctccccc

SEQ ID NO: 5793928 - DNA, 13 bp, Homo sapiens
tcctccagaactc

SEQ ID NO: 5793929 - DNA, 16 bp, Homo sapiens
tcctccagaactcttc

SEQ ID NO: 5793930 - DNA, 18 bp, Homo sapiens
tcctccagaactcttcct

SEQ ID NO: 5793931 - DNA, 21 bp, Homo sapiens
tcctccagaactcttcctcca

SEQ ID NO: 5793932 - DNA, 18 bp, Homo sapiens
tcctccagaagcctctgg

SEQ ID NO: 5793933 - DNA, 20 bp, Homo sapiens
tcctccagaagcctctggct

SEQ ID NO: 5793934 - DNA, 14 bp, Homo sapiens
tcctccagacagat

SEQ ID NO: 5793935 - DNA, 22 bp, Homo sapiens
tcctccagacagatacagcccc

SEQ ID NO: 5793936 - DNA, 12 bp, Homo sapiens
tcctccagacca

SEQ ID NO: 5793937 - DNA, 15 bp, Homo sapiens
tcctccagagcctgg

SEQ ID NO: 5793938 - DNA, 14 bp, Homo sapiens
tcctccagcaggga

SEQ ID NO: 5793939 - DNA, 11 bp, Homo sapiens
tcctccagccc

SEQ ID NO: 5793940 - DNA, 15 bp, Homo sapiens
tcctccagcccaccc

SEQ ID NO: 5793941 - DNA, 14 bp, Homo sapiens
tcctccagcccctg

SEQ ID NO: 5793942 - DNA, 16 bp, Homo sapiens
tcctccagccctgccc

SEQ ID NO: 5793943 - DNA, 14 bp, Homo sapiens
tcctccagccctgg

SEQ ID NO: 5793944 - DNA, 17 bp, Homo sapiens
tcctccagccctgggca

SEQ ID NO: 5793945 - DNA, 13 bp, Homo sapiens
tcctccagcctcc

SEQ ID NO: 5793946 - DNA, 19 bp, Homo sapiens
tcctccagcctcccctccc

SEQ ID NO: 5793947 - DNA, 22 bp, Homo sapiens
tcctccagcctcccctcccctg

SEQ ID NO: 5793948 - DNA, 22 bp, Homo sapiens
tcctccagcgagtaccccagcc

SEQ ID NO: 5793949 - DNA, 18 bp, Homo sapiens
tcctccagctcctgcccc

SEQ ID NO: 5793950 - DNA, 13 bp, Homo sapiens
tcctccagcttct

SEQ ID NO: 5793951 - DNA, 19 bp, Homo sapiens
tcctccaggagcttcttgt

SEQ ID NO: 5793952 - DNA, 20 bp, Homo sapiens
tcctccaggaggactgttct

SEQ ID NO: 5793953 - DNA, 17 bp, Homo sapiens
tcctccaggcctgcctc

SEQ ID NO: 5793954 - DNA, 19 bp, Homo sapiens
tcctccagggccacgtgcc

SEQ ID NO: 5793955 - DNA, 16 bp, Homo sapiens
tcctccagggggcctg

SEQ ID NO: 5793956 - DNA, 20 bp, Homo sapiens
tcctccagggggcctgcagg

SEQ ID NO: 5793957 - DNA, 12 bp, Homo sapiens
tcctccaggtgc

SEQ ID NO: 5793958 - DNA, 14 bp, Homo sapiens
tcctccaggtgcac

SEQ ID NO: 5793959 - DNA, 18 bp, Homo sapiens
tcctccaggtgcacaagc

SEQ ID NO: 5793960 - DNA, 22 bp, Homo sapiens
tcctccaggtgcacaagctcca

SEQ ID NO: 5793961 - DNA, 15 bp, Homo sapiens
tcctccaggtttttc

SEQ ID NO: 5793962 - DNA, 17 bp, Homo sapiens
tcctccaggtttttcaa

SEQ ID NO: 5793963 - DNA, 16 bp, Homo sapiens
tcctccatactcagga

SEQ ID NO: 5793964 - DNA, 16 bp, Homo sapiens
tcctccatcacccctg

SEQ ID NO: 5793965 - DNA, 21 bp, Homo sapiens
tcctccatcacctgaaacact

SEQ ID NO: 5793966 - DNA, 22 bp, Homo sapiens
tcctccatccacgtggcctctc

SEQ ID NO: 5793967 - DNA, 20 bp, Homo sapiens
tcctccatccatgtgttcca

SEQ ID NO: 5793968 - DNA, 22 bp, Homo sapiens
tcctccatccatgtgttccaaa

SEQ ID NO: 5793969 - DNA, 15 bp, Homo sapiens
tcctccatcctcctc

SEQ ID NO: 5793970 - DNA, 17 bp, Homo sapiens
tcctccatcgcagtgtt

SEQ ID NO: 5793971 - DNA, 22 bp, Homo sapiens
tcctccatcttactctgcccta

SEQ ID NO: 5793972 - DNA, 17 bp, Homo sapiens
tcctccatctttctaca

SEQ ID NO: 5793973 - DNA, 21 bp, Homo sapiens
tcctccatctttctacagaga

SEQ ID NO: 5793974 - DNA, 18 bp, Homo sapiens
tcctccatgctgtccctg

SEQ ID NO: 5793975 - DNA, 14 bp, Homo sapiens
tcctccattgctgt

SEQ ID NO: 5793976 - DNA, 22 bp, Homo sapiens
tcctcccaaaagtatcgggggc

SEQ ID NO: 5793977 - DNA, 17 bp, Homo sapiens
tcctcccaacagtttta

SEQ ID NO: 5793978 - DNA, 17 bp, Homo sapiens
tcctcccaactctggcc

SEQ ID NO: 5793979 - DNA, 18 bp, Homo sapiens
tcctcccaagctgtgctg

SEQ ID NO: 5793980 - DNA, 22 bp, Homo sapiens
tcctcccaaggcattctcccag

SEQ ID NO: 5793981 - DNA, 19 bp, Homo sapiens
tcctcccaagtggtgccta

SEQ ID NO: 5793982 - DNA, 23 bp, Homo sapiens
tcctcccaatctcaatacagcct

SEQ ID NO: 5793983 - DNA, 21 bp, Homo sapiens
tcctcccaatttcagactccc

SEQ ID NO: 5793984 - DNA, 14 bp, Homo sapiens
tcctcccacagacc

SEQ ID NO: 5793985 - DNA, 15 bp, Homo sapiens
tcctcccacagacct

SEQ ID NO: 5793986 - DNA, 16 bp, Homo sapiens
tcctcccacagacctg

SEQ ID NO: 5793987 - DNA, 17 bp, Homo sapiens
tcctcccacagacctgc

SEQ ID NO: 5793988 - DNA, 23 bp, Homo sapiens
tcctcccacagacctgcagtgag

SEQ ID NO: 5793989 - DNA, 15 bp, Homo sapiens
tcctcccaccaccct

SEQ ID NO: 5793990 - DNA, 12 bp, Homo sapiens
tcctcccaccca

SEQ ID NO: 5793991 - DNA, 20 bp, Homo sapiens
tcctcccacccaacttcccc

SEQ ID NO: 5793992 - DNA, 19 bp, Homo sapiens
tcctcccacccctccccac

SEQ ID NO: 5793993 - DNA, 11 bp, Homo sapiens
tcctcccacct

SEQ ID NO: 5793994 - DNA, 21 bp, Homo sapiens
tcctctccccctcctccaggg

SEQ ID NO: 5793995 - DNA, 13 bp, Homo sapiens
tcctctccccctt

SEQ ID NO: 5793996 - DNA, 18 bp, Homo sapiens
tcctctcccccttcagct

SEQ ID NO: 5793997 - DNA, 20 bp, Homo sapiens
tcctctcccccttcagctcc

SEQ ID NO: 5793998 - DNA, 22 bp, Homo sapiens
tcctctcccccttcagctcctg

SEQ ID NO: 5793999 - DNA, 18 bp, Homo sapiens
tcctctcccctaccactg

SEQ ID NO: 5794000 - DNA, 13 bp, Homo sapiens
tcctctcccctcc

SEQ ID NO: 5794001 - DNA, 16 bp, Homo sapiens
tcctctcccctccagc

SEQ ID NO: 5794002 - DNA, 15 bp, Homo sapiens
tcctctccctgccaa

SEQ ID NO: 5794003 - DNA, 11 bp, Homo sapiens
tcctctccctt

SEQ ID NO: 5794004 - DNA, 15 bp, Homo sapiens
tcctctcccttccct

SEQ ID NO: 5794005 - DNA, 18 bp, Homo sapiens
tcctctcccttcccttcc

SEQ ID NO: 5794006 - DNA, 20 bp, Homo sapiens
tcctctccgcagttcctgtc

SEQ ID NO: 5794007 - DNA, 16 bp, Homo sapiens
tcctctccgcgccctc

SEQ ID NO: 5794008 - DNA, 23 bp, Homo sapiens
tcctctcctcgtccggcctgcag

SEQ ID NO: 5794009 - DNA, 20 bp, Homo sapiens
tcctctcctgcccagctctg

SEQ ID NO: 5794010 - DNA, 14 bp, Homo sapiens
tcctctcctggagg

SEQ ID NO: 5794011 - DNA, 16 bp, Homo sapiens
tcctctcctgggtact

SEQ ID NO: 5794012 - DNA, 15 bp, Homo sapiens
tcctctccttccttg

SEQ ID NO: 5794013 - DNA, 14 bp, Homo sapiens
tcctctccttgggc

SEQ ID NO: 5794014 - DNA, 22 bp, Homo sapiens
tcctctccttgggctcctggct

SEQ ID NO: 5794015 - DNA, 23 bp, Homo sapiens
tcctctcctttgaaacctgctct

SEQ ID NO: 5794016 - DNA, 22 bp, Homo sapiens
tcctctcgagcccagatggaaa

SEQ ID NO: 5794017 - DNA, 17 bp, Homo sapiens
tcctctcgcggccctca

SEQ ID NO: 5794018 - DNA, 23 bp, Homo sapiens
tcctctcggctgccaggggctct

SEQ ID NO: 5794019 - DNA, 23 bp, Homo sapiens
tcctctcggctggaagaacatca

SEQ ID NO: 5794020 - DNA, 20 bp, Homo sapiens
tcctctcgtagaacctgcgc

SEQ ID NO: 5794021 - DNA, 21 bp, Homo sapiens
tcctctctaacctcctttacc

SEQ ID NO: 5794022 - DNA, 15 bp, Homo sapiens
tcctctctagggcag

SEQ ID NO: 5794023 - DNA, 20 bp, Homo sapiens
tcctctctagggcagaagac

SEQ ID NO: 5794024 - DNA, 13 bp, Homo sapiens
tcctctctatatt

SEQ ID NO: 5794025 - DNA, 14 bp, Homo sapiens
tcctctctatattt

SEQ ID NO: 5794026 - DNA, 14 bp, Homo sapiens
tcctctctccagat

SEQ ID NO: 5794027 - DNA, 19 bp, Homo sapiens
tcctctctccagatgtttc

SEQ ID NO: 5794028 - DNA, 17 bp, Homo sapiens
tcctctctccctgcctc

SEQ ID NO: 5794029 - DNA, 22 bp, Homo sapiens
tcctctctccctgcctcacatc

SEQ ID NO: 5794030 - DNA, 12 bp, Homo sapiens
tcctctctctca

SEQ ID NO: 5794031 - DNA, 21 bp, Homo sapiens
tcctctctctcacctacttcc

SEQ ID NO: 5794032 - DNA, 14 bp, Homo sapiens
tcctctctctccct

SEQ ID NO: 5794033 - DNA, 21 bp, Homo sapiens
tcctctctctctctctctctg

SEQ ID NO: 5794034 - DNA, 22 bp, Homo sapiens
tcctctctctctctctctctgt

SEQ ID NO: 5794035 - DNA, 16 bp, Homo sapiens
tcctctctctcttcta

SEQ ID NO: 5794036 - DNA, 12 bp, Homo sapiens
tcctctctctgt

SEQ ID NO: 5794037 - DNA, 16 bp, Homo sapiens
tcctctctctgtgtta

SEQ ID NO: 5794038 - DNA, 14 bp, Homo sapiens
tcctctctgagact

SEQ ID NO: 5794039 - DNA, 17 bp, Homo sapiens
tcctctctgagactgct

SEQ ID NO: 5794040 - DNA, 19 bp, Homo sapiens
tcctctctgagtcaaatcc

SEQ ID NO: 5794041 - DNA, 20 bp, Homo sapiens
tcctctctgagtcaaatcca

SEQ ID NO: 5794042 - DNA, 22 bp, Homo sapiens
tcctctctgagtcaaatccagt

SEQ ID NO: 5794043 - DNA, 12 bp, Homo sapiens
tcctctctgccc

SEQ ID NO: 5794044 - DNA, 14 bp, Homo sapiens
tcctctctgcccta

SEQ ID NO: 5794045 - DNA, 15 bp, Homo sapiens
tcctctctgctgggt

SEQ ID NO: 5794046 - DNA, 12 bp, Homo sapiens
tcctctctgggc

SEQ ID NO: 5794047 - DNA, 14 bp, Homo sapiens
tcctctctgggcct

SEQ ID NO: 5794048 - DNA, 13 bp, Homo sapiens
tcctctctggtgg

SEQ ID NO: 5794049 - DNA, 17 bp, Homo sapiens
tcctctctggtggctct

SEQ ID NO: 5794050 - DNA, 21 bp, Homo sapiens
tcctctctggtggctgggctg

SEQ ID NO: 5794051 - DNA, 24 bp, Homo sapiens
tcctctctggtggctgggctgctc

SEQ ID NO: 5794052 - DNA, 17 bp, Homo sapiens
tcctctctgtctgtctc

SEQ ID NO: 5794053 - DNA, 14 bp, Homo sapiens
tcctctcttccaca

SEQ ID NO: 5794054 - DNA, 13 bp, Homo sapiens
tcctctcttggca

SEQ ID NO: 5794055 - DNA, 14 bp, Homo sapiens
tcctctcttggcaa

SEQ ID NO: 5794056 - DNA, 17 bp, Homo sapiens
tcctctctttgttctca

SEQ ID NO: 5794057 - DNA, 20 bp, Homo sapiens
tcctctgaaacagctgcctt

SEQ ID NO: 5794058 - DNA, 15 bp, Homo sapiens
tcctctgaatattaa

SEQ ID NO: 5794059 - DNA, 23 bp, Homo sapiens
tcctctgaatttaattctttcaa

SEQ ID NO: 5794060 - DNA, 23 bp, Homo sapiens
tcctctgacagctgtcctgagct

SEQ ID NO: 5794061 - DNA, 15 bp, Homo sapiens
tcctctgaccctcct

SEQ ID NO: 5794062 - DNA, 21 bp, Homo sapiens
tcctctgaccctccttctatt

SEQ ID NO: 5794063 - DNA, 14 bp, Homo sapiens
tcctctgactccac

SEQ ID NO: 5794064 - DNA, 23 bp, Homo sapiens
tcctctgactccactcaaagagg

SEQ ID NO: 5794065 - DNA, 13 bp, Homo sapiens
tcctctgagcagc

SEQ ID NO: 5794066 - DNA, 18 bp, Homo sapiens
tcctctgagcagcctctg

SEQ ID NO: 5794067 - DNA, 22 bp, Homo sapiens
tcctctgagcagcctctgccag

SEQ ID NO: 5794068 - DNA, 23 bp, Homo sapiens
tcctctgagcagcctctgccagg

SEQ ID NO: 5794069 - DNA, 21 bp, Homo sapiens
tcctctgagcccagctgcctg

SEQ ID NO: 5794070 - DNA, 22 bp, Homo sapiens
tcctctgagcccagctgcctgg

SEQ ID NO: 5794071 - DNA, 14 bp, Homo sapiens
tcctctgagccgca

SEQ ID NO: 5794072 - DNA, 13 bp, Homo sapiens
tcctctgagcctt

SEQ ID NO: 5794073 - DNA, 16 bp, Homo sapiens
tcctctgagctgttat

SEQ ID NO: 5794074 - DNA, 23 bp, Homo sapiens
tcctctgaggaagcagttggggc

SEQ ID NO: 5794075 - DNA, 14 bp, Homo sapiens
tcctctgaggacag

SEQ ID NO: 5794076 - DNA, 21 bp, Homo sapiens
tcctctgatagctgtttcaaa

SEQ ID NO: 5794077 - DNA, 13 bp, Homo sapiens
tcctctgatctcc

SEQ ID NO: 5794078 - DNA, 17 bp, Homo sapiens
tcctctgatctccatgg

SEQ ID NO: 5794079 - DNA, 14 bp, Homo sapiens
tcctctgcaaaaag

SEQ ID NO: 5794080 - DNA, 20 bp, Homo sapiens
tcctctgcaagtgctcaggg

SEQ ID NO: 5794081 - DNA, 16 bp, Homo sapiens
tcctctgcactcccac

SEQ ID NO: 5794082 - DNA, 15 bp, Homo sapiens
tcctctgcagcactt

SEQ ID NO: 5794083 - DNA, 16 bp, Homo sapiens
tcctctgcagctgacc

SEQ ID NO: 5794084 - DNA, 18 bp, Homo sapiens
tcctctgcagctgacctc

SEQ ID NO: 5794085 - DNA, 20 bp, Homo sapiens
tcctctgcaggacacagatc

SEQ ID NO: 5794086 - DNA, 14 bp, Homo sapiens
tcctctgcagtttt

SEQ ID NO: 5794087 - DNA, 13 bp, Homo sapiens
tcctctgccagca

SEQ ID NO: 5794088 - DNA, 14 bp, Homo sapiens
tcctctgccagcag

SEQ ID NO: 5794089 - DNA, 20 bp, Homo sapiens
tcctctgccagcaggaataa

SEQ ID NO: 5794090 - DNA, 15 bp, Homo sapiens
tcctctgccatgttt

SEQ ID NO: 5794091 - DNA, 15 bp, Homo sapiens
tcctctgccccctcc

SEQ ID NO: 5794092 - DNA, 16 bp, Homo sapiens
tcctctgccccctccc

SEQ ID NO: 5794093 - DNA, 19 bp, Homo sapiens
tcctctgccccctcccccg

SEQ ID NO: 5794094 - DNA, 20 bp, Homo sapiens
tcctctgccccctcccccgc

SEQ ID NO: 5794095 - DNA, 22 bp, Homo sapiens
tcctctgccccctcccccgcag

SEQ ID NO: 5794096 - DNA, 19 bp, Homo sapiens
tcctctgcccgcgggtggc

SEQ ID NO: 5794097 - DNA, 22 bp, Homo sapiens
tcctctgccctcccttcttgtg

SEQ ID NO: 5794098 - DNA, 10 bp, Homo sapiens
tcctctgcct

SEQ ID NO: 5794099 - DNA, 13 bp, Homo sapiens
tcctctgcctgcc

SEQ ID NO: 5794100 - DNA, 14 bp, Homo sapiens
tcctctgcctgggc

SEQ ID NO: 5794101 - DNA, 23 bp, Homo sapiens
tcctctgctatgcattttcttca

SEQ ID NO: 5794102 - DNA, 14 bp, Homo sapiens
tcctctgctccagc

SEQ ID NO: 5794103 - DNA, 15 bp, Homo sapiens
tcctctgctccagca

SEQ ID NO: 5794104 - DNA, 13 bp, Homo sapiens
tcctctgctgcat

SEQ ID NO: 5794105 - DNA, 17 bp, Homo sapiens
tcctctgctgcatcccc

SEQ ID NO: 5794106 - DNA, 19 bp, Homo sapiens
tcctctgctgcatcccctt

SEQ ID NO: 5794107 - DNA, 14 bp, Homo sapiens
tcctctgctgctgg

SEQ ID NO: 5794108 - DNA, 15 bp, Homo sapiens
tcctctgctgctggc

SEQ ID NO: 5794109 - DNA, 17 bp, Homo sapiens
tcctctgctgctggctg

SEQ ID NO: 5794110 - DNA, 21 bp, Homo sapiens
tcctctgctggttcctgactg

SEQ ID NO: 5794111 - DNA, 17 bp, Homo sapiens
tcctctgcttaaaaact

SEQ ID NO: 5794112 - DNA, 14 bp, Homo sapiens
tcctctgcttgcca

SEQ ID NO: 5794113 - DNA, 22 bp, Homo sapiens
tcctctgcttgccatccctccc

SEQ ID NO: 5794114 - DNA, 17 bp, Homo sapiens
tcctctgctttgaaagc

SEQ ID NO: 5794115 - DNA, 17 bp, Homo sapiens
tcctctggacggcaggc

SEQ ID NO: 5794116 - DNA, 18 bp, Homo sapiens
tcctctggacggcaggct

SEQ ID NO: 5794117 - DNA, 20 bp, Homo sapiens
tcctctggacggcaggctca

SEQ ID NO: 5794118 - DNA, 24 bp, Homo sapiens
tcctctggacggcaggctcactgc

SEQ ID NO: 5794119 - DNA, 12 bp, Homo sapiens
tcctctggagcc

SEQ ID NO: 5794120 - DNA, 13 bp, Homo sapiens
tcctctggagcca

SEQ ID NO: 5794121 - DNA, 17 bp, Homo sapiens
tcctctggatggcacca

SEQ ID NO: 5794122 - DNA, 12 bp, Homo sapiens
tcctctggccca

SEQ ID NO: 5794123 - DNA, 13 bp, Homo sapiens
tcctctggcccag

SEQ ID NO: 5794124 - DNA, 18 bp, Homo sapiens
tcctctggcccagcctac

SEQ ID NO: 5794125 - DNA, 17 bp, Homo sapiens
tcctctggccgcagagg

SEQ ID NO: 5794126 - DNA, 18 bp, Homo sapiens
tcctctggccgcagaggt

SEQ ID NO: 5794127 - DNA, 19 bp, Homo sapiens
tcctctggctccccaaggc

SEQ ID NO: 5794128 - DNA, 13 bp, Homo sapiens
tcctctggcttcc

SEQ ID NO: 5794129 - DNA, 20 bp, Homo sapiens
tcctctgggcaggacctcag

SEQ ID NO: 5794130 - DNA, 16 bp, Homo sapiens
tcctctgggcctgggg

SEQ ID NO: 5794131 - DNA, 20 bp, Homo sapiens
tcctctgggcctggggtgca

SEQ ID NO: 5794132 - DNA, 15 bp, Homo sapiens
tcctctggtaaacat

SEQ ID NO: 5794133 - DNA, 24 bp, Homo sapiens
tcctctggtaaacattcctccagc

SEQ ID NO: 5794134 - DNA, 15 bp, Homo sapiens
tcctctggttccttt

SEQ ID NO: 5794135 - DNA, 17 bp, Homo sapiens
tcctctggttcctttca

SEQ ID NO: 5794136 - DNA, 20 bp, Homo sapiens
tcctctggttcctttcatct

SEQ ID NO: 5794137 - DNA, 13 bp, Homo sapiens
tcctctggtttct

SEQ ID NO: 5794138 - DNA, 15 bp, Homo sapiens
tcctctggtttctgt

SEQ ID NO: 5794139 - DNA, 18 bp, Homo sapiens
tcctctggtttctgtgtg

SEQ ID NO: 5794140 - DNA, 20 bp, Homo sapiens
tcctctggtttctgtgtgtc

SEQ ID NO: 5794141 - DNA, 17 bp, Homo sapiens
tcctctgtaagacaaca

SEQ ID NO: 5794142 - DNA, 16 bp, Homo sapiens
tcctctgtacagagcc

SEQ ID NO: 5794143 - DNA, 17 bp, Homo sapiens
tcctctgtacagagccc

SEQ ID NO: 5794144 - DNA, 23 bp, Homo sapiens
tcctctgtacagagcccacgccc

SEQ ID NO: 5794145 - DNA, 13 bp, Homo sapiens
tcctctgtacagc

SEQ ID NO: 5794146 - DNA, 15 bp, Homo sapiens
tcctctgtacagcaa

SEQ ID NO: 5794147 - DNA, 19 bp, Homo sapiens
tcctctgtagtatttttta

SEQ ID NO: 5794148 - DNA, 14 bp, Homo sapiens
tcctctgtccaggg

SEQ ID NO: 5794149 - DNA, 12 bp, Homo sapiens
tcctctgtccta

SEQ ID NO: 5794150 - DNA, 19 bp, Homo sapiens
tcctctgtcctgcttctga

SEQ ID NO: 5794151 - DNA, 15 bp, Homo sapiens
tcctctgtctctgct

SEQ ID NO: 5794152 - DNA, 17 bp, Homo sapiens
tcctctgtctctgctct

SEQ ID NO: 5794153 - DNA, 14 bp, Homo sapiens
tcctctgtgaactg

SEQ ID NO: 5794154 - DNA, 15 bp, Homo sapiens
tcctctgtgaactgt

SEQ ID NO: 5794155 - DNA, 12 bp, Homo sapiens
tcctctgtgaag

SEQ ID NO: 5794156 - DNA, 19 bp, Homo sapiens
tcctctgtgaccaatgtct

SEQ ID NO: 5794157 - DNA, 13 bp, Homo sapiens
tcctctgtgccac

SEQ ID NO: 5794158 - DNA, 14 bp, Homo sapiens
tcctctgtgctccc

SEQ ID NO: 5794159 - DNA, 16 bp, Homo sapiens
tcctctgtgctccctc

SEQ ID NO: 5794160 - DNA, 16 bp, Homo sapiens
tcctctgtgctctcct

SEQ ID NO: 5794161 - DNA, 22 bp, Homo sapiens
tcctctgtgctctcctagagct

SEQ ID NO: 5794162 - DNA, 14 bp, Homo sapiens
tcctctgtggccag

SEQ ID NO: 5794163 - DNA, 13 bp, Homo sapiens
tcctctgtggtgt

SEQ ID NO: 5794164 - DNA, 21 bp, Homo sapiens
tcctctgtggtgtctgcctgt

SEQ ID NO: 5794165 - DNA, 15 bp, Homo sapiens
tcctctgttaatgtg

SEQ ID NO: 5794166 - DNA, 22 bp, Homo sapiens
tcctctgttatttgtcctcatg

SEQ ID NO: 5794167 - DNA, 13 bp, Homo sapiens
tcctctgttcagt

SEQ ID NO: 5794168 - DNA, 23 bp, Homo sapiens
tcctctgttgcaaactcagttcc

SEQ ID NO: 5794169 - DNA, 15 bp, Homo sapiens
tcctcttaagacact

SEQ ID NO: 5794170 - DNA, 18 bp, Homo sapiens
tcctcttaagacactagt

SEQ ID NO: 5794171 - DNA, 14 bp, Homo sapiens
tcctcttagcctct

SEQ ID NO: 5794172 - DNA, 16 bp, Homo sapiens
tcctcttagcctctgg

SEQ ID NO: 5794173 - DNA, 16 bp, Homo sapiens
tcctgctacctttgtc

SEQ ID NO: 5794174 - DNA, 17 bp, Homo sapiens
tcctgctacctttgtct

SEQ ID NO: 5794175 - DNA, 14 bp, Homo sapiens
tcctgctactctgt

SEQ ID NO: 5794176 - DNA, 17 bp, Homo sapiens
tcctgctacttccccag

SEQ ID NO: 5794177 - DNA, 13 bp, Homo sapiens
tcctgctagaaat

SEQ ID NO: 5794178 - DNA, 15 bp, Homo sapiens
tcctgctagaaatgg

SEQ ID NO: 5794179 - DNA, 18 bp, Homo sapiens
tcctgctagcacctcccc

SEQ ID NO: 5794180 - DNA, 20 bp, Homo sapiens
tcctgctagcacctccccag

SEQ ID NO: 5794181 - DNA, 22 bp, Homo sapiens
tcctgctagcacctccccagac

SEQ ID NO: 5794182 - DNA, 23 bp, Homo sapiens
tcctgctagcacctccccagaca

SEQ ID NO: 5794183 - DNA, 14 bp, Homo sapiens
tcctgctagcaggc

SEQ ID NO: 5794184 - DNA, 23 bp, Homo sapiens
tcctgctagcaggccccctagga

SEQ ID NO: 5794185 - DNA, 17 bp, Homo sapiens
tcctgctagctgtagaa

SEQ ID NO: 5794186 - DNA, 22 bp, Homo sapiens
tcctgctagctgtagaaatgta

SEQ ID NO: 5794187 - DNA, 17 bp, Homo sapiens
tcctgctatgacagctg

SEQ ID NO: 5794188 - DNA, 15 bp, Homo sapiens
tcctgctcacatctg

SEQ ID NO: 5794189 - DNA, 13 bp, Homo sapiens
tcctgctcagcag

SEQ ID NO: 5794190 - DNA, 22 bp, Homo sapiens
tcctgctcattatgccacttcc

SEQ ID NO: 5794191 - DNA, 13 bp, Homo sapiens
tcctgctccagaa

SEQ ID NO: 5794192 - DNA, 12 bp, Homo sapiens
tcctgctccagc

SEQ ID NO: 5794193 - DNA, 13 bp, Homo sapiens
tcctgctccagca

SEQ ID NO: 5794194 - DNA, 15 bp, Homo sapiens
tcctgctccagcagc

SEQ ID NO: 5794195 - DNA, 12 bp, Homo sapiens
tcctgctccagt

SEQ ID NO: 5794196 - DNA, 19 bp, Homo sapiens
tcctgctccatgactggct

SEQ ID NO: 5794197 - DNA, 20 bp, Homo sapiens
tcctgctccatgactggctg

SEQ ID NO: 5794198 - DNA, 20 bp, Homo sapiens
tcctgctccctgtggcactc

SEQ ID NO: 5794199 - DNA, 18 bp, Homo sapiens
tcctgctccgctgcctgg

SEQ ID NO: 5794200 - DNA, 19 bp, Homo sapiens
tcctgctccgctgcctgga

SEQ ID NO: 5794201 - DNA, 13 bp, Homo sapiens
tcctgctcctcac

SEQ ID NO: 5794202 - DNA, 13 bp, Homo sapiens
tcctgctcctccc

SEQ ID NO: 5794203 - DNA, 19 bp, Homo sapiens
tcctgctcctccctgcccc

SEQ ID NO: 5794204 - DNA, 13 bp, Homo sapiens
tcctgctcgccct

SEQ ID NO: 5794205 - DNA, 15 bp, Homo sapiens
tcctgctctaaaata

SEQ ID NO: 5794206 - DNA, 18 bp, Homo sapiens
tcctgctctctacccagc

SEQ ID NO: 5794207 - DNA, 22 bp, Homo sapiens
tcctgctctctatccaaaataa

SEQ ID NO: 5794208 - DNA, 15 bp, Homo sapiens
tcctgctctctgctc

SEQ ID NO: 5794209 - DNA, 13 bp, Homo sapiens
tcctgctctgccc

SEQ ID NO: 5794210 - DNA, 12 bp, Homo sapiens
tcctgctctgct

SEQ ID NO: 5794211 - DNA, 13 bp, Homo sapiens
tcctgctctgctc

SEQ ID NO: 5794212 - DNA, 13 bp, Homo sapiens
tcctgctctgctt

SEQ ID NO: 5794213 - DNA, 19 bp, Homo sapiens
tcctgctctgcttcctcag

SEQ ID NO: 5794214 - DNA, 18 bp, Homo sapiens
tcctgctcttccatttct

SEQ ID NO: 5794215 - DNA, 17 bp, Homo sapiens
tcctgctcttttgtgat

SEQ ID NO: 5794216 - DNA, 21 bp, Homo sapiens
tcctgctgaaacacctcccag

SEQ ID NO: 5794217 - DNA, 22 bp, Homo sapiens
tcctgctgaaagtcctgctttc

SEQ ID NO: 5794218 - DNA, 23 bp, Homo sapiens
tcctgctgactatttgaccccca

SEQ ID NO: 5794219 - DNA, 14 bp, Homo sapiens
tcctgctgagctgc

SEQ ID NO: 5794220 - DNA, 16 bp, Homo sapiens
tcctgctgagctgccc

SEQ ID NO: 5794221 - DNA, 20 bp, Homo sapiens
tcctgctgagctgcccctgc

SEQ ID NO: 5794222 - DNA, 19 bp, Homo sapiens
tcctgctgagtggtccaca

SEQ ID NO: 5794223 - DNA, 20 bp, Homo sapiens
tcctgctgcacaggccctgg

SEQ ID NO: 5794224 - DNA, 19 bp, Homo sapiens
tcctgctgcaccaacccag

SEQ ID NO: 5794225 - DNA, 13 bp, Homo sapiens
tcctgctgcaccc

SEQ ID NO: 5794226 - DNA, 13 bp, Homo sapiens
tcctgctgcagtt

SEQ ID NO: 5794227 - DNA, 10 bp, Homo sapiens
tcctgctgcc

SEQ ID NO: 5794228 - DNA, 13 bp, Homo sapiens
tcctgctgccagt

SEQ ID NO: 5794229 - DNA, 19 bp, Homo sapiens
tcctgctgcctctctttca

SEQ ID NO: 5794230 - DNA, 14 bp, Homo sapiens
tcctgctgcctggg

SEQ ID NO: 5794231 - DNA, 20 bp, Homo sapiens
tcctgctgccttttctggag

SEQ ID NO: 5794232 - DNA, 16 bp, Homo sapiens
tcctgctgctccctca

SEQ ID NO: 5794233 - DNA, 19 bp, Homo sapiens
tcctgctgctcctctgact

SEQ ID NO: 5794234 - DNA, 12 bp, Homo sapiens
tcctgctgctcg

SEQ ID NO: 5794235 - DNA, 21 bp, Homo sapiens
tcctgctgctcgggaaggcct

SEQ ID NO: 5794236 - DNA, 22 bp, Homo sapiens
tcctgctgctcgggaaggcctg

SEQ ID NO: 5794237 - DNA, 23 bp, Homo sapiens
tcctgctgctcgggaaggcctga

SEQ ID NO: 5794238 - DNA, 21 bp, Homo sapiens
tcctgctgctgtaactgctga

SEQ ID NO: 5794239 - DNA, 24 bp, Homo sapiens
tcctgctgctgtaactgctgagcc

SEQ ID NO: 5794240 - DNA, 13 bp, Homo sapiens
tcctgctgctgtc

SEQ ID NO: 5794241 - DNA, 17 bp, Homo sapiens
tcctgctgctgtctggg

SEQ ID NO: 5794242 - DNA, 20 bp, Homo sapiens
tcctgctgctgtctgggtgc

SEQ ID NO: 5794243 - DNA, 15 bp, Homo sapiens
tcctgctgctgtgtt

SEQ ID NO: 5794244 - DNA, 16 bp, Homo sapiens
tcctgctggcacctca

SEQ ID NO: 5794245 - DNA, 16 bp, Homo sapiens
tcctgctggcctgctc

SEQ ID NO: 5794246 - DNA, 22 bp, Homo sapiens
tcctgctggctgaggcttgggc

SEQ ID NO: 5794247 - DNA, 14 bp, Homo sapiens
tcctgctgggactg

SEQ ID NO: 5794248 - DNA, 23 bp, Homo sapiens
tcctgctggtacctgccctctat

SEQ ID NO: 5794249 - DNA, 14 bp, Homo sapiens
tcctgctggtgacc

SEQ ID NO: 5794250 - DNA, 22 bp, Homo sapiens
tcctgctgtagtcctttctgcc

SEQ ID NO: 5794251 - DNA, 12 bp, Homo sapiens
tcctgctgtccc

SEQ ID NO: 5794252 - DNA, 14 bp, Homo sapiens
tcctgctgtcctgg

SEQ ID NO: 5794253 - DNA, 16 bp, Homo sapiens
tcctgctgtcctggtg

SEQ ID NO: 5794254 - DNA, 13 bp, Homo sapiens
tcctgctgtcttc

SEQ ID NO: 5794255 - DNA, 16 bp, Homo sapiens
tcctgctgtcttctcc

SEQ ID NO: 5794256 - DNA, 14 bp, Homo sapiens
tcctgctgtggcct

SEQ ID NO: 5794257 - DNA, 16 bp, Homo sapiens
tcctgctgtggcctca

SEQ ID NO: 5794258 - DNA, 21 bp, Homo sapiens
tcctgctgtgtgaattcccag

SEQ ID NO: 5794259 - DNA, 23 bp, Homo sapiens
tcctgctgtgtgaattcccaggt

SEQ ID NO: 5794260 - DNA, 14 bp, Homo sapiens
tcctgctgttacat

SEQ ID NO: 5794261 - DNA, 17 bp, Homo sapiens
tcctgcttaaacacaag

SEQ ID NO: 5794262 - DNA, 19 bp, Homo sapiens
tcctgcttaaacttgaccc

SEQ ID NO: 5794263 - DNA, 16 bp, Homo sapiens
tcctgcttagaattaa

SEQ ID NO: 5794264 - DNA, 15 bp, Homo sapiens
tcctgcttcccctcc

SEQ ID NO: 5794265 - DNA, 16 bp, Homo sapiens
tcctgcttcccctccc

SEQ ID NO: 5794266 - DNA, 19 bp, Homo sapiens
tcctgcttcccctccctac

SEQ ID NO: 5794267 - DNA, 12 bp, Homo sapiens
tcctgcttccct

SEQ ID NO: 5794268 - DNA, 22 bp, Homo sapiens
tcctgcttcctaggccccagag

SEQ ID NO: 5794269 - DNA, 23 bp, Homo sapiens
tcctgcttcctaggccccagagc

SEQ ID NO: 5794270 - DNA, 17 bp, Homo sapiens
tcctgcttcctcttttc

SEQ ID NO: 5794271 - DNA, 12 bp, Homo sapiens
tcctgcttcctg

SEQ ID NO: 5794272 - DNA, 21 bp, Homo sapiens
tcctgcttcctgaaagctgtt

SEQ ID NO: 5794273 - DNA, 17 bp, Homo sapiens
tcctgcttctctcagcc

SEQ ID NO: 5794274 - DNA, 20 bp, Homo sapiens
tcctgcttgaactgctgcca

SEQ ID NO: 5794275 - DNA, 22 bp, Homo sapiens
tcctgcttgatgggattctgga

SEQ ID NO: 5794276 - DNA, 12 bp, Homo sapiens
tcctgcttgcca

SEQ ID NO: 5794277 - DNA, 21 bp, Homo sapiens
tcctgcttgtactaagccagg

SEQ ID NO: 5794278 - DNA, 23 bp, Homo sapiens
tcctgcttgtactaagccaggag

SEQ ID NO: 5794279 - DNA, 14 bp, Homo sapiens
tcctgctttctctt

SEQ ID NO: 5794280 - DNA, 17 bp, Homo sapiens
tcctgcttttctgtcct

SEQ ID NO: 5794281 - DNA, 15 bp, Homo sapiens
tcctggaaacagcat

SEQ ID NO: 5794282 - DNA, 18 bp, Homo sapiens
tcctggaaacagcatgaa

SEQ ID NO: 5794283 - DNA, 20 bp, Homo sapiens
tcctggaaacagcatgaata

SEQ ID NO: 5794284 - DNA, 14 bp, Homo sapiens
tcctggaaaccaca

SEQ ID NO: 5794285 - DNA, 16 bp, Homo sapiens
tcctggaaatttgtgt

SEQ ID NO: 5794286 - DNA, 22 bp, Homo sapiens
tcctggaaatttgtgtgcttca

SEQ ID NO: 5794287 - DNA, 14 bp, Homo sapiens
tcctggaacaatat

SEQ ID NO: 5794288 - DNA, 19 bp, Homo sapiens
tcctggaacaatattttat

SEQ ID NO: 5794289 - DNA, 15 bp, Homo sapiens
tcctggaacctggac

SEQ ID NO: 5794290 - DNA, 18 bp, Homo sapiens
tcctggaacctggcaggc

SEQ ID NO: 5794291 - DNA, 20 bp, Homo sapiens
tcctggaacctggcaggccc

SEQ ID NO: 5794292 - DNA, 18 bp, Homo sapiens
tcctggaacctgtctcca

SEQ ID NO: 5794293 - DNA, 23 bp, Homo sapiens
tcctggaagaacaaatctaccag

SEQ ID NO: 5794294 - DNA, 19 bp, Homo sapiens
tcctggaagacaacccagg

SEQ ID NO: 5794295 - DNA, 21 bp, Homo sapiens
tcctggaagacaacccaggca

SEQ ID NO: 5794296 - DNA, 16 bp, Homo sapiens
tcctggaagcagagca

SEQ ID NO: 5794297 - DNA, 19 bp, Homo sapiens
tcctggaagcagagcaaaa

SEQ ID NO: 5794298 - DNA, 17 bp, Homo sapiens
tcctggaagcaggtgct

SEQ ID NO: 5794299 - DNA, 18 bp, Homo sapiens
tcctggaagcaggtgcta

SEQ ID NO: 5794300 - DNA, 20 bp, Homo sapiens
tcctggaagccagctttccc

SEQ ID NO: 5794301 - DNA, 22 bp, Homo sapiens
tcctggaagcgcgagggcctca

SEQ ID NO: 5794302 - DNA, 17 bp, Homo sapiens
tcctggaaggacacagt

SEQ ID NO: 5794303 - DNA, 23 bp, Homo sapiens
tcctggaaggacacagtgatgaa

SEQ ID NO: 5794304 - DNA, 20 bp, Homo sapiens
tcctggaagtgtgtgtttct

SEQ ID NO: 5794305 - DNA, 17 bp, Homo sapiens
tcctggaattgccagct

SEQ ID NO: 5794306 - DNA, 12 bp, Homo sapiens
tcctggacacac

SEQ ID NO: 5794307 - DNA, 13 bp, Homo sapiens
tcctggacacctc

SEQ ID NO: 5794308 - DNA, 19 bp, Homo sapiens
tcctggacacctcccaggg

SEQ ID NO: 5794309 - DNA, 21 bp, Homo sapiens
tcctggacacctcccagggga

SEQ ID NO: 5794310 - DNA, 17 bp, Homo sapiens
tcctggacactcagacc

SEQ ID NO: 5794311 - DNA, 19 bp, Homo sapiens
tcctggacactcagacctg

SEQ ID NO: 5794312 - DNA, 16 bp, Homo sapiens
tcctggacagctgtgc

SEQ ID NO: 5794313 - DNA, 18 bp, Homo sapiens
tcctggacagctgtgcct

SEQ ID NO: 5794314 - DNA, 19 bp, Homo sapiens
tcctggacagctgtgcctc

SEQ ID NO: 5794315 - DNA, 22 bp, Homo sapiens
tcctggacagctgtgcctcgct

SEQ ID NO: 5794316 - DNA, 22 bp, Homo sapiens
tcctggacagtgagagcagggc

SEQ ID NO: 5794317 - DNA, 22 bp, Homo sapiens
tcctggacatcctcttctgctt

SEQ ID NO: 5794318 - DNA, 21 bp, Homo sapiens
tcctggacatgaagattcttt

SEQ ID NO: 5794319 - DNA, 17 bp, Homo sapiens
tcctggaccaggcccat

SEQ ID NO: 5794320 - DNA, 14 bp, Homo sapiens
tcctggaccctggc

SEQ ID NO: 5794321 - DNA, 13 bp, Homo sapiens
tcctggacctgaa

SEQ ID NO: 5794322 - DNA, 20 bp, Homo sapiens
tcctggaccttgacagagca

SEQ ID NO: 5794323 - DNA, 21 bp, Homo sapiens
tcctggaccttgacagagcag

SEQ ID NO: 5794324 - DNA, 23 bp, Homo sapiens
tcctggaccttgacagagcagct

SEQ ID NO: 5794325 - DNA, 18 bp, Homo sapiens
tcctggactactttcatt

SEQ ID NO: 5794326 - DNA, 14 bp, Homo sapiens
tcctggactcattg

SEQ ID NO: 5794327 - DNA, 17 bp, Homo sapiens
tcctggactccggagga

SEQ ID NO: 5794328 - DNA, 23 bp, Homo sapiens
tcctggactccggaggactgagc

SEQ ID NO: 5794329 - DNA, 22 bp, Homo sapiens
tcctggactgagggggcctgga

SEQ ID NO: 5794330 - DNA, 16 bp, Homo sapiens
tcctggactggccctt

SEQ ID NO: 5794331 - DNA, 21 bp, Homo sapiens
tcctggactggcccttgccca

SEQ ID NO: 5794332 - DNA, 14 bp, Homo sapiens
tcctggactggtta

SEQ ID NO: 5794333 - DNA, 19 bp, Homo sapiens
tcctggactggttatcttg

SEQ ID NO: 5794334 - DNA, 22 bp, Homo sapiens
tcctggactggttatcttgtta

SEQ ID NO: 5794335 - DNA, 12 bp, Homo sapiens
tcctggactgta

SEQ ID NO: 5794336 - DNA, 20 bp, Homo sapiens
tcctggacttacaaaatgcc

SEQ ID NO: 5794337 - DNA, 21 bp, Homo sapiens
tcctggagacttaatagacat

SEQ ID NO: 5794338 - DNA, 18 bp, Homo sapiens
tcctggagagtctcactc

SEQ ID NO: 5794339 - DNA, 19 bp, Homo sapiens
tcctggagagtctcactcc

SEQ ID NO: 5794340 - DNA, 13 bp, Homo sapiens
tcctggagcactg

SEQ ID NO: 5794341 - DNA, 13 bp, Homo sapiens
tcctggagcagaa

SEQ ID NO: 5794342 - DNA, 18 bp, Homo sapiens
tcctggagcagaagcagc

SEQ ID NO: 5794343 - DNA, 19 bp, Homo sapiens
tcctggagcagaagcagca

SEQ ID NO: 5794344 - DNA, 20 bp, Homo sapiens
tcctggagcagaagcagcaa

SEQ ID NO: 5794345 - DNA, 18 bp, Homo sapiens
tcctggagcagaccaccc

SEQ ID NO: 5794346 - DNA, 16 bp, Homo sapiens
tcctggagcatcccag

SEQ ID NO: 5794347 - DNA, 18 bp, Homo sapiens
tcctggagcatcccaggc

SEQ ID NO: 5794348 - DNA, 15 bp, Homo sapiens
tcctggagctctgtg

SEQ ID NO: 5794349 - DNA, 18 bp, Homo sapiens
tcctggagctctgtgggt

SEQ ID NO: 5794350 - DNA, 11 bp, Homo sapiens
tcctgtttcta

SEQ ID NO: 5794351 - DNA, 20 bp, Homo sapiens
tcctgtttctcagtctcaca

SEQ ID NO: 5794352 - DNA, 18 bp, Homo sapiens
tcctgtttctgaaaagaa

SEQ ID NO: 5794353 - DNA, 16 bp, Homo sapiens
tcctgtttgaacccag

SEQ ID NO: 5794354 - DNA, 18 bp, Homo sapiens
tcctgtttgaacccagga

SEQ ID NO: 5794355 - DNA, 24 bp, Homo sapiens
tcctgtttggaaatggggagctgg

SEQ ID NO: 5794356 - DNA, 22 bp, Homo sapiens
tcctgtttgggcccctctccca

SEQ ID NO: 5794357 - DNA, 12 bp, Homo sapiens
tcctgtttgtat

SEQ ID NO: 5794358 - DNA, 21 bp, Homo sapiens
tcctgtttgtatttttttcca

SEQ ID NO: 5794359 - DNA, 22 bp, Homo sapiens
tcctgtttgtatttttttccaa

SEQ ID NO: 5794360 - DNA, 17 bp, Homo sapiens
tcctgtttgtctacata

SEQ ID NO: 5794361 - DNA, 20 bp, Homo sapiens
tcctgttttaagcagctcta

SEQ ID NO: 5794362 - DNA, 18 bp, Homo sapiens
tcctgttttacagctgcc

SEQ ID NO: 5794363 - DNA, 14 bp, Homo sapiens
tcctgttttatata

SEQ ID NO: 5794364 - DNA, 15 bp, Homo sapiens
tcctgttttatatat

SEQ ID NO: 5794365 - DNA, 20 bp, Homo sapiens
tcctgttttatatattatgt

SEQ ID NO: 5794366 - DNA, 14 bp, Homo sapiens
tcctgttttcatgg

SEQ ID NO: 5794367 - DNA, 16 bp, Homo sapiens
tcctgttttctccctc

SEQ ID NO: 5794368 - DNA, 17 bp, Homo sapiens
tcctgttttctctgtga

SEQ ID NO: 5794369 - DNA, 22 bp, Homo sapiens
tcctgttttcttaggcactgag

SEQ ID NO: 5794370 - DNA, 20 bp, Homo sapiens
tcctgtttttattattaaca

SEQ ID NO: 5794371 - DNA, 13 bp, Homo sapiens
tcctgtttttgtt

SEQ ID NO: 5794372 - DNA, 19 bp, Homo sapiens
tcctgtttttgttaacttt

SEQ ID NO: 5794373 - DNA, 20 bp, Homo sapiens
tccttaaaaaaaaaaaaatt

SEQ ID NO: 5794374 - DNA, 19 bp, Homo sapiens
tccttaaaaaaaaaaatga

SEQ ID NO: 5794375 - DNA, 12 bp, Homo sapiens
tccttaaaaatc

SEQ ID NO: 5794376 - DNA, 19 bp, Homo sapiens
tccttaaaaatcacactgt

SEQ ID NO: 5794377 - DNA, 15 bp, Homo sapiens
tccttaaaacagaga

SEQ ID NO: 5794378 - DNA, 18 bp, Homo sapiens
tccttaaaatgtaagatt

SEQ ID NO: 5794379 - DNA, 22 bp, Homo sapiens
tccttaaaatgtgagtgacctc

SEQ ID NO: 5794380 - DNA, 21 bp, Homo sapiens
tccttaaaattaagttgaaaa

SEQ ID NO: 5794381 - DNA, 17 bp, Homo sapiens
tccttaaactgtgtgga

SEQ ID NO: 5794382 - DNA, 17 bp, Homo sapiens
tccttaaagagtgtggc

SEQ ID NO: 5794383 - DNA, 23 bp, Homo sapiens
tccttaaaggcaccatctaatag

SEQ ID NO: 5794384 - DNA, 21 bp, Homo sapiens
tccttaaagggtttgagatgt

SEQ ID NO: 5794385 - DNA, 17 bp, Homo sapiens
tccttaaatcttaatgt

SEQ ID NO: 5794386 - DNA, 23 bp, Homo sapiens
tccttaaccaccgcatatgcatg

SEQ ID NO: 5794387 - DNA, 17 bp, Homo sapiens
tccttaacctttattaa

SEQ ID NO: 5794388 - DNA, 22 bp, Homo sapiens
tccttaactaaatgataaatgt

SEQ ID NO: 5794389 - DNA, 17 bp, Homo sapiens
tccttaagagaagaaat

SEQ ID NO: 5794390 - DNA, 16 bp, Homo sapiens
tccttaagagacaatt

SEQ ID NO: 5794391 - DNA, 14 bp, Homo sapiens
tccttaagcagagg

SEQ ID NO: 5794392 - DNA, 17 bp, Homo sapiens
tccttaagtcagaacag

SEQ ID NO: 5794393 - DNA, 13 bp, Homo sapiens
tccttaataacta

SEQ ID NO: 5794394 - DNA, 20 bp, Homo sapiens
tccttaatgaagagccagcc

SEQ ID NO: 5794395 - DNA, 22 bp, Homo sapiens
tccttaatgaagagccagccca

SEQ ID NO: 5794396 - DNA, 14 bp, Homo sapiens
tccttaatgatccg

SEQ ID NO: 5794397 - DNA, 18 bp, Homo sapiens
tccttaattcactcccac

SEQ ID NO: 5794398 - DNA, 16 bp, Homo sapiens
tccttacaaatgattg

SEQ ID NO: 5794399 - DNA, 21 bp, Homo sapiens
tccttacaagttagaaaacat

SEQ ID NO: 5794400 - DNA, 19 bp, Homo sapiens
tccttacaatgtgaataat

SEQ ID NO: 5794401 - DNA, 14 bp, Homo sapiens
tccttacactcccc

SEQ ID NO: 5794402 - DNA, 23 bp, Homo sapiens
tccttacagacacccataataaa

SEQ ID NO: 5794403 - DNA, 13 bp, Homo sapiens
tccttacaggtgt

SEQ ID NO: 5794404 - DNA, 23 bp, Homo sapiens
tccttaccaaggataattaaata

SEQ ID NO: 5794405 - DNA, 21 bp, Homo sapiens
tccttaccaatagcctgaatt

SEQ ID NO: 5794406 - DNA, 23 bp, Homo sapiens
tccttaccagagacgcccagccc

SEQ ID NO: 5794407 - DNA, 16 bp, Homo sapiens
tccttaccagcagagc

SEQ ID NO: 5794408 - DNA, 17 bp, Homo sapiens
tccttaccagcagagca

SEQ ID NO: 5794409 - DNA, 18 bp, Homo sapiens
tccttaccagcagagcac

SEQ ID NO: 5794410 - DNA, 21 bp, Homo sapiens
tccttaccagcagagcacctt

SEQ ID NO: 5794411 - DNA, 15 bp, Homo sapiens
tccttaccccagctg

SEQ ID NO: 5794412 - DNA, 19 bp, Homo sapiens
tccttaccccagctgcggc

SEQ ID NO: 5794413 - DNA, 20 bp, Homo sapiens
tccttaccccagctgcggca

SEQ ID NO: 5794414 - DNA, 15 bp, Homo sapiens
tccttacctcgggga

SEQ ID NO: 5794415 - DNA, 13 bp, Homo sapiens
tccttacctggaa

SEQ ID NO: 5794416 - DNA, 14 bp, Homo sapiens
tccttacctggaaa

SEQ ID NO: 5794417 - DNA, 16 bp, Homo sapiens
tccttactagaaatat

SEQ ID NO: 5794418 - DNA, 15 bp, Homo sapiens
tccttactcagagct

SEQ ID NO: 5794419 - DNA, 16 bp, Homo sapiens
tccttactcagagctg

SEQ ID NO: 5794420 - DNA, 17 bp, Homo sapiens
tccttactcagagctgc

SEQ ID NO: 5794421 - DNA, 20 bp, Homo sapiens
tccttactcccccaccactc

SEQ ID NO: 5794422 - DNA, 17 bp, Homo sapiens
tccttactcctgtggga

SEQ ID NO: 5794423 - DNA, 23 bp, Homo sapiens
tccttactcctgtgggagcctcg

SEQ ID NO: 5794424 - DNA, 17 bp, Homo sapiens
tccttactctgagccca

SEQ ID NO: 5794425 - DNA, 22 bp, Homo sapiens
tccttactctgagcccaggccg

SEQ ID NO: 5794426 - DNA, 15 bp, Homo sapiens
tccttacttccagca

SEQ ID NO: 5794427 - DNA, 16 bp, Homo sapiens
tccttacttccagcaa

SEQ ID NO: 5794428 - DNA, 15 bp, Homo sapiens
tccttacttgcactg

SEQ ID NO: 5794429 - DNA, 17 bp, Homo sapiens
tccttactttttatata

SEQ ID NO: 5794430 - DNA, 18 bp, Homo sapiens
tccttactttttatatat

SEQ ID NO: 5794431 - DNA, 20 bp, Homo sapiens
tccttagaaaagactgacct

SEQ ID NO: 5794432 - DNA, 15 bp, Homo sapiens
tccttagaacatttt

SEQ ID NO: 5794433 - DNA, 14 bp, Homo sapiens
tccttagaagtgga

SEQ ID NO: 5794434 - DNA, 20 bp, Homo sapiens
tccttagaatactgtattgt

SEQ ID NO: 5794435 - DNA, 22 bp, Homo sapiens
tccttagacacctatcagagaa

SEQ ID NO: 5794436 - DNA, 22 bp, Homo sapiens
tccttagacactttggaatcta

SEQ ID NO: 5794437 - DNA, 18 bp, Homo sapiens
tccttagacccgccaggt

SEQ ID NO: 5794438 - DNA, 19 bp, Homo sapiens
tccttagagaagtttgtgg

SEQ ID NO: 5794439 - DNA, 13 bp, Homo sapiens
tccttagaggaag

SEQ ID NO: 5794440 - DNA, 17 bp, Homo sapiens
tccttagaggaagaata

SEQ ID NO: 5794441 - DNA, 20 bp, Homo sapiens
tccttagatgtgtctcctgt

SEQ ID NO: 5794442 - DNA, 17 bp, Homo sapiens
tccttagcagctcaggc

SEQ ID NO: 5794443 - DNA, 22 bp, Homo sapiens
tccttagcagctcaggcgcagc

SEQ ID NO: 5794444 - DNA, 23 bp, Homo sapiens
tccttagcctggacctctgacag

SEQ ID NO: 5794445 - DNA, 17 bp, Homo sapiens
tccttagcctgggcctc

SEQ ID NO: 5794446 - DNA, 21 bp, Homo sapiens
tccttagcctgggcctcctcc

SEQ ID NO: 5794447 - DNA, 21 bp, Homo sapiens
tccttagctgtaaaatggaag

SEQ ID NO: 5794448 - DNA, 18 bp, Homo sapiens
tccttagcttagacctca

SEQ ID NO: 5794449 - DNA, 21 bp, Homo sapiens
tccttagcttagacctcagcc

SEQ ID NO: 5794450 - DNA, 22 bp, Homo sapiens
tccttagcttagacctcagcct

SEQ ID NO: 5794451 - DNA, 15 bp, Homo sapiens
tccttagctttccct

SEQ ID NO: 5794452 - DNA, 20 bp, Homo sapiens
tccttagctttccctgtgcc

SEQ ID NO: 5794453 - DNA, 21 bp, Homo sapiens
tccttagctttccctgtgcca

SEQ ID NO: 5794454 - DNA, 20 bp, Homo sapiens
tccttaggaaaatgcttctg

SEQ ID NO: 5794455 - DNA, 21 bp, Homo sapiens
tccttaggagacgctgcactt

SEQ ID NO: 5794456 - DNA, 14 bp, Homo sapiens
tccttaggctactg

SEQ ID NO: 5794457 - DNA, 13 bp, Homo sapiens
tccttaggcttac

SEQ ID NO: 5794458 - DNA, 18 bp, Homo sapiens
tccttaggttgtagcaga

SEQ ID NO: 5794459 - DNA, 14 bp, Homo sapiens
tccttagtaaattc

SEQ ID NO: 5794460 - DNA, 15 bp, Homo sapiens
tccttagtatcagtc

SEQ ID NO: 5794461 - DNA, 23 bp, Homo sapiens
tccttagtatcagtcatgacaga

SEQ ID NO: 5794462 - DNA, 16 bp, Homo sapiens
tccttagtcttctcat

SEQ ID NO: 5794463 - DNA, 17 bp, Homo sapiens
tccttagtcttctcata

SEQ ID NO: 5794464 - DNA, 18 bp, Homo sapiens
tccttagtcttctcatag

SEQ ID NO: 5794465 - DNA, 15 bp, Homo sapiens
tccttataaaaattc

SEQ ID NO: 5794466 - DNA, 17 bp, Homo sapiens
tccttataaaaattcta

SEQ ID NO: 5794467 - DNA, 13 bp, Homo sapiens
tccttataagaat

SEQ ID NO: 5794468 - DNA, 14 bp, Homo sapiens
tccttatactgtat

SEQ ID NO: 5794469 - DNA, 21 bp, Homo sapiens
tccttataggtgtaaatgaga

SEQ ID NO: 5794470 - DNA, 15 bp, Homo sapiens
tccttatcaaaggac

SEQ ID NO: 5794471 - DNA, 14 bp, Homo sapiens
tccttatcagagct

SEQ ID NO: 5794472 - DNA, 14 bp, Homo sapiens
tccttatccctctc

SEQ ID NO: 5794473 - DNA, 17 bp, Homo sapiens
tccttatccctctcttc

SEQ ID NO: 5794474 - DNA, 19 bp, Homo sapiens
tccttatccctctcttccc

SEQ ID NO: 5794475 - DNA, 22 bp, Homo sapiens
tccttatcctagcctttgggca

SEQ ID NO: 5794476 - DNA, 17 bp, Homo sapiens
tccttatcgaaactcat

SEQ ID NO: 5794477 - DNA, 15 bp, Homo sapiens
tccttatctagctgc

SEQ ID NO: 5794478 - DNA, 15 bp, Homo sapiens
tccttatctataaaa

SEQ ID NO: 5794479 - DNA, 19 bp, Homo sapiens
tccttatgagactcttaaa

SEQ ID NO: 5794480 - DNA, 22 bp, Homo sapiens
tccttatgagactcttaaatat

SEQ ID NO: 5794481 - DNA, 19 bp, Homo sapiens
tccttatgcatgaaatgaa

SEQ ID NO: 5794482 - DNA, 17 bp, Homo sapiens
tccttatgcttgggcct

SEQ ID NO: 5794483 - DNA, 21 bp, Homo sapiens
tccttatgtatcagtgtcctt

SEQ ID NO: 5794484 - DNA, 15 bp, Homo sapiens
tccttatgtcctcca

SEQ ID NO: 5794485 - DNA, 18 bp, Homo sapiens
tccttattatcccagctt

SEQ ID NO: 5794486 - DNA, 23 bp, Homo sapiens
tccttattatcccagcttgctga

SEQ ID NO: 5794487 - DNA, 14 bp, Homo sapiens
tccttattccacag

SEQ ID NO: 5794488 - DNA, 17 bp, Homo sapiens
tccttattccacagata

SEQ ID NO: 5794489 - DNA, 15 bp, Homo sapiens
tccttattcttctca

SEQ ID NO: 5794490 - DNA, 16 bp, Homo sapiens
tccttattcttgtggt

SEQ ID NO: 5794491 - DNA, 19 bp, Homo sapiens
tccttattgggacttttct

SEQ ID NO: 5794492 - DNA, 19 bp, Homo sapiens
tccttattgtttgtaaaca

SEQ ID NO: 5794493 - DNA, 23 bp, Homo sapiens
tccttattgtttgtaaacaacaa

SEQ ID NO: 5794494 - DNA, 14 bp, Homo sapiens
tccttatttatcaa

SEQ ID NO: 5794495 - DNA, 20 bp, Homo sapiens
tccttatttcaagggttgct

SEQ ID NO: 5794496 - DNA, 15 bp, Homo sapiens
tccttatttctctct

SEQ ID NO: 5794497 - DNA, 17 bp, Homo sapiens
tccttatttctctctcc

SEQ ID NO: 5794498 - DNA, 13 bp, Homo sapiens
tccttatttgcct

SEQ ID NO: 5794499 - DNA, 14 bp, Homo sapiens
tccttatttgcctt

SEQ ID NO: 5794500 - DNA, 15 bp, Homo sapiens
tccttatttgccttc

SEQ ID NO: 5794501 - DNA, 13 bp, Homo sapiens
tccttattttgta

SEQ ID NO: 5794502 - DNA, 23 bp, Homo sapiens
tccttcaaaacattctcctttgc

SEQ ID NO: 5794503 - DNA, 15 bp, Homo sapiens
tccttcaaaatcctt

SEQ ID NO: 5794504 - DNA, 16 bp, Homo sapiens
tccttcaaagcaaatg

SEQ ID NO: 5794505 - DNA, 13 bp, Homo sapiens
tccttcaaagtct

SEQ ID NO: 5794506 - DNA, 18 bp, Homo sapiens
tccttcaaagtctcaatg

SEQ ID NO: 5794507 - DNA, 17 bp, Homo sapiens
tccttcaaataaagaaa

SEQ ID NO: 5794508 - DNA, 15 bp, Homo sapiens
tccttcaactctgtg

SEQ ID NO: 5794509 - DNA, 16 bp, Homo sapiens
tccttcaactctgtga

SEQ ID NO: 5794510 - DNA, 18 bp, Homo sapiens
tccttcaactctgtgagg

SEQ ID NO: 5794511 - DNA, 20 bp, Homo sapiens
tccttcaagatcatgtaccc

SEQ ID NO: 5794512 - DNA, 22 bp, Homo sapiens
tccttcaagattccatttctta

SEQ ID NO: 5794513 - DNA, 19 bp, Homo sapiens
tccttcaagttagctcagg

SEQ ID NO: 5794514 - DNA, 19 bp, Homo sapiens
tccttcacaggcagtgcat

SEQ ID NO: 5794515 - DNA, 15 bp, Homo sapiens
tccttcacatctccc

SEQ ID NO: 5794516 - DNA, 16 bp, Homo sapiens
tccttcacatctccca

SEQ ID NO: 5794517 - DNA, 13 bp, Homo sapiens
tccttcaccaccc

SEQ ID NO: 5794518 - DNA, 14 bp, Homo sapiens
tccttcaccagagc

SEQ ID NO: 5794519 - DNA, 18 bp, Homo sapiens
tccttcaccctccgttga

SEQ ID NO: 5794520 - DNA, 22 bp, Homo sapiens
tccttcaccctccgttgacagt

SEQ ID NO: 5794521 - DNA, 13 bp, Homo sapiens
tccttcacctctg

SEQ ID NO: 5794522 - DNA, 15 bp, Homo sapiens
tccttcactccctgt

SEQ ID NO: 5794523 - DNA, 22 bp, Homo sapiens
tccttcactccctgtcatagtt

SEQ ID NO: 5794524 - DNA, 22 bp, Homo sapiens
tccttcactcctgcctcctcag

SEQ ID NO: 5794525 - DNA, 18 bp, Homo sapiens
tccttcactctaaaaata

SEQ ID NO: 5794526 - DNA, 16 bp, Homo sapiens
tcctttaccctcatct

SEQ ID NO: 5794527 - DNA, 17 bp, Homo sapiens
tcctttaccctccacac

SEQ ID NO: 5794528 - DNA, 15 bp, Homo sapiens
tcctttacctttcag

SEQ ID NO: 5794529 - DNA, 17 bp, Homo sapiens
tcctttacctttcagtg

SEQ ID NO: 5794530 - DNA, 16 bp, Homo sapiens
tcctttacgtgtttaa

SEQ ID NO: 5794531 - DNA, 15 bp, Homo sapiens
tcctttactcctggc

SEQ ID NO: 5794532 - DNA, 16 bp, Homo sapiens
tcctttactcctggct

SEQ ID NO: 5794533 - DNA, 17 bp, Homo sapiens
tcctttactttcccttg

SEQ ID NO: 5794534 - DNA, 22 bp, Homo sapiens
tcctttagatagcagcctggct

SEQ ID NO: 5794535 - DNA, 15 bp, Homo sapiens
tcctttagcgcccag

SEQ ID NO: 5794536 - DNA, 14 bp, Homo sapiens
tcctttaggcagcc

SEQ ID NO: 5794537 - DNA, 18 bp, Homo sapiens
tcctttaggtttgaaagg

SEQ ID NO: 5794538 - DNA, 23 bp, Homo sapiens
tcctttagtaaaactccgagtga

SEQ ID NO: 5794539 - DNA, 12 bp, Homo sapiens
tcctttataagt

SEQ ID NO: 5794540 - DNA, 18 bp, Homo sapiens
tcctttataatatttcag

SEQ ID NO: 5794541 - DNA, 12 bp, Homo sapiens
tcctttatagag

SEQ ID NO: 5794542 - DNA, 18 bp, Homo sapiens
tcctttatccacttttct

SEQ ID NO: 5794543 - DNA, 19 bp, Homo sapiens
tcctttatccacttttctt

SEQ ID NO: 5794544 - DNA, 15 bp, Homo sapiens
tcctttatcccctcc

SEQ ID NO: 5794545 - DNA, 17 bp, Homo sapiens
tcctttatcccctcctt

SEQ ID NO: 5794546 - DNA, 14 bp, Homo sapiens
tcctttatctgtaa

SEQ ID NO: 5794547 - DNA, 16 bp, Homo sapiens
tcctttatgtgaattt

SEQ ID NO: 5794548 - DNA, 19 bp, Homo sapiens
tcctttatgtgatgtaact

SEQ ID NO: 5794549 - DNA, 19 bp, Homo sapiens
tcctttatttaggaaacac

SEQ ID NO: 5794550 - DNA, 16 bp, Homo sapiens
tcctttattttaaatg

SEQ ID NO: 5794551 - DNA, 15 bp, Homo sapiens
tcctttattttattg

SEQ ID NO: 5794552 - DNA, 23 bp, Homo sapiens
tcctttattttattgaaatgtat

SEQ ID NO: 5794553 - DNA, 13 bp, Homo sapiens
tcctttcaagggg

SEQ ID NO: 5794554 - DNA, 19 bp, Homo sapiens
tcctttcaataaagttgtt

SEQ ID NO: 5794555 - DNA, 20 bp, Homo sapiens
tcctttcaataaagttgttg

SEQ ID NO: 5794556 - DNA, 21 bp, Homo sapiens
tcctttcaccccagggcctga

SEQ ID NO: 5794557 - DNA, 13 bp, Homo sapiens
tcctttcagagtt

SEQ ID NO: 5794558 - DNA, 23 bp, Homo sapiens
tcctttcagggaatttcaggaac

SEQ ID NO: 5794559 - DNA, 20 bp, Homo sapiens
tcctttcagtggcttggact

SEQ ID NO: 5794560 - DNA, 19 bp, Homo sapiens
tcctttcatatagttagct

SEQ ID NO: 5794561 - DNA, 13 bp, Homo sapiens
tcctttcatcctc

SEQ ID NO: 5794562 - DNA, 16 bp, Homo sapiens
tcctttcatctctcta

SEQ ID NO: 5794563 - DNA, 17 bp, Homo sapiens
tcctttcatctctctac

SEQ ID NO: 5794564 - DNA, 21 bp, Homo sapiens
tcctttcatctctctacctcc

SEQ ID NO: 5794565 - DNA, 19 bp, Homo sapiens
tcctttcattaccctacag

SEQ ID NO: 5794566 - DNA, 22 bp, Homo sapiens
tcctttcattaggcaaagtaca

SEQ ID NO: 5794567 - DNA, 20 bp, Homo sapiens
tcctttcatttactgtggct

SEQ ID NO: 5794568 - DNA, 14 bp, Homo sapiens
tcctttccaccttc

SEQ ID NO: 5794569 - DNA, 19 bp, Homo sapiens
tcctttccaccttctcaca

SEQ ID NO: 5794570 - DNA, 12 bp, Homo sapiens
tcctttccactg

SEQ ID NO: 5794571 - DNA, 14 bp, Homo sapiens
tcctttccaggtat

SEQ ID NO: 5794572 - DNA, 15 bp, Homo sapiens
tcctttccatcagct

SEQ ID NO: 5794573 - DNA, 21 bp, Homo sapiens
tcctttccatcagctttataa

SEQ ID NO: 5794574 - DNA, 13 bp, Homo sapiens
tcctttcccaagc

SEQ ID NO: 5794575 - DNA, 12 bp, Homo sapiens
tcctttcccaca

SEQ ID NO: 5794576 - DNA, 15 bp, Homo sapiens
tcctttcccacagtc

SEQ ID NO: 5794577 - DNA, 15 bp, Homo sapiens
tcctttccccagccc

SEQ ID NO: 5794578 - DNA, 16 bp, Homo sapiens
tcctttccccagccca

SEQ ID NO: 5794579 - DNA, 13 bp, Homo sapiens
tcctttcccctct

SEQ ID NO: 5794580 - DNA, 18 bp, Homo sapiens
tcctttcccctctctgcc

SEQ ID NO: 5794581 - DNA, 22 bp, Homo sapiens
tcctttcccctctctgcccctg

SEQ ID NO: 5794582 - DNA, 19 bp, Homo sapiens
tcctttccccttcccttcc

SEQ ID NO: 5794583 - DNA, 13 bp, Homo sapiens
tcctttccctcca

SEQ ID NO: 5794584 - DNA, 19 bp, Homo sapiens
tcctttccctccgaacgct

SEQ ID NO: 5794585 - DNA, 16 bp, Homo sapiens
tcctttccctctccca

SEQ ID NO: 5794586 - DNA, 14 bp, Homo sapiens
tcctttcccttcct

SEQ ID NO: 5794587 - DNA, 16 bp, Homo sapiens
tcctttcccttcctct

SEQ ID NO: 5794588 - DNA, 16 bp, Homo sapiens
tcctttcctccctccc

SEQ ID NO: 5794589 - DNA, 17 bp, Homo sapiens
tcctttccttcccaggc

SEQ ID NO: 5794590 - DNA, 18 bp, Homo sapiens
tcctttccttcccaggcc

SEQ ID NO: 5794591 - DNA, 15 bp, Homo sapiens
tcctttcctttcatt

SEQ ID NO: 5794592 - DNA, 19 bp, Homo sapiens
tcctttcctttcctttctt

SEQ ID NO: 5794593 - DNA, 14 bp, Homo sapiens
tcctttcctttctt

SEQ ID NO: 5794594 - DNA, 13 bp, Homo sapiens
tcctttccttttt

SEQ ID NO: 5794595 - DNA, 15 bp, Homo sapiens
tcctttctaaacaag

SEQ ID NO: 5794596 - DNA, 17 bp, Homo sapiens
tcctttctaagccctgt

SEQ ID NO: 5794597 - DNA, 21 bp, Homo sapiens
tcctttctaagccctgttctc

SEQ ID NO: 5794598 - DNA, 20 bp, Homo sapiens
tcctttctagagcactgcca

SEQ ID NO: 5794599 - DNA, 15 bp, Homo sapiens
tcctttctattgaaa

SEQ ID NO: 5794600 - DNA, 16 bp, Homo sapiens
tcctttctcaccagcc

SEQ ID NO: 5794601 - DNA, 15 bp, Homo sapiens
tcctttctcagaggg

SEQ ID NO: 5794602 - DNA, 15 bp, Homo sapiens
tcctttctcatccca

SEQ ID NO: 5794603 - DNA, 15 bp, Homo sapiens
tcctttctcatttct

SEQ ID NO: 5794604 - DNA, 14 bp, Homo sapiens
tcctttctccaggc

SEQ ID NO: 5794605 - DNA, 23 bp, Homo sapiens
tcctttctcccctattttttggt

SEQ ID NO: 5794606 - DNA, 15 bp, Homo sapiens
tcctttctccctgca

SEQ ID NO: 5794607 - DNA, 17 bp, Homo sapiens
tcctttctccctgcagc

SEQ ID NO: 5794608 - DNA, 18 bp, Homo sapiens
tcctttctccctgcagcc

SEQ ID NO: 5794609 - DNA, 13 bp, Homo sapiens
tcctttctcctgc

SEQ ID NO: 5794610 - DNA, 14 bp, Homo sapiens
tcctttctcctgcc

SEQ ID NO: 5794611 - DNA, 22 bp, Homo sapiens
tcctttctcctttgctttttct

SEQ ID NO: 5794612 - DNA, 22 bp, Homo sapiens
tcctttctctatcccaagccaa

SEQ ID NO: 5794613 - DNA, 16 bp, Homo sapiens
tcctttctctcctggc

SEQ ID NO: 5794614 - DNA, 12 bp, Homo sapiens
tcctttctctgg

SEQ ID NO: 5794615 - DNA, 13 bp, Homo sapiens
tcctttctctggg

SEQ ID NO: 5794616 - DNA, 12 bp, Homo sapiens
tcctttctctgt

SEQ ID NO: 5794617 - DNA, 18 bp, Homo sapiens
tcctttctctgtatattg

SEQ ID NO: 5794618 - DNA, 13 bp, Homo sapiens
tcctttctctttc

SEQ ID NO: 5794619 - DNA, 19 bp, Homo sapiens
tcctttctgactgtccctg

SEQ ID NO: 5794620 - DNA, 21 bp, Homo sapiens
tcctttctgactgtccctgcc

SEQ ID NO: 5794621 - DNA, 17 bp, Homo sapiens
tcctttctgatcctctc

SEQ ID NO: 5794622 - DNA, 18 bp, Homo sapiens
tcctttctgccccccagg

SEQ ID NO: 5794623 - DNA, 20 bp, Homo sapiens
tcctttctgccccccagggc

SEQ ID NO: 5794624 - DNA, 16 bp, Homo sapiens
tcctttctgccgaccc

SEQ ID NO: 5794625 - DNA, 19 bp, Homo sapiens
tcctttctggaagtttctg

SEQ ID NO: 5794626 - DNA, 13 bp, Homo sapiens
tcctttctggccc

SEQ ID NO: 5794627 - DNA, 13 bp, Homo sapiens
tcctttctgtgca

SEQ ID NO: 5794628 - DNA, 14 bp, Homo sapiens
tcctttctgtgcat

SEQ ID NO: 5794629 - DNA, 16 bp, Homo sapiens
tcctttctgtgcccta

SEQ ID NO: 5794630 - DNA, 16 bp, Homo sapiens
tcctttcttaattttg

SEQ ID NO: 5794631 - DNA, 15 bp, Homo sapiens
tcctttcttccttcc

SEQ ID NO: 5794632 - DNA, 13 bp, Homo sapiens
tcctttcttgtct

SEQ ID NO: 5794633 - DNA, 19 bp, Homo sapiens
tcctttcttgtctttcctc

SEQ ID NO: 5794634 - DNA, 14 bp, Homo sapiens
tcctttcttgtgcc

SEQ ID NO: 5794635 - DNA, 20 bp, Homo sapiens
tcctttctttactatgtttc

SEQ ID NO: 5794636 - DNA, 12 bp, Homo sapiens
tcctttcttttc

SEQ ID NO: 5794637 - DNA, 12 bp, Homo sapiens
tcctttcttttt

SEQ ID NO: 5794638 - DNA, 16 bp, Homo sapiens
tcctttctttttcttc

SEQ ID NO: 5794639 - DNA, 17 bp, Homo sapiens
tcctttctttttcttct

SEQ ID NO: 5794640 - DNA, 17 bp, Homo sapiens
tcctttcttttttttct

SEQ ID NO: 5794641 - DNA, 14 bp, Homo sapiens
tcctttgaaagact

SEQ ID NO: 5794642 - DNA, 18 bp, Homo sapiens
tcctttgaacctgtgcaa

SEQ ID NO: 5794643 - DNA, 18 bp, Homo sapiens
tcctttgaacgtgcttct

SEQ ID NO: 5794644 - DNA, 20 bp, Homo sapiens
tcctttgaacgtgcttcttt

SEQ ID NO: 5794645 - DNA, 22 bp, Homo sapiens
tcctttgaacgtgcttctttgt

SEQ ID NO: 5794646 - DNA, 14 bp, Homo sapiens
tcctttgaagagga

SEQ ID NO: 5794647 - DNA, 12 bp, Homo sapiens
tcctttgaagat

SEQ ID NO: 5794648 - DNA, 22 bp, Homo sapiens
tcctttgaagatagtaactgta

SEQ ID NO: 5794649 - DNA, 22 bp, Homo sapiens
tcctttgaagctttaggcagag

SEQ ID NO: 5794650 - DNA, 21 bp, Homo sapiens
tcctttgaccactgtcttttt

SEQ ID NO: 5794651 - DNA, 18 bp, Homo sapiens
tcctttgactttctgtgt

SEQ ID NO: 5794652 - DNA, 17 bp, Homo sapiens
tcctttgagaaagaaat

SEQ ID NO: 5794653 - DNA, 16 bp, Homo sapiens
tcctttgagaatgtga

SEQ ID NO: 5794654 - DNA, 14 bp, Homo sapiens
tcctttgagggcag

SEQ ID NO: 5794655 - DNA, 12 bp, Homo sapiens
tcctttgcaata

SEQ ID NO: 5794656 - DNA, 19 bp, Homo sapiens
tcctttgcaatagcagtta

SEQ ID NO: 5794657 - DNA, 14 bp, Homo sapiens
tcctttgcaccctg

SEQ ID NO: 5794658 - DNA, 16 bp, Homo sapiens
tcctttgcaccctgta

SEQ ID NO: 5794659 - DNA, 17 bp, Homo sapiens
tcctttgcactgagggc

SEQ ID NO: 5794660 - DNA, 14 bp, Homo sapiens
tcctttgcagggca

SEQ ID NO: 5794661 - DNA, 14 bp, Homo sapiens
tcctttgcattcat

SEQ ID NO: 5794662 - DNA, 20 bp, Homo sapiens
tcctttgccccctgtgccct

SEQ ID NO: 5794663 - DNA, 19 bp, Homo sapiens
tcctttgcccttcctcctg

SEQ ID NO: 5794664 - DNA, 13 bp, Homo sapiens
tcctttgcctctg

SEQ ID NO: 5794665 - DNA, 15 bp, Homo sapiens
tcctttgctagtgtc

SEQ ID NO: 5794666 - DNA, 13 bp, Homo sapiens
tcctttgggaaag

SEQ ID NO: 5794667 - DNA, 20 bp, Homo sapiens
tcctttggggcttctgtgaa

SEQ ID NO: 5794668 - DNA, 17 bp, Homo sapiens
tcctttggtatttcact

SEQ ID NO: 5794669 - DNA, 16 bp, Homo sapiens
tcctttggtcctggtg

SEQ ID NO: 5794670 - DNA, 17 bp, Homo sapiens
tcctttggtcctggtgc

SEQ ID NO: 5794671 - DNA, 11 bp, Homo sapiens
tcctttgtaat

SEQ ID NO: 5794672 - DNA, 18 bp, Homo sapiens
tcctttgtactttgtgct

SEQ ID NO: 5794673 - DNA, 13 bp, Homo sapiens
tcctttgtagcta

SEQ ID NO: 5794674 - DNA, 15 bp, Homo sapiens
tcctttgtagctact

SEQ ID NO: 5794675 - DNA, 17 bp, Homo sapiens
tcctttgtattctgtct

SEQ ID NO: 5794676 - DNA, 12 bp, Homo sapiens
tcctttgtcttc

SEQ ID NO: 5794677 - DNA, 14 bp, Homo sapiens
tcctttgtctttct

SEQ ID NO: 5794678 - DNA, 17 bp, Homo sapiens
tcctttgtgaggaagcc

SEQ ID NO: 5794679 - DNA, 22 bp, Homo sapiens
tcctttgtgaggaagccgctgg

SEQ ID NO: 5794680 - DNA, 20 bp, Homo sapiens
tcctttgtgtgtactcactg

SEQ ID NO: 5794681 - DNA, 17 bp, Homo sapiens
tcctttgtgtgtgtgtc

SEQ ID NO: 5794682 - DNA, 18 bp, Homo sapiens
tcctttgtgtgtgtgtca

SEQ ID NO: 5794683 - DNA, 14 bp, Homo sapiens
tcctttgttgctgt

SEQ ID NO: 5794684 - DNA, 16 bp, Homo sapiens
tcctttgttggcttct

SEQ ID NO: 5794685 - DNA, 17 bp, Homo sapiens
tcctttgttggcttctt

SEQ ID NO: 5794686 - DNA, 17 bp, Homo sapiens
tcctttgtttaataaag

SEQ ID NO: 5794687 - DNA, 18 bp, Homo sapiens
tcctttgttttctgacta

SEQ ID NO: 5794688 - DNA, 22 bp, Homo sapiens
tcctttgttttctgactaatta

SEQ ID NO: 5794689 - DNA, 23 bp, Homo sapiens
tcctttgtttttttttcctgtcc

SEQ ID NO: 5794690 - DNA, 19 bp, Homo sapiens
tccttttaaaacacttcca

SEQ ID NO: 5794691 - DNA, 13 bp, Homo sapiens
tccttttaaagaa

SEQ ID NO: 5794692 - DNA, 21 bp, Homo sapiens
tccttttaaagaagctttatc

SEQ ID NO: 5794693 - DNA, 23 bp, Homo sapiens
tccttttaagaaagcttcttgtg

SEQ ID NO: 5794694 - DNA, 23 bp, Homo sapiens
tccttttaagtggactctctgac

SEQ ID NO: 5794695 - DNA, 17 bp, Homo sapiens
tccttttaattttcctg

SEQ ID NO: 5794696 - DNA, 15 bp, Homo sapiens
tccttttagaagcag

SEQ ID NO: 5794697 - DNA, 21 bp, Homo sapiens
tccttttagcacatcactgag

SEQ ID NO: 5794698 - DNA, 22 bp, Homo sapiens
tccttttagcacatcactgaga

SEQ ID NO: 5794699 - DNA, 13 bp, Homo sapiens
tccttttagccta

SEQ ID NO: 5794700 - DNA, 22 bp, Homo sapiens
tccttttatctggtgcctcctc

SEQ ID NO: 5794701 - DNA, 17 bp, Homo sapiens
tccttttcaatatatat

SEQ ID NO: 5794702 - DNA, 23 bp, Homo sapiens
tccttttcacattagataaatta

SEQ ID NO: 5794703 - DNA, 14 bp, Homo sapiens
tccttttcagaagt

SEQ ID NO: 5794704 - DNA, 17 bp, Homo sapiens
tccttttcatctgttgt

SEQ ID NO: 5794705 - DNA, 14 bp, Homo sapiens
tccttttccagagc

SEQ ID NO: 5794706 - DNA, 17 bp, Homo sapiens
tcggacagagcccccct

SEQ ID NO: 5794707 - DNA, 17 bp, Homo sapiens
tcggacattctaatgca

SEQ ID NO: 5794708 - DNA, 21 bp, Homo sapiens
tcggacattctaatgcatatt

SEQ ID NO: 5794709 - DNA, 21 bp, Homo sapiens
tcggacccaccaaactgcaca

SEQ ID NO: 5794710 - DNA, 13 bp, Homo sapiens
tcggacccacccc

SEQ ID NO: 5794711 - DNA, 16 bp, Homo sapiens
tcggacggggcaggcg

SEQ ID NO: 5794712 - DNA, 20 bp, Homo sapiens
tcggactaaactatctgtat

SEQ ID NO: 5794713 - DNA, 23 bp, Homo sapiens
tcggactaaactatctgtattta

SEQ ID NO: 5794714 - DNA, 19 bp, Homo sapiens
tcggactaagcctacctgc

SEQ ID NO: 5794715 - DNA, 22 bp, Homo sapiens
tcggactaagcctacctgctct

SEQ ID NO: 5794716 - DNA, 12 bp, Homo sapiens
tcggactgccaa

SEQ ID NO: 5794717 - DNA, 13 bp, Homo sapiens
tcggactgccaaa

SEQ ID NO: 5794718 - DNA, 16 bp, Homo sapiens
tcggacttactgcctg

SEQ ID NO: 5794719 - DNA, 18 bp, Homo sapiens
tcggacttagctgggaga

SEQ ID NO: 5794720 - DNA, 15 bp, Homo sapiens
tcggactttgcagga

SEQ ID NO: 5794721 - DNA, 14 bp, Homo sapiens
tcggagaagagctg

SEQ ID NO: 5794722 - DNA, 23 bp, Homo sapiens
tcggagacagtgatctccatatg

SEQ ID NO: 5794723 - DNA, 13 bp, Homo sapiens
tcggagcaccctt

SEQ ID NO: 5794724 - DNA, 16 bp, Homo sapiens
tcggagccccccactc

SEQ ID NO: 5794725 - DNA, 15 bp, Homo sapiens
tcggagcccccgcag

SEQ ID NO: 5794726 - DNA, 14 bp, Homo sapiens
tcggagccctcaga

SEQ ID NO: 5794727 - DNA, 14 bp, Homo sapiens
tcggagccctgtct

SEQ ID NO: 5794728 - DNA, 22 bp, Homo sapiens
tcggagcctcatccgaggcagg

SEQ ID NO: 5794729 - DNA, 23 bp, Homo sapiens
tcggagcctcatccgaggcaggg

SEQ ID NO: 5794730 - DNA, 23 bp, Homo sapiens
tcggagcctgtgttagtgtctgt

SEQ ID NO: 5794731 - DNA, 14 bp, Homo sapiens
tcggagctcgcctg

SEQ ID NO: 5794732 - DNA, 15 bp, Homo sapiens
tcggagctgcctgca

SEQ ID NO: 5794733 - DNA, 20 bp, Homo sapiens
tcggagctgcctgcagcaca

SEQ ID NO: 5794734 - DNA, 14 bp, Homo sapiens
tcggagctggccca

SEQ ID NO: 5794735 - DNA, 17 bp, Homo sapiens
tcggagctggcccaggg

SEQ ID NO: 5794736 - DNA, 21 bp, Homo sapiens
tcggagctggcccagggggcc

SEQ ID NO: 5794737 - DNA, 13 bp, Homo sapiens
tcggaggaagccc

SEQ ID NO: 5794738 - DNA, 12 bp, Homo sapiens
tcggaggccagg

SEQ ID NO: 5794739 - DNA, 18 bp, Homo sapiens
tcggaggccaggccctcc

SEQ ID NO: 5794740 - DNA, 12 bp, Homo sapiens
tcggaggcccca

SEQ ID NO: 5794741 - DNA, 22 bp, Homo sapiens
tcggaggctacccgctgtggcc

SEQ ID NO: 5794742 - DNA, 17 bp, Homo sapiens
tcggaggctcctccctc

SEQ ID NO: 5794743 - DNA, 21 bp, Homo sapiens
tcggaggctcctccctctgcc

SEQ ID NO: 5794744 - DNA, 14 bp, Homo sapiens
tcggaggctgggcc

SEQ ID NO: 5794745 - DNA, 19 bp, Homo sapiens
tcggaggctgggcccctgg

SEQ ID NO: 5794746 - DNA, 21 bp, Homo sapiens
tcggaggctgggcccctggga

SEQ ID NO: 5794747 - DNA, 21 bp, Homo sapiens
tcggagggatggagaaagaag

SEQ ID NO: 5794748 - DNA, 14 bp, Homo sapiens
tcggagggccgcag

SEQ ID NO: 5794749 - DNA, 14 bp, Homo sapiens
tcggagggtgccgt

SEQ ID NO: 5794750 - DNA, 15 bp, Homo sapiens
tcggaggtcaagaaa

SEQ ID NO: 5794751 - DNA, 17 bp, Homo sapiens
tcggaggtgctgtcccc

SEQ ID NO: 5794752 - DNA, 14 bp, Homo sapiens
tcggaggtggcagc

SEQ ID NO: 5794753 - DNA, 17 bp, Homo sapiens
tcggaggtggtggagga

SEQ ID NO: 5794754 - DNA, 20 bp, Homo sapiens
tcggaggtggtggaggagga

SEQ ID NO: 5794755 - DNA, 17 bp, Homo sapiens
tcggagtatctgggaac

SEQ ID NO: 5794756 - DNA, 19 bp, Homo sapiens
tcggagtatctgggaactg

SEQ ID NO: 5794757 - DNA, 15 bp, Homo sapiens
tcggagtgaatgtgg

SEQ ID NO: 5794758 - DNA, 17 bp, Homo sapiens
tcggagtgcctggagtc

SEQ ID NO: 5794759 - DNA, 12 bp, Homo sapiens
tcggagttcttc

SEQ ID NO: 5794760 - DNA, 13 bp, Homo sapiens
tcggagttcttct

SEQ ID NO: 5794761 - DNA, 23 bp, Homo sapiens
tcggatagttgctatttttgtaa

SEQ ID NO: 5794762 - DNA, 16 bp, Homo sapiens
tcggatcaggctccca

SEQ ID NO: 5794763 - DNA, 15 bp, Homo sapiens
tcggatccccttcct

SEQ ID NO: 5794764 - DNA, 16 bp, Homo sapiens
tcggatgacaccctgg

SEQ ID NO: 5794765 - DNA, 23 bp, Homo sapiens
tcggatgaccaaaccagccttcg

SEQ ID NO: 5794766 - DNA, 20 bp, Homo sapiens
tcggatggaccaacctgctc

SEQ ID NO: 5794767 - DNA, 23 bp, Homo sapiens
tcggatggaccaacctgctctgt

SEQ ID NO: 5794768 - DNA, 16 bp, Homo sapiens
tcggatttggggtgga

SEQ ID NO: 5794769 - DNA, 20 bp, Homo sapiens
tcggcaacagggcttctctt

SEQ ID NO: 5794770 - DNA, 13 bp, Homo sapiens
tcggcaaggaagt

SEQ ID NO: 5794771 - DNA, 12 bp, Homo sapiens
tcggcacacact

SEQ ID NO: 5794772 - DNA, 13 bp, Homo sapiens
tcggcacagcctg

SEQ ID NO: 5794773 - DNA, 21 bp, Homo sapiens
tcggcaccttcccctgaggac

SEQ ID NO: 5794774 - DNA, 15 bp, Homo sapiens
tcggcactgtacaaa

SEQ ID NO: 5794775 - DNA, 19 bp, Homo sapiens
tcggcagaggaacccccac

SEQ ID NO: 5794776 - DNA, 20 bp, Homo sapiens
tcggcagccttaaggccctc

SEQ ID NO: 5794777 - DNA, 15 bp, Homo sapiens
tcggcatagtcccca

SEQ ID NO: 5794778 - DNA, 21 bp, Homo sapiens
tcggcatagtccccagagctc

SEQ ID NO: 5794779 - DNA, 23 bp, Homo sapiens
tcggcatagtccccagagctccc

SEQ ID NO: 5794780 - DNA, 14 bp, Homo sapiens
tcggcatgccagga

SEQ ID NO: 5794781 - DNA, 17 bp, Homo sapiens
tcggcatgccaggaccc

SEQ ID NO: 5794782 - DNA, 16 bp, Homo sapiens
tcggcattcacacaca

SEQ ID NO: 5794783 - DNA, 17 bp, Homo sapiens
tcggcattcacacacag

SEQ ID NO: 5794784 - DNA, 18 bp, Homo sapiens
tcggcattcacacacagc

SEQ ID NO: 5794785 - DNA, 22 bp, Homo sapiens
tcggcattggttccctttgctc

SEQ ID NO: 5794786 - DNA, 20 bp, Homo sapiens
tcggcatttaacttacattt

SEQ ID NO: 5794787 - DNA, 23 bp, Homo sapiens
tcggccaagatgtacttctctgt

SEQ ID NO: 5794788 - DNA, 14 bp, Homo sapiens
tcggccacacccca

SEQ ID NO: 5794789 - DNA, 20 bp, Homo sapiens
tcggccacaccccagactcc

SEQ ID NO: 5794790 - DNA, 13 bp, Homo sapiens
tcggccacagggc

SEQ ID NO: 5794791 - DNA, 22 bp, Homo sapiens
tcggccactagtggggtcctga

SEQ ID NO: 5794792 - DNA, 15 bp, Homo sapiens
tcggccagagctccc

SEQ ID NO: 5794793 - DNA, 17 bp, Homo sapiens
tcggccagagctcccag

SEQ ID NO: 5794794 - DNA, 15 bp, Homo sapiens
tcggccagaggggct

SEQ ID NO: 5794795 - DNA, 22 bp, Homo sapiens
tcggccattgaacactgcaccc

SEQ ID NO: 5794796 - DNA, 23 bp, Homo sapiens
tcggcccacagctcccaccccac

SEQ ID NO: 5794797 - DNA, 11 bp, Homo sapiens
tcggcccagca

SEQ ID NO: 5794798 - DNA, 17 bp, Homo sapiens
tcggcccatctgtccat

SEQ ID NO: 5794799 - DNA, 14 bp, Homo sapiens
tcggccccacatgg

SEQ ID NO: 5794800 - DNA, 19 bp, Homo sapiens
tcggccccctcaccccagc

SEQ ID NO: 5794801 - DNA, 20 bp, Homo sapiens
tcggccccctcaccccagct

SEQ ID NO: 5794802 - DNA, 13 bp, Homo sapiens
tcggcccctcctc

SEQ ID NO: 5794803 - DNA, 23 bp, Homo sapiens
tcggcccctgtctgttcccagcc

SEQ ID NO: 5794804 - DNA, 18 bp, Homo sapiens
tcggcccggagcagcagg

SEQ ID NO: 5794805 - DNA, 11 bp, Homo sapiens
tcggccctgcg

SEQ ID NO: 5794806 - DNA, 22 bp, Homo sapiens
tcggccctgcgtcggccctggg

SEQ ID NO: 5794807 - DNA, 16 bp, Homo sapiens
tcggccctgtagccct

SEQ ID NO: 5794808 - DNA, 19 bp, Homo sapiens
tcggccctgtagccctggc

SEQ ID NO: 5794809 - DNA, 21 bp, Homo sapiens
tcggccctgtagccctggccc

SEQ ID NO: 5794810 - DNA, 13 bp, Homo sapiens
tcggccgaggcct

SEQ ID NO: 5794811 - DNA, 13 bp, Homo sapiens
tcggcctccagac

SEQ ID NO: 5794812 - DNA, 23 bp, Homo sapiens
tcggcctcccaaagtgctgggat

SEQ ID NO: 5794813 - DNA, 20 bp, Homo sapiens
tcggcctctaaccccaggcc

SEQ ID NO: 5794814 - DNA, 23 bp, Homo sapiens
tcggcctctaaccccaggccccg

SEQ ID NO: 5794815 - DNA, 23 bp, Homo sapiens
tcggcctctactttgtcccctca

SEQ ID NO: 5794816 - DNA, 20 bp, Homo sapiens
tcggcctcttgagagcccca

SEQ ID NO: 5794817 - DNA, 14 bp, Homo sapiens
tcggcctgccccca

SEQ ID NO: 5794818 - DNA, 14 bp, Homo sapiens
tcggcctttgggtg

SEQ ID NO: 5794819 - DNA, 20 bp, Homo sapiens
tcggcgggcttttctggggc

SEQ ID NO: 5794820 - DNA, 18 bp, Homo sapiens
tcggcgtggcccaaggct

SEQ ID NO: 5794821 - DNA, 16 bp, Homo sapiens
tcggcgttagtcccta

SEQ ID NO: 5794822 - DNA, 14 bp, Homo sapiens
tcggctcacaaatt

SEQ ID NO: 5794823 - DNA, 16 bp, Homo sapiens
tcggctcactgcaacc

SEQ ID NO: 5794824 - DNA, 18 bp, Homo sapiens
tcggctcactgcatcctc

SEQ ID NO: 5794825 - DNA, 15 bp, Homo sapiens
tcggctcagcctccc

SEQ ID NO: 5794826 - DNA, 14 bp, Homo sapiens
tcggctcagctcgg

SEQ ID NO: 5794827 - DNA, 14 bp, Homo sapiens
tcggctcaggctct

SEQ ID NO: 5794828 - DNA, 19 bp, Homo sapiens
tcggctcaggctctgctgg

SEQ ID NO: 5794829 - DNA, 22 bp, Homo sapiens
tcggctccagtccccagaactc

SEQ ID NO: 5794830 - DNA, 19 bp, Homo sapiens
tcggctccccatgtgtcct

SEQ ID NO: 5794831 - DNA, 12 bp, Homo sapiens
tcggctcctgct

SEQ ID NO: 5794832 - DNA, 13 bp, Homo sapiens
tcggctcctgctg

SEQ ID NO: 5794833 - DNA, 15 bp, Homo sapiens
tcggctcctgctgca

SEQ ID NO: 5794834 - DNA, 18 bp, Homo sapiens
tcggctcctgctgcacca

SEQ ID NO: 5794835 - DNA, 12 bp, Homo sapiens
tcggctctgccg

SEQ ID NO: 5794836 - DNA, 12 bp, Homo sapiens
tcggctgccagg

SEQ ID NO: 5794837 - DNA, 21 bp, Homo sapiens
tcggctgccaggggctctgtg

SEQ ID NO: 5794838 - DNA, 12 bp, Homo sapiens
tcggctggaaga

SEQ ID NO: 5794839 - DNA, 21 bp, Homo sapiens
tcggctggctcccctgcagcc

SEQ ID NO: 5794840 - DNA, 13 bp, Homo sapiens
tcggctgggcagg

SEQ ID NO: 5794841 - DNA, 12 bp, Homo sapiens
tcggctgtgagg

SEQ ID NO: 5794842 - DNA, 20 bp, Homo sapiens
tcggctgtgaggcgggtggc

SEQ ID NO: 5794843 - DNA, 14 bp, Homo sapiens
tcggcttcctgtgg

SEQ ID NO: 5794844 - DNA, 22 bp, Homo sapiens
tcggcttcctgtggggtgtagg

SEQ ID NO: 5794845 - DNA, 13 bp, Homo sapiens
tcggcttgatcac

SEQ ID NO: 5794846 - DNA, 17 bp, Homo sapiens
tcggcttgatcacagct

SEQ ID NO: 5794847 - DNA, 17 bp, Homo sapiens
tcggcttttctcagctg

SEQ ID NO: 5794848 - DNA, 18 bp, Homo sapiens
tcgggaaacacacaagca

SEQ ID NO: 5794849 - DNA, 14 bp, Homo sapiens
tcgggaaattctgc

SEQ ID NO: 5794850 - DNA, 19 bp, Homo sapiens
tcgggaaattctgctgctt

SEQ ID NO: 5794851 - DNA, 15 bp, Homo sapiens
tcgggaacagtgttt

SEQ ID NO: 5794852 - DNA, 22 bp, Homo sapiens
tcgggaagagaggagttcaatg

SEQ ID NO: 5794853 - DNA, 15 bp, Homo sapiens
tcgggaagcagccag

SEQ ID NO: 5794854 - DNA, 18 bp, Homo sapiens
tcgggaaggatgggaaaa

SEQ ID NO: 5794855 - DNA, 15 bp, Homo sapiens
tcgggaaggcctgag

SEQ ID NO: 5794856 - DNA, 20 bp, Homo sapiens
tcgggaaggcctgagggaag

SEQ ID NO: 5794857 - DNA, 14 bp, Homo sapiens
tcgggaagggaggg

SEQ ID NO: 5794858 - DNA, 20 bp, Homo sapiens
tcgggaatactagggagaag

SEQ ID NO: 5794859 - DNA, 19 bp, Homo sapiens
tcgggacacctgccctgcc

SEQ ID NO: 5794860 - DNA, 13 bp, Homo sapiens
tcgggacagctgt

SEQ ID NO: 5794861 - DNA, 20 bp, Homo sapiens
tcgggaccacatctgtcctc

SEQ ID NO: 5794862 - DNA, 12 bp, Homo sapiens
tcgggaccagaa

SEQ ID NO: 5794863 - DNA, 17 bp, Homo sapiens
tcgggaccagaaacctg

SEQ ID NO: 5794864 - DNA, 18 bp, Homo sapiens
tcgggacctcccaggaca

SEQ ID NO: 5794865 - DNA, 22 bp, Homo sapiens
tcgggagaggggacgcaggccc

SEQ ID NO: 5794866 - DNA, 15 bp, Homo sapiens
tcgggagcagggctg

SEQ ID NO: 5794867 - DNA, 13 bp, Homo sapiens
tcgggagcagtgt

SEQ ID NO: 5794868 - DNA, 14 bp, Homo sapiens
tcgggagcagtgtc

SEQ ID NO: 5794869 - DNA, 16 bp, Homo sapiens
tcgggagcagtgtctt

SEQ ID NO: 5794870 - DNA, 20 bp, Homo sapiens
tcgggagccctagccctgct

SEQ ID NO: 5794871 - DNA, 15 bp, Homo sapiens
tcgggagctgcacac

SEQ ID NO: 5794872 - DNA, 22 bp, Homo sapiens
tcgggaggagcagcccggggag

SEQ ID NO: 5794873 - DNA, 19 bp, Homo sapiens
tcgggaggctgaggcacaa

SEQ ID NO: 5794874 - DNA, 23 bp, Homo sapiens
tcgggaggctgaggcaggagact

SEQ ID NO: 5794875 - DNA, 23 bp, Homo sapiens
tcgggagggaacatcctgctgca

SEQ ID NO: 5794876 - DNA, 19 bp, Homo sapiens
tcgggaggtcgaggcagga

SEQ ID NO: 5794877 - DNA, 18 bp, Homo sapiens
tcgggaggtttggggggc

SEQ ID NO: 5794878 - DNA, 12 bp, Homo sapiens
tcgggagtagca

SEQ ID NO: 5794879 - DNA, 16 bp, Homo sapiens
tcgggagtttgagacc

SEQ ID NO: 5794880 - DNA, 22 bp, Homo sapiens
tcgggatcaaacctttctggcc

SEQ ID NO: 5794881 - DNA, 16 bp, Homo sapiens
tcgggatgtcagcaga

SEQ ID NO: 5794882 - DNA, 15 bp, Homo sapiens
tcgggattacagaaa

SEQ ID NO: 5794883 - DNA, 12 bp, Homo sapiens
tcgggattcttt

SEQ ID NO: 5794884 - DNA, 16 bp, Homo sapiens
tcgggcactccctaag

SEQ ID NO: 5794885 - DNA, 19 bp, Homo sapiens
tctaacttggctcacactc

SEQ ID NO: 5794886 - DNA, 12 bp, Homo sapiens
tctaactttgta

SEQ ID NO: 5794887 - DNA, 13 bp, Homo sapiens
tctaactttgtaa

SEQ ID NO: 5794888 - DNA, 12 bp, Homo sapiens
tctaagaaaaga

SEQ ID NO: 5794889 - DNA, 13 bp, Homo sapiens
tctaagaaaagag

SEQ ID NO: 5794890 - DNA, 14 bp, Homo sapiens
tctaagaaacattg

SEQ ID NO: 5794891 - DNA, 18 bp, Homo sapiens
tctaagaaacatttatat

SEQ ID NO: 5794892 - DNA, 12 bp, Homo sapiens
tctaagaaaccc

SEQ ID NO: 5794893 - DNA, 21 bp, Homo sapiens
tctaagaaatatctgtgaaat

SEQ ID NO: 5794894 - DNA, 13 bp, Homo sapiens
tctaagaagacat

SEQ ID NO: 5794895 - DNA, 16 bp, Homo sapiens
tctaagaagctgcaat

SEQ ID NO: 5794896 - DNA, 17 bp, Homo sapiens
tctaagaataataaaat

SEQ ID NO: 5794897 - DNA, 19 bp, Homo sapiens
tctaagaataataaaatca

SEQ ID NO: 5794898 - DNA, 16 bp, Homo sapiens
tctaagaatacagctt

SEQ ID NO: 5794899 - DNA, 15 bp, Homo sapiens
tctaagacaaatgca

SEQ ID NO: 5794900 - DNA, 16 bp, Homo sapiens
tctaagacaaatgcag

SEQ ID NO: 5794901 - DNA, 23 bp, Homo sapiens
tctaagacattcaccaacaacag

SEQ ID NO: 5794902 - DNA, 21 bp, Homo sapiens
tctaagactatatatataaat

SEQ ID NO: 5794903 - DNA, 12 bp, Homo sapiens
tctaagactctg

SEQ ID NO: 5794904 - DNA, 20 bp, Homo sapiens
tctaagactctgtgtggctg

SEQ ID NO: 5794905 - DNA, 21 bp, Homo sapiens
tctaagactctgtgtggctgt

SEQ ID NO: 5794906 - DNA, 19 bp, Homo sapiens
tctaagacttactctaaga

SEQ ID NO: 5794907 - DNA, 23 bp, Homo sapiens
tctaagacttactctaagatctt

SEQ ID NO: 5794908 - DNA, 22 bp, Homo sapiens
tctaagaggattcaacaccttt

SEQ ID NO: 5794909 - DNA, 12 bp, Homo sapiens
tctaagagtgcc

SEQ ID NO: 5794910 - DNA, 15 bp, Homo sapiens
tctaagataaaaata

SEQ ID NO: 5794911 - DNA, 13 bp, Homo sapiens
tctaagatacact

SEQ ID NO: 5794912 - DNA, 20 bp, Homo sapiens
tctaagatacactgcacttt

SEQ ID NO: 5794913 - DNA, 12 bp, Homo sapiens
tctaagatctta

SEQ ID NO: 5794914 - DNA, 17 bp, Homo sapiens
tctaagatcttagattc

SEQ ID NO: 5794915 - DNA, 18 bp, Homo sapiens
tctaagatgaatccaaat

SEQ ID NO: 5794916 - DNA, 13 bp, Homo sapiens
tctaagatgtgat

SEQ ID NO: 5794917 - DNA, 18 bp, Homo sapiens
tctaagatgttatatttt

SEQ ID NO: 5794918 - DNA, 21 bp, Homo sapiens
tctaagattcatccatttatt

SEQ ID NO: 5794919 - DNA, 13 bp, Homo sapiens
tctaagattctaa

SEQ ID NO: 5794920 - DNA, 16 bp, Homo sapiens
tctaagattctaaagg

SEQ ID NO: 5794921 - DNA, 14 bp, Homo sapiens
tctaagattctaga

SEQ ID NO: 5794922 - DNA, 15 bp, Homo sapiens
tctaagattctagat

SEQ ID NO: 5794923 - DNA, 16 bp, Homo sapiens
tctaagattctagatc

SEQ ID NO: 5794924 - DNA, 13 bp, Homo sapiens
tctaagattctga

SEQ ID NO: 5794925 - DNA, 19 bp, Homo sapiens
tctaagattctgattttag

SEQ ID NO: 5794926 - DNA, 15 bp, Homo sapiens
tctaagcaagatgtt

SEQ ID NO: 5794927 - DNA, 16 bp, Homo sapiens
tctaagcaagatgttt

SEQ ID NO: 5794928 - DNA, 18 bp, Homo sapiens
tctaagcaagatgttttg

SEQ ID NO: 5794929 - DNA, 15 bp, Homo sapiens
tctaagcagccagga

SEQ ID NO: 5794930 - DNA, 18 bp, Homo sapiens
tctaagcagttttgtaaa

SEQ ID NO: 5794931 - DNA, 22 bp, Homo sapiens
tctaagcagttttgtaaatgta

SEQ ID NO: 5794932 - DNA, 23 bp, Homo sapiens
tctaagcagttttgtaaatgtac

SEQ ID NO: 5794933 - DNA, 19 bp, Homo sapiens
tctaagccagttttcattt

SEQ ID NO: 5794934 - DNA, 22 bp, Homo sapiens
tctaagccctgttctcctgtcc

SEQ ID NO: 5794935 - DNA, 16 bp, Homo sapiens
tctaagcctgaagggg

SEQ ID NO: 5794936 - DNA, 17 bp, Homo sapiens
tctaagcctttccataa

SEQ ID NO: 5794937 - DNA, 16 bp, Homo sapiens
tctaagctcagtgctc

SEQ ID NO: 5794938 - DNA, 12 bp, Homo sapiens
tctaagctgcag

SEQ ID NO: 5794939 - DNA, 17 bp, Homo sapiens
tctaagctgcagcttcc

SEQ ID NO: 5794940 - DNA, 13 bp, Homo sapiens
tctaagctggagc

SEQ ID NO: 5794941 - DNA, 14 bp, Homo sapiens
tctaagctggagct

SEQ ID NO: 5794942 - DNA, 19 bp, Homo sapiens
tctaagctggagctcttgg

SEQ ID NO: 5794943 - DNA, 21 bp, Homo sapiens
tctaagctggagctcttggaa

SEQ ID NO: 5794944 - DNA, 18 bp, Homo sapiens
tctaagctgtttgccaag

SEQ ID NO: 5794945 - DNA, 23 bp, Homo sapiens
tctaagctgtttgccaagctgaa

SEQ ID NO: 5794946 - DNA, 18 bp, Homo sapiens
tctaagcttatttctaac

SEQ ID NO: 5794947 - DNA, 20 bp, Homo sapiens
tctaaggaaatggagaagct

SEQ ID NO: 5794948 - DNA, 22 bp, Homo sapiens
tctaaggaagatcactttgctc

SEQ ID NO: 5794949 - DNA, 16 bp, Homo sapiens
tctaaggaatgcacaa

SEQ ID NO: 5794950 - DNA, 11 bp, Homo sapiens
tctaaggacaa

SEQ ID NO: 5794951 - DNA, 17 bp, Homo sapiens
tctaaggacctgaaatt

SEQ ID NO: 5794952 - DNA, 16 bp, Homo sapiens
tctaaggactttttct

SEQ ID NO: 5794953 - DNA, 19 bp, Homo sapiens
tctaaggagatataatata

SEQ ID NO: 5794954 - DNA, 20 bp, Homo sapiens
tctaaggagcgctagtgcct

SEQ ID NO: 5794955 - DNA, 17 bp, Homo sapiens
tctaaggataatgaaat

SEQ ID NO: 5794956 - DNA, 17 bp, Homo sapiens
tctaaggatagcctttg

SEQ ID NO: 5794957 - DNA, 21 bp, Homo sapiens
tctaaggatagcctttgtagg

SEQ ID NO: 5794958 - DNA, 11 bp, Homo sapiens
tctaaggcatg

SEQ ID NO: 5794959 - DNA, 19 bp, Homo sapiens
tctaaggccctttttccta

SEQ ID NO: 5794960 - DNA, 18 bp, Homo sapiens
tctaaggcctaggattct

SEQ ID NO: 5794961 - DNA, 20 bp, Homo sapiens
tctaaggcctaggattctaa

SEQ ID NO: 5794962 - DNA, 20 bp, Homo sapiens
tctaaggctaaggataggga

SEQ ID NO: 5794963 - DNA, 15 bp, Homo sapiens
tctaaggctctgaga

SEQ ID NO: 5794964 - DNA, 17 bp, Homo sapiens
tctaaggctctgagagt

SEQ ID NO: 5794965 - DNA, 22 bp, Homo sapiens
tctaaggctctgagagtctaga

SEQ ID NO: 5794966 - DNA, 23 bp, Homo sapiens
tctaaggctctgagagtctagat

SEQ ID NO: 5794967 - DNA, 20 bp, Homo sapiens
tctaagggaaaaagttgtat

SEQ ID NO: 5794968 - DNA, 14 bp, Homo sapiens
tctaagggggaggg

SEQ ID NO: 5794969 - DNA, 16 bp, Homo sapiens
tctaagggtagaagag

SEQ ID NO: 5794970 - DNA, 22 bp, Homo sapiens
tctaagtaaaaccacagcagtt

SEQ ID NO: 5794971 - DNA, 23 bp, Homo sapiens
tctaagtaaaaccacagcagttg

SEQ ID NO: 5794972 - DNA, 19 bp, Homo sapiens
tctaagtaaatacaatttt

SEQ ID NO: 5794973 - DNA, 20 bp, Homo sapiens
tctaagtaaatacaattttt

SEQ ID NO: 5794974 - DNA, 19 bp, Homo sapiens
tctaagtacatatgtagat

SEQ ID NO: 5794975 - DNA, 20 bp, Homo sapiens
tctaagtagatagaaagcaa

SEQ ID NO: 5794976 - DNA, 17 bp, Homo sapiens
tctaagtatttaaatgt

SEQ ID NO: 5794977 - DNA, 19 bp, Homo sapiens
tctaagtatttaaatgttc

SEQ ID NO: 5794978 - DNA, 19 bp, Homo sapiens
tctaagtcaatccaagagt

SEQ ID NO: 5794979 - DNA, 21 bp, Homo sapiens
tctaagtcagtacccaccacc

SEQ ID NO: 5794980 - DNA, 15 bp, Homo sapiens
tctaagtcagtttca

SEQ ID NO: 5794981 - DNA, 17 bp, Homo sapiens
tctaagtcagtttcaca

SEQ ID NO: 5794982 - DNA, 20 bp, Homo sapiens
tctaagtcagtttcacatat

SEQ ID NO: 5794983 - DNA, 23 bp, Homo sapiens
tctaagtcagtttcacatatttg

SEQ ID NO: 5794984 - DNA, 17 bp, Homo sapiens
tctaagtccacttaaat

SEQ ID NO: 5794985 - DNA, 20 bp, Homo sapiens
tctaagtcggttaaaatgga

SEQ ID NO: 5794986 - DNA, 18 bp, Homo sapiens
tctaagtctccaagaata

SEQ ID NO: 5794987 - DNA, 22 bp, Homo sapiens
tctaagtctccaagaatacaga

SEQ ID NO: 5794988 - DNA, 14 bp, Homo sapiens
tctaagtctttcca

SEQ ID NO: 5794989 - DNA, 21 bp, Homo sapiens
tctaagtgaatacttggaagt

SEQ ID NO: 5794990 - DNA, 13 bp, Homo sapiens
tctaagtgatata

SEQ ID NO: 5794991 - DNA, 15 bp, Homo sapiens
tctaagtgctgctgt

SEQ ID NO: 5794992 - DNA, 18 bp, Homo sapiens
tctaagtgggcattgcca

SEQ ID NO: 5794993 - DNA, 22 bp, Homo sapiens
tctaagtgtaaaagtagtaaat

SEQ ID NO: 5794994 - DNA, 17 bp, Homo sapiens
tctaagtgtaaatgtta

SEQ ID NO: 5794995 - DNA, 13 bp, Homo sapiens
tctaagtgtactt

SEQ ID NO: 5794996 - DNA, 14 bp, Homo sapiens
tctaagtgtacttc

SEQ ID NO: 5794997 - DNA, 14 bp, Homo sapiens
tctaagtgtttgct

SEQ ID NO: 5794998 - DNA, 15 bp, Homo sapiens
tctaagttaaatcat

SEQ ID NO: 5794999 - DNA, 20 bp, Homo sapiens
tctaagttataagactctca

SEQ ID NO: 5795000 - DNA, 19 bp, Homo sapiens
tctaagttcacagtgtttc

SEQ ID NO: 5795001 - DNA, 20 bp, Homo sapiens
tctaagttcatgtttgtaaa

SEQ ID NO: 5795002 - DNA, 16 bp, Homo sapiens
tctaagttctattgaa

SEQ ID NO: 5795003 - DNA, 21 bp, Homo sapiens
tctaagtttagaagcgctcat

SEQ ID NO: 5795004 - DNA, 22 bp, Homo sapiens
tctaataaaacagctgtctcta

SEQ ID NO: 5795005 - DNA, 12 bp, Homo sapiens
tctaataaaatt

SEQ ID NO: 5795006 - DNA, 17 bp, Homo sapiens
tctaataaacactgttt

SEQ ID NO: 5795007 - DNA, 22 bp, Homo sapiens
tctaataaacttggattctcta

SEQ ID NO: 5795008 - DNA, 19 bp, Homo sapiens
tctaataaagctcctctgc

SEQ ID NO: 5795009 - DNA, 18 bp, Homo sapiens
tctaataaagtcatttgt

SEQ ID NO: 5795010 - DNA, 20 bp, Homo sapiens
tctaataaagtcatttgtga

SEQ ID NO: 5795011 - DNA, 14 bp, Homo sapiens
tctaataaatcagt

SEQ ID NO: 5795012 - DNA, 18 bp, Homo sapiens
tctaataagtttgtgtta

SEQ ID NO: 5795013 - DNA, 13 bp, Homo sapiens
tctaataataaat

SEQ ID NO: 5795014 - DNA, 19 bp, Homo sapiens
tctaatacaaaattataaa

SEQ ID NO: 5795015 - DNA, 14 bp, Homo sapiens
tctaatacctctgt

SEQ ID NO: 5795016 - DNA, 22 bp, Homo sapiens
tctaatacgagccttctcaccc

SEQ ID NO: 5795017 - DNA, 22 bp, Homo sapiens
tctaatactaatgttatttctt

SEQ ID NO: 5795018 - DNA, 19 bp, Homo sapiens
tctaatagaaaagtctcca

SEQ ID NO: 5795019 - DNA, 22 bp, Homo sapiens
tctaatagaaaagtctccaccc

SEQ ID NO: 5795020 - DNA, 18 bp, Homo sapiens
tctaatagagaacttttt

SEQ ID NO: 5795021 - DNA, 12 bp, Homo sapiens
tctaatagtata

SEQ ID NO: 5795022 - DNA, 15 bp, Homo sapiens
tctaatagtttttca

SEQ ID NO: 5795023 - DNA, 15 bp, Homo sapiens
tctaatataatatgg

SEQ ID NO: 5795024 - DNA, 15 bp, Homo sapiens
tctaatatattttta

SEQ ID NO: 5795025 - DNA, 17 bp, Homo sapiens
tctaatatcattcacta

SEQ ID NO: 5795026 - DNA, 19 bp, Homo sapiens
tctaatatccccaaattag

SEQ ID NO: 5795027 - DNA, 16 bp, Homo sapiens
tctaatatgattatac

SEQ ID NO: 5795028 - DNA, 18 bp, Homo sapiens
tctaatatgattatacaa

SEQ ID NO: 5795029 - DNA, 20 bp, Homo sapiens
tctaatatggcaaaaatggc

SEQ ID NO: 5795030 - DNA, 14 bp, Homo sapiens
tctaatatgtaaca

SEQ ID NO: 5795031 - DNA, 12 bp, Homo sapiens
tctaatattgct

SEQ ID NO: 5795032 - DNA, 22 bp, Homo sapiens
tctaatatttattgctttataa

SEQ ID NO: 5795033 - DNA, 15 bp, Homo sapiens
tctaatatttctagt

SEQ ID NO: 5795034 - DNA, 14 bp, Homo sapiens
tctaatcacagtgt

SEQ ID NO: 5795035 - DNA, 18 bp, Homo sapiens
tctaatcatgaaactccc

SEQ ID NO: 5795036 - DNA, 16 bp, Homo sapiens
tctaatccatgtgctg

SEQ ID NO: 5795037 - DNA, 13 bp, Homo sapiens
tctaatccttgct

SEQ ID NO: 5795038 - DNA, 20 bp, Homo sapiens
tctaatcgaaagaaaatggg

SEQ ID NO: 5795039 - DNA, 20 bp, Homo sapiens
tctaatctagatatcgactt

SEQ ID NO: 5795040 - DNA, 21 bp, Homo sapiens
tctaatctcttattctaataa

SEQ ID NO: 5795041 - DNA, 13 bp, Homo sapiens
tctaatctgaact

SEQ ID NO: 5795042 - DNA, 22 bp, Homo sapiens
tctaatctgagctgcagcctgg

SEQ ID NO: 5795043 - DNA, 20 bp, Homo sapiens
tctaatctgtgctgtttcaa

SEQ ID NO: 5795044 - DNA, 13 bp, Homo sapiens
tctaatgaagaca

SEQ ID NO: 5795045 - DNA, 15 bp, Homo sapiens
tctaatgaagacaat

SEQ ID NO: 5795046 - DNA, 14 bp, Homo sapiens
tctaatgaagagaa

SEQ ID NO: 5795047 - DNA, 14 bp, Homo sapiens
tctaatgacagata

SEQ ID NO: 5795048 - DNA, 21 bp, Homo sapiens
tctaatgacatgcctatatga

SEQ ID NO: 5795049 - DNA, 19 bp, Homo sapiens
tctaatgacattcaataaa

SEQ ID NO: 5795050 - DNA, 15 bp, Homo sapiens
tctaatgacccagat

SEQ ID NO: 5795051 - DNA, 16 bp, Homo sapiens
tctaatgagcatttcc

SEQ ID NO: 5795052 - DNA, 21 bp, Homo sapiens
tctaatgagctagtgtcttat

SEQ ID NO: 5795053 - DNA, 22 bp, Homo sapiens
tctaatgatggcccattctact

SEQ ID NO: 5795054 - DNA, 13 bp, Homo sapiens
tctaatgcatatt

SEQ ID NO: 5795055 - DNA, 22 bp, Homo sapiens
tctaatgcatatttataagaga

SEQ ID NO: 5795056 - DNA, 18 bp, Homo sapiens
tctaatgccttttgaata

SEQ ID NO: 5795057 - DNA, 15 bp, Homo sapiens
tctaatgctcacgct

SEQ ID NO: 5795058 - DNA, 20 bp, Homo sapiens
tctaatgcttgtttatgata

SEQ ID NO: 5795059 - DNA, 20 bp, Homo sapiens
tctaatggcacttatcatta

SEQ ID NO: 5795060 - DNA, 22 bp, Homo sapiens
tctaatggctgtggcattgttg

SEQ ID NO: 5795061 - DNA, 23 bp, Homo sapiens
tctaatgggggcagtctcccctt

SEQ ID NO: 5795062 - DNA, 11 bp, Homo sapiens
tctagaaaata

SEQ ID NO: 5795063 - DNA, 23 bp, Homo sapiens
tctagaaaataatgcaaatgtca

SEQ ID NO: 5795064 - DNA, 20 bp, Homo sapiens
tctagaaagaaaagaccctg

SEQ ID NO: 5795065 - DNA, 21 bp, Homo sapiens
tctagaaagaaaagaccctga

SEQ ID NO: 5795066 - DNA, 19 bp, Homo sapiens
tctagaaagagaaacagtt

SEQ ID NO: 5795067 - DNA, 22 bp, Homo sapiens
tctagaaagcccctcacctcag

SEQ ID NO: 5795068 - DNA, 20 bp, Homo sapiens
tctagaaagtaagaaaacaa

SEQ ID NO: 5795069 - DNA, 17 bp, Homo sapiens
tctagaacaattacatg

SEQ ID NO: 5795070 - DNA, 20 bp, Homo sapiens
tctagaacacccactggcca

SEQ ID NO: 5795071 - DNA, 22 bp, Homo sapiens
tctagaacacccactggccagt

SEQ ID NO: 5795072 - DNA, 20 bp, Homo sapiens
tctagaaccactaaccccgc

SEQ ID NO: 5795073 - DNA, 14 bp, Homo sapiens
tctagaacctgggc

SEQ ID NO: 5795074 - DNA, 18 bp, Homo sapiens
tctagaacttgaccccct

SEQ ID NO: 5795075 - DNA, 14 bp, Homo sapiens
tctagaagaaatga

SEQ ID NO: 5795076 - DNA, 17 bp, Homo sapiens
tctagaagaattaagct

SEQ ID NO: 5795077 - DNA, 18 bp, Homo sapiens
tctagaagataacatttt

SEQ ID NO: 5795078 - DNA, 16 bp, Homo sapiens
tctagaagatgtgtaa

SEQ ID NO: 5795079 - DNA, 17 bp, Homo sapiens
tctagaagatgtgtaaa

SEQ ID NO: 5795080 - DNA, 23 bp, Homo sapiens
tctagaagatgtgtaaacaggta

SEQ ID NO: 5795081 - DNA, 20 bp, Homo sapiens
tctagaagccaagggaaagg

SEQ ID NO: 5795082 - DNA, 12 bp, Homo sapiens
tctagaagctcc

SEQ ID NO: 5795083 - DNA, 18 bp, Homo sapiens
tctagaatactaataaaa

SEQ ID NO: 5795084 - DNA, 19 bp, Homo sapiens
tctagaatcacagctcaag

SEQ ID NO: 5795085 - DNA, 22 bp, Homo sapiens
tctagaatcacagctcaagcat

SEQ ID NO: 5795086 - DNA, 16 bp, Homo sapiens
tctagaatcagagctg

SEQ ID NO: 5795087 - DNA, 14 bp, Homo sapiens
tctagaatcctgct

SEQ ID NO: 5795088 - DNA, 17 bp, Homo sapiens
tctagaatcctgcttta

SEQ ID NO: 5795089 - DNA, 22 bp, Homo sapiens
tctagaatgtctgaagtacaaa

SEQ ID NO: 5795090 - DNA, 11 bp, Homo sapiens
tctagaatgtg

SEQ ID NO: 5795091 - DNA, 18 bp, Homo sapiens
tctagaattctagaaaga

SEQ ID NO: 5795092 - DNA, 19 bp, Homo sapiens
tctagaattttaagtgctt

SEQ ID NO: 5795093 - DNA, 17 bp, Homo sapiens
tctagacaaccctgcaa

SEQ ID NO: 5795094 - DNA, 20 bp, Homo sapiens
tctagacaagatattgtaca

SEQ ID NO: 5795095 - DNA, 17 bp, Homo sapiens
tctagacactgaaggca

SEQ ID NO: 5795096 - DNA, 14 bp, Homo sapiens
tctagacactgcca

SEQ ID NO: 5795097 - DNA, 16 bp, Homo sapiens
tctagacagtattgcc

SEQ ID NO: 5795098 - DNA, 23 bp, Homo sapiens
tctagacagtattgccacctctg

SEQ ID NO: 5795099 - DNA, 20 bp, Homo sapiens
tctagacatggaggttctaa

SEQ ID NO: 5795100 - DNA, 13 bp, Homo sapiens
tctagaccagggc

SEQ ID NO: 5795101 - DNA, 14 bp, Homo sapiens
tctagactaaaaga

SEQ ID NO: 5795102 - DNA, 16 bp, Homo sapiens
tctagactataaatgt

SEQ ID NO: 5795103 - DNA, 15 bp, Homo sapiens
tctagactgcaagaa

SEQ ID NO: 5795104 - DNA, 19 bp, Homo sapiens
tctagactgcaagaactgt

SEQ ID NO: 5795105 - DNA, 18 bp, Homo sapiens
tctagacttccccatccc

SEQ ID NO: 5795106 - DNA, 17 bp, Homo sapiens
tctagactttctcagtg

SEQ ID NO: 5795107 - DNA, 11 bp, Homo sapiens
tctagagagag

SEQ ID NO: 5795108 - DNA, 20 bp, Homo sapiens
tctagagagatgagaagcca

SEQ ID NO: 5795109 - DNA, 22 bp, Homo sapiens
tctagagagccttaacttctta

SEQ ID NO: 5795110 - DNA, 22 bp, Homo sapiens
tctagagagggaattctcttgg

SEQ ID NO: 5795111 - DNA, 23 bp, Homo sapiens
tctagagagggaattctcttggc

SEQ ID NO: 5795112 - DNA, 16 bp, Homo sapiens
tctagagatagtacat

SEQ ID NO: 5795113 - DNA, 16 bp, Homo sapiens
tctagagatatatata

SEQ ID NO: 5795114 - DNA, 18 bp, Homo sapiens
tctagagatatatatact

SEQ ID NO: 5795115 - DNA, 20 bp, Homo sapiens
tctagagatgtgcctgtggg

SEQ ID NO: 5795116 - DNA, 21 bp, Homo sapiens
tctagagattttcttggcagt

SEQ ID NO: 5795117 - DNA, 15 bp, Homo sapiens
tctagagcactgcca

SEQ ID NO: 5795118 - DNA, 15 bp, Homo sapiens
tctagagcagggatt

SEQ ID NO: 5795119 - DNA, 12 bp, Homo sapiens
tctagagctttt

SEQ ID NO: 5795120 - DNA, 15 bp, Homo sapiens
tctagaggcctcagt

SEQ ID NO: 5795121 - DNA, 19 bp, Homo sapiens
tctagaggctcatggccct

SEQ ID NO: 5795122 - DNA, 15 bp, Homo sapiens
tctagaggctggcaa

SEQ ID NO: 5795123 - DNA, 14 bp, Homo sapiens
tctagagggagaag

SEQ ID NO: 5795124 - DNA, 22 bp, Homo sapiens
tctagagggagaagactgtgcg

SEQ ID NO: 5795125 - DNA, 16 bp, Homo sapiens
tctagaggtctctctg

SEQ ID NO: 5795126 - DNA, 22 bp, Homo sapiens
tctagagtagaggtataattgt

SEQ ID NO: 5795127 - DNA, 21 bp, Homo sapiens
tctagagtcatgtgagcctcg

SEQ ID NO: 5795128 - DNA, 20 bp, Homo sapiens
tctagagtgagaatctggct

SEQ ID NO: 5795129 - DNA, 18 bp, Homo sapiens
tctagagttatcttcttt

SEQ ID NO: 5795130 - DNA, 18 bp, Homo sapiens
tctagagttcagagtcct

SEQ ID NO: 5795131 - DNA, 22 bp, Homo sapiens
tctagagtttatacagtgtaca

SEQ ID NO: 5795132 - DNA, 23 bp, Homo sapiens
tctagagtttatacagtgtacat

SEQ ID NO: 5795133 - DNA, 14 bp, Homo sapiens
tctagataaaagga

SEQ ID NO: 5795134 - DNA, 20 bp, Homo sapiens
tctagatacaataaattgct

SEQ ID NO: 5795135 - DNA, 15 bp, Homo sapiens
tctagatacctaaaa

SEQ ID NO: 5795136 - DNA, 17 bp, Homo sapiens
tctagatacctaaaaca

SEQ ID NO: 5795137 - DNA, 13 bp, Homo sapiens
tctagatactgta

SEQ ID NO: 5795138 - DNA, 24 bp, Homo sapiens
tctagatactgtatcatgacaaag

SEQ ID NO: 5795139 - DNA, 15 bp, Homo sapiens
tctagatatcgactt

SEQ ID NO: 5795140 - DNA, 20 bp, Homo sapiens
tctagatcactgtgcttatt

SEQ ID NO: 5795141 - DNA, 21 bp, Homo sapiens
tctagatcagatgctccaaga

SEQ ID NO: 5795142 - DNA, 21 bp, Homo sapiens
tctagatgaagttttacattg

SEQ ID NO: 5795143 - DNA, 16 bp, Homo sapiens
tctagatgagctgggc

SEQ ID NO: 5795144 - DNA, 16 bp, Homo sapiens
tctagatgatcaacat

SEQ ID NO: 5795145 - DNA, 14 bp, Homo sapiens
tctagatgattttt

SEQ ID NO: 5795146 - DNA, 11 bp, Homo sapiens
tctagatgctt

SEQ ID NO: 5795147 - DNA, 19 bp, Homo sapiens
tctagatggaccccagcat

SEQ ID NO: 5795148 - DNA, 20 bp, Homo sapiens
tctagatggatattagatgc

SEQ ID NO: 5795149 - DNA, 16 bp, Homo sapiens
tctagatggcaacatt

SEQ ID NO: 5795150 - DNA, 23 bp, Homo sapiens
tctagatggcaacattggacaga

SEQ ID NO: 5795151 - DNA, 19 bp, Homo sapiens
tctagatgggttcttagct

SEQ ID NO: 5795152 - DNA, 11 bp, Homo sapiens
tctagatgtaa

SEQ ID NO: 5795153 - DNA, 21 bp, Homo sapiens
tctagatgtttattcttctag

SEQ ID NO: 5795154 - DNA, 20 bp, Homo sapiens
tctagattaatactctattt

SEQ ID NO: 5795155 - DNA, 21 bp, Homo sapiens
tctagattaccccctcattgt

SEQ ID NO: 5795156 - DNA, 18 bp, Homo sapiens
tctagattcaaaggttct

SEQ ID NO: 5795157 - DNA, 22 bp, Homo sapiens
tctagattccattggtccaaga

SEQ ID NO: 5795158 - DNA, 14 bp, Homo sapiens
tctagattctctgg

SEQ ID NO: 5795159 - DNA, 15 bp, Homo sapiens
tctagattttgaaaa

SEQ ID NO: 5795160 - DNA, 17 bp, Homo sapiens
tctagattttgaaaaat

SEQ ID NO: 5795161 - DNA, 15 bp, Homo sapiens
tctagcaaatgttat

SEQ ID NO: 5795162 - DNA, 13 bp, Homo sapiens
tctagcaactgtt

SEQ ID NO: 5795163 - DNA, 22 bp, Homo sapiens
tctagcaagaagattctaaaac

SEQ ID NO: 5795164 - DNA, 19 bp, Homo sapiens
tctagcaagatagtcttca

SEQ ID NO: 5795165 - DNA, 22 bp, Homo sapiens
tctagcaattttctttgtttct

SEQ ID NO: 5795166 - DNA, 22 bp, Homo sapiens
tctagcacaatttgcactaaat

SEQ ID NO: 5795167 - DNA, 22 bp, Homo sapiens
tctagcacagctgtgaggacag

SEQ ID NO: 5795168 - DNA, 18 bp, Homo sapiens
tctagcacatcatggcag

SEQ ID NO: 5795169 - DNA, 19 bp, Homo sapiens
tctagcacatcatggcagt

SEQ ID NO: 5795170 - DNA, 12 bp, Homo sapiens
tctagcacatgt

SEQ ID NO: 5795171 - DNA, 19 bp, Homo sapiens
tctagcactcctcaagact

SEQ ID NO: 5795172 - DNA, 14 bp, Homo sapiens
tctagcactggcct

SEQ ID NO: 5795173 - DNA, 15 bp, Homo sapiens
tctagcacttccttg

SEQ ID NO: 5795174 - DNA, 13 bp, Homo sapiens
tctagcagagtga

SEQ ID NO: 5795175 - DNA, 16 bp, Homo sapiens
tctagcagcacctcct

SEQ ID NO: 5795176 - DNA, 16 bp, Homo sapiens
tctagcagcagatctg

SEQ ID NO: 5795177 - DNA, 15 bp, Homo sapiens
tctagcagctggcct

SEQ ID NO: 5795178 - DNA, 15 bp, Homo sapiens
tctagcagtaaatac

SEQ ID NO: 5795179 - DNA, 19 bp, Homo sapiens
tctagcagtatgtgtgctc

SEQ ID NO: 5795180 - DNA, 20 bp, Homo sapiens
tctagcagtatgtgtgctct

SEQ ID NO: 5795181 - DNA, 16 bp, Homo sapiens
tctagcatcctcttaa

SEQ ID NO: 5795182 - DNA, 20 bp, Homo sapiens
tctagcatgccaacaagaat

SEQ ID NO: 5795183 - DNA, 22 bp, Homo sapiens
tctagcatgccaacaagaatgc

SEQ ID NO: 5795184 - DNA, 15 bp, Homo sapiens
tctagcatgctactt

SEQ ID NO: 5795185 - DNA, 23 bp, Homo sapiens
tctagcatggcatatttttcaca

SEQ ID NO: 5795186 - DNA, 19 bp, Homo sapiens
tctagcattaggtatatct

SEQ ID NO: 5795187 - DNA, 15 bp, Homo sapiens
tctagcatttatttc

SEQ ID NO: 5795188 - DNA, 19 bp, Homo sapiens
tctagcatttatttctctg

SEQ ID NO: 5795189 - DNA, 16 bp, Homo sapiens
tctagccaaagagctc

SEQ ID NO: 5795190 - DNA, 19 bp, Homo sapiens
tctagccactccctcccag

SEQ ID NO: 5795191 - DNA, 21 bp, Homo sapiens
tctagccaggagtctgtgctc

SEQ ID NO: 5795192 - DNA, 15 bp, Homo sapiens
tctagccatcccttg

SEQ ID NO: 5795193 - DNA, 17 bp, Homo sapiens
tctagccatcccttggg

SEQ ID NO: 5795194 - DNA, 15 bp, Homo sapiens
tctagcccactccct

SEQ ID NO: 5795195 - DNA, 17 bp, Homo sapiens
tctagccgatggaaaat

SEQ ID NO: 5795196 - DNA, 14 bp, Homo sapiens
tctagccgctgccc

SEQ ID NO: 5795197 - DNA, 19 bp, Homo sapiens
tctagccgggccatgcttt

SEQ ID NO: 5795198 - DNA, 23 bp, Homo sapiens
tctagcctaagtgtggagaagga

SEQ ID NO: 5795199 - DNA, 12 bp, Homo sapiens
tctagcctctga

SEQ ID NO: 5795200 - DNA, 13 bp, Homo sapiens
tctagcctctgga

SEQ ID NO: 5795201 - DNA, 22 bp, Homo sapiens
tctagcctgcactttgatgtca

SEQ ID NO: 5795202 - DNA, 14 bp, Homo sapiens
tctagcctggcaac

SEQ ID NO: 5795203 - DNA, 22 bp, Homo sapiens
tctagcctggcaacagagcgag

SEQ ID NO: 5795204 - DNA, 18 bp, Homo sapiens
tctagccttaaggggggc

SEQ ID NO: 5795205 - DNA, 22 bp, Homo sapiens
tctagcctttattattactgtt

SEQ ID NO: 5795206 - DNA, 20 bp, Homo sapiens
tctagcgaacgtatttctcc

SEQ ID NO: 5795207 - DNA, 15 bp, Homo sapiens
tctagcgtagtgcag

SEQ ID NO: 5795208 - DNA, 16 bp, Homo sapiens
tctagctagaaatatg

SEQ ID NO: 5795209 - DNA, 21 bp, Homo sapiens
tctagctagaaatatgatttt

SEQ ID NO: 5795210 - DNA, 21 bp, Homo sapiens
tctagctataacaactctatt

SEQ ID NO: 5795211 - DNA, 16 bp, Homo sapiens
tctagctattattttc

SEQ ID NO: 5795212 - DNA, 14 bp, Homo sapiens
tctagctctggtgg

SEQ ID NO: 5795213 - DNA, 21 bp, Homo sapiens
tctagctgcagatgcctctgc

SEQ ID NO: 5795214 - DNA, 21 bp, Homo sapiens
tctagctgggggtgggccagg

SEQ ID NO: 5795215 - DNA, 17 bp, Homo sapiens
tctagctggtggtttca

SEQ ID NO: 5795216 - DNA, 17 bp, Homo sapiens
tctagctgtatgatttg

SEQ ID NO: 5795217 - DNA, 19 bp, Homo sapiens
tctagctgtatgatttgtt

SEQ ID NO: 5795218 - DNA, 14 bp, Homo sapiens
tctagctgttcttt

SEQ ID NO: 5795219 - DNA, 19 bp, Homo sapiens
tctagctgttgagctgttt

SEQ ID NO: 5795220 - DNA, 19 bp, Homo sapiens
tctagcttcatgcctcagt

SEQ ID NO: 5795221 - DNA, 17 bp, Homo sapiens
tctagctttgttgtcct

SEQ ID NO: 5795222 - DNA, 22 bp, Homo sapiens
tctagctttgttgtcctcccag

SEQ ID NO: 5795223 - DNA, 16 bp, Homo sapiens
tctagctttgtttagt

SEQ ID NO: 5795224 - DNA, 12 bp, Homo sapiens
tctagcttttct

SEQ ID NO: 5795225 - DNA, 13 bp, Homo sapiens
tctagcttttcta

SEQ ID NO: 5795226 - DNA, 22 bp, Homo sapiens
tctagcttttctatttttgatt

SEQ ID NO: 5795227 - DNA, 16 bp, Homo sapiens
tctaggaaaatatttt

SEQ ID NO: 5795228 - DNA, 21 bp, Homo sapiens
tctaggaaaatattttgatct

SEQ ID NO: 5795229 - DNA, 22 bp, Homo sapiens
tctaggaagaagacaaatgaca

SEQ ID NO: 5795230 - DNA, 15 bp, Homo sapiens
tctaggaagaatttt

SEQ ID NO: 5795231 - DNA, 20 bp, Homo sapiens
tctaggaagaattttaaaaa

SEQ ID NO: 5795232 - DNA, 22 bp, Homo sapiens
tctaggaagaattttaaaaatg

SEQ ID NO: 5795233 - DNA, 15 bp, Homo sapiens
tctaggaagactttg

SEQ ID NO: 5795234 - DNA, 16 bp, Homo sapiens
tctaggaatggaggag

SEQ ID NO: 5795235 - DNA, 20 bp, Homo sapiens
tctaggacccccagtgctca

SEQ ID NO: 5795236 - DNA, 15 bp, Homo sapiens
tctaggacctgtgtc

SEQ ID NO: 5795237 - DNA, 16 bp, Homo sapiens
tctaggactgcagtgt

SEQ ID NO: 5795238 - DNA, 22 bp, Homo sapiens
tctatgcagaacaggcagaaat

SEQ ID NO: 5795239 - DNA, 15 bp, Homo sapiens
tctatgcagcctgct

SEQ ID NO: 5795240 - DNA, 17 bp, Homo sapiens
tctatgccctgcagagc

SEQ ID NO: 5795241 - DNA, 18 bp, Homo sapiens
tctatgccctgcagagca

SEQ ID NO: 5795242 - DNA, 19 bp, Homo sapiens
tctatgccctgcagagcaa

SEQ ID NO: 5795243 - DNA, 12 bp, Homo sapiens
tctatgcctgca

SEQ ID NO: 5795244 - DNA, 14 bp, Homo sapiens
tctatgcctgtatt

SEQ ID NO: 5795245 - DNA, 12 bp, Homo sapiens
tctatgctctcg

SEQ ID NO: 5795246 - DNA, 20 bp, Homo sapiens
tctatgctgagtttgtgctg

SEQ ID NO: 5795247 - DNA, 22 bp, Homo sapiens
tctatgctgcttttatatctgt

SEQ ID NO: 5795248 - DNA, 18 bp, Homo sapiens
tctatgctggcttttcac

SEQ ID NO: 5795249 - DNA, 18 bp, Homo sapiens
tctatgctttccaaacct

SEQ ID NO: 5795250 - DNA, 14 bp, Homo sapiens
tctatggaaatgtg

SEQ ID NO: 5795251 - DNA, 19 bp, Homo sapiens
tctatggaaatgtgagaaa

SEQ ID NO: 5795252 - DNA, 22 bp, Homo sapiens
tctatggaaatgtgagaaatgt

SEQ ID NO: 5795253 - DNA, 20 bp, Homo sapiens
tctatggaaggaggcctcca

SEQ ID NO: 5795254 - DNA, 17 bp, Homo sapiens
tctatggagactttgct

SEQ ID NO: 5795255 - DNA, 19 bp, Homo sapiens
tctatggagactttgctgt

SEQ ID NO: 5795256 - DNA, 13 bp, Homo sapiens
tctatggagcagc

SEQ ID NO: 5795257 - DNA, 15 bp, Homo sapiens
tctatggagggcaga

SEQ ID NO: 5795258 - DNA, 18 bp, Homo sapiens
tctatggcagtccagcca

SEQ ID NO: 5795259 - DNA, 22 bp, Homo sapiens
tctatggcatattgataataaa

SEQ ID NO: 5795260 - DNA, 20 bp, Homo sapiens
tctatggctcatgtctgaaa

SEQ ID NO: 5795261 - DNA, 19 bp, Homo sapiens
tctatggcttatttctatg

SEQ ID NO: 5795262 - DNA, 20 bp, Homo sapiens
tctatggcttatttctatga

SEQ ID NO: 5795263 - DNA, 15 bp, Homo sapiens
tctatgggaaatcta

SEQ ID NO: 5795264 - DNA, 23 bp, Homo sapiens
tctatggggatacatgaacttca

SEQ ID NO: 5795265 - DNA, 21 bp, Homo sapiens
tctatgggtttagttacttta

SEQ ID NO: 5795266 - DNA, 22 bp, Homo sapiens
tctatggtaaagatattattca

SEQ ID NO: 5795267 - DNA, 22 bp, Homo sapiens
tctatggttatgaaagaatata

SEQ ID NO: 5795268 - DNA, 13 bp, Homo sapiens
tctatgtaaaaat

SEQ ID NO: 5795269 - DNA, 19 bp, Homo sapiens
tctatgtaaatgcatctgt

SEQ ID NO: 5795270 - DNA, 12 bp, Homo sapiens
tctatgtaaatt

SEQ ID NO: 5795271 - DNA, 11 bp, Homo sapiens
tctatgtaact

SEQ ID NO: 5795272 - DNA, 13 bp, Homo sapiens
tctatgtacctct

SEQ ID NO: 5795273 - DNA, 12 bp, Homo sapiens
tctatgtactag

SEQ ID NO: 5795274 - DNA, 15 bp, Homo sapiens
tctatgtagaactgt

SEQ ID NO: 5795275 - DNA, 17 bp, Homo sapiens
tctatgtagaactgttc

SEQ ID NO: 5795276 - DNA, 20 bp, Homo sapiens
tctatgtagaactgttcatt

SEQ ID NO: 5795277 - DNA, 14 bp, Homo sapiens
tctatgtaggaaaa

SEQ ID NO: 5795278 - DNA, 19 bp, Homo sapiens
tctatgtaggaaaaaaata

SEQ ID NO: 5795279 - DNA, 16 bp, Homo sapiens
tctatgtagtggtttt

SEQ ID NO: 5795280 - DNA, 12 bp, Homo sapiens
tctatgtatgtg

SEQ ID NO: 5795281 - DNA, 22 bp, Homo sapiens
tctatgtatgtgccaattttgt

SEQ ID NO: 5795282 - DNA, 20 bp, Homo sapiens
tctatgtatgttaatttatt

SEQ ID NO: 5795283 - DNA, 18 bp, Homo sapiens
tctatgtcaattgatatt

SEQ ID NO: 5795284 - DNA, 15 bp, Homo sapiens
tctatgtcattttta

SEQ ID NO: 5795285 - DNA, 18 bp, Homo sapiens
tctatgtcatttttaatg

SEQ ID NO: 5795286 - DNA, 17 bp, Homo sapiens
tctatgtcgtgttttca

SEQ ID NO: 5795287 - DNA, 14 bp, Homo sapiens
tctatgtctgcctt

SEQ ID NO: 5795288 - DNA, 15 bp, Homo sapiens
tctatgtctgccttc

SEQ ID NO: 5795289 - DNA, 12 bp, Homo sapiens
tctatgtgaata

SEQ ID NO: 5795290 - DNA, 16 bp, Homo sapiens
tctatgtgaatatttg

SEQ ID NO: 5795291 - DNA, 23 bp, Homo sapiens
tctatgtgggaaaaaagaaatcc

SEQ ID NO: 5795292 - DNA, 12 bp, Homo sapiens
tctatgtgtata

SEQ ID NO: 5795293 - DNA, 13 bp, Homo sapiens
tctatgtgtatat

SEQ ID NO: 5795294 - DNA, 22 bp, Homo sapiens
tctatgtgtttctgtaacaaat

SEQ ID NO: 5795295 - DNA, 23 bp, Homo sapiens
tctatgtgtttctgtaacaaatt

SEQ ID NO: 5795296 - DNA, 16 bp, Homo sapiens
tctatgttaaatactg

SEQ ID NO: 5795297 - DNA, 20 bp, Homo sapiens
tctatgttaaatactgtgca

SEQ ID NO: 5795298 - DNA, 16 bp, Homo sapiens
tctatgttaatatttt

SEQ ID NO: 5795299 - DNA, 23 bp, Homo sapiens
tctatgttaatattttatgtgta

SEQ ID NO: 5795300 - DNA, 19 bp, Homo sapiens
tctatgttagtataagctt

SEQ ID NO: 5795301 - DNA, 18 bp, Homo sapiens
tctatgttcaaagactgt

SEQ ID NO: 5795302 - DNA, 17 bp, Homo sapiens
tctatgttcataaaaaa

SEQ ID NO: 5795303 - DNA, 21 bp, Homo sapiens
tctatgttgcatgataaacat

SEQ ID NO: 5795304 - DNA, 19 bp, Homo sapiens
tctatgttggcattaacaa

SEQ ID NO: 5795305 - DNA, 22 bp, Homo sapiens
tctatgtttacaaatggacata

SEQ ID NO: 5795306 - DNA, 14 bp, Homo sapiens
tctatgtttattct

SEQ ID NO: 5795307 - DNA, 12 bp, Homo sapiens
tctatgtttgta

SEQ ID NO: 5795308 - DNA, 14 bp, Homo sapiens
tctatgtttgtatt

SEQ ID NO: 5795309 - DNA, 19 bp, Homo sapiens
tctatgtttgtatttggaa

SEQ ID NO: 5795310 - DNA, 13 bp, Homo sapiens
tctatgtttgtgt

SEQ ID NO: 5795311 - DNA, 21 bp, Homo sapiens
tctatgtttgtgtgatttcct

SEQ ID NO: 5795312 - DNA, 15 bp, Homo sapiens
tctatgttttctact

SEQ ID NO: 5795313 - DNA, 17 bp, Homo sapiens
tctatgttttctactcc

SEQ ID NO: 5795314 - DNA, 19 bp, Homo sapiens
tctatgttttctactccaa

SEQ ID NO: 5795315 - DNA, 20 bp, Homo sapiens
tctatgttttctactccaat

SEQ ID NO: 5795316 - DNA, 13 bp, Homo sapiens
tctattaaaagac

SEQ ID NO: 5795317 - DNA, 15 bp, Homo sapiens
tctattaaaagactc

SEQ ID NO: 5795318 - DNA, 16 bp, Homo sapiens
tctattaaaattctga

SEQ ID NO: 5795319 - DNA, 18 bp, Homo sapiens
tctattaaaattctgatg

SEQ ID NO: 5795320 - DNA, 16 bp, Homo sapiens
tctattaaaattgcca

SEQ ID NO: 5795321 - DNA, 11 bp, Homo sapiens
tctattaaagg

SEQ ID NO: 5795322 - DNA, 12 bp, Homo sapiens
tctattaaaggt

SEQ ID NO: 5795323 - DNA, 23 bp, Homo sapiens
tctattaaatagttatataattc

SEQ ID NO: 5795324 - DNA, 16 bp, Homo sapiens
tctattaagatttcca

SEQ ID NO: 5795325 - DNA, 17 bp, Homo sapiens
tctattaaggacattta

SEQ ID NO: 5795326 - DNA, 15 bp, Homo sapiens
tctattaagggatta

SEQ ID NO: 5795327 - DNA, 14 bp, Homo sapiens
tctattaatatcaa

SEQ ID NO: 5795328 - DNA, 17 bp, Homo sapiens
tctattaatatttatgt

SEQ ID NO: 5795329 - DNA, 23 bp, Homo sapiens
tctattaatcaagagaaacttca

SEQ ID NO: 5795330 - DNA, 19 bp, Homo sapiens
tctattaatcacctctctg

SEQ ID NO: 5795331 - DNA, 14 bp, Homo sapiens
tctattacactgga

SEQ ID NO: 5795332 - DNA, 18 bp, Homo sapiens
tctattacccctcattta

SEQ ID NO: 5795333 - DNA, 15 bp, Homo sapiens
tctattactctgaca

SEQ ID NO: 5795334 - DNA, 13 bp, Homo sapiens
tctattagatttt

SEQ ID NO: 5795335 - DNA, 14 bp, Homo sapiens
tctattagtttcaa

SEQ ID NO: 5795336 - DNA, 19 bp, Homo sapiens
tctattagttttctttgta

SEQ ID NO: 5795337 - DNA, 20 bp, Homo sapiens
tctattagttttctttgtaa

SEQ ID NO: 5795338 - DNA, 17 bp, Homo sapiens
tctattataaaaccatg

SEQ ID NO: 5795339 - DNA, 22 bp, Homo sapiens
tctattatactgtattaagagt

SEQ ID NO: 5795340 - DNA, 18 bp, Homo sapiens
tctattatagtgaaacat

SEQ ID NO: 5795341 - DNA, 15 bp, Homo sapiens
tctattatcacatta

SEQ ID NO: 5795342 - DNA, 15 bp, Homo sapiens
tctattatggaaata

SEQ ID NO: 5795343 - DNA, 20 bp, Homo sapiens
tctattattataaaaataat

SEQ ID NO: 5795344 - DNA, 12 bp, Homo sapiens
tctattcataat

SEQ ID NO: 5795345 - DNA, 13 bp, Homo sapiens
tctattccattcc

SEQ ID NO: 5795346 - DNA, 18 bp, Homo sapiens
tctattccatttgtattg

SEQ ID NO: 5795347 - DNA, 21 bp, Homo sapiens
tctattcccatcgctggaaaa

SEQ ID NO: 5795348 - DNA, 16 bp, Homo sapiens
tctattccctcagcct

SEQ ID NO: 5795349 - DNA, 15 bp, Homo sapiens
tctattcctgaccct

SEQ ID NO: 5795350 - DNA, 19 bp, Homo sapiens
tctattcgccacacagtat

SEQ ID NO: 5795351 - DNA, 15 bp, Homo sapiens
tctattctccagaca

SEQ ID NO: 5795352 - DNA, 16 bp, Homo sapiens
tctattctccagctga

SEQ ID NO: 5795353 - DNA, 13 bp, Homo sapiens
tctattctctcca

SEQ ID NO: 5795354 - DNA, 16 bp, Homo sapiens
tctattctctgcaatt

SEQ ID NO: 5795355 - DNA, 14 bp, Homo sapiens
tctattctttgcct

SEQ ID NO: 5795356 - DNA, 13 bp, Homo sapiens
tctattgaaaaat

SEQ ID NO: 5795357 - DNA, 13 bp, Homo sapiens
tctattgaaaaca

SEQ ID NO: 5795358 - DNA, 19 bp, Homo sapiens
tctattgaaaacagtgtct

SEQ ID NO: 5795359 - DNA, 15 bp, Homo sapiens
tctattgaaagtttt

SEQ ID NO: 5795360 - DNA, 14 bp, Homo sapiens
tctattgagccaag

SEQ ID NO: 5795361 - DNA, 22 bp, Homo sapiens
tctattgatacaatattgtgca

SEQ ID NO: 5795362 - DNA, 15 bp, Homo sapiens
tctattgcagagact

SEQ ID NO: 5795363 - DNA, 22 bp, Homo sapiens
tctattgcctctgagagcatca

SEQ ID NO: 5795364 - DNA, 16 bp, Homo sapiens
tctattgggattttct

SEQ ID NO: 5795365 - DNA, 15 bp, Homo sapiens
tctattgggttcatt

SEQ ID NO: 5795366 - DNA, 16 bp, Homo sapiens
tctattgggttcatta

SEQ ID NO: 5795367 - DNA, 17 bp, Homo sapiens
tctattgggttcattat

SEQ ID NO: 5795368 - DNA, 18 bp, Homo sapiens
tctattgggttcattatt

SEQ ID NO: 5795369 - DNA, 20 bp, Homo sapiens
tctattgtaattttgttcct

SEQ ID NO: 5795370 - DNA, 22 bp, Homo sapiens
tctattgtaattttgttcctgt

SEQ ID NO: 5795371 - DNA, 13 bp, Homo sapiens
tctattgtacaga

SEQ ID NO: 5795372 - DNA, 17 bp, Homo sapiens
tctattgtagcatttct

SEQ ID NO: 5795373 - DNA, 19 bp, Homo sapiens
tctattgtagcatttcttg

SEQ ID NO: 5795374 - DNA, 17 bp, Homo sapiens
tctattgtcaagatgct

SEQ ID NO: 5795375 - DNA, 18 bp, Homo sapiens
tctattgtgggacttatt

SEQ ID NO: 5795376 - DNA, 22 bp, Homo sapiens
tctattgtgttggctttacaaa

SEQ ID NO: 5795377 - DNA, 22 bp, Homo sapiens
tctattgttgtacacagaaata

SEQ ID NO: 5795378 - DNA, 12 bp, Homo sapiens
tctattgtttac

SEQ ID NO: 5795379 - DNA, 17 bp, Homo sapiens
tctattgtttgttgcac

SEQ ID NO: 5795380 - DNA, 14 bp, Homo sapiens
tctatttaaaaaac

SEQ ID NO: 5795381 - DNA, 16 bp, Homo sapiens
tctatttaaaaaactg

SEQ ID NO: 5795382 - DNA, 14 bp, Homo sapiens
tctatttaaaaaat

SEQ ID NO: 5795383 - DNA, 15 bp, Homo sapiens
tctatttaaattctt

SEQ ID NO: 5795384 - DNA, 16 bp, Homo sapiens
tctatttaagtgcaat

SEQ ID NO: 5795385 - DNA, 18 bp, Homo sapiens
tctatttaattaggaaaa

SEQ ID NO: 5795386 - DNA, 20 bp, Homo sapiens
tctatttaattaggaaaaaa

SEQ ID NO: 5795387 - DNA, 15 bp, Homo sapiens
tctatttaattgaaa

SEQ ID NO: 5795388 - DNA, 13 bp, Homo sapiens
tctatttaatttt

SEQ ID NO: 5795389 - DNA, 21 bp, Homo sapiens
tctatttagccagcgtttatt

SEQ ID NO: 5795390 - DNA, 19 bp, Homo sapiens
tctatttatctgtctgagc

SEQ ID NO: 5795391 - DNA, 14 bp, Homo sapiens
tctatttatgagat

SEQ ID NO: 5795392 - DNA, 13 bp, Homo sapiens
tctatttatgttt

SEQ ID NO: 5795393 - DNA, 12 bp, Homo sapiens
tctatttattag

SEQ ID NO: 5795394 - DNA, 12 bp, Homo sapiens
tctatttattgg

SEQ ID NO: 5795395 - DNA, 15 bp, Homo sapiens
tctatttatttactg

SEQ ID NO: 5795396 - DNA, 13 bp, Homo sapiens
tctatttatttat

SEQ ID NO: 5795397 - DNA, 14 bp, Homo sapiens
tctatttcatgttt

SEQ ID NO: 5795398 - DNA, 15 bp, Homo sapiens
tctatttccactgaa

SEQ ID NO: 5795399 - DNA, 19 bp, Homo sapiens
tctatttccactgaacaaa

SEQ ID NO: 5795400 - DNA, 20 bp, Homo sapiens
tctatttcggaaatacacta

SEQ ID NO: 5795401 - DNA, 15 bp, Homo sapiens
tctatttctcctcca

SEQ ID NO: 5795402 - DNA, 20 bp, Homo sapiens
tctatttctcctccatggga

SEQ ID NO: 5795403 - DNA, 17 bp, Homo sapiens
tctatttctctccttaa

SEQ ID NO: 5795404 - DNA, 13 bp, Homo sapiens
tctatttctctct

SEQ ID NO: 5795405 - DNA, 14 bp, Homo sapiens
tctatttctctgtg

SEQ ID NO: 5795406 - DNA, 15 bp, Homo sapiens
tctatttctgagaag

SEQ ID NO: 5795407 - DNA, 11 bp, Homo sapiens
tctatttctgc

SEQ ID NO: 5795408 - DNA, 16 bp, Homo sapiens
tctatttctgcctccc

SEQ ID NO: 5795409 - DNA, 12 bp, Homo sapiens
tctatttcttta

SEQ ID NO: 5795410 - DNA, 15 bp, Homo sapiens
tctatttgagaagtt

SEQ ID NO: 5795411 - DNA, 18 bp, Homo sapiens
tctatttgatttgcaaca

SEQ ID NO: 5795412 - DNA, 18 bp, Homo sapiens
tctatttggggcttgatg

SEQ ID NO: 5795413 - DNA, 14 bp, Homo sapiens
tctatttgtacaat

SEQ ID NO: 5795414 - DNA, 18 bp, Homo sapiens
tctatttgtacaatttta

SEQ ID NO: 5795415 - DNA, 22 bp, Homo sapiens
tctatttgtacaattttaaagt

SEQ ID NO: 5795416 - DNA, 12 bp, Homo sapiens
tctatttgtaga

SEQ ID NO: 5795417 - DNA, 13 bp, Homo sapiens
tctatttgtgtaa

SEQ ID NO: 5795418 - DNA, 10 bp, Homo sapiens
tctcatccca

SEQ ID NO: 5795419 - DNA, 15 bp, Homo sapiens
tctcatcccaataaa

SEQ ID NO: 5795420 - DNA, 19 bp, Homo sapiens
tctcatcccacgcactcca

SEQ ID NO: 5795421 - DNA, 21 bp, Homo sapiens
tctcatcccagtctgatattc

SEQ ID NO: 5795422 - DNA, 16 bp, Homo sapiens
tctcatccccagtccc

SEQ ID NO: 5795423 - DNA, 23 bp, Homo sapiens
tctcatccccagtcccaatgcac

SEQ ID NO: 5795424 - DNA, 17 bp, Homo sapiens
tctcatccccctgtgga

SEQ ID NO: 5795425 - DNA, 13 bp, Homo sapiens
tctcatccctcaa

SEQ ID NO: 5795426 - DNA, 19 bp, Homo sapiens
tctcatcctcccattgccc

SEQ ID NO: 5795427 - DNA, 22 bp, Homo sapiens
tctcatcctcccattgcccagt

SEQ ID NO: 5795428 - DNA, 24 bp, Homo sapiens
tctcatcctcccattgcccagtga

SEQ ID NO: 5795429 - DNA, 15 bp, Homo sapiens
tctcatcctcctgga

SEQ ID NO: 5795430 - DNA, 16 bp, Homo sapiens
tctcatcctcctggaa

SEQ ID NO: 5795431 - DNA, 17 bp, Homo sapiens
tctcatcctcctggaac

SEQ ID NO: 5795432 - DNA, 14 bp, Homo sapiens
tctcatcctccttt

SEQ ID NO: 5795433 - DNA, 18 bp, Homo sapiens
tctcatcctcctttcagt

SEQ ID NO: 5795434 - DNA, 15 bp, Homo sapiens
tctcatcctgcaggc

SEQ ID NO: 5795435 - DNA, 16 bp, Homo sapiens
tctcatccttttctcc

SEQ ID NO: 5795436 - DNA, 21 bp, Homo sapiens
tctcatctactcattgtctca

SEQ ID NO: 5795437 - DNA, 20 bp, Homo sapiens
tctcatctcagtgaagaata

SEQ ID NO: 5795438 - DNA, 11 bp, Homo sapiens
tctcatctccc

SEQ ID NO: 5795439 - DNA, 13 bp, Homo sapiens
tctcatctcctga

SEQ ID NO: 5795440 - DNA, 14 bp, Homo sapiens
tctcatctcctgac

SEQ ID NO: 5795441 - DNA, 17 bp, Homo sapiens
tctcatctcctgaccct

SEQ ID NO: 5795442 - DNA, 19 bp, Homo sapiens
tctcatctgcacccttctt

SEQ ID NO: 5795443 - DNA, 23 bp, Homo sapiens
tctcatctgcacccttcttttct

SEQ ID NO: 5795444 - DNA, 22 bp, Homo sapiens
tctcatctgccggcccccagga

SEQ ID NO: 5795445 - DNA, 23 bp, Homo sapiens
tctcatctgccggcccccaggac

SEQ ID NO: 5795446 - DNA, 13 bp, Homo sapiens
tctcatcttaaaa

SEQ ID NO: 5795447 - DNA, 17 bp, Homo sapiens
tctcatcttaaaaatat

SEQ ID NO: 5795448 - DNA, 17 bp, Homo sapiens
tctcatcttgacagagc

SEQ ID NO: 5795449 - DNA, 22 bp, Homo sapiens
tctcatcttgacagagcctgcc

SEQ ID NO: 5795450 - DNA, 14 bp, Homo sapiens
tctcatcttgtgaa

SEQ ID NO: 5795451 - DNA, 21 bp, Homo sapiens
tctcatcttgttcttccccct

SEQ ID NO: 5795452 - DNA, 19 bp, Homo sapiens
tctcatgaaagcagtgaag

SEQ ID NO: 5795453 - DNA, 14 bp, Homo sapiens
tctcatgaacctca

SEQ ID NO: 5795454 - DNA, 22 bp, Homo sapiens
tctcatgaacctcaagctgcat

SEQ ID NO: 5795455 - DNA, 17 bp, Homo sapiens
tctcatgaagcccttag

SEQ ID NO: 5795456 - DNA, 16 bp, Homo sapiens
tctcatgaaggagagg

SEQ ID NO: 5795457 - DNA, 18 bp, Homo sapiens
tctcatgaatctgcaatg

SEQ ID NO: 5795458 - DNA, 21 bp, Homo sapiens
tctcatgactcctacttttca

SEQ ID NO: 5795459 - DNA, 22 bp, Homo sapiens
tctcatgaggggagaggagacg

SEQ ID NO: 5795460 - DNA, 23 bp, Homo sapiens
tctcatgcaagacttcactgcag

SEQ ID NO: 5795461 - DNA, 18 bp, Homo sapiens
tctcatgccagtgcctta

SEQ ID NO: 5795462 - DNA, 15 bp, Homo sapiens
tctcatgcccactcc

SEQ ID NO: 5795463 - DNA, 12 bp, Homo sapiens
tctcatgccccg

SEQ ID NO: 5795464 - DNA, 13 bp, Homo sapiens
tctcatgcctgag

SEQ ID NO: 5795465 - DNA, 14 bp, Homo sapiens
tctcatgcctgaga

SEQ ID NO: 5795466 - DNA, 24 bp, Homo sapiens
tctcatgcctgagaatgcctaggc

SEQ ID NO: 5795467 - DNA, 15 bp, Homo sapiens
tctcatgcctgcctg

SEQ ID NO: 5795468 - DNA, 21 bp, Homo sapiens
tctcatgcctgcctgataccc

SEQ ID NO: 5795469 - DNA, 17 bp, Homo sapiens
tctcatgctatttctac

SEQ ID NO: 5795470 - DNA, 13 bp, Homo sapiens
tctcatgctgccc

SEQ ID NO: 5795471 - DNA, 19 bp, Homo sapiens
tctcatgctgcccctgcct

SEQ ID NO: 5795472 - DNA, 17 bp, Homo sapiens
tctcatgcttcttctca

SEQ ID NO: 5795473 - DNA, 19 bp, Homo sapiens
tctcatggaaactggccag

SEQ ID NO: 5795474 - DNA, 23 bp, Homo sapiens
tctcatggaaactggccaggggt

SEQ ID NO: 5795475 - DNA, 19 bp, Homo sapiens
tctcatggaccagtggctg

SEQ ID NO: 5795476 - DNA, 22 bp, Homo sapiens
tctcatggagaagcagaaatac

SEQ ID NO: 5795477 - DNA, 21 bp, Homo sapiens
tctcatgggaaggggaggacc

SEQ ID NO: 5795478 - DNA, 23 bp, Homo sapiens
tctcatggtattatctagtaggt

SEQ ID NO: 5795479 - DNA, 19 bp, Homo sapiens
tctcatgtaaaataagaaa

SEQ ID NO: 5795480 - DNA, 18 bp, Homo sapiens
tctcatgtagaacaagaa

SEQ ID NO: 5795481 - DNA, 14 bp, Homo sapiens
tctcatgtcaatga

SEQ ID NO: 5795482 - DNA, 15 bp, Homo sapiens
tctcatgtccccttc

SEQ ID NO: 5795483 - DNA, 17 bp, Homo sapiens
tctcatgtcctgctggc

SEQ ID NO: 5795484 - DNA, 17 bp, Homo sapiens
tctcatgtgatcctttt

SEQ ID NO: 5795485 - DNA, 21 bp, Homo sapiens
tctcatgtgtgctcttcttct

SEQ ID NO: 5795486 - DNA, 17 bp, Homo sapiens
tctcatgtgtttgcata

SEQ ID NO: 5795487 - DNA, 22 bp, Homo sapiens
tctcatgttgaagccactgcct

SEQ ID NO: 5795488 - DNA, 14 bp, Homo sapiens
tctcatgtttgtgc

SEQ ID NO: 5795489 - DNA, 18 bp, Homo sapiens
tctcatgtttgtgcatgt

SEQ ID NO: 5795490 - DNA, 20 bp, Homo sapiens
tctcatgttttatatgatta

SEQ ID NO: 5795491 - DNA, 18 bp, Homo sapiens
tctcatgttttccattgt

SEQ ID NO: 5795492 - DNA, 20 bp, Homo sapiens
tctcattaaaagaatatctg

SEQ ID NO: 5795493 - DNA, 12 bp, Homo sapiens
tctcattaaaat

SEQ ID NO: 5795494 - DNA, 18 bp, Homo sapiens
tctcattaattcaattaa

SEQ ID NO: 5795495 - DNA, 21 bp, Homo sapiens
tctcattaattcaattaaaac

SEQ ID NO: 5795496 - DNA, 20 bp, Homo sapiens
tctcattacccacccgacct

SEQ ID NO: 5795497 - DNA, 19 bp, Homo sapiens
tctcattactgcttcattt

SEQ ID NO: 5795498 - DNA, 16 bp, Homo sapiens
tctcattacttttgaa

SEQ ID NO: 5795499 - DNA, 14 bp, Homo sapiens
tctcattatttcaa

SEQ ID NO: 5795500 - DNA, 16 bp, Homo sapiens
tctcattatttcaaaa

SEQ ID NO: 5795501 - DNA, 21 bp, Homo sapiens
tctcattcaggtgttctcttc

SEQ ID NO: 5795502 - DNA, 12 bp, Homo sapiens
tctcattcagta

SEQ ID NO: 5795503 - DNA, 17 bp, Homo sapiens
tctcattcagtattaaa

SEQ ID NO: 5795504 - DNA, 16 bp, Homo sapiens
tctcattccagaggaa

SEQ ID NO: 5795505 - DNA, 14 bp, Homo sapiens
tctcattccgttgt

SEQ ID NO: 5795506 - DNA, 18 bp, Homo sapiens
tctcattccgttgtctgt

SEQ ID NO: 5795507 - DNA, 18 bp, Homo sapiens
tctcattcctgttctttc

SEQ ID NO: 5795508 - DNA, 16 bp, Homo sapiens
tctcattcgcctttgt

SEQ ID NO: 5795509 - DNA, 18 bp, Homo sapiens
tctcattcgcctttgtct

SEQ ID NO: 5795510 - DNA, 21 bp, Homo sapiens
tctcattctctttctttttct

SEQ ID NO: 5795511 - DNA, 14 bp, Homo sapiens
tctcattctgttgc

SEQ ID NO: 5795512 - DNA, 19 bp, Homo sapiens
tctcattcttctaaaacta

SEQ ID NO: 5795513 - DNA, 19 bp, Homo sapiens
tctcattgaccttcagatt

SEQ ID NO: 5795514 - DNA, 16 bp, Homo sapiens
tctcattgaggacaaa

SEQ ID NO: 5795515 - DNA, 23 bp, Homo sapiens
tctcattgaggacaaagaaaact

SEQ ID NO: 5795516 - DNA, 22 bp, Homo sapiens
tctcattgccaaggcatcccca

SEQ ID NO: 5795517 - DNA, 23 bp, Homo sapiens
tctcattgccaaggcatccccag

SEQ ID NO: 5795518 - DNA, 15 bp, Homo sapiens
tctcattgcttctga

SEQ ID NO: 5795519 - DNA, 20 bp, Homo sapiens
tctcattggaaatttagcat

SEQ ID NO: 5795520 - DNA, 23 bp, Homo sapiens
tctcattggaaatttagcattgt

SEQ ID NO: 5795521 - DNA, 20 bp, Homo sapiens
tctcattggacccttccatg

SEQ ID NO: 5795522 - DNA, 20 bp, Homo sapiens
tctcattggggttgcaacaa

SEQ ID NO: 5795523 - DNA, 23 bp, Homo sapiens
tctcattgtagagcttggtggct

SEQ ID NO: 5795524 - DNA, 13 bp, Homo sapiens
tctcattgtgaat

SEQ ID NO: 5795525 - DNA, 17 bp, Homo sapiens
tctcatttcacccctcc

SEQ ID NO: 5795526 - DNA, 15 bp, Homo sapiens
tctcatttccagctt

SEQ ID NO: 5795527 - DNA, 21 bp, Homo sapiens
tctcatttccagcttctcagt

SEQ ID NO: 5795528 - DNA, 23 bp, Homo sapiens
tctcatttcgggtgaatctgtct

SEQ ID NO: 5795529 - DNA, 14 bp, Homo sapiens
tctcatttctcaac

SEQ ID NO: 5795530 - DNA, 19 bp, Homo sapiens
tctcatttctttcaagaca

SEQ ID NO: 5795531 - DNA, 16 bp, Homo sapiens
tctcatttctttctaa

SEQ ID NO: 5795532 - DNA, 17 bp, Homo sapiens
tctcatttgaaatgttt

SEQ ID NO: 5795533 - DNA, 19 bp, Homo sapiens
tctcatttgccaataataa

SEQ ID NO: 5795534 - DNA, 17 bp, Homo sapiens
tctcatttggtctgcca

SEQ ID NO: 5795535 - DNA, 23 bp, Homo sapiens
tctcatttggtttgattttccct

SEQ ID NO: 5795536 - DNA, 18 bp, Homo sapiens
tctcattttaatgtaaag

SEQ ID NO: 5795537 - DNA, 20 bp, Homo sapiens
tctcattttaatgtaaagat

SEQ ID NO: 5795538 - DNA, 18 bp, Homo sapiens
tctcattttggtctgttt

SEQ ID NO: 5795539 - DNA, 16 bp, Homo sapiens
tctcattttgtatgta

SEQ ID NO: 5795540 - DNA, 18 bp, Homo sapiens
tctcattttgtatgtatg

SEQ ID NO: 5795541 - DNA, 22 bp, Homo sapiens
tctcattttttcctgagaacct

SEQ ID NO: 5795542 - DNA, 21 bp, Homo sapiens
tctccaaaaaaaaaaaaaata

SEQ ID NO: 5795543 - DNA, 19 bp, Homo sapiens
tctccaaaaatctgcctgg

SEQ ID NO: 5795544 - DNA, 21 bp, Homo sapiens
tctccaaaaatctgcctgggt

SEQ ID NO: 5795545 - DNA, 13 bp, Homo sapiens
tctccaaaataaa

SEQ ID NO: 5795546 - DNA, 19 bp, Homo sapiens
tctccaaaataaaactttt

SEQ ID NO: 5795547 - DNA, 22 bp, Homo sapiens
tctccaaactgaagcagcctct

SEQ ID NO: 5795548 - DNA, 23 bp, Homo sapiens
tctccaaactgaagcagcctctc

SEQ ID NO: 5795549 - DNA, 15 bp, Homo sapiens
tctccaaaggggctg

SEQ ID NO: 5795550 - DNA, 19 bp, Homo sapiens
tctccaaaggggctgctgg

SEQ ID NO: 5795551 - DNA, 22 bp, Homo sapiens
tctccaaaggggctgctggggc

SEQ ID NO: 5795552 - DNA, 16 bp, Homo sapiens
tctccaaataaaaatt

SEQ ID NO: 5795553 - DNA, 12 bp, Homo sapiens
tctccaaatgag

SEQ ID NO: 5795554 - DNA, 17 bp, Homo sapiens
tctccaacaagttgcct

SEQ ID NO: 5795555 - DNA, 21 bp, Homo sapiens
tctccaacatcacagcccagc

SEQ ID NO: 5795556 - DNA, 17 bp, Homo sapiens
tctccaaccccccagca

SEQ ID NO: 5795557 - DNA, 18 bp, Homo sapiens
tctccaaccccccagcac

SEQ ID NO: 5795558 - DNA, 19 bp, Homo sapiens
tctccaaccccccagcact

SEQ ID NO: 5795559 - DNA, 20 bp, Homo sapiens
tctccaaccccggaaaacat

SEQ ID NO: 5795560 - DNA, 15 bp, Homo sapiens
tctccaacctggaca

SEQ ID NO: 5795561 - DNA, 13 bp, Homo sapiens
tctccaactttat

SEQ ID NO: 5795562 - DNA, 21 bp, Homo sapiens
tctccaagaaactgaatgaat

SEQ ID NO: 5795563 - DNA, 14 bp, Homo sapiens
tctccaagaatgct

SEQ ID NO: 5795564 - DNA, 18 bp, Homo sapiens
tctccaagaatgctgaaa

SEQ ID NO: 5795565 - DNA, 19 bp, Homo sapiens
tctccaagaatggaagcct

SEQ ID NO: 5795566 - DNA, 21 bp, Homo sapiens
tctccaagaatggaagcctga

SEQ ID NO: 5795567 - DNA, 17 bp, Homo sapiens
tctccaagacaataatt

SEQ ID NO: 5795568 - DNA, 14 bp, Homo sapiens
tctccaagacagca

SEQ ID NO: 5795569 - DNA, 16 bp, Homo sapiens
tctccaagacagcagc

SEQ ID NO: 5795570 - DNA, 17 bp, Homo sapiens
tctccaagacagcagca

SEQ ID NO: 5795571 - DNA, 16 bp, Homo sapiens
tctccaagaccttggc

SEQ ID NO: 5795572 - DNA, 22 bp, Homo sapiens
tctccaagcactagccttccca

SEQ ID NO: 5795573 - DNA, 16 bp, Homo sapiens
tctccaaggaccaggt

SEQ ID NO: 5795574 - DNA, 22 bp, Homo sapiens
tctccaagggagggtgcagccc

SEQ ID NO: 5795575 - DNA, 16 bp, Homo sapiens
tctccaagggcttctg

SEQ ID NO: 5795576 - DNA, 20 bp, Homo sapiens
tctccaagggcttctgcacc

SEQ ID NO: 5795577 - DNA, 16 bp, Homo sapiens
tctccaagtctctctg

SEQ ID NO: 5795578 - DNA, 21 bp, Homo sapiens
tctccaagtctctctgtgaat

SEQ ID NO: 5795579 - DNA, 23 bp, Homo sapiens
tctccaagtctctctgtgaatac

SEQ ID NO: 5795580 - DNA, 14 bp, Homo sapiens
tctccaagtgccag

SEQ ID NO: 5795581 - DNA, 16 bp, Homo sapiens
tctccaatatcagtgc

SEQ ID NO: 5795582 - DNA, 20 bp, Homo sapiens
tctccaatcccatctattct

SEQ ID NO: 5795583 - DNA, 15 bp, Homo sapiens
tctccaattctgaaa

SEQ ID NO: 5795584 - DNA, 16 bp, Homo sapiens
tctccacaacctcctc

SEQ ID NO: 5795585 - DNA, 17 bp, Homo sapiens
tctccacacccagcctg

SEQ ID NO: 5795586 - DNA, 20 bp, Homo sapiens
tctccacacggagctcctgg

SEQ ID NO: 5795587 - DNA, 23 bp, Homo sapiens
tctccacacggagctcctggcag

SEQ ID NO: 5795588 - DNA, 21 bp, Homo sapiens
tctccacagatgtaattatgt

SEQ ID NO: 5795589 - DNA, 17 bp, Homo sapiens
tctccacaggagagact

SEQ ID NO: 5795590 - DNA, 21 bp, Homo sapiens
tctccacagtgttgtgcccct

SEQ ID NO: 5795591 - DNA, 23 bp, Homo sapiens
tctccaccatcgtcttcttggcc

SEQ ID NO: 5795592 - DNA, 22 bp, Homo sapiens
tctccacccaaaccccttccca

SEQ ID NO: 5795593 - DNA, 18 bp, Homo sapiens
tctcctcctcctccctcc

SEQ ID NO: 5795594 - DNA, 13 bp, Homo sapiens
tctcctcctctgt

SEQ ID NO: 5795595 - DNA, 18 bp, Homo sapiens
tctcctccttgggcaggg

SEQ ID NO: 5795596 - DNA, 21 bp, Homo sapiens
tctcctccttgggcagggtct

SEQ ID NO: 5795597 - DNA, 21 bp, Homo sapiens
tctcctccttttcacagttct

SEQ ID NO: 5795598 - DNA, 16 bp, Homo sapiens
tctcctcgcaagctgg

SEQ ID NO: 5795599 - DNA, 21 bp, Homo sapiens
tctcctcggccccctccatcg

SEQ ID NO: 5795600 - DNA, 14 bp, Homo sapiens
tctcctcgggccct

SEQ ID NO: 5795601 - DNA, 16 bp, Homo sapiens
tctcctcgggccctgt

SEQ ID NO: 5795602 - DNA, 21 bp, Homo sapiens
tctcctcgggccctgtggtgc

SEQ ID NO: 5795603 - DNA, 23 bp, Homo sapiens
tctcctcggtggcatttgctgaa

SEQ ID NO: 5795604 - DNA, 24 bp, Homo sapiens
tctcctcggtggcatttgctgaat

SEQ ID NO: 5795605 - DNA, 20 bp, Homo sapiens
tctcctcgtccggcctgcag

SEQ ID NO: 5795606 - DNA, 21 bp, Homo sapiens
tctcctcgtccggcctgcagc

SEQ ID NO: 5795607 - DNA, 20 bp, Homo sapiens
tctcctcgttggttcatgtg

SEQ ID NO: 5795608 - DNA, 21 bp, Homo sapiens
tctcctcgttggttcatgtgt

SEQ ID NO: 5795609 - DNA, 17 bp, Homo sapiens
tctcctctatggaagga

SEQ ID NO: 5795610 - DNA, 16 bp, Homo sapiens
tctcctctcagcccct

SEQ ID NO: 5795611 - DNA, 14 bp, Homo sapiens
tctcctctcagctt

SEQ ID NO: 5795612 - DNA, 18 bp, Homo sapiens
tctcctctcagcttctaa

SEQ ID NO: 5795613 - DNA, 14 bp, Homo sapiens
tctcctctccagcc

SEQ ID NO: 5795614 - DNA, 17 bp, Homo sapiens
tctcctctccagcccta

SEQ ID NO: 5795615 - DNA, 12 bp, Homo sapiens
tctcctctccat

SEQ ID NO: 5795616 - DNA, 14 bp, Homo sapiens
tctcctctccatct

SEQ ID NO: 5795617 - DNA, 16 bp, Homo sapiens
tctcctctcccctcta

SEQ ID NO: 5795618 - DNA, 15 bp, Homo sapiens
tctcctctctaaaag

SEQ ID NO: 5795619 - DNA, 11 bp, Homo sapiens
tctcctctctc

SEQ ID NO: 5795620 - DNA, 19 bp, Homo sapiens
tctcctctctctccctcca

SEQ ID NO: 5795621 - DNA, 18 bp, Homo sapiens
tctcctctctgcttcata

SEQ ID NO: 5795622 - DNA, 12 bp, Homo sapiens
tctcctctgccc

SEQ ID NO: 5795623 - DNA, 17 bp, Homo sapiens
tctcctctgccctctgc

SEQ ID NO: 5795624 - DNA, 11 bp, Homo sapiens
tctcctctgct

SEQ ID NO: 5795625 - DNA, 15 bp, Homo sapiens
tctcctctgctgctg

SEQ ID NO: 5795626 - DNA, 17 bp, Homo sapiens
tctcctctgctgctggc

SEQ ID NO: 5795627 - DNA, 13 bp, Homo sapiens
tctcctctgtcag

SEQ ID NO: 5795628 - DNA, 22 bp, Homo sapiens
tctcctcttaaaaaataaaaac

SEQ ID NO: 5795629 - DNA, 17 bp, Homo sapiens
tctcctcttgccactgc

SEQ ID NO: 5795630 - DNA, 21 bp, Homo sapiens
tctcctcttgtaaataaagcc

SEQ ID NO: 5795631 - DNA, 23 bp, Homo sapiens
tctcctcttgtaaataaagccct

SEQ ID NO: 5795632 - DNA, 19 bp, Homo sapiens
tctcctctttaaaacaaaa

SEQ ID NO: 5795633 - DNA, 12 bp, Homo sapiens
tctcctctttga

SEQ ID NO: 5795634 - DNA, 13 bp, Homo sapiens
tctcctctttgag

SEQ ID NO: 5795635 - DNA, 14 bp, Homo sapiens
tctcctctttgaga

SEQ ID NO: 5795636 - DNA, 17 bp, Homo sapiens
tctcctctttgttttgt

SEQ ID NO: 5795637 - DNA, 23 bp, Homo sapiens
tctcctctttttctgtgtgaggt

SEQ ID NO: 5795638 - DNA, 22 bp, Homo sapiens
tctcctgaaaaaagcagttctt

SEQ ID NO: 5795639 - DNA, 17 bp, Homo sapiens
tctcctgaagttcagcc

SEQ ID NO: 5795640 - DNA, 15 bp, Homo sapiens
tctcctgaatatttt

SEQ ID NO: 5795641 - DNA, 15 bp, Homo sapiens
tctcctgacagaagg

SEQ ID NO: 5795642 - DNA, 19 bp, Homo sapiens
tctcctgaccagggcaagg

SEQ ID NO: 5795643 - DNA, 17 bp, Homo sapiens
tctcctgacccagtccc

SEQ ID NO: 5795644 - DNA, 16 bp, Homo sapiens
tctcctgacccctgcc

SEQ ID NO: 5795645 - DNA, 23 bp, Homo sapiens
tctcctgaccctcccactcccat

SEQ ID NO: 5795646 - DNA, 15 bp, Homo sapiens
tctcctgacctcgtg

SEQ ID NO: 5795647 - DNA, 16 bp, Homo sapiens
tctcctgacctcgtga

SEQ ID NO: 5795648 - DNA, 19 bp, Homo sapiens
tctcctgaccttgtgatcc

SEQ ID NO: 5795649 - DNA, 15 bp, Homo sapiens
tctcctgactccagt

SEQ ID NO: 5795650 - DNA, 14 bp, Homo sapiens
tctcctgactttta

SEQ ID NO: 5795651 - DNA, 20 bp, Homo sapiens
tctcctgagaggtgctgcag

SEQ ID NO: 5795652 - DNA, 16 bp, Homo sapiens
tctcctgagcctgtct

SEQ ID NO: 5795653 - DNA, 20 bp, Homo sapiens
tctcctgagcctgtctctcc

SEQ ID NO: 5795654 - DNA, 13 bp, Homo sapiens
tctcctgcaaatt

SEQ ID NO: 5795655 - DNA, 14 bp, Homo sapiens
tctcctgcagcctg

SEQ ID NO: 5795656 - DNA, 22 bp, Homo sapiens
tctcctgcagcctgagatggat

SEQ ID NO: 5795657 - DNA, 19 bp, Homo sapiens
tctcctgcatccctccacc

SEQ ID NO: 5795658 - DNA, 14 bp, Homo sapiens
tctcctgcatggca

SEQ ID NO: 5795659 - DNA, 19 bp, Homo sapiens
tctcctgccacattagaac

SEQ ID NO: 5795660 - DNA, 15 bp, Homo sapiens
tctcctgccagccca

SEQ ID NO: 5795661 - DNA, 16 bp, Homo sapiens
tctcctgccatgggtg

SEQ ID NO: 5795662 - DNA, 20 bp, Homo sapiens
tctcctgccctctgctctgc

SEQ ID NO: 5795663 - DNA, 21 bp, Homo sapiens
tctcctgccctctgctctgcc

SEQ ID NO: 5795664 - DNA, 12 bp, Homo sapiens
tctcctgccctg

SEQ ID NO: 5795665 - DNA, 13 bp, Homo sapiens
tctcctgccctgt

SEQ ID NO: 5795666 - DNA, 14 bp, Homo sapiens
tctcctgccctgtg

SEQ ID NO: 5795667 - DNA, 18 bp, Homo sapiens
tctcctgccctttcccag

SEQ ID NO: 5795668 - DNA, 11 bp, Homo sapiens
tctcctgccta

SEQ ID NO: 5795669 - DNA, 12 bp, Homo sapiens
tctcctgcctac

SEQ ID NO: 5795670 - DNA, 14 bp, Homo sapiens
tctcctgcctacat

SEQ ID NO: 5795671 - DNA, 14 bp, Homo sapiens
tctcctgcctactc

SEQ ID NO: 5795672 - DNA, 15 bp, Homo sapiens
tctcctgcctactca

SEQ ID NO: 5795673 - DNA, 15 bp, Homo sapiens
tctcctgcctcagcc

SEQ ID NO: 5795674 - DNA, 16 bp, Homo sapiens
tctcctgcctcagcct

SEQ ID NO: 5795675 - DNA, 17 bp, Homo sapiens
tctcctgcctcagcctc

SEQ ID NO: 5795676 - DNA, 18 bp, Homo sapiens
tctcctgcctcagcctcc

SEQ ID NO: 5795677 - DNA, 23 bp, Homo sapiens
tctcctgcctcagcctccccagt

SEQ ID NO: 5795678 - DNA, 18 bp, Homo sapiens
tctcctgcctcagccttc

SEQ ID NO: 5795679 - DNA, 15 bp, Homo sapiens
tctcctgcctcagct

SEQ ID NO: 5795680 - DNA, 22 bp, Homo sapiens
tctcctgcctgtagcagtgaga

SEQ ID NO: 5795681 - DNA, 20 bp, Homo sapiens
tctcctgccttcctcctggg

SEQ ID NO: 5795682 - DNA, 13 bp, Homo sapiens
tctcctgcctttg

SEQ ID NO: 5795683 - DNA, 15 bp, Homo sapiens
tctcctgcctttgcc

SEQ ID NO: 5795684 - DNA, 16 bp, Homo sapiens
tctcctgcctttgcct

SEQ ID NO: 5795685 - DNA, 17 bp, Homo sapiens
tctcctgcctttgcctc

SEQ ID NO: 5795686 - DNA, 17 bp, Homo sapiens
tctcctgcgccccgccc

SEQ ID NO: 5795687 - DNA, 22 bp, Homo sapiens
tctcctgcgccccgcccacacc

SEQ ID NO: 5795688 - DNA, 21 bp, Homo sapiens
tctcctgcgtgttctcagagg

SEQ ID NO: 5795689 - DNA, 22 bp, Homo sapiens
tctcctgctcaccacctgcctc

SEQ ID NO: 5795690 - DNA, 17 bp, Homo sapiens
tctcctgctgatttcac

SEQ ID NO: 5795691 - DNA, 11 bp, Homo sapiens
tctcctgctgc

SEQ ID NO: 5795692 - DNA, 17 bp, Homo sapiens
tctcctgctgctccctc

SEQ ID NO: 5795693 - DNA, 21 bp, Homo sapiens
tctcctgctgctccctcagac

SEQ ID NO: 5795694 - DNA, 15 bp, Homo sapiens
tctcctgctgctcct

SEQ ID NO: 5795695 - DNA, 16 bp, Homo sapiens
tctcctgcttgtacta

SEQ ID NO: 5795696 - DNA, 10 bp, Homo sapiens
tctcctggaa

SEQ ID NO: 5795697 - DNA, 22 bp, Homo sapiens
tctcctggaccttgacagagca

SEQ ID NO: 5795698 - DNA, 15 bp, Homo sapiens
tctcctggactggtt

SEQ ID NO: 5795699 - DNA, 21 bp, Homo sapiens
tctcctggactggttatcttg

SEQ ID NO: 5795700 - DNA, 18 bp, Homo sapiens
tctcctggagatagctgg

SEQ ID NO: 5795701 - DNA, 21 bp, Homo sapiens
tctcctggagatagctggggc

SEQ ID NO: 5795702 - DNA, 22 bp, Homo sapiens
tctcctggagatagctggggct

SEQ ID NO: 5795703 - DNA, 22 bp, Homo sapiens
tctcctggagcaagctctgccc

SEQ ID NO: 5795704 - DNA, 23 bp, Homo sapiens
tctcctggagcaagctctgccct

SEQ ID NO: 5795705 - DNA, 12 bp, Homo sapiens
tctcctggagga

SEQ ID NO: 5795706 - DNA, 17 bp, Homo sapiens
tctcctggaggattgca

SEQ ID NO: 5795707 - DNA, 23 bp, Homo sapiens
tctcctggagggcgcccagcagc

SEQ ID NO: 5795708 - DNA, 22 bp, Homo sapiens
tctcctggagtctgaagcctgc

SEQ ID NO: 5795709 - DNA, 12 bp, Homo sapiens
tctcctggcccc

SEQ ID NO: 5795710 - DNA, 23 bp, Homo sapiens
tctcctggcctatccgctgccag

SEQ ID NO: 5795711 - DNA, 21 bp, Homo sapiens
tctcctggcctggccatctcc

SEQ ID NO: 5795712 - DNA, 12 bp, Homo sapiens
tctcctggcctt

SEQ ID NO: 5795713 - DNA, 18 bp, Homo sapiens
tctcctggccttctagga

SEQ ID NO: 5795714 - DNA, 12 bp, Homo sapiens
tctcctggctgg

SEQ ID NO: 5795715 - DNA, 14 bp, Homo sapiens
tctcctggctgggc

SEQ ID NO: 5795716 - DNA, 15 bp, Homo sapiens
tctcctggcttccca

SEQ ID NO: 5795717 - DNA, 20 bp, Homo sapiens
tctcctgggaaacctgcctt

SEQ ID NO: 5795718 - DNA, 17 bp, Homo sapiens
tctcctgggcagctgcc

SEQ ID NO: 5795719 - DNA, 20 bp, Homo sapiens
tctcctgggccagggtctcg

SEQ ID NO: 5795720 - DNA, 13 bp, Homo sapiens
tctcctgggcccc

SEQ ID NO: 5795721 - DNA, 22 bp, Homo sapiens
tctcctgggcccctccctacct

SEQ ID NO: 5795722 - DNA, 23 bp, Homo sapiens
tctcctgggcccctccctacctc

SEQ ID NO: 5795723 - DNA, 18 bp, Homo sapiens
tctcctgggggtggcagg

SEQ ID NO: 5795724 - DNA, 14 bp, Homo sapiens
tctcctggtagcat

SEQ ID NO: 5795725 - DNA, 16 bp, Homo sapiens
tctcctggtctgtgct

SEQ ID NO: 5795726 - DNA, 20 bp, Homo sapiens
tctcctggtgactcaaataa

SEQ ID NO: 5795727 - DNA, 23 bp, Homo sapiens
tctcctgtaagccaaagaaatga

SEQ ID NO: 5795728 - DNA, 16 bp, Homo sapiens
tctcctgtagcacaaa

SEQ ID NO: 5795729 - DNA, 19 bp, Homo sapiens
tctcctgtagccactggca

SEQ ID NO: 5795730 - DNA, 15 bp, Homo sapiens
tctcctgtatcattt

SEQ ID NO: 5795731 - DNA, 17 bp, Homo sapiens
tctcctgtctcagcctc

SEQ ID NO: 5795732 - DNA, 21 bp, Homo sapiens
tctcctgtctcagcctcctga

SEQ ID NO: 5795733 - DNA, 12 bp, Homo sapiens
tctcctgtctgc

SEQ ID NO: 5795734 - DNA, 20 bp, Homo sapiens
tctcctgtctgccctctggg

SEQ ID NO: 5795735 - DNA, 22 bp, Homo sapiens
tctcctgtcttatggtccagaa

SEQ ID NO: 5795736 - DNA, 12 bp, Homo sapiens
tctcctgtgaat

SEQ ID NO: 5795737 - DNA, 16 bp, Homo sapiens
tctcctgtgagctccc

SEQ ID NO: 5795738 - DNA, 18 bp, Homo sapiens
tctcctgtgagctcccca

SEQ ID NO: 5795739 - DNA, 17 bp, Homo sapiens
tctcctgtgatgtccca

SEQ ID NO: 5795740 - DNA, 16 bp, Homo sapiens
tctcctgtgcccacat

SEQ ID NO: 5795741 - DNA, 18 bp, Homo sapiens
tctcctgtgcccctcaga

SEQ ID NO: 5795742 - DNA, 14 bp, Homo sapiens
tctcctgtgtctta

SEQ ID NO: 5795743 - DNA, 19 bp, Homo sapiens
tctcctgtttattcccatc

SEQ ID NO: 5795744 - DNA, 20 bp, Homo sapiens
tctcctgtttattcccatct

SEQ ID NO: 5795745 - DNA, 17 bp, Homo sapiens
tctcctgttttatatat

SEQ ID NO: 5795746 - DNA, 14 bp, Homo sapiens
tctcctgtttttct

SEQ ID NO: 5795747 - DNA, 21 bp, Homo sapiens
tctccttaaactaccaccctc

SEQ ID NO: 5795748 - DNA, 20 bp, Homo sapiens
tctccttaaagagtgtggca

SEQ ID NO: 5795749 - DNA, 11 bp, Homo sapiens
tctccttaacc

SEQ ID NO: 5795750 - DNA, 16 bp, Homo sapiens
tctccttaacccccat

SEQ ID NO: 5795751 - DNA, 19 bp, Homo sapiens
tctccttaagagacaattt

SEQ ID NO: 5795752 - DNA, 20 bp, Homo sapiens
tctccttaagctgcagagat

SEQ ID NO: 5795753 - DNA, 14 bp, Homo sapiens
tctccttacctgtg

SEQ ID NO: 5795754 - DNA, 22 bp, Homo sapiens
tctccttactctgagcccaggc

SEQ ID NO: 5795755 - DNA, 23 bp, Homo sapiens
tctccttactctgagcccaggcc

SEQ ID NO: 5795756 - DNA, 14 bp, Homo sapiens
tctccttactgtgt

SEQ ID NO: 5795757 - DNA, 21 bp, Homo sapiens
tctccttagaagtggaagtag

SEQ ID NO: 5795758 - DNA, 15 bp, Homo sapiens
tctccttagttggct

SEQ ID NO: 5795759 - DNA, 14 bp, Homo sapiens
tctccttatcttta

SEQ ID NO: 5795760 - DNA, 14 bp, Homo sapiens
tctccttcaaaaca

SEQ ID NO: 5795761 - DNA, 15 bp, Homo sapiens
tctccttcacctttg

SEQ ID NO: 5795762 - DNA, 20 bp, Homo sapiens
tctccttcagccctcacccc

SEQ ID NO: 5795763 - DNA, 21 bp, Homo sapiens
tctccttcatgacagcctcca

SEQ ID NO: 5795764 - DNA, 22 bp, Homo sapiens
tctccttccaactgctgcccca

SEQ ID NO: 5795765 - DNA, 22 bp, Homo sapiens
tctccttccacaatgactgctt

SEQ ID NO: 5795766 - DNA, 14 bp, Homo sapiens
tctccttccattca

SEQ ID NO: 5795767 - DNA, 14 bp, Homo sapiens
tctccttcccaagg

SEQ ID NO: 5795768 - DNA, 19 bp, Homo sapiens
tctccttcccacccctaca

SEQ ID NO: 5795769 - DNA, 13 bp, Homo sapiens
tctccttcccact

SEQ ID NO: 5795770 - DNA, 17 bp, Homo sapiens
tctccttccccaggatg

SEQ ID NO: 5795771 - DNA, 14 bp, Homo sapiens
tctctccctgcctc

SEQ ID NO: 5795772 - DNA, 14 bp, Homo sapiens
tctctccctgcctt

SEQ ID NO: 5795773 - DNA, 13 bp, Homo sapiens
tctctccctgggg

SEQ ID NO: 5795774 - DNA, 20 bp, Homo sapiens
tctctccctgtcacacactg

SEQ ID NO: 5795775 - DNA, 23 bp, Homo sapiens
tctctccctgtcacacactggac

SEQ ID NO: 5795776 - DNA, 22 bp, Homo sapiens
tctctcccttactattcccact

SEQ ID NO: 5795777 - DNA, 13 bp, Homo sapiens
tctctcccttctt

SEQ ID NO: 5795778 - DNA, 15 bp, Homo sapiens
tctctcccttcttta

SEQ ID NO: 5795779 - DNA, 20 bp, Homo sapiens
tctctccgcgggtgggactc

SEQ ID NO: 5795780 - DNA, 19 bp, Homo sapiens
tctctcctaatgatgactt

SEQ ID NO: 5795781 - DNA, 16 bp, Homo sapiens
tctctcctagcccctc

SEQ ID NO: 5795782 - DNA, 22 bp, Homo sapiens
tctctcctagcccctctctcac

SEQ ID NO: 5795783 - DNA, 14 bp, Homo sapiens
tctctcctcagact

SEQ ID NO: 5795784 - DNA, 11 bp, Homo sapiens
tctctcctcca

SEQ ID NO: 5795785 - DNA, 13 bp, Homo sapiens
tctctcctctctc

SEQ ID NO: 5795786 - DNA, 21 bp, Homo sapiens
tctctcctctctgcttcataa

SEQ ID NO: 5795787 - DNA, 17 bp, Homo sapiens
tctctcctgaactgctt

SEQ ID NO: 5795788 - DNA, 14 bp, Homo sapiens
tctctcctgcggga

SEQ ID NO: 5795789 - DNA, 12 bp, Homo sapiens
tctctcctgctc

SEQ ID NO: 5795790 - DNA, 19 bp, Homo sapiens
tctctcctgctctcataat

SEQ ID NO: 5795791 - DNA, 15 bp, Homo sapiens
tctctcctggactgg

SEQ ID NO: 5795792 - DNA, 19 bp, Homo sapiens
tctctcctggactggttat

SEQ ID NO: 5795793 - DNA, 11 bp, Homo sapiens
tctctcctggc

SEQ ID NO: 5795794 - DNA, 12 bp, Homo sapiens
tctctcctggcc

SEQ ID NO: 5795795 - DNA, 16 bp, Homo sapiens
tctctcctggcctatc

SEQ ID NO: 5795796 - DNA, 13 bp, Homo sapiens
tctctcctggctg

SEQ ID NO: 5795797 - DNA, 14 bp, Homo sapiens
tctctcctggctgg

SEQ ID NO: 5795798 - DNA, 20 bp, Homo sapiens
tctctcctgtacctcttgag

SEQ ID NO: 5795799 - DNA, 17 bp, Homo sapiens
tctctcctgtgagctcc

SEQ ID NO: 5795800 - DNA, 13 bp, Homo sapiens
tctctccttccct

SEQ ID NO: 5795801 - DNA, 15 bp, Homo sapiens
tctctccttgccccc

SEQ ID NO: 5795802 - DNA, 17 bp, Homo sapiens
tctctccttggccacag

SEQ ID NO: 5795803 - DNA, 22 bp, Homo sapiens
tctctccttggcctttcctgga

SEQ ID NO: 5795804 - DNA, 14 bp, Homo sapiens
tctctcctttcttt

SEQ ID NO: 5795805 - DNA, 22 bp, Homo sapiens
tctctcctttctttttcttctt

SEQ ID NO: 5795806 - DNA, 17 bp, Homo sapiens
tctctccttttcttttg

SEQ ID NO: 5795807 - DNA, 17 bp, Homo sapiens
tctctcgctgcgtcctc

SEQ ID NO: 5795808 - DNA, 13 bp, Homo sapiens
tctctcggccccc

SEQ ID NO: 5795809 - DNA, 15 bp, Homo sapiens
tctctcggccccctc

SEQ ID NO: 5795810 - DNA, 20 bp, Homo sapiens
tctctcggcccctgtctgtt

SEQ ID NO: 5795811 - DNA, 21 bp, Homo sapiens
tctctcggcccctgtctgttc

SEQ ID NO: 5795812 - DNA, 23 bp, Homo sapiens
tctctcggctccccatgtgtcct

SEQ ID NO: 5795813 - DNA, 16 bp, Homo sapiens
tctctcgggagcccta

SEQ ID NO: 5795814 - DNA, 18 bp, Homo sapiens
tctctcggggcgacccct

SEQ ID NO: 5795815 - DNA, 22 bp, Homo sapiens
tctctcggggcgacccctcagt

SEQ ID NO: 5795816 - DNA, 23 bp, Homo sapiens
tctctcggggcgacccctcagtg

SEQ ID NO: 5795817 - DNA, 18 bp, Homo sapiens
tctctcggttccacgtcc

SEQ ID NO: 5795818 - DNA, 18 bp, Homo sapiens
tctctcgttaattttcct

SEQ ID NO: 5795819 - DNA, 19 bp, Homo sapiens
tctctctaaaaataaaatg

SEQ ID NO: 5795820 - DNA, 20 bp, Homo sapiens
tctctctaaaaataaaatga

SEQ ID NO: 5795821 - DNA, 12 bp, Homo sapiens
tctctctaagac

SEQ ID NO: 5795822 - DNA, 17 bp, Homo sapiens
tctctctaccagtctat

SEQ ID NO: 5795823 - DNA, 13 bp, Homo sapiens
tctctctacctcc

SEQ ID NO: 5795824 - DNA, 14 bp, Homo sapiens
tctctctacctcca

SEQ ID NO: 5795825 - DNA, 19 bp, Homo sapiens
tctctctactcctacctca

SEQ ID NO: 5795826 - DNA, 20 bp, Homo sapiens
tctctctactcctacctcag

SEQ ID NO: 5795827 - DNA, 22 bp, Homo sapiens
tctctctactcctacctcagcc

SEQ ID NO: 5795828 - DNA, 19 bp, Homo sapiens
tctctctatatatacatgt

SEQ ID NO: 5795829 - DNA, 14 bp, Homo sapiens
tctctctattacca

SEQ ID NO: 5795830 - DNA, 17 bp, Homo sapiens
tctctctcaatttttgg

SEQ ID NO: 5795831 - DNA, 15 bp, Homo sapiens
tctctctcacacaca

SEQ ID NO: 5795832 - DNA, 11 bp, Homo sapiens
tctctctcact

SEQ ID NO: 5795833 - DNA, 20 bp, Homo sapiens
tctctctcactcacattttc

SEQ ID NO: 5795834 - DNA, 14 bp, Homo sapiens
tctctctcatgcct

SEQ ID NO: 5795835 - DNA, 23 bp, Homo sapiens
tctctctccaccccccacgtctg

SEQ ID NO: 5795836 - DNA, 12 bp, Homo sapiens
tctctctccagg

SEQ ID NO: 5795837 - DNA, 14 bp, Homo sapiens
tctctctccagggt

SEQ ID NO: 5795838 - DNA, 15 bp, Homo sapiens
tctctctccagggtg

SEQ ID NO: 5795839 - DNA, 13 bp, Homo sapiens
tctctctccctac

SEQ ID NO: 5795840 - DNA, 12 bp, Homo sapiens
tctctctccctc

SEQ ID NO: 5795841 - DNA, 14 bp, Homo sapiens
tctctctccctctg

SEQ ID NO: 5795842 - DNA, 19 bp, Homo sapiens
tctctctccctctttctag

SEQ ID NO: 5795843 - DNA, 13 bp, Homo sapiens
tctctctccctgc

SEQ ID NO: 5795844 - DNA, 15 bp, Homo sapiens
tctctctccctgtca

SEQ ID NO: 5795845 - DNA, 21 bp, Homo sapiens
tctctctccctgtcacacact

SEQ ID NO: 5795846 - DNA, 13 bp, Homo sapiens
tctctctccctta

SEQ ID NO: 5795847 - DNA, 15 bp, Homo sapiens
tctctctcccttact

SEQ ID NO: 5795848 - DNA, 22 bp, Homo sapiens
tctctctcccttttaaatggtg

SEQ ID NO: 5795849 - DNA, 16 bp, Homo sapiens
tctctctcctctttga

SEQ ID NO: 5795850 - DNA, 11 bp, Homo sapiens
tctctctcctg

SEQ ID NO: 5795851 - DNA, 13 bp, Homo sapiens
tctctctcctgga

SEQ ID NO: 5795852 - DNA, 22 bp, Homo sapiens
tctctctcctgtactttttcca

SEQ ID NO: 5795853 - DNA, 13 bp, Homo sapiens
tctctctctccct

SEQ ID NO: 5795854 - DNA, 11 bp, Homo sapiens
tctctctctct

SEQ ID NO: 5795855 - DNA, 15 bp, Homo sapiens
tctctctctctcgct

SEQ ID NO: 5795856 - DNA, 15 bp, Homo sapiens
tctctctctctctgt

SEQ ID NO: 5795857 - DNA, 12 bp, Homo sapiens
tctctctctctg

SEQ ID NO: 5795858 - DNA, 12 bp, Homo sapiens
tctctctctgct

SEQ ID NO: 5795859 - DNA, 11 bp, Homo sapiens
tctctctctgg

SEQ ID NO: 5795860 - DNA, 13 bp, Homo sapiens
tctctctctggtc

SEQ ID NO: 5795861 - DNA, 14 bp, Homo sapiens
tctctctctggtca

SEQ ID NO: 5795862 - DNA, 14 bp, Homo sapiens
tctctctctgtcct

SEQ ID NO: 5795863 - DNA, 12 bp, Homo sapiens
tctctctctgtt

SEQ ID NO: 5795864 - DNA, 14 bp, Homo sapiens
tctctctctgttcc

SEQ ID NO: 5795865 - DNA, 15 bp, Homo sapiens
tctctctctgttcca

SEQ ID NO: 5795866 - DNA, 21 bp, Homo sapiens
tctctctgactctcaaatctt

SEQ ID NO: 5795867 - DNA, 11 bp, Homo sapiens
tctctctgagc

SEQ ID NO: 5795868 - DNA, 12 bp, Homo sapiens
tctctctgccca

SEQ ID NO: 5795869 - DNA, 23 bp, Homo sapiens
tctctctgcccaagttgctctgt

SEQ ID NO: 5795870 - DNA, 15 bp, Homo sapiens
tctctctgcccactc

SEQ ID NO: 5795871 - DNA, 15 bp, Homo sapiens
tctctctgccctctc

SEQ ID NO: 5795872 - DNA, 11 bp, Homo sapiens
tctctctgcct

SEQ ID NO: 5795873 - DNA, 14 bp, Homo sapiens
tctctctgcctgct

SEQ ID NO: 5795874 - DNA, 16 bp, Homo sapiens
tctctctgcctgctgg

SEQ ID NO: 5795875 - DNA, 17 bp, Homo sapiens
tctctctgcctgctggg

SEQ ID NO: 5795876 - DNA, 15 bp, Homo sapiens
tctctctgcctgtga

SEQ ID NO: 5795877 - DNA, 17 bp, Homo sapiens
tctctctgcctgtgagc

SEQ ID NO: 5795878 - DNA, 13 bp, Homo sapiens
tctctctgctcag

SEQ ID NO: 5795879 - DNA, 13 bp, Homo sapiens
tctctctggccct

SEQ ID NO: 5795880 - DNA, 15 bp, Homo sapiens
tctctctggcttctc

SEQ ID NO: 5795881 - DNA, 17 bp, Homo sapiens
tctctctggcttctctc

SEQ ID NO: 5795882 - DNA, 11 bp, Homo sapiens
tctctctgggc

SEQ ID NO: 5795883 - DNA, 20 bp, Homo sapiens
tctctctggggccacacaga

SEQ ID NO: 5795884 - DNA, 21 bp, Homo sapiens
tctctctgtgctgtggaagca

SEQ ID NO: 5795885 - DNA, 20 bp, Homo sapiens
tctctctgtggtggttcatt

SEQ ID NO: 5795886 - DNA, 23 bp, Homo sapiens
tctctctgtggtggttcattcca

SEQ ID NO: 5795887 - DNA, 19 bp, Homo sapiens
tctctctgtgtctttctct

SEQ ID NO: 5795888 - DNA, 17 bp, Homo sapiens
tctctctgtgtggcaaa

SEQ ID NO: 5795889 - DNA, 18 bp, Homo sapiens
tctctctgtgtggcaaac

SEQ ID NO: 5795890 - DNA, 13 bp, Homo sapiens
tctctctgttaca

SEQ ID NO: 5795891 - DNA, 16 bp, Homo sapiens
tctctctgttccaagt

SEQ ID NO: 5795892 - DNA, 18 bp, Homo sapiens
tctctctgttcccttcct

SEQ ID NO: 5795893 - DNA, 14 bp, Homo sapiens
tctctcttaaagtt

SEQ ID NO: 5795894 - DNA, 16 bp, Homo sapiens
tctctcttcagactct

SEQ ID NO: 5795895 - DNA, 20 bp, Homo sapiens
tctctcttcagactctcagc

SEQ ID NO: 5795896 - DNA, 18 bp, Homo sapiens
tctctcttcccttctccc

SEQ ID NO: 5795897 - DNA, 11 bp, Homo sapiens
tctctcttctg

SEQ ID NO: 5795898 - DNA, 14 bp, Homo sapiens
tctctcttctgcct

SEQ ID NO: 5795899 - DNA, 14 bp, Homo sapiens
tctctcttctgctc

SEQ ID NO: 5795900 - DNA, 16 bp, Homo sapiens
tctctcttctgctcca

SEQ ID NO: 5795901 - DNA, 19 bp, Homo sapiens
tctctcttctgctccaccc

SEQ ID NO: 5795902 - DNA, 12 bp, Homo sapiens
tctctcttctta

SEQ ID NO: 5795903 - DNA, 23 bp, Homo sapiens
tctctcttcttattacccaaacc

SEQ ID NO: 5795904 - DNA, 19 bp, Homo sapiens
tctctcttggacccacctg

SEQ ID NO: 5795905 - DNA, 21 bp, Homo sapiens
tctctcttgggccaagccagc

SEQ ID NO: 5795906 - DNA, 13 bp, Homo sapiens
tctctcttggtct

SEQ ID NO: 5795907 - DNA, 16 bp, Homo sapiens
tctctcttggtctctt

SEQ ID NO: 5795908 - DNA, 21 bp, Homo sapiens
tctctcttgtcctcttctgct

SEQ ID NO: 5795909 - DNA, 11 bp, Homo sapiens
tctctctttcc

SEQ ID NO: 5795910 - DNA, 18 bp, Homo sapiens
tctctctttcctccaccc

SEQ ID NO: 5795911 - DNA, 15 bp, Homo sapiens
tctctctttctctct

SEQ ID NO: 5795912 - DNA, 19 bp, Homo sapiens
tctctctttcttttgtgca

SEQ ID NO: 5795913 - DNA, 20 bp, Homo sapiens
tctctctttgcatggatttc

SEQ ID NO: 5795914 - DNA, 16 bp, Homo sapiens
tctctctttggactct

SEQ ID NO: 5795915 - DNA, 19 bp, Homo sapiens
tctctcttttcctctctct

SEQ ID NO: 5795916 - DNA, 20 bp, Homo sapiens
tctctcttttctacacactc

SEQ ID NO: 5795917 - DNA, 14 bp, Homo sapiens
tctctctttttctt

SEQ ID NO: 5795918 - DNA, 22 bp, Homo sapiens
tctctgaaaattctggaaggaa

SEQ ID NO: 5795919 - DNA, 15 bp, Homo sapiens
tctctgaacacaggc

SEQ ID NO: 5795920 - DNA, 17 bp, Homo sapiens
tctctgaacacaggcag

SEQ ID NO: 5795921 - DNA, 14 bp, Homo sapiens
tctctgaacagaaa

SEQ ID NO: 5795922 - DNA, 21 bp, Homo sapiens
tctctgaactgcaacactgga

SEQ ID NO: 5795923 - DNA, 12 bp, Homo sapiens
tctctgaactgg

SEQ ID NO: 5795924 - DNA, 15 bp, Homo sapiens
tctctgaacttcagc

SEQ ID NO: 5795925 - DNA, 16 bp, Homo sapiens
tctctgaacttcagct

SEQ ID NO: 5795926 - DNA, 22 bp, Homo sapiens
tctctgaagagtgggtttcaca

SEQ ID NO: 5795927 - DNA, 14 bp, Homo sapiens
tctctgaagcatgt

SEQ ID NO: 5795928 - DNA, 19 bp, Homo sapiens
tctctgaagcatgtttcat

SEQ ID NO: 5795929 - DNA, 13 bp, Homo sapiens
tctctgaagccac

SEQ ID NO: 5795930 - DNA, 19 bp, Homo sapiens
tctctgaagcgactctcct

SEQ ID NO: 5795931 - DNA, 20 bp, Homo sapiens
tctctgaagcgactctcctg

SEQ ID NO: 5795932 - DNA, 20 bp, Homo sapiens
tctctgaaggaggccacctc

SEQ ID NO: 5795933 - DNA, 23 bp, Homo sapiens
tctctgaaggaggccacctccta

SEQ ID NO: 5795934 - DNA, 16 bp, Homo sapiens
tctctgaagtgaaact

SEQ ID NO: 5795935 - DNA, 17 bp, Homo sapiens
tctctgaatacacagta

SEQ ID NO: 5795936 - DNA, 13 bp, Homo sapiens
tctctgaatcaga

SEQ ID NO: 5795937 - DNA, 15 bp, Homo sapiens
tctctgaatgcccca

SEQ ID NO: 5795938 - DNA, 23 bp, Homo sapiens
tctctgaatgctgagctgaagaa

SEQ ID NO: 5795939 - DNA, 13 bp, Homo sapiens
tctctgacaaagt

SEQ ID NO: 5795940 - DNA, 21 bp, Homo sapiens
tctctgacaatgcgtggcaca

SEQ ID NO: 5795941 - DNA, 21 bp, Homo sapiens
tctctgacactgtgtaagaag

SEQ ID NO: 5795942 - DNA, 21 bp, Homo sapiens
tctctgacctactcgagggac

SEQ ID NO: 5795943 - DNA, 16 bp, Homo sapiens
tctctgacctctgctg

SEQ ID NO: 5795944 - DNA, 13 bp, Homo sapiens
tctctgacgtcaa

SEQ ID NO: 5795945 - DNA, 17 bp, Homo sapiens
tctctgactcttgcctt

SEQ ID NO: 5795946 - DNA, 14 bp, Homo sapiens
tctctgactgcttt

SEQ ID NO: 5795947 - DNA, 13 bp, Homo sapiens
tctctgacttctg

SEQ ID NO: 5795948 - DNA, 18 bp, Homo sapiens
tctctgacttctgcctgg

SEQ ID NO: 5795949 - DNA, 14 bp, Homo sapiens
tctctgagaacaga

SEQ ID NO: 5795950 - DNA, 13 bp, Homo sapiens
tctctgagaagag

SEQ ID NO: 5795951 - DNA, 19 bp, Homo sapiens
tctctgagaccacagaggc

SEQ ID NO: 5795952 - DNA, 12 bp, Homo sapiens
tctctgagactg

SEQ ID NO: 5795953 - DNA, 23 bp, Homo sapiens
tctgaaacccacagatgtctctg

SEQ ID NO: 5795954 - DNA, 23 bp, Homo sapiens
tctgaaaccctggaccagtggtc

SEQ ID NO: 5795955 - DNA, 18 bp, Homo sapiens
tctgaaactatagaataa

SEQ ID NO: 5795956 - DNA, 19 bp, Homo sapiens
tctgaaactatagaataaa

SEQ ID NO: 5795957 - DNA, 11 bp, Homo sapiens
tctgaaactgg

SEQ ID NO: 5795958 - DNA, 12 bp, Homo sapiens
tctgaaactggc

SEQ ID NO: 5795959 - DNA, 15 bp, Homo sapiens
tctgaaactggcttc

SEQ ID NO: 5795960 - DNA, 16 bp, Homo sapiens
tctgaaacttcccaac

SEQ ID NO: 5795961 - DNA, 22 bp, Homo sapiens
tctgaaagaattatttgccttc

SEQ ID NO: 5795962 - DNA, 20 bp, Homo sapiens
tctgaaagacagaatgtcac

SEQ ID NO: 5795963 - DNA, 22 bp, Homo sapiens
tctgaaagagtctttcttcttc

SEQ ID NO: 5795964 - DNA, 15 bp, Homo sapiens
tctgaaagctttata

SEQ ID NO: 5795965 - DNA, 14 bp, Homo sapiens
tctgaaaggaaaag

SEQ ID NO: 5795966 - DNA, 20 bp, Homo sapiens
tctgaaaggccagcagctga

SEQ ID NO: 5795967 - DNA, 22 bp, Homo sapiens
tctgaaaggtaatacagcttgt

SEQ ID NO: 5795968 - DNA, 16 bp, Homo sapiens
tctgaaagtatatttt

SEQ ID NO: 5795969 - DNA, 15 bp, Homo sapiens
tctgaaagttgtaca

SEQ ID NO: 5795970 - DNA, 21 bp, Homo sapiens
tctgaaagttgtcaccctgga

SEQ ID NO: 5795971 - DNA, 14 bp, Homo sapiens
tctgaaataaaaat

SEQ ID NO: 5795972 - DNA, 17 bp, Homo sapiens
tctgaaatataaagtct

SEQ ID NO: 5795973 - DNA, 14 bp, Homo sapiens
tctgaaatctacaa

SEQ ID NO: 5795974 - DNA, 15 bp, Homo sapiens
tctgaaatctgaaga

SEQ ID NO: 5795975 - DNA, 18 bp, Homo sapiens
tctgaaatgttacaaaaa

SEQ ID NO: 5795976 - DNA, 15 bp, Homo sapiens
tctgaaattaggaaa

SEQ ID NO: 5795977 - DNA, 19 bp, Homo sapiens
tctgaaattcaaaatgctc

SEQ ID NO: 5795978 - DNA, 21 bp, Homo sapiens
tctgaaattcacagaagccta

SEQ ID NO: 5795979 - DNA, 21 bp, Homo sapiens
tctgaaattggtgggaagcaa

SEQ ID NO: 5795980 - DNA, 15 bp, Homo sapiens
tctgaaatttcccac

SEQ ID NO: 5795981 - DNA, 17 bp, Homo sapiens
tctgaaatttttcttct

SEQ ID NO: 5795982 - DNA, 15 bp, Homo sapiens
tctgaacaaaagcag

SEQ ID NO: 5795983 - DNA, 17 bp, Homo sapiens
tctgaacaaaatgcctt

SEQ ID NO: 5795984 - DNA, 14 bp, Homo sapiens
tctgaacaaacact

SEQ ID NO: 5795985 - DNA, 15 bp, Homo sapiens
tctgaacaaacactg

SEQ ID NO: 5795986 - DNA, 15 bp, Homo sapiens
tctgaacaattctct

SEQ ID NO: 5795987 - DNA, 19 bp, Homo sapiens
tctgaacacaaccagaggt

SEQ ID NO: 5795988 - DNA, 22 bp, Homo sapiens
tctgaacacacacgccagctcc

SEQ ID NO: 5795989 - DNA, 15 bp, Homo sapiens
tctgaacacaggcag

SEQ ID NO: 5795990 - DNA, 22 bp, Homo sapiens
tctgaacacagtttagtgcttt

SEQ ID NO: 5795991 - DNA, 15 bp, Homo sapiens
tctgaacacgaagct

SEQ ID NO: 5795992 - DNA, 22 bp, Homo sapiens
tctgaacagcagtaatcctggg

SEQ ID NO: 5795993 - DNA, 14 bp, Homo sapiens
tctgaacagctggt

SEQ ID NO: 5795994 - DNA, 16 bp, Homo sapiens
tctgaacagctggtgt

SEQ ID NO: 5795995 - DNA, 21 bp, Homo sapiens
tctgaacagctggtgtagcta

SEQ ID NO: 5795996 - DNA, 15 bp, Homo sapiens
tctgaaccactttgc

SEQ ID NO: 5795997 - DNA, 15 bp, Homo sapiens
tctgaacccaggcag

SEQ ID NO: 5795998 - DNA, 17 bp, Homo sapiens
tctgaacccaggcagct

SEQ ID NO: 5795999 - DNA, 22 bp, Homo sapiens
tctgaacccaggcagctggcag

SEQ ID NO: 5796000 - DNA, 15 bp, Homo sapiens
tctgaaccctccaaa

SEQ ID NO: 5796001 - DNA, 21 bp, Homo sapiens
tctgaactaattcatttatta

SEQ ID NO: 5796002 - DNA, 12 bp, Homo sapiens
tctgaactcaaa

SEQ ID NO: 5796003 - DNA, 20 bp, Homo sapiens
tctgaactccatacagcctc

SEQ ID NO: 5796004 - DNA, 21 bp, Homo sapiens
tctgaactccatacagcctct

SEQ ID NO: 5796005 - DNA, 20 bp, Homo sapiens
tctgaactctaagcagaaga

SEQ ID NO: 5796006 - DNA, 14 bp, Homo sapiens
tctgaactctcaaa

SEQ ID NO: 5796007 - DNA, 14 bp, Homo sapiens
tctgaactctgaca

SEQ ID NO: 5796008 - DNA, 15 bp, Homo sapiens
tctgaactctgacag

SEQ ID NO: 5796009 - DNA, 18 bp, Homo sapiens
tctgaactgcacaatgca

SEQ ID NO: 5796010 - DNA, 14 bp, Homo sapiens
tctgaactgctgct

SEQ ID NO: 5796011 - DNA, 20 bp, Homo sapiens
tctgaactggagccatgggc

SEQ ID NO: 5796012 - DNA, 13 bp, Homo sapiens
tctgaactgttac

SEQ ID NO: 5796013 - DNA, 14 bp, Homo sapiens
tctgaactgttaca

SEQ ID NO: 5796014 - DNA, 14 bp, Homo sapiens
tctgaacttcagct

SEQ ID NO: 5796015 - DNA, 15 bp, Homo sapiens
tctgaacttcagcta

SEQ ID NO: 5796016 - DNA, 18 bp, Homo sapiens
tctgaacttgcattgtga

SEQ ID NO: 5796017 - DNA, 19 bp, Homo sapiens
tctgaacttgcattgtgat

SEQ ID NO: 5796018 - DNA, 17 bp, Homo sapiens
tctgaacttgccttaaa

SEQ ID NO: 5796019 - DNA, 16 bp, Homo sapiens
tctgaactttggaagc

SEQ ID NO: 5796020 - DNA, 14 bp, Homo sapiens
tctgaactttggga

SEQ ID NO: 5796021 - DNA, 15 bp, Homo sapiens
tctgaactttgggaa

SEQ ID NO: 5796022 - DNA, 23 bp, Homo sapiens
tctgaactttgtttccagaaatt

SEQ ID NO: 5796023 - DNA, 17 bp, Homo sapiens
tctgaacttttgtggag

SEQ ID NO: 5796024 - DNA, 13 bp, Homo sapiens
tctgaagaagcaa

SEQ ID NO: 5796025 - DNA, 17 bp, Homo sapiens
tctgaagaaggaaggcc

SEQ ID NO: 5796026 - DNA, 19 bp, Homo sapiens
tctgaagaaggaaggcctg

SEQ ID NO: 5796027 - DNA, 21 bp, Homo sapiens
tctgaagaaggaaggcctgag

SEQ ID NO: 5796028 - DNA, 18 bp, Homo sapiens
tctgaagactgagaactt

SEQ ID NO: 5796029 - DNA, 13 bp, Homo sapiens
tctgaagagacca

SEQ ID NO: 5796030 - DNA, 18 bp, Homo sapiens
tctgaagagaccttggct

SEQ ID NO: 5796031 - DNA, 13 bp, Homo sapiens
tctgaagagctga

SEQ ID NO: 5796032 - DNA, 10 bp, Homo sapiens
tctgaagagg

SEQ ID NO: 5796033 - DNA, 19 bp, Homo sapiens
tctgaagatcagaacattc

SEQ ID NO: 5796034 - DNA, 18 bp, Homo sapiens
tctgaagatctaaacttt

SEQ ID NO: 5796035 - DNA, 13 bp, Homo sapiens
tctgaagatctca

SEQ ID NO: 5796036 - DNA, 15 bp, Homo sapiens
tctgaagatctcaga

SEQ ID NO: 5796037 - DNA, 13 bp, Homo sapiens
tctgaagccatgt

SEQ ID NO: 5796038 - DNA, 22 bp, Homo sapiens
tctgaagccatgtagccaccca

SEQ ID NO: 5796039 - DNA, 17 bp, Homo sapiens
tctgaagcccaaagcct

SEQ ID NO: 5796040 - DNA, 18 bp, Homo sapiens
tctgaagcccaaagcctg

SEQ ID NO: 5796041 - DNA, 19 bp, Homo sapiens
tctgaagcccaaagcctga

SEQ ID NO: 5796042 - DNA, 15 bp, Homo sapiens
tctgaagcctctaac

SEQ ID NO: 5796043 - DNA, 22 bp, Homo sapiens
tctgaagctagaaacaatctat

SEQ ID NO: 5796044 - DNA, 16 bp, Homo sapiens
tctgaagctagaggaa

SEQ ID NO: 5796045 - DNA, 23 bp, Homo sapiens
tctgaagctcgcatccagacagt

SEQ ID NO: 5796046 - DNA, 21 bp, Homo sapiens
tctgaagctgacgaacttcca

SEQ ID NO: 5796047 - DNA, 14 bp, Homo sapiens
tctgaagctgctgc

SEQ ID NO: 5796048 - DNA, 19 bp, Homo sapiens
tctgaagctgctgcagctc

SEQ ID NO: 5796049 - DNA, 17 bp, Homo sapiens
tctgaagcttatgtttc

SEQ ID NO: 5796050 - DNA, 18 bp, Homo sapiens
tctgaagcttatgtttct

SEQ ID NO: 5796051 - DNA, 20 bp, Homo sapiens
tctgaagcttcactcactgt

SEQ ID NO: 5796052 - DNA, 16 bp, Homo sapiens
tctgaagcttgactcc

SEQ ID NO: 5796053 - DNA, 17 bp, Homo sapiens
tctgaagcttgactccc

SEQ ID NO: 5796054 - DNA, 18 bp, Homo sapiens
tctgaagcttgactccca

SEQ ID NO: 5796055 - DNA, 22 bp, Homo sapiens
tctgaagcttgactcccaagtt

SEQ ID NO: 5796056 - DNA, 17 bp, Homo sapiens
tctgaaggaccccaggt

SEQ ID NO: 5796057 - DNA, 18 bp, Homo sapiens
tctgaaggaccccaggta

SEQ ID NO: 5796058 - DNA, 13 bp, Homo sapiens
tctgaaggagagg

SEQ ID NO: 5796059 - DNA, 14 bp, Homo sapiens
tctgaaggagagga

SEQ ID NO: 5796060 - DNA, 16 bp, Homo sapiens
tctgaaggagaggagt

SEQ ID NO: 5796061 - DNA, 15 bp, Homo sapiens
tctgaaggcctccat

SEQ ID NO: 5796062 - DNA, 20 bp, Homo sapiens
tctgaaggccttgttaaaat

SEQ ID NO: 5796063 - DNA, 19 bp, Homo sapiens
tctgaaggggcaaattctt

SEQ ID NO: 5796064 - DNA, 18 bp, Homo sapiens
tctgaaggtaatactata

SEQ ID NO: 5796065 - DNA, 20 bp, Homo sapiens
tctgaaggtaatactataaa

SEQ ID NO: 5796066 - DNA, 16 bp, Homo sapiens
tctgaaggtgcccagg

SEQ ID NO: 5796067 - DNA, 15 bp, Homo sapiens
tctgaagtaatttgt

SEQ ID NO: 5796068 - DNA, 22 bp, Homo sapiens
tctgaagtaatttgtaaaaaag

SEQ ID NO: 5796069 - DNA, 21 bp, Homo sapiens
tctgaagtatggtattacaaa

SEQ ID NO: 5796070 - DNA, 22 bp, Homo sapiens
tctgaagtatggtattacaaaa

SEQ ID NO: 5796071 - DNA, 17 bp, Homo sapiens
tctgaagtcacatcaca

SEQ ID NO: 5796072 - DNA, 15 bp, Homo sapiens
tctgaagtcactgca

SEQ ID NO: 5796073 - DNA, 18 bp, Homo sapiens
tctgaagtcactgcacag

SEQ ID NO: 5796074 - DNA, 15 bp, Homo sapiens
tctgaagtcagatct

SEQ ID NO: 5796075 - DNA, 21 bp, Homo sapiens
tctgaagtcccttcctgtcct

SEQ ID NO: 5796076 - DNA, 17 bp, Homo sapiens
tctgaagtctgagccca

SEQ ID NO: 5796077 - DNA, 19 bp, Homo sapiens
tctgaagtctgagcccatt

SEQ ID NO: 5796078 - DNA, 18 bp, Homo sapiens
tctgaagtggttcagtct

SEQ ID NO: 5796079 - DNA, 22 bp, Homo sapiens
tctgaagtggtttgcaggtcag

SEQ ID NO: 5796080 - DNA, 14 bp, Homo sapiens
tctgaagttatatt

SEQ ID NO: 5796081 - DNA, 17 bp, Homo sapiens
tctgaagttatatttcc

SEQ ID NO: 5796082 - DNA, 15 bp, Homo sapiens
tctgaagttggacag

SEQ ID NO: 5796083 - DNA, 15 bp, Homo sapiens
tctgaagttttattt

SEQ ID NO: 5796084 - DNA, 18 bp, Homo sapiens
tctgaagttttattttaa

SEQ ID NO: 5796085 - DNA, 19 bp, Homo sapiens
tctgaataaagtaattgta

SEQ ID NO: 5796086 - DNA, 14 bp, Homo sapiens
tctgaataaatacc

SEQ ID NO: 5796087 - DNA, 16 bp, Homo sapiens
tctgaataacatttgt

SEQ ID NO: 5796088 - DNA, 13 bp, Homo sapiens
tctgaataacttg

SEQ ID NO: 5796089 - DNA, 18 bp, Homo sapiens
tctgaataagcacttttt

SEQ ID NO: 5796090 - DNA, 19 bp, Homo sapiens
tctgaataagcacttttta

SEQ ID NO: 5796091 - DNA, 16 bp, Homo sapiens
tctgaataatgaagat

SEQ ID NO: 5796092 - DNA, 15 bp, Homo sapiens
tctgaataatttctt

SEQ ID NO: 5796093 - DNA, 17 bp, Homo sapiens
tctgaatacctctttga

SEQ ID NO: 5796094 - DNA, 16 bp, Homo sapiens
tctgaatagaaatggg

SEQ ID NO: 5796095 - DNA, 14 bp, Homo sapiens
tctgaatatgctgc

SEQ ID NO: 5796096 - DNA, 14 bp, Homo sapiens
tctgaatattagat

SEQ ID NO: 5796097 - DNA, 16 bp, Homo sapiens
tctgaatcatgtctgt

SEQ ID NO: 5796098 - DNA, 16 bp, Homo sapiens
tctgaatccttagaat

SEQ ID NO: 5796099 - DNA, 18 bp, Homo sapiens
tctgaatccttagaatgg

SEQ ID NO: 5796100 - DNA, 22 bp, Homo sapiens
tctgaatcgagtgagacaaaat

SEQ ID NO: 5796101 - DNA, 14 bp, Homo sapiens
tctgaatctcccaa

SEQ ID NO: 5796102 - DNA, 18 bp, Homo sapiens
tctgaatctctcaaaatg

SEQ ID NO: 5796103 - DNA, 20 bp, Homo sapiens
tctgaatctgcgagtagatg

SEQ ID NO: 5796104 - DNA, 22 bp, Homo sapiens
tctgaatgaagccttctgacct

SEQ ID NO: 5796105 - DNA, 21 bp, Homo sapiens
tctgaatgagcctttgtgctt

SEQ ID NO: 5796106 - DNA, 22 bp, Homo sapiens
tctgaatgccgtgcctgcaaaa

SEQ ID NO: 5796107 - DNA, 13 bp, Homo sapiens
tctgaatgctgcc

SEQ ID NO: 5796108 - DNA, 13 bp, Homo sapiens
tctgaatgctgct

SEQ ID NO: 5796109 - DNA, 17 bp, Homo sapiens
tctgaatgctgctactt

SEQ ID NO: 5796110 - DNA, 22 bp, Homo sapiens
tctgaatgggagccagaattca

SEQ ID NO: 5796111 - DNA, 20 bp, Homo sapiens
tctgaatgggcaattccaga

SEQ ID NO: 5796112 - DNA, 20 bp, Homo sapiens
tctgaatggggctttcctga

SEQ ID NO: 5796113 - DNA, 14 bp, Homo sapiens
tctgaatgtaattt

SEQ ID NO: 5796114 - DNA, 20 bp, Homo sapiens
tctgaatgtaatttgtgtaa

SEQ ID NO: 5796115 - DNA, 17 bp, Homo sapiens
tctgaatgtagccagcc

SEQ ID NO: 5796116 - DNA, 21 bp, Homo sapiens
tctgaatgtagccagcccaca

SEQ ID NO: 5796117 - DNA, 17 bp, Homo sapiens
tctgaatgtatttatgt

SEQ ID NO: 5796118 - DNA, 12 bp, Homo sapiens
tctgaatgttct

SEQ ID NO: 5796119 - DNA, 14 bp, Homo sapiens
tctgaatgttctga

SEQ ID NO: 5796120 - DNA, 19 bp, Homo sapiens
tctgaatgttctgacatta

SEQ ID NO: 5796121 - DNA, 22 bp, Homo sapiens
tctgaatgttctgacattaaca

SEQ ID NO: 5796122 - DNA, 23 bp, Homo sapiens
tctgaatgttctgacattaacag

SEQ ID NO: 5796123 - DNA, 19 bp, Homo sapiens
tctgaatgtttgtgtctgt

SEQ ID NO: 5796124 - DNA, 20 bp, Homo sapiens
tctgaatgtttgtgtctgtg

SEQ ID NO: 5796125 - DNA, 10 bp, Homo sapiens
tctgaattat

SEQ ID NO: 5796126 - DNA, 15 bp, Homo sapiens
tctgaattattttct

SEQ ID NO: 5796127 - DNA, 16 bp, Homo sapiens
tctgaattcaaagctt

SEQ ID NO: 5796128 - DNA, 20 bp, Homo sapiens
tctgaattcaaagcttgtga

SEQ ID NO: 5796129 - DNA, 22 bp, Homo sapiens
tctgaattcaaagcttgtgaaa

SEQ ID NO: 5796130 - DNA, 13 bp, Homo sapiens
tctgaattcctgt

SEQ ID NO: 5796131 - DNA, 19 bp, Homo sapiens
tctgagtggaggaagccca

SEQ ID NO: 5796132 - DNA, 17 bp, Homo sapiens
tctgagtggcttcactc

SEQ ID NO: 5796133 - DNA, 21 bp, Homo sapiens
tctgagtggcttcactcctgc

SEQ ID NO: 5796134 - DNA, 20 bp, Homo sapiens
tctgagtggtggttcctttg

SEQ ID NO: 5796135 - DNA, 12 bp, Homo sapiens
tctgagtggtgt

SEQ ID NO: 5796136 - DNA, 21 bp, Homo sapiens
tctgagtgtctctgcctggag

SEQ ID NO: 5796137 - DNA, 20 bp, Homo sapiens
tctgagttctctttcttagt

SEQ ID NO: 5796138 - DNA, 19 bp, Homo sapiens
tctgagttctgtgtatttt

SEQ ID NO: 5796139 - DNA, 19 bp, Homo sapiens
tctgagttgccaagacaaa

SEQ ID NO: 5796140 - DNA, 21 bp, Homo sapiens
tctgagttgccaagacaaatc

SEQ ID NO: 5796141 - DNA, 14 bp, Homo sapiens
tctgagtttaccat

SEQ ID NO: 5796142 - DNA, 15 bp, Homo sapiens
tctgagtttcattct

SEQ ID NO: 5796143 - DNA, 17 bp, Homo sapiens
tctgagttttgatgctg

SEQ ID NO: 5796144 - DNA, 23 bp, Homo sapiens
tctgataaaattgtgatgttttg

SEQ ID NO: 5796145 - DNA, 12 bp, Homo sapiens
tctgataaacac

SEQ ID NO: 5796146 - DNA, 21 bp, Homo sapiens
tctgataagactggaaaatag

SEQ ID NO: 5796147 - DNA, 20 bp, Homo sapiens
tctgataatgtattgcagtg

SEQ ID NO: 5796148 - DNA, 14 bp, Homo sapiens
tctgataatttaaa

SEQ ID NO: 5796149 - DNA, 13 bp, Homo sapiens
tctgatacacagt

SEQ ID NO: 5796150 - DNA, 13 bp, Homo sapiens
tctgatacagaaa

SEQ ID NO: 5796151 - DNA, 14 bp, Homo sapiens
tctgatacccagag

SEQ ID NO: 5796152 - DNA, 21 bp, Homo sapiens
tctgatacttatttataacat

SEQ ID NO: 5796153 - DNA, 13 bp, Homo sapiens
tctgatacttttt

SEQ ID NO: 5796154 - DNA, 19 bp, Homo sapiens
tctgatacttttttgaaat

SEQ ID NO: 5796155 - DNA, 12 bp, Homo sapiens
tctgatagagtt

SEQ ID NO: 5796156 - DNA, 23 bp, Homo sapiens
tctgatagagtttaacagatatt

SEQ ID NO: 5796157 - DNA, 15 bp, Homo sapiens
tctgataggccaagt

SEQ ID NO: 5796158 - DNA, 22 bp, Homo sapiens
tctgatagtagtctttaaaaga

SEQ ID NO: 5796159 - DNA, 17 bp, Homo sapiens
tctgatatcagcactgg

SEQ ID NO: 5796160 - DNA, 17 bp, Homo sapiens
tctgatatctttgtctt

SEQ ID NO: 5796161 - DNA, 20 bp, Homo sapiens
tctgatattaaagatttctt

SEQ ID NO: 5796162 - DNA, 21 bp, Homo sapiens
tctgatattaaagatttcttt

SEQ ID NO: 5796163 - DNA, 19 bp, Homo sapiens
tctgatattaatcaaaatt

SEQ ID NO: 5796164 - DNA, 21 bp, Homo sapiens
tctgatattcaaacacacagt

SEQ ID NO: 5796165 - DNA, 22 bp, Homo sapiens
tctgatattcaaacacacagta

SEQ ID NO: 5796166 - DNA, 18 bp, Homo sapiens
tctgatatttgctggagt

SEQ ID NO: 5796167 - DNA, 19 bp, Homo sapiens
tctgatatttgctggagtg

SEQ ID NO: 5796168 - DNA, 14 bp, Homo sapiens
tctgatcaagagtc

SEQ ID NO: 5796169 - DNA, 15 bp, Homo sapiens
tctgatcaaggcctt

SEQ ID NO: 5796170 - DNA, 18 bp, Homo sapiens
tctgatcacaacttttct

SEQ ID NO: 5796171 - DNA, 19 bp, Homo sapiens
tctgatcacccccctgctt

SEQ ID NO: 5796172 - DNA, 21 bp, Homo sapiens
tctgatcagaggtgtacacta

SEQ ID NO: 5796173 - DNA, 21 bp, Homo sapiens
tctgatcatccactgtgccat

SEQ ID NO: 5796174 - DNA, 15 bp, Homo sapiens
tctgatccctcgccc

SEQ ID NO: 5796175 - DNA, 22 bp, Homo sapiens
tctgatccctgatcaagcttca

SEQ ID NO: 5796176 - DNA, 14 bp, Homo sapiens
tctgatcctcagcc

SEQ ID NO: 5796177 - DNA, 19 bp, Homo sapiens
tctgatcgggataacaaaa

SEQ ID NO: 5796178 - DNA, 22 bp, Homo sapiens
tctgatcgtgacgctgaataaa

SEQ ID NO: 5796179 - DNA, 14 bp, Homo sapiens
tctgatctaacaaa

SEQ ID NO: 5796180 - DNA, 15 bp, Homo sapiens
tctgatctccatggc

SEQ ID NO: 5796181 - DNA, 17 bp, Homo sapiens
tctgatctgtactttgt

SEQ ID NO: 5796182 - DNA, 14 bp, Homo sapiens
tctgatctgtgcag

SEQ ID NO: 5796183 - DNA, 20 bp, Homo sapiens
tctgatctgtgcagggtatt

SEQ ID NO: 5796184 - DNA, 22 bp, Homo sapiens
tctgatctgtgcagggtattaa

SEQ ID NO: 5796185 - DNA, 14 bp, Homo sapiens
tctgatctgtgctt

SEQ ID NO: 5796186 - DNA, 15 bp, Homo sapiens
tctgatctgtgcttt

SEQ ID NO: 5796187 - DNA, 23 bp, Homo sapiens
tctgatctgtgctttccagctca

SEQ ID NO: 5796188 - DNA, 20 bp, Homo sapiens
tctgatctttttatacacaa

SEQ ID NO: 5796189 - DNA, 13 bp, Homo sapiens
tctgatgaaatgt

SEQ ID NO: 5796190 - DNA, 12 bp, Homo sapiens
tctgatgaatct

SEQ ID NO: 5796191 - DNA, 14 bp, Homo sapiens
tctgatgaatcttg

SEQ ID NO: 5796192 - DNA, 14 bp, Homo sapiens
tctgatgacgcctg

SEQ ID NO: 5796193 - DNA, 16 bp, Homo sapiens
tctgatgatgttctga

SEQ ID NO: 5796194 - DNA, 18 bp, Homo sapiens
tctgatgatgttctgaaa

SEQ ID NO: 5796195 - DNA, 13 bp, Homo sapiens
tctgatgcagaaa

SEQ ID NO: 5796196 - DNA, 14 bp, Homo sapiens
tctgatgcagaaat

SEQ ID NO: 5796197 - DNA, 15 bp, Homo sapiens
tctgatgcagaactt

SEQ ID NO: 5796198 - DNA, 16 bp, Homo sapiens
tctgatgccaaagctg

SEQ ID NO: 5796199 - DNA, 20 bp, Homo sapiens
tctgatgccaaagctgcttt

SEQ ID NO: 5796200 - DNA, 21 bp, Homo sapiens
tctgatggaatgtgccacctg

SEQ ID NO: 5796201 - DNA, 18 bp, Homo sapiens
tctgatggaccttctaga

SEQ ID NO: 5796202 - DNA, 23 bp, Homo sapiens
tctgatggcacctataaaattat

SEQ ID NO: 5796203 - DNA, 20 bp, Homo sapiens
tctgatggcacttttgagct

SEQ ID NO: 5796204 - DNA, 15 bp, Homo sapiens
tctgatggccttaat

SEQ ID NO: 5796205 - DNA, 15 bp, Homo sapiens
tctgatggcttctcc

SEQ ID NO: 5796206 - DNA, 23 bp, Homo sapiens
tctgatgggttcatgtctctgat

SEQ ID NO: 5796207 - DNA, 16 bp, Homo sapiens
tctgatggtgagcagt

SEQ ID NO: 5796208 - DNA, 16 bp, Homo sapiens
tctgatgtactctaaa

SEQ ID NO: 5796209 - DNA, 23 bp, Homo sapiens
tctgatgtataatgtaatgtttt

SEQ ID NO: 5796210 - DNA, 15 bp, Homo sapiens
tctgatgtattttgt

SEQ ID NO: 5796211 - DNA, 19 bp, Homo sapiens
tctgatgtggcaaaaggcc

SEQ ID NO: 5796212 - DNA, 12 bp, Homo sapiens
tctgatgtttat

SEQ ID NO: 5796213 - DNA, 16 bp, Homo sapiens
tctgatgtttctgtga

SEQ ID NO: 5796214 - DNA, 17 bp, Homo sapiens
tctgattagaaaggaaa

SEQ ID NO: 5796215 - DNA, 17 bp, Homo sapiens
tctgattagctttgtgt

SEQ ID NO: 5796216 - DNA, 22 bp, Homo sapiens
tctgattataccatgtgtgcta

SEQ ID NO: 5796217 - DNA, 13 bp, Homo sapiens
tctgattatcagg

SEQ ID NO: 5796218 - DNA, 13 bp, Homo sapiens
tctgattatgtaa

SEQ ID NO: 5796219 - DNA, 14 bp, Homo sapiens
tctgattatttgca

SEQ ID NO: 5796220 - DNA, 20 bp, Homo sapiens
tctgattcacctcttcctct

SEQ ID NO: 5796221 - DNA, 21 bp, Homo sapiens
tctgattcagcatcactaaac

SEQ ID NO: 5796222 - DNA, 13 bp, Homo sapiens
tctgattccactt

SEQ ID NO: 5796223 - DNA, 19 bp, Homo sapiens
tctgattcccaagctctgc

SEQ ID NO: 5796224 - DNA, 23 bp, Homo sapiens
tctgattcccaagctctgctcct

SEQ ID NO: 5796225 - DNA, 18 bp, Homo sapiens
tctgattcccagaaatac

SEQ ID NO: 5796226 - DNA, 19 bp, Homo sapiens
tctgattcgaatgacactg

SEQ ID NO: 5796227 - DNA, 22 bp, Homo sapiens
tctgattcgaatgacactgttc

SEQ ID NO: 5796228 - DNA, 14 bp, Homo sapiens
tctgattctatgta

SEQ ID NO: 5796229 - DNA, 15 bp, Homo sapiens
tctgattctatgtaa

SEQ ID NO: 5796230 - DNA, 16 bp, Homo sapiens
tctgattctatgtaac

SEQ ID NO: 5796231 - DNA, 18 bp, Homo sapiens
tctgattctatgtaactt

SEQ ID NO: 5796232 - DNA, 21 bp, Homo sapiens
tctgattctatgtaacttgtt

SEQ ID NO: 5796233 - DNA, 21 bp, Homo sapiens
tctgattctctttaactgtgt

SEQ ID NO: 5796234 - DNA, 14 bp, Homo sapiens
tctgattctgattg

SEQ ID NO: 5796235 - DNA, 19 bp, Homo sapiens
tctgattctggctttaagc

SEQ ID NO: 5796236 - DNA, 22 bp, Homo sapiens
tctgattgatttgattgggatg

SEQ ID NO: 5796237 - DNA, 19 bp, Homo sapiens
tctgattgctatcagcaat

SEQ ID NO: 5796238 - DNA, 20 bp, Homo sapiens
tctgattggacattttcttc

SEQ ID NO: 5796239 - DNA, 13 bp, Homo sapiens
tctgattggctgc

SEQ ID NO: 5796240 - DNA, 14 bp, Homo sapiens
tctgattggctgga

SEQ ID NO: 5796241 - DNA, 23 bp, Homo sapiens
tctgattggctggattgccttgt

SEQ ID NO: 5796242 - DNA, 17 bp, Homo sapiens
tctgattggcttgtaga

SEQ ID NO: 5796243 - DNA, 21 bp, Homo sapiens
tctgattgtaacgttgctgtg

SEQ ID NO: 5796244 - DNA, 23 bp, Homo sapiens
tctgattgtaacgttgctgtggg

SEQ ID NO: 5796245 - DNA, 16 bp, Homo sapiens
tctgattgtgatgtga

SEQ ID NO: 5796246 - DNA, 16 bp, Homo sapiens
tctgattgttcctccc

SEQ ID NO: 5796247 - DNA, 21 bp, Homo sapiens
tctgattgttcctccccagcc

SEQ ID NO: 5796248 - DNA, 12 bp, Homo sapiens
tctgatttaatg

SEQ ID NO: 5796249 - DNA, 19 bp, Homo sapiens
tctgatttaatgttttctg

SEQ ID NO: 5796250 - DNA, 14 bp, Homo sapiens
tctgatttagcaat

SEQ ID NO: 5796251 - DNA, 19 bp, Homo sapiens
tctgatttagcaatgctgt

SEQ ID NO: 5796252 - DNA, 16 bp, Homo sapiens
tctgatttattttgta

SEQ ID NO: 5796253 - DNA, 23 bp, Homo sapiens
tctgatttattttgtatgaaata

SEQ ID NO: 5796254 - DNA, 12 bp, Homo sapiens
tctgatttcagt

SEQ ID NO: 5796255 - DNA, 22 bp, Homo sapiens
tctgatttcagtttttcatttg

SEQ ID NO: 5796256 - DNA, 12 bp, Homo sapiens
tctgatttcata

SEQ ID NO: 5796257 - DNA, 14 bp, Homo sapiens
tctgatttgcagga

SEQ ID NO: 5796258 - DNA, 17 bp, Homo sapiens
tctgatttgcaggattt

SEQ ID NO: 5796259 - DNA, 17 bp, Homo sapiens
tctgatttgtaacccac

SEQ ID NO: 5796260 - DNA, 20 bp, Homo sapiens
tctgatttgtattaaaattg

SEQ ID NO: 5796261 - DNA, 13 bp, Homo sapiens
tctgattttaatg

SEQ ID NO: 5796262 - DNA, 23 bp, Homo sapiens
tctgattttaatgaaatcaaatg

SEQ ID NO: 5796263 - DNA, 17 bp, Homo sapiens
tctgattttatgtaaaa

SEQ ID NO: 5796264 - DNA, 21 bp, Homo sapiens
tctgattttatgtaaaatttt

SEQ ID NO: 5796265 - DNA, 23 bp, Homo sapiens
tctgattttgatattttcacaga

SEQ ID NO: 5796266 - DNA, 14 bp, Homo sapiens
tctgattttgcttc

SEQ ID NO: 5796267 - DNA, 21 bp, Homo sapiens
tctgattttgtgcaaaagctt

SEQ ID NO: 5796268 - DNA, 20 bp, Homo sapiens
tctgatttttaagatttcct

SEQ ID NO: 5796269 - DNA, 14 bp, Homo sapiens
tctgatttttaatt

SEQ ID NO: 5796270 - DNA, 22 bp, Homo sapiens
tctgattttttactggctgtgt

SEQ ID NO: 5796271 - DNA, 22 bp, Homo sapiens
tctgattttttattcaacaaac

SEQ ID NO: 5796272 - DNA, 18 bp, Homo sapiens
tctgcaaaacgagggggt

SEQ ID NO: 5796273 - DNA, 21 bp, Homo sapiens
tctgcaaaatgaggaatgtat

SEQ ID NO: 5796274 - DNA, 22 bp, Homo sapiens
tctgcaaacaaacaccttctta

SEQ ID NO: 5796275 - DNA, 22 bp, Homo sapiens
tctgcaaagatgattttgcttt

SEQ ID NO: 5796276 - DNA, 23 bp, Homo sapiens
tctgcaaagcatgttttgcatgt

SEQ ID NO: 5796277 - DNA, 13 bp, Homo sapiens
tctgcaaaggagg

SEQ ID NO: 5796278 - DNA, 15 bp, Homo sapiens
tctgcaaagtggcag

SEQ ID NO: 5796279 - DNA, 16 bp, Homo sapiens
tctgcaaatagaaaac

SEQ ID NO: 5796280 - DNA, 21 bp, Homo sapiens
tctgcaaatagaaaacaggaa

SEQ ID NO: 5796281 - DNA, 14 bp, Homo sapiens
tctgcaacagcctg

SEQ ID NO: 5796282 - DNA, 22 bp, Homo sapiens
tctgcaacatggattccaaagc

SEQ ID NO: 5796283 - DNA, 20 bp, Homo sapiens
tctgcaactcatgaacaaaa

SEQ ID NO: 5796284 - DNA, 16 bp, Homo sapiens
tctgcaactgaaatta

SEQ ID NO: 5796285 - DNA, 14 bp, Homo sapiens
tctgcaactttaag

SEQ ID NO: 5796286 - DNA, 21 bp, Homo sapiens
tctgcaactttaagcagctct

SEQ ID NO: 5796287 - DNA, 13 bp, Homo sapiens
tctgcaagaacac

SEQ ID NO: 5796288 - DNA, 15 bp, Homo sapiens
tctgcaagaattaaa

SEQ ID NO: 5796289 - DNA, 19 bp, Homo sapiens
tctgcaagaattaaaactg

SEQ ID NO: 5796290 - DNA, 22 bp, Homo sapiens
tctgcaagaattaaaactgagt

SEQ ID NO: 5796291 - DNA, 20 bp, Homo sapiens
tctgcaagaattgaagcagg

SEQ ID NO: 5796292 - DNA, 21 bp, Homo sapiens
tctgcaagaattgaagcagga

SEQ ID NO: 5796293 - DNA, 14 bp, Homo sapiens
tctgcaagacaaag

SEQ ID NO: 5796294 - DNA, 12 bp, Homo sapiens
tctgcaagaggg

SEQ ID NO: 5796295 - DNA, 14 bp, Homo sapiens
tctgcaagcccact

SEQ ID NO: 5796296 - DNA, 15 bp, Homo sapiens
tctgcaagcccactg

SEQ ID NO: 5796297 - DNA, 23 bp, Homo sapiens
tctgcaagggcagaacactaacc

SEQ ID NO: 5796298 - DNA, 22 bp, Homo sapiens
tctgcaagtatactagggagcc

SEQ ID NO: 5796299 - DNA, 12 bp, Homo sapiens
tctgcaagtcag

SEQ ID NO: 5796300 - DNA, 19 bp, Homo sapiens
tctgcaagtgtctggagcg

SEQ ID NO: 5796301 - DNA, 14 bp, Homo sapiens
tctgcaataacagt

SEQ ID NO: 5796302 - DNA, 11 bp, Homo sapiens
tctgcaatgct

SEQ ID NO: 5796303 - DNA, 20 bp, Homo sapiens
tctgcaatggaaacttttat

SEQ ID NO: 5796304 - DNA, 18 bp, Homo sapiens
tctgcaattcccctctgc

SEQ ID NO: 5796305 - DNA, 22 bp, Homo sapiens
tctgcaattcccctctgctgct

SEQ ID NO: 5796306 - DNA, 12 bp, Homo sapiens
tctgcaatttgt

SEQ ID NO: 5796307 - DNA, 19 bp, Homo sapiens
tctgcaatttgtttaaaga

SEQ ID NO: 5796308 - DNA, 15 bp, Homo sapiens
tctgccctgcctccc

SEQ ID NO: 5796309 - DNA, 14 bp, Homo sapiens
tctgccctgcctga

SEQ ID NO: 5796310 - DNA, 22 bp, Homo sapiens
tctgccctgcgggtcacaggag

SEQ ID NO: 5796311 - DNA, 16 bp, Homo sapiens
tctgccctggctgtgg

SEQ ID NO: 5796312 - DNA, 17 bp, Homo sapiens
tctgccctgggctcctc

SEQ ID NO: 5796313 - DNA, 20 bp, Homo sapiens
tctgccctgtgggaccccag

SEQ ID NO: 5796314 - DNA, 21 bp, Homo sapiens
tctgccctgtgggaccccagg

SEQ ID NO: 5796315 - DNA, 22 bp, Homo sapiens
tctgccctgtgggaccccaggc

SEQ ID NO: 5796316 - DNA, 15 bp, Homo sapiens
tctgccctgtgtact

SEQ ID NO: 5796317 - DNA, 13 bp, Homo sapiens
tctgcccttcccc

SEQ ID NO: 5796318 - DNA, 17 bp, Homo sapiens
tctgcccttctctgcct

SEQ ID NO: 5796319 - DNA, 12 bp, Homo sapiens
tctgcccttggt

SEQ ID NO: 5796320 - DNA, 18 bp, Homo sapiens
tctgccctttcctaggcc

SEQ ID NO: 5796321 - DNA, 16 bp, Homo sapiens
tctgccgaccgcctgc

SEQ ID NO: 5796322 - DNA, 18 bp, Homo sapiens
tctgccgcaatacaggaa

SEQ ID NO: 5796323 - DNA, 15 bp, Homo sapiens
tctgccgcagccctg

SEQ ID NO: 5796324 - DNA, 22 bp, Homo sapiens
tctgccgcagccctgcagaggg

SEQ ID NO: 5796325 - DNA, 18 bp, Homo sapiens
tctgccgccccctcctga

SEQ ID NO: 5796326 - DNA, 18 bp, Homo sapiens
tctgccgccgcccgctgg

SEQ ID NO: 5796327 - DNA, 15 bp, Homo sapiens
tctgccgctacctcc

SEQ ID NO: 5796328 - DNA, 20 bp, Homo sapiens
tctgccgctacctccctccc

SEQ ID NO: 5796329 - DNA, 15 bp, Homo sapiens
tctgccgctgccatg

SEQ ID NO: 5796330 - DNA, 22 bp, Homo sapiens
tctgccgctgtcaaggccgagg

SEQ ID NO: 5796331 - DNA, 21 bp, Homo sapiens
tctgccgctttgtctgtccag

SEQ ID NO: 5796332 - DNA, 15 bp, Homo sapiens
tctgccggcccccag

SEQ ID NO: 5796333 - DNA, 15 bp, Homo sapiens
tctgccgtctctcct

SEQ ID NO: 5796334 - DNA, 18 bp, Homo sapiens
tctgccgtctctcctgct

SEQ ID NO: 5796335 - DNA, 16 bp, Homo sapiens
tctgccgtctctggag

SEQ ID NO: 5796336 - DNA, 16 bp, Homo sapiens
tctgcctaacttgtaa

SEQ ID NO: 5796337 - DNA, 16 bp, Homo sapiens
tctgcctagaaacagt

SEQ ID NO: 5796338 - DNA, 21 bp, Homo sapiens
tctgcctagagtgtagcctaa

SEQ ID NO: 5796339 - DNA, 19 bp, Homo sapiens
tctgcctagatccacgtgt

SEQ ID NO: 5796340 - DNA, 20 bp, Homo sapiens
tctgcctaggagctggctgg

SEQ ID NO: 5796341 - DNA, 15 bp, Homo sapiens
tctgcctagtctaca

SEQ ID NO: 5796342 - DNA, 15 bp, Homo sapiens
tctgcctataaattt

SEQ ID NO: 5796343 - DNA, 15 bp, Homo sapiens
tctgcctatcctggc

SEQ ID NO: 5796344 - DNA, 13 bp, Homo sapiens
tctgcctatgcac

SEQ ID NO: 5796345 - DNA, 20 bp, Homo sapiens
tctgcctatgcactgaagag

SEQ ID NO: 5796346 - DNA, 14 bp, Homo sapiens
tctgcctcaactcc

SEQ ID NO: 5796347 - DNA, 16 bp, Homo sapiens
tctgcctcaactccac

SEQ ID NO: 5796348 - DNA, 17 bp, Homo sapiens
tctgcctcagcctcctg

SEQ ID NO: 5796349 - DNA, 14 bp, Homo sapiens
tctgcctcagcttc

SEQ ID NO: 5796350 - DNA, 12 bp, Homo sapiens
tctgcctcatcc

SEQ ID NO: 5796351 - DNA, 14 bp, Homo sapiens
tctgcctcatcctc

SEQ ID NO: 5796352 - DNA, 17 bp, Homo sapiens
tctgcctcatcctcctc

SEQ ID NO: 5796353 - DNA, 18 bp, Homo sapiens
tctgcctcatcctcctcc

SEQ ID NO: 5796354 - DNA, 15 bp, Homo sapiens
tctgcctccaccctc

SEQ ID NO: 5796355 - DNA, 20 bp, Homo sapiens
tctgcctccaccctcctcct

SEQ ID NO: 5796356 - DNA, 14 bp, Homo sapiens
tctgcctccaggag

SEQ ID NO: 5796357 - DNA, 19 bp, Homo sapiens
tctgcctccaggttgcctc

SEQ ID NO: 5796358 - DNA, 20 bp, Homo sapiens
tctgcctccaggttgcctca

SEQ ID NO: 5796359 - DNA, 20 bp, Homo sapiens
tctgcctccatgctgcagtg

SEQ ID NO: 5796360 - DNA, 22 bp, Homo sapiens
tctgcctcccaaagtgctggga

SEQ ID NO: 5796361 - DNA, 21 bp, Homo sapiens
tctgcctcccacgctgggaca

SEQ ID NO: 5796362 - DNA, 12 bp, Homo sapiens
tctgcctcccat

SEQ ID NO: 5796363 - DNA, 13 bp, Homo sapiens
tctgcctcccatc

SEQ ID NO: 5796364 - DNA, 15 bp, Homo sapiens
tctgcctcccatcac

SEQ ID NO: 5796365 - DNA, 16 bp, Homo sapiens
tctgcctcccatcacc

SEQ ID NO: 5796366 - DNA, 17 bp, Homo sapiens
tctgcctcccatcaccc

SEQ ID NO: 5796367 - DNA, 13 bp, Homo sapiens
tctgcctccctct

SEQ ID NO: 5796368 - DNA, 12 bp, Homo sapiens
tctgcctcctca

SEQ ID NO: 5796369 - DNA, 13 bp, Homo sapiens
tctgcctcctccc

SEQ ID NO: 5796370 - DNA, 16 bp, Homo sapiens
tctgcctcctcctcac

SEQ ID NO: 5796371 - DNA, 22 bp, Homo sapiens
tctgcctcctgctttgggaaga

SEQ ID NO: 5796372 - DNA, 23 bp, Homo sapiens
tctgcctctaactccctcctcac

SEQ ID NO: 5796373 - DNA, 15 bp, Homo sapiens
tctgcctctaaggcc

SEQ ID NO: 5796374 - DNA, 14 bp, Homo sapiens
tctgcctctcccag

SEQ ID NO: 5796375 - DNA, 18 bp, Homo sapiens
tctgcctctccctgggtc

SEQ ID NO: 5796376 - DNA, 22 bp, Homo sapiens
tctgcctctccctgggtctggg

SEQ ID NO: 5796377 - DNA, 22 bp, Homo sapiens
tctgcctctcttcttccccttt

SEQ ID NO: 5796378 - DNA, 20 bp, Homo sapiens
tctgcctctgatgtattttg

SEQ ID NO: 5796379 - DNA, 15 bp, Homo sapiens
tctgcctctgggcag

SEQ ID NO: 5796380 - DNA, 19 bp, Homo sapiens
tctgcctctgggcagcctg

SEQ ID NO: 5796381 - DNA, 21 bp, Homo sapiens
tctgcctctgggcagcctgct

SEQ ID NO: 5796382 - DNA, 23 bp, Homo sapiens
tctgcctcttaacttaaaagaac

SEQ ID NO: 5796383 - DNA, 17 bp, Homo sapiens
tctgcctcttctgggag

SEQ ID NO: 5796384 - DNA, 16 bp, Homo sapiens
tctgcctgacaaggcc

SEQ ID NO: 5796385 - DNA, 22 bp, Homo sapiens
tctgcctgacagcatcctctct

SEQ ID NO: 5796386 - DNA, 19 bp, Homo sapiens
tctgcctgagattctttaa

SEQ ID NO: 5796387 - DNA, 9 bp, Homo sapiens
tctgcctgc

SEQ ID NO: 5796388 - DNA, 13 bp, Homo sapiens
tctgcctgcactc

SEQ ID NO: 5796389 - DNA, 22 bp, Homo sapiens
tctgcctgcactccctggcctt

SEQ ID NO: 5796390 - DNA, 17 bp, Homo sapiens
tctgcctgccagctgca

SEQ ID NO: 5796391 - DNA, 13 bp, Homo sapiens
tctgcctgcccag

SEQ ID NO: 5796392 - DNA, 16 bp, Homo sapiens
tctgcctgcccaggcc

SEQ ID NO: 5796393 - DNA, 22 bp, Homo sapiens
tctgcctgcccaggcccctgcc

SEQ ID NO: 5796394 - DNA, 13 bp, Homo sapiens
tctgcctgcctgc

SEQ ID NO: 5796395 - DNA, 14 bp, Homo sapiens
tctgcctgcctggg

SEQ ID NO: 5796396 - DNA, 15 bp, Homo sapiens
tctgcctgcctggga

SEQ ID NO: 5796397 - DNA, 15 bp, Homo sapiens
tctgcctgcggccca

SEQ ID NO: 5796398 - DNA, 11 bp, Homo sapiens
tctgcctgctg

SEQ ID NO: 5796399 - DNA, 14 bp, Homo sapiens
tctgcctgctgggc

SEQ ID NO: 5796400 - DNA, 17 bp, Homo sapiens
tctgcctgctgggctct

SEQ ID NO: 5796401 - DNA, 18 bp, Homo sapiens
tctgcctgctgggctctt

SEQ ID NO: 5796402 - DNA, 10 bp, Homo sapiens
tctgcctgga

SEQ ID NO: 5796403 - DNA, 20 bp, Homo sapiens
tctgcctggaaagtcctcct

SEQ ID NO: 5796404 - DNA, 23 bp, Homo sapiens
tctgcctggaaattctggaactg

SEQ ID NO: 5796405 - DNA, 23 bp, Homo sapiens
tctgcctggagacaaggtgctaa

SEQ ID NO: 5796406 - DNA, 23 bp, Homo sapiens
tctgcctggagacttagggcacc

SEQ ID NO: 5796407 - DNA, 14 bp, Homo sapiens
tctgcctggagcct

SEQ ID NO: 5796408 - DNA, 18 bp, Homo sapiens
tctgcctggagcctgggc

SEQ ID NO: 5796409 - DNA, 22 bp, Homo sapiens
tctgcctggagcctgggcagca

SEQ ID NO: 5796410 - DNA, 20 bp, Homo sapiens
tctgcctggcctggctcccc

SEQ ID NO: 5796411 - DNA, 21 bp, Homo sapiens
tctgcctgggatgcccttccc

SEQ ID NO: 5796412 - DNA, 23 bp, Homo sapiens
tctgcctgggatgcccttccccc

SEQ ID NO: 5796413 - DNA, 18 bp, Homo sapiens
tctgcctgggcaatggcc

SEQ ID NO: 5796414 - DNA, 23 bp, Homo sapiens
tctgcctgggcaatggccagggg

SEQ ID NO: 5796415 - DNA, 12 bp, Homo sapiens
tctgcctgggcc

SEQ ID NO: 5796416 - DNA, 13 bp, Homo sapiens
tctgcctgggcct

SEQ ID NO: 5796417 - DNA, 16 bp, Homo sapiens
tctgcctgggcctgtg

SEQ ID NO: 5796418 - DNA, 17 bp, Homo sapiens
tctgcctgggcctgtgc

SEQ ID NO: 5796419 - DNA, 22 bp, Homo sapiens
tctgcctgggcctgtgcagcag

SEQ ID NO: 5796420 - DNA, 21 bp, Homo sapiens
tctgcctggtggtcagatgca

SEQ ID NO: 5796421 - DNA, 15 bp, Homo sapiens
tctgcctgtcaagtt

SEQ ID NO: 5796422 - DNA, 23 bp, Homo sapiens
tctgcctgtccccaaacaggaca

SEQ ID NO: 5796423 - DNA, 17 bp, Homo sapiens
tctgcctgtccctctca

SEQ ID NO: 5796424 - DNA, 14 bp, Homo sapiens
tctgcctgtctccc

SEQ ID NO: 5796425 - DNA, 17 bp, Homo sapiens
tctgcctgtgcccgctg

SEQ ID NO: 5796426 - DNA, 14 bp, Homo sapiens
tctgcctgtggcct

SEQ ID NO: 5796427 - DNA, 21 bp, Homo sapiens
tctgcctgtggccttgcccgc

SEQ ID NO: 5796428 - DNA, 13 bp, Homo sapiens
tctgcctgttctg

SEQ ID NO: 5796429 - DNA, 21 bp, Homo sapiens
tctgcctgtttccctcctccc

SEQ ID NO: 5796430 - DNA, 16 bp, Homo sapiens
tctgccttaaaaccaa

SEQ ID NO: 5796431 - DNA, 17 bp, Homo sapiens
tctgccttaaaaccaaa

SEQ ID NO: 5796432 - DNA, 23 bp, Homo sapiens
tctgccttaaacacacattgcag

SEQ ID NO: 5796433 - DNA, 15 bp, Homo sapiens
tctgccttaattttt

SEQ ID NO: 5796434 - DNA, 22 bp, Homo sapiens
tctgccttaatttttgaaaagc

SEQ ID NO: 5796435 - DNA, 16 bp, Homo sapiens
tctgccttagaggagc

SEQ ID NO: 5796436 - DNA, 21 bp, Homo sapiens
tctgccttcacaaatgtcatt

SEQ ID NO: 5796437 - DNA, 11 bp, Homo sapiens
tctgccttcca

SEQ ID NO: 5796438 - DNA, 13 bp, Homo sapiens
tctgccttccttg

SEQ ID NO: 5796439 - DNA, 15 bp, Homo sapiens
tctgccttccttgct

SEQ ID NO: 5796440 - DNA, 17 bp, Homo sapiens
tctgccttctcaggccc

SEQ ID NO: 5796441 - DNA, 13 bp, Homo sapiens
tctgccttctgct

SEQ ID NO: 5796442 - DNA, 15 bp, Homo sapiens
tctgccttctgctga

SEQ ID NO: 5796443 - DNA, 15 bp, Homo sapiens
tctgccttgccctcc

SEQ ID NO: 5796444 - DNA, 17 bp, Homo sapiens
tctgccttgccctcctg

SEQ ID NO: 5796445 - DNA, 23 bp, Homo sapiens
tctgccttgccctcctgggccct

SEQ ID NO: 5796446 - DNA, 12 bp, Homo sapiens
tctgccttgctg

SEQ ID NO: 5796447 - DNA, 14 bp, Homo sapiens
tctgccttgctgca

SEQ ID NO: 5796448 - DNA, 22 bp, Homo sapiens
tctgccttgctgcacctgaggc

SEQ ID NO: 5796449 - DNA, 14 bp, Homo sapiens
tctgccttggacac

SEQ ID NO: 5796450 - DNA, 22 bp, Homo sapiens
tctgccttggttctggccaccc

SEQ ID NO: 5796451 - DNA, 16 bp, Homo sapiens
tctgcctttattgtgt

SEQ ID NO: 5796452 - DNA, 14 bp, Homo sapiens
tctgcctttgacat

SEQ ID NO: 5796453 - DNA, 16 bp, Homo sapiens
tctgcctttgacattt

SEQ ID NO: 5796454 - DNA, 23 bp, Homo sapiens
tctgcctttgacatttaatttag

SEQ ID NO: 5796455 - DNA, 15 bp, Homo sapiens
tctgcctttgagtgt

SEQ ID NO: 5796456 - DNA, 13 bp, Homo sapiens
tctgcctttgcag

SEQ ID NO: 5796457 - DNA, 19 bp, Homo sapiens
tctgcctttgcagaaacag

SEQ ID NO: 5796458 - DNA, 22 bp, Homo sapiens
tctgcctttggggacttttctt

SEQ ID NO: 5796459 - DNA, 20 bp, Homo sapiens
tctgcctttgttcactgtga

SEQ ID NO: 5796460 - DNA, 21 bp, Homo sapiens
tctgcctttgttcactgtgag

SEQ ID NO: 5796461 - DNA, 18 bp, Homo sapiens
tctgcgagaatgaacata

SEQ ID NO: 5796462 - DNA, 18 bp, Homo sapiens
tctgcgattttatctgtt

SEQ ID NO: 5796463 - DNA, 17 bp, Homo sapiens
tctgcgccacttccttt

SEQ ID NO: 5796464 - DNA, 21 bp, Homo sapiens
tctgcgccacttcctttgtgt

SEQ ID NO: 5796465 - DNA, 15 bp, Homo sapiens
tctgcgccaggcaga

SEQ ID NO: 5796466 - DNA, 13 bp, Homo sapiens
tctgcgccccagc

SEQ ID NO: 5796467 - DNA, 16 bp, Homo sapiens
tctgcgccccagcgac

SEQ ID NO: 5796468 - DNA, 19 bp, Homo sapiens
tctgcgccccgcctcccca

SEQ ID NO: 5796469 - DNA, 18 bp, Homo sapiens
tctgcgccgctgtgctgt

SEQ ID NO: 5796470 - DNA, 11 bp, Homo sapiens
tctgcgcctga

SEQ ID NO: 5796471 - DNA, 15 bp, Homo sapiens
tctgcgcctgaaaag

SEQ ID NO: 5796472 - DNA, 23 bp, Homo sapiens
tctgcgcttggtctttctgtgct

SEQ ID NO: 5796473 - DNA, 14 bp, Homo sapiens
tctgcggaccccag

SEQ ID NO: 5796474 - DNA, 16 bp, Homo sapiens
tctgcggaccccagct

SEQ ID NO: 5796475 - DNA, 22 bp, Homo sapiens
tctgcggaccccagctgtgagc

SEQ ID NO: 5796476 - DNA, 23 bp, Homo sapiens
tctgcggagccagcgcctgcccg

SEQ ID NO: 5796477 - DNA, 18 bp, Homo sapiens
tctgcggagcttctccag

SEQ ID NO: 5796478 - DNA, 21 bp, Homo sapiens
tctgcggagcttctccagcca

SEQ ID NO: 5796479 - DNA, 19 bp, Homo sapiens
tctgcggatctcagctttg

SEQ ID NO: 5796480 - DNA, 14 bp, Homo sapiens
tctgcggcagagtc

SEQ ID NO: 5796481 - DNA, 16 bp, Homo sapiens
tctgcggcccgggccg

SEQ ID NO: 5796482 - DNA, 19 bp, Homo sapiens
tctgcggcccgggccgacc

SEQ ID NO: 5796483 - DNA, 14 bp, Homo sapiens
tctgcgggctccct

SEQ ID NO: 5796484 - DNA, 19 bp, Homo sapiens
tctgcgggctccctcctct

SEQ ID NO: 5796485 - DNA, 14 bp, Homo sapiens
tctgcggggctgag

SEQ ID NO: 5796486 - DNA, 21 bp, Homo sapiens
tctggccctctacccctgatc

SEQ ID NO: 5796487 - DNA, 14 bp, Homo sapiens
tctggccctgcctt

SEQ ID NO: 5796488 - DNA, 15 bp, Homo sapiens
tctggccctgccttc

SEQ ID NO: 5796489 - DNA, 16 bp, Homo sapiens
tctggccctgctgccc

SEQ ID NO: 5796490 - DNA, 14 bp, Homo sapiens
tctggccctggcgg

SEQ ID NO: 5796491 - DNA, 11 bp, Homo sapiens
tctggccctgt

SEQ ID NO: 5796492 - DNA, 13 bp, Homo sapiens
tctggccctgttg

SEQ ID NO: 5796493 - DNA, 19 bp, Homo sapiens
tctggcccttacacactca

SEQ ID NO: 5796494 - DNA, 18 bp, Homo sapiens
tctggcccttggaataaa

SEQ ID NO: 5796495 - DNA, 22 bp, Homo sapiens
tctggcccttgggtttcctggt

SEQ ID NO: 5796496 - DNA, 20 bp, Homo sapiens
tctggccggtgctgggttcc

SEQ ID NO: 5796497 - DNA, 22 bp, Homo sapiens
tctggcctaaaatcttggaagt

SEQ ID NO: 5796498 - DNA, 13 bp, Homo sapiens
tctggcctagtcc

SEQ ID NO: 5796499 - DNA, 18 bp, Homo sapiens
tctggcctagtcccttcc

SEQ ID NO: 5796500 - DNA, 18 bp, Homo sapiens
tctggcctatgaccctgt

SEQ ID NO: 5796501 - DNA, 19 bp, Homo sapiens
tctggcctatgaccctgtg

SEQ ID NO: 5796502 - DNA, 15 bp, Homo sapiens
tctggcctcagacca

SEQ ID NO: 5796503 - DNA, 17 bp, Homo sapiens
tctggcctcagcaggaa

SEQ ID NO: 5796504 - DNA, 13 bp, Homo sapiens
tctggcctcccac

SEQ ID NO: 5796505 - DNA, 14 bp, Homo sapiens
tctggcctcccacc

SEQ ID NO: 5796506 - DNA, 12 bp, Homo sapiens
tctggcctccta

SEQ ID NO: 5796507 - DNA, 13 bp, Homo sapiens
tctggcctcctgg

SEQ ID NO: 5796508 - DNA, 15 bp, Homo sapiens
tctggcctctgcttt

SEQ ID NO: 5796509 - DNA, 12 bp, Homo sapiens
tctggcctctgg

SEQ ID NO: 5796510 - DNA, 14 bp, Homo sapiens
tctggcctctggcc

SEQ ID NO: 5796511 - DNA, 16 bp, Homo sapiens
tctggcctctggcctg

SEQ ID NO: 5796512 - DNA, 18 bp, Homo sapiens
tctggcctctggcctggg

SEQ ID NO: 5796513 - DNA, 14 bp, Homo sapiens
tctggcctgccagg

SEQ ID NO: 5796514 - DNA, 13 bp, Homo sapiens
tctggcctggcca

SEQ ID NO: 5796515 - DNA, 17 bp, Homo sapiens
tctggcctggccagtgc

SEQ ID NO: 5796516 - DNA, 19 bp, Homo sapiens
tctggcctggccagtgccc

SEQ ID NO: 5796517 - DNA, 16 bp, Homo sapiens
tctggcctggcctggc

SEQ ID NO: 5796518 - DNA, 20 bp, Homo sapiens
tctggcctggcctggccctg

SEQ ID NO: 5796519 - DNA, 21 bp, Homo sapiens
tctggcctggcctggccctgc

SEQ ID NO: 5796520 - DNA, 22 bp, Homo sapiens
tctggcctggcctggccctgcc

SEQ ID NO: 5796521 - DNA, 19 bp, Homo sapiens
tctggcctgggttttgtgg

SEQ ID NO: 5796522 - DNA, 10 bp, Homo sapiens
tctggccttc

SEQ ID NO: 5796523 - DNA, 15 bp, Homo sapiens
tctggcgagccctta

SEQ ID NO: 5796524 - DNA, 18 bp, Homo sapiens
tctggcgagcccttagcc

SEQ ID NO: 5796525 - DNA, 14 bp, Homo sapiens
tctggcgccagggg

SEQ ID NO: 5796526 - DNA, 16 bp, Homo sapiens
tctggcgccaggggca

SEQ ID NO: 5796527 - DNA, 19 bp, Homo sapiens
tctggcgccaggggcaggc

SEQ ID NO: 5796528 - DNA, 21 bp, Homo sapiens
tctggcgccaggggcaggcag

SEQ ID NO: 5796529 - DNA, 23 bp, Homo sapiens
tctggcgccaggggcaggcagct

SEQ ID NO: 5796530 - DNA, 19 bp, Homo sapiens
tctggcggaggtctctggg

SEQ ID NO: 5796531 - DNA, 15 bp, Homo sapiens
tctggcggcttcctg

SEQ ID NO: 5796532 - DNA, 22 bp, Homo sapiens
tctggcggtggccacagcgtgc

SEQ ID NO: 5796533 - DNA, 16 bp, Homo sapiens
tctggctaaggacagg

SEQ ID NO: 5796534 - DNA, 18 bp, Homo sapiens
tctggctaaggcatcatt

SEQ ID NO: 5796535 - DNA, 16 bp, Homo sapiens
tctggctacctgtttg

SEQ ID NO: 5796536 - DNA, 20 bp, Homo sapiens
tctggctacctgtttgaagg

SEQ ID NO: 5796537 - DNA, 21 bp, Homo sapiens
tctggctacgacttgggacgg

SEQ ID NO: 5796538 - DNA, 18 bp, Homo sapiens
tctggctactccctggac

SEQ ID NO: 5796539 - DNA, 23 bp, Homo sapiens
tctggctactttttcatgtatgt

SEQ ID NO: 5796540 - DNA, 22 bp, Homo sapiens
tctggctagagccgaggggaga

SEQ ID NO: 5796541 - DNA, 17 bp, Homo sapiens
tctggctagaggccagc

SEQ ID NO: 5796542 - DNA, 14 bp, Homo sapiens
tctggctatgcatt

SEQ ID NO: 5796543 - DNA, 17 bp, Homo sapiens
tctggctatgcatttga

SEQ ID NO: 5796544 - DNA, 19 bp, Homo sapiens
tctggctatgcatttgaaa

SEQ ID NO: 5796545 - DNA, 18 bp, Homo sapiens
tctggctcaaagcagcag

SEQ ID NO: 5796546 - DNA, 14 bp, Homo sapiens
tctggctcacagga

SEQ ID NO: 5796547 - DNA, 15 bp, Homo sapiens
tctggctcacaggaa

SEQ ID NO: 5796548 - DNA, 18 bp, Homo sapiens
tctggctcactgcagcct

SEQ ID NO: 5796549 - DNA, 22 bp, Homo sapiens
tctggctcagcccgggatcctg

SEQ ID NO: 5796550 - DNA, 19 bp, Homo sapiens
tctggctcagcctgtctcg

SEQ ID NO: 5796551 - DNA, 16 bp, Homo sapiens
tctggctcagctgtgg

SEQ ID NO: 5796552 - DNA, 21 bp, Homo sapiens
tctggctcagctgtggtccca

SEQ ID NO: 5796553 - DNA, 23 bp, Homo sapiens
tctggctcagggcccacctcctc

SEQ ID NO: 5796554 - DNA, 13 bp, Homo sapiens
tctggctccacac

SEQ ID NO: 5796555 - DNA, 16 bp, Homo sapiens
tctggctccaccggga

SEQ ID NO: 5796556 - DNA, 18 bp, Homo sapiens
tctggctccagaggacct

SEQ ID NO: 5796557 - DNA, 19 bp, Homo sapiens
tctggctccagaggacctg

SEQ ID NO: 5796558 - DNA, 20 bp, Homo sapiens
tctggctccctcttctttca

SEQ ID NO: 5796559 - DNA, 15 bp, Homo sapiens
tctggctccctgccc

SEQ ID NO: 5796560 - DNA, 18 bp, Homo sapiens
tctggctccctgcccctt

SEQ ID NO: 5796561 - DNA, 19 bp, Homo sapiens
tctggctcctcaaacagta

SEQ ID NO: 5796562 - DNA, 13 bp, Homo sapiens
tctggctcctcct

SEQ ID NO: 5796563 - DNA, 22 bp, Homo sapiens
tctggctctaattcacagtgct

SEQ ID NO: 5796564 - DNA, 17 bp, Homo sapiens
tctggctcttccaggct

SEQ ID NO: 5796565 - DNA, 17 bp, Homo sapiens
tctggctgaaaatggtg

SEQ ID NO: 5796566 - DNA, 18 bp, Homo sapiens
tctggctgaaccctgtgc

SEQ ID NO: 5796567 - DNA, 18 bp, Homo sapiens
tctggctgactaaatttg

SEQ ID NO: 5796568 - DNA, 23 bp, Homo sapiens
tctggctgataaaagatacattt

SEQ ID NO: 5796569 - DNA, 22 bp, Homo sapiens
tctggctgccccaacctgctga

SEQ ID NO: 5796570 - DNA, 13 bp, Homo sapiens
tctggctgcctgg

SEQ ID NO: 5796571 - DNA, 18 bp, Homo sapiens
tctggctgctgcagtcag

SEQ ID NO: 5796572 - DNA, 22 bp, Homo sapiens
tctggctggaaagcagagcctc

SEQ ID NO: 5796573 - DNA, 22 bp, Homo sapiens
tctggctggagaggaaaagcca

SEQ ID NO: 5796574 - DNA, 14 bp, Homo sapiens
tctggctgggtcac

SEQ ID NO: 5796575 - DNA, 18 bp, Homo sapiens
tctggctggtagagcagg

SEQ ID NO: 5796576 - DNA, 22 bp, Homo sapiens
tctggctggtcttcactttcct

SEQ ID NO: 5796577 - DNA, 17 bp, Homo sapiens
tctggctggtgttaaca

SEQ ID NO: 5796578 - DNA, 21 bp, Homo sapiens
tctggctgtctagaatgtgga

SEQ ID NO: 5796579 - DNA, 14 bp, Homo sapiens
tctggctgtggccc

SEQ ID NO: 5796580 - DNA, 14 bp, Homo sapiens
tctggctgtggtca

SEQ ID NO: 5796581 - DNA, 14 bp, Homo sapiens
tctggctgtttagc

SEQ ID NO: 5796582 - DNA, 20 bp, Homo sapiens
tctggctgtttagcagaact

SEQ ID NO: 5796583 - DNA, 22 bp, Homo sapiens
tctggctgtttagcagaactca

SEQ ID NO: 5796584 - DNA, 19 bp, Homo sapiens
tctggcttaaacaacacct

SEQ ID NO: 5796585 - DNA, 21 bp, Homo sapiens
tctggcttaaacaacacctcc

SEQ ID NO: 5796586 - DNA, 15 bp, Homo sapiens
tctggcttagaaatt

SEQ ID NO: 5796587 - DNA, 23 bp, Homo sapiens
tctggcttatgctcagaagccag

SEQ ID NO: 5796588 - DNA, 22 bp, Homo sapiens
tctggcttcaaaaagccacagc

SEQ ID NO: 5796589 - DNA, 23 bp, Homo sapiens
tctggcttcaaaaagccacagca

SEQ ID NO: 5796590 - DNA, 21 bp, Homo sapiens
tctggcttcagcccccaccag

SEQ ID NO: 5796591 - DNA, 13 bp, Homo sapiens
tctggcttccagg

SEQ ID NO: 5796592 - DNA, 12 bp, Homo sapiens
tctggcttccct

SEQ ID NO: 5796593 - DNA, 14 bp, Homo sapiens
tctggcttccctgg

SEQ ID NO: 5796594 - DNA, 17 bp, Homo sapiens
tctggcttccctggaag

SEQ ID NO: 5796595 - DNA, 18 bp, Homo sapiens
tctggcttcctgctgagt

SEQ ID NO: 5796596 - DNA, 15 bp, Homo sapiens
tctggcttctctctt

SEQ ID NO: 5796597 - DNA, 21 bp, Homo sapiens
tctggcttctctcttttcctc

SEQ ID NO: 5796598 - DNA, 15 bp, Homo sapiens
tctggcttctgcatt

SEQ ID NO: 5796599 - DNA, 15 bp, Homo sapiens
tctggcttctgcttc

SEQ ID NO: 5796600 - DNA, 18 bp, Homo sapiens
tctggcttctggccagga

SEQ ID NO: 5796601 - DNA, 19 bp, Homo sapiens
tctggcttctggccaggaa

SEQ ID NO: 5796602 - DNA, 19 bp, Homo sapiens
tctggcttgccccaggact

SEQ ID NO: 5796603 - DNA, 17 bp, Homo sapiens
tctggctttaagccttc

SEQ ID NO: 5796604 - DNA, 23 bp, Homo sapiens
tctggctttgggcaggtctgaga

SEQ ID NO: 5796605 - DNA, 19 bp, Homo sapiens
tctggctttgttcttgtca

SEQ ID NO: 5796606 - DNA, 23 bp, Homo sapiens
tctggcttttcgcttgcttctgc

SEQ ID NO: 5796607 - DNA, 19 bp, Homo sapiens
tctggctttttcctctgag

SEQ ID NO: 5796608 - DNA, 17 bp, Homo sapiens
tctggctttttctgcca

SEQ ID NO: 5796609 - DNA, 18 bp, Homo sapiens
tctggctttttctgccac

SEQ ID NO: 5796610 - DNA, 17 bp, Homo sapiens
tctgggaaaatacccca

SEQ ID NO: 5796611 - DNA, 18 bp, Homo sapiens
tctgggaaagcagagtgg

SEQ ID NO: 5796612 - DNA, 20 bp, Homo sapiens
tctgggaaaggtgctcaaag

SEQ ID NO: 5796613 - DNA, 23 bp, Homo sapiens
tctgggaaaggtgctcaaagatg

SEQ ID NO: 5796614 - DNA, 20 bp, Homo sapiens
tctgggaaattgaagtgtct

SEQ ID NO: 5796615 - DNA, 16 bp, Homo sapiens
tctgggaacctcccag

SEQ ID NO: 5796616 - DNA, 20 bp, Homo sapiens
tctgggaacctcccagaggt

SEQ ID NO: 5796617 - DNA, 10 bp, Homo sapiens
tctgggaaga

SEQ ID NO: 5796618 - DNA, 15 bp, Homo sapiens
tctgggaagaatgtc

SEQ ID NO: 5796619 - DNA, 18 bp, Homo sapiens
tctgggaagatttgaaaa

SEQ ID NO: 5796620 - DNA, 21 bp, Homo sapiens
tctgggaagatttgaaaacaa

SEQ ID NO: 5796621 - DNA, 15 bp, Homo sapiens
tctgggaaggcaaca

SEQ ID NO: 5796622 - DNA, 12 bp, Homo sapiens
tctgggaaggga

SEQ ID NO: 5796623 - DNA, 19 bp, Homo sapiens
tctgggaagggagagggcc

SEQ ID NO: 5796624 - DNA, 18 bp, Homo sapiens
tctgggaagtcctagccc

SEQ ID NO: 5796625 - DNA, 21 bp, Homo sapiens
tctgggaagtcctagcccctc

SEQ ID NO: 5796626 - DNA, 22 bp, Homo sapiens
tctgggaatcatgtccatccct

SEQ ID NO: 5796627 - DNA, 18 bp, Homo sapiens
tctgggaatgggagaggg

SEQ ID NO: 5796628 - DNA, 14 bp, Homo sapiens
tctgggaatgtata

SEQ ID NO: 5796629 - DNA, 17 bp, Homo sapiens
tctgggaatgtatagta

SEQ ID NO: 5796630 - DNA, 15 bp, Homo sapiens
tctgggacagggagg

SEQ ID NO: 5796631 - DNA, 14 bp, Homo sapiens
tctgggacccacag

SEQ ID NO: 5796632 - DNA, 19 bp, Homo sapiens
tctgggaccctttccttcc

SEQ ID NO: 5796633 - DNA, 21 bp, Homo sapiens
tctgggacctgccaggcaggg

SEQ ID NO: 5796634 - DNA, 14 bp, Homo sapiens
tctgggactccagg

SEQ ID NO: 5796635 - DNA, 21 bp, Homo sapiens
tctgggactctcctcctcccc

SEQ ID NO: 5796636 - DNA, 22 bp, Homo sapiens
tctgggactctcctcctcccct

SEQ ID NO: 5796637 - DNA, 20 bp, Homo sapiens
tctgggactgtgcctggctc

SEQ ID NO: 5796638 - DNA, 24 bp, Homo sapiens
tctgggactgtgcctggctccctg

SEQ ID NO: 5796639 - DNA, 17 bp, Homo sapiens
tctgggacttccttgct

SEQ ID NO: 5796640 - DNA, 17 bp, Homo sapiens
tctgggacttgaaatca

SEQ ID NO: 5796641 - DNA, 13 bp, Homo sapiens
tctgggagaggat

SEQ ID NO: 5796642 - DNA, 21 bp, Homo sapiens
tctgggagcagaaacagccat

SEQ ID NO: 5796643 - DNA, 16 bp, Homo sapiens
tctgggagccacgcct

SEQ ID NO: 5796644 - DNA, 21 bp, Homo sapiens
tctgggagccagagcctctgt

SEQ ID NO: 5796645 - DNA, 18 bp, Homo sapiens
tctgggagcccagaaccc

SEQ ID NO: 5796646 - DNA, 19 bp, Homo sapiens
tctgggaggaatggacaga

SEQ ID NO: 5796647 - DNA, 17 bp, Homo sapiens
tctgggaggcaagaaaa

SEQ ID NO: 5796648 - DNA, 20 bp, Homo sapiens
tctgggaggcaagaaaagga

SEQ ID NO: 5796649 - DNA, 20 bp, Homo sapiens
tctgggaggcagaacaggct

SEQ ID NO: 5796650 - DNA, 22 bp, Homo sapiens
tctgggaggctggtctccctcc

SEQ ID NO: 5796651 - DNA, 13 bp, Homo sapiens
tctgggagggcag

SEQ ID NO: 5796652 - DNA, 21 bp, Homo sapiens
tctgggagggcagcagggcta

SEQ ID NO: 5796653 - DNA, 11 bp, Homo sapiens
tctgggagggg

SEQ ID NO: 5796654 - DNA, 16 bp, Homo sapiens
tctgggaggggtgctg

SEQ ID NO: 5796655 - DNA, 13 bp, Homo sapiens
tctgggaggtctc

SEQ ID NO: 5796656 - DNA, 19 bp, Homo sapiens
tctgggaggtctccactga

SEQ ID NO: 5796657 - DNA, 15 bp, Homo sapiens
tctgggagtcaggcc

SEQ ID NO: 5796658 - DNA, 13 bp, Homo sapiens
tctgggagtcctg

SEQ ID NO: 5796659 - DNA, 14 bp, Homo sapiens
tctgggagtcctgt

SEQ ID NO: 5796660 - DNA, 19 bp, Homo sapiens
tctgggagtggggaagtga

SEQ ID NO: 5796661 - DNA, 20 bp, Homo sapiens
tctgggagtgttctgtttcc

SEQ ID NO: 5796662 - DNA, 21 bp, Homo sapiens
tctgggagtgttctgtttccc

SEQ ID NO: 5796663 - DNA, 19 bp, Homo sapiens
tctgtacagaatgctattt

SEQ ID NO: 5796664 - DNA, 18 bp, Homo sapiens
tctgtacagattcagcct

SEQ ID NO: 5796665 - DNA, 11 bp, Homo sapiens
tctgtacatac

SEQ ID NO: 5796666 - DNA, 17 bp, Homo sapiens
tctgtacatactggcct

SEQ ID NO: 5796667 - DNA, 18 bp, Homo sapiens
tctgtacatctctactta

SEQ ID NO: 5796668 - DNA, 15 bp, Homo sapiens
tctgtacatgttctt

SEQ ID NO: 5796669 - DNA, 19 bp, Homo sapiens
tctgtacattttgttgtaa

SEQ ID NO: 5796670 - DNA, 13 bp, Homo sapiens
tctgtacattttt

SEQ ID NO: 5796671 - DNA, 19 bp, Homo sapiens
tctgtaccctgcttcccaa

SEQ ID NO: 5796672 - DNA, 17 bp, Homo sapiens
tctgtaccgcccggcag

SEQ ID NO: 5796673 - DNA, 17 bp, Homo sapiens
tctgtacctcaaatgaa

SEQ ID NO: 5796674 - DNA, 20 bp, Homo sapiens
tctgtacgaggcttctctaa

SEQ ID NO: 5796675 - DNA, 17 bp, Homo sapiens
tctgtacgtctgacagg

SEQ ID NO: 5796676 - DNA, 22 bp, Homo sapiens
tctgtactaaacatttcctttt

SEQ ID NO: 5796677 - DNA, 18 bp, Homo sapiens
tctgtactatctagtgtc

SEQ ID NO: 5796678 - DNA, 13 bp, Homo sapiens
tctgtactgaaag

SEQ ID NO: 5796679 - DNA, 18 bp, Homo sapiens
tctgtactgaaagcaaat

SEQ ID NO: 5796680 - DNA, 12 bp, Homo sapiens
tctgtactgtaa

SEQ ID NO: 5796681 - DNA, 13 bp, Homo sapiens
tctgtactttttg

SEQ ID NO: 5796682 - DNA, 14 bp, Homo sapiens
tctgtactttttgg

SEQ ID NO: 5796683 - DNA, 15 bp, Homo sapiens
tctgtacttttttca

SEQ ID NO: 5796684 - DNA, 16 bp, Homo sapiens
tctgtacttttttcaa

SEQ ID NO: 5796685 - DNA, 17 bp, Homo sapiens
tctgtacttttttcaaa

SEQ ID NO: 5796686 - DNA, 19 bp, Homo sapiens
tctgtacttttttcaaata

SEQ ID NO: 5796687 - DNA, 18 bp, Homo sapiens
tctgtagaaagaatgtgt

SEQ ID NO: 5796688 - DNA, 17 bp, Homo sapiens
tctgtagaaatggttgt

SEQ ID NO: 5796689 - DNA, 18 bp, Homo sapiens
tctgtagaatgctgtaga

SEQ ID NO: 5796690 - DNA, 21 bp, Homo sapiens
tctgtagaatgctgtagaatc

SEQ ID NO: 5796691 - DNA, 14 bp, Homo sapiens
tctgtagaatttag

SEQ ID NO: 5796692 - DNA, 18 bp, Homo sapiens
tctgtagacttttgaaaa

SEQ ID NO: 5796693 - DNA, 16 bp, Homo sapiens
tctgtagagaatgaaa

SEQ ID NO: 5796694 - DNA, 16 bp, Homo sapiens
tctgtagagcagggca

SEQ ID NO: 5796695 - DNA, 15 bp, Homo sapiens
tctgtagagccaatt

SEQ ID NO: 5796696 - DNA, 18 bp, Homo sapiens
tctgtagagggccctggt

SEQ ID NO: 5796697 - DNA, 16 bp, Homo sapiens
tctgtagcaaatttgt

SEQ ID NO: 5796698 - DNA, 23 bp, Homo sapiens
tctgtagcaaatttgtttaatct

SEQ ID NO: 5796699 - DNA, 20 bp, Homo sapiens
tctgtagccacctccttggc

SEQ ID NO: 5796700 - DNA, 15 bp, Homo sapiens
tctgtagccactagt

SEQ ID NO: 5796701 - DNA, 23 bp, Homo sapiens
tctgtagcctgaagagtttgtaa

SEQ ID NO: 5796702 - DNA, 20 bp, Homo sapiens
tctgtagcctggtctgtgca

SEQ ID NO: 5796703 - DNA, 19 bp, Homo sapiens
tctgtagctattctttgac

SEQ ID NO: 5796704 - DNA, 18 bp, Homo sapiens
tctgtagctccctcctcc

SEQ ID NO: 5796705 - DNA, 19 bp, Homo sapiens
tctgtagctccctcctccc

SEQ ID NO: 5796706 - DNA, 22 bp, Homo sapiens
tctgtagctccctcctcccatc

SEQ ID NO: 5796707 - DNA, 17 bp, Homo sapiens
tctgtagcttaaaccaa

SEQ ID NO: 5796708 - DNA, 22 bp, Homo sapiens
tctgtagcttatctgcccctcc

SEQ ID NO: 5796709 - DNA, 16 bp, Homo sapiens
tctgtagctttctgga

SEQ ID NO: 5796710 - DNA, 17 bp, Homo sapiens
tctgtagctttctggaa

SEQ ID NO: 5796711 - DNA, 19 bp, Homo sapiens
tctgtaggatcgtaaaaaa

SEQ ID NO: 5796712 - DNA, 19 bp, Homo sapiens
tctgtaggcacagagctgc

SEQ ID NO: 5796713 - DNA, 14 bp, Homo sapiens
tctgtagggctgga

SEQ ID NO: 5796714 - DNA, 17 bp, Homo sapiens
tctgtagggctggacct

SEQ ID NO: 5796715 - DNA, 17 bp, Homo sapiens
tctgtaggttgcacact

SEQ ID NO: 5796716 - DNA, 23 bp, Homo sapiens
tctgtagtaaaatgttttcattt

SEQ ID NO: 5796717 - DNA, 23 bp, Homo sapiens
tctgtagtaatttattgtctgtc

SEQ ID NO: 5796718 - DNA, 18 bp, Homo sapiens
tctgtagtcatttactaa

SEQ ID NO: 5796719 - DNA, 14 bp, Homo sapiens
tctgtagtgagata

SEQ ID NO: 5796720 - DNA, 23 bp, Homo sapiens
tctgtagtgtattaatctctgtg

SEQ ID NO: 5796721 - DNA, 24 bp, Homo sapiens
tctgtagtgtattaatctctgtgt

SEQ ID NO: 5796722 - DNA, 22 bp, Homo sapiens
tctgtagttgcagctgatgcct

SEQ ID NO: 5796723 - DNA, 23 bp, Homo sapiens
tctgtataaacattaaatgtctt

SEQ ID NO: 5796724 - DNA, 15 bp, Homo sapiens
tctgtataaataaga

SEQ ID NO: 5796725 - DNA, 14 bp, Homo sapiens
tctgtataaatgtc

SEQ ID NO: 5796726 - DNA, 17 bp, Homo sapiens
tctgtataaatgtctat

SEQ ID NO: 5796727 - DNA, 16 bp, Homo sapiens
tctgtataaatgtgaa

SEQ ID NO: 5796728 - DNA, 16 bp, Homo sapiens
tctgtataatagagat

SEQ ID NO: 5796729 - DNA, 14 bp, Homo sapiens
tctgtataatctat

SEQ ID NO: 5796730 - DNA, 15 bp, Homo sapiens
tctgtatacaaccct

SEQ ID NO: 5796731 - DNA, 15 bp, Homo sapiens
tctgtatactcctgt

SEQ ID NO: 5796732 - DNA, 15 bp, Homo sapiens
tctgtatactgtaaa

SEQ ID NO: 5796733 - DNA, 21 bp, Homo sapiens
tctgtatactgtaaaagttat

SEQ ID NO: 5796734 - DNA, 14 bp, Homo sapiens
tctgtatactgtgg

SEQ ID NO: 5796735 - DNA, 16 bp, Homo sapiens
tctgtatagaaatcta

SEQ ID NO: 5796736 - DNA, 23 bp, Homo sapiens
tctgtatagacaggagaagaaag

SEQ ID NO: 5796737 - DNA, 19 bp, Homo sapiens
tctgtatagattataaaat

SEQ ID NO: 5796738 - DNA, 14 bp, Homo sapiens
tctgtatataaatg

SEQ ID NO: 5796739 - DNA, 17 bp, Homo sapiens
tctgtatataaatggga

SEQ ID NO: 5796740 - DNA, 17 bp, Homo sapiens
tctgtatataacttatt

SEQ ID NO: 5796741 - DNA, 13 bp, Homo sapiens
tctgtatatacat

SEQ ID NO: 5796742 - DNA, 19 bp, Homo sapiens
tctgtatatagatgtctgt

SEQ ID NO: 5796743 - DNA, 16 bp, Homo sapiens
tctgtatatagctcta

SEQ ID NO: 5796744 - DNA, 20 bp, Homo sapiens
tctgtatatagctctacaca

SEQ ID NO: 5796745 - DNA, 22 bp, Homo sapiens
tctgtatatgattctctgtggt

SEQ ID NO: 5796746 - DNA, 13 bp, Homo sapiens
tctgtatattggg

SEQ ID NO: 5796747 - DNA, 20 bp, Homo sapiens
tctgtatatttatgaccaga

SEQ ID NO: 5796748 - DNA, 14 bp, Homo sapiens
tctgtatatttgtc

SEQ ID NO: 5796749 - DNA, 15 bp, Homo sapiens
tctgtatatttgtca

SEQ ID NO: 5796750 - DNA, 16 bp, Homo sapiens
tctgtatattttggga

SEQ ID NO: 5796751 - DNA, 20 bp, Homo sapiens
tctgtatcaggacccagagg

SEQ ID NO: 5796752 - DNA, 14 bp, Homo sapiens
tctgtatcatcagt

SEQ ID NO: 5796753 - DNA, 14 bp, Homo sapiens
tctgtatccccagt

SEQ ID NO: 5796754 - DNA, 19 bp, Homo sapiens
tctgtatccgtgaattgct

SEQ ID NO: 5796755 - DNA, 21 bp, Homo sapiens
tctgtatccgtgaattgcttt

SEQ ID NO: 5796756 - DNA, 16 bp, Homo sapiens
tctgtatctagaaaga

SEQ ID NO: 5796757 - DNA, 19 bp, Homo sapiens
tctgtatctagaaagagat

SEQ ID NO: 5796758 - DNA, 12 bp, Homo sapiens
tctgtatctctc

SEQ ID NO: 5796759 - DNA, 12 bp, Homo sapiens
tctgtatgcatc

SEQ ID NO: 5796760 - DNA, 14 bp, Homo sapiens
tctgtatggcatga

SEQ ID NO: 5796761 - DNA, 13 bp, Homo sapiens
tctgtatggtcag

SEQ ID NO: 5796762 - DNA, 19 bp, Homo sapiens
tctgtatgtgacaacattt

SEQ ID NO: 5796763 - DNA, 23 bp, Homo sapiens
tctgtattaatccccatcattac

SEQ ID NO: 5796764 - DNA, 20 bp, Homo sapiens
tctgtattcatacagcacta

SEQ ID NO: 5796765 - DNA, 16 bp, Homo sapiens
tctgtattcctgatat

SEQ ID NO: 5796766 - DNA, 18 bp, Homo sapiens
tctgtattgaaaatggct

SEQ ID NO: 5796767 - DNA, 17 bp, Homo sapiens
tctgtattggcagcaca

SEQ ID NO: 5796768 - DNA, 18 bp, Homo sapiens
tctgtatttaatggtttt

SEQ ID NO: 5796769 - DNA, 20 bp, Homo sapiens
tctgtatttaatggttttta

SEQ ID NO: 5796770 - DNA, 15 bp, Homo sapiens
tctgtatttaatttt

SEQ ID NO: 5796771 - DNA, 17 bp, Homo sapiens
tctgtatttattatttg

SEQ ID NO: 5796772 - DNA, 13 bp, Homo sapiens
tctgtatttctag

SEQ ID NO: 5796773 - DNA, 15 bp, Homo sapiens
tctgtatttgaaagt

SEQ ID NO: 5796774 - DNA, 18 bp, Homo sapiens
tctgtatttgaaagtgcc

SEQ ID NO: 5796775 - DNA, 15 bp, Homo sapiens
tctgtattttcatgt

SEQ ID NO: 5796776 - DNA, 15 bp, Homo sapiens
tctgtattttccacc

SEQ ID NO: 5796777 - DNA, 19 bp, Homo sapiens
tctgtatttttaaattctg

SEQ ID NO: 5796778 - DNA, 15 bp, Homo sapiens
tctgtatttttctaa

SEQ ID NO: 5796779 - DNA, 23 bp, Homo sapiens
tctgtattttttcttgcattgac

SEQ ID NO: 5796780 - DNA, 20 bp, Homo sapiens
tctgtattttttgtttgtat

SEQ ID NO: 5796781 - DNA, 22 bp, Homo sapiens
tctgtattttttgtttgtattg

SEQ ID NO: 5796782 - DNA, 17 bp, Homo sapiens
tctgtcaaaacactgtg

SEQ ID NO: 5796783 - DNA, 18 bp, Homo sapiens
tctgtcaaaacactgtgg

SEQ ID NO: 5796784 - DNA, 15 bp, Homo sapiens
tctgtcacaccagcc

SEQ ID NO: 5796785 - DNA, 14 bp, Homo sapiens
tctgtcacaggctg

SEQ ID NO: 5796786 - DNA, 15 bp, Homo sapiens
tctgtcacaggctgg

SEQ ID NO: 5796787 - DNA, 20 bp, Homo sapiens
tctgtcacataaaagtctgt

SEQ ID NO: 5796788 - DNA, 19 bp, Homo sapiens
tctgtcaccaattggttaa

SEQ ID NO: 5796789 - DNA, 19 bp, Homo sapiens
tctgtcaccagctatctgt

SEQ ID NO: 5796790 - DNA, 20 bp, Homo sapiens
tctgtcaccagctatctgtc

SEQ ID NO: 5796791 - DNA, 22 bp, Homo sapiens
tctgtcacccagtctgttgctg

SEQ ID NO: 5796792 - DNA, 18 bp, Homo sapiens
tctgtcacgtgaaatatt

SEQ ID NO: 5796793 - DNA, 23 bp, Homo sapiens
tctgtcactaaatggcagtgaga

SEQ ID NO: 5796794 - DNA, 12 bp, Homo sapiens
tctgtcactcag

SEQ ID NO: 5796795 - DNA, 11 bp, Homo sapiens
tctgtcactga

SEQ ID NO: 5796796 - DNA, 14 bp, Homo sapiens
tctgtcactgagca

SEQ ID NO: 5796797 - DNA, 13 bp, Homo sapiens
tctgtcacttaat

SEQ ID NO: 5796798 - DNA, 20 bp, Homo sapiens
tctgtcacttgcattccact

SEQ ID NO: 5796799 - DNA, 18 bp, Homo sapiens
tctgtcagaagacactaa

SEQ ID NO: 5796800 - DNA, 18 bp, Homo sapiens
tctgtcagaatgctattg

SEQ ID NO: 5796801 - DNA, 21 bp, Homo sapiens
tctgtcagatgagaacaaagc

SEQ ID NO: 5796802 - DNA, 19 bp, Homo sapiens
tctgtcagcatctggctgt

SEQ ID NO: 5796803 - DNA, 20 bp, Homo sapiens
tctgtcagccagccgccctg

SEQ ID NO: 5796804 - DNA, 21 bp, Homo sapiens
tctgtcagccagccgccctgg

SEQ ID NO: 5796805 - DNA, 21 bp, Homo sapiens
tctgtcagcttcccaacaata

SEQ ID NO: 5796806 - DNA, 16 bp, Homo sapiens
tctgtcaggggcttgg

SEQ ID NO: 5796807 - DNA, 18 bp, Homo sapiens
tctgtcaggggcttggat

SEQ ID NO: 5796808 - DNA, 21 bp, Homo sapiens
tctgtcagggttggaaagtcc

SEQ ID NO: 5796809 - DNA, 15 bp, Homo sapiens
tctgtcagtaaaact

SEQ ID NO: 5796810 - DNA, 13 bp, Homo sapiens
tctgtcagtcatg

SEQ ID NO: 5796811 - DNA, 18 bp, Homo sapiens
tctgtcagtgagtcagag

SEQ ID NO: 5796812 - DNA, 15 bp, Homo sapiens
tctgtcagtgtgaaa

SEQ ID NO: 5796813 - DNA, 15 bp, Homo sapiens
tctgtcatcactccc

SEQ ID NO: 5796814 - DNA, 18 bp, Homo sapiens
tctgtcatcactccctgg

SEQ ID NO: 5796815 - DNA, 19 bp, Homo sapiens
tctgtcatccatatttgct

SEQ ID NO: 5796816 - DNA, 20 bp, Homo sapiens
tctgtcatcccgctcctgct

SEQ ID NO: 5796817 - DNA, 17 bp, Homo sapiens
tctgtcatcctcaggaa

SEQ ID NO: 5796818 - DNA, 17 bp, Homo sapiens
tctgtcatctctctggg

SEQ ID NO: 5796819 - DNA, 17 bp, Homo sapiens
tctgtcattgtaccctt

SEQ ID NO: 5796820 - DNA, 19 bp, Homo sapiens
tctgtcatttctctttcaa

SEQ ID NO: 5796821 - DNA, 15 bp, Homo sapiens
tctgtcatttgagca

SEQ ID NO: 5796822 - DNA, 13 bp, Homo sapiens
tctgtcatttgtt

SEQ ID NO: 5796823 - DNA, 17 bp, Homo sapiens
tctgtccaaaggaggct

SEQ ID NO: 5796824 - DNA, 18 bp, Homo sapiens
tctgtccaactgagaagt

SEQ ID NO: 5796825 - DNA, 13 bp, Homo sapiens
tctgtccaaggca

SEQ ID NO: 5796826 - DNA, 21 bp, Homo sapiens
tctgtccaattccagagctgt

SEQ ID NO: 5796827 - DNA, 14 bp, Homo sapiens
tctgtccacatccc

SEQ ID NO: 5796828 - DNA, 19 bp, Homo sapiens
tctgtccacatccccagag

SEQ ID NO: 5796829 - DNA, 20 bp, Homo sapiens
tctgtccacatccccagagc

SEQ ID NO: 5796830 - DNA, 21 bp, Homo sapiens
tctgtccacatccccagagcc

SEQ ID NO: 5796831 - DNA, 22 bp, Homo sapiens
tctgtccacatccccagagccc

SEQ ID NO: 5796832 - DNA, 17 bp, Homo sapiens
tctgtccacctcggcct

SEQ ID NO: 5796833 - DNA, 13 bp, Homo sapiens
tctgtccactctg

SEQ ID NO: 5796834 - DNA, 23 bp, Homo sapiens
tctgtccagccgtgtgtgcatgt

SEQ ID NO: 5796835 - DNA, 13 bp, Homo sapiens
tctgtccaggcca

SEQ ID NO: 5796836 - DNA, 16 bp, Homo sapiens
tctgtccaggccactg

SEQ ID NO: 5796837 - DNA, 18 bp, Homo sapiens
tctgtccaggccactgtg

SEQ ID NO: 5796838 - DNA, 12 bp, Homo sapiens
tctgtccagggc

SEQ ID NO: 5796839 - DNA, 17 bp, Homo sapiens
tctgtccagggccctga

SEQ ID NO: 5796840 - DNA, 14 bp, Homo sapiens
tctgtccatcctcc

SEQ ID NO: 5796841 - DNA, 23 bp, Homo sapiens
tctgtgtaacatccaagccagag

SEQ ID NO: 5796842 - DNA, 21 bp, Homo sapiens
tctgtgtaactttaaacatct

SEQ ID NO: 5796843 - DNA, 18 bp, Homo sapiens
tctgtgtaagaaaacaaa

SEQ ID NO: 5796844 - DNA, 19 bp, Homo sapiens
tctgtgtaagacacgtgca

SEQ ID NO: 5796845 - DNA, 17 bp, Homo sapiens
tctgtgtaatctctgat

SEQ ID NO: 5796846 - DNA, 16 bp, Homo sapiens
tctgtgtacaaagaaa

SEQ ID NO: 5796847 - DNA, 16 bp, Homo sapiens
tctgtgtacaatttta

SEQ ID NO: 5796848 - DNA, 13 bp, Homo sapiens
tctgtgtacataa

SEQ ID NO: 5796849 - DNA, 14 bp, Homo sapiens
tctgtgtacataaa

SEQ ID NO: 5796850 - DNA, 18 bp, Homo sapiens
tctgtgtaccacttctgt

SEQ ID NO: 5796851 - DNA, 20 bp, Homo sapiens
tctgtgtagaaactggaagc

SEQ ID NO: 5796852 - DNA, 13 bp, Homo sapiens
tctgtgtagacat

SEQ ID NO: 5796853 - DNA, 15 bp, Homo sapiens
tctgtgtagccgccc

SEQ ID NO: 5796854 - DNA, 23 bp, Homo sapiens
tctgtgtagtagctcgtgtgctt

SEQ ID NO: 5796855 - DNA, 12 bp, Homo sapiens
tctgtgtataca

SEQ ID NO: 5796856 - DNA, 16 bp, Homo sapiens
tctgtgtatacatatg

SEQ ID NO: 5796857 - DNA, 17 bp, Homo sapiens
tctgtgtatacatatgt

SEQ ID NO: 5796858 - DNA, 19 bp, Homo sapiens
tctgtgtatacatatgtat

SEQ ID NO: 5796859 - DNA, 18 bp, Homo sapiens
tctgtgtatattatttgg

SEQ ID NO: 5796860 - DNA, 20 bp, Homo sapiens
tctgtgtatttaattgtaaa

SEQ ID NO: 5796861 - DNA, 22 bp, Homo sapiens
tctgtgtatttaattgtaaact

SEQ ID NO: 5796862 - DNA, 21 bp, Homo sapiens
tctgtgtatttatataaaaat

SEQ ID NO: 5796863 - DNA, 20 bp, Homo sapiens
tctgtgtcacgtgaccctgt

SEQ ID NO: 5796864 - DNA, 22 bp, Homo sapiens
tctgtgtcacgtgaccctgtgc

SEQ ID NO: 5796865 - DNA, 15 bp, Homo sapiens
tctgtgtcactggct

SEQ ID NO: 5796866 - DNA, 15 bp, Homo sapiens
tctgtgtcagcctgt

SEQ ID NO: 5796867 - DNA, 17 bp, Homo sapiens
tctgtgtcaggtggggc

SEQ ID NO: 5796868 - DNA, 16 bp, Homo sapiens
tctgtgtcatttcttc

SEQ ID NO: 5796869 - DNA, 14 bp, Homo sapiens
tctgtgtccaatta

SEQ ID NO: 5796870 - DNA, 14 bp, Homo sapiens
tctgtgtcccagca

SEQ ID NO: 5796871 - DNA, 15 bp, Homo sapiens
tctgtgtcccagcca

SEQ ID NO: 5796872 - DNA, 18 bp, Homo sapiens
tctgtgtcccagccacgc

SEQ ID NO: 5796873 - DNA, 20 bp, Homo sapiens
tctgtgtccgtctgtgtatg

SEQ ID NO: 5796874 - DNA, 14 bp, Homo sapiens
tctgtgtcctcgca

SEQ ID NO: 5796875 - DNA, 15 bp, Homo sapiens
tctgtgtcctctgcc

SEQ ID NO: 5796876 - DNA, 15 bp, Homo sapiens
tctgtgtccttccct

SEQ ID NO: 5796877 - DNA, 14 bp, Homo sapiens
tctgtgtctaagat

SEQ ID NO: 5796878 - DNA, 12 bp, Homo sapiens
tctgtgtctctt

SEQ ID NO: 5796879 - DNA, 13 bp, Homo sapiens
tctgtgtctgctg

SEQ ID NO: 5796880 - DNA, 14 bp, Homo sapiens
tctgtgtctggcag

SEQ ID NO: 5796881 - DNA, 13 bp, Homo sapiens
tctgtgtctgtgt

SEQ ID NO: 5796882 - DNA, 12 bp, Homo sapiens
tctgtgtcttgt

SEQ ID NO: 5796883 - DNA, 14 bp, Homo sapiens
tctgtgtctttctc

SEQ ID NO: 5796884 - DNA, 13 bp, Homo sapiens
tctgtgtgaaaat

SEQ ID NO: 5796885 - DNA, 21 bp, Homo sapiens
tctgtgtgaaactttcattcc

SEQ ID NO: 5796886 - DNA, 20 bp, Homo sapiens
tctgtgtgatgaactttctc

SEQ ID NO: 5796887 - DNA, 14 bp, Homo sapiens
tctgtgtgcacaaa

SEQ ID NO: 5796888 - DNA, 15 bp, Homo sapiens
tctgtgtgcagcaac

SEQ ID NO: 5796889 - DNA, 12 bp, Homo sapiens
tctgtgtgccct

SEQ ID NO: 5796890 - DNA, 21 bp, Homo sapiens
tctgtgtgccctagggctcag

SEQ ID NO: 5796891 - DNA, 14 bp, Homo sapiens
tctgtgtgctacta

SEQ ID NO: 5796892 - DNA, 14 bp, Homo sapiens
tctgtgtgctgtgg

SEQ ID NO: 5796893 - DNA, 18 bp, Homo sapiens
tctgtgtggcaaacattt

SEQ ID NO: 5796894 - DNA, 19 bp, Homo sapiens
tctgtgtggcaaacattta

SEQ ID NO: 5796895 - DNA, 16 bp, Homo sapiens
tctgtgtggctgtgca

SEQ ID NO: 5796896 - DNA, 21 bp, Homo sapiens
tctgtgtgggactgtacacac

SEQ ID NO: 5796897 - DNA, 23 bp, Homo sapiens
tctgtgtggggttctcagtgccg

SEQ ID NO: 5796898 - DNA, 23 bp, Homo sapiens
tctgtgtggtatatttgtgtatg

SEQ ID NO: 5796899 - DNA, 23 bp, Homo sapiens
tctgtgtggtctccagctcctct

SEQ ID NO: 5796900 - DNA, 14 bp, Homo sapiens
tctgtgtggtgaaa

SEQ ID NO: 5796901 - DNA, 16 bp, Homo sapiens
tctgtgtggtgcattc

SEQ ID NO: 5796902 - DNA, 16 bp, Homo sapiens
tctgtgtggtggagcc

SEQ ID NO: 5796903 - DNA, 21 bp, Homo sapiens
tctgtgtggtggagccagggc

SEQ ID NO: 5796904 - DNA, 19 bp, Homo sapiens
tctgtgtgtagccaggaag

SEQ ID NO: 5796905 - DNA, 16 bp, Homo sapiens
tctgtgtgtgacacca

SEQ ID NO: 5796906 - DNA, 20 bp, Homo sapiens
tctgtgtgtgacccctcctg

SEQ ID NO: 5796907 - DNA, 21 bp, Homo sapiens
tctgtgtgtgacccctcctgg

SEQ ID NO: 5796908 - DNA, 23 bp, Homo sapiens
tctgtgtgtgacccctcctgggg

SEQ ID NO: 5796909 - DNA, 11 bp, Homo sapiens
tctgtgtgtgt

SEQ ID NO: 5796910 - DNA, 15 bp, Homo sapiens
tctgtgtgtgtatga

SEQ ID NO: 5796911 - DNA, 15 bp, Homo sapiens
tctgtgtgtgttctt

SEQ ID NO: 5796912 - DNA, 12 bp, Homo sapiens
tctgtgttactc

SEQ ID NO: 5796913 - DNA, 16 bp, Homo sapiens
tctgtgttatttggac

SEQ ID NO: 5796914 - DNA, 14 bp, Homo sapiens
tctgtgttcatttt

SEQ ID NO: 5796915 - DNA, 20 bp, Homo sapiens
tctgtgttctcaacacacag

SEQ ID NO: 5796916 - DNA, 16 bp, Homo sapiens
tctgtgttgccaagct

SEQ ID NO: 5796917 - DNA, 16 bp, Homo sapiens
tctgtgttgctgttta

SEQ ID NO: 5796918 - DNA, 17 bp, Homo sapiens
tctgtgtttaatttctt

SEQ ID NO: 5796919 - DNA, 18 bp, Homo sapiens
tctgtgtttaatttcttc

SEQ ID NO: 5796920 - DNA, 15 bp, Homo sapiens
tctgtgtttacagac

SEQ ID NO: 5796921 - DNA, 21 bp, Homo sapiens
tctgtgtttacagacagaaga

SEQ ID NO: 5796922 - DNA, 12 bp, Homo sapiens
tctgtgtttagc

SEQ ID NO: 5796923 - DNA, 17 bp, Homo sapiens
tctgtgtttagctattt

SEQ ID NO: 5796924 - DNA, 13 bp, Homo sapiens
tctgtgttttcag

SEQ ID NO: 5796925 - DNA, 15 bp, Homo sapiens
tctgtgtttttgaaa

SEQ ID NO: 5796926 - DNA, 12 bp, Homo sapiens
tctgttaaatat

SEQ ID NO: 5796927 - DNA, 18 bp, Homo sapiens
tctgttaaatatttttgt

SEQ ID NO: 5796928 - DNA, 21 bp, Homo sapiens
tctgttaaatatttttgtaca

SEQ ID NO: 5796929 - DNA, 21 bp, Homo sapiens
tctgttaactgaataccactc

SEQ ID NO: 5796930 - DNA, 13 bp, Homo sapiens
tctgttaagaaag

SEQ ID NO: 5796931 - DNA, 21 bp, Homo sapiens
tctgttaaggttgaactttgc

SEQ ID NO: 5796932 - DNA, 21 bp, Homo sapiens
tctgttaatctttttcatcat

SEQ ID NO: 5796933 - DNA, 15 bp, Homo sapiens
tctgttaatttagta

SEQ ID NO: 5796934 - DNA, 20 bp, Homo sapiens
tctgttacaaaatgtaactg

SEQ ID NO: 5796935 - DNA, 20 bp, Homo sapiens
tctgttacacactaacatca

SEQ ID NO: 5796936 - DNA, 19 bp, Homo sapiens
tctgttaccatgtcactgt

SEQ ID NO: 5796937 - DNA, 20 bp, Homo sapiens
tctgttactccaaaaagaaa

SEQ ID NO: 5796938 - DNA, 14 bp, Homo sapiens
tctgttactgaaat

SEQ ID NO: 5796939 - DNA, 16 bp, Homo sapiens
tctgttagcagagtct

SEQ ID NO: 5796940 - DNA, 16 bp, Homo sapiens
tctgttagctgctcac

SEQ ID NO: 5796941 - DNA, 20 bp, Homo sapiens
tctgttagctgggtttacat

SEQ ID NO: 5796942 - DNA, 23 bp, Homo sapiens
tctgttaggtgtacatcctgcag

SEQ ID NO: 5796943 - DNA, 14 bp, Homo sapiens
tctgttatacacag

SEQ ID NO: 5796944 - DNA, 21 bp, Homo sapiens
tctgttatcagctgggcagtg

SEQ ID NO: 5796945 - DNA, 14 bp, Homo sapiens
tctgttatcctgct

SEQ ID NO: 5796946 - DNA, 23 bp, Homo sapiens
tctgttatgatttccttcaatgt

SEQ ID NO: 5796947 - DNA, 21 bp, Homo sapiens
tctgttatgcactgtggtttc

SEQ ID NO: 5796948 - DNA, 22 bp, Homo sapiens
tctgttatgcactgtggtttca

SEQ ID NO: 5796949 - DNA, 17 bp, Homo sapiens
tctgttatgtactgtac

SEQ ID NO: 5796950 - DNA, 12 bp, Homo sapiens
tctgttattgtt

SEQ ID NO: 5796951 - DNA, 16 bp, Homo sapiens
tctgttattgttttgt

SEQ ID NO: 5796952 - DNA, 23 bp, Homo sapiens
tctgttatttatccctcattcat

SEQ ID NO: 5796953 - DNA, 15 bp, Homo sapiens
tctgttatttcctaa

SEQ ID NO: 5796954 - DNA, 20 bp, Homo sapiens
tctgttcaaagctgcctgtc

SEQ ID NO: 5796955 - DNA, 21 bp, Homo sapiens
tctgttcacagtctctggaaa

SEQ ID NO: 5796956 - DNA, 13 bp, Homo sapiens
tctgttcaccttc

SEQ ID NO: 5796957 - DNA, 18 bp, Homo sapiens
tctgttcagattaaaaaa

SEQ ID NO: 5796958 - DNA, 15 bp, Homo sapiens
tctgttcagcaaact

SEQ ID NO: 5796959 - DNA, 22 bp, Homo sapiens
tctgttcaggaagtccttatct

SEQ ID NO: 5796960 - DNA, 21 bp, Homo sapiens
tctgttcagttcattcccaga

SEQ ID NO: 5796961 - DNA, 14 bp, Homo sapiens
tctgttcatctctt

SEQ ID NO: 5796962 - DNA, 20 bp, Homo sapiens
tctgttcatctctttgtcct

SEQ ID NO: 5796963 - DNA, 19 bp, Homo sapiens
tctgttcatttcacacagt

SEQ ID NO: 5796964 - DNA, 18 bp, Homo sapiens
tctgttcatttcctcaaa

SEQ ID NO: 5796965 - DNA, 17 bp, Homo sapiens
tctgttcatttctaaat

SEQ ID NO: 5796966 - DNA, 10 bp, Homo sapiens
tctgttccaa

SEQ ID NO: 5796967 - DNA, 14 bp, Homo sapiens
tctgttccaaattc

SEQ ID NO: 5796968 - DNA, 19 bp, Homo sapiens
tctgttccaaattcagttt

SEQ ID NO: 5796969 - DNA, 22 bp, Homo sapiens
tctgttccaaattcagtttcat

SEQ ID NO: 5796970 - DNA, 20 bp, Homo sapiens
tctgttccaacctcctgctc

SEQ ID NO: 5796971 - DNA, 21 bp, Homo sapiens
tctgttccaacctcctgctct

SEQ ID NO: 5796972 - DNA, 23 bp, Homo sapiens
tctgttccacacccaatgctgct

SEQ ID NO: 5796973 - DNA, 24 bp, Homo sapiens
tctgttccatagttaaagaagaca

SEQ ID NO: 5796974 - DNA, 17 bp, Homo sapiens
tctgttccatgcaactg

SEQ ID NO: 5796975 - DNA, 16 bp, Homo sapiens
tctgttccattttaac

SEQ ID NO: 5796976 - DNA, 20 bp, Homo sapiens
tctgttcccagcccctcctc

SEQ ID NO: 5796977 - DNA, 17 bp, Homo sapiens
tctgttcccagcccctg

SEQ ID NO: 5796978 - DNA, 17 bp, Homo sapiens
tctgttcccagtagtta

SEQ ID NO: 5796979 - DNA, 15 bp, Homo sapiens
tctgttccccaccca

SEQ ID NO: 5796980 - DNA, 17 bp, Homo sapiens
tctgttcccctccccct

SEQ ID NO: 5796981 - DNA, 13 bp, Homo sapiens
tctgttccctgct

SEQ ID NO: 5796982 - DNA, 14 bp, Homo sapiens
tctgttccctgctg

SEQ ID NO: 5796983 - DNA, 16 bp, Homo sapiens
tctgttcccttcctca

SEQ ID NO: 5796984 - DNA, 23 bp, Homo sapiens
tctgttcctggctcagcctcaaa

SEQ ID NO: 5796985 - DNA, 15 bp, Homo sapiens
tctgttccttcctcc

SEQ ID NO: 5796986 - DNA, 18 bp, Homo sapiens
tctgttcgaagttcattt

SEQ ID NO: 5796987 - DNA, 21 bp, Homo sapiens
tctgttctacccgttccaaaa

SEQ ID NO: 5796988 - DNA, 14 bp, Homo sapiens
tctgttctacttga

SEQ ID NO: 5796989 - DNA, 13 bp, Homo sapiens
tctgttctatgga

SEQ ID NO: 5796990 - DNA, 22 bp, Homo sapiens
tctgttctatggaccaaatgta

SEQ ID NO: 5796991 - DNA, 15 bp, Homo sapiens
tctgttctcttgctt

SEQ ID NO: 5796992 - DNA, 17 bp, Homo sapiens
tctgttctgcacacagc

SEQ ID NO: 5796993 - DNA, 19 bp, Homo sapiens
tctgttctgcacacagcac

SEQ ID NO: 5796994 - DNA, 19 bp, Homo sapiens
tctgttctgccccctcagg

SEQ ID NO: 5796995 - DNA, 14 bp, Homo sapiens
tctgttctggggga

SEQ ID NO: 5796996 - DNA, 22 bp, Homo sapiens
tctgttctgtggaaagtgtaaa

SEQ ID NO: 5796997 - DNA, 13 bp, Homo sapiens
tctgttctgttga

SEQ ID NO: 5796998 - DNA, 16 bp, Homo sapiens
tctgttctgtttcaag

SEQ ID NO: 5796999 - DNA, 21 bp, Homo sapiens
tctgttcttacaaatgtgaaa

SEQ ID NO: 5797000 - DNA, 17 bp, Homo sapiens
tctgttcttcatttcta

SEQ ID NO: 5797001 - DNA, 14 bp, Homo sapiens
tctgttcttgctac

SEQ ID NO: 5797002 - DNA, 15 bp, Homo sapiens
tctgttctttcatac

SEQ ID NO: 5797003 - DNA, 22 bp, Homo sapiens
tctgttgaaaaggtgtcctttt

SEQ ID NO: 5797004 - DNA, 10 bp, Homo sapiens
tctgttgaag

SEQ ID NO: 5797005 - DNA, 23 bp, Homo sapiens
tctgttgaatatttagcataaat

SEQ ID NO: 5797006 - DNA, 17 bp, Homo sapiens
tctgttgacctgtgcac

SEQ ID NO: 5797007 - DNA, 17 bp, Homo sapiens
tctgttgataaatccat

SEQ ID NO: 5797008 - DNA, 17 bp, Homo sapiens
tctgttgatcccacttc

SEQ ID NO: 5797009 - DNA, 20 bp, Homo sapiens
tctgttgatcccacttcact

SEQ ID NO: 5797010 - DNA, 21 bp, Homo sapiens
tctgttgattactactttaag

SEQ ID NO: 5797011 - DNA, 19 bp, Homo sapiens
tctgttgcaattaggattt

SEQ ID NO: 5797012 - DNA, 22 bp, Homo sapiens
tctgttgcaattaggattttga

SEQ ID NO: 5797013 - DNA, 14 bp, Homo sapiens
tctgttgcacctga

SEQ ID NO: 5797014 - DNA, 17 bp, Homo sapiens
tctgttgcccaggctgg

SEQ ID NO: 5797015 - DNA, 21 bp, Homo sapiens
tctgttgcccaggctggagtg

SEQ ID NO: 5797016 - DNA, 13 bp, Homo sapiens
tctgttgcctcct

SEQ ID NO: 5797017 - DNA, 22 bp, Homo sapiens
tctgttgcctcctctctccctg

SEQ ID NO: 5797018 - DNA, 16 bp, Homo sapiens
tctgttgcctttttac

SEQ ID NO: 5797019 - DNA, 23 bp, Homo sapiens
tcttagacctcttcctggaataa

SEQ ID NO: 5797020 - DNA, 14 bp, Homo sapiens
tcttagactacatt

SEQ ID NO: 5797021 - DNA, 14 bp, Homo sapiens
tcttagactcgcct

SEQ ID NO: 5797022 - DNA, 23 bp, Homo sapiens
tcttagacttgaaatactactta

SEQ ID NO: 5797023 - DNA, 16 bp, Homo sapiens
tcttagacttttccaa

SEQ ID NO: 5797024 - DNA, 22 bp, Homo sapiens
tcttagagaataagaataataa

SEQ ID NO: 5797025 - DNA, 16 bp, Homo sapiens
tcttagagatgattca

SEQ ID NO: 5797026 - DNA, 13 bp, Homo sapiens
tcttagagccttt

SEQ ID NO: 5797027 - DNA, 22 bp, Homo sapiens
tcttagagccttttatctgcag

SEQ ID NO: 5797028 - DNA, 19 bp, Homo sapiens
tcttagaggttaatcagag

SEQ ID NO: 5797029 - DNA, 17 bp, Homo sapiens
tcttagagtttacagtt

SEQ ID NO: 5797030 - DNA, 19 bp, Homo sapiens
tcttagagttttattcctt

SEQ ID NO: 5797031 - DNA, 13 bp, Homo sapiens
tcttagataactt

SEQ ID NO: 5797032 - DNA, 23 bp, Homo sapiens
tcttagataacttcttgaaaaag

SEQ ID NO: 5797033 - DNA, 22 bp, Homo sapiens
tcttagatacactaaaaatctg

SEQ ID NO: 5797034 - DNA, 16 bp, Homo sapiens
tcttagatcatagttt

SEQ ID NO: 5797035 - DNA, 17 bp, Homo sapiens
tcttagatcatagtttt

SEQ ID NO: 5797036 - DNA, 14 bp, Homo sapiens
tcttagatctggtg

SEQ ID NO: 5797037 - DNA, 18 bp, Homo sapiens
tcttagatggattctcca

SEQ ID NO: 5797038 - DNA, 21 bp, Homo sapiens
tcttagattctctgtgtctaa

SEQ ID NO: 5797039 - DNA, 13 bp, Homo sapiens
tcttagattctta

SEQ ID NO: 5797040 - DNA, 13 bp, Homo sapiens
tcttagcaataaa

SEQ ID NO: 5797041 - DNA, 16 bp, Homo sapiens
tcttagcaataaatgc

SEQ ID NO: 5797042 - DNA, 16 bp, Homo sapiens
tcttagcatcctgcct

SEQ ID NO: 5797043 - DNA, 22 bp, Homo sapiens
tcttagcatgcctccaaaaatt

SEQ ID NO: 5797044 - DNA, 18 bp, Homo sapiens
tcttagccctcaccacag

SEQ ID NO: 5797045 - DNA, 14 bp, Homo sapiens
tcttagcctctgga

SEQ ID NO: 5797046 - DNA, 17 bp, Homo sapiens
tcttagcctctggatct

SEQ ID NO: 5797047 - DNA, 18 bp, Homo sapiens
tcttagcctctggatcta

SEQ ID NO: 5797048 - DNA, 15 bp, Homo sapiens
tcttagcctgtggca

SEQ ID NO: 5797049 - DNA, 15 bp, Homo sapiens
tcttagctactgtat

SEQ ID NO: 5797050 - DNA, 20 bp, Homo sapiens
tcttagctactgtatgcaaa

SEQ ID NO: 5797051 - DNA, 16 bp, Homo sapiens
tcttagctcccctcca

SEQ ID NO: 5797052 - DNA, 13 bp, Homo sapiens
tcttagctcttgg

SEQ ID NO: 5797053 - DNA, 20 bp, Homo sapiens
tcttagctgaggctgagaaa

SEQ ID NO: 5797054 - DNA, 12 bp, Homo sapiens
tcttagctgagt

SEQ ID NO: 5797055 - DNA, 21 bp, Homo sapiens
tcttagctgcactgtttatgg

SEQ ID NO: 5797056 - DNA, 13 bp, Homo sapiens
tcttagctggata

SEQ ID NO: 5797057 - DNA, 15 bp, Homo sapiens
tcttagctttgaaac

SEQ ID NO: 5797058 - DNA, 16 bp, Homo sapiens
tcttagcttttctgca

SEQ ID NO: 5797059 - DNA, 17 bp, Homo sapiens
tcttagctttttaattg

SEQ ID NO: 5797060 - DNA, 22 bp, Homo sapiens
tcttagctttttaattgttgtt

SEQ ID NO: 5797061 - DNA, 16 bp, Homo sapiens
tcttaggagcaagaag

SEQ ID NO: 5797062 - DNA, 21 bp, Homo sapiens
tcttaggagcaagaagaaaat

SEQ ID NO: 5797063 - DNA, 15 bp, Homo sapiens
tcttaggatatttga

SEQ ID NO: 5797064 - DNA, 19 bp, Homo sapiens
tcttagggaactttgatac

SEQ ID NO: 5797065 - DNA, 19 bp, Homo sapiens
tcttaggggagagctttct

SEQ ID NO: 5797066 - DNA, 13 bp, Homo sapiens
tcttaggggcttg

SEQ ID NO: 5797067 - DNA, 21 bp, Homo sapiens
tcttagggtacagcccaggcg

SEQ ID NO: 5797068 - DNA, 15 bp, Homo sapiens
tcttagggtagggga

SEQ ID NO: 5797069 - DNA, 19 bp, Homo sapiens
tcttagggtaggggaagtg

SEQ ID NO: 5797070 - DNA, 22 bp, Homo sapiens
tcttagggttatgattaagtaa

SEQ ID NO: 5797071 - DNA, 20 bp, Homo sapiens
tcttaggtcttcctgtggct

SEQ ID NO: 5797072 - DNA, 18 bp, Homo sapiens
tcttaggtgcgcagtggc

SEQ ID NO: 5797073 - DNA, 18 bp, Homo sapiens
tcttaggtggcagggctg

SEQ ID NO: 5797074 - DNA, 20 bp, Homo sapiens
tcttaggttggcaaaaaggc

SEQ ID NO: 5797075 - DNA, 23 bp, Homo sapiens
tcttaggttggcaaaaaggcagg

SEQ ID NO: 5797076 - DNA, 16 bp, Homo sapiens
tcttaggtttactgtg

SEQ ID NO: 5797077 - DNA, 14 bp, Homo sapiens
tcttagtaatagca

SEQ ID NO: 5797078 - DNA, 19 bp, Homo sapiens
tcttagtatagtagaaaga

SEQ ID NO: 5797079 - DNA, 21 bp, Homo sapiens
tcttagtatgtgcatttaatt

SEQ ID NO: 5797080 - DNA, 20 bp, Homo sapiens
tcttagtcctccctgctcag

SEQ ID NO: 5797081 - DNA, 23 bp, Homo sapiens
tcttagtcgaatgttagattcct

SEQ ID NO: 5797082 - DNA, 18 bp, Homo sapiens
tcttagtgacacacactg

SEQ ID NO: 5797083 - DNA, 18 bp, Homo sapiens
tcttagtgcctgagagta

SEQ ID NO: 5797084 - DNA, 16 bp, Homo sapiens
tcttagtggaagacaa

SEQ ID NO: 5797085 - DNA, 21 bp, Homo sapiens
tcttagtgttgcgtcctgcct

SEQ ID NO: 5797086 - DNA, 17 bp, Homo sapiens
tcttagttacatttcta

SEQ ID NO: 5797087 - DNA, 14 bp, Homo sapiens
tcttagttatatag

SEQ ID NO: 5797088 - DNA, 19 bp, Homo sapiens
tcttagttctgtatataaa

SEQ ID NO: 5797089 - DNA, 21 bp, Homo sapiens
tcttagttctgtatataaata

SEQ ID NO: 5797090 - DNA, 12 bp, Homo sapiens
tcttagtttact

SEQ ID NO: 5797091 - DNA, 18 bp, Homo sapiens
tcttagtttcagaagtac

SEQ ID NO: 5797092 - DNA, 20 bp, Homo sapiens
tcttagtttcagaagtactg

SEQ ID NO: 5797093 - DNA, 22 bp, Homo sapiens
tcttagtttttaaaaaggcctt

SEQ ID NO: 5797094 - DNA, 21 bp, Homo sapiens
tcttagtttttacttgtttaa

SEQ ID NO: 5797095 - DNA, 22 bp, Homo sapiens
tcttataaaccttgtcaataaa

SEQ ID NO: 5797096 - DNA, 21 bp, Homo sapiens
tcttataaagtggaagtatgt

SEQ ID NO: 5797097 - DNA, 17 bp, Homo sapiens
tcttataaagtggactt

SEQ ID NO: 5797098 - DNA, 13 bp, Homo sapiens
tcttataaatatg

SEQ ID NO: 5797099 - DNA, 17 bp, Homo sapiens
tcttataaattctgtta

SEQ ID NO: 5797100 - DNA, 21 bp, Homo sapiens
tcttataaattctgttagctg

SEQ ID NO: 5797101 - DNA, 19 bp, Homo sapiens
tcttataacattgtatgtt

SEQ ID NO: 5797102 - DNA, 19 bp, Homo sapiens
tcttataatactctgttgt

SEQ ID NO: 5797103 - DNA, 23 bp, Homo sapiens
tcttatacaacagcaaaccctga

SEQ ID NO: 5797104 - DNA, 14 bp, Homo sapiens
tcttatacacattg

SEQ ID NO: 5797105 - DNA, 20 bp, Homo sapiens
tcttatacagataaaacatg

SEQ ID NO: 5797106 - DNA, 19 bp, Homo sapiens
tcttatacgcttttctttg

SEQ ID NO: 5797107 - DNA, 15 bp, Homo sapiens
tcttatactgtacaa

SEQ ID NO: 5797108 - DNA, 15 bp, Homo sapiens
tcttatagaaagcac

SEQ ID NO: 5797109 - DNA, 13 bp, Homo sapiens
tcttatagaaagt

SEQ ID NO: 5797110 - DNA, 18 bp, Homo sapiens
tcttatagaagcttcagc

SEQ ID NO: 5797111 - DNA, 13 bp, Homo sapiens
tcttatagaataa

SEQ ID NO: 5797112 - DNA, 17 bp, Homo sapiens
tcttatagaataaaagc

SEQ ID NO: 5797113 - DNA, 18 bp, Homo sapiens
tcttatagaataaaagct

SEQ ID NO: 5797114 - DNA, 21 bp, Homo sapiens
tcttatagaataaaagctgtg

SEQ ID NO: 5797115 - DNA, 22 bp, Homo sapiens
tcttatagaataaaagctgtgg

SEQ ID NO: 5797116 - DNA, 16 bp, Homo sapiens
tcttatagcactttga

SEQ ID NO: 5797117 - DNA, 23 bp, Homo sapiens
tcttatagcactttgaaatacct

SEQ ID NO: 5797118 - DNA, 16 bp, Homo sapiens
tcttatagttctaggc

SEQ ID NO: 5797119 - DNA, 19 bp, Homo sapiens
tcttatataagatcactga

SEQ ID NO: 5797120 - DNA, 12 bp, Homo sapiens
tcttatatagca

SEQ ID NO: 5797121 - DNA, 22 bp, Homo sapiens
tcttatattggtttgcacaagt

SEQ ID NO: 5797122 - DNA, 21 bp, Homo sapiens
tcttatatttacaacacttta

SEQ ID NO: 5797123 - DNA, 23 bp, Homo sapiens
tcttatcaagagttgtgacaact

SEQ ID NO: 5797124 - DNA, 18 bp, Homo sapiens
tcttatcaagtgttacag

SEQ ID NO: 5797125 - DNA, 17 bp, Homo sapiens
tcttatcacacttgcaa

SEQ ID NO: 5797126 - DNA, 23 bp, Homo sapiens
tcttatcacataagagagatgag

SEQ ID NO: 5797127 - DNA, 23 bp, Homo sapiens
tcttatcaccacagtaagttcct

SEQ ID NO: 5797128 - DNA, 14 bp, Homo sapiens
tcttatcactaaga

SEQ ID NO: 5797129 - DNA, 21 bp, Homo sapiens
tcttatctcagatatttgcac

SEQ ID NO: 5797130 - DNA, 14 bp, Homo sapiens
tcttatctctagct

SEQ ID NO: 5797131 - DNA, 16 bp, Homo sapiens
tcttatctgccatgtc

SEQ ID NO: 5797132 - DNA, 19 bp, Homo sapiens
tcttatctgccatgtccat

SEQ ID NO: 5797133 - DNA, 14 bp, Homo sapiens
tcttatcttacgaa

SEQ ID NO: 5797134 - DNA, 17 bp, Homo sapiens
tcttatcttgctttgga

SEQ ID NO: 5797135 - DNA, 12 bp, Homo sapiens
tcttatctttga

SEQ ID NO: 5797136 - DNA, 20 bp, Homo sapiens
tcttatgaaatgggctttaa

SEQ ID NO: 5797137 - DNA, 23 bp, Homo sapiens
tcttatgaatagacataaattgt

SEQ ID NO: 5797138 - DNA, 22 bp, Homo sapiens
tcttatgagtataatgaacact

SEQ ID NO: 5797139 - DNA, 17 bp, Homo sapiens
tcttatgattttattac

SEQ ID NO: 5797140 - DNA, 14 bp, Homo sapiens
tcttatgccatttg

SEQ ID NO: 5797141 - DNA, 21 bp, Homo sapiens
tcttatgctctcactgtttgt

SEQ ID NO: 5797142 - DNA, 15 bp, Homo sapiens
tcttatgctgtaccc

SEQ ID NO: 5797143 - DNA, 18 bp, Homo sapiens
tcttatgctgtacccagt

SEQ ID NO: 5797144 - DNA, 23 bp, Homo sapiens
tcttatgctgtacccagtttcta

SEQ ID NO: 5797145 - DNA, 23 bp, Homo sapiens
tcttatgcttccattaacaaatg

SEQ ID NO: 5797146 - DNA, 15 bp, Homo sapiens
tcttatggattcatt

SEQ ID NO: 5797147 - DNA, 17 bp, Homo sapiens
tcttatggattcattta

SEQ ID NO: 5797148 - DNA, 13 bp, Homo sapiens
tcttatgggggtg

SEQ ID NO: 5797149 - DNA, 22 bp, Homo sapiens
tcttatggtattatatctctgt

SEQ ID NO: 5797150 - DNA, 17 bp, Homo sapiens
tcttatggtcttgatcc

SEQ ID NO: 5797151 - DNA, 17 bp, Homo sapiens
tcttatggtggaagagg

SEQ ID NO: 5797152 - DNA, 17 bp, Homo sapiens
tcttatgtagagttttt

SEQ ID NO: 5797153 - DNA, 15 bp, Homo sapiens
tcttatgttgaatat

SEQ ID NO: 5797154 - DNA, 14 bp, Homo sapiens
tcttattaaaacac

SEQ ID NO: 5797155 - DNA, 20 bp, Homo sapiens
tcttattaatttcagtcttg

SEQ ID NO: 5797156 - DNA, 18 bp, Homo sapiens
tcttattacccaaaccca

SEQ ID NO: 5797157 - DNA, 15 bp, Homo sapiens
tcttattatatatat

SEQ ID NO: 5797158 - DNA, 13 bp, Homo sapiens
tcttattcacttt

SEQ ID NO: 5797159 - DNA, 12 bp, Homo sapiens
tcttattcatca

SEQ ID NO: 5797160 - DNA, 23 bp, Homo sapiens
tcttattcatgctttctcctttt

SEQ ID NO: 5797161 - DNA, 19 bp, Homo sapiens
tcttattccatattagaaa

SEQ ID NO: 5797162 - DNA, 16 bp, Homo sapiens
tcttattcccaaacta

SEQ ID NO: 5797163 - DNA, 21 bp, Homo sapiens
tcttattcccaaactacagaa

SEQ ID NO: 5797164 - DNA, 20 bp, Homo sapiens
tcttattcccttcctgccag

SEQ ID NO: 5797165 - DNA, 17 bp, Homo sapiens
tcttattcctaattcct

SEQ ID NO: 5797166 - DNA, 15 bp, Homo sapiens
tcttattctcactcc

SEQ ID NO: 5797167 - DNA, 18 bp, Homo sapiens
tcttattctttacaaaat

SEQ ID NO: 5797168 - DNA, 21 bp, Homo sapiens
tcttattctttcgttcagtta

SEQ ID NO: 5797169 - DNA, 22 bp, Homo sapiens
tcttattgaaaaaaaaaatgtt

SEQ ID NO: 5797170 - DNA, 21 bp, Homo sapiens
tcttattggccaaatgcctgt

SEQ ID NO: 5797171 - DNA, 19 bp, Homo sapiens
tcttattgttctttcatat

SEQ ID NO: 5797172 - DNA, 12 bp, Homo sapiens
tcttatttaatc

SEQ ID NO: 5797173 - DNA, 12 bp, Homo sapiens
tcttatttaatt

SEQ ID NO: 5797174 - DNA, 14 bp, Homo sapiens
tcttatttatagaa

SEQ ID NO: 5797175 - DNA, 14 bp, Homo sapiens
tcttatttatatat

SEQ ID NO: 5797176 - DNA, 17 bp, Homo sapiens
tcttatttatatatgaa

SEQ ID NO: 5797177 - DNA, 19 bp, Homo sapiens
tcttatttatatatgaagt

SEQ ID NO: 5797178 - DNA, 13 bp, Homo sapiens
tcttatttatttt

SEQ ID NO: 5797179 - DNA, 13 bp, Homo sapiens
tcttatttctgaa

SEQ ID NO: 5797180 - DNA, 14 bp, Homo sapiens
tcttatttctgaat

SEQ ID NO: 5797181 - DNA, 14 bp, Homo sapiens
tcttatttgaaagt

SEQ ID NO: 5797182 - DNA, 13 bp, Homo sapiens
tcttatttgcaat

SEQ ID NO: 5797183 - DNA, 21 bp, Homo sapiens
tcttattttgtaataaactct

SEQ ID NO: 5797184 - DNA, 18 bp, Homo sapiens
tcttatttttaatttttc

SEQ ID NO: 5797185 - DNA, 13 bp, Homo sapiens
tcttatttttcct

SEQ ID NO: 5797186 - DNA, 17 bp, Homo sapiens
tcttatttttcctgtcc

SEQ ID NO: 5797187 - DNA, 19 bp, Homo sapiens
tcttatttttcctgtcctg

SEQ ID NO: 5797188 - DNA, 13 bp, Homo sapiens
tcttatttttcta

SEQ ID NO: 5797189 - DNA, 18 bp, Homo sapiens
tcttatttttctaaacgt

SEQ ID NO: 5797190 - DNA, 16 bp, Homo sapiens
tcttatttttttctat

SEQ ID NO: 5797191 - DNA, 16 bp, Homo sapiens
tcttcaaaaagcattt

SEQ ID NO: 5797192 - DNA, 13 bp, Homo sapiens
tcttcaaaaatac

SEQ ID NO: 5797193 - DNA, 20 bp, Homo sapiens
tcttcaaaaatacagaattt

SEQ ID NO: 5797194 - DNA, 21 bp, Homo sapiens
tcttcaaaaggtaaatacaat

SEQ ID NO: 5797195 - DNA, 17 bp, Homo sapiens
tcttcaaaatgagccct

SEQ ID NO: 5797196 - DNA, 14 bp, Homo sapiens
tcttcctgctgctg

SEQ ID NO: 5797197 - DNA, 12 bp, Homo sapiens
tcttcctgctgg

SEQ ID NO: 5797198 - DNA, 13 bp, Homo sapiens
tcttcctgctgga

SEQ ID NO: 5797199 - DNA, 22 bp, Homo sapiens
tcttcctggatggggcagagct

SEQ ID NO: 5797200 - DNA, 17 bp, Homo sapiens
tcttcctggattattca

SEQ ID NO: 5797201 - DNA, 22 bp, Homo sapiens
tcttcctggccgcctgggtcca

SEQ ID NO: 5797202 - DNA, 21 bp, Homo sapiens
tcttcctggtcgaaagttagt

SEQ ID NO: 5797203 - DNA, 16 bp, Homo sapiens
tcttcctggtgaccct

SEQ ID NO: 5797204 - DNA, 15 bp, Homo sapiens
tcttcctgtaatctt

SEQ ID NO: 5797205 - DNA, 22 bp, Homo sapiens
tcttcctgtctttgttgtctcc

SEQ ID NO: 5797206 - DNA, 22 bp, Homo sapiens
tcttcctgtgaagtttaattgt

SEQ ID NO: 5797207 - DNA, 12 bp, Homo sapiens
tcttcctgtggc

SEQ ID NO: 5797208 - DNA, 15 bp, Homo sapiens
tcttcctgtggctcc

SEQ ID NO: 5797209 - DNA, 19 bp, Homo sapiens
tcttcctgtggctccctct

SEQ ID NO: 5797210 - DNA, 16 bp, Homo sapiens
tcttcctgtgtcctga

SEQ ID NO: 5797211 - DNA, 16 bp, Homo sapiens
tcttccttacaggtgt

SEQ ID NO: 5797212 - DNA, 23 bp, Homo sapiens
tcttccttacctggaaaaacatg

SEQ ID NO: 5797213 - DNA, 23 bp, Homo sapiens
tcttccttactttttatatatat

SEQ ID NO: 5797214 - DNA, 21 bp, Homo sapiens
tcttccttcagaagtttcgtc

SEQ ID NO: 5797215 - DNA, 10 bp, Homo sapiens
tcttccttcc

SEQ ID NO: 5797216 - DNA, 13 bp, Homo sapiens
tcttccttccccc

SEQ ID NO: 5797217 - DNA, 14 bp, Homo sapiens
tcttccttccccca

SEQ ID NO: 5797218 - DNA, 15 bp, Homo sapiens
tcttccttcccccat

SEQ ID NO: 5797219 - DNA, 15 bp, Homo sapiens
tcttccttccctcct

SEQ ID NO: 5797220 - DNA, 14 bp, Homo sapiens
tcttccttcctaga

SEQ ID NO: 5797221 - DNA, 13 bp, Homo sapiens
tcttccttccttt

SEQ ID NO: 5797222 - DNA, 15 bp, Homo sapiens
tcttccttctcagca

SEQ ID NO: 5797223 - DNA, 21 bp, Homo sapiens
tcttccttggccaagagaagg

SEQ ID NO: 5797224 - DNA, 14 bp, Homo sapiens
tcttccttgtggaa

SEQ ID NO: 5797225 - DNA, 20 bp, Homo sapiens
tcttccttgttgtttgcttt

SEQ ID NO: 5797226 - DNA, 17 bp, Homo sapiens
tcttcctttactttccc

SEQ ID NO: 5797227 - DNA, 20 bp, Homo sapiens
tcttcctttactttcccttg

SEQ ID NO: 5797228 - DNA, 11 bp, Homo sapiens
tcttcctttcc

SEQ ID NO: 5797229 - DNA, 17 bp, Homo sapiens
tcttcctttccctggag

SEQ ID NO: 5797230 - DNA, 13 bp, Homo sapiens
tcttcctttcctt

SEQ ID NO: 5797231 - DNA, 20 bp, Homo sapiens
tcttcctttcttgtctttcc

SEQ ID NO: 5797232 - DNA, 16 bp, Homo sapiens
tcttcctttgtaaaaa

SEQ ID NO: 5797233 - DNA, 23 bp, Homo sapiens
tcttccttttttaaaataaaata

SEQ ID NO: 5797234 - DNA, 13 bp, Homo sapiens
tcttcgaggtgga

SEQ ID NO: 5797235 - DNA, 21 bp, Homo sapiens
tcttcgccctctgaaattaaa

SEQ ID NO: 5797236 - DNA, 23 bp, Homo sapiens
tcttcgccctctgaaattaaaga

SEQ ID NO: 5797237 - DNA, 21 bp, Homo sapiens
tcttcgcctttcccaccctcc

SEQ ID NO: 5797238 - DNA, 14 bp, Homo sapiens
tcttcgctggacta

SEQ ID NO: 5797239 - DNA, 13 bp, Homo sapiens
tcttcgctgtgat

SEQ ID NO: 5797240 - DNA, 22 bp, Homo sapiens
tcttcggccctcagatgtccct

SEQ ID NO: 5797241 - DNA, 23 bp, Homo sapiens
tcttcggccctcagatgtccctt

SEQ ID NO: 5797242 - DNA, 22 bp, Homo sapiens
tcttcgggaagagaggagttca

SEQ ID NO: 5797243 - DNA, 19 bp, Homo sapiens
tcttcggggaactcctgga

SEQ ID NO: 5797244 - DNA, 17 bp, Homo sapiens
tcttcggggtgtgatga

SEQ ID NO: 5797245 - DNA, 15 bp, Homo sapiens
tcttcgtaacttcat

SEQ ID NO: 5797246 - DNA, 17 bp, Homo sapiens
tcttcgtacagttcttc

SEQ ID NO: 5797247 - DNA, 20 bp, Homo sapiens
tcttcgtcctgatccctcca

SEQ ID NO: 5797248 - DNA, 14 bp, Homo sapiens
tcttcgtcttcact

SEQ ID NO: 5797249 - DNA, 14 bp, Homo sapiens
tcttcgtgaacata

SEQ ID NO: 5797250 - DNA, 15 bp, Homo sapiens
tcttcgtgaacatag

SEQ ID NO: 5797251 - DNA, 22 bp, Homo sapiens
tcttcgtggattgttttttctg

SEQ ID NO: 5797252 - DNA, 14 bp, Homo sapiens
tcttcgtggttgtg

SEQ ID NO: 5797253 - DNA, 19 bp, Homo sapiens
tcttcgtggttgtgtttct

SEQ ID NO: 5797254 - DNA, 23 bp, Homo sapiens
tcttcgttaatagattatttcat

SEQ ID NO: 5797255 - DNA, 18 bp, Homo sapiens
tcttcgttcttgttagta

SEQ ID NO: 5797256 - DNA, 16 bp, Homo sapiens
tcttctaaaaaaaaac

SEQ ID NO: 5797257 - DNA, 17 bp, Homo sapiens
tcttctaaaactactgc

SEQ ID NO: 5797258 - DNA, 21 bp, Homo sapiens
tcttctaaaactactgccttt

SEQ ID NO: 5797259 - DNA, 17 bp, Homo sapiens
tcttctaaaacttgagt

SEQ ID NO: 5797260 - DNA, 16 bp, Homo sapiens
tcttctaaaatagcaa

SEQ ID NO: 5797261 - DNA, 12 bp, Homo sapiens
tcttctaaatgg

SEQ ID NO: 5797262 - DNA, 14 bp, Homo sapiens
tcttctaacatctt

SEQ ID NO: 5797263 - DNA, 17 bp, Homo sapiens
tcttctaagaagacatt

SEQ ID NO: 5797264 - DNA, 16 bp, Homo sapiens
tcttctaatgtaaatt

SEQ ID NO: 5797265 - DNA, 16 bp, Homo sapiens
tcttctacaaccagag

SEQ ID NO: 5797266 - DNA, 22 bp, Homo sapiens
tcttctaccacacctggaaaca

SEQ ID NO: 5797267 - DNA, 14 bp, Homo sapiens
tcttctaccaccca

SEQ ID NO: 5797268 - DNA, 19 bp, Homo sapiens
tcttctacgtataaatatg

SEQ ID NO: 5797269 - DNA, 16 bp, Homo sapiens
tcttctactcttgaga

SEQ ID NO: 5797270 - DNA, 19 bp, Homo sapiens
tcttctactgccttgaaaa

SEQ ID NO: 5797271 - DNA, 21 bp, Homo sapiens
tcttctactgccttgaaaaat

SEQ ID NO: 5797272 - DNA, 21 bp, Homo sapiens
tcttctacttgtaaaatgctt

SEQ ID NO: 5797273 - DNA, 20 bp, Homo sapiens
tcttctagaagataacattt

SEQ ID NO: 5797274 - DNA, 23 bp, Homo sapiens
tcttctagagccgtgatgcctcc

SEQ ID NO: 5797275 - DNA, 14 bp, Homo sapiens
tcttctagagttca

SEQ ID NO: 5797276 - DNA, 17 bp, Homo sapiens
tcttctagagttcagag

SEQ ID NO: 5797277 - DNA, 23 bp, Homo sapiens
tcttctagatgattttttgaaag

SEQ ID NO: 5797278 - DNA, 21 bp, Homo sapiens
tcttctagatggaccccagca

SEQ ID NO: 5797279 - DNA, 16 bp, Homo sapiens
tcttctagcatttctt

SEQ ID NO: 5797280 - DNA, 17 bp, Homo sapiens
tcttctagctgagcttt

SEQ ID NO: 5797281 - DNA, 23 bp, Homo sapiens
tcttctagctgcagatgcctctg

SEQ ID NO: 5797282 - DNA, 20 bp, Homo sapiens
tcttctaggcccattgtcct

SEQ ID NO: 5797283 - DNA, 21 bp, Homo sapiens
tcttctaggcccattgtcctc

SEQ ID NO: 5797284 - DNA, 20 bp, Homo sapiens
tcttctataatatttccttt

SEQ ID NO: 5797285 - DNA, 16 bp, Homo sapiens
tcttctatcattccaa

SEQ ID NO: 5797286 - DNA, 20 bp, Homo sapiens
tcttctattaatcaagagaa

SEQ ID NO: 5797287 - DNA, 14 bp, Homo sapiens
tcttctattgcctc

SEQ ID NO: 5797288 - DNA, 16 bp, Homo sapiens
tcttctattttattcc

SEQ ID NO: 5797289 - DNA, 18 bp, Homo sapiens
tcttctcaaaaaataatt

SEQ ID NO: 5797290 - DNA, 22 bp, Homo sapiens
tcttctcaaccttatcaaggat

SEQ ID NO: 5797291 - DNA, 22 bp, Homo sapiens
tcttctcaacttttttcccttg

SEQ ID NO: 5797292 - DNA, 19 bp, Homo sapiens
tcttctcaagttctaagat

SEQ ID NO: 5797293 - DNA, 23 bp, Homo sapiens
tcttctcaagttctaagattcta

SEQ ID NO: 5797294 - DNA, 17 bp, Homo sapiens
tcttctcactcccttct

SEQ ID NO: 5797295 - DNA, 21 bp, Homo sapiens
tcttctcagaaggcaaatgac

SEQ ID NO: 5797296 - DNA, 16 bp, Homo sapiens
tcttctcagctccact

SEQ ID NO: 5797297 - DNA, 20 bp, Homo sapiens
tcttctcagctccactctga

SEQ ID NO: 5797298 - DNA, 14 bp, Homo sapiens
tcttctcagctctt

SEQ ID NO: 5797299 - DNA, 17 bp, Homo sapiens
tcttctcagctcttcca

SEQ ID NO: 5797300 - DNA, 14 bp, Homo sapiens
tcttctcaggctct

SEQ ID NO: 5797301 - DNA, 20 bp, Homo sapiens
tcttctcaggctctgccctg

SEQ ID NO: 5797302 - DNA, 15 bp, Homo sapiens
tcttctcataaatct

SEQ ID NO: 5797303 - DNA, 10 bp, Homo sapiens
tcttctcatt

SEQ ID NO: 5797304 - DNA, 15 bp, Homo sapiens
tcttctcattacttg

SEQ ID NO: 5797305 - DNA, 17 bp, Homo sapiens
tcttctcattacttgtt

SEQ ID NO: 5797306 - DNA, 19 bp, Homo sapiens
tcttctcattcccatgtgg

SEQ ID NO: 5797307 - DNA, 15 bp, Homo sapiens
tcttctcattttttc

SEQ ID NO: 5797308 - DNA, 12 bp, Homo sapiens
tcttctccactg

SEQ ID NO: 5797309 - DNA, 17 bp, Homo sapiens
tcttctccagatttttc

SEQ ID NO: 5797310 - DNA, 14 bp, Homo sapiens
tcttctccaggctg

SEQ ID NO: 5797311 - DNA, 15 bp, Homo sapiens
tcttctccaggctgt

SEQ ID NO: 5797312 - DNA, 19 bp, Homo sapiens
tcttctccatcctaccaca

SEQ ID NO: 5797313 - DNA, 21 bp, Homo sapiens
tcttctccattctagatgctt

SEQ ID NO: 5797314 - DNA, 21 bp, Homo sapiens
tcttctcccaaatgtctattt

SEQ ID NO: 5797315 - DNA, 18 bp, Homo sapiens
tcttctcccaactcagcc

SEQ ID NO: 5797316 - DNA, 13 bp, Homo sapiens
tcttctcccagaa

SEQ ID NO: 5797317 - DNA, 16 bp, Homo sapiens
tcttctcctcagcttg

SEQ ID NO: 5797318 - DNA, 17 bp, Homo sapiens
tcttctcctgcagcctg

SEQ ID NO: 5797319 - DNA, 21 bp, Homo sapiens
tcttctcctggagttgcattg

SEQ ID NO: 5797320 - DNA, 18 bp, Homo sapiens
tcttctcctttgtcaaat

SEQ ID NO: 5797321 - DNA, 15 bp, Homo sapiens
tcttctcgcctagga

SEQ ID NO: 5797322 - DNA, 20 bp, Homo sapiens
tcttctcgcctaggatttca

SEQ ID NO: 5797323 - DNA, 14 bp, Homo sapiens
tcttctcggctcag

SEQ ID NO: 5797324 - DNA, 16 bp, Homo sapiens
tcttctcggctcaggc

SEQ ID NO: 5797325 - DNA, 17 bp, Homo sapiens
tcttctcggctcaggct

SEQ ID NO: 5797326 - DNA, 13 bp, Homo sapiens
tcttctctagctg

SEQ ID NO: 5797327 - DNA, 22 bp, Homo sapiens
tcttctctatatttttatttca

SEQ ID NO: 5797328 - DNA, 11 bp, Homo sapiens
tcttctctcaa

SEQ ID NO: 5797329 - DNA, 22 bp, Homo sapiens
tcttctctcaaccttggccttc

SEQ ID NO: 5797330 - DNA, 15 bp, Homo sapiens
tcttctctcccacac

SEQ ID NO: 5797331 - DNA, 19 bp, Homo sapiens
tcttctctcctcagtttct

SEQ ID NO: 5797332 - DNA, 15 bp, Homo sapiens
tcttctctcctttct

SEQ ID NO: 5797333 - DNA, 17 bp, Homo sapiens
tcttctctctgctctga

SEQ ID NO: 5797334 - DNA, 16 bp, Homo sapiens
tcttctctctgtgctg

SEQ ID NO: 5797335 - DNA, 14 bp, Homo sapiens
tcttctctctgttc

SEQ ID NO: 5797336 - DNA, 15 bp, Homo sapiens
tcttctctcttcaat

SEQ ID NO: 5797337 - DNA, 20 bp, Homo sapiens
tcttctctcttgattgattt

SEQ ID NO: 5797338 - DNA, 12 bp, Homo sapiens
tcttctctgcaa

SEQ ID NO: 5797339 - DNA, 15 bp, Homo sapiens
tcttctctgcaatgc

SEQ ID NO: 5797340 - DNA, 12 bp, Homo sapiens
tcttctctgcct

SEQ ID NO: 5797341 - DNA, 15 bp, Homo sapiens
tcttctctgcctcct

SEQ ID NO: 5797342 - DNA, 17 bp, Homo sapiens
tcttctctgcctcctcc

SEQ ID NO: 5797343 - DNA, 13 bp, Homo sapiens
tcttctctgttgt

SEQ ID NO: 5797344 - DNA, 21 bp, Homo sapiens
tcttctcttccttttatcagt

SEQ ID NO: 5797345 - DNA, 15 bp, Homo sapiens
tcttctcttctttgg

SEQ ID NO: 5797346 - DNA, 15 bp, Homo sapiens
tcttctcttggtgaa

SEQ ID NO: 5797347 - DNA, 19 bp, Homo sapiens
tcttctcttggtgaaataa

SEQ ID NO: 5797348 - DNA, 21 bp, Homo sapiens
tcttctcttggtgaaataata

SEQ ID NO: 5797349 - DNA, 15 bp, Homo sapiens
tcttctcttttccca

SEQ ID NO: 5797350 - DNA, 18 bp, Homo sapiens
tcttctctttttccagaa

SEQ ID NO: 5797351 - DNA, 13 bp, Homo sapiens
tcttctgaaatga

SEQ ID NO: 5797352 - DNA, 22 bp, Homo sapiens
tcttctgaaatgaaacaaataa

SEQ ID NO: 5797353 - DNA, 21 bp, Homo sapiens
tcttctgaacttggcgctgcc

SEQ ID NO: 5797354 - DNA, 16 bp, Homo sapiens
tcttctgaagattctt

SEQ ID NO: 5797355 - DNA, 20 bp, Homo sapiens
tcttctgaagtgctgctcca

SEQ ID NO: 5797356 - DNA, 14 bp, Homo sapiens
tcttctgacaaact

SEQ ID NO: 5797357 - DNA, 17 bp, Homo sapiens
tcttctgacaaactgtg

SEQ ID NO: 5797358 - DNA, 22 bp, Homo sapiens
tcttctgacacttgtggtatag

SEQ ID NO: 5797359 - DNA, 14 bp, Homo sapiens
tcttctgacgtgcc

SEQ ID NO: 5797360 - DNA, 15 bp, Homo sapiens
tcttctgacgtgcct

SEQ ID NO: 5797361 - DNA, 21 bp, Homo sapiens
tcttctgacttaagtgtgcaa

SEQ ID NO: 5797362 - DNA, 11 bp, Homo sapiens
tcttctgagct

SEQ ID NO: 5797363 - DNA, 14 bp, Homo sapiens
tcttctgagctagt

SEQ ID NO: 5797364 - DNA, 19 bp, Homo sapiens
tcttctgagctatttcatc

SEQ ID NO: 5797365 - DNA, 20 bp, Homo sapiens
tcttctgagtggctaaaact

SEQ ID NO: 5797366 - DNA, 13 bp, Homo sapiens
tcttctgccccac

SEQ ID NO: 5797367 - DNA, 17 bp, Homo sapiens
tcttctgcgcctcaggc

SEQ ID NO: 5797368 - DNA, 19 bp, Homo sapiens
tcttctgctaatacctctt

SEQ ID NO: 5797369 - DNA, 22 bp, Homo sapiens
tcttctgctatgtgacttgcat

SEQ ID NO: 5797370 - DNA, 12 bp, Homo sapiens
tcttctgctcca

SEQ ID NO: 5797371 - DNA, 13 bp, Homo sapiens
tcttctgctccac

SEQ ID NO: 5797372 - DNA, 16 bp, Homo sapiens
tcttctgctccaccct

SEQ ID NO: 5797373 - DNA, 20 bp, Homo sapiens
tcttctgctccacccttggc

SEQ ID NO: 5797374 - DNA, 18 bp, Homo sapiens
tcttgctatattgcccag

SEQ ID NO: 5797375 - DNA, 14 bp, Homo sapiens
tcttgctcagagct

SEQ ID NO: 5797376 - DNA, 20 bp, Homo sapiens
tcttgctcagtccctctggg

SEQ ID NO: 5797377 - DNA, 20 bp, Homo sapiens
tcttgctcattcttcagttc

SEQ ID NO: 5797378 - DNA, 15 bp, Homo sapiens
tcttgctccaataaa

SEQ ID NO: 5797379 - DNA, 14 bp, Homo sapiens
tcttgctcccttca

SEQ ID NO: 5797380 - DNA, 17 bp, Homo sapiens
tcttgctcccttcagcc

SEQ ID NO: 5797381 - DNA, 19 bp, Homo sapiens
tcttgctcccttcagcccc

SEQ ID NO: 5797382 - DNA, 22 bp, Homo sapiens
tcttgctcccttcagcccccag

SEQ ID NO: 5797383 - DNA, 13 bp, Homo sapiens
tcttgctcctgct

SEQ ID NO: 5797384 - DNA, 14 bp, Homo sapiens
tcttgctcctgggg

SEQ ID NO: 5797385 - DNA, 17 bp, Homo sapiens
tcttgctcctggggaga

SEQ ID NO: 5797386 - DNA, 21 bp, Homo sapiens
tcttgctctatctcacagcac

SEQ ID NO: 5797387 - DNA, 11 bp, Homo sapiens
tcttgctctct

SEQ ID NO: 5797388 - DNA, 15 bp, Homo sapiens
tcttgctctctttta

SEQ ID NO: 5797389 - DNA, 14 bp, Homo sapiens
tcttgctctgctga

SEQ ID NO: 5797390 - DNA, 14 bp, Homo sapiens
tcttgctctgtagc

SEQ ID NO: 5797391 - DNA, 18 bp, Homo sapiens
tcttgctctgtcacccag

SEQ ID NO: 5797392 - DNA, 13 bp, Homo sapiens
tcttgctctgtct

SEQ ID NO: 5797393 - DNA, 17 bp, Homo sapiens
tcttgctctgtctccca

SEQ ID NO: 5797394 - DNA, 22 bp, Homo sapiens
tcttgctctgtctcccaggctg

SEQ ID NO: 5797395 - DNA, 16 bp, Homo sapiens
tcttgctctgtggcct

SEQ ID NO: 5797396 - DNA, 17 bp, Homo sapiens
tcttgctctgtggcctt

SEQ ID NO: 5797397 - DNA, 15 bp, Homo sapiens
tcttgctgaaagcca

SEQ ID NO: 5797398 - DNA, 21 bp, Homo sapiens
tcttgctgcaggccctccctc

SEQ ID NO: 5797399 - DNA, 14 bp, Homo sapiens
tcttgctgccctgc

SEQ ID NO: 5797400 - DNA, 10 bp, Homo sapiens
tcttgctgct

SEQ ID NO: 5797401 - DNA, 19 bp, Homo sapiens
tcttgctgctagaactttt

SEQ ID NO: 5797402 - DNA, 18 bp, Homo sapiens
tcttgctggattaatgtt

SEQ ID NO: 5797403 - DNA, 11 bp, Homo sapiens
tcttgctgggc

SEQ ID NO: 5797404 - DNA, 22 bp, Homo sapiens
tcttgctggtctagtcacgcat

SEQ ID NO: 5797405 - DNA, 19 bp, Homo sapiens
tcttgctgtctctgctcgc

SEQ ID NO: 5797406 - DNA, 11 bp, Homo sapiens
tcttgctgtgc

SEQ ID NO: 5797407 - DNA, 13 bp, Homo sapiens
tcttgctgtgctt

SEQ ID NO: 5797408 - DNA, 14 bp, Homo sapiens
tcttgctgttcagt

SEQ ID NO: 5797409 - DNA, 15 bp, Homo sapiens
tcttgctgttcagtg

SEQ ID NO: 5797410 - DNA, 22 bp, Homo sapiens
tcttgctgttcagtgctttttc

SEQ ID NO: 5797411 - DNA, 19 bp, Homo sapiens
tcttgctgttgacatattt

SEQ ID NO: 5797412 - DNA, 16 bp, Homo sapiens
tcttgctgtttcttga

SEQ ID NO: 5797413 - DNA, 22 bp, Homo sapiens
tcttgctgtttcttgatgctca

SEQ ID NO: 5797414 - DNA, 21 bp, Homo sapiens
tcttgcttaccttgactgttg

SEQ ID NO: 5797415 - DNA, 17 bp, Homo sapiens
tcttgcttccaagacca

SEQ ID NO: 5797416 - DNA, 18 bp, Homo sapiens
tcttgcttccctaatcta

SEQ ID NO: 5797417 - DNA, 11 bp, Homo sapiens
tcttgcttctt

SEQ ID NO: 5797418 - DNA, 16 bp, Homo sapiens
tcttgcttctttctag

SEQ ID NO: 5797419 - DNA, 18 bp, Homo sapiens
tcttgcttctttctagaa

SEQ ID NO: 5797420 - DNA, 15 bp, Homo sapiens
tcttgcttgtaaaaa

SEQ ID NO: 5797421 - DNA, 15 bp, Homo sapiens
tcttgcttgtacata

SEQ ID NO: 5797422 - DNA, 15 bp, Homo sapiens
tcttgcttgtacctc

SEQ ID NO: 5797423 - DNA, 22 bp, Homo sapiens
tcttgcttgtacctctggctga

SEQ ID NO: 5797424 - DNA, 14 bp, Homo sapiens
tcttgcttgtcatt

SEQ ID NO: 5797425 - DNA, 18 bp, Homo sapiens
tcttgctttagaaaacat

SEQ ID NO: 5797426 - DNA, 13 bp, Homo sapiens
tcttgctttctat

SEQ ID NO: 5797427 - DNA, 14 bp, Homo sapiens
tcttgctttctctc

SEQ ID NO: 5797428 - DNA, 21 bp, Homo sapiens
tcttgctttctttcttaaaaa

SEQ ID NO: 5797429 - DNA, 14 bp, Homo sapiens
tcttgctttgctgt

SEQ ID NO: 5797430 - DNA, 22 bp, Homo sapiens
tcttgctttggtcttcttccaa

SEQ ID NO: 5797431 - DNA, 12 bp, Homo sapiens
tcttggaaaaaa

SEQ ID NO: 5797432 - DNA, 22 bp, Homo sapiens
tcttggaaacagacggcggcac

SEQ ID NO: 5797433 - DNA, 16 bp, Homo sapiens
tcttggaaagaaacaa

SEQ ID NO: 5797434 - DNA, 20 bp, Homo sapiens
tcttggaaagaggttctgca

SEQ ID NO: 5797435 - DNA, 20 bp, Homo sapiens
tcttggaacacctggcatgt

SEQ ID NO: 5797436 - DNA, 16 bp, Homo sapiens
tcttggaactgtccca

SEQ ID NO: 5797437 - DNA, 16 bp, Homo sapiens
tcttggaacttgcctg

SEQ ID NO: 5797438 - DNA, 20 bp, Homo sapiens
tcttggaacttgcctgcctt

SEQ ID NO: 5797439 - DNA, 21 bp, Homo sapiens
tcttggaagacttaattctga

SEQ ID NO: 5797440 - DNA, 19 bp, Homo sapiens
tcttggaagctgtttggaa

SEQ ID NO: 5797441 - DNA, 16 bp, Homo sapiens
tcttggaagtctgtct

SEQ ID NO: 5797442 - DNA, 21 bp, Homo sapiens
tcttggaagtctgtctcagga

SEQ ID NO: 5797443 - DNA, 14 bp, Homo sapiens
tcttggaattacaa

SEQ ID NO: 5797444 - DNA, 19 bp, Homo sapiens
tcttggaattttgtaaaaa

SEQ ID NO: 5797445 - DNA, 17 bp, Homo sapiens
tcttggacaacagctct

SEQ ID NO: 5797446 - DNA, 15 bp, Homo sapiens
tcttggaccagggca

SEQ ID NO: 5797447 - DNA, 16 bp, Homo sapiens
tcttggaccagtttgc

SEQ ID NO: 5797448 - DNA, 17 bp, Homo sapiens
tcttggaccagtttgca

SEQ ID NO: 5797449 - DNA, 19 bp, Homo sapiens
tcttggaccagtttgcaga

SEQ ID NO: 5797450 - DNA, 14 bp, Homo sapiens
tcttggacctctgc

SEQ ID NO: 5797451 - DNA, 16 bp, Homo sapiens
tcttggactaagaaga

SEQ ID NO: 5797452 - DNA, 19 bp, Homo sapiens
tcttggactccctccccac

SEQ ID NO: 5797453 - DNA, 16 bp, Homo sapiens
tcttggagaagtctca

SEQ ID NO: 5797454 - DNA, 19 bp, Homo sapiens
tcttggagaagtctcagct

SEQ ID NO: 5797455 - DNA, 17 bp, Homo sapiens
tcttggagaccttaccc

SEQ ID NO: 5797456 - DNA, 22 bp, Homo sapiens
tcttggagcctctttttccttc

SEQ ID NO: 5797457 - DNA, 23 bp, Homo sapiens
tcttggagcctctttttccttct

SEQ ID NO: 5797458 - DNA, 12 bp, Homo sapiens
tcttggagcctg

SEQ ID NO: 5797459 - DNA, 18 bp, Homo sapiens
tcttggagcctgcagagc

SEQ ID NO: 5797460 - DNA, 16 bp, Homo sapiens
tcttggagctgagcct

SEQ ID NO: 5797461 - DNA, 21 bp, Homo sapiens
tcttggagctgagcctctcac

SEQ ID NO: 5797462 - DNA, 14 bp, Homo sapiens
tcttggagctgctt

SEQ ID NO: 5797463 - DNA, 16 bp, Homo sapiens
tcttggagctgcttgg

SEQ ID NO: 5797464 - DNA, 15 bp, Homo sapiens
tcttggagctgtgag

SEQ ID NO: 5797465 - DNA, 23 bp, Homo sapiens
tcttggagctgtgagttctccct

SEQ ID NO: 5797466 - DNA, 19 bp, Homo sapiens
tcttggagctttttcaaaa

SEQ ID NO: 5797467 - DNA, 14 bp, Homo sapiens
tcttggagtcttcc

SEQ ID NO: 5797468 - DNA, 15 bp, Homo sapiens
tcttggagtgcattt

SEQ ID NO: 5797469 - DNA, 15 bp, Homo sapiens
tcttggagtttttca

SEQ ID NO: 5797470 - DNA, 19 bp, Homo sapiens
tcttggatgggacattttt

SEQ ID NO: 5797471 - DNA, 22 bp, Homo sapiens
tcttggatggtgacattgaaac

SEQ ID NO: 5797472 - DNA, 17 bp, Homo sapiens
tcttggcaaaagccttg

SEQ ID NO: 5797473 - DNA, 22 bp, Homo sapiens
tcttggcaaaagccttgtgtat

SEQ ID NO: 5797474 - DNA, 18 bp, Homo sapiens
tcttggcaagatgtttct

SEQ ID NO: 5797475 - DNA, 19 bp, Homo sapiens
tcttggcaataaattttga

SEQ ID NO: 5797476 - DNA, 18 bp, Homo sapiens
tcttggcagcacctgtct

SEQ ID NO: 5797477 - DNA, 19 bp, Homo sapiens
tcttggcagcacctgtctc

SEQ ID NO: 5797478 - DNA, 23 bp, Homo sapiens
tcttggcagtattccatgggatg

SEQ ID NO: 5797479 - DNA, 19 bp, Homo sapiens
tcttggcattaaaccacat

SEQ ID NO: 5797480 - DNA, 19 bp, Homo sapiens
tcttggcattggaattcta

SEQ ID NO: 5797481 - DNA, 20 bp, Homo sapiens
tcttggcattttcctcgcct

SEQ ID NO: 5797482 - DNA, 14 bp, Homo sapiens
tcttggccagagct

SEQ ID NO: 5797483 - DNA, 14 bp, Homo sapiens
tcttggccagccaa

SEQ ID NO: 5797484 - DNA, 16 bp, Homo sapiens
tcttggccatgggagg

SEQ ID NO: 5797485 - DNA, 22 bp, Homo sapiens
tcttggccatgggaggcctttc

SEQ ID NO: 5797486 - DNA, 13 bp, Homo sapiens
tcttggcccctgt

SEQ ID NO: 5797487 - DNA, 16 bp, Homo sapiens
tcttggcccctgtgtg

SEQ ID NO: 5797488 - DNA, 18 bp, Homo sapiens
tcttggccctattcatta

SEQ ID NO: 5797489 - DNA, 21 bp, Homo sapiens
tcttggccctcctcagctccc

SEQ ID NO: 5797490 - DNA, 21 bp, Homo sapiens
tcttggcctcccaaagtgctg

SEQ ID NO: 5797491 - DNA, 14 bp, Homo sapiens
tcttggcctctgct

SEQ ID NO: 5797492 - DNA, 14 bp, Homo sapiens
tcttggcctgctag

SEQ ID NO: 5797493 - DNA, 15 bp, Homo sapiens
tcttggcctttgcat

SEQ ID NO: 5797494 - DNA, 16 bp, Homo sapiens
tcttggcctttgcatt

SEQ ID NO: 5797495 - DNA, 15 bp, Homo sapiens
tcttggcggcagcag

SEQ ID NO: 5797496 - DNA, 19 bp, Homo sapiens
tcttggcggcagcagccat

SEQ ID NO: 5797497 - DNA, 16 bp, Homo sapiens
tcttggctattgaaga

SEQ ID NO: 5797498 - DNA, 14 bp, Homo sapiens
tcttggctcactgc

SEQ ID NO: 5797499 - DNA, 22 bp, Homo sapiens
tcttggctcgcaacctccgcct

SEQ ID NO: 5797500 - DNA, 16 bp, Homo sapiens
tcttggctgacccctc

SEQ ID NO: 5797501 - DNA, 17 bp, Homo sapiens
tcttggctggacccagc

SEQ ID NO: 5797502 - DNA, 19 bp, Homo sapiens
tcttggctggacccagcca

SEQ ID NO: 5797503 - DNA, 16 bp, Homo sapiens
tcttggctggcttcct

SEQ ID NO: 5797504 - DNA, 15 bp, Homo sapiens
tcttggcttaatcat

SEQ ID NO: 5797505 - DNA, 20 bp, Homo sapiens
tcttggcttaatcattttca

SEQ ID NO: 5797506 - DNA, 21 bp, Homo sapiens
tcttggcttaatcattttcat

SEQ ID NO: 5797507 - DNA, 19 bp, Homo sapiens
tcttggcttctcagcccct

SEQ ID NO: 5797508 - DNA, 21 bp, Homo sapiens
tcttggcttcttaaaaactgt

SEQ ID NO: 5797509 - DNA, 15 bp, Homo sapiens
tcttggctttcatgt

SEQ ID NO: 5797510 - DNA, 16 bp, Homo sapiens
tcttggctttcatgtt

SEQ ID NO: 5797511 - DNA, 12 bp, Homo sapiens
tcttggctttgt

SEQ ID NO: 5797512 - DNA, 13 bp, Homo sapiens
tcttgggaaacac

SEQ ID NO: 5797513 - DNA, 13 bp, Homo sapiens
tcttgggaactga

SEQ ID NO: 5797514 - DNA, 20 bp, Homo sapiens
tcttgggacaacgtgctgct

SEQ ID NO: 5797515 - DNA, 17 bp, Homo sapiens
tcttgggaccccagaga

SEQ ID NO: 5797516 - DNA, 22 bp, Homo sapiens
tcttgggaccccagagaaaacc

SEQ ID NO: 5797517 - DNA, 22 bp, Homo sapiens
tcttgggactgggtttggaccc

SEQ ID NO: 5797518 - DNA, 16 bp, Homo sapiens
tcttgggagtatgttg

SEQ ID NO: 5797519 - DNA, 20 bp, Homo sapiens
tcttgggatagtgttctgct

SEQ ID NO: 5797520 - DNA, 23 bp, Homo sapiens
tcttgggatagtgttctgctcct

SEQ ID NO: 5797521 - DNA, 14 bp, Homo sapiens
tcttgggattcctc

SEQ ID NO: 5797522 - DNA, 22 bp, Homo sapiens
tcttgggcaatattctctgtac

SEQ ID NO: 5797523 - DNA, 24 bp, Homo sapiens
tcttgggcaatattctctgtacat

SEQ ID NO: 5797524 - DNA, 14 bp, Homo sapiens
tcttgggcaggcag

SEQ ID NO: 5797525 - DNA, 15 bp, Homo sapiens
tcttgggcagtcttt

SEQ ID NO: 5797526 - DNA, 18 bp, Homo sapiens
tcttgggcagtctttctt

SEQ ID NO: 5797527 - DNA, 17 bp, Homo sapiens
tcttgggccaagccagc

SEQ ID NO: 5797528 - DNA, 19 bp, Homo sapiens
tcttgggccaagccagctg

SEQ ID NO: 5797529 - DNA, 23 bp, Homo sapiens
tcttgggccaagccagctgccta

SEQ ID NO: 5797530 - DNA, 11 bp, Homo sapiens
tcttgggccct

SEQ ID NO: 5797531 - DNA, 20 bp, Homo sapiens
tcttgggcctcaggctctgc

SEQ ID NO: 5797532 - DNA, 15 bp, Homo sapiens
tcttgggctactggc

SEQ ID NO: 5797533 - DNA, 14 bp, Homo sapiens
tcttgggctctcct

SEQ ID NO: 5797534 - DNA, 20 bp, Homo sapiens
tcttggggactaacccaatg

SEQ ID NO: 5797535 - DNA, 17 bp, Homo sapiens
tcttggggcaagactgc

SEQ ID NO: 5797536 - DNA, 17 bp, Homo sapiens
tcttggggcccagtgca

SEQ ID NO: 5797537 - DNA, 16 bp, Homo sapiens
tcttggggcgcccacc

SEQ ID NO: 5797538 - DNA, 13 bp, Homo sapiens
tcttggggctcgc

SEQ ID NO: 5797539 - DNA, 16 bp, Homo sapiens
tcttggggctcgcccc

SEQ ID NO: 5797540 - DNA, 20 bp, Homo sapiens
tcttggggctcgccccaccc

SEQ ID NO: 5797541 - DNA, 17 bp, Homo sapiens
tcttggggctgatgaag

SEQ ID NO: 5797542 - DNA, 20 bp, Homo sapiens
tcttgggggacagggctggc

SEQ ID NO: 5797543 - DNA, 22 bp, Homo sapiens
tcttgggggacagggctggccc

SEQ ID NO: 5797544 - DNA, 24 bp, Homo sapiens
tcttgggggacagggctggcccag

SEQ ID NO: 5797545 - DNA, 13 bp, Homo sapiens
tcttgggggaggc

SEQ ID NO: 5797546 - DNA, 18 bp, Homo sapiens
tcttgggggaggccaccc

SEQ ID NO: 5797547 - DNA, 19 bp, Homo sapiens
tcttgggggaggccacccc

SEQ ID NO: 5797548 - DNA, 20 bp, Homo sapiens
tcttgggggggtggccgctg

SEQ ID NO: 5797549 - DNA, 17 bp, Homo sapiens
tcttgggggtcacccat

SEQ ID NO: 5797550 - DNA, 22 bp, Homo sapiens
tcttgggggtggggctgcatcc

SEQ ID NO: 5797551 - DNA, 21 bp, Homo sapiens
tcttggggtactcttgatgtg

SEQ ID NO: 5797552 - DNA, 22 bp, Homo sapiens
tctttagtttttggttgggaat

SEQ ID NO: 5797553 - DNA, 15 bp, Homo sapiens
tctttagtttttgtg

SEQ ID NO: 5797554 - DNA, 18 bp, Homo sapiens
tctttataaatgcaaatg

SEQ ID NO: 5797555 - DNA, 10 bp, Homo sapiens
tctttataac

SEQ ID NO: 5797556 - DNA, 20 bp, Homo sapiens
tctttataacaaaacaggga

SEQ ID NO: 5797557 - DNA, 16 bp, Homo sapiens
tctttataagaaagcc

SEQ ID NO: 5797558 - DNA, 17 bp, Homo sapiens
tctttataagaaagcct

SEQ ID NO: 5797559 - DNA, 19 bp, Homo sapiens
tctttataagaaagcctga

SEQ ID NO: 5797560 - DNA, 16 bp, Homo sapiens
tctttatactctcttc

SEQ ID NO: 5797561 - DNA, 19 bp, Homo sapiens
tctttatactctcttccct

SEQ ID NO: 5797562 - DNA, 18 bp, Homo sapiens
tctttatacttaaacagc

SEQ ID NO: 5797563 - DNA, 21 bp, Homo sapiens
tctttatacttaaacagcttt

SEQ ID NO: 5797564 - DNA, 13 bp, Homo sapiens
tctttatagtgaa

SEQ ID NO: 5797565 - DNA, 17 bp, Homo sapiens
tctttatagtgaagtgt

SEQ ID NO: 5797566 - DNA, 15 bp, Homo sapiens
tctttatagtgcaca

SEQ ID NO: 5797567 - DNA, 12 bp, Homo sapiens
tctttatagttg

SEQ ID NO: 5797568 - DNA, 12 bp, Homo sapiens
tctttatataag

SEQ ID NO: 5797569 - DNA, 23 bp, Homo sapiens
tctttatatacaataatggaaaa

SEQ ID NO: 5797570 - DNA, 18 bp, Homo sapiens
tctttatatatggacagc

SEQ ID NO: 5797571 - DNA, 16 bp, Homo sapiens
tctttatatgaacata

SEQ ID NO: 5797572 - DNA, 14 bp, Homo sapiens
tctttatatttcaa

SEQ ID NO: 5797573 - DNA, 19 bp, Homo sapiens
tctttatcctaaaaatctg

SEQ ID NO: 5797574 - DNA, 14 bp, Homo sapiens
tctttatctcctgg

SEQ ID NO: 5797575 - DNA, 15 bp, Homo sapiens
tctttatgactgttt

SEQ ID NO: 5797576 - DNA, 23 bp, Homo sapiens
tctttatgagctaaaaatatgca

SEQ ID NO: 5797577 - DNA, 17 bp, Homo sapiens
tctttatgatttcatga

SEQ ID NO: 5797578 - DNA, 17 bp, Homo sapiens
tctttatgcaaaaacat

SEQ ID NO: 5797579 - DNA, 21 bp, Homo sapiens
tctttatgcaaaaacatatgt

SEQ ID NO: 5797580 - DNA, 13 bp, Homo sapiens
tctttatgctgta

SEQ ID NO: 5797581 - DNA, 17 bp, Homo sapiens
tctttatgctgtatttt

SEQ ID NO: 5797582 - DNA, 21 bp, Homo sapiens
tctttatgtaagaagaaactg

SEQ ID NO: 5797583 - DNA, 15 bp, Homo sapiens
tctttatgttgagtc

SEQ ID NO: 5797584 - DNA, 17 bp, Homo sapiens
tctttattaaatgtaga

SEQ ID NO: 5797585 - DNA, 21 bp, Homo sapiens
tctttattaaatgtagaaagt

SEQ ID NO: 5797586 - DNA, 19 bp, Homo sapiens
tctttattaacaaacagga

SEQ ID NO: 5797587 - DNA, 15 bp, Homo sapiens
tctttattaacctca

SEQ ID NO: 5797588 - DNA, 19 bp, Homo sapiens
tctttattaagtagatgaa

SEQ ID NO: 5797589 - DNA, 16 bp, Homo sapiens
tctttattaatcacta

SEQ ID NO: 5797590 - DNA, 16 bp, Homo sapiens
tctttattagctttct

SEQ ID NO: 5797591 - DNA, 17 bp, Homo sapiens
tctttattagctttctc

SEQ ID NO: 5797592 - DNA, 17 bp, Homo sapiens
tctttattagtaacatc

SEQ ID NO: 5797593 - DNA, 21 bp, Homo sapiens
tctttattatttttctctctc

SEQ ID NO: 5797594 - DNA, 21 bp, Homo sapiens
tctttattcaccttttcttca

SEQ ID NO: 5797595 - DNA, 14 bp, Homo sapiens
tctttattcctagt

SEQ ID NO: 5797596 - DNA, 21 bp, Homo sapiens
tctttattctcagtaactttt

SEQ ID NO: 5797597 - DNA, 20 bp, Homo sapiens
tctttattcttattactatt

SEQ ID NO: 5797598 - DNA, 23 bp, Homo sapiens
tctttattgtccaccatgctctc

SEQ ID NO: 5797599 - DNA, 12 bp, Homo sapiens
tctttattgtct

SEQ ID NO: 5797600 - DNA, 18 bp, Homo sapiens
tctttatttctagcagag

SEQ ID NO: 5797601 - DNA, 23 bp, Homo sapiens
tctttattttaacctttgataga

SEQ ID NO: 5797602 - DNA, 15 bp, Homo sapiens
tctttatttttctct

SEQ ID NO: 5797603 - DNA, 17 bp, Homo sapiens
tctttatttttttccca

SEQ ID NO: 5797604 - DNA, 18 bp, Homo sapiens
tctttcaaaccagcttca

SEQ ID NO: 5797605 - DNA, 22 bp, Homo sapiens
tctttcaaaggtagccatcatg

SEQ ID NO: 5797606 - DNA, 21 bp, Homo sapiens
tctttcaaataacttagttct

SEQ ID NO: 5797607 - DNA, 17 bp, Homo sapiens
tctttcaacttatttct

SEQ ID NO: 5797608 - DNA, 14 bp, Homo sapiens
tctttcaagaatga

SEQ ID NO: 5797609 - DNA, 23 bp, Homo sapiens
tctttcaagacagcctaatgaag

SEQ ID NO: 5797610 - DNA, 19 bp, Homo sapiens
tctttcaagtgaatctaaa

SEQ ID NO: 5797611 - DNA, 16 bp, Homo sapiens
tctttcaataaatgta

SEQ ID NO: 5797612 - DNA, 19 bp, Homo sapiens
tctttcaataaatgtatca

SEQ ID NO: 5797613 - DNA, 20 bp, Homo sapiens
tctttcaataaatgtatcat

SEQ ID NO: 5797614 - DNA, 16 bp, Homo sapiens
tctttcaatacagata

SEQ ID NO: 5797615 - DNA, 18 bp, Homo sapiens
tctttcaatacagatata

SEQ ID NO: 5797616 - DNA, 19 bp, Homo sapiens
tctttcaatacagatatat

SEQ ID NO: 5797617 - DNA, 17 bp, Homo sapiens
tctttcaatccacagta

SEQ ID NO: 5797618 - DNA, 16 bp, Homo sapiens
tctttcaatgcagcac

SEQ ID NO: 5797619 - DNA, 16 bp, Homo sapiens
tctttcaattctgtga

SEQ ID NO: 5797620 - DNA, 20 bp, Homo sapiens
tctttcacacttccaccagc

SEQ ID NO: 5797621 - DNA, 14 bp, Homo sapiens
tctttcacagctcc

SEQ ID NO: 5797622 - DNA, 15 bp, Homo sapiens
tctttcacagctcct

SEQ ID NO: 5797623 - DNA, 18 bp, Homo sapiens
tctttcacaggcatcagg

SEQ ID NO: 5797624 - DNA, 23 bp, Homo sapiens
tctttcacattgtttgctgctat

SEQ ID NO: 5797625 - DNA, 17 bp, Homo sapiens
tctttcacatttaaata

SEQ ID NO: 5797626 - DNA, 19 bp, Homo sapiens
tctttcaccaagtaaattt

SEQ ID NO: 5797627 - DNA, 14 bp, Homo sapiens
tctttcacttgaaa

SEQ ID NO: 5797628 - DNA, 16 bp, Homo sapiens
tctttcacttgaaaga

SEQ ID NO: 5797629 - DNA, 14 bp, Homo sapiens
tctttcagaaaaca

SEQ ID NO: 5797630 - DNA, 15 bp, Homo sapiens
tctttcagaaaacag

SEQ ID NO: 5797631 - DNA, 14 bp, Homo sapiens
tctttcagaaagct

SEQ ID NO: 5797632 - DNA, 11 bp, Homo sapiens
tctttcagaag

SEQ ID NO: 5797633 - DNA, 14 bp, Homo sapiens
tctttcagatcatt

SEQ ID NO: 5797634 - DNA, 15 bp, Homo sapiens
tctttcagatcattt

SEQ ID NO: 5797635 - DNA, 16 bp, Homo sapiens
tctttcagatcattta

SEQ ID NO: 5797636 - DNA, 20 bp, Homo sapiens
tctttcagccaagaattctt

SEQ ID NO: 5797637 - DNA, 14 bp, Homo sapiens
tctttcagcctgct

SEQ ID NO: 5797638 - DNA, 23 bp, Homo sapiens
tctttcagctcatttaatcccag

SEQ ID NO: 5797639 - DNA, 16 bp, Homo sapiens
tctttcagctgtgtct

SEQ ID NO: 5797640 - DNA, 19 bp, Homo sapiens
tctttcaggaaatttttgc

SEQ ID NO: 5797641 - DNA, 21 bp, Homo sapiens
tctttcagtacttttttaaat

SEQ ID NO: 5797642 - DNA, 17 bp, Homo sapiens
tctttcagtattaaact

SEQ ID NO: 5797643 - DNA, 12 bp, Homo sapiens
tctttcatacat

SEQ ID NO: 5797644 - DNA, 15 bp, Homo sapiens
tctttcatacatata

SEQ ID NO: 5797645 - DNA, 21 bp, Homo sapiens
tctttcatacatatatatatt

SEQ ID NO: 5797646 - DNA, 19 bp, Homo sapiens
tctttcatacattatattc

SEQ ID NO: 5797647 - DNA, 15 bp, Homo sapiens
tctttcatactacat

SEQ ID NO: 5797648 - DNA, 15 bp, Homo sapiens
tctttcatagttctg

SEQ ID NO: 5797649 - DNA, 23 bp, Homo sapiens
tctttcatccactagtgcaaatc

SEQ ID NO: 5797650 - DNA, 13 bp, Homo sapiens
tctttcatggaat

SEQ ID NO: 5797651 - DNA, 15 bp, Homo sapiens
tctttcatgtaagta

SEQ ID NO: 5797652 - DNA, 17 bp, Homo sapiens
tctttcatgtcttgtca

SEQ ID NO: 5797653 - DNA, 17 bp, Homo sapiens
tctttccaaagtacact

SEQ ID NO: 5797654 - DNA, 18 bp, Homo sapiens
tctttccaaattatttct

SEQ ID NO: 5797655 - DNA, 20 bp, Homo sapiens
tctttccaaattatttctta

SEQ ID NO: 5797656 - DNA, 19 bp, Homo sapiens
tctttccaaccggctttgt

SEQ ID NO: 5797657 - DNA, 21 bp, Homo sapiens
tctttccaccataccttagag

SEQ ID NO: 5797658 - DNA, 21 bp, Homo sapiens
tctttccactcctcctagcca

SEQ ID NO: 5797659 - DNA, 13 bp, Homo sapiens
tctttccactctg

SEQ ID NO: 5797660 - DNA, 17 bp, Homo sapiens
tctttccactctggatt

SEQ ID NO: 5797661 - DNA, 19 bp, Homo sapiens
tctttccacttctctgggt

SEQ ID NO: 5797662 - DNA, 16 bp, Homo sapiens
tctttccacttgccct

SEQ ID NO: 5797663 - DNA, 15 bp, Homo sapiens
tctttccactttcat

SEQ ID NO: 5797664 - DNA, 22 bp, Homo sapiens
tctttccagaggagtttcttaa

SEQ ID NO: 5797665 - DNA, 12 bp, Homo sapiens
tctttccaggct

SEQ ID NO: 5797666 - DNA, 22 bp, Homo sapiens
tctttccaggcttccctgactt

SEQ ID NO: 5797667 - DNA, 16 bp, Homo sapiens
tctttccatatccata

SEQ ID NO: 5797668 - DNA, 13 bp, Homo sapiens
tctttccatgcag

SEQ ID NO: 5797669 - DNA, 19 bp, Homo sapiens
tctttccattatgattctt

SEQ ID NO: 5797670 - DNA, 16 bp, Homo sapiens
tctttccatttctctc

SEQ ID NO: 5797671 - DNA, 16 bp, Homo sapiens
tctttccatttgcatt

SEQ ID NO: 5797672 - DNA, 17 bp, Homo sapiens
tctttcccacactgaaa

SEQ ID NO: 5797673 - DNA, 15 bp, Homo sapiens
tctttccccacctct

SEQ ID NO: 5797674 - DNA, 22 bp, Homo sapiens
tctttccccacctcttccttcc

SEQ ID NO: 5797675 - DNA, 14 bp, Homo sapiens
tctttccccactga

SEQ ID NO: 5797676 - DNA, 20 bp, Homo sapiens
tctttccccagaggctccca

SEQ ID NO: 5797677 - DNA, 22 bp, Homo sapiens
tctttccccagcagtttctgtc

SEQ ID NO: 5797678 - DNA, 20 bp, Homo sapiens
tctttcccctcagagctctt

SEQ ID NO: 5797679 - DNA, 13 bp, Homo sapiens
tctttcccctcct

SEQ ID NO: 5797680 - DNA, 17 bp, Homo sapiens
tctttccctagaggcaa

SEQ ID NO: 5797681 - DNA, 14 bp, Homo sapiens
tctttccctcatgt

SEQ ID NO: 5797682 - DNA, 13 bp, Homo sapiens
tctttccctccct

SEQ ID NO: 5797683 - DNA, 12 bp, Homo sapiens
tctttccctgcg

SEQ ID NO: 5797684 - DNA, 14 bp, Homo sapiens
tctttccctgcgag

SEQ ID NO: 5797685 - DNA, 17 bp, Homo sapiens
tctttccctggacaggc

SEQ ID NO: 5797686 - DNA, 22 bp, Homo sapiens
tctttcccttactccctatcta

SEQ ID NO: 5797687 - DNA, 14 bp, Homo sapiens
tctttcccttcctc

SEQ ID NO: 5797688 - DNA, 16 bp, Homo sapiens
tctttcccttcctcca

SEQ ID NO: 5797689 - DNA, 19 bp, Homo sapiens
tctttccctttaccactgt

SEQ ID NO: 5797690 - DNA, 21 bp, Homo sapiens
tctttccctttaccactgtgg

SEQ ID NO: 5797691 - DNA, 13 bp, Homo sapiens
tctttcccttttc

SEQ ID NO: 5797692 - DNA, 22 bp, Homo sapiens
tctttcccttttctgtttagga

SEQ ID NO: 5797693 - DNA, 18 bp, Homo sapiens
tctttccgactgcccaga

SEQ ID NO: 5797694 - DNA, 22 bp, Homo sapiens
tctttccgtctccctaaaataa

SEQ ID NO: 5797695 - DNA, 16 bp, Homo sapiens
tctttcctaaagccaa

SEQ ID NO: 5797696 - DNA, 17 bp, Homo sapiens
tctttcctaagacctgg

SEQ ID NO: 5797697 - DNA, 23 bp, Homo sapiens
tctttcctaaggctgcaaggttt

SEQ ID NO: 5797698 - DNA, 14 bp, Homo sapiens
tctttcctatttca

SEQ ID NO: 5797699 - DNA, 16 bp, Homo sapiens
tctttcctatttcagt

SEQ ID NO: 5797700 - DNA, 16 bp, Homo sapiens
tctttcctcaatatag

SEQ ID NO: 5797701 - DNA, 15 bp, Homo sapiens
tctttcctcacattt

SEQ ID NO: 5797702 - DNA, 14 bp, Homo sapiens
tctttcctcatttc

SEQ ID NO: 5797703 - DNA, 15 bp, Homo sapiens
tctttcctccaccca

SEQ ID NO: 5797704 - DNA, 14 bp, Homo sapiens
tctttcctcctttc

SEQ ID NO: 5797705 - DNA, 18 bp, Homo sapiens
tctttcctctccaattgt

SEQ ID NO: 5797706 - DNA, 13 bp, Homo sapiens
tctttcctctctg

SEQ ID NO: 5797707 - DNA, 12 bp, Homo sapiens
tctttcctgagg

SEQ ID NO: 5797708 - DNA, 17 bp, Homo sapiens
tctttcctgaggctggg

SEQ ID NO: 5797709 - DNA, 14 bp, Homo sapiens
tctttcctgccctt

SEQ ID NO: 5797710 - DNA, 15 bp, Homo sapiens
tctttcctgtgccag

SEQ ID NO: 5797711 - DNA, 14 bp, Homo sapiens
tctttccttcccaa

SEQ ID NO: 5797712 - DNA, 16 bp, Homo sapiens
tctttccttcccaata

SEQ ID NO: 5797713 - DNA, 12 bp, Homo sapiens
tctttccttcct

SEQ ID NO: 5797714 - DNA, 16 bp, Homo sapiens
tctttccttcctctca

SEQ ID NO: 5797715 - DNA, 13 bp, Homo sapiens
tctttccttcctt

SEQ ID NO: 5797716 - DNA, 20 bp, Homo sapiens
tctttccttgaaaataaaaa

SEQ ID NO: 5797717 - DNA, 15 bp, Homo sapiens
tctttcctttaaaaa

SEQ ID NO: 5797718 - DNA, 20 bp, Homo sapiens
tctttcctttcatcctcagc

SEQ ID NO: 5797719 - DNA, 12 bp, Homo sapiens
tctttcctttcc

SEQ ID NO: 5797720 - DNA, 16 bp, Homo sapiens
tctttcggtctcctta

SEQ ID NO: 5797721 - DNA, 21 bp, Homo sapiens
tctttcgttggttgtttctct

SEQ ID NO: 5797722 - DNA, 22 bp, Homo sapiens
tctttcgttggttgtttctctg

SEQ ID NO: 5797723 - DNA, 14 bp, Homo sapiens
tctttctacagtat

SEQ ID NO: 5797724 - DNA, 17 bp, Homo sapiens
tctttctacatgactgg

SEQ ID NO: 5797725 - DNA, 18 bp, Homo sapiens
tctttctacattctcatc

SEQ ID NO: 5797726 - DNA, 13 bp, Homo sapiens
tctttctagagca

SEQ ID NO: 5797727 - DNA, 16 bp, Homo sapiens
tctttctagagccagc

SEQ ID NO: 5797728 - DNA, 15 bp, Homo sapiens
tctttctagaggtgc

SEQ ID NO: 5797729 - DNA, 11 bp, Homo sapiens
tctttctagcc

SEQ ID NO: 5797730 - DNA, 21 bp, Homo sapiens
tctttctagtggtctttgtaa

SEQ ID NO: 5797731 - DNA, 17 bp, Homo sapiens
tcttttttgtacagtat

SEQ ID NO: 5797732 - DNA, 22 bp, Homo sapiens
tctttttttaaaaataaatcta

SEQ ID NO: 5797733 - DNA, 14 bp, Homo sapiens
tctttttttaaaag

SEQ ID NO: 5797734 - DNA, 17 bp, Homo sapiens
tctttttttaactggtg

SEQ ID NO: 5797735 - DNA, 18 bp, Homo sapiens
tctttttttaactggtga

SEQ ID NO: 5797736 - DNA, 21 bp, Homo sapiens
tctttttttaagtgttctgtg

SEQ ID NO: 5797737 - DNA, 18 bp, Homo sapiens
tctttttttacttatgcc

SEQ ID NO: 5797738 - DNA, 12 bp, Homo sapiens
tctttttttatg

SEQ ID NO: 5797739 - DNA, 17 bp, Homo sapiens
tctttttttccccccct

SEQ ID NO: 5797740 - DNA, 16 bp, Homo sapiens
tctttttttctctaga

SEQ ID NO: 5797741 - DNA, 15 bp, Homo sapiens
tctttttttcttggc

SEQ ID NO: 5797742 - DNA, 15 bp, Homo sapiens
tctttttttctttgg

SEQ ID NO: 5797743 - DNA, 19 bp, Homo sapiens
tctttttttgctgttccac

SEQ ID NO: 5797744 - DNA, 15 bp, Homo sapiens
tctttttttgcttta

SEQ ID NO: 5797745 - DNA, 22 bp, Homo sapiens
tctttttttgctttaaaacaaa

SEQ ID NO: 5797746 - DNA, 15 bp, Homo sapiens
tctttttttgtatag

SEQ ID NO: 5797747 - DNA, 16 bp, Homo sapiens
tctttttttgtgatgt

SEQ ID NO: 5797748 - DNA, 16 bp, Homo sapiens
tcttttttttatataa

SEQ ID NO: 5797749 - DNA, 15 bp, Homo sapiens
tcttttttttcttca

SEQ ID NO: 5797750 - DNA, 21 bp, Homo sapiens
tctttttttttcttcattgta

SEQ ID NO: 5797751 - DNA, 23 bp, Homo sapiens
tcttttttttttaagtgaaattt

SEQ ID NO: 5797752 - DNA, 17 bp, Homo sapiens
tcttttttttttattat

SEQ ID NO: 5797753 - DNA, 18 bp, Homo sapiens
tcttttttttttattatg

SEQ ID NO: 5797754 - DNA, 16 bp, Homo sapiens
tcttttttttttccaa

SEQ ID NO: 5797755 - DNA, 18 bp, Homo sapiens
tcttttttttttccaaat

SEQ ID NO: 5797756 - DNA, 15 bp, Homo sapiens
tcttttttttttccc

SEQ ID NO: 5797757 - DNA, 23 bp, Homo sapiens
tctttttttttttttttaaagaa

SEQ ID NO: 5797758 - DNA, 21 bp, Homo sapiens
tctttttttttttttttgaaa

SEQ ID NO: 5797759 - DNA, 20 bp, Homo sapiens
tctttttttttttttttgtg

SEQ ID NO: 5797760 - DNA, 19 bp, Homo sapiens
tgaaaaaaaaaagtaatta

SEQ ID NO: 5797761 - DNA, 18 bp, Homo sapiens
tgaaaaaaaaaatgctga

SEQ ID NO: 5797762 - DNA, 22 bp, Homo sapiens
tgaaaaaaaaaatgttgagaag

SEQ ID NO: 5797763 - DNA, 14 bp, Homo sapiens
tgaaaaaaaaaggg

SEQ ID NO: 5797764 - DNA, 21 bp, Homo sapiens
tgaaaaaaaaattatttgcct

SEQ ID NO: 5797765 - DNA, 22 bp, Homo sapiens
tgaaaaaaaacctgagatttat

SEQ ID NO: 5797766 - DNA, 14 bp, Homo sapiens
tgaaaaaaaagttt

SEQ ID NO: 5797767 - DNA, 16 bp, Homo sapiens
tgaaaaaaaatagatg

SEQ ID NO: 5797768 - DNA, 21 bp, Homo sapiens
tgaaaaaaaatagatgtttta

SEQ ID NO: 5797769 - DNA, 23 bp, Homo sapiens
tgaaaaaaaattcctttcagatt

SEQ ID NO: 5797770 - DNA, 21 bp, Homo sapiens
tgaaaaaaaatttgttttcaa

SEQ ID NO: 5797771 - DNA, 20 bp, Homo sapiens
tgaaaaaaagtgctgaaaat

SEQ ID NO: 5797772 - DNA, 17 bp, Homo sapiens
tgaaaaaaagtttacaa

SEQ ID NO: 5797773 - DNA, 19 bp, Homo sapiens
tgaaaaaaagtttctattt

SEQ ID NO: 5797774 - DNA, 18 bp, Homo sapiens
tgaaaaaaataattttaa

SEQ ID NO: 5797775 - DNA, 14 bp, Homo sapiens
tgaaaaaaatatat

SEQ ID NO: 5797776 - DNA, 21 bp, Homo sapiens
tgaaaaaaccgttcaaattct

SEQ ID NO: 5797777 - DNA, 22 bp, Homo sapiens
tgaaaaaactttctctttgcca

SEQ ID NO: 5797778 - DNA, 14 bp, Homo sapiens
tgaaaaaagaaaat

SEQ ID NO: 5797779 - DNA, 21 bp, Homo sapiens
tgaaaaaagaaattccctgga

SEQ ID NO: 5797780 - DNA, 21 bp, Homo sapiens
tgaaaaaagaagtttgggcta

SEQ ID NO: 5797781 - DNA, 12 bp, Homo sapiens
tgaaaaaagaga

SEQ ID NO: 5797782 - DNA, 20 bp, Homo sapiens
tgaaaaaagcaagattgaaa

SEQ ID NO: 5797783 - DNA, 20 bp, Homo sapiens
tgaaaaaagctcatttcatg

SEQ ID NO: 5797784 - DNA, 17 bp, Homo sapiens
tgaaaaaagcttttatg

SEQ ID NO: 5797785 - DNA, 12 bp, Homo sapiens
tgaaaaaatata

SEQ ID NO: 5797786 - DNA, 12 bp, Homo sapiens
tgaaaaaatatt

SEQ ID NO: 5797787 - DNA, 11 bp, Homo sapiens
tgaaaaaatgt

SEQ ID NO: 5797788 - DNA, 21 bp, Homo sapiens
tgaaaaaatgtagcttttatg

SEQ ID NO: 5797789 - DNA, 15 bp, Homo sapiens
tgaaaaaatgttcta

SEQ ID NO: 5797790 - DNA, 18 bp, Homo sapiens
tgaaaaaatgttctatat

SEQ ID NO: 5797791 - DNA, 23 bp, Homo sapiens
tgaaaaaatgttctatatgcatt

SEQ ID NO: 5797792 - DNA, 22 bp, Homo sapiens
tgaaaaaattaaaatctttctt

SEQ ID NO: 5797793 - DNA, 16 bp, Homo sapiens
tgaaaaacaaaaagct

SEQ ID NO: 5797794 - DNA, 11 bp, Homo sapiens
tgaaaaacaag

SEQ ID NO: 5797795 - DNA, 14 bp, Homo sapiens
tgaaaaacaatttt

SEQ ID NO: 5797796 - DNA, 20 bp, Homo sapiens
tgaaaaacaattttctgtaa

SEQ ID NO: 5797797 - DNA, 13 bp, Homo sapiens
tgaaaaacagaaa

SEQ ID NO: 5797798 - DNA, 14 bp, Homo sapiens
tgaaaaacagcaga

SEQ ID NO: 5797799 - DNA, 14 bp, Homo sapiens
tgaaaaacattcca

SEQ ID NO: 5797800 - DNA, 18 bp, Homo sapiens
tgaaaaacattccaggaa

SEQ ID NO: 5797801 - DNA, 16 bp, Homo sapiens
tgaaaaactaatgtgt

SEQ ID NO: 5797802 - DNA, 17 bp, Homo sapiens
tgaaaaactaatgtgtc

SEQ ID NO: 5797803 - DNA, 13 bp, Homo sapiens
tgaaaaactgagt

SEQ ID NO: 5797804 - DNA, 18 bp, Homo sapiens
tgaaaaactgatcaaaaa

SEQ ID NO: 5797805 - DNA, 23 bp, Homo sapiens
tgaaaaactgatcaaaaataaac

SEQ ID NO: 5797806 - DNA, 23 bp, Homo sapiens
tgaaaaactggcaacattccaag

SEQ ID NO: 5797807 - DNA, 9 bp, Homo sapiens
tgaaaaaga

SEQ ID NO: 5797808 - DNA, 13 bp, Homo sapiens
tgaaaaagaaaaa

SEQ ID NO: 5797809 - DNA, 19 bp, Homo sapiens
tgaaaaagaaaaaaatgat

SEQ ID NO: 5797810 - DNA, 13 bp, Homo sapiens
tgaaaaagacata

SEQ ID NO: 5797811 - DNA, 14 bp, Homo sapiens
tgaaaaagacataa

SEQ ID NO: 5797812 - DNA, 21 bp, Homo sapiens
tgaaaaagacataaaacagaa

SEQ ID NO: 5797813 - DNA, 18 bp, Homo sapiens
tgaaaaagatatttatga

SEQ ID NO: 5797814 - DNA, 15 bp, Homo sapiens
tgaaaaagatgccaa

SEQ ID NO: 5797815 - DNA, 13 bp, Homo sapiens
tgaaaaagcagac

SEQ ID NO: 5797816 - DNA, 21 bp, Homo sapiens
tgaaaaagcagctaccaggtg

SEQ ID NO: 5797817 - DNA, 14 bp, Homo sapiens
tgaaaaagcatgta

SEQ ID NO: 5797818 - DNA, 18 bp, Homo sapiens
tgaaaaagcatgtacagt

SEQ ID NO: 5797819 - DNA, 21 bp, Homo sapiens
tgaaaaagcatgtacagtgtt

SEQ ID NO: 5797820 - DNA, 19 bp, Homo sapiens
tgaaaaagcctaagaaaaa

SEQ ID NO: 5797821 - DNA, 16 bp, Homo sapiens
tgaaaaagctgcttct

SEQ ID NO: 5797822 - DNA, 18 bp, Homo sapiens
tgaaaaaggaaatattct

SEQ ID NO: 5797823 - DNA, 18 bp, Homo sapiens
tgaaaaaggaataaattg

SEQ ID NO: 5797824 - DNA, 16 bp, Homo sapiens
tgaaaaaggaggaaga

SEQ ID NO: 5797825 - DNA, 20 bp, Homo sapiens
tgaaaaaggaggaagagaaa

SEQ ID NO: 5797826 - DNA, 22 bp, Homo sapiens
tgaaaaaggaggaagagaaaaa

SEQ ID NO: 5797827 - DNA, 16 bp, Homo sapiens
tgaaaaagtgtacatg

SEQ ID NO: 5797828 - DNA, 22 bp, Homo sapiens
tgaaaaagtgtacatgaagaat

SEQ ID NO: 5797829 - DNA, 16 bp, Homo sapiens
tgaaaaataaaaacca

SEQ ID NO: 5797830 - DNA, 17 bp, Homo sapiens
tgaaaaatacgttttgt

SEQ ID NO: 5797831 - DNA, 11 bp, Homo sapiens
tgaaaaatata

SEQ ID NO: 5797832 - DNA, 12 bp, Homo sapiens
tgaaaaatataa

SEQ ID NO: 5797833 - DNA, 17 bp, Homo sapiens
tgaaaaatatctttgca

SEQ ID NO: 5797834 - DNA, 16 bp, Homo sapiens
tgaaaaatattgctaa

SEQ ID NO: 5797835 - DNA, 19 bp, Homo sapiens
tgaaaaatattgctaaaag

SEQ ID NO: 5797836 - DNA, 22 bp, Homo sapiens
tgaaaaatattgctaaaagtgc

SEQ ID NO: 5797837 - DNA, 24 bp, Homo sapiens
tgaaaaatattgctaaaagtgcat

SEQ ID NO: 5797838 - DNA, 18 bp, Homo sapiens
tgaaaaatcggcttacca

SEQ ID NO: 5797839 - DNA, 19 bp, Homo sapiens
tgaaaaatctagtatttgt

SEQ ID NO: 5797840 - DNA, 19 bp, Homo sapiens
tgaaaaatctcaattgaaa

SEQ ID NO: 5797841 - DNA, 19 bp, Homo sapiens
tgaaaaatctgaatttcta

SEQ ID NO: 5797842 - DNA, 23 bp, Homo sapiens
tgaaaaatctgttgataaatcca

SEQ ID NO: 5797843 - DNA, 17 bp, Homo sapiens
tgaaaaatgacaattgt

SEQ ID NO: 5797844 - DNA, 21 bp, Homo sapiens
tgaaaaatggagcagtaatgc

SEQ ID NO: 5797845 - DNA, 13 bp, Homo sapiens
tgaaaaatgtaaa

SEQ ID NO: 5797846 - DNA, 11 bp, Homo sapiens
tgaaaaattaa

SEQ ID NO: 5797847 - DNA, 17 bp, Homo sapiens
tgaaaaattaacttttt

SEQ ID NO: 5797848 - DNA, 20 bp, Homo sapiens
tgaaaaattacctgtataat

SEQ ID NO: 5797849 - DNA, 21 bp, Homo sapiens
tgaaaaattccactcaaaata

SEQ ID NO: 5797850 - DNA, 19 bp, Homo sapiens
tgaaaaattgcattcattg

SEQ ID NO: 5797851 - DNA, 14 bp, Homo sapiens
tgaaaaattgctga

SEQ ID NO: 5797852 - DNA, 23 bp, Homo sapiens
tgaaaaattgctgactgtagctt

SEQ ID NO: 5797853 - DNA, 15 bp, Homo sapiens
tgaaaaatttctaac

SEQ ID NO: 5797854 - DNA, 18 bp, Homo sapiens
tgaaaacaaaaaaaatgt

SEQ ID NO: 5797855 - DNA, 18 bp, Homo sapiens
tgaaaacaaagacattct

SEQ ID NO: 5797856 - DNA, 15 bp, Homo sapiens
tgaaaacaagaaaga

SEQ ID NO: 5797857 - DNA, 17 bp, Homo sapiens
tgaaaacaagaaagaaa

SEQ ID NO: 5797858 - DNA, 20 bp, Homo sapiens
tgaaaacaagagactgcttg

SEQ ID NO: 5797859 - DNA, 14 bp, Homo sapiens
tgaaaacaagtgct

SEQ ID NO: 5797860 - DNA, 16 bp, Homo sapiens
tgaaaacaattcagtg

SEQ ID NO: 5797861 - DNA, 12 bp, Homo sapiens
tgaaaacacatt

SEQ ID NO: 5797862 - DNA, 19 bp, Homo sapiens
tgaaaacacatttgctttt

SEQ ID NO: 5797863 - DNA, 14 bp, Homo sapiens
tgaaaacacatttt

SEQ ID NO: 5797864 - DNA, 16 bp, Homo sapiens
tgaaaacacctgagct

SEQ ID NO: 5797865 - DNA, 13 bp, Homo sapiens
tgaaaacactaac

SEQ ID NO: 5797866 - DNA, 12 bp, Homo sapiens
tgaaaacactta

SEQ ID NO: 5797867 - DNA, 15 bp, Homo sapiens
tgaaaacagaaattg

SEQ ID NO: 5797868 - DNA, 17 bp, Homo sapiens
tgaaaacagaaattggt

SEQ ID NO: 5797869 - DNA, 18 bp, Homo sapiens
tgaaaacagaaattggta

SEQ ID NO: 5797870 - DNA, 14 bp, Homo sapiens
tgaaaacagaatgt

SEQ ID NO: 5797871 - DNA, 18 bp, Homo sapiens
tgaaaacagatattacag

SEQ ID NO: 5797872 - DNA, 21 bp, Homo sapiens
tgaaaacagcccaggtcctcc

SEQ ID NO: 5797873 - DNA, 22 bp, Homo sapiens
tgaaaacataagccatggtgaa

SEQ ID NO: 5797874 - DNA, 17 bp, Homo sapiens
tgaaaacatctggaagg

SEQ ID NO: 5797875 - DNA, 23 bp, Homo sapiens
tgaaaacatggtagaattggaga

SEQ ID NO: 5797876 - DNA, 20 bp, Homo sapiens
tgaaaacatgtactacagct

SEQ ID NO: 5797877 - DNA, 15 bp, Homo sapiens
tgaaaaccaaccctg

SEQ ID NO: 5797878 - DNA, 22 bp, Homo sapiens
tgaaaaccatctggcctggcct

SEQ ID NO: 5797879 - DNA, 15 bp, Homo sapiens
tgaaaacccctggct

SEQ ID NO: 5797880 - DNA, 17 bp, Homo sapiens
tgaaaacccctggctga

SEQ ID NO: 5797881 - DNA, 15 bp, Homo sapiens
tgaaaacctaccagc

SEQ ID NO: 5797882 - DNA, 18 bp, Homo sapiens
tgaaaacctaccagccag

SEQ ID NO: 5797883 - DNA, 20 bp, Homo sapiens
tgaaaacgtcttccttcttt

SEQ ID NO: 5797884 - DNA, 17 bp, Homo sapiens
tgaaaacgttttattgt

SEQ ID NO: 5797885 - DNA, 19 bp, Homo sapiens
tgaaaacgttttattgtgt

SEQ ID NO: 5797886 - DNA, 23 bp, Homo sapiens
tgaaaactaatgtactgtacata

SEQ ID NO: 5797887 - DNA, 17 bp, Homo sapiens
tgaaaactacattttaa

SEQ ID NO: 5797888 - DNA, 19 bp, Homo sapiens
tgaaaactacattttaaca

SEQ ID NO: 5797889 - DNA, 20 bp, Homo sapiens
tgaaaactacattttaacat

SEQ ID NO: 5797890 - DNA, 14 bp, Homo sapiens
tgaaaactatttta

SEQ ID NO: 5797891 - DNA, 16 bp, Homo sapiens
tgaaaactattttaaa

SEQ ID NO: 5797892 - DNA, 21 bp, Homo sapiens
tgaaaactgctgataaaatat

SEQ ID NO: 5797893 - DNA, 14 bp, Homo sapiens
tgaaaactggatta

SEQ ID NO: 5797894 - DNA, 15 bp, Homo sapiens
tgaaaactgtaaata

SEQ ID NO: 5797895 - DNA, 23 bp, Homo sapiens
tgaaaactgtgcaactttttaaa

SEQ ID NO: 5797896 - DNA, 16 bp, Homo sapiens
tgaaaacttagccaga

SEQ ID NO: 5797897 - DNA, 12 bp, Homo sapiens
tgaaaacttcaa

SEQ ID NO: 5797898 - DNA, 16 bp, Homo sapiens
tgaaaacttcaaagct

SEQ ID NO: 5797899 - DNA, 15 bp, Homo sapiens
tgaaaacttcagaag

SEQ ID NO: 5797900 - DNA, 22 bp, Homo sapiens
tgaaaacttctcatttatgtta

SEQ ID NO: 5797901 - DNA, 18 bp, Homo sapiens
tgaaaacttgctgaaaaa

SEQ ID NO: 5797902 - DNA, 17 bp, Homo sapiens
tgaaaacttttgtaaat

SEQ ID NO: 5797903 - DNA, 23 bp, Homo sapiens
tgaaaacttttgtaaattattga

SEQ ID NO: 5797904 - DNA, 15 bp, Homo sapiens
tgaaaagaaaaatga

SEQ ID NO: 5797905 - DNA, 15 bp, Homo sapiens
tgaaaagaaagtgtt

SEQ ID NO: 5797906 - DNA, 22 bp, Homo sapiens
tgaaaagaacaaccctgaagca

SEQ ID NO: 5797907 - DNA, 18 bp, Homo sapiens
tgaaaagaagaaagtcta

SEQ ID NO: 5797908 - DNA, 22 bp, Homo sapiens
tgaaacaccaagatgtctgtct

SEQ ID NO: 5797909 - DNA, 18 bp, Homo sapiens
tgaaacaccttctctgga

SEQ ID NO: 5797910 - DNA, 19 bp, Homo sapiens
tgaaacaccttctctggag

SEQ ID NO: 5797911 - DNA, 15 bp, Homo sapiens
tgaaacacgaaactt

SEQ ID NO: 5797912 - DNA, 19 bp, Homo sapiens
tgaaacacgaaacttgtta

SEQ ID NO: 5797913 - DNA, 20 bp, Homo sapiens
tgaaacacgaaacttgttat

SEQ ID NO: 5797914 - DNA, 21 bp, Homo sapiens
tgaaacacgaaacttgttatt

SEQ ID NO: 5797915 - DNA, 23 bp, Homo sapiens
tgaaacactcagttgttcaataa

SEQ ID NO: 5797916 - DNA, 18 bp, Homo sapiens
tgaaacactcgtgtgcat

SEQ ID NO: 5797917 - DNA, 12 bp, Homo sapiens
tgaaacactgga

SEQ ID NO: 5797918 - DNA, 21 bp, Homo sapiens
tgaaacactggacctgggggt

SEQ ID NO: 5797919 - DNA, 15 bp, Homo sapiens
tgaaacactggtttt

SEQ ID NO: 5797920 - DNA, 14 bp, Homo sapiens
tgaaacacttgctt

SEQ ID NO: 5797921 - DNA, 15 bp, Homo sapiens
tgaaacagaaagttg

SEQ ID NO: 5797922 - DNA, 13 bp, Homo sapiens
tgaaacagacttg

SEQ ID NO: 5797923 - DNA, 11 bp, Homo sapiens
tgaaacagaga

SEQ ID NO: 5797924 - DNA, 22 bp, Homo sapiens
tgaaacagagaaagaaaaggca

SEQ ID NO: 5797925 - DNA, 13 bp, Homo sapiens
tgaaacagagaac

SEQ ID NO: 5797926 - DNA, 23 bp, Homo sapiens
tgaaacagattcaggccagccca

SEQ ID NO: 5797927 - DNA, 19 bp, Homo sapiens
tgaaacagctgccttagct

SEQ ID NO: 5797928 - DNA, 22 bp, Homo sapiens
tgaaacagctgccttagcttca

SEQ ID NO: 5797929 - DNA, 18 bp, Homo sapiens
tgaaacagctttctgggt

SEQ ID NO: 5797930 - DNA, 21 bp, Homo sapiens
tgaaacaggagagaaagggga

SEQ ID NO: 5797931 - DNA, 18 bp, Homo sapiens
tgaaacagggaaaatgaa

SEQ ID NO: 5797932 - DNA, 20 bp, Homo sapiens
tgaaacagtgtggatgtaaa

SEQ ID NO: 5797933 - DNA, 13 bp, Homo sapiens
tgaaacagttcca

SEQ ID NO: 5797934 - DNA, 16 bp, Homo sapiens
tgaaacagttgctgtg

SEQ ID NO: 5797935 - DNA, 22 bp, Homo sapiens
tgaaacatgaaacaactcatgt

SEQ ID NO: 5797936 - DNA, 23 bp, Homo sapiens
tgaaacatgcacattttgtacat

SEQ ID NO: 5797937 - DNA, 20 bp, Homo sapiens
tgaaacatgcttgtgtttct

SEQ ID NO: 5797938 - DNA, 18 bp, Homo sapiens
tgaaacatgggctgtgat

SEQ ID NO: 5797939 - DNA, 20 bp, Homo sapiens
tgaaacatgtgcccctgcca

SEQ ID NO: 5797940 - DNA, 14 bp, Homo sapiens
tgaaacatgttcat

SEQ ID NO: 5797941 - DNA, 20 bp, Homo sapiens
tgaaacatgttcatctggaa

SEQ ID NO: 5797942 - DNA, 12 bp, Homo sapiens
tgaaacattatt

SEQ ID NO: 5797943 - DNA, 23 bp, Homo sapiens
tgaaacattcacacagggctctt

SEQ ID NO: 5797944 - DNA, 16 bp, Homo sapiens
tgaaacattgctttta

SEQ ID NO: 5797945 - DNA, 18 bp, Homo sapiens
tgaaacattgcttttaaa

SEQ ID NO: 5797946 - DNA, 18 bp, Homo sapiens
tgaaacattttttcttct

SEQ ID NO: 5797947 - DNA, 19 bp, Homo sapiens
tgaaacattttttcttctg

SEQ ID NO: 5797948 - DNA, 21 bp, Homo sapiens
tgaaaccacaggcccttgggg

SEQ ID NO: 5797949 - DNA, 15 bp, Homo sapiens
tgaaaccacagtttc

SEQ ID NO: 5797950 - DNA, 21 bp, Homo sapiens
tgaaaccaccgtgaaccagag

SEQ ID NO: 5797951 - DNA, 13 bp, Homo sapiens
tgaaaccagaaga

SEQ ID NO: 5797952 - DNA, 21 bp, Homo sapiens
tgaaaccagaagactggatca

SEQ ID NO: 5797953 - DNA, 20 bp, Homo sapiens
tgaaaccagtgttagggaag

SEQ ID NO: 5797954 - DNA, 21 bp, Homo sapiens
tgaaacccacagtttgagacc

SEQ ID NO: 5797955 - DNA, 23 bp, Homo sapiens
tgaaacccattaggcatgcctaa

SEQ ID NO: 5797956 - DNA, 16 bp, Homo sapiens
tgaaacccatttactt

SEQ ID NO: 5797957 - DNA, 18 bp, Homo sapiens
tgaaacccatttacttag

SEQ ID NO: 5797958 - DNA, 23 bp, Homo sapiens
tgaaaccccaaacagtgactgta

SEQ ID NO: 5797959 - DNA, 18 bp, Homo sapiens
tgaaaccccatctctact

SEQ ID NO: 5797960 - DNA, 16 bp, Homo sapiens
tgaaacccccacacac

SEQ ID NO: 5797961 - DNA, 17 bp, Homo sapiens
tgaaacccccacacaca

SEQ ID NO: 5797962 - DNA, 16 bp, Homo sapiens
tgaaaccctgtctcta

SEQ ID NO: 5797963 - DNA, 20 bp, Homo sapiens
tgaaacctacacactgtcat

SEQ ID NO: 5797964 - DNA, 15 bp, Homo sapiens
tgaaacctaggaagc

SEQ ID NO: 5797965 - DNA, 15 bp, Homo sapiens
tgaaacctctgttct

SEQ ID NO: 5797966 - DNA, 17 bp, Homo sapiens
tgaaacctctgttctca

SEQ ID NO: 5797967 - DNA, 23 bp, Homo sapiens
tgaaacctctgttctcatgaagg

SEQ ID NO: 5797968 - DNA, 16 bp, Homo sapiens
tgaaacctcttcctag

SEQ ID NO: 5797969 - DNA, 18 bp, Homo sapiens
tgaaacctgacacctaga

SEQ ID NO: 5797970 - DNA, 13 bp, Homo sapiens
tgaaacctgagat

SEQ ID NO: 5797971 - DNA, 22 bp, Homo sapiens
tgaaacctgtataaccctgtta

SEQ ID NO: 5797972 - DNA, 15 bp, Homo sapiens
tgaaaccttgaagtt

SEQ ID NO: 5797973 - DNA, 17 bp, Homo sapiens
tgaaaccttttttaaga

SEQ ID NO: 5797974 - DNA, 18 bp, Homo sapiens
tgaaaccttttttaagat

SEQ ID NO: 5797975 - DNA, 19 bp, Homo sapiens
tgaaaccttttttaagatt

SEQ ID NO: 5797976 - DNA, 20 bp, Homo sapiens
tgaaaccttttttaagattt

SEQ ID NO: 5797977 - DNA, 18 bp, Homo sapiens
tgaaacgactcaaaatga

SEQ ID NO: 5797978 - DNA, 20 bp, Homo sapiens
tgaaacgctcctttgtgtgt

SEQ ID NO: 5797979 - DNA, 15 bp, Homo sapiens
tgaaacggatgattt

SEQ ID NO: 5797980 - DNA, 17 bp, Homo sapiens
tgaaacgtattcagagt

SEQ ID NO: 5797981 - DNA, 16 bp, Homo sapiens
tgaaacgtcccacact

SEQ ID NO: 5797982 - DNA, 16 bp, Homo sapiens
tgaaacgtctggactg

SEQ ID NO: 5797983 - DNA, 11 bp, Homo sapiens
tgaaactaaaa

SEQ ID NO: 5797984 - DNA, 19 bp, Homo sapiens
tgaaactagaaatctgtcc

SEQ ID NO: 5797985 - DNA, 23 bp, Homo sapiens
tgaaactagaaatctgtcctgtg

SEQ ID NO: 5797986 - DNA, 20 bp, Homo sapiens
tgaaactagacttgaggaaa

SEQ ID NO: 5797987 - DNA, 22 bp, Homo sapiens
tgaaactatccttctctttcaa

SEQ ID NO: 5797988 - DNA, 17 bp, Homo sapiens
tgaaactcacaaatgat

SEQ ID NO: 5797989 - DNA, 18 bp, Homo sapiens
tgaaactcatagacactg

SEQ ID NO: 5797990 - DNA, 19 bp, Homo sapiens
tgaaactcatagacactga

SEQ ID NO: 5797991 - DNA, 15 bp, Homo sapiens
tgaaactcatctcat

SEQ ID NO: 5797992 - DNA, 18 bp, Homo sapiens
tgaaactcatctgtaaac

SEQ ID NO: 5797993 - DNA, 13 bp, Homo sapiens
tgaaactccacct

SEQ ID NO: 5797994 - DNA, 18 bp, Homo sapiens
tgaaactccagatgccac

SEQ ID NO: 5797995 - DNA, 20 bp, Homo sapiens
tgaaactcctgattttgtag

SEQ ID NO: 5797996 - DNA, 15 bp, Homo sapiens
tgaaactctattatg

SEQ ID NO: 5797997 - DNA, 13 bp, Homo sapiens
tgaaactctctgt

SEQ ID NO: 5797998 - DNA, 22 bp, Homo sapiens
tgaaactgagatgtgaacacat

SEQ ID NO: 5797999 - DNA, 20 bp, Homo sapiens
tgaaactgagtataatcaat

SEQ ID NO: 5798000 - DNA, 13 bp, Homo sapiens
tgaaactgcctat

SEQ ID NO: 5798001 - DNA, 19 bp, Homo sapiens
tgaaactgcctattcacgc

SEQ ID NO: 5798002 - DNA, 15 bp, Homo sapiens
tgaaactgctgtttt

SEQ ID NO: 5798003 - DNA, 19 bp, Homo sapiens
tgaaactgcttgtttccta

SEQ ID NO: 5798004 - DNA, 17 bp, Homo sapiens
tgaaactggattaaact

SEQ ID NO: 5798005 - DNA, 15 bp, Homo sapiens
tgaaactggttccta

SEQ ID NO: 5798006 - DNA, 22 bp, Homo sapiens
tgaaactgtatcatctttgcca

SEQ ID NO: 5798007 - DNA, 23 bp, Homo sapiens
tgaaactgtggggcttacagaaa

SEQ ID NO: 5798008 - DNA, 19 bp, Homo sapiens
tgaaactgtgtattatttg

SEQ ID NO: 5798009 - DNA, 14 bp, Homo sapiens
tgaaacttaagaat

SEQ ID NO: 5798010 - DNA, 17 bp, Homo sapiens
tgaaacttaagaattga

SEQ ID NO: 5798011 - DNA, 12 bp, Homo sapiens
tgaaacttattt

SEQ ID NO: 5798012 - DNA, 18 bp, Homo sapiens
tgaaacttgagcattcaa

SEQ ID NO: 5798013 - DNA, 23 bp, Homo sapiens
tgaaacttggttcccagaaaaca

SEQ ID NO: 5798014 - DNA, 16 bp, Homo sapiens
tgaaacttgtgctata

SEQ ID NO: 5798015 - DNA, 18 bp, Homo sapiens
tgaaacttgtgctatagt

SEQ ID NO: 5798016 - DNA, 23 bp, Homo sapiens
tgaaactttcattccttcagatt

SEQ ID NO: 5798017 - DNA, 17 bp, Homo sapiens
tgaaactttctttctaa

SEQ ID NO: 5798018 - DNA, 19 bp, Homo sapiens
tgaaactttgaaaaagata

SEQ ID NO: 5798019 - DNA, 23 bp, Homo sapiens
tgaaactttgagatctaaaaata

SEQ ID NO: 5798020 - DNA, 22 bp, Homo sapiens
tgaaactttgaggataactttt

SEQ ID NO: 5798021 - DNA, 19 bp, Homo sapiens
tgaaactttgggaaaacat

SEQ ID NO: 5798022 - DNA, 15 bp, Homo sapiens
tgaaacttttctaaa

SEQ ID NO: 5798023 - DNA, 16 bp, Homo sapiens
tgaaacttttctagaa

SEQ ID NO: 5798024 - DNA, 17 bp, Homo sapiens
tgaaacttttctagaat

SEQ ID NO: 5798025 - DNA, 23 bp, Homo sapiens
tgaaacttttctagaattatttt

SEQ ID NO: 5798026 - DNA, 20 bp, Homo sapiens
tgaaagaaaaaaaaatactt

SEQ ID NO: 5798027 - DNA, 18 bp, Homo sapiens
tgaaagaaaacttttatg

SEQ ID NO: 5798028 - DNA, 13 bp, Homo sapiens
tgaaagaaaataa

SEQ ID NO: 5798029 - DNA, 22 bp, Homo sapiens
tgaaagaaaataccaaggaaca

SEQ ID NO: 5798030 - DNA, 15 bp, Homo sapiens
tgaaagaaaattgag

SEQ ID NO: 5798031 - DNA, 17 bp, Homo sapiens
tgaaagaaactaagatt

SEQ ID NO: 5798032 - DNA, 15 bp, Homo sapiens
tgaaagaaagggacc

SEQ ID NO: 5798033 - DNA, 16 bp, Homo sapiens
tgaaagaaagggaccc

SEQ ID NO: 5798034 - DNA, 21 bp, Homo sapiens
tgaaagaaagggacccacctg

SEQ ID NO: 5798035 - DNA, 15 bp, Homo sapiens
tgaaagaaagtgtta

SEQ ID NO: 5798036 - DNA, 16 bp, Homo sapiens
tgaaagaaagtgttaa

SEQ ID NO: 5798037 - DNA, 14 bp, Homo sapiens
tgaaagaaatcatg

SEQ ID NO: 5798038 - DNA, 18 bp, Homo sapiens
tgaaagaaatcatgttat

SEQ ID NO: 5798039 - DNA, 19 bp, Homo sapiens
tgaaagaagaacagctgtt

SEQ ID NO: 5798040 - DNA, 22 bp, Homo sapiens
tgaaagaagaatgtgtttcaaa

SEQ ID NO: 5798041 - DNA, 14 bp, Homo sapiens
tgaaagaaggagca

SEQ ID NO: 5798042 - DNA, 17 bp, Homo sapiens
tgaaagaagtcaaatga

SEQ ID NO: 5798043 - DNA, 18 bp, Homo sapiens
tgaaagaagtcaaatgaa

SEQ ID NO: 5798044 - DNA, 22 bp, Homo sapiens
tgaaagaagtcaaatgaatgag

SEQ ID NO: 5798045 - DNA, 16 bp, Homo sapiens
tgaaagaataggatta

SEQ ID NO: 5798046 - DNA, 14 bp, Homo sapiens
tgaaagaatatatt

SEQ ID NO: 5798047 - DNA, 22 bp, Homo sapiens
tgaaagaatatatttatttaaa

SEQ ID NO: 5798048 - DNA, 20 bp, Homo sapiens
tgaaagaattatttttgtgt

SEQ ID NO: 5798049 - DNA, 14 bp, Homo sapiens
tgaaagaattctat

SEQ ID NO: 5798050 - DNA, 16 bp, Homo sapiens
tgaaagacaaaattta

SEQ ID NO: 5798051 - DNA, 14 bp, Homo sapiens
tgaaagacaaagaa

SEQ ID NO: 5798052 - DNA, 18 bp, Homo sapiens
tgaaagacaaagaaggaa

SEQ ID NO: 5798053 - DNA, 22 bp, Homo sapiens
tgaaagacaaagaaggaaaaga

SEQ ID NO: 5798054 - DNA, 15 bp, Homo sapiens
tgaaagacagaatgt

SEQ ID NO: 5798055 - DNA, 17 bp, Homo sapiens
tgaaagacaggagttta

SEQ ID NO: 5798056 - DNA, 11 bp, Homo sapiens
tgaaagacatc

SEQ ID NO: 5798057 - DNA, 14 bp, Homo sapiens
tgaaagacatcaat

SEQ ID NO: 5798058 - DNA, 17 bp, Homo sapiens
tgaaagacatcaatgaa

SEQ ID NO: 5798059 - DNA, 22 bp, Homo sapiens
tgaaagacctgaataccactta

SEQ ID NO: 5798060 - DNA, 12 bp, Homo sapiens
tgaaagaccttc

SEQ ID NO: 5798061 - DNA, 16 bp, Homo sapiens
tgaaagactgaagaaa

SEQ ID NO: 5798062 - DNA, 16 bp, Homo sapiens
tgaaagactgtacaaa

SEQ ID NO: 5798063 - DNA, 13 bp, Homo sapiens
tgaaagacttatg

SEQ ID NO: 5798064 - DNA, 18 bp, Homo sapiens
tgaaagacttccaaagaa

SEQ ID NO: 5798065 - DNA, 11 bp, Homo sapiens
tgaaagagaaa

SEQ ID NO: 5798066 - DNA, 12 bp, Homo sapiens
tgaaagagaaaa

SEQ ID NO: 5798067 - DNA, 18 bp, Homo sapiens
tgaaagagaaaatatata

SEQ ID NO: 5798068 - DNA, 21 bp, Homo sapiens
tgaaagagaaaatgctttctc

SEQ ID NO: 5798069 - DNA, 14 bp, Homo sapiens
tgaaagagaaacac

SEQ ID NO: 5798070 - DNA, 18 bp, Homo sapiens
tgaaagagaaccagtttc

SEQ ID NO: 5798071 - DNA, 15 bp, Homo sapiens
tgaaagagaggactg

SEQ ID NO: 5798072 - DNA, 22 bp, Homo sapiens
tgaaagaggacgtgttacccac

SEQ ID NO: 5798073 - DNA, 23 bp, Homo sapiens
tgaaagaggccaaacaggccctc

SEQ ID NO: 5798074 - DNA, 21 bp, Homo sapiens
tgaaagaggctgaggcctgga

SEQ ID NO: 5798075 - DNA, 14 bp, Homo sapiens
tgaaagagtaaaac

SEQ ID NO: 5798076 - DNA, 20 bp, Homo sapiens
tgaaagagtaaaggaaatga

SEQ ID NO: 5798077 - DNA, 20 bp, Homo sapiens
tgaaagagtagtgcatttaa

SEQ ID NO: 5798078 - DNA, 19 bp, Homo sapiens
tgaaagagttaagaatgtc

SEQ ID NO: 5798079 - DNA, 15 bp, Homo sapiens
tgaaagataaatgat

SEQ ID NO: 5798080 - DNA, 15 bp, Homo sapiens
tgaaagatatgtata

SEQ ID NO: 5798081 - DNA, 14 bp, Homo sapiens
tgaaagatctctgt

SEQ ID NO: 5798082 - DNA, 19 bp, Homo sapiens
tgaaagatctctgtcacat

SEQ ID NO: 5798083 - DNA, 15 bp, Homo sapiens
tgaaagatgcaagca

SEQ ID NO: 5798084 - DNA, 21 bp, Homo sapiens
tgaaagatggctgtgcctctg

SEQ ID NO: 5798085 - DNA, 13 bp, Homo sapiens
tgaaatttaaata

SEQ ID NO: 5798086 - DNA, 13 bp, Homo sapiens
tgaaatttaagca

SEQ ID NO: 5798087 - DNA, 17 bp, Homo sapiens
tgaaatttaagcacaaa

SEQ ID NO: 5798088 - DNA, 12 bp, Homo sapiens
tgaaatttaatg

SEQ ID NO: 5798089 - DNA, 15 bp, Homo sapiens
tgaaatttacacagt

SEQ ID NO: 5798090 - DNA, 17 bp, Homo sapiens
tgaaatttacacagtga

SEQ ID NO: 5798091 - DNA, 23 bp, Homo sapiens
tgaaatttacacagtgagactgt

SEQ ID NO: 5798092 - DNA, 15 bp, Homo sapiens
tgaaatttacagtga

SEQ ID NO: 5798093 - DNA, 17 bp, Homo sapiens
tgaaatttacagtgata

SEQ ID NO: 5798094 - DNA, 18 bp, Homo sapiens
tgaaatttattcacatat

SEQ ID NO: 5798095 - DNA, 13 bp, Homo sapiens
tgaaatttattga

SEQ ID NO: 5798096 - DNA, 12 bp, Homo sapiens
tgaaatttcaga

SEQ ID NO: 5798097 - DNA, 15 bp, Homo sapiens
tgaaatttcatgaaa

SEQ ID NO: 5798098 - DNA, 14 bp, Homo sapiens
tgaaatttcatgat

SEQ ID NO: 5798099 - DNA, 14 bp, Homo sapiens
tgaaatttctagcc

SEQ ID NO: 5798100 - DNA, 15 bp, Homo sapiens
tgaaatttgaatttt

SEQ ID NO: 5798101 - DNA, 15 bp, Homo sapiens
tgaaatttgataaac

SEQ ID NO: 5798102 - DNA, 17 bp, Homo sapiens
tgaaatttgcaaaatca

SEQ ID NO: 5798103 - DNA, 14 bp, Homo sapiens
tgaaatttgcctct

SEQ ID NO: 5798104 - DNA, 18 bp, Homo sapiens
tgaaatttgcctctgtcc

SEQ ID NO: 5798105 - DNA, 20 bp, Homo sapiens
tgaaatttgcctctgtccaa

SEQ ID NO: 5798106 - DNA, 15 bp, Homo sapiens
tgaaatttgttaata

SEQ ID NO: 5798107 - DNA, 19 bp, Homo sapiens
tgaaattttaaaaattgtt

SEQ ID NO: 5798108 - DNA, 16 bp, Homo sapiens
tgaaattttaaatgca

SEQ ID NO: 5798109 - DNA, 13 bp, Homo sapiens
tgaaattttacca

SEQ ID NO: 5798110 - DNA, 14 bp, Homo sapiens
tgaaattttaccaa

SEQ ID NO: 5798111 - DNA, 16 bp, Homo sapiens
tgaaattttaccaagt

SEQ ID NO: 5798112 - DNA, 16 bp, Homo sapiens
tgaaattttagaaata

SEQ ID NO: 5798113 - DNA, 18 bp, Homo sapiens
tgaaattttatttagttc

SEQ ID NO: 5798114 - DNA, 15 bp, Homo sapiens
tgaaattttatttat

SEQ ID NO: 5798115 - DNA, 18 bp, Homo sapiens
tgaaattttccaatgtct

SEQ ID NO: 5798116 - DNA, 19 bp, Homo sapiens
tgaaattttccaatgtctg

SEQ ID NO: 5798117 - DNA, 13 bp, Homo sapiens
tgaaattttctag

SEQ ID NO: 5798118 - DNA, 18 bp, Homo sapiens
tgaaattttctagaatac

SEQ ID NO: 5798119 - DNA, 17 bp, Homo sapiens
tgaaattttctagactt

SEQ ID NO: 5798120 - DNA, 23 bp, Homo sapiens
tgaaattttgattaaccttttca

SEQ ID NO: 5798121 - DNA, 18 bp, Homo sapiens
tgaaattttgcaaatata

SEQ ID NO: 5798122 - DNA, 21 bp, Homo sapiens
tgaaatttttaaatcatttca

SEQ ID NO: 5798123 - DNA, 19 bp, Homo sapiens
tgaaatttttattaaatta

SEQ ID NO: 5798124 - DNA, 13 bp, Homo sapiens
tgaaatttttcat

SEQ ID NO: 5798125 - DNA, 16 bp, Homo sapiens
tgaaatttttcatatt

SEQ ID NO: 5798126 - DNA, 13 bp, Homo sapiens
tgaaatttttcca

SEQ ID NO: 5798127 - DNA, 14 bp, Homo sapiens
tgaaatttttccac

SEQ ID NO: 5798128 - DNA, 13 bp, Homo sapiens
tgaaatttttctt

SEQ ID NO: 5798129 - DNA, 15 bp, Homo sapiens
tgaaatttttcttct

SEQ ID NO: 5798130 - DNA, 18 bp, Homo sapiens
tgaaatttttgtaaatca

SEQ ID NO: 5798131 - DNA, 21 bp, Homo sapiens
tgaaattttttagtatgttca

SEQ ID NO: 5798132 - DNA, 14 bp, Homo sapiens
tgaacaaaaaaatg

SEQ ID NO: 5798133 - DNA, 17 bp, Homo sapiens
tgaacaaaagcttttct

SEQ ID NO: 5798134 - DNA, 16 bp, Homo sapiens
tgaacaaaataaattg

SEQ ID NO: 5798135 - DNA, 18 bp, Homo sapiens
tgaacaaaatctgttgcc

SEQ ID NO: 5798136 - DNA, 14 bp, Homo sapiens
tgaacaaaatgaag

SEQ ID NO: 5798137 - DNA, 18 bp, Homo sapiens
tgaacaaaatgaagttaa

SEQ ID NO: 5798138 - DNA, 17 bp, Homo sapiens
tgaacaaacactgaatc

SEQ ID NO: 5798139 - DNA, 23 bp, Homo sapiens
tgaacaaacactgaatcatgtta

SEQ ID NO: 5798140 - DNA, 19 bp, Homo sapiens
tgaacaaagaaaaaaatat

SEQ ID NO: 5798141 - DNA, 18 bp, Homo sapiens
tgaacaaagcacctcaag

SEQ ID NO: 5798142 - DNA, 19 bp, Homo sapiens
tgaacaaagcacctcaagt

SEQ ID NO: 5798143 - DNA, 16 bp, Homo sapiens
tgaacaaagcagccac

SEQ ID NO: 5798144 - DNA, 23 bp, Homo sapiens
tgaacaaagtttaccagaaagca

SEQ ID NO: 5798145 - DNA, 15 bp, Homo sapiens
tgaacaaatatgctt

SEQ ID NO: 5798146 - DNA, 19 bp, Homo sapiens
tgaacaaatcaaattgctt

SEQ ID NO: 5798147 - DNA, 17 bp, Homo sapiens
tgaacaaattctttagt

SEQ ID NO: 5798148 - DNA, 18 bp, Homo sapiens
tgaacaaattgaactctt

SEQ ID NO: 5798149 - DNA, 19 bp, Homo sapiens
tgaacaaatttacagagac

SEQ ID NO: 5798150 - DNA, 22 bp, Homo sapiens
tgaacaacctcggctcctggac

SEQ ID NO: 5798151 - DNA, 20 bp, Homo sapiens
tgaacaactcgaatcactca

SEQ ID NO: 5798152 - DNA, 23 bp, Homo sapiens
tgaacaactcgaatcactcattt

SEQ ID NO: 5798153 - DNA, 20 bp, Homo sapiens
tgaacaactggaaataaagt

SEQ ID NO: 5798154 - DNA, 14 bp, Homo sapiens
tgaacaagaaagag

SEQ ID NO: 5798155 - DNA, 14 bp, Homo sapiens
tgaacaagaaattg

SEQ ID NO: 5798156 - DNA, 14 bp, Homo sapiens
tgaacaagaattgg

SEQ ID NO: 5798157 - DNA, 17 bp, Homo sapiens
tgaacaagagaagcatt

SEQ ID NO: 5798158 - DNA, 23 bp, Homo sapiens
tgaacaagcaaacccagacggct

SEQ ID NO: 5798159 - DNA, 15 bp, Homo sapiens
tgaacaagcattctc

SEQ ID NO: 5798160 - DNA, 16 bp, Homo sapiens
tgaacaagtgaacaca

SEQ ID NO: 5798161 - DNA, 17 bp, Homo sapiens
tgaacaatcaaggcaac

SEQ ID NO: 5798162 - DNA, 14 bp, Homo sapiens
tgaacaatgaagtt

SEQ ID NO: 5798163 - DNA, 18 bp, Homo sapiens
tgaacaatgaagttgaaa

SEQ ID NO: 5798164 - DNA, 21 bp, Homo sapiens
tgaacaatgtatacaatgcac

SEQ ID NO: 5798165 - DNA, 15 bp, Homo sapiens
tgaacacaaagcctg

SEQ ID NO: 5798166 - DNA, 14 bp, Homo sapiens
tgaacacaaattat

SEQ ID NO: 5798167 - DNA, 17 bp, Homo sapiens
tgaacacaaattatgct

SEQ ID NO: 5798168 - DNA, 22 bp, Homo sapiens
tgaacacaagcaaaccttctca

SEQ ID NO: 5798169 - DNA, 23 bp, Homo sapiens
tgaacacaatacatgttttcact

SEQ ID NO: 5798170 - DNA, 13 bp, Homo sapiens
tgaacacaattga

SEQ ID NO: 5798171 - DNA, 21 bp, Homo sapiens
tgaacacaattgatacttcag

SEQ ID NO: 5798172 - DNA, 22 bp, Homo sapiens
tgaacacaattgatacttcagg

SEQ ID NO: 5798173 - DNA, 21 bp, Homo sapiens
tgaacacacacgccagctcct

SEQ ID NO: 5798174 - DNA, 19 bp, Homo sapiens
tgaacacacatggatgcac

SEQ ID NO: 5798175 - DNA, 18 bp, Homo sapiens
tgaacacactgtgtcctg

SEQ ID NO: 5798176 - DNA, 17 bp, Homo sapiens
tgaacacagatcattct

SEQ ID NO: 5798177 - DNA, 15 bp, Homo sapiens
tgaacacagcagacc

SEQ ID NO: 5798178 - DNA, 15 bp, Homo sapiens
tgaacacagcctggg

SEQ ID NO: 5798179 - DNA, 20 bp, Homo sapiens
tgaacacagctctttaacat

SEQ ID NO: 5798180 - DNA, 12 bp, Homo sapiens
tgaacacaggca

SEQ ID NO: 5798181 - DNA, 17 bp, Homo sapiens
tgaacacaggcaaagag

SEQ ID NO: 5798182 - DNA, 22 bp, Homo sapiens
tgaacacaggcaaagaggtgct

SEQ ID NO: 5798183 - DNA, 15 bp, Homo sapiens
tgaacacaggcaatg

SEQ ID NO: 5798184 - DNA, 16 bp, Homo sapiens
tgaacacaggcagctt

SEQ ID NO: 5798185 - DNA, 11 bp, Homo sapiens
tgaacacagta

SEQ ID NO: 5798186 - DNA, 19 bp, Homo sapiens
tgaacacagtattttccca

SEQ ID NO: 5798187 - DNA, 14 bp, Homo sapiens
tgaacacagtgtct

SEQ ID NO: 5798188 - DNA, 20 bp, Homo sapiens
tgaacacagtgtctgttcag

SEQ ID NO: 5798189 - DNA, 15 bp, Homo sapiens
tgaacacagtttagt

SEQ ID NO: 5798190 - DNA, 20 bp, Homo sapiens
tgaacacatcagctagcaaa

SEQ ID NO: 5798191 - DNA, 13 bp, Homo sapiens
tgaacacatggca

SEQ ID NO: 5798192 - DNA, 15 bp, Homo sapiens
tgaacacatggcaga

SEQ ID NO: 5798193 - DNA, 15 bp, Homo sapiens
tgaacacatgtgtat

SEQ ID NO: 5798194 - DNA, 12 bp, Homo sapiens
tgaacacatttc

SEQ ID NO: 5798195 - DNA, 14 bp, Homo sapiens
tgaacacatttctt

SEQ ID NO: 5798196 - DNA, 19 bp, Homo sapiens
tgaacaccactttgtctct

SEQ ID NO: 5798197 - DNA, 19 bp, Homo sapiens
tgaacaccaggactttaat

SEQ ID NO: 5798198 - DNA, 16 bp, Homo sapiens
tgaacacgaagcttag

SEQ ID NO: 5798199 - DNA, 17 bp, Homo sapiens
tgaacactagtctgtgt

SEQ ID NO: 5798200 - DNA, 18 bp, Homo sapiens
tgaacactagtctgtgta

SEQ ID NO: 5798201 - DNA, 19 bp, Homo sapiens
tgaacactagtctgtgtaa

SEQ ID NO: 5798202 - DNA, 14 bp, Homo sapiens
tgaacactcatgct

SEQ ID NO: 5798203 - DNA, 22 bp, Homo sapiens
tgaacactccaattaaggattt

SEQ ID NO: 5798204 - DNA, 17 bp, Homo sapiens
tgaacactgcaccctcc

SEQ ID NO: 5798205 - DNA, 18 bp, Homo sapiens
tgaacactggcaacaaca

SEQ ID NO: 5798206 - DNA, 13 bp, Homo sapiens
tgaacactgtcat

SEQ ID NO: 5798207 - DNA, 14 bp, Homo sapiens
tgaacacttaaatt

SEQ ID NO: 5798208 - DNA, 14 bp, Homo sapiens
tgaacacttagtga

SEQ ID NO: 5798209 - DNA, 17 bp, Homo sapiens
tgaacacttattgcttt

SEQ ID NO: 5798210 - DNA, 18 bp, Homo sapiens
tgaacacttggtgctggg

SEQ ID NO: 5798211 - DNA, 23 bp, Homo sapiens
tgaacagaaactacatttctact

SEQ ID NO: 5798212 - DNA, 13 bp, Homo sapiens
tgaacagaacata

SEQ ID NO: 5798213 - DNA, 21 bp, Homo sapiens
tgaacagaagctcttactctt

SEQ ID NO: 5798214 - DNA, 21 bp, Homo sapiens
tgaacagactagaagtatttg

SEQ ID NO: 5798215 - DNA, 18 bp, Homo sapiens
tgaacagactgaccttga

SEQ ID NO: 5798216 - DNA, 20 bp, Homo sapiens
tgaacagagagaaccaggag

SEQ ID NO: 5798217 - DNA, 15 bp, Homo sapiens
tgaacagatgtaaat

SEQ ID NO: 5798218 - DNA, 18 bp, Homo sapiens
tgaacagcaggatgccct

SEQ ID NO: 5798219 - DNA, 19 bp, Homo sapiens
tgaacagcaggatgccctg

SEQ ID NO: 5798220 - DNA, 20 bp, Homo sapiens
tgaacagcagtaatcctggg

SEQ ID NO: 5798221 - DNA, 17 bp, Homo sapiens
tgaacagccaaaagcta

SEQ ID NO: 5798222 - DNA, 21 bp, Homo sapiens
tgaacagccctctctctcact

SEQ ID NO: 5798223 - DNA, 18 bp, Homo sapiens
tgaacagctatcacgttg

SEQ ID NO: 5798224 - DNA, 15 bp, Homo sapiens
tgaacagctggtgcc

SEQ ID NO: 5798225 - DNA, 14 bp, Homo sapiens
tgaacagctggtgt

SEQ ID NO: 5798226 - DNA, 23 bp, Homo sapiens
tgaacagctggtgtagctacaga

SEQ ID NO: 5798227 - DNA, 14 bp, Homo sapiens
tgaacagctgtgag

SEQ ID NO: 5798228 - DNA, 22 bp, Homo sapiens
tgaacagctgtgagccatgcct

SEQ ID NO: 5798229 - DNA, 24 bp, Homo sapiens
tgaacagctgtgagccatgcctcc

SEQ ID NO: 5798230 - DNA, 13 bp, Homo sapiens
tgaacagctgtgt

SEQ ID NO: 5798231 - DNA, 16 bp, Homo sapiens
tgaacagcttcactta

SEQ ID NO: 5798232 - DNA, 22 bp, Homo sapiens
tgaacaggaaactcctgtgacc

SEQ ID NO: 5798233 - DNA, 13 bp, Homo sapiens
tgaacaggctggg

SEQ ID NO: 5798234 - DNA, 14 bp, Homo sapiens
tgaacaggctgggg

SEQ ID NO: 5798235 - DNA, 19 bp, Homo sapiens
tgaacaggctggggccttt

SEQ ID NO: 5798236 - DNA, 12 bp, Homo sapiens
tgaacagggcaa

SEQ ID NO: 5798237 - DNA, 21 bp, Homo sapiens
tgaacagggcccaggcctgga

SEQ ID NO: 5798238 - DNA, 19 bp, Homo sapiens
tgaacaggtgggtgtctgc

SEQ ID NO: 5798239 - DNA, 12 bp, Homo sapiens
tgaacagtgcac

SEQ ID NO: 5798240 - DNA, 16 bp, Homo sapiens
tgaacagtgttaataa

SEQ ID NO: 5798241 - DNA, 22 bp, Homo sapiens
tgaacagtttatcgaccagttt

SEQ ID NO: 5798242 - DNA, 22 bp, Homo sapiens
tgaacagtttggatgtcctcaa

SEQ ID NO: 5798243 - DNA, 23 bp, Homo sapiens
tgaacataaatcagttaatggct

SEQ ID NO: 5798244 - DNA, 19 bp, Homo sapiens
tgaacataactgtaacata

SEQ ID NO: 5798245 - DNA, 16 bp, Homo sapiens
tgaacataacttctca

SEQ ID NO: 5798246 - DNA, 17 bp, Homo sapiens
tgaacataacttctcat

SEQ ID NO: 5798247 - DNA, 20 bp, Homo sapiens
tgaacataacttctcatgta

SEQ ID NO: 5798248 - DNA, 21 bp, Homo sapiens
tgaacataacttctcatgtat

SEQ ID NO: 5798249 - DNA, 23 bp, Homo sapiens
tgaacataacttctcatgtatat

SEQ ID NO: 5798250 - DNA, 15 bp, Homo sapiens
tgaacataatgaaca

SEQ ID NO: 5798251 - DNA, 18 bp, Homo sapiens
tgaacataatgaacagaa

SEQ ID NO: 5798252 - DNA, 21 bp, Homo sapiens
tgaacataatgaacagaattt

SEQ ID NO: 5798253 - DNA, 16 bp, Homo sapiens
tgaacataattcttat

SEQ ID NO: 5798254 - DNA, 18 bp, Homo sapiens
tgaacatacttcaaaaat

SEQ ID NO: 5798255 - DNA, 19 bp, Homo sapiens
tgaacatacttcaaaaata

SEQ ID NO: 5798256 - DNA, 20 bp, Homo sapiens
tgaacatagactagagaaac

SEQ ID NO: 5798257 - DNA, 16 bp, Homo sapiens
tgaacatagttttcac

SEQ ID NO: 5798258 - DNA, 19 bp, Homo sapiens
tgaacatagttttcaccca

SEQ ID NO: 5798259 - DNA, 15 bp, Homo sapiens
tgaacatattcatga

SEQ ID NO: 5798260 - DNA, 13 bp, Homo sapiens
tgaacatcagaag

SEQ ID NO: 5798261 - DNA, 18 bp, Homo sapiens
tgaacatcagaaggtatt

SEQ ID NO: 5798262 - DNA, 22 bp, Homo sapiens
tgaacatcagggtgtggcattt

SEQ ID NO: 5798263 - DNA, 21 bp, Homo sapiens
tgaagatattccaactcaaaa

SEQ ID NO: 5798264 - DNA, 11 bp, Homo sapiens
tgaagatattt

SEQ ID NO: 5798265 - DNA, 17 bp, Homo sapiens
tgaagatatttattctg

SEQ ID NO: 5798266 - DNA, 15 bp, Homo sapiens
tgaagatatttttcc

SEQ ID NO: 5798267 - DNA, 13 bp, Homo sapiens
tgaagatcaattt

SEQ ID NO: 5798268 - DNA, 15 bp, Homo sapiens
tgaagatcagagctg

SEQ ID NO: 5798269 - DNA, 17 bp, Homo sapiens
tgaagatcagagctgca

SEQ ID NO: 5798270 - DNA, 13 bp, Homo sapiens
tgaagatccccaa

SEQ ID NO: 5798271 - DNA, 20 bp, Homo sapiens
tgaagatccccattctttct

SEQ ID NO: 5798272 - DNA, 19 bp, Homo sapiens
tgaagatcgttagtatcta

SEQ ID NO: 5798273 - DNA, 22 bp, Homo sapiens
tgaagatctaaatagcccttgg

SEQ ID NO: 5798274 - DNA, 17 bp, Homo sapiens
tgaagatctcagataaa

SEQ ID NO: 5798275 - DNA, 19 bp, Homo sapiens
tgaagatctgagatttttt

SEQ ID NO: 5798276 - DNA, 14 bp, Homo sapiens
tgaagatctgattt

SEQ ID NO: 5798277 - DNA, 17 bp, Homo sapiens
tgaagatctgatttata

SEQ ID NO: 5798278 - DNA, 18 bp, Homo sapiens
tgaagatgaaggggctct

SEQ ID NO: 5798279 - DNA, 21 bp, Homo sapiens
tgaagatgcattttaaatgtc

SEQ ID NO: 5798280 - DNA, 23 bp, Homo sapiens
tgaagatgcattttaaatgtcta

SEQ ID NO: 5798281 - DNA, 13 bp, Homo sapiens
tgaagatgctgcc

SEQ ID NO: 5798282 - DNA, 15 bp, Homo sapiens
tgaagatgctgtaaa

SEQ ID NO: 5798283 - DNA, 22 bp, Homo sapiens
tgaagatggagggggctggggt

SEQ ID NO: 5798284 - DNA, 18 bp, Homo sapiens
tgaagatggcatcctgtg

SEQ ID NO: 5798285 - DNA, 13 bp, Homo sapiens
tgaagatggcttt

SEQ ID NO: 5798286 - DNA, 18 bp, Homo sapiens
tgaagatgggggcctctt

SEQ ID NO: 5798287 - DNA, 23 bp, Homo sapiens
tgaagatggtttcaattcagatt

SEQ ID NO: 5798288 - DNA, 16 bp, Homo sapiens
tgaagatgtagcttcc

SEQ ID NO: 5798289 - DNA, 11 bp, Homo sapiens
tgaagatgtcc

SEQ ID NO: 5798290 - DNA, 13 bp, Homo sapiens
tgaagatgtctcc

SEQ ID NO: 5798291 - DNA, 19 bp, Homo sapiens
tgaagatgtctcctcaagc

SEQ ID NO: 5798292 - DNA, 22 bp, Homo sapiens
tgaagatgtgtaaataagcgtt

SEQ ID NO: 5798293 - DNA, 16 bp, Homo sapiens
tgaagatgttaaaatc

SEQ ID NO: 5798294 - DNA, 22 bp, Homo sapiens
tgaagatgtttttagaggggca

SEQ ID NO: 5798295 - DNA, 20 bp, Homo sapiens
tgaagattaggagaaacaca

SEQ ID NO: 5798296 - DNA, 20 bp, Homo sapiens
tgaagattaggcacacagat

SEQ ID NO: 5798297 - DNA, 17 bp, Homo sapiens
tgaagattataaaagcc

SEQ ID NO: 5798298 - DNA, 15 bp, Homo sapiens
tgaagattcagcagt

SEQ ID NO: 5798299 - DNA, 16 bp, Homo sapiens
tgaagattcagttcaa

SEQ ID NO: 5798300 - DNA, 21 bp, Homo sapiens
tgaagattctatgttaatatt

SEQ ID NO: 5798301 - DNA, 18 bp, Homo sapiens
tgaagattctcctgtgct

SEQ ID NO: 5798302 - DNA, 19 bp, Homo sapiens
tgaagattctcctgtgcta

SEQ ID NO: 5798303 - DNA, 19 bp, Homo sapiens
tgaagattcttaaaaattg

SEQ ID NO: 5798304 - DNA, 22 bp, Homo sapiens
tgaagattcttaaaaattgaat

SEQ ID NO: 5798305 - DNA, 16 bp, Homo sapiens
tgaagattctttccca

SEQ ID NO: 5798306 - DNA, 13 bp, Homo sapiens
tgaagattgttta

SEQ ID NO: 5798307 - DNA, 20 bp, Homo sapiens
tgaagatttaccacttgtgt

SEQ ID NO: 5798308 - DNA, 22 bp, Homo sapiens
tgaagatttacctcgttctgct

SEQ ID NO: 5798309 - DNA, 21 bp, Homo sapiens
tgaagatttatttttaatatg

SEQ ID NO: 5798310 - DNA, 22 bp, Homo sapiens
tgaagatttatttttaatatgt

SEQ ID NO: 5798311 - DNA, 16 bp, Homo sapiens
tgaagatttggttttt

SEQ ID NO: 5798312 - DNA, 22 bp, Homo sapiens
tgaagatttttaattacaataa

SEQ ID NO: 5798313 - DNA, 23 bp, Homo sapiens
tgaagcaaacacacagactctgt

SEQ ID NO: 5798314 - DNA, 15 bp, Homo sapiens
tgaagcaaacacatt

SEQ ID NO: 5798315 - DNA, 20 bp, Homo sapiens
tgaagcaaactaactttttt

SEQ ID NO: 5798316 - DNA, 22 bp, Homo sapiens
tgaagcaaactctaaaattata

SEQ ID NO: 5798317 - DNA, 17 bp, Homo sapiens
tgaagcaaataccaaag

SEQ ID NO: 5798318 - DNA, 15 bp, Homo sapiens
tgaagcaaatcagaa

SEQ ID NO: 5798319 - DNA, 22 bp, Homo sapiens
tgaagcaaatgtcatgctgcct

SEQ ID NO: 5798320 - DNA, 13 bp, Homo sapiens
tgaagcaaatgtg

SEQ ID NO: 5798321 - DNA, 20 bp, Homo sapiens
tgaagcaactacaacttctc

SEQ ID NO: 5798322 - DNA, 14 bp, Homo sapiens
tgaagcaagagtga

SEQ ID NO: 5798323 - DNA, 13 bp, Homo sapiens
tgaagcaagctgt

SEQ ID NO: 5798324 - DNA, 14 bp, Homo sapiens
tgaagcaagctgtg

SEQ ID NO: 5798325 - DNA, 17 bp, Homo sapiens
tgaagcaagctgtgtta

SEQ ID NO: 5798326 - DNA, 20 bp, Homo sapiens
tgaagcaagctgtgttactt

SEQ ID NO: 5798327 - DNA, 22 bp, Homo sapiens
tgaagcaagctgtgttacttga

SEQ ID NO: 5798328 - DNA, 15 bp, Homo sapiens
tgaagcaagttcact

SEQ ID NO: 5798329 - DNA, 14 bp, Homo sapiens
tgaagcaataactc

SEQ ID NO: 5798330 - DNA, 15 bp, Homo sapiens
tgaagcaataactcc

SEQ ID NO: 5798331 - DNA, 18 bp, Homo sapiens
tgaagcaattagtctgaa

SEQ ID NO: 5798332 - DNA, 21 bp, Homo sapiens
tgaagcaattagtctgaaact

SEQ ID NO: 5798333 - DNA, 20 bp, Homo sapiens
tgaagcaatttatatcttta

SEQ ID NO: 5798334 - DNA, 19 bp, Homo sapiens
tgaagcacaagttcctggt

SEQ ID NO: 5798335 - DNA, 22 bp, Homo sapiens
tgaagcacagcaccgggggaga

SEQ ID NO: 5798336 - DNA, 22 bp, Homo sapiens
tgaagcacagtgatcaagttat

SEQ ID NO: 5798337 - DNA, 18 bp, Homo sapiens
tgaagcagaaccttcttt

SEQ ID NO: 5798338 - DNA, 19 bp, Homo sapiens
tgaagcagaaccttctttg

SEQ ID NO: 5798339 - DNA, 14 bp, Homo sapiens
tgaagcagaagccc

SEQ ID NO: 5798340 - DNA, 13 bp, Homo sapiens
tgaagcagaggaa

SEQ ID NO: 5798341 - DNA, 14 bp, Homo sapiens
tgaagcagaggaag

SEQ ID NO: 5798342 - DNA, 15 bp, Homo sapiens
tgaagcagaggaagg

SEQ ID NO: 5798343 - DNA, 13 bp, Homo sapiens
tgaagcagagtca

SEQ ID NO: 5798344 - DNA, 21 bp, Homo sapiens
tgaagcagagtcaagctgatg

SEQ ID NO: 5798345 - DNA, 23 bp, Homo sapiens
tgaagcagatgcaaagaggcaag

SEQ ID NO: 5798346 - DNA, 17 bp, Homo sapiens
tgaagcagcactgtgag

SEQ ID NO: 5798347 - DNA, 10 bp, Homo sapiens
tgaagcagct

SEQ ID NO: 5798348 - DNA, 13 bp, Homo sapiens
tgaagcagctctg

SEQ ID NO: 5798349 - DNA, 19 bp, Homo sapiens
tgaagcagctctgccttct

SEQ ID NO: 5798350 - DNA, 19 bp, Homo sapiens
tgaagcaggagaatcactt

SEQ ID NO: 5798351 - DNA, 21 bp, Homo sapiens
tgaagcagggtttcttttctt

SEQ ID NO: 5798352 - DNA, 13 bp, Homo sapiens
tgaagcataattt

SEQ ID NO: 5798353 - DNA, 15 bp, Homo sapiens
tgaagcataatttgt

SEQ ID NO: 5798354 - DNA, 15 bp, Homo sapiens
tgaagcatccaggca

SEQ ID NO: 5798355 - DNA, 23 bp, Homo sapiens
tgaagcatgagttatctgatttt

SEQ ID NO: 5798356 - DNA, 14 bp, Homo sapiens
tgaagcatgtttca

SEQ ID NO: 5798357 - DNA, 20 bp, Homo sapiens
tgaagcatgtttcatgtttt

SEQ ID NO: 5798358 - DNA, 18 bp, Homo sapiens
tgaagcattatggtctaa

SEQ ID NO: 5798359 - DNA, 15 bp, Homo sapiens
tgaagcatttaaaag

SEQ ID NO: 5798360 - DNA, 16 bp, Homo sapiens
tgaagcattttataaa

SEQ ID NO: 5798361 - DNA, 22 bp, Homo sapiens
tgaagcattttataaatcgctt

SEQ ID NO: 5798362 - DNA, 14 bp, Homo sapiens
tgaagccaaagaaa

SEQ ID NO: 5798363 - DNA, 15 bp, Homo sapiens
tgaagccaaatgaaa

SEQ ID NO: 5798364 - DNA, 19 bp, Homo sapiens
tgaagccaaatgaaactca

SEQ ID NO: 5798365 - DNA, 19 bp, Homo sapiens
tgaagccaactgacaaaga

SEQ ID NO: 5798366 - DNA, 19 bp, Homo sapiens
tgaagccaattcagacagg

SEQ ID NO: 5798367 - DNA, 18 bp, Homo sapiens
tgaagccacacagcccag

SEQ ID NO: 5798368 - DNA, 20 bp, Homo sapiens
tgaagccacacagcccagaa

SEQ ID NO: 5798369 - DNA, 23 bp, Homo sapiens
tgaagccacacagcccagaaggc

SEQ ID NO: 5798370 - DNA, 20 bp, Homo sapiens
tgaagccacagcccaggcct

SEQ ID NO: 5798371 - DNA, 16 bp, Homo sapiens
tgaagccactgaagct

SEQ ID NO: 5798372 - DNA, 13 bp, Homo sapiens
tgaagccacttgg

SEQ ID NO: 5798373 - DNA, 11 bp, Homo sapiens
tgaagccagat

SEQ ID NO: 5798374 - DNA, 23 bp, Homo sapiens
tgaagccagatctcgggactcag

SEQ ID NO: 5798375 - DNA, 21 bp, Homo sapiens
tgaagccagccttcttccatc

SEQ ID NO: 5798376 - DNA, 14 bp, Homo sapiens
tgaagccagctccc

SEQ ID NO: 5798377 - DNA, 21 bp, Homo sapiens
tgaagccagctggacttcctg

SEQ ID NO: 5798378 - DNA, 14 bp, Homo sapiens
tgaagccatctaaa

SEQ ID NO: 5798379 - DNA, 13 bp, Homo sapiens
tgaagccatgtct

SEQ ID NO: 5798380 - DNA, 21 bp, Homo sapiens
tgaagccattggagagctgtc

SEQ ID NO: 5798381 - DNA, 20 bp, Homo sapiens
tgaagccatttagagggtga

SEQ ID NO: 5798382 - DNA, 14 bp, Homo sapiens
tgaagcccaaagcc

SEQ ID NO: 5798383 - DNA, 20 bp, Homo sapiens
tgaagcccaaagcctgagga

SEQ ID NO: 5798384 - DNA, 16 bp, Homo sapiens
tgaagcccaagaagtt

SEQ ID NO: 5798385 - DNA, 16 bp, Homo sapiens
tgaagcccaagtgaaa

SEQ ID NO: 5798386 - DNA, 19 bp, Homo sapiens
tgaagcccaataaacctct

SEQ ID NO: 5798387 - DNA, 15 bp, Homo sapiens
tgaagcccaggagga

SEQ ID NO: 5798388 - DNA, 17 bp, Homo sapiens
tgaagcccatgctttcc

SEQ ID NO: 5798389 - DNA, 17 bp, Homo sapiens
tgaagcccatttctccg

SEQ ID NO: 5798390 - DNA, 18 bp, Homo sapiens
tgaagccccttgtcctct

SEQ ID NO: 5798391 - DNA, 21 bp, Homo sapiens
tgaagccccttgtcctctccc

SEQ ID NO: 5798392 - DNA, 23 bp, Homo sapiens
tgaagccccttgtcctctcccgc

SEQ ID NO: 5798393 - DNA, 16 bp, Homo sapiens
tgaagccctccaaaag

SEQ ID NO: 5798394 - DNA, 22 bp, Homo sapiens
tgaagccctccaaaagcactta

SEQ ID NO: 5798395 - DNA, 13 bp, Homo sapiens
tgaagccctttgc

SEQ ID NO: 5798396 - DNA, 17 bp, Homo sapiens
tgaagccggacagctgc

SEQ ID NO: 5798397 - DNA, 13 bp, Homo sapiens
tgaagccgtgcct

SEQ ID NO: 5798398 - DNA, 20 bp, Homo sapiens
tgaagccgtgcctgtagcct

SEQ ID NO: 5798399 - DNA, 16 bp, Homo sapiens
tgaagcctatttattt

SEQ ID NO: 5798400 - DNA, 12 bp, Homo sapiens
tgaagcctcccg

SEQ ID NO: 5798401 - DNA, 19 bp, Homo sapiens
tgaagcctctaacaaatga

SEQ ID NO: 5798402 - DNA, 21 bp, Homo sapiens
tgaagcctctaacaaatgatc

SEQ ID NO: 5798403 - DNA, 15 bp, Homo sapiens
tgaagcctctctcct

SEQ ID NO: 5798404 - DNA, 19 bp, Homo sapiens
tgaagcctctgccctgcct

SEQ ID NO: 5798405 - DNA, 21 bp, Homo sapiens
tgaagcctctgccctgcctcc

SEQ ID NO: 5798406 - DNA, 18 bp, Homo sapiens
tgaagcctgaacccaaga

SEQ ID NO: 5798407 - DNA, 15 bp, Homo sapiens
tgaagcctgctcctt

SEQ ID NO: 5798408 - DNA, 17 bp, Homo sapiens
tgaagcctgctccttcc

SEQ ID NO: 5798409 - DNA, 18 bp, Homo sapiens
tgaagcctgtgccacctg

SEQ ID NO: 5798410 - DNA, 13 bp, Homo sapiens
tgaagcctgtgga

SEQ ID NO: 5798411 - DNA, 17 bp, Homo sapiens
tgaagccttctgacctg

SEQ ID NO: 5798412 - DNA, 18 bp, Homo sapiens
tgaagccttctgacctgg

SEQ ID NO: 5798413 - DNA, 12 bp, Homo sapiens
tgaagcctttgt

SEQ ID NO: 5798414 - DNA, 15 bp, Homo sapiens
tgaagccttttcctg

SEQ ID NO: 5798415 - DNA, 18 bp, Homo sapiens
tgaagcgaacatcttcat

SEQ ID NO: 5798416 - DNA, 15 bp, Homo sapiens
tgaagcgactctcct

SEQ ID NO: 5798417 - DNA, 22 bp, Homo sapiens
tgaagcgcctcagttacacagg

SEQ ID NO: 5798418 - DNA, 21 bp, Homo sapiens
tgaagcggtcagactggaggt

SEQ ID NO: 5798419 - DNA, 17 bp, Homo sapiens
tgaagcgtgattttaaa

SEQ ID NO: 5798420 - DNA, 14 bp, Homo sapiens
tgaagcgtgttttt

SEQ ID NO: 5798421 - DNA, 17 bp, Homo sapiens
tgaagctaaaaggaaaa

SEQ ID NO: 5798422 - DNA, 18 bp, Homo sapiens
tgaagctaaaaggaaaag

SEQ ID NO: 5798423 - DNA, 10 bp, Homo sapiens
tgaagctaat

SEQ ID NO: 5798424 - DNA, 21 bp, Homo sapiens
tgaagctaataaaattcgctt

SEQ ID NO: 5798425 - DNA, 23 bp, Homo sapiens
tgaagctaatgaccaacctgttt

SEQ ID NO: 5798426 - DNA, 15 bp, Homo sapiens
tgaagctaatgtgaa

SEQ ID NO: 5798427 - DNA, 19 bp, Homo sapiens
tgaagctaattattttaat

SEQ ID NO: 5798428 - DNA, 22 bp, Homo sapiens
tgaagctaattattttaattag

SEQ ID NO: 5798429 - DNA, 20 bp, Homo sapiens
tgaagctacaggttgtgaaa

SEQ ID NO: 5798430 - DNA, 22 bp, Homo sapiens
tgaagctactgtgtgtgtgaat

SEQ ID NO: 5798431 - DNA, 15 bp, Homo sapiens
tgaagctagaaacaa

SEQ ID NO: 5798432 - DNA, 11 bp, Homo sapiens
tgaagctcaac

SEQ ID NO: 5798433 - DNA, 15 bp, Homo sapiens
tgaagctcaataatg

SEQ ID NO: 5798434 - DNA, 16 bp, Homo sapiens
tgaagctcacactgat

SEQ ID NO: 5798435 - DNA, 19 bp, Homo sapiens
tgaagctcgcatccagaca

SEQ ID NO: 5798436 - DNA, 22 bp, Homo sapiens
tgaagctgaggctgctgccagg

SEQ ID NO: 5798437 - DNA, 14 bp, Homo sapiens
tgaagctgcagtga

SEQ ID NO: 5798438 - DNA, 18 bp, Homo sapiens
tgaagctgccctaataaa

SEQ ID NO: 5798439 - DNA, 17 bp, Homo sapiens
tgaagctgctcactgct

SEQ ID NO: 5798440 - DNA, 17 bp, Homo sapiens
tgaataaatacctctta

SEQ ID NO: 5798441 - DNA, 19 bp, Homo sapiens
tgaataaatacctcttagc

SEQ ID NO: 5798442 - DNA, 14 bp, Homo sapiens
tgaataaatgagaa

SEQ ID NO: 5798443 - DNA, 15 bp, Homo sapiens
tgaataaatgagaaa

SEQ ID NO: 5798444 - DNA, 15 bp, Homo sapiens
tgaataaatgtatct

SEQ ID NO: 5798445 - DNA, 12 bp, Homo sapiens
tgaataaatgtc

SEQ ID NO: 5798446 - DNA, 13 bp, Homo sapiens
tgaataaatgtgt

SEQ ID NO: 5798447 - DNA, 15 bp, Homo sapiens
tgaataaattcagta

SEQ ID NO: 5798448 - DNA, 19 bp, Homo sapiens
tgaataaattttcaaatcc

SEQ ID NO: 5798449 - DNA, 12 bp, Homo sapiens
tgaataacaaca

SEQ ID NO: 5798450 - DNA, 20 bp, Homo sapiens
tgaataacataggtgctctt

SEQ ID NO: 5798451 - DNA, 15 bp, Homo sapiens
tgaataaccacttaa

SEQ ID NO: 5798452 - DNA, 20 bp, Homo sapiens
tgaataacctgcacaggctt

SEQ ID NO: 5798453 - DNA, 13 bp, Homo sapiens
tgaataactcttt

SEQ ID NO: 5798454 - DNA, 23 bp, Homo sapiens
tgaataactgattagtaagtctt

SEQ ID NO: 5798455 - DNA, 13 bp, Homo sapiens
tgaataagcactt

SEQ ID NO: 5798456 - DNA, 13 bp, Homo sapiens
tgaataagcagaa

SEQ ID NO: 5798457 - DNA, 16 bp, Homo sapiens
tgaataagcagaacat

SEQ ID NO: 5798458 - DNA, 21 bp, Homo sapiens
tgaataagtaaagaattactt

SEQ ID NO: 5798459 - DNA, 17 bp, Homo sapiens
tgaataagtattcttca

SEQ ID NO: 5798460 - DNA, 21 bp, Homo sapiens
tgaataagttgattctgtccc

SEQ ID NO: 5798461 - DNA, 16 bp, Homo sapiens
tgaataataaaatcaa

SEQ ID NO: 5798462 - DNA, 13 bp, Homo sapiens
tgaataatgattt

SEQ ID NO: 5798463 - DNA, 18 bp, Homo sapiens
tgaataatgctaccagga

SEQ ID NO: 5798464 - DNA, 15 bp, Homo sapiens
tgaataatgtctaga

SEQ ID NO: 5798465 - DNA, 19 bp, Homo sapiens
tgaataattccatgattaa

SEQ ID NO: 5798466 - DNA, 19 bp, Homo sapiens
tgaataatttcacttaata

SEQ ID NO: 5798467 - DNA, 14 bp, Homo sapiens
tgaataatttccca

SEQ ID NO: 5798468 - DNA, 13 bp, Homo sapiens
tgaataatttctt

SEQ ID NO: 5798469 - DNA, 16 bp, Homo sapiens
tgaatacaaacaatgg

SEQ ID NO: 5798470 - DNA, 15 bp, Homo sapiens
tgaatacaaacattt

SEQ ID NO: 5798471 - DNA, 15 bp, Homo sapiens
tgaatacaaagtgat

SEQ ID NO: 5798472 - DNA, 12 bp, Homo sapiens
tgaatacaatta

SEQ ID NO: 5798473 - DNA, 17 bp, Homo sapiens
tgaatacaattaaaggt

SEQ ID NO: 5798474 - DNA, 14 bp, Homo sapiens
tgaatacacaaatt

SEQ ID NO: 5798475 - DNA, 15 bp, Homo sapiens
tgaatacacagtatt

SEQ ID NO: 5798476 - DNA, 19 bp, Homo sapiens
tgaatacagggcatgcatt

SEQ ID NO: 5798477 - DNA, 21 bp, Homo sapiens
tgaatacagttacttaatgac

SEQ ID NO: 5798478 - DNA, 17 bp, Homo sapiens
tgaatacatttgtattt

SEQ ID NO: 5798479 - DNA, 20 bp, Homo sapiens
tgaatacattttataatttc

SEQ ID NO: 5798480 - DNA, 20 bp, Homo sapiens
tgaataccactctgtaattg

SEQ ID NO: 5798481 - DNA, 12 bp, Homo sapiens
tgaataccactt

SEQ ID NO: 5798482 - DNA, 18 bp, Homo sapiens
tgaataccacttacctca

SEQ ID NO: 5798483 - DNA, 23 bp, Homo sapiens
tgaataccattaaaactgctttt

SEQ ID NO: 5798484 - DNA, 22 bp, Homo sapiens
tgaataccccaagactcccatg

SEQ ID NO: 5798485 - DNA, 15 bp, Homo sapiens
tgaatacccccagag

SEQ ID NO: 5798486 - DNA, 16 bp, Homo sapiens
tgaatacccccagaga

SEQ ID NO: 5798487 - DNA, 18 bp, Homo sapiens
tgaatacccccagagacc

SEQ ID NO: 5798488 - DNA, 21 bp, Homo sapiens
tgaatacctaagatttctgtc

SEQ ID NO: 5798489 - DNA, 21 bp, Homo sapiens
tgaataccttagtgcagttat

SEQ ID NO: 5798490 - DNA, 15 bp, Homo sapiens
tgaatactcctgtta

SEQ ID NO: 5798491 - DNA, 15 bp, Homo sapiens
tgaatactcttccca

SEQ ID NO: 5798492 - DNA, 14 bp, Homo sapiens
tgaatactgctaca

SEQ ID NO: 5798493 - DNA, 21 bp, Homo sapiens
tgaatactgcttgaataaaca

SEQ ID NO: 5798494 - DNA, 20 bp, Homo sapiens
tgaatacttactataatttg

SEQ ID NO: 5798495 - DNA, 23 bp, Homo sapiens
tgaatacttactataatttgact

SEQ ID NO: 5798496 - DNA, 16 bp, Homo sapiens
tgaatacttgaaccat

SEQ ID NO: 5798497 - DNA, 14 bp, Homo sapiens
tgaatacttgaagt

SEQ ID NO: 5798498 - DNA, 15 bp, Homo sapiens
tgaatactttataaa

SEQ ID NO: 5798499 - DNA, 12 bp, Homo sapiens
tgaatagaagaa

SEQ ID NO: 5798500 - DNA, 15 bp, Homo sapiens
tgaatagaagaaaga

SEQ ID NO: 5798501 - DNA, 17 bp, Homo sapiens
tgaatagaagaaagaaa

SEQ ID NO: 5798502 - DNA, 17 bp, Homo sapiens
tgaatagaagcccaaat

SEQ ID NO: 5798503 - DNA, 20 bp, Homo sapiens
tgaatagacagaggtttcat

SEQ ID NO: 5798504 - DNA, 22 bp, Homo sapiens
tgaatagacagaggtttcattt

SEQ ID NO: 5798505 - DNA, 19 bp, Homo sapiens
tgaatagaggccaaattaa

SEQ ID NO: 5798506 - DNA, 23 bp, Homo sapiens
tgaatagagggagtagaaagctt

SEQ ID NO: 5798507 - DNA, 16 bp, Homo sapiens
tgaatagatgtgatca

SEQ ID NO: 5798508 - DNA, 20 bp, Homo sapiens
tgaatagattttctctggaa

SEQ ID NO: 5798509 - DNA, 21 bp, Homo sapiens
tgaatagcaatagcatggata

SEQ ID NO: 5798510 - DNA, 17 bp, Homo sapiens
tgaatagcagtggcaaa

SEQ ID NO: 5798511 - DNA, 23 bp, Homo sapiens
tgaatagcagtggcaaaatatta

SEQ ID NO: 5798512 - DNA, 18 bp, Homo sapiens
tgaatagccatatttgta

SEQ ID NO: 5798513 - DNA, 14 bp, Homo sapiens
tgaatagcctggcc

SEQ ID NO: 5798514 - DNA, 15 bp, Homo sapiens
tgaatagctgtcata

SEQ ID NO: 5798515 - DNA, 20 bp, Homo sapiens
tgaatagctgtgtatctgtt

SEQ ID NO: 5798516 - DNA, 19 bp, Homo sapiens
tgaatagcttatgtacaaa

SEQ ID NO: 5798517 - DNA, 16 bp, Homo sapiens
tgaataggaaaatgta

SEQ ID NO: 5798518 - DNA, 22 bp, Homo sapiens
tgaataggagttctcctggagc

SEQ ID NO: 5798519 - DNA, 22 bp, Homo sapiens
tgaataggcattaaatgcaaaa

SEQ ID NO: 5798520 - DNA, 18 bp, Homo sapiens
tgaataggtagtatcata

SEQ ID NO: 5798521 - DNA, 13 bp, Homo sapiens
tgaataggttccc

SEQ ID NO: 5798522 - DNA, 19 bp, Homo sapiens
tgaatagtgctgcaataaa

SEQ ID NO: 5798523 - DNA, 21 bp, Homo sapiens
tgaatagttgcttaattttga

SEQ ID NO: 5798524 - DNA, 21 bp, Homo sapiens
tgaatagtttatttctgtgaa

SEQ ID NO: 5798525 - DNA, 12 bp, Homo sapiens
tgaatataaaaa

SEQ ID NO: 5798526 - DNA, 14 bp, Homo sapiens
tgaatataaacact

SEQ ID NO: 5798527 - DNA, 17 bp, Homo sapiens
tgaatataaagcttaat

SEQ ID NO: 5798528 - DNA, 12 bp, Homo sapiens
tgaatataaatg

SEQ ID NO: 5798529 - DNA, 17 bp, Homo sapiens
tgaatataaatgtgtgt

SEQ ID NO: 5798530 - DNA, 22 bp, Homo sapiens
tgaatataaatgtgtgtatgtg

SEQ ID NO: 5798531 - DNA, 17 bp, Homo sapiens
tgaatataacttttgtg

SEQ ID NO: 5798532 - DNA, 15 bp, Homo sapiens
tgaatataagaaaat

SEQ ID NO: 5798533 - DNA, 21 bp, Homo sapiens
tgaatataagaaaatgcttga

SEQ ID NO: 5798534 - DNA, 15 bp, Homo sapiens
tgaatatactcatta

SEQ ID NO: 5798535 - DNA, 15 bp, Homo sapiens
tgaatatagcctgcc

SEQ ID NO: 5798536 - DNA, 23 bp, Homo sapiens
tgaatatatatgatgaaattctt

SEQ ID NO: 5798537 - DNA, 12 bp, Homo sapiens
tgaatatatgat

SEQ ID NO: 5798538 - DNA, 17 bp, Homo sapiens
tgaatatatgatttgca

SEQ ID NO: 5798539 - DNA, 20 bp, Homo sapiens
tgaatatatgatttgcatgt

SEQ ID NO: 5798540 - DNA, 20 bp, Homo sapiens
tgaatatatggcatttgcag

SEQ ID NO: 5798541 - DNA, 14 bp, Homo sapiens
tgaatatcaagaat

SEQ ID NO: 5798542 - DNA, 17 bp, Homo sapiens
tgaatatcagtcactgt

SEQ ID NO: 5798543 - DNA, 16 bp, Homo sapiens
tgaatatcatatgtat

SEQ ID NO: 5798544 - DNA, 15 bp, Homo sapiens
tgaatatcattaaat

SEQ ID NO: 5798545 - DNA, 23 bp, Homo sapiens
tgaatatccattctcgttttagg

SEQ ID NO: 5798546 - DNA, 14 bp, Homo sapiens
tgaatatcccctcc

SEQ ID NO: 5798547 - DNA, 21 bp, Homo sapiens
tgaatatctattaatatatgt

SEQ ID NO: 5798548 - DNA, 20 bp, Homo sapiens
tgaatatctgccccagtagt

SEQ ID NO: 5798549 - DNA, 20 bp, Homo sapiens
tgaatatgaacggtgagcat

SEQ ID NO: 5798550 - DNA, 14 bp, Homo sapiens
tgaatatgattaaa

SEQ ID NO: 5798551 - DNA, 15 bp, Homo sapiens
tgaatatgattaaaa

SEQ ID NO: 5798552 - DNA, 14 bp, Homo sapiens
tgaatatgcaattt

SEQ ID NO: 5798553 - DNA, 21 bp, Homo sapiens
tgaatatgcctgtaattcagt

SEQ ID NO: 5798554 - DNA, 13 bp, Homo sapiens
tgaatatgcctta

SEQ ID NO: 5798555 - DNA, 17 bp, Homo sapiens
tgaatatggaagtaaag

SEQ ID NO: 5798556 - DNA, 19 bp, Homo sapiens
tgaatatggaagtaaaggc

SEQ ID NO: 5798557 - DNA, 20 bp, Homo sapiens
tgaatatggaagtaaaggca

SEQ ID NO: 5798558 - DNA, 22 bp, Homo sapiens
tgaatatggacaagaggtacag

SEQ ID NO: 5798559 - DNA, 19 bp, Homo sapiens
tgaatatggttggagagcc

SEQ ID NO: 5798560 - DNA, 21 bp, Homo sapiens
tgaatatggttggagagccct

SEQ ID NO: 5798561 - DNA, 21 bp, Homo sapiens
tgaatatgtgccttctagaat

SEQ ID NO: 5798562 - DNA, 13 bp, Homo sapiens
tgaatatgtgtaa

SEQ ID NO: 5798563 - DNA, 11 bp, Homo sapiens
tgaatattaaa

SEQ ID NO: 5798564 - DNA, 16 bp, Homo sapiens
tgaatattaagctaaa

SEQ ID NO: 5798565 - DNA, 14 bp, Homo sapiens
tgaatattaatccc

SEQ ID NO: 5798566 - DNA, 14 bp, Homo sapiens
tgaatattacatgt

SEQ ID NO: 5798567 - DNA, 20 bp, Homo sapiens
tgaatattacatgtaaagct

SEQ ID NO: 5798568 - DNA, 21 bp, Homo sapiens
tgaatattacatgtaaagctg

SEQ ID NO: 5798569 - DNA, 15 bp, Homo sapiens
tgaatattactctca

SEQ ID NO: 5798570 - DNA, 16 bp, Homo sapiens
tgaatattactctcaa

SEQ ID NO: 5798571 - DNA, 22 bp, Homo sapiens
tgaatattactggataaattgt

SEQ ID NO: 5798572 - DNA, 13 bp, Homo sapiens
tgaatattatata

SEQ ID NO: 5798573 - DNA, 14 bp, Homo sapiens
tgaatattatatat

SEQ ID NO: 5798574 - DNA, 17 bp, Homo sapiens
tgaatattcctggactt

SEQ ID NO: 5798575 - DNA, 16 bp, Homo sapiens
tgaatattcctttatt

SEQ ID NO: 5798576 - DNA, 15 bp, Homo sapiens
tgaatattctagaac

SEQ ID NO: 5798577 - DNA, 16 bp, Homo sapiens
tgaatattgccattat

SEQ ID NO: 5798578 - DNA, 22 bp, Homo sapiens
tgaatattggtaattaaaagac

SEQ ID NO: 5798579 - DNA, 17 bp, Homo sapiens
tgaatattgtggctccc

SEQ ID NO: 5798580 - DNA, 18 bp, Homo sapiens
tgaatattgttcatattg

SEQ ID NO: 5798581 - DNA, 17 bp, Homo sapiens
tgaatatttacgttttt

SEQ ID NO: 5798582 - DNA, 22 bp, Homo sapiens
tgaatatttacgtttttgtaaa

SEQ ID NO: 5798583 - DNA, 19 bp, Homo sapiens
tgaatatttataacagcat

SEQ ID NO: 5798584 - DNA, 19 bp, Homo sapiens
tgaatatttatatttcact

SEQ ID NO: 5798585 - DNA, 16 bp, Homo sapiens
tgaatatttattcagt

SEQ ID NO: 5798586 - DNA, 18 bp, Homo sapiens
tgaatatttcaaaataaa

SEQ ID NO: 5798587 - DNA, 13 bp, Homo sapiens
tgaatatttcatt

SEQ ID NO: 5798588 - DNA, 21 bp, Homo sapiens
tgaatatttccatatggattt

SEQ ID NO: 5798589 - DNA, 12 bp, Homo sapiens
tgaatatttgct

SEQ ID NO: 5798590 - DNA, 13 bp, Homo sapiens
tgaatatttgctt

SEQ ID NO: 5798591 - DNA, 17 bp, Homo sapiens
tgaatatttgcttaaaa

SEQ ID NO: 5798592 - DNA, 23 bp, Homo sapiens
tgaatatttgtcgatatttccat

SEQ ID NO: 5798593 - DNA, 19 bp, Homo sapiens
tgaatatttgttttaatac

SEQ ID NO: 5798594 - DNA, 20 bp, Homo sapiens
tgaatattttatctttcctt

SEQ ID NO: 5798595 - DNA, 19 bp, Homo sapiens
tgaatattttattaaaaca

SEQ ID NO: 5798596 - DNA, 15 bp, Homo sapiens
tgaatattttcaagt

SEQ ID NO: 5798597 - DNA, 15 bp, Homo sapiens
tgaatattttgataa

SEQ ID NO: 5798598 - DNA, 14 bp, Homo sapiens
tgaatattttggaa

SEQ ID NO: 5798599 - DNA, 19 bp, Homo sapiens
tgaatattttggaaactgc

SEQ ID NO: 5798600 - DNA, 18 bp, Homo sapiens
tgaatatttttgtatttt

SEQ ID NO: 5798601 - DNA, 21 bp, Homo sapiens
tgaatatttttgtattttaca

SEQ ID NO: 5798602 - DNA, 24 bp, Homo sapiens
tgaatattttttatttctaagtat

SEQ ID NO: 5798603 - DNA, 19 bp, Homo sapiens
tgaatattttttgaaggtt

SEQ ID NO: 5798604 - DNA, 21 bp, Homo sapiens
tgaatcaaaagctgaaattct

SEQ ID NO: 5798605 - DNA, 15 bp, Homo sapiens
tgaatcaaaagtgcc

SEQ ID NO: 5798606 - DNA, 14 bp, Homo sapiens
tgaatcaaagacat

SEQ ID NO: 5798607 - DNA, 21 bp, Homo sapiens
tgaatcaaagacatttcatcc

SEQ ID NO: 5798608 - DNA, 20 bp, Homo sapiens
tgaatcaagggtcaggcctt

SEQ ID NO: 5798609 - DNA, 18 bp, Homo sapiens
tgaatcaatctggcttct

SEQ ID NO: 5798610 - DNA, 13 bp, Homo sapiens
tgaatcaatgaaa

SEQ ID NO: 5798611 - DNA, 14 bp, Homo sapiens
tgaatcaatgaaaa

SEQ ID NO: 5798612 - DNA, 21 bp, Homo sapiens
tgaatcaatgaaaaatgtaat

SEQ ID NO: 5798613 - DNA, 16 bp, Homo sapiens
tgaatcaatgtattaa

SEQ ID NO: 5798614 - DNA, 18 bp, Homo sapiens
tgaatcaccaattaaaaa

SEQ ID NO: 5798615 - DNA, 15 bp, Homo sapiens
tgaatcacctagggg

SEQ ID NO: 5798616 - DNA, 16 bp, Homo sapiens
tgaatcacctaggggt

SEQ ID NO: 5798617 - DNA, 15 bp, Homo sapiens
tgaatcacctggctg

SEQ ID NO: 5798618 - DNA, 15 bp, Homo sapiens
tgacaaagtcatccc

SEQ ID NO: 5798619 - DNA, 16 bp, Homo sapiens
tgacaaagtcatcccc

SEQ ID NO: 5798620 - DNA, 19 bp, Homo sapiens
tgacaaagtcatcccctct

SEQ ID NO: 5798621 - DNA, 13 bp, Homo sapiens
tgacaaagtgcct

SEQ ID NO: 5798622 - DNA, 15 bp, Homo sapiens
tgacaaagtgcctca

SEQ ID NO: 5798623 - DNA, 21 bp, Homo sapiens
tgacaaagtgtgtctcaaaaa

SEQ ID NO: 5798624 - DNA, 21 bp, Homo sapiens
tgacaaagtgttgaaaatgta

SEQ ID NO: 5798625 - DNA, 14 bp, Homo sapiens
tgacaaagttactg

SEQ ID NO: 5798626 - DNA, 13 bp, Homo sapiens
tgacaaagttata

SEQ ID NO: 5798627 - DNA, 20 bp, Homo sapiens
tgacaaataaattaggacca

SEQ ID NO: 5798628 - DNA, 15 bp, Homo sapiens
tgacaaatattttca

SEQ ID NO: 5798629 - DNA, 14 bp, Homo sapiens
tgacaaatcaagtt

SEQ ID NO: 5798630 - DNA, 15 bp, Homo sapiens
tgacaaatcaagttt

SEQ ID NO: 5798631 - DNA, 23 bp, Homo sapiens
tgacaaatgtgtatcggatgctt

SEQ ID NO: 5798632 - DNA, 14 bp, Homo sapiens
tgacaaatgtttct

SEQ ID NO: 5798633 - DNA, 23 bp, Homo sapiens
tgacaacaaaagggaaaaaagca

SEQ ID NO: 5798634 - DNA, 17 bp, Homo sapiens
tgacaacagaaaaacaa

SEQ ID NO: 5798635 - DNA, 13 bp, Homo sapiens
tgacaacagaagc

SEQ ID NO: 5798636 - DNA, 14 bp, Homo sapiens
tgacaacagactga

SEQ ID NO: 5798637 - DNA, 15 bp, Homo sapiens
tgacaacagcctgag

SEQ ID NO: 5798638 - DNA, 15 bp, Homo sapiens
tgacaacatcccaca

SEQ ID NO: 5798639 - DNA, 12 bp, Homo sapiens
tgacaacatctg

SEQ ID NO: 5798640 - DNA, 21 bp, Homo sapiens
tgacaacatggcttctccttt

SEQ ID NO: 5798641 - DNA, 22 bp, Homo sapiens
tgacaacatggcttctcctttg

SEQ ID NO: 5798642 - DNA, 16 bp, Homo sapiens
tgacaaccaccgctcc

SEQ ID NO: 5798643 - DNA, 16 bp, Homo sapiens
tgacaaccactggtct

SEQ ID NO: 5798644 - DNA, 19 bp, Homo sapiens
tgacaaccatgagaccact

SEQ ID NO: 5798645 - DNA, 17 bp, Homo sapiens
tgacaaccattaaagtc

SEQ ID NO: 5798646 - DNA, 17 bp, Homo sapiens
tgacaaccctggcctca

SEQ ID NO: 5798647 - DNA, 19 bp, Homo sapiens
tgacaaccgagaaggttta

SEQ ID NO: 5798648 - DNA, 13 bp, Homo sapiens
tgacaacctccat

SEQ ID NO: 5798649 - DNA, 21 bp, Homo sapiens
tgacaacctgtgtgagagaat

SEQ ID NO: 5798650 - DNA, 20 bp, Homo sapiens
tgacaacctttgtgtaataa

SEQ ID NO: 5798651 - DNA, 13 bp, Homo sapiens
tgacaactaaaat

SEQ ID NO: 5798652 - DNA, 19 bp, Homo sapiens
tgacaactaaacaaggcat

SEQ ID NO: 5798653 - DNA, 16 bp, Homo sapiens
tgacaactacagaaaa

SEQ ID NO: 5798654 - DNA, 14 bp, Homo sapiens
tgacaactgaagag

SEQ ID NO: 5798655 - DNA, 18 bp, Homo sapiens
tgacaactgaagagacac

SEQ ID NO: 5798656 - DNA, 22 bp, Homo sapiens
tgacaactgaagagacacgtgg

SEQ ID NO: 5798657 - DNA, 18 bp, Homo sapiens
tgacaactgcacatgaaa

SEQ ID NO: 5798658 - DNA, 19 bp, Homo sapiens
tgacaactggaatagtttt

SEQ ID NO: 5798659 - DNA, 14 bp, Homo sapiens
tgacaactggcagg

SEQ ID NO: 5798660 - DNA, 22 bp, Homo sapiens
tgacaactgtgaagccaccctg

SEQ ID NO: 5798661 - DNA, 13 bp, Homo sapiens
tgacaacttctga

SEQ ID NO: 5798662 - DNA, 18 bp, Homo sapiens
tgacaacttttaaagaaa

SEQ ID NO: 5798663 - DNA, 20 bp, Homo sapiens
tgacaagaataattttggaa

SEQ ID NO: 5798664 - DNA, 14 bp, Homo sapiens
tgacaagagcctga

SEQ ID NO: 5798665 - DNA, 23 bp, Homo sapiens
tgacaagagcctgatctcttcct

SEQ ID NO: 5798666 - DNA, 16 bp, Homo sapiens
tgacaagatgggacag

SEQ ID NO: 5798667 - DNA, 22 bp, Homo sapiens
tgacaagattataatattttaa

SEQ ID NO: 5798668 - DNA, 22 bp, Homo sapiens
tgacaagcagatactgctgtgt

SEQ ID NO: 5798669 - DNA, 18 bp, Homo sapiens
tgacaagccaatgtgaat

SEQ ID NO: 5798670 - DNA, 15 bp, Homo sapiens
tgacaagccccaggc

SEQ ID NO: 5798671 - DNA, 17 bp, Homo sapiens
tgacaagccccaggcag

SEQ ID NO: 5798672 - DNA, 21 bp, Homo sapiens
tgacaagctaggaaagaggag

SEQ ID NO: 5798673 - DNA, 12 bp, Homo sapiens
tgacaagctcac

SEQ ID NO: 5798674 - DNA, 21 bp, Homo sapiens
tgacaagctccatttaaacag

SEQ ID NO: 5798675 - DNA, 22 bp, Homo sapiens
tgacaagctgacttggcactta

SEQ ID NO: 5798676 - DNA, 21 bp, Homo sapiens
tgacaagctggcttacactgg

SEQ ID NO: 5798677 - DNA, 19 bp, Homo sapiens
tgacaagctgtatcactgc

SEQ ID NO: 5798678 - DNA, 11 bp, Homo sapiens
tgacaaggaaa

SEQ ID NO: 5798679 - DNA, 15 bp, Homo sapiens
tgacaaggaaaatct

SEQ ID NO: 5798680 - DNA, 21 bp, Homo sapiens
tgacaaggacgcccgaagcac

SEQ ID NO: 5798681 - DNA, 11 bp, Homo sapiens
tgacaaggcca

SEQ ID NO: 5798682 - DNA, 13 bp, Homo sapiens
tgacaaggccagc

SEQ ID NO: 5798683 - DNA, 21 bp, Homo sapiens
tgacaaggccagcacccaaag

SEQ ID NO: 5798684 - DNA, 16 bp, Homo sapiens
tgacaaggcctgcttg

SEQ ID NO: 5798685 - DNA, 19 bp, Homo sapiens
tgacaaggcctgcttgact

SEQ ID NO: 5798686 - DNA, 14 bp, Homo sapiens
tgacaagggcacaa

SEQ ID NO: 5798687 - DNA, 16 bp, Homo sapiens
tgacaaggtagacatg

SEQ ID NO: 5798688 - DNA, 17 bp, Homo sapiens
tgacaaggtagacatgg

SEQ ID NO: 5798689 - DNA, 19 bp, Homo sapiens
tgacaaggtgtttctctgt

SEQ ID NO: 5798690 - DNA, 20 bp, Homo sapiens
tgacaagtcattttaacttt

SEQ ID NO: 5798691 - DNA, 10 bp, Homo sapiens
tgacaataaa

SEQ ID NO: 5798692 - DNA, 13 bp, Homo sapiens
tgacaataaaaca

SEQ ID NO: 5798693 - DNA, 20 bp, Homo sapiens
tgacaataaaatattattga

SEQ ID NO: 5798694 - DNA, 11 bp, Homo sapiens
tgacaataaag

SEQ ID NO: 5798695 - DNA, 23 bp, Homo sapiens
tgacaataaagatatttccaaga

SEQ ID NO: 5798696 - DNA, 14 bp, Homo sapiens
tgacaataaagctt

SEQ ID NO: 5798697 - DNA, 19 bp, Homo sapiens
tgacaataaagcttgttga

SEQ ID NO: 5798698 - DNA, 16 bp, Homo sapiens
tgacaataaataatat

SEQ ID NO: 5798699 - DNA, 14 bp, Homo sapiens
tgacaataaatgtg

SEQ ID NO: 5798700 - DNA, 16 bp, Homo sapiens
tgacaataagaaacag

SEQ ID NO: 5798701 - DNA, 22 bp, Homo sapiens
tgacaataatattgttgtataa

SEQ ID NO: 5798702 - DNA, 21 bp, Homo sapiens
tgacaatagggctaaatgttt

SEQ ID NO: 5798703 - DNA, 18 bp, Homo sapiens
tgacaatatcaatcacat

SEQ ID NO: 5798704 - DNA, 16 bp, Homo sapiens
tgacaatatgacactt

SEQ ID NO: 5798705 - DNA, 21 bp, Homo sapiens
tgacaatatgacacttgtaaa

SEQ ID NO: 5798706 - DNA, 14 bp, Homo sapiens
tgacaatatgattt

SEQ ID NO: 5798707 - DNA, 16 bp, Homo sapiens
tgacaatatgatttta

SEQ ID NO: 5798708 - DNA, 20 bp, Homo sapiens
tgacaatatgattttaaatt

SEQ ID NO: 5798709 - DNA, 24 bp, Homo sapiens
tgacaatattccagatctttcaga

SEQ ID NO: 5798710 - DNA, 13 bp, Homo sapiens
tgacaatcaaaga

SEQ ID NO: 5798711 - DNA, 19 bp, Homo sapiens
tgacaatcaaagaaaagac

SEQ ID NO: 5798712 - DNA, 13 bp, Homo sapiens
tgacaatcacctt

SEQ ID NO: 5798713 - DNA, 16 bp, Homo sapiens
tgacaatcatgtgtgt

SEQ ID NO: 5798714 - DNA, 17 bp, Homo sapiens
tgacaatcatgtgtgtt

SEQ ID NO: 5798715 - DNA, 18 bp, Homo sapiens
tgacaatccgagcagtgg

SEQ ID NO: 5798716 - DNA, 14 bp, Homo sapiens
tgacaatcctattt

SEQ ID NO: 5798717 - DNA, 12 bp, Homo sapiens
tgacaatgaagg

SEQ ID NO: 5798718 - DNA, 16 bp, Homo sapiens
tgacaatgactaagcc

SEQ ID NO: 5798719 - DNA, 12 bp, Homo sapiens
tgacaatgcaat

SEQ ID NO: 5798720 - DNA, 14 bp, Homo sapiens
tgacaatgctgcca

SEQ ID NO: 5798721 - DNA, 19 bp, Homo sapiens
tgacaatgctgccatgccc

SEQ ID NO: 5798722 - DNA, 15 bp, Homo sapiens
tgacaatggacctct

SEQ ID NO: 5798723 - DNA, 15 bp, Homo sapiens
tgacaattcagaggc

SEQ ID NO: 5798724 - DNA, 21 bp, Homo sapiens
tgacaattcccgggcccttca

SEQ ID NO: 5798725 - DNA, 16 bp, Homo sapiens
tgacaattctgttttt

SEQ ID NO: 5798726 - DNA, 17 bp, Homo sapiens
tgacaattgtgaacatg

SEQ ID NO: 5798727 - DNA, 18 bp, Homo sapiens
tgacaattgtgaacatga

SEQ ID NO: 5798728 - DNA, 18 bp, Homo sapiens
tgacaatttcaaaatgca

SEQ ID NO: 5798729 - DNA, 17 bp, Homo sapiens
tgacaatttctggcaga

SEQ ID NO: 5798730 - DNA, 16 bp, Homo sapiens
tgacaatttgccatag

SEQ ID NO: 5798731 - DNA, 22 bp, Homo sapiens
tgacaattttgtacaaatttgt

SEQ ID NO: 5798732 - DNA, 13 bp, Homo sapiens
tgacaattttgtc

SEQ ID NO: 5798733 - DNA, 19 bp, Homo sapiens
tgacaattttgtcttaagt

SEQ ID NO: 5798734 - DNA, 21 bp, Homo sapiens
tgacaattttgtcttaagtgt

SEQ ID NO: 5798735 - DNA, 17 bp, Homo sapiens
tgacacaaaaaaagttg

SEQ ID NO: 5798736 - DNA, 12 bp, Homo sapiens
tgacacaaacac

SEQ ID NO: 5798737 - DNA, 17 bp, Homo sapiens
tgacacaaacacacaca

SEQ ID NO: 5798738 - DNA, 18 bp, Homo sapiens
tgacacaaacctgcctgg

SEQ ID NO: 5798739 - DNA, 18 bp, Homo sapiens
tgacacaaaggtggaata

SEQ ID NO: 5798740 - DNA, 16 bp, Homo sapiens
tgacacaacatctgag

SEQ ID NO: 5798741 - DNA, 17 bp, Homo sapiens
tgacacaacatctgaga

SEQ ID NO: 5798742 - DNA, 14 bp, Homo sapiens
tgacacaactcatc

SEQ ID NO: 5798743 - DNA, 18 bp, Homo sapiens
tgacacaactcatccaga

SEQ ID NO: 5798744 - DNA, 22 bp, Homo sapiens
tgacacaactgtgtgattaaaa

SEQ ID NO: 5798745 - DNA, 20 bp, Homo sapiens
tgacacaagaggaataagaa

SEQ ID NO: 5798746 - DNA, 16 bp, Homo sapiens
tgacacaagtggacct

SEQ ID NO: 5798747 - DNA, 17 bp, Homo sapiens
tgacacaatccctgggg

SEQ ID NO: 5798748 - DNA, 22 bp, Homo sapiens
tgacacaatccctggggctgtg

SEQ ID NO: 5798749 - DNA, 17 bp, Homo sapiens
tgacacaattggaattg

SEQ ID NO: 5798750 - DNA, 19 bp, Homo sapiens
tgacacacactgtctgggg

SEQ ID NO: 5798751 - DNA, 19 bp, Homo sapiens
tgacacacagaaatgtgtc

SEQ ID NO: 5798752 - DNA, 19 bp, Homo sapiens
tgacacacagctctgtcct

SEQ ID NO: 5798753 - DNA, 11 bp, Homo sapiens
tgacacaccag

SEQ ID NO: 5798754 - DNA, 23 bp, Homo sapiens
tgacacaccaggcgctaattcaa

SEQ ID NO: 5798755 - DNA, 19 bp, Homo sapiens
tgacacacgtatttatatt

SEQ ID NO: 5798756 - DNA, 13 bp, Homo sapiens
tgacacactacac

SEQ ID NO: 5798757 - DNA, 17 bp, Homo sapiens
tgacacactacaccaca

SEQ ID NO: 5798758 - DNA, 18 bp, Homo sapiens
tgacacactacaccacac

SEQ ID NO: 5798759 - DNA, 20 bp, Homo sapiens
tgacacactacaccacacac

SEQ ID NO: 5798760 - DNA, 18 bp, Homo sapiens
tgacacagaaaatgttga

SEQ ID NO: 5798761 - DNA, 12 bp, Homo sapiens
tgacacagacat

SEQ ID NO: 5798762 - DNA, 14 bp, Homo sapiens
tgacacagacattt

SEQ ID NO: 5798763 - DNA, 15 bp, Homo sapiens
tgacacagacatttt

SEQ ID NO: 5798764 - DNA, 12 bp, Homo sapiens
tgacacagactc

SEQ ID NO: 5798765 - DNA, 16 bp, Homo sapiens
tgacacagcagcttca

SEQ ID NO: 5798766 - DNA, 17 bp, Homo sapiens
tgacacagcttgtgaat

SEQ ID NO: 5798767 - DNA, 12 bp, Homo sapiens
tgacacaggcca

SEQ ID NO: 5798768 - DNA, 14 bp, Homo sapiens
tgacacaggccagc

SEQ ID NO: 5798769 - DNA, 15 bp, Homo sapiens
tgacacaggccagcc

SEQ ID NO: 5798770 - DNA, 16 bp, Homo sapiens
tgacacaggccagccc

SEQ ID NO: 5798771 - DNA, 16 bp, Homo sapiens
tgacacaggccagcct

SEQ ID NO: 5798772 - DNA, 22 bp, Homo sapiens
tgacacaggggacactgaacct

SEQ ID NO: 5798773 - DNA, 16 bp, Homo sapiens
tgacacaggtcagggc

SEQ ID NO: 5798774 - DNA, 18 bp, Homo sapiens
tgacacaggtcagggctc

SEQ ID NO: 5798775 - DNA, 17 bp, Homo sapiens
tgacacaggtctttcct

SEQ ID NO: 5798776 - DNA, 18 bp, Homo sapiens
tgacacaggtctttccta

SEQ ID NO: 5798777 - DNA, 21 bp, Homo sapiens
tgacacagtcagcatgcttcc

SEQ ID NO: 5798778 - DNA, 20 bp, Homo sapiens
tgacacagtgctcgaccttg

SEQ ID NO: 5798779 - DNA, 15 bp, Homo sapiens
tgacacataaatctg

SEQ ID NO: 5798780 - DNA, 16 bp, Homo sapiens
tgacacataaatctgt

SEQ ID NO: 5798781 - DNA, 17 bp, Homo sapiens
tgacacataaatctgtc

SEQ ID NO: 5798782 - DNA, 21 bp, Homo sapiens
tgacacataatttgaatggtg

SEQ ID NO: 5798783 - DNA, 22 bp, Homo sapiens
tgacacataatttgaatggtgc

SEQ ID NO: 5798784 - DNA, 19 bp, Homo sapiens
tgacacatatcattctgtg

SEQ ID NO: 5798785 - DNA, 18 bp, Homo sapiens
tgacacatatgaacacag

SEQ ID NO: 5798786 - DNA, 22 bp, Homo sapiens
tgacacatatgcaccttgtgtc

SEQ ID NO: 5798787 - DNA, 14 bp, Homo sapiens
tgacacatcagcat

SEQ ID NO: 5798788 - DNA, 18 bp, Homo sapiens
tgacacatcagcatgttt

SEQ ID NO: 5798789 - DNA, 19 bp, Homo sapiens
tgacacatccattgctggc

SEQ ID NO: 5798790 - DNA, 21 bp, Homo sapiens
tgacacatccattgctggcaa

SEQ ID NO: 5798791 - DNA, 19 bp, Homo sapiens
tgacacatcgttttggggg

SEQ ID NO: 5798792 - DNA, 12 bp, Homo sapiens
tgacacatgcaa

SEQ ID NO: 5798793 - DNA, 13 bp, Homo sapiens
tgacacatgctct

SEQ ID NO: 5798794 - DNA, 19 bp, Homo sapiens
tgacacattaatgataaac

SEQ ID NO: 5798795 - DNA, 18 bp, Homo sapiens
tgacacattacaaagcca

SEQ ID NO: 5798796 - DNA, 22 bp, Homo sapiens
tgacacattacaagcctggaaa

SEQ ID NO: 5798797 - DNA, 16 bp, Homo sapiens
tgacattctctattgt

SEQ ID NO: 5798798 - DNA, 19 bp, Homo sapiens
tgacattctctattgtaat

SEQ ID NO: 5798799 - DNA, 15 bp, Homo sapiens
tgacattctgaatgc

SEQ ID NO: 5798800 - DNA, 14 bp, Homo sapiens
tgacattcttagct

SEQ ID NO: 5798801 - DNA, 18 bp, Homo sapiens
tgacattcttagctgtaa

SEQ ID NO: 5798802 - DNA, 14 bp, Homo sapiens
tgacattcttcact

SEQ ID NO: 5798803 - DNA, 13 bp, Homo sapiens
tgacattgaaatc

SEQ ID NO: 5798804 - DNA, 21 bp, Homo sapiens
tgacattgaatggatcaatac

SEQ ID NO: 5798805 - DNA, 19 bp, Homo sapiens
tgacattgccaaaaaggat

SEQ ID NO: 5798806 - DNA, 18 bp, Homo sapiens
tgacattgctaagatgct

SEQ ID NO: 5798807 - DNA, 19 bp, Homo sapiens
tgacattgctaagatgctc

SEQ ID NO: 5798808 - DNA, 15 bp, Homo sapiens
tgacattgctttact

SEQ ID NO: 5798809 - DNA, 17 bp, Homo sapiens
tgacattgtcagaatgt

SEQ ID NO: 5798810 - DNA, 18 bp, Homo sapiens
tgacattgtcagaatgtt

SEQ ID NO: 5798811 - DNA, 20 bp, Homo sapiens
tgacattgtcagaatgttgt

SEQ ID NO: 5798812 - DNA, 14 bp, Homo sapiens
tgacattgtctcct

SEQ ID NO: 5798813 - DNA, 20 bp, Homo sapiens
tgacattgttggccaaagcc

SEQ ID NO: 5798814 - DNA, 16 bp, Homo sapiens
tgacatttaatttagt

SEQ ID NO: 5798815 - DNA, 23 bp, Homo sapiens
tgacatttacaccacactttcaa

SEQ ID NO: 5798816 - DNA, 21 bp, Homo sapiens
tgacatttatgtctcatgtaa

SEQ ID NO: 5798817 - DNA, 18 bp, Homo sapiens
tgacatttatttttcatt

SEQ ID NO: 5798818 - DNA, 22 bp, Homo sapiens
tgacatttatttttctcatgaa

SEQ ID NO: 5798819 - DNA, 16 bp, Homo sapiens
tgacatttcaatcact

SEQ ID NO: 5798820 - DNA, 12 bp, Homo sapiens
tgacatttcact

SEQ ID NO: 5798821 - DNA, 18 bp, Homo sapiens
tgacatttcatctgggtg

SEQ ID NO: 5798822 - DNA, 19 bp, Homo sapiens
tgacatttcatctgggtgg

SEQ ID NO: 5798823 - DNA, 23 bp, Homo sapiens
tgacatttcccaagtcagacaga

SEQ ID NO: 5798824 - DNA, 15 bp, Homo sapiens
tgacatttctaacat

SEQ ID NO: 5798825 - DNA, 16 bp, Homo sapiens
tgacatttctcaaagt

SEQ ID NO: 5798826 - DNA, 12 bp, Homo sapiens
tgacatttcttt

SEQ ID NO: 5798827 - DNA, 19 bp, Homo sapiens
tgacatttgacagtgtggg

SEQ ID NO: 5798828 - DNA, 15 bp, Homo sapiens
tgacatttgtttggt

SEQ ID NO: 5798829 - DNA, 22 bp, Homo sapiens
tgacatttgtttggttatagtg

SEQ ID NO: 5798830 - DNA, 24 bp, Homo sapiens
tgacatttgtttggttatagtgca

SEQ ID NO: 5798831 - DNA, 15 bp, Homo sapiens
tgacattttacatta

SEQ ID NO: 5798832 - DNA, 14 bp, Homo sapiens
tgacattttactat

SEQ ID NO: 5798833 - DNA, 16 bp, Homo sapiens
tgacattttatttttt

SEQ ID NO: 5798834 - DNA, 22 bp, Homo sapiens
tgacattttctttttaaatttt

SEQ ID NO: 5798835 - DNA, 19 bp, Homo sapiens
tgacattttgcatgatgaa

SEQ ID NO: 5798836 - DNA, 16 bp, Homo sapiens
tgacattttgtagcta

SEQ ID NO: 5798837 - DNA, 12 bp, Homo sapiens
tgaccaaaaaaa

SEQ ID NO: 5798838 - DNA, 22 bp, Homo sapiens
tgaccaaaagttacatgtttgc

SEQ ID NO: 5798839 - DNA, 23 bp, Homo sapiens
tgaccaaaagttacatgtttgca

SEQ ID NO: 5798840 - DNA, 14 bp, Homo sapiens
tgaccaaaatacct

SEQ ID NO: 5798841 - DNA, 18 bp, Homo sapiens
tgaccaaaatccccttct

SEQ ID NO: 5798842 - DNA, 20 bp, Homo sapiens
tgaccaaaatggtgaaacct

SEQ ID NO: 5798843 - DNA, 13 bp, Homo sapiens
tgaccaaaccagc

SEQ ID NO: 5798844 - DNA, 15 bp, Homo sapiens
tgaccaaactgtggg

SEQ ID NO: 5798845 - DNA, 18 bp, Homo sapiens
tgaccaaagactgcagaa

SEQ ID NO: 5798846 - DNA, 18 bp, Homo sapiens
tgaccaaagtgataaatt

SEQ ID NO: 5798847 - DNA, 19 bp, Homo sapiens
tgaccaaatatcaccagga

SEQ ID NO: 5798848 - DNA, 21 bp, Homo sapiens
tgaccaaatatcaccaggact

SEQ ID NO: 5798849 - DNA, 23 bp, Homo sapiens
tgaccaaatcacccaatcccagt

SEQ ID NO: 5798850 - DNA, 24 bp, Homo sapiens
tgaccaaatcacccaatcccagtt

SEQ ID NO: 5798851 - DNA, 19 bp, Homo sapiens
tgaccaaatggccagtttt

SEQ ID NO: 5798852 - DNA, 17 bp, Homo sapiens
tgaccaaattgggagat

SEQ ID NO: 5798853 - DNA, 23 bp, Homo sapiens
tgaccaacaggctgttctgcact

SEQ ID NO: 5798854 - DNA, 16 bp, Homo sapiens
tgaccaacatggagaa

SEQ ID NO: 5798855 - DNA, 22 bp, Homo sapiens
tgaccaaccttttcccaaccat

SEQ ID NO: 5798856 - DNA, 20 bp, Homo sapiens
tgaccaacgtggagaaaccc

SEQ ID NO: 5798857 - DNA, 18 bp, Homo sapiens
tgaccaactagacattct

SEQ ID NO: 5798858 - DNA, 23 bp, Homo sapiens
tgaccaactgtgttgtattaaca

SEQ ID NO: 5798859 - DNA, 17 bp, Homo sapiens
tgaccaagaaaaagaaa

SEQ ID NO: 5798860 - DNA, 10 bp, Homo sapiens
tgaccaagac

SEQ ID NO: 5798861 - DNA, 18 bp, Homo sapiens
tgaccaagatgatcacat

SEQ ID NO: 5798862 - DNA, 22 bp, Homo sapiens
tgaccaagcggctcaagaataa

SEQ ID NO: 5798863 - DNA, 22 bp, Homo sapiens
tgaccaaggtaccgatttctgc

SEQ ID NO: 5798864 - DNA, 24 bp, Homo sapiens
tgaccaaggtaccgatttctgcta

SEQ ID NO: 5798865 - DNA, 21 bp, Homo sapiens
tgaccaaggtgaagatggcct

SEQ ID NO: 5798866 - DNA, 21 bp, Homo sapiens
tgaccaagtgatgtgtttaca

SEQ ID NO: 5798867 - DNA, 13 bp, Homo sapiens
tgaccaagttata

SEQ ID NO: 5798868 - DNA, 19 bp, Homo sapiens
tgaccaataaaaaaataag

SEQ ID NO: 5798869 - DNA, 20 bp, Homo sapiens
tgaccaatacatttgtattt

SEQ ID NO: 5798870 - DNA, 19 bp, Homo sapiens
tgaccaatactactgtaaa

SEQ ID NO: 5798871 - DNA, 20 bp, Homo sapiens
tgaccaatactactgtaaat

SEQ ID NO: 5798872 - DNA, 23 bp, Homo sapiens
tgaccaatcgggagtagcaagga

SEQ ID NO: 5798873 - DNA, 16 bp, Homo sapiens
tgaccaatctctgtga

SEQ ID NO: 5798874 - DNA, 15 bp, Homo sapiens
tgaccaatgtcttga

SEQ ID NO: 5798875 - DNA, 15 bp, Homo sapiens
tgaccaattgccctg

SEQ ID NO: 5798876 - DNA, 17 bp, Homo sapiens
tgaccaattgccctgcc

SEQ ID NO: 5798877 - DNA, 14 bp, Homo sapiens
tgaccaatttgcac

SEQ ID NO: 5798878 - DNA, 15 bp, Homo sapiens
tgaccacaaagagta

SEQ ID NO: 5798879 - DNA, 17 bp, Homo sapiens
tgaccacaccttggcct

SEQ ID NO: 5798880 - DNA, 14 bp, Homo sapiens
tgaccacacgctgt

SEQ ID NO: 5798881 - DNA, 15 bp, Homo sapiens
tgaccacacttcctg

SEQ ID NO: 5798882 - DNA, 20 bp, Homo sapiens
tgaccacacttcctgtccag

SEQ ID NO: 5798883 - DNA, 23 bp, Homo sapiens
tgaccacacttcctgtccagaga

SEQ ID NO: 5798884 - DNA, 14 bp, Homo sapiens
tgaccacagaagca

SEQ ID NO: 5798885 - DNA, 14 bp, Homo sapiens
tgaccacagcacag

SEQ ID NO: 5798886 - DNA, 15 bp, Homo sapiens
tgaccacagcacagc

SEQ ID NO: 5798887 - DNA, 19 bp, Homo sapiens
tgaccacagcacagccaac

SEQ ID NO: 5798888 - DNA, 17 bp, Homo sapiens
tgaccacatacgtgtta

SEQ ID NO: 5798889 - DNA, 18 bp, Homo sapiens
tgaccacatagcatgagg

SEQ ID NO: 5798890 - DNA, 21 bp, Homo sapiens
tgaccacatagcatgaggcca

SEQ ID NO: 5798891 - DNA, 12 bp, Homo sapiens
tgaccaccagtt

SEQ ID NO: 5798892 - DNA, 13 bp, Homo sapiens
tgaccacccacca

SEQ ID NO: 5798893 - DNA, 13 bp, Homo sapiens
tgaccaccccctg

SEQ ID NO: 5798894 - DNA, 22 bp, Homo sapiens
tgaccacccctctcgcctcatt

SEQ ID NO: 5798895 - DNA, 23 bp, Homo sapiens
tgaccacccctctcgcctcatta

SEQ ID NO: 5798896 - DNA, 12 bp, Homo sapiens
tgaccaccctcc

SEQ ID NO: 5798897 - DNA, 12 bp, Homo sapiens
tgaccaccctgc

SEQ ID NO: 5798898 - DNA, 13 bp, Homo sapiens
tgaccaccctgcc

SEQ ID NO: 5798899 - DNA, 17 bp, Homo sapiens
tgaccaccctgcctgtg

SEQ ID NO: 5798900 - DNA, 18 bp, Homo sapiens
tgaccaccctgcctgtgg

SEQ ID NO: 5798901 - DNA, 16 bp, Homo sapiens
tgaccaccttctattt

SEQ ID NO: 5798902 - DNA, 16 bp, Homo sapiens
tgaccacgcacctcca

SEQ ID NO: 5798903 - DNA, 20 bp, Homo sapiens
tgaccacggacgtttccatc

SEQ ID NO: 5798904 - DNA, 18 bp, Homo sapiens
tgaccacgggcctcagtt

SEQ ID NO: 5798905 - DNA, 23 bp, Homo sapiens
tgaccacgggcctcagtttcccc

SEQ ID NO: 5798906 - DNA, 20 bp, Homo sapiens
tgaccactcagagacatgca

SEQ ID NO: 5798907 - DNA, 15 bp, Homo sapiens
tgaccactccagaga

SEQ ID NO: 5798908 - DNA, 21 bp, Homo sapiens
tgaccactcttggctattgaa

SEQ ID NO: 5798909 - DNA, 19 bp, Homo sapiens
tgaccactgaattcactcc

SEQ ID NO: 5798910 - DNA, 21 bp, Homo sapiens
tgaccactgaattcactccag

SEQ ID NO: 5798911 - DNA, 17 bp, Homo sapiens
tgaccactgcagaagac

SEQ ID NO: 5798912 - DNA, 16 bp, Homo sapiens
tgaccactggccctgg

SEQ ID NO: 5798913 - DNA, 14 bp, Homo sapiens
tgaccactggccta

SEQ ID NO: 5798914 - DNA, 16 bp, Homo sapiens
tgaccacttgaggcct

SEQ ID NO: 5798915 - DNA, 18 bp, Homo sapiens
tgaccacttgaggcctga

SEQ ID NO: 5798916 - DNA, 18 bp, Homo sapiens
tgaccactttggagcact

SEQ ID NO: 5798917 - DNA, 14 bp, Homo sapiens
tgaccagaaagctt

SEQ ID NO: 5798918 - DNA, 18 bp, Homo sapiens
tgaccagaactttttcct

SEQ ID NO: 5798919 - DNA, 20 bp, Homo sapiens
tgaccagaactttttcctct

SEQ ID NO: 5798920 - DNA, 21 bp, Homo sapiens
tgaccagaagacaaaggccca

SEQ ID NO: 5798921 - DNA, 11 bp, Homo sapiens
tgaccagaagc

SEQ ID NO: 5798922 - DNA, 17 bp, Homo sapiens
tgaccagaagccttgga

SEQ ID NO: 5798923 - DNA, 18 bp, Homo sapiens
tgaccagaagtggcagga

SEQ ID NO: 5798924 - DNA, 23 bp, Homo sapiens
tgaccagaatgaggcacatgaca

SEQ ID NO: 5798925 - DNA, 18 bp, Homo sapiens
tgaccagacctagacctg

SEQ ID NO: 5798926 - DNA, 20 bp, Homo sapiens
tgaccagacctagacctggg

SEQ ID NO: 5798927 - DNA, 22 bp, Homo sapiens
tgaccagacctagacctgggcc

SEQ ID NO: 5798928 - DNA, 21 bp, Homo sapiens
tgaccagactgtgggtccctg

SEQ ID NO: 5798929 - DNA, 13 bp, Homo sapiens
tgaccagagcaaa

SEQ ID NO: 5798930 - DNA, 20 bp, Homo sapiens
tgaccagatctttctcttcc

SEQ ID NO: 5798931 - DNA, 19 bp, Homo sapiens
tgaccagcaccatctctcc

SEQ ID NO: 5798932 - DNA, 18 bp, Homo sapiens
tgaccagcactgtctcag

SEQ ID NO: 5798933 - DNA, 14 bp, Homo sapiens
tgaccagcagcgcc

SEQ ID NO: 5798934 - DNA, 15 bp, Homo sapiens
tgaccagcagcgcct

SEQ ID NO: 5798935 - DNA, 15 bp, Homo sapiens
tgaccagcataccag

SEQ ID NO: 5798936 - DNA, 12 bp, Homo sapiens
tgaccagccccg

SEQ ID NO: 5798937 - DNA, 21 bp, Homo sapiens
tgaccagcctccatgctgcct

SEQ ID NO: 5798938 - DNA, 22 bp, Homo sapiens
tgaccagcctccatgctgcctc

SEQ ID NO: 5798939 - DNA, 22 bp, Homo sapiens
tgaccaggatcccaagcctcct

SEQ ID NO: 5798940 - DNA, 19 bp, Homo sapiens
tgaccaggcccaaggaggg

SEQ ID NO: 5798941 - DNA, 16 bp, Homo sapiens
tgaccaggccctgctc

SEQ ID NO: 5798942 - DNA, 21 bp, Homo sapiens
tgaccaggctcacaactgttt

SEQ ID NO: 5798943 - DNA, 16 bp, Homo sapiens
tgaccaggctgcctcc

SEQ ID NO: 5798944 - DNA, 21 bp, Homo sapiens
tgaccaggctggagtgaagtg

SEQ ID NO: 5798945 - DNA, 15 bp, Homo sapiens
tgaccaggcttcttc

SEQ ID NO: 5798946 - DNA, 16 bp, Homo sapiens
tgaccaggcttcttcc

SEQ ID NO: 5798947 - DNA, 12 bp, Homo sapiens
tgaccagggaag

SEQ ID NO: 5798948 - DNA, 16 bp, Homo sapiens
tgaccagggatgctgg

SEQ ID NO: 5798949 - DNA, 18 bp, Homo sapiens
tgaccagggatgctgggc

SEQ ID NO: 5798950 - DNA, 19 bp, Homo sapiens
tgaccagggatgctgggct

SEQ ID NO: 5798951 - DNA, 17 bp, Homo sapiens
tgaccagggcaaggccc

SEQ ID NO: 5798952 - DNA, 17 bp, Homo sapiens
tgaccagggcagtgaaa

SEQ ID NO: 5798953 - DNA, 20 bp, Homo sapiens
tgaccagggcagtgaaaatg

SEQ ID NO: 5798954 - DNA, 21 bp, Homo sapiens
tgaccaggggccctacctggg

SEQ ID NO: 5798955 - DNA, 16 bp, Homo sapiens
tgaccagtctgaccct

SEQ ID NO: 5798956 - DNA, 19 bp, Homo sapiens
tgaccagtggctatggcct

SEQ ID NO: 5798957 - DNA, 21 bp, Homo sapiens
tgaccagtttaacctgatgca

SEQ ID NO: 5798958 - DNA, 12 bp, Homo sapiens
tgaccagtttac

SEQ ID NO: 5798959 - DNA, 14 bp, Homo sapiens
tgaccagtttcttt

SEQ ID NO: 5798960 - DNA, 12 bp, Homo sapiens
tgaccagttttg

SEQ ID NO: 5798961 - DNA, 13 bp, Homo sapiens
tgaccataaaatt

SEQ ID NO: 5798962 - DNA, 19 bp, Homo sapiens
tgaccataacagtgccagc

SEQ ID NO: 5798963 - DNA, 21 bp, Homo sapiens
tgaccataacagtgccagctt

SEQ ID NO: 5798964 - DNA, 13 bp, Homo sapiens
tgaccatactaat

SEQ ID NO: 5798965 - DNA, 16 bp, Homo sapiens
tgaccatactaataaa

SEQ ID NO: 5798966 - DNA, 17 bp, Homo sapiens
tgaccatactaataaat

SEQ ID NO: 5798967 - DNA, 14 bp, Homo sapiens
tgaccatcatgccc

SEQ ID NO: 5798968 - DNA, 14 bp, Homo sapiens
tgaccatcatttca

SEQ ID NO: 5798969 - DNA, 19 bp, Homo sapiens
tgaccatccactctaccct

SEQ ID NO: 5798970 - DNA, 13 bp, Homo sapiens
tgaccatcccatg

SEQ ID NO: 5798971 - DNA, 15 bp, Homo sapiens
tgaccatcccatgag

SEQ ID NO: 5798972 - DNA, 15 bp, Homo sapiens
tgaccatcctgtcct

SEQ ID NO: 5798973 - DNA, 18 bp, Homo sapiens
tgaccatcttcataattt

SEQ ID NO: 5798974 - DNA, 17 bp, Homo sapiens
tgactcagcagaggcag

SEQ ID NO: 5798975 - DNA, 18 bp, Homo sapiens
tgactcagcatcacccac

SEQ ID NO: 5798976 - DNA, 12 bp, Homo sapiens
tgactcaggagc

SEQ ID NO: 5798977 - DNA, 13 bp, Homo sapiens
tgactcaggagcc

SEQ ID NO: 5798978 - DNA, 15 bp, Homo sapiens
tgactcaggagcctg

SEQ ID NO: 5798979 - DNA, 19 bp, Homo sapiens
tgactcaggagcctgtgac

SEQ ID NO: 5798980 - DNA, 21 bp, Homo sapiens
tgactcaggagcctgtgacat

SEQ ID NO: 5798981 - DNA, 23 bp, Homo sapiens
tgactcaggatttaaaaactgga

SEQ ID NO: 5798982 - DNA, 18 bp, Homo sapiens
tgactcaggcgcctggca

SEQ ID NO: 5798983 - DNA, 20 bp, Homo sapiens
tgactcaggcgcctggcaca

SEQ ID NO: 5798984 - DNA, 18 bp, Homo sapiens
tgactcagggctcctggg

SEQ ID NO: 5798985 - DNA, 19 bp, Homo sapiens
tgactcagggctcctgggt

SEQ ID NO: 5798986 - DNA, 21 bp, Homo sapiens
tgactcaggtggtgtccttct

SEQ ID NO: 5798987 - DNA, 23 bp, Homo sapiens
tgactcagtgtctgcctttaaat

SEQ ID NO: 5798988 - DNA, 13 bp, Homo sapiens
tgactcagttcca

SEQ ID NO: 5798989 - DNA, 15 bp, Homo sapiens
tgactcatcatttgt

SEQ ID NO: 5798990 - DNA, 22 bp, Homo sapiens
tgactcatccccacagctggct

SEQ ID NO: 5798991 - DNA, 15 bp, Homo sapiens
tgactcatccgcctg

SEQ ID NO: 5798992 - DNA, 18 bp, Homo sapiens
tgactcatgcctctgagc

SEQ ID NO: 5798993 - DNA, 16 bp, Homo sapiens
tgactcatggcagctg

SEQ ID NO: 5798994 - DNA, 21 bp, Homo sapiens
tgactcatggcagctgtttct

SEQ ID NO: 5798995 - DNA, 23 bp, Homo sapiens
tgactcatggcagctgtttctca

SEQ ID NO: 5798996 - DNA, 14 bp, Homo sapiens
tgactcattcccag

SEQ ID NO: 5798997 - DNA, 15 bp, Homo sapiens
tgactcattcttttg

SEQ ID NO: 5798998 - DNA, 22 bp, Homo sapiens
tgactcattcttttggattgct

SEQ ID NO: 5798999 - DNA, 13 bp, Homo sapiens
tgactccaaagct

SEQ ID NO: 5799000 - DNA, 19 bp, Homo sapiens
tgactccaagaacaattgt

SEQ ID NO: 5799001 - DNA, 19 bp, Homo sapiens
tgactccacgatcctgcca

SEQ ID NO: 5799002 - DNA, 20 bp, Homo sapiens
tgactccactgtggaaaatg

SEQ ID NO: 5799003 - DNA, 15 bp, Homo sapiens
tgactccaggaagaa

SEQ ID NO: 5799004 - DNA, 12 bp, Homo sapiens
tgactccaggag

SEQ ID NO: 5799005 - DNA, 18 bp, Homo sapiens
tgactccagggtgacaag

SEQ ID NO: 5799006 - DNA, 22 bp, Homo sapiens
tgactccagggtgacaaggcct

SEQ ID NO: 5799007 - DNA, 17 bp, Homo sapiens
tgactccatagaccttt

SEQ ID NO: 5799008 - DNA, 19 bp, Homo sapiens
tgactccatatggaggcct

SEQ ID NO: 5799009 - DNA, 18 bp, Homo sapiens
tgactccatgtgtgctgt

SEQ ID NO: 5799010 - DNA, 18 bp, Homo sapiens
tgactcccaaagagctgc

SEQ ID NO: 5799011 - DNA, 23 bp, Homo sapiens
tgactccccagcccagcacccct

SEQ ID NO: 5799012 - DNA, 17 bp, Homo sapiens
tgactccctccccaccc

SEQ ID NO: 5799013 - DNA, 20 bp, Homo sapiens
tgactccctccccacccaag

SEQ ID NO: 5799014 - DNA, 14 bp, Homo sapiens
tgactccctgggag

SEQ ID NO: 5799015 - DNA, 22 bp, Homo sapiens
tgactcccttaaaatagaaata

SEQ ID NO: 5799016 - DNA, 17 bp, Homo sapiens
tgactcctacctgccct

SEQ ID NO: 5799017 - DNA, 19 bp, Homo sapiens
tgactcctacctgccctgg

SEQ ID NO: 5799018 - DNA, 22 bp, Homo sapiens
tgactcctacctgccctggaac

SEQ ID NO: 5799019 - DNA, 18 bp, Homo sapiens
tgactcctcagtccctct

SEQ ID NO: 5799020 - DNA, 19 bp, Homo sapiens
tgactcctctggctttccc

SEQ ID NO: 5799021 - DNA, 22 bp, Homo sapiens
tgactcctgaaacctcttccta

SEQ ID NO: 5799022 - DNA, 20 bp, Homo sapiens
tgactcctgaagggaaggca

SEQ ID NO: 5799023 - DNA, 14 bp, Homo sapiens
tgactcctgctggt

SEQ ID NO: 5799024 - DNA, 15 bp, Homo sapiens
tgactcctgctggta

SEQ ID NO: 5799025 - DNA, 23 bp, Homo sapiens
tgactcctgctggtacctgccct

SEQ ID NO: 5799026 - DNA, 12 bp, Homo sapiens
tgactcctggac

SEQ ID NO: 5799027 - DNA, 17 bp, Homo sapiens
tgactcctggactccgg

SEQ ID NO: 5799028 - DNA, 18 bp, Homo sapiens
tgactcctggactccgga

SEQ ID NO: 5799029 - DNA, 12 bp, Homo sapiens
tgactcctggtc

SEQ ID NO: 5799030 - DNA, 19 bp, Homo sapiens
tgactcctgttgccatgga

SEQ ID NO: 5799031 - DNA, 19 bp, Homo sapiens
tgactccttatctctttcc

SEQ ID NO: 5799032 - DNA, 23 bp, Homo sapiens
tgactccttatctctttccacca

SEQ ID NO: 5799033 - DNA, 21 bp, Homo sapiens
tgactccttgtggtttatgtc

SEQ ID NO: 5799034 - DNA, 17 bp, Homo sapiens
tgactcctttctctatc

SEQ ID NO: 5799035 - DNA, 13 bp, Homo sapiens
tgactcctttggt

SEQ ID NO: 5799036 - DNA, 14 bp, Homo sapiens
tgactcgaaactga

SEQ ID NO: 5799037 - DNA, 20 bp, Homo sapiens
tgactcgacaaaggccacag

SEQ ID NO: 5799038 - DNA, 18 bp, Homo sapiens
tgactcgagtcacactca

SEQ ID NO: 5799039 - DNA, 19 bp, Homo sapiens
tgactcgagtgtttaaatg

SEQ ID NO: 5799040 - DNA, 21 bp, Homo sapiens
tgactcgagtgtttaaatgct

SEQ ID NO: 5799041 - DNA, 13 bp, Homo sapiens
tgactcgccataa

SEQ ID NO: 5799042 - DNA, 19 bp, Homo sapiens
tgactcgggagctgcacac

SEQ ID NO: 5799043 - DNA, 19 bp, Homo sapiens
tgactcgggctcctgtgcc

SEQ ID NO: 5799044 - DNA, 20 bp, Homo sapiens
tgactcgggctcctgtgccc

SEQ ID NO: 5799045 - DNA, 20 bp, Homo sapiens
tgactcgggggctgtctcag

SEQ ID NO: 5799046 - DNA, 22 bp, Homo sapiens
tgactcgggggctgtctcagac

SEQ ID NO: 5799047 - DNA, 18 bp, Homo sapiens
tgactcgggggtggggaa

SEQ ID NO: 5799048 - DNA, 18 bp, Homo sapiens
tgactcggtttctccaaa

SEQ ID NO: 5799049 - DNA, 15 bp, Homo sapiens
tgactcgtctgactg

SEQ ID NO: 5799050 - DNA, 17 bp, Homo sapiens
tgactcgttacctgccg

SEQ ID NO: 5799051 - DNA, 14 bp, Homo sapiens
tgactctaaagaaa

SEQ ID NO: 5799052 - DNA, 19 bp, Homo sapiens
tgactctaagctcagtgct

SEQ ID NO: 5799053 - DNA, 24 bp, Homo sapiens
tgactctaaggttatctactttta

SEQ ID NO: 5799054 - DNA, 22 bp, Homo sapiens
tgactctaatatgattatacaa

SEQ ID NO: 5799055 - DNA, 15 bp, Homo sapiens
tgactctataagcaa

SEQ ID NO: 5799056 - DNA, 14 bp, Homo sapiens
tgactctcaaatct

SEQ ID NO: 5799057 - DNA, 14 bp, Homo sapiens
tgactctcactagg

SEQ ID NO: 5799058 - DNA, 13 bp, Homo sapiens
tgactctccaggg

SEQ ID NO: 5799059 - DNA, 13 bp, Homo sapiens
tgactctcctgcc

SEQ ID NO: 5799060 - DNA, 14 bp, Homo sapiens
tgactctcctgcct

SEQ ID NO: 5799061 - DNA, 20 bp, Homo sapiens
tgactctcctgcctcagcct

SEQ ID NO: 5799062 - DNA, 21 bp, Homo sapiens
tgactctcgtgcatttcaact

SEQ ID NO: 5799063 - DNA, 22 bp, Homo sapiens
tgactctctgaccctctggaaa

SEQ ID NO: 5799064 - DNA, 13 bp, Homo sapiens
tgactctctgtga

SEQ ID NO: 5799065 - DNA, 14 bp, Homo sapiens
tgactctgaaatct

SEQ ID NO: 5799066 - DNA, 16 bp, Homo sapiens
tgactctgaaatctga

SEQ ID NO: 5799067 - DNA, 22 bp, Homo sapiens
tgactctgaaatctgaagacct

SEQ ID NO: 5799068 - DNA, 17 bp, Homo sapiens
tgactctgccagggtgg

SEQ ID NO: 5799069 - DNA, 14 bp, Homo sapiens
tgactctgccccct

SEQ ID NO: 5799070 - DNA, 18 bp, Homo sapiens
tgactctgccccctgctg

SEQ ID NO: 5799071 - DNA, 19 bp, Homo sapiens
tgactctgccccctgctgg

SEQ ID NO: 5799072 - DNA, 17 bp, Homo sapiens
tgactctggaccatgct

SEQ ID NO: 5799073 - DNA, 16 bp, Homo sapiens
tgactctggctgccaa

SEQ ID NO: 5799074 - DNA, 17 bp, Homo sapiens
tgactctggctgccaag

SEQ ID NO: 5799075 - DNA, 18 bp, Homo sapiens
tgactctggctgccaaga

SEQ ID NO: 5799076 - DNA, 16 bp, Homo sapiens
tgactctggcttggcc

SEQ ID NO: 5799077 - DNA, 13 bp, Homo sapiens
tgactctgggcag

SEQ ID NO: 5799078 - DNA, 17 bp, Homo sapiens
tgactctgggcagggac

SEQ ID NO: 5799079 - DNA, 11 bp, Homo sapiens
tgactctgggt

SEQ ID NO: 5799080 - DNA, 19 bp, Homo sapiens
tgactctgggtccttcctg

SEQ ID NO: 5799081 - DNA, 20 bp, Homo sapiens
tgactctgggtccttcctga

SEQ ID NO: 5799082 - DNA, 22 bp, Homo sapiens
tgactctgggttcgttggggac

SEQ ID NO: 5799083 - DNA, 13 bp, Homo sapiens
tgactcttaagaa

SEQ ID NO: 5799084 - DNA, 23 bp, Homo sapiens
tgactcttactaaccaccatttc

SEQ ID NO: 5799085 - DNA, 20 bp, Homo sapiens
tgactcttagccctcaccac

SEQ ID NO: 5799086 - DNA, 21 bp, Homo sapiens
tgactcttagccctcaccaca

SEQ ID NO: 5799087 - DNA, 22 bp, Homo sapiens
tgactcttagccctcaccacag

SEQ ID NO: 5799088 - DNA, 22 bp, Homo sapiens
tgactcttatttatagaattta

SEQ ID NO: 5799089 - DNA, 18 bp, Homo sapiens
tgactcttccccaggaag

SEQ ID NO: 5799090 - DNA, 12 bp, Homo sapiens
tgactcttctct

SEQ ID NO: 5799091 - DNA, 19 bp, Homo sapiens
tgactcttgagttgttttt

SEQ ID NO: 5799092 - DNA, 23 bp, Homo sapiens
tgactcttgagttgtttttgtat

SEQ ID NO: 5799093 - DNA, 11 bp, Homo sapiens
tgactcttgga

SEQ ID NO: 5799094 - DNA, 18 bp, Homo sapiens
tgactctttcaaagaaat

SEQ ID NO: 5799095 - DNA, 13 bp, Homo sapiens
tgactctttccaa

SEQ ID NO: 5799096 - DNA, 19 bp, Homo sapiens
tgactctttcctaaagcca

SEQ ID NO: 5799097 - DNA, 20 bp, Homo sapiens
tgactctttcctaaagccaa

SEQ ID NO: 5799098 - DNA, 21 bp, Homo sapiens
tgactctttttggactcagcc

SEQ ID NO: 5799099 - DNA, 12 bp, Homo sapiens
tgactgaaatta

SEQ ID NO: 5799100 - DNA, 15 bp, Homo sapiens
tgactgaaattactt

SEQ ID NO: 5799101 - DNA, 16 bp, Homo sapiens
tgactgaaattacttt

SEQ ID NO: 5799102 - DNA, 20 bp, Homo sapiens
tgactgaaattactttaaca

SEQ ID NO: 5799103 - DNA, 22 bp, Homo sapiens
tgactgaacgatccttcaaagt

SEQ ID NO: 5799104 - DNA, 18 bp, Homo sapiens
tgactgaagaagatgagc

SEQ ID NO: 5799105 - DNA, 19 bp, Homo sapiens
tgactgaagccgtgcctgt

SEQ ID NO: 5799106 - DNA, 21 bp, Homo sapiens
tgactgaagcgaacatcttca

SEQ ID NO: 5799107 - DNA, 15 bp, Homo sapiens
tgactgaaggaaaag

SEQ ID NO: 5799108 - DNA, 13 bp, Homo sapiens
tgactgaatgcag

SEQ ID NO: 5799109 - DNA, 13 bp, Homo sapiens
tgactgaatttct

SEQ ID NO: 5799110 - DNA, 18 bp, Homo sapiens
tgactgacactcagatgc

SEQ ID NO: 5799111 - DNA, 16 bp, Homo sapiens
tgactgaccatgcact

SEQ ID NO: 5799112 - DNA, 18 bp, Homo sapiens
tgactgacggctgtgtat

SEQ ID NO: 5799113 - DNA, 15 bp, Homo sapiens
tgactgagatttgta

SEQ ID NO: 5799114 - DNA, 13 bp, Homo sapiens
tgactgaggcagt

SEQ ID NO: 5799115 - DNA, 19 bp, Homo sapiens
tgactgaggcagtttgagg

SEQ ID NO: 5799116 - DNA, 16 bp, Homo sapiens
tgactgaggcctgctt

SEQ ID NO: 5799117 - DNA, 14 bp, Homo sapiens
tgactgagggcctg

SEQ ID NO: 5799118 - DNA, 22 bp, Homo sapiens
tgactgatagcttacactgagg

SEQ ID NO: 5799119 - DNA, 18 bp, Homo sapiens
tgactgatgattttcctt

SEQ ID NO: 5799120 - DNA, 17 bp, Homo sapiens
tgactgatggtttggaa

SEQ ID NO: 5799121 - DNA, 21 bp, Homo sapiens
tgactgatggtttggaaaata

SEQ ID NO: 5799122 - DNA, 22 bp, Homo sapiens
tgactgatggtttggaaaataa

SEQ ID NO: 5799123 - DNA, 16 bp, Homo sapiens
tgactgattcttcagc

SEQ ID NO: 5799124 - DNA, 12 bp, Homo sapiens
tgactgcagccc

SEQ ID NO: 5799125 - DNA, 12 bp, Homo sapiens
tgactgcagttg

SEQ ID NO: 5799126 - DNA, 21 bp, Homo sapiens
tgactgccaagactgctgtgg

SEQ ID NO: 5799127 - DNA, 22 bp, Homo sapiens
tgactgccaagactgctgtggc

SEQ ID NO: 5799128 - DNA, 17 bp, Homo sapiens
tgactgccaagccagat

SEQ ID NO: 5799129 - DNA, 17 bp, Homo sapiens
tgactgccaagccatgg

SEQ ID NO: 5799130 - DNA, 21 bp, Homo sapiens
tgactgcccagcatttgggta

SEQ ID NO: 5799131 - DNA, 19 bp, Homo sapiens
tgactgccccttgcttctc

SEQ ID NO: 5799132 - DNA, 20 bp, Homo sapiens
tgactgcccgctcctcggga

SEQ ID NO: 5799133 - DNA, 15 bp, Homo sapiens
tgactgccctccgaa

SEQ ID NO: 5799134 - DNA, 19 bp, Homo sapiens
tgactgccgcatcatggga

SEQ ID NO: 5799135 - DNA, 21 bp, Homo sapiens
tgactgccggtcatttgaatg

SEQ ID NO: 5799136 - DNA, 12 bp, Homo sapiens
tgactgctcagg

SEQ ID NO: 5799137 - DNA, 15 bp, Homo sapiens
tgactgctcaggcct

SEQ ID NO: 5799138 - DNA, 20 bp, Homo sapiens
tgactgctgcgctgtgctgg

SEQ ID NO: 5799139 - DNA, 14 bp, Homo sapiens
tgactgcttgccct

SEQ ID NO: 5799140 - DNA, 16 bp, Homo sapiens
tgactgcttgccctaa

SEQ ID NO: 5799141 - DNA, 22 bp, Homo sapiens
tgactgcttgtaggtatgtctg

SEQ ID NO: 5799142 - DNA, 23 bp, Homo sapiens
tgactggagggtccatttttctt

SEQ ID NO: 5799143 - DNA, 11 bp, Homo sapiens
tgactggatat

SEQ ID NO: 5799144 - DNA, 24 bp, Homo sapiens
tgactggcaagaggcctcatgcct

SEQ ID NO: 5799145 - DNA, 15 bp, Homo sapiens
tgactggcacagtct

SEQ ID NO: 5799146 - DNA, 15 bp, Homo sapiens
tgactggcaccaaca

SEQ ID NO: 5799147 - DNA, 11 bp, Homo sapiens
tgactggcagg

SEQ ID NO: 5799148 - DNA, 14 bp, Homo sapiens
tgactggcaggtgc

SEQ ID NO: 5799149 - DNA, 16 bp, Homo sapiens
tgactggcaggtgcag

SEQ ID NO: 5799150 - DNA, 21 bp, Homo sapiens
tgactggccagttgcccagag

SEQ ID NO: 5799151 - DNA, 15 bp, Homo sapiens
tgagaagtaaattat

SEQ ID NO: 5799152 - DNA, 19 bp, Homo sapiens
tgagaagtaattcctctga

SEQ ID NO: 5799153 - DNA, 17 bp, Homo sapiens
tgagaagtagccacagt

SEQ ID NO: 5799154 - DNA, 12 bp, Homo sapiens
tgagaagtatac

SEQ ID NO: 5799155 - DNA, 22 bp, Homo sapiens
tgagaagtcaaacatttcaaag

SEQ ID NO: 5799156 - DNA, 18 bp, Homo sapiens
tgagaagtccccttccat

SEQ ID NO: 5799157 - DNA, 19 bp, Homo sapiens
tgagaagtccccttccatc

SEQ ID NO: 5799158 - DNA, 19 bp, Homo sapiens
tgagaagtgaatgctggga

SEQ ID NO: 5799159 - DNA, 22 bp, Homo sapiens
tgagaagtgaatgctgggactc

SEQ ID NO: 5799160 - DNA, 19 bp, Homo sapiens
tgagaagtgcttaacgttt

SEQ ID NO: 5799161 - DNA, 16 bp, Homo sapiens
tgagaagttaagcagc

SEQ ID NO: 5799162 - DNA, 18 bp, Homo sapiens
tgagaagttaagcagcct

SEQ ID NO: 5799163 - DNA, 19 bp, Homo sapiens
tgagaagttaagcagcctt

SEQ ID NO: 5799164 - DNA, 19 bp, Homo sapiens
tgagaataaaaccagctat

SEQ ID NO: 5799165 - DNA, 17 bp, Homo sapiens
tgagaataagagagtca

SEQ ID NO: 5799166 - DNA, 19 bp, Homo sapiens
tgagaataagagagtcata

SEQ ID NO: 5799167 - DNA, 16 bp, Homo sapiens
tgagaataattatttc

SEQ ID NO: 5799168 - DNA, 17 bp, Homo sapiens
tgagaataattatttca

SEQ ID NO: 5799169 - DNA, 18 bp, Homo sapiens
tgagaataattgtgtaca

SEQ ID NO: 5799170 - DNA, 19 bp, Homo sapiens
tgagaataattgtgtacaa

SEQ ID NO: 5799171 - DNA, 20 bp, Homo sapiens
tgagaataattgtgtacaaa

SEQ ID NO: 5799172 - DNA, 16 bp, Homo sapiens
tgagaatacaagatat

SEQ ID NO: 5799173 - DNA, 23 bp, Homo sapiens
tgagaatagaaatttgcccctgg

SEQ ID NO: 5799174 - DNA, 18 bp, Homo sapiens
tgagaatagctttaaaag

SEQ ID NO: 5799175 - DNA, 16 bp, Homo sapiens
tgagaataggggattt

SEQ ID NO: 5799176 - DNA, 16 bp, Homo sapiens
tgagaatagtggagga

SEQ ID NO: 5799177 - DNA, 21 bp, Homo sapiens
tgagaatataccttatttatt

SEQ ID NO: 5799178 - DNA, 16 bp, Homo sapiens
tgagaatcaaaactct

SEQ ID NO: 5799179 - DNA, 23 bp, Homo sapiens
tgagaatcacggtggtaaagaaa

SEQ ID NO: 5799180 - DNA, 20 bp, Homo sapiens
tgagaatcactgctccaggc

SEQ ID NO: 5799181 - DNA, 17 bp, Homo sapiens
tgagaatcagatcattt

SEQ ID NO: 5799182 - DNA, 19 bp, Homo sapiens
tgagaatcaggttgcaaaa

SEQ ID NO: 5799183 - DNA, 17 bp, Homo sapiens
tgagaatcccttaaaat

SEQ ID NO: 5799184 - DNA, 18 bp, Homo sapiens
tgagaatcccttaaaatt

SEQ ID NO: 5799185 - DNA, 14 bp, Homo sapiens
tgagaatcctgcct

SEQ ID NO: 5799186 - DNA, 20 bp, Homo sapiens
tgagaatctaggccacccca

SEQ ID NO: 5799187 - DNA, 18 bp, Homo sapiens
tgagaatctatatttaac

SEQ ID NO: 5799188 - DNA, 14 bp, Homo sapiens
tgagaatctggggg

SEQ ID NO: 5799189 - DNA, 16 bp, Homo sapiens
tgagaatctgggggtg

SEQ ID NO: 5799190 - DNA, 20 bp, Homo sapiens
tgagaatctgtgcagtcatc

SEQ ID NO: 5799191 - DNA, 22 bp, Homo sapiens
tgagaatctttattgagaaaga

SEQ ID NO: 5799192 - DNA, 18 bp, Homo sapiens
tgagaatctttgcatgca

SEQ ID NO: 5799193 - DNA, 14 bp, Homo sapiens
tgagaatgaacaaa

SEQ ID NO: 5799194 - DNA, 22 bp, Homo sapiens
tgagaatgacctgccctggccc

SEQ ID NO: 5799195 - DNA, 16 bp, Homo sapiens
tgagaatgagtgggaa

SEQ ID NO: 5799196 - DNA, 17 bp, Homo sapiens
tgagaatgagtgggaat

SEQ ID NO: 5799197 - DNA, 23 bp, Homo sapiens
tgagaatggcctggagcaggccc

SEQ ID NO: 5799198 - DNA, 15 bp, Homo sapiens
tgagaatgtaagaac

SEQ ID NO: 5799199 - DNA, 19 bp, Homo sapiens
tgagaatgtagaagtggca

SEQ ID NO: 5799200 - DNA, 16 bp, Homo sapiens
tgagaatgtatcccca

SEQ ID NO: 5799201 - DNA, 14 bp, Homo sapiens
tgagaatgtcattt

SEQ ID NO: 5799202 - DNA, 16 bp, Homo sapiens
tgagaatgtcatttgc

SEQ ID NO: 5799203 - DNA, 12 bp, Homo sapiens
tgagaatgtgac

SEQ ID NO: 5799204 - DNA, 13 bp, Homo sapiens
tgagaatgtgacc

SEQ ID NO: 5799205 - DNA, 12 bp, Homo sapiens
tgagaatgtgat

SEQ ID NO: 5799206 - DNA, 18 bp, Homo sapiens
tgagaattactgtttgaa

SEQ ID NO: 5799207 - DNA, 20 bp, Homo sapiens
tgagaattattcctttccta

SEQ ID NO: 5799208 - DNA, 15 bp, Homo sapiens
tgagaattccaagga

SEQ ID NO: 5799209 - DNA, 18 bp, Homo sapiens
tgagaattccctgtggat

SEQ ID NO: 5799210 - DNA, 21 bp, Homo sapiens
tgagaattccctgtggatttt

SEQ ID NO: 5799211 - DNA, 22 bp, Homo sapiens
tgagaattgaggggaggtggcc

SEQ ID NO: 5799212 - DNA, 14 bp, Homo sapiens
tgagaattgcaaaa

SEQ ID NO: 5799213 - DNA, 23 bp, Homo sapiens
tgagaattgggactctgttgctg

SEQ ID NO: 5799214 - DNA, 21 bp, Homo sapiens
tgagaattgtgttatttcact

SEQ ID NO: 5799215 - DNA, 14 bp, Homo sapiens
tgagaatttctaaa

SEQ ID NO: 5799216 - DNA, 15 bp, Homo sapiens
tgagaattttaaatt

SEQ ID NO: 5799217 - DNA, 20 bp, Homo sapiens
tgagaattttatattctaag

SEQ ID NO: 5799218 - DNA, 16 bp, Homo sapiens
tgagaattttgtttca

SEQ ID NO: 5799219 - DNA, 12 bp, Homo sapiens
tgagacaaaaat

SEQ ID NO: 5799220 - DNA, 14 bp, Homo sapiens
tgagacaaaaatta

SEQ ID NO: 5799221 - DNA, 15 bp, Homo sapiens
tgagacaaaaattat

SEQ ID NO: 5799222 - DNA, 16 bp, Homo sapiens
tgagacaaaaattatc

SEQ ID NO: 5799223 - DNA, 22 bp, Homo sapiens
tgagacaaatcctttctgcccc

SEQ ID NO: 5799224 - DNA, 18 bp, Homo sapiens
tgagacaaatggaggcct

SEQ ID NO: 5799225 - DNA, 23 bp, Homo sapiens
tgagacaaattttaacttcttgt

SEQ ID NO: 5799226 - DNA, 14 bp, Homo sapiens
tgagacaacacaca

SEQ ID NO: 5799227 - DNA, 16 bp, Homo sapiens
tgagacaacacacaca

SEQ ID NO: 5799228 - DNA, 21 bp, Homo sapiens
tgagacaagaaaataagagct

SEQ ID NO: 5799229 - DNA, 19 bp, Homo sapiens
tgagacaagccctggcaac

SEQ ID NO: 5799230 - DNA, 16 bp, Homo sapiens
tgagacaatgttttct

SEQ ID NO: 5799231 - DNA, 19 bp, Homo sapiens
tgagacaatgttttcttca

SEQ ID NO: 5799232 - DNA, 23 bp, Homo sapiens
tgagacacagcccagagactgaa

SEQ ID NO: 5799233 - DNA, 17 bp, Homo sapiens
tgagacacatacaaaaa

SEQ ID NO: 5799234 - DNA, 11 bp, Homo sapiens
tgagacacatg

SEQ ID NO: 5799235 - DNA, 17 bp, Homo sapiens
tgagacacatgggtgct

SEQ ID NO: 5799236 - DNA, 19 bp, Homo sapiens
tgagacacatgggtgctat

SEQ ID NO: 5799237 - DNA, 17 bp, Homo sapiens
tgagacacggagcccag

SEQ ID NO: 5799238 - DNA, 15 bp, Homo sapiens
tgagacactgtcaag

SEQ ID NO: 5799239 - DNA, 13 bp, Homo sapiens
tgagacagaatct

SEQ ID NO: 5799240 - DNA, 20 bp, Homo sapiens
tgagacagaatctcgctctg

SEQ ID NO: 5799241 - DNA, 12 bp, Homo sapiens
tgagacagagtc

SEQ ID NO: 5799242 - DNA, 12 bp, Homo sapiens
tgagacagcaag

SEQ ID NO: 5799243 - DNA, 21 bp, Homo sapiens
tgagacagcaccactgctgag

SEQ ID NO: 5799244 - DNA, 22 bp, Homo sapiens
tgagacagcaccactgctgagg

SEQ ID NO: 5799245 - DNA, 15 bp, Homo sapiens
tgagacagcagtctt

SEQ ID NO: 5799246 - DNA, 18 bp, Homo sapiens
tgagacagcccgggctct

SEQ ID NO: 5799247 - DNA, 19 bp, Homo sapiens
tgagacagcccgggctctg

SEQ ID NO: 5799248 - DNA, 22 bp, Homo sapiens
tgagacagcccgggctctgcct

SEQ ID NO: 5799249 - DNA, 22 bp, Homo sapiens
tgagacagcggtcccaggggcc

SEQ ID NO: 5799250 - DNA, 12 bp, Homo sapiens
tgagacagctct

SEQ ID NO: 5799251 - DNA, 16 bp, Homo sapiens
tgagacagctctgcat

SEQ ID NO: 5799252 - DNA, 21 bp, Homo sapiens
tgagacaggaggattgcctga

SEQ ID NO: 5799253 - DNA, 23 bp, Homo sapiens
tgagacaggcagtttcagagatg

SEQ ID NO: 5799254 - DNA, 23 bp, Homo sapiens
tgagacaggctgggtcctgccag

SEQ ID NO: 5799255 - DNA, 13 bp, Homo sapiens
tgagacagggtct

SEQ ID NO: 5799256 - DNA, 20 bp, Homo sapiens
tgagacagggtcttgctctg

SEQ ID NO: 5799257 - DNA, 23 bp, Homo sapiens
tgagacagggtgctgatgggaag

SEQ ID NO: 5799258 - DNA, 22 bp, Homo sapiens
tgagacagggttttttcatttt

SEQ ID NO: 5799259 - DNA, 22 bp, Homo sapiens
tgagacaggtgcctaacctggg

SEQ ID NO: 5799260 - DNA, 21 bp, Homo sapiens
tgagacaggtgcctggggctg

SEQ ID NO: 5799261 - DNA, 22 bp, Homo sapiens
tgagacaggtgcctggggctgg

SEQ ID NO: 5799262 - DNA, 17 bp, Homo sapiens
tgagacagtctggaaag

SEQ ID NO: 5799263 - DNA, 15 bp, Homo sapiens
tgagacagtcttgct

SEQ ID NO: 5799264 - DNA, 14 bp, Homo sapiens
tgagacagtgaatt

SEQ ID NO: 5799265 - DNA, 15 bp, Homo sapiens
tgagacagtgaattt

SEQ ID NO: 5799266 - DNA, 18 bp, Homo sapiens
tgagacagtgcacatgaa

SEQ ID NO: 5799267 - DNA, 15 bp, Homo sapiens
tgagacagtgggaaa

SEQ ID NO: 5799268 - DNA, 16 bp, Homo sapiens
tgagacagtgggaaat

SEQ ID NO: 5799269 - DNA, 16 bp, Homo sapiens
tgagacagtgggggtg

SEQ ID NO: 5799270 - DNA, 16 bp, Homo sapiens
tgagacagtttcttag

SEQ ID NO: 5799271 - DNA, 19 bp, Homo sapiens
tgagacagtttcttagctt

SEQ ID NO: 5799272 - DNA, 21 bp, Homo sapiens
tgagacataaatgttcacttt

SEQ ID NO: 5799273 - DNA, 13 bp, Homo sapiens
tgagacatattta

SEQ ID NO: 5799274 - DNA, 18 bp, Homo sapiens
tgagacatgaagacacca

SEQ ID NO: 5799275 - DNA, 18 bp, Homo sapiens
tgagacattccaaaacga

SEQ ID NO: 5799276 - DNA, 22 bp, Homo sapiens
tgagacattgacaccagaaagc

SEQ ID NO: 5799277 - DNA, 12 bp, Homo sapiens
tgagaccacctc

SEQ ID NO: 5799278 - DNA, 14 bp, Homo sapiens
tgagaccagcctgc

SEQ ID NO: 5799279 - DNA, 15 bp, Homo sapiens
tgagaccagcctggc

SEQ ID NO: 5799280 - DNA, 17 bp, Homo sapiens
tgagaccagcctggcca

SEQ ID NO: 5799281 - DNA, 17 bp, Homo sapiens
tgagaccaggggaccag

SEQ ID NO: 5799282 - DNA, 14 bp, Homo sapiens
tgagaccagggtct

SEQ ID NO: 5799283 - DNA, 22 bp, Homo sapiens
tgagaccagtggtctggaaaca

SEQ ID NO: 5799284 - DNA, 13 bp, Homo sapiens
tgagaccagtgta

SEQ ID NO: 5799285 - DNA, 21 bp, Homo sapiens
tgagaccagttgaataaaagt

SEQ ID NO: 5799286 - DNA, 18 bp, Homo sapiens
tgagaccatccattctcc

SEQ ID NO: 5799287 - DNA, 19 bp, Homo sapiens
tgagaccatccattctcct

SEQ ID NO: 5799288 - DNA, 21 bp, Homo sapiens
tgagaccatccattctcctca

SEQ ID NO: 5799289 - DNA, 23 bp, Homo sapiens
tgagaccatgtttcaaacaagaa

SEQ ID NO: 5799290 - DNA, 17 bp, Homo sapiens
tgagacccagccccttc

SEQ ID NO: 5799291 - DNA, 20 bp, Homo sapiens
tgagacccagccctcatccc

SEQ ID NO: 5799292 - DNA, 13 bp, Homo sapiens
tgagacccaggac

SEQ ID NO: 5799293 - DNA, 16 bp, Homo sapiens
tgagacccaggagccg

SEQ ID NO: 5799294 - DNA, 19 bp, Homo sapiens
tgagacccagtgcactccg

SEQ ID NO: 5799295 - DNA, 23 bp, Homo sapiens
tgagaccccaaagactctggagg

SEQ ID NO: 5799296 - DNA, 20 bp, Homo sapiens
tgagaccccagtgcctgcac

SEQ ID NO: 5799297 - DNA, 18 bp, Homo sapiens
tgagacccccaagcttcc

SEQ ID NO: 5799298 - DNA, 13 bp, Homo sapiens
tgagacccccaca

SEQ ID NO: 5799299 - DNA, 17 bp, Homo sapiens
tgagacccccacacctc

SEQ ID NO: 5799300 - DNA, 15 bp, Homo sapiens
tgagaccccgcactg

SEQ ID NO: 5799301 - DNA, 18 bp, Homo sapiens
tgagaccccgcactgcag

SEQ ID NO: 5799302 - DNA, 20 bp, Homo sapiens
tgagaccccgcactgcagac

SEQ ID NO: 5799303 - DNA, 15 bp, Homo sapiens
tgagacccctggcct

SEQ ID NO: 5799304 - DNA, 13 bp, Homo sapiens
tgagaccctactg

SEQ ID NO: 5799305 - DNA, 15 bp, Homo sapiens
tgagaccctactgaa

SEQ ID NO: 5799306 - DNA, 18 bp, Homo sapiens
tgagaccctcttctctgg

SEQ ID NO: 5799307 - DNA, 21 bp, Homo sapiens
tgagaccctcttctctgggcc

SEQ ID NO: 5799308 - DNA, 12 bp, Homo sapiens
tgagaccctgtc

SEQ ID NO: 5799309 - DNA, 15 bp, Homo sapiens
tgagacccttttctc

SEQ ID NO: 5799310 - DNA, 17 bp, Homo sapiens
tgagacccttttctcag

SEQ ID NO: 5799311 - DNA, 20 bp, Homo sapiens
tgagaccgtgaagatacttt

SEQ ID NO: 5799312 - DNA, 23 bp, Homo sapiens
tgagaccgtgaagatactttgta

SEQ ID NO: 5799313 - DNA, 18 bp, Homo sapiens
tgagacctaatctctgta

SEQ ID NO: 5799314 - DNA, 19 bp, Homo sapiens
tgagacctaatctctgtaa

SEQ ID NO: 5799315 - DNA, 20 bp, Homo sapiens
tgagacctaatctctgtaaa

SEQ ID NO: 5799316 - DNA, 17 bp, Homo sapiens
tgagacctacaggctga

SEQ ID NO: 5799317 - DNA, 12 bp, Homo sapiens
tgagacctcagc

SEQ ID NO: 5799318 - DNA, 16 bp, Homo sapiens
tgagacctcagccatg

SEQ ID NO: 5799319 - DNA, 15 bp, Homo sapiens
tgagacctcccccag

SEQ ID NO: 5799320 - DNA, 13 bp, Homo sapiens
tgagacctgcccc

SEQ ID NO: 5799321 - DNA, 15 bp, Homo sapiens
tgagacctgcccctc

SEQ ID NO: 5799322 - DNA, 18 bp, Homo sapiens
tgagacctgggatttgag

SEQ ID NO: 5799323 - DNA, 22 bp, Homo sapiens
tgagacctggggtttagaaccc

SEQ ID NO: 5799324 - DNA, 19 bp, Homo sapiens
tgagaccttccttttactt

SEQ ID NO: 5799325 - DNA, 15 bp, Homo sapiens
tgagacctttcctct

SEQ ID NO: 5799326 - DNA, 23 bp, Homo sapiens
tgagacgaatgccattggaacct

SEQ ID NO: 5799327 - DNA, 21 bp, Homo sapiens
tgagacggagaccccggtggc

SEQ ID NO: 5799328 - DNA, 16 bp, Homo sapiens
tgagcacatctctctg

SEQ ID NO: 5799329 - DNA, 21 bp, Homo sapiens
tgagcacatctctctgccctc

SEQ ID NO: 5799330 - DNA, 22 bp, Homo sapiens
tgagcacatctctctgccctct

SEQ ID NO: 5799331 - DNA, 23 bp, Homo sapiens
tgagcacatctctctgccctctc

SEQ ID NO: 5799332 - DNA, 17 bp, Homo sapiens
tgagcacatctcttcat

SEQ ID NO: 5799333 - DNA, 15 bp, Homo sapiens
tgagcacatctggga

SEQ ID NO: 5799334 - DNA, 21 bp, Homo sapiens
tgagcacatctgggaggctgg

SEQ ID NO: 5799335 - DNA, 14 bp, Homo sapiens
tgagcaccaccagg

SEQ ID NO: 5799336 - DNA, 17 bp, Homo sapiens
tgagcaccaccagggct

SEQ ID NO: 5799337 - DNA, 18 bp, Homo sapiens
tgagcaccaccagggctc

SEQ ID NO: 5799338 - DNA, 13 bp, Homo sapiens
tgagcaccagggg

SEQ ID NO: 5799339 - DNA, 16 bp, Homo sapiens
tgagcaccaggggatg

SEQ ID NO: 5799340 - DNA, 21 bp, Homo sapiens
tgagcaccgtgtcaagctgct

SEQ ID NO: 5799341 - DNA, 14 bp, Homo sapiens
tgagcacctcccag

SEQ ID NO: 5799342 - DNA, 15 bp, Homo sapiens
tgagcacctcccagc

SEQ ID NO: 5799343 - DNA, 16 bp, Homo sapiens
tgagcacctctcagag

SEQ ID NO: 5799344 - DNA, 21 bp, Homo sapiens
tgagcacctttggaaacaaca

SEQ ID NO: 5799345 - DNA, 22 bp, Homo sapiens
tgagcacctttggaaacaacat

SEQ ID NO: 5799346 - DNA, 21 bp, Homo sapiens
tgagcactaaggtgtgctctg

SEQ ID NO: 5799347 - DNA, 17 bp, Homo sapiens
tgagcactatctttcag

SEQ ID NO: 5799348 - DNA, 15 bp, Homo sapiens
tgagcactcccaagt

SEQ ID NO: 5799349 - DNA, 13 bp, Homo sapiens
tgagcactcctgg

SEQ ID NO: 5799350 - DNA, 14 bp, Homo sapiens
tgagcactcctggt

SEQ ID NO: 5799351 - DNA, 23 bp, Homo sapiens
tgagcactcctggtgcaggtctc

SEQ ID NO: 5799352 - DNA, 13 bp, Homo sapiens
tgagcactgccag

SEQ ID NO: 5799353 - DNA, 17 bp, Homo sapiens
tgagcactgccaggagg

SEQ ID NO: 5799354 - DNA, 13 bp, Homo sapiens
tgagcactgtagg

SEQ ID NO: 5799355 - DNA, 22 bp, Homo sapiens
tgagcactgtttatacactgtg

SEQ ID NO: 5799356 - DNA, 14 bp, Homo sapiens
tgagcactgttttc

SEQ ID NO: 5799357 - DNA, 22 bp, Homo sapiens
tgagcactgttttctagtgtat

SEQ ID NO: 5799358 - DNA, 13 bp, Homo sapiens
tgagcagaactga

SEQ ID NO: 5799359 - DNA, 14 bp, Homo sapiens
tgagcagaatacaa

SEQ ID NO: 5799360 - DNA, 15 bp, Homo sapiens
tgagcagaatacaat

SEQ ID NO: 5799361 - DNA, 18 bp, Homo sapiens
tgagcagaatactggtct

SEQ ID NO: 5799362 - DNA, 19 bp, Homo sapiens
tgagcagaatactggtctc

SEQ ID NO: 5799363 - DNA, 18 bp, Homo sapiens
tgagcagaatgttgtact

SEQ ID NO: 5799364 - DNA, 22 bp, Homo sapiens
tgagcagaatgttgtacttgaa

SEQ ID NO: 5799365 - DNA, 15 bp, Homo sapiens
tgagcagaattcatt

SEQ ID NO: 5799366 - DNA, 15 bp, Homo sapiens
tgagcagacaggctg

SEQ ID NO: 5799367 - DNA, 20 bp, Homo sapiens
tgagcagacagggcgtcctc

SEQ ID NO: 5799368 - DNA, 21 bp, Homo sapiens
tgagcagacagggcgtcctct

SEQ ID NO: 5799369 - DNA, 22 bp, Homo sapiens
tgagcagacagggcgtcctctc

SEQ ID NO: 5799370 - DNA, 23 bp, Homo sapiens
tgagcagagaactgatgcgactt

SEQ ID NO: 5799371 - DNA, 17 bp, Homo sapiens
tgagcagagatgtactg

SEQ ID NO: 5799372 - DNA, 12 bp, Homo sapiens
tgagcagagcgg

SEQ ID NO: 5799373 - DNA, 14 bp, Homo sapiens
tgagcagagcggga

SEQ ID NO: 5799374 - DNA, 20 bp, Homo sapiens
tgagcagagcgggactctgt

SEQ ID NO: 5799375 - DNA, 21 bp, Homo sapiens
tgagcagagtcttgctacctc

SEQ ID NO: 5799376 - DNA, 19 bp, Homo sapiens
tgagcagatcgtgccgtgg

SEQ ID NO: 5799377 - DNA, 20 bp, Homo sapiens
tgagcagatctgaaaggcac

SEQ ID NO: 5799378 - DNA, 21 bp, Homo sapiens
tgagcagcatccaccccaccc

SEQ ID NO: 5799379 - DNA, 14 bp, Homo sapiens
tgagcagcccagca

SEQ ID NO: 5799380 - DNA, 23 bp, Homo sapiens
tgagcagcccctcccagatagaa

SEQ ID NO: 5799381 - DNA, 21 bp, Homo sapiens
tgagcagcccttacagtattg

SEQ ID NO: 5799382 - DNA, 16 bp, Homo sapiens
tgagcagccgccagct

SEQ ID NO: 5799383 - DNA, 19 bp, Homo sapiens
tgagcagccgccagctggg

SEQ ID NO: 5799384 - DNA, 15 bp, Homo sapiens
tgagcagcctctgga

SEQ ID NO: 5799385 - DNA, 21 bp, Homo sapiens
tgagcagcctctggacagcca

SEQ ID NO: 5799386 - DNA, 23 bp, Homo sapiens
tgagcagcctctggacagccagt

SEQ ID NO: 5799387 - DNA, 21 bp, Homo sapiens
tgagcagcctggagccctgga

SEQ ID NO: 5799388 - DNA, 17 bp, Homo sapiens
tgagcagcgagcctgct

SEQ ID NO: 5799389 - DNA, 18 bp, Homo sapiens
tgagcagctactgtaact

SEQ ID NO: 5799390 - DNA, 21 bp, Homo sapiens
tgagcagctactgtaactttt

SEQ ID NO: 5799391 - DNA, 12 bp, Homo sapiens
tgagcagctgaa

SEQ ID NO: 5799392 - DNA, 21 bp, Homo sapiens
tgagcagctgaataacctgca

SEQ ID NO: 5799393 - DNA, 22 bp, Homo sapiens
tgagcagctgaataacctgcac

SEQ ID NO: 5799394 - DNA, 22 bp, Homo sapiens
tgagcaggaaccggagggtgac

SEQ ID NO: 5799395 - DNA, 19 bp, Homo sapiens
tgagcaggaaggcctgggt

SEQ ID NO: 5799396 - DNA, 17 bp, Homo sapiens
tgagcaggacagccagc

SEQ ID NO: 5799397 - DNA, 11 bp, Homo sapiens
tgagcaggagc

SEQ ID NO: 5799398 - DNA, 12 bp, Homo sapiens
tgagcaggagct

SEQ ID NO: 5799399 - DNA, 18 bp, Homo sapiens
tgagcaggagcttgggtc

SEQ ID NO: 5799400 - DNA, 13 bp, Homo sapiens
tgagcaggcaggg

SEQ ID NO: 5799401 - DNA, 16 bp, Homo sapiens
tgagcaggcagggctg

SEQ ID NO: 5799402 - DNA, 20 bp, Homo sapiens
tgagcaggcagggctgggcc

SEQ ID NO: 5799403 - DNA, 20 bp, Homo sapiens
tgagcaggcccgacagagag

SEQ ID NO: 5799404 - DNA, 23 bp, Homo sapiens
tgagcaggcccgacagagagatg

SEQ ID NO: 5799405 - DNA, 17 bp, Homo sapiens
tgagcagggatcctggt

SEQ ID NO: 5799406 - DNA, 15 bp, Homo sapiens
tgagcagggccctca

SEQ ID NO: 5799407 - DNA, 19 bp, Homo sapiens
tgagcagggccctcagagg

SEQ ID NO: 5799408 - DNA, 14 bp, Homo sapiens
tgagcagggccggg

SEQ ID NO: 5799409 - DNA, 20 bp, Homo sapiens
tgagcagggccggggaactg

SEQ ID NO: 5799410 - DNA, 15 bp, Homo sapiens
tgagcagggctcagc

SEQ ID NO: 5799411 - DNA, 16 bp, Homo sapiens
tgagcagggctcagcg

SEQ ID NO: 5799412 - DNA, 22 bp, Homo sapiens
tgagcagggctcagcggggaca

SEQ ID NO: 5799413 - DNA, 17 bp, Homo sapiens
tgagcagggcttgctcc

SEQ ID NO: 5799414 - DNA, 18 bp, Homo sapiens
tgagcagggcttgctcct

SEQ ID NO: 5799415 - DNA, 23 bp, Homo sapiens
tgagcagggcttgctcctgccaa

SEQ ID NO: 5799416 - DNA, 15 bp, Homo sapiens
tgagcaggggaagca

SEQ ID NO: 5799417 - DNA, 12 bp, Homo sapiens
tgagcaggggca

SEQ ID NO: 5799418 - DNA, 15 bp, Homo sapiens
tgagcaggggcccct

SEQ ID NO: 5799419 - DNA, 20 bp, Homo sapiens
tgagcaggggcccctgggga

SEQ ID NO: 5799420 - DNA, 17 bp, Homo sapiens
tgagcagggtccacagc

SEQ ID NO: 5799421 - DNA, 18 bp, Homo sapiens
tgagcagggtccacagct

SEQ ID NO: 5799422 - DNA, 20 bp, Homo sapiens
tgagcagggtggggtctggg

SEQ ID NO: 5799423 - DNA, 22 bp, Homo sapiens
tgagcagggtggggtctgggag

SEQ ID NO: 5799424 - DNA, 15 bp, Homo sapiens
tgagcagtcacactg

SEQ ID NO: 5799425 - DNA, 16 bp, Homo sapiens
tgagcagtcacactgt

SEQ ID NO: 5799426 - DNA, 17 bp, Homo sapiens
tgagcagtcaggaaaga

SEQ ID NO: 5799427 - DNA, 20 bp, Homo sapiens
tgagcagtcaggaaagagaa

SEQ ID NO: 5799428 - DNA, 14 bp, Homo sapiens
tgagcagtccagag

SEQ ID NO: 5799429 - DNA, 20 bp, Homo sapiens
tgagcagtccttggcctgct

SEQ ID NO: 5799430 - DNA, 15 bp, Homo sapiens
tgagcagtcgcctgc

SEQ ID NO: 5799431 - DNA, 22 bp, Homo sapiens
tgagcagtcgcctgcctgcagc

SEQ ID NO: 5799432 - DNA, 21 bp, Homo sapiens
tgagcagtctacttctgtgtc

SEQ ID NO: 5799433 - DNA, 22 bp, Homo sapiens
tgagcagtctacttctgtgtct

SEQ ID NO: 5799434 - DNA, 17 bp, Homo sapiens
tgagcagtgagcactga

SEQ ID NO: 5799435 - DNA, 22 bp, Homo sapiens
tgagcagtgatattctttgtta

SEQ ID NO: 5799436 - DNA, 15 bp, Homo sapiens
tgagcagtgcctctt

SEQ ID NO: 5799437 - DNA, 18 bp, Homo sapiens
tgagcagtggctggtcca

SEQ ID NO: 5799438 - DNA, 15 bp, Homo sapiens
tgagcagtggggagc

SEQ ID NO: 5799439 - DNA, 18 bp, Homo sapiens
tgagcagtgtgtctcctg

SEQ ID NO: 5799440 - DNA, 16 bp, Homo sapiens
tgagcagtgttagctt

SEQ ID NO: 5799441 - DNA, 14 bp, Homo sapiens
tgagcataactcca

SEQ ID NO: 5799442 - DNA, 22 bp, Homo sapiens
tgagcatacatcttaaatcttt

SEQ ID NO: 5799443 - DNA, 17 bp, Homo sapiens
tgagcatagagaacaaa

SEQ ID NO: 5799444 - DNA, 17 bp, Homo sapiens
tgagcatatctggtata

SEQ ID NO: 5799445 - DNA, 17 bp, Homo sapiens
tgagcatcaatcttgtt

SEQ ID NO: 5799446 - DNA, 13 bp, Homo sapiens
tgagcatcacaga

SEQ ID NO: 5799447 - DNA, 16 bp, Homo sapiens
tgagcatcacagtttt

SEQ ID NO: 5799448 - DNA, 17 bp, Homo sapiens
tgagcatcacagttttg

SEQ ID NO: 5799449 - DNA, 22 bp, Homo sapiens
tgagcatcagagggctgatgga

SEQ ID NO: 5799450 - DNA, 22 bp, Homo sapiens
tgagcatcaggatactcaaagt

SEQ ID NO: 5799451 - DNA, 16 bp, Homo sapiens
tgagcatcaggccagg

SEQ ID NO: 5799452 - DNA, 18 bp, Homo sapiens
tgagcatcaggccaggcc

SEQ ID NO: 5799453 - DNA, 15 bp, Homo sapiens
tgagcatccagacct

SEQ ID NO: 5799454 - DNA, 14 bp, Homo sapiens
tgagcatcctgagc

SEQ ID NO: 5799455 - DNA, 18 bp, Homo sapiens
tgagcatcctgagccccg

SEQ ID NO: 5799456 - DNA, 19 bp, Homo sapiens
tgagcatcctgagccccgc

SEQ ID NO: 5799457 - DNA, 16 bp, Homo sapiens
tgagcatcctggcagg

SEQ ID NO: 5799458 - DNA, 23 bp, Homo sapiens
tgagcatcgcttaggagaagtct

SEQ ID NO: 5799459 - DNA, 18 bp, Homo sapiens
tgagcatctcaaatgttt

SEQ ID NO: 5799460 - DNA, 16 bp, Homo sapiens
tgagcatctgtccccc

SEQ ID NO: 5799461 - DNA, 18 bp, Homo sapiens
tgagcatctgtccccctt

SEQ ID NO: 5799462 - DNA, 16 bp, Homo sapiens
tgagcatctgtctcaa

SEQ ID NO: 5799463 - DNA, 15 bp, Homo sapiens
tgagcatcttgccag

SEQ ID NO: 5799464 - DNA, 21 bp, Homo sapiens
tgagcatgacagcctgcagca

SEQ ID NO: 5799465 - DNA, 14 bp, Homo sapiens
tgagcatgcacact

SEQ ID NO: 5799466 - DNA, 17 bp, Homo sapiens
tgagcatgcacagctgc

SEQ ID NO: 5799467 - DNA, 18 bp, Homo sapiens
tgagcatgcacagctgct

SEQ ID NO: 5799468 - DNA, 19 bp, Homo sapiens
tgagcatgcacagctgctt

SEQ ID NO: 5799469 - DNA, 20 bp, Homo sapiens
tgagcatgcacagctgcttg

SEQ ID NO: 5799470 - DNA, 21 bp, Homo sapiens
tgagcatgcccaaatataaca

SEQ ID NO: 5799471 - DNA, 22 bp, Homo sapiens
tgagcatgcccaaatataacat

SEQ ID NO: 5799472 - DNA, 23 bp, Homo sapiens
tgagcatgctccctcatgcagat

SEQ ID NO: 5799473 - DNA, 17 bp, Homo sapiens
tgagcatggagacagca

SEQ ID NO: 5799474 - DNA, 13 bp, Homo sapiens
tgagcatggagct

SEQ ID NO: 5799475 - DNA, 14 bp, Homo sapiens
tgagcatggagctg

SEQ ID NO: 5799476 - DNA, 17 bp, Homo sapiens
tgagcatggcagctggt

SEQ ID NO: 5799477 - DNA, 22 bp, Homo sapiens
tgagcatggccagactattccc

SEQ ID NO: 5799478 - DNA, 14 bp, Homo sapiens
tgagcatggggcca

SEQ ID NO: 5799479 - DNA, 18 bp, Homo sapiens
tgagcatgggtgtgccct

SEQ ID NO: 5799480 - DNA, 18 bp, Homo sapiens
tgagcatgtaaaagcgga

SEQ ID NO: 5799481 - DNA, 15 bp, Homo sapiens
tgagcatgttactga

SEQ ID NO: 5799482 - DNA, 23 bp, Homo sapiens
tgagcatgtttagactttaacat

SEQ ID NO: 5799483 - DNA, 18 bp, Homo sapiens
tgagcatgtttgcctaga

SEQ ID NO: 5799484 - DNA, 20 bp, Homo sapiens
tgagcattagaatggaggaa

SEQ ID NO: 5799485 - DNA, 22 bp, Homo sapiens
tgagcattagaatggaggaaat

SEQ ID NO: 5799486 - DNA, 11 bp, Homo sapiens
tgagcattcag

SEQ ID NO: 5799487 - DNA, 18 bp, Homo sapiens
tgagcattctgcagcccg

SEQ ID NO: 5799488 - DNA, 22 bp, Homo sapiens
tgagcatttagaacgagcctgg

SEQ ID NO: 5799489 - DNA, 23 bp, Homo sapiens
tgagcatttttttaaaagaagct

SEQ ID NO: 5799490 - DNA, 18 bp, Homo sapiens
tgagccaaacacactgta

SEQ ID NO: 5799491 - DNA, 21 bp, Homo sapiens
tgagccaaacacactgtaaat

SEQ ID NO: 5799492 - DNA, 12 bp, Homo sapiens
tgagccaaacca

SEQ ID NO: 5799493 - DNA, 13 bp, Homo sapiens
tgagccaaagcca

SEQ ID NO: 5799494 - DNA, 17 bp, Homo sapiens
tgagccaaattctaaag

SEQ ID NO: 5799495 - DNA, 20 bp, Homo sapiens
tgagccaaatttcttttgct

SEQ ID NO: 5799496 - DNA, 12 bp, Homo sapiens
tgagccaagacc

SEQ ID NO: 5799497 - DNA, 23 bp, Homo sapiens
tgagccaagatcgcaccactgca

SEQ ID NO: 5799498 - DNA, 17 bp, Homo sapiens
tgagccaaggaggcctg

SEQ ID NO: 5799499 - DNA, 18 bp, Homo sapiens
tgagccaaggaggcctgg

SEQ ID NO: 5799500 - DNA, 15 bp, Homo sapiens
tgagccaagggaggg

SEQ ID NO: 5799501 - DNA, 18 bp, Homo sapiens
tgagccaaggggtctgct

SEQ ID NO: 5799502 - DNA, 21 bp, Homo sapiens
tgagccaataaagctcacact

SEQ ID NO: 5799503 - DNA, 19 bp, Homo sapiens
tgagccacagaccacctgc

SEQ ID NO: 5799504 - DNA, 13 bp, Homo sapiens
tgagctggggccg

SEQ ID NO: 5799505 - DNA, 19 bp, Homo sapiens
tgagctggggcctggagag

SEQ ID NO: 5799506 - DNA, 22 bp, Homo sapiens
tgagctggggcctggagagggg

SEQ ID NO: 5799507 - DNA, 15 bp, Homo sapiens
tgagctgggtactga

SEQ ID NO: 5799508 - DNA, 15 bp, Homo sapiens
tgagctgtaaaaatg

SEQ ID NO: 5799509 - DNA, 19 bp, Homo sapiens
tgagctgtaaaaatgttac

SEQ ID NO: 5799510 - DNA, 22 bp, Homo sapiens
tgagctgtaatttcgccttaaa

SEQ ID NO: 5799511 - DNA, 16 bp, Homo sapiens
tgagctgtcaacgaga

SEQ ID NO: 5799512 - DNA, 16 bp, Homo sapiens
tgagctgtcccctgga

SEQ ID NO: 5799513 - DNA, 18 bp, Homo sapiens
tgagctgtcgctgcctcc

SEQ ID NO: 5799514 - DNA, 14 bp, Homo sapiens
tgagctgtctaaaa

SEQ ID NO: 5799515 - DNA, 22 bp, Homo sapiens
tgagctgtctgaagcccaaagc

SEQ ID NO: 5799516 - DNA, 21 bp, Homo sapiens
tgagctgtgactgctttgctg

SEQ ID NO: 5799517 - DNA, 20 bp, Homo sapiens
tgagctgtgcacaaagtggc

SEQ ID NO: 5799518 - DNA, 13 bp, Homo sapiens
tgagctgtgccag

SEQ ID NO: 5799519 - DNA, 15 bp, Homo sapiens
tgagctgtgccagct

SEQ ID NO: 5799520 - DNA, 17 bp, Homo sapiens
tgagctgtgccagctgc

SEQ ID NO: 5799521 - DNA, 24 bp, Homo sapiens
tgagctgtgccagctgcttctgcc

SEQ ID NO: 5799522 - DNA, 12 bp, Homo sapiens
tgagctgtgccc

SEQ ID NO: 5799523 - DNA, 16 bp, Homo sapiens
tgagctgtgcgctgct

SEQ ID NO: 5799524 - DNA, 12 bp, Homo sapiens
tgagctgtttcc

SEQ ID NO: 5799525 - DNA, 19 bp, Homo sapiens
tgagcttaaaatacaagac

SEQ ID NO: 5799526 - DNA, 22 bp, Homo sapiens
tgagcttaaaatacaagactgc

SEQ ID NO: 5799527 - DNA, 23 bp, Homo sapiens
tgagcttaagaattttgagcagg

SEQ ID NO: 5799528 - DNA, 23 bp, Homo sapiens
tgagcttacaattaggaactgag

SEQ ID NO: 5799529 - DNA, 13 bp, Homo sapiens
tgagcttacattg

SEQ ID NO: 5799530 - DNA, 18 bp, Homo sapiens
tgagcttacgtagttcta

SEQ ID NO: 5799531 - DNA, 14 bp, Homo sapiens
tgagcttcaatata

SEQ ID NO: 5799532 - DNA, 21 bp, Homo sapiens
tgagcttcggttctccagaat

SEQ ID NO: 5799533 - DNA, 23 bp, Homo sapiens
tgagcttcggttctccagaatgt

SEQ ID NO: 5799534 - DNA, 20 bp, Homo sapiens
tgagcttctcctctgctcca

SEQ ID NO: 5799535 - DNA, 13 bp, Homo sapiens
tgagcttctgaga

SEQ ID NO: 5799536 - DNA, 15 bp, Homo sapiens
tgagcttctgagaca

SEQ ID NO: 5799537 - DNA, 16 bp, Homo sapiens
tgagcttgagctcccc

SEQ ID NO: 5799538 - DNA, 17 bp, Homo sapiens
tgagcttgagctcccct

SEQ ID NO: 5799539 - DNA, 17 bp, Homo sapiens
tgagcttgctggagagt

SEQ ID NO: 5799540 - DNA, 18 bp, Homo sapiens
tgagcttgcttctttctt

SEQ ID NO: 5799541 - DNA, 18 bp, Homo sapiens
tgagcttgtcttttctgc

SEQ ID NO: 5799542 - DNA, 21 bp, Homo sapiens
tgagcttgtcttttctgctga

SEQ ID NO: 5799543 - DNA, 22 bp, Homo sapiens
tgagcttgtcttttctgctgag

SEQ ID NO: 5799544 - DNA, 22 bp, Homo sapiens
tgagctttatgtaataatgtga

SEQ ID NO: 5799545 - DNA, 20 bp, Homo sapiens
tgagctttccagttagggct

SEQ ID NO: 5799546 - DNA, 18 bp, Homo sapiens
tgagctttccatgttgct

SEQ ID NO: 5799547 - DNA, 21 bp, Homo sapiens
tgagctttccatgttgctgcc

SEQ ID NO: 5799548 - DNA, 22 bp, Homo sapiens
tgagctttccatgttgctgcca

SEQ ID NO: 5799549 - DNA, 21 bp, Homo sapiens
tgagctttccgcgtcagcaag

SEQ ID NO: 5799550 - DNA, 10 bp, Homo sapiens
tgagctttct

SEQ ID NO: 5799551 - DNA, 17 bp, Homo sapiens
tgagctttctgtgcatg

SEQ ID NO: 5799552 - DNA, 20 bp, Homo sapiens
tgagctttctgtgcatgtgc

SEQ ID NO: 5799553 - DNA, 14 bp, Homo sapiens
tgagctttctttgc

SEQ ID NO: 5799554 - DNA, 20 bp, Homo sapiens
tgagctttgaagtaggtggc

SEQ ID NO: 5799555 - DNA, 14 bp, Homo sapiens
tgagctttgctgct

SEQ ID NO: 5799556 - DNA, 17 bp, Homo sapiens
tgagctttgctgctaca

SEQ ID NO: 5799557 - DNA, 19 bp, Homo sapiens
tgagctttggacgcacaca

SEQ ID NO: 5799558 - DNA, 21 bp, Homo sapiens
tgagctttggggacagttggc

SEQ ID NO: 5799559 - DNA, 23 bp, Homo sapiens
tgagcttttaaataaaattgaaa

SEQ ID NO: 5799560 - DNA, 16 bp, Homo sapiens
tgagcttttaccacta

SEQ ID NO: 5799561 - DNA, 17 bp, Homo sapiens
tgagcttttaccactag

SEQ ID NO: 5799562 - DNA, 18 bp, Homo sapiens
tgagcttttcatggaagt

SEQ ID NO: 5799563 - DNA, 12 bp, Homo sapiens
tgaggaaaaaaa

SEQ ID NO: 5799564 - DNA, 23 bp, Homo sapiens
tgaggaaaaaaatcgtccaggga

SEQ ID NO: 5799565 - DNA, 20 bp, Homo sapiens
tgaggaaaaaatggtataaa

SEQ ID NO: 5799566 - DNA, 15 bp, Homo sapiens
tgaggaaaaatatgt

SEQ ID NO: 5799567 - DNA, 19 bp, Homo sapiens
tgaggaaaaatatgtgaag

SEQ ID NO: 5799568 - DNA, 16 bp, Homo sapiens
tgaggaaaagactgtg

SEQ ID NO: 5799569 - DNA, 19 bp, Homo sapiens
tgaggaaaagactgtgggt

SEQ ID NO: 5799570 - DNA, 15 bp, Homo sapiens
tgaggaaacaggcct

SEQ ID NO: 5799571 - DNA, 17 bp, Homo sapiens
tgaggaaactcatacag

SEQ ID NO: 5799572 - DNA, 20 bp, Homo sapiens
tgaggaaactgagtcactca

SEQ ID NO: 5799573 - DNA, 21 bp, Homo sapiens
tgaggaaactgagtcactcac

SEQ ID NO: 5799574 - DNA, 22 bp, Homo sapiens
tgaggaaacttcggttgcagat

SEQ ID NO: 5799575 - DNA, 14 bp, Homo sapiens
tgaggaaagcacac

SEQ ID NO: 5799576 - DNA, 19 bp, Homo sapiens
tgaggaaagcatgtattca

SEQ ID NO: 5799577 - DNA, 22 bp, Homo sapiens
tgaggaaagtcattggctttat

SEQ ID NO: 5799578 - DNA, 23 bp, Homo sapiens
tgaggaaagtgcgttctcccagc

SEQ ID NO: 5799579 - DNA, 12 bp, Homo sapiens
tgaggaaatatt

SEQ ID NO: 5799580 - DNA, 16 bp, Homo sapiens
tgaggaaatattaatt

SEQ ID NO: 5799581 - DNA, 21 bp, Homo sapiens
tgaggaaatccattgtttaaa

SEQ ID NO: 5799582 - DNA, 19 bp, Homo sapiens
tgaggaactcacatactga

SEQ ID NO: 5799583 - DNA, 19 bp, Homo sapiens
tgaggaactgtagatgatg

SEQ ID NO: 5799584 - DNA, 24 bp, Homo sapiens
tgaggaagaagggataatagacac

SEQ ID NO: 5799585 - DNA, 17 bp, Homo sapiens
tgaggaagagggactgt

SEQ ID NO: 5799586 - DNA, 23 bp, Homo sapiens
tgaggaagatgggggcaagaaga

SEQ ID NO: 5799587 - DNA, 16 bp, Homo sapiens
tgaggaagcagttggg

SEQ ID NO: 5799588 - DNA, 21 bp, Homo sapiens
tgaggaagccgctggggccag

SEQ ID NO: 5799589 - DNA, 18 bp, Homo sapiens
tgaggaagcctaaataaa

SEQ ID NO: 5799590 - DNA, 20 bp, Homo sapiens
tgaggaagctccagtcctgc

SEQ ID NO: 5799591 - DNA, 23 bp, Homo sapiens
tgaggaagctccagtcctgctct

SEQ ID NO: 5799592 - DNA, 23 bp, Homo sapiens
tgaggaaggaggggaagctgcag

SEQ ID NO: 5799593 - DNA, 18 bp, Homo sapiens
tgaggaagttttgtctaa

SEQ ID NO: 5799594 - DNA, 23 bp, Homo sapiens
tgaggaataaagcttctctctga

SEQ ID NO: 5799595 - DNA, 17 bp, Homo sapiens
tgaggaataaatgcctt

SEQ ID NO: 5799596 - DNA, 22 bp, Homo sapiens
tgaggaataaatgcctttatat

SEQ ID NO: 5799597 - DNA, 19 bp, Homo sapiens
tgaggaatatgactgtttt

SEQ ID NO: 5799598 - DNA, 18 bp, Homo sapiens
tgaggaatccaaaagaca

SEQ ID NO: 5799599 - DNA, 21 bp, Homo sapiens
tgaggaatgcggttcagggct

SEQ ID NO: 5799600 - DNA, 18 bp, Homo sapiens
tgaggaatgctctgtgcc

SEQ ID NO: 5799601 - DNA, 19 bp, Homo sapiens
tgaggaattatcatgggaa

SEQ ID NO: 5799602 - DNA, 17 bp, Homo sapiens
tgaggaattcagaagtg

SEQ ID NO: 5799603 - DNA, 14 bp, Homo sapiens
tgaggaattctgta

SEQ ID NO: 5799604 - DNA, 15 bp, Homo sapiens
tgaggaattctgtat

SEQ ID NO: 5799605 - DNA, 18 bp, Homo sapiens
tgaggaattctgtataga

SEQ ID NO: 5799606 - DNA, 19 bp, Homo sapiens
tgaggaattctgtatagat

SEQ ID NO: 5799607 - DNA, 15 bp, Homo sapiens
tgaggaatttcacct

SEQ ID NO: 5799608 - DNA, 22 bp, Homo sapiens
tgaggaatttcacctgtaaacc

SEQ ID NO: 5799609 - DNA, 19 bp, Homo sapiens
tgaggacaaccattccaga

SEQ ID NO: 5799610 - DNA, 13 bp, Homo sapiens
tgaggacaagtta

SEQ ID NO: 5799611 - DNA, 16 bp, Homo sapiens
tgaggacacattgccc

SEQ ID NO: 5799612 - DNA, 21 bp, Homo sapiens
tgaggacaccagtgaaagaag

SEQ ID NO: 5799613 - DNA, 22 bp, Homo sapiens
tgaggacaccagtgaaagaagc

SEQ ID NO: 5799614 - DNA, 19 bp, Homo sapiens
tgaggacagaaagaccctg

SEQ ID NO: 5799615 - DNA, 17 bp, Homo sapiens
tgaggacagaaggactg

SEQ ID NO: 5799616 - DNA, 14 bp, Homo sapiens
tgaggacagagggc

SEQ ID NO: 5799617 - DNA, 20 bp, Homo sapiens
tgaggacagatgcctccttc

SEQ ID NO: 5799618 - DNA, 18 bp, Homo sapiens
tgaggacagctgtcctct

SEQ ID NO: 5799619 - DNA, 18 bp, Homo sapiens
tgaggacatggagagaga

SEQ ID NO: 5799620 - DNA, 12 bp, Homo sapiens
tgaggaccaggg

SEQ ID NO: 5799621 - DNA, 18 bp, Homo sapiens
tgaggaccatgaaacatt

SEQ ID NO: 5799622 - DNA, 15 bp, Homo sapiens
tgaggacccagagct

SEQ ID NO: 5799623 - DNA, 16 bp, Homo sapiens
tgaggacccagagctg

SEQ ID NO: 5799624 - DNA, 15 bp, Homo sapiens
tgaggaccctcagcc

SEQ ID NO: 5799625 - DNA, 17 bp, Homo sapiens
tgaggaccctcagcccc

SEQ ID NO: 5799626 - DNA, 17 bp, Homo sapiens
tgaggaccctcccaggt

SEQ ID NO: 5799627 - DNA, 18 bp, Homo sapiens
tgaggaccgctgataagc

SEQ ID NO: 5799628 - DNA, 22 bp, Homo sapiens
tgaggaccgctgataagcattg

SEQ ID NO: 5799629 - DNA, 16 bp, Homo sapiens
tgaggacctccacctg

SEQ ID NO: 5799630 - DNA, 20 bp, Homo sapiens
tgaggacctccacctgggag

SEQ ID NO: 5799631 - DNA, 22 bp, Homo sapiens
tgaggacctccacctgggagat

SEQ ID NO: 5799632 - DNA, 15 bp, Homo sapiens
tgaggacctttctga

SEQ ID NO: 5799633 - DNA, 19 bp, Homo sapiens
tgaggacggggcagagctg

SEQ ID NO: 5799634 - DNA, 20 bp, Homo sapiens
tgaggacggggcagagctga

SEQ ID NO: 5799635 - DNA, 16 bp, Homo sapiens
tgaggactatggaaat

SEQ ID NO: 5799636 - DNA, 18 bp, Homo sapiens
tgaggactcggccactgt

SEQ ID NO: 5799637 - DNA, 19 bp, Homo sapiens
tgaggactcggccactgtg

SEQ ID NO: 5799638 - DNA, 20 bp, Homo sapiens
tgaggactcggccactgtgt

SEQ ID NO: 5799639 - DNA, 23 bp, Homo sapiens
tgaggactcggccactgtgtctc

SEQ ID NO: 5799640 - DNA, 24 bp, Homo sapiens
tgaggactctgcaagtgtctggag

SEQ ID NO: 5799641 - DNA, 22 bp, Homo sapiens
tgaggactctttccgactgccc

SEQ ID NO: 5799642 - DNA, 15 bp, Homo sapiens
tgaggactgaagctg

SEQ ID NO: 5799643 - DNA, 18 bp, Homo sapiens
tgaggactgaagctgggg

SEQ ID NO: 5799644 - DNA, 21 bp, Homo sapiens
tgaggactgaagctggggctt

SEQ ID NO: 5799645 - DNA, 13 bp, Homo sapiens
tgaggactgtcct

SEQ ID NO: 5799646 - DNA, 22 bp, Homo sapiens
tgaggacttgggcgggacacag

SEQ ID NO: 5799647 - DNA, 21 bp, Homo sapiens
tgaggactttgcccaggatga

SEQ ID NO: 5799648 - DNA, 18 bp, Homo sapiens
tgaggagaaatttgataa

SEQ ID NO: 5799649 - DNA, 15 bp, Homo sapiens
tgaggagaagtgggg

SEQ ID NO: 5799650 - DNA, 15 bp, Homo sapiens
tgaggagacacacct

SEQ ID NO: 5799651 - DNA, 14 bp, Homo sapiens
tgaggagacatcta

SEQ ID NO: 5799652 - DNA, 21 bp, Homo sapiens
tgaggagagaaaatatatgta

SEQ ID NO: 5799653 - DNA, 14 bp, Homo sapiens
tgaggagagaagga

SEQ ID NO: 5799654 - DNA, 12 bp, Homo sapiens
tgaggagagagg

SEQ ID NO: 5799655 - DNA, 18 bp, Homo sapiens
tgaggagagaggaggaaa

SEQ ID NO: 5799656 - DNA, 16 bp, Homo sapiens
tgaggagatgaccagg

SEQ ID NO: 5799657 - DNA, 18 bp, Homo sapiens
tgaggagattctgccttt

SEQ ID NO: 5799658 - DNA, 16 bp, Homo sapiens
tgaggagcagcttcag

SEQ ID NO: 5799659 - DNA, 15 bp, Homo sapiens
tgaggagccaggccg

SEQ ID NO: 5799660 - DNA, 22 bp, Homo sapiens
tgaggagcccatactcagcctg

SEQ ID NO: 5799661 - DNA, 12 bp, Homo sapiens
tgaggagcctct

SEQ ID NO: 5799662 - DNA, 13 bp, Homo sapiens
tgaggagcctctg

SEQ ID NO: 5799663 - DNA, 18 bp, Homo sapiens
tgaggagcctctgatcaa

SEQ ID NO: 5799664 - DNA, 21 bp, Homo sapiens
tgaggagcggactcacttgat

SEQ ID NO: 5799665 - DNA, 20 bp, Homo sapiens
tgaggagctcaacggtctgg

SEQ ID NO: 5799666 - DNA, 23 bp, Homo sapiens
tgaggagctcaacggtctggcag

SEQ ID NO: 5799667 - DNA, 13 bp, Homo sapiens
tgaggagctcagg

SEQ ID NO: 5799668 - DNA, 20 bp, Homo sapiens
tgaggagctcagggctggat

SEQ ID NO: 5799669 - DNA, 11 bp, Homo sapiens
tgaggagctgc

SEQ ID NO: 5799670 - DNA, 12 bp, Homo sapiens
tgaggagctgca

SEQ ID NO: 5799671 - DNA, 14 bp, Homo sapiens
tgaggagctgcact

SEQ ID NO: 5799672 - DNA, 17 bp, Homo sapiens
tgaggagctgctggctt

SEQ ID NO: 5799673 - DNA, 20 bp, Homo sapiens
tgaggagctggggatccctc

SEQ ID NO: 5799674 - DNA, 12 bp, Homo sapiens
tgaggaggaaaa

SEQ ID NO: 5799675 - DNA, 17 bp, Homo sapiens
tgaggaggagctggcct

SEQ ID NO: 5799676 - DNA, 16 bp, Homo sapiens
tgaggaggaggacaca

SEQ ID NO: 5799677 - DNA, 17 bp, Homo sapiens
tgaggaggaggacacag

SEQ ID NO: 5799678 - DNA, 22 bp, Homo sapiens
tgaggaggaggacacagcacaa

SEQ ID NO: 5799679 - DNA, 14 bp, Homo sapiens
tgagtaaattggaa

SEQ ID NO: 5799680 - DNA, 15 bp, Homo sapiens
tgagtaacatttgct

SEQ ID NO: 5799681 - DNA, 19 bp, Homo sapiens
tgagtaactggttgctgtg

SEQ ID NO: 5799682 - DNA, 14 bp, Homo sapiens
tgagtaacttagaa

SEQ ID NO: 5799683 - DNA, 17 bp, Homo sapiens
tgagtaagaaatgctgc

SEQ ID NO: 5799684 - DNA, 14 bp, Homo sapiens
tgagtaagaacatc

SEQ ID NO: 5799685 - DNA, 18 bp, Homo sapiens
tgagtaagagctggtgtc

SEQ ID NO: 5799686 - DNA, 21 bp, Homo sapiens
tgagtaagagctggtgtctga

SEQ ID NO: 5799687 - DNA, 16 bp, Homo sapiens
tgagtaagtgtgttca

SEQ ID NO: 5799688 - DNA, 16 bp, Homo sapiens
tgagtaatattacatt

SEQ ID NO: 5799689 - DNA, 22 bp, Homo sapiens
tgagtaatcaatacagacaagg

SEQ ID NO: 5799690 - DNA, 18 bp, Homo sapiens
tgagtaatgggatttgaa

SEQ ID NO: 5799691 - DNA, 18 bp, Homo sapiens
tgagtaatggtgtagaac

SEQ ID NO: 5799692 - DNA, 14 bp, Homo sapiens
tgagtaatgtttaa

SEQ ID NO: 5799693 - DNA, 22 bp, Homo sapiens
tgagtaattcaagcctctaaac

SEQ ID NO: 5799694 - DNA, 21 bp, Homo sapiens
tgagtaattctagctttcaaa

SEQ ID NO: 5799695 - DNA, 16 bp, Homo sapiens
tgagtaattgaggaaa

SEQ ID NO: 5799696 - DNA, 19 bp, Homo sapiens
tgagtacagtgaggagggt

SEQ ID NO: 5799697 - DNA, 14 bp, Homo sapiens
tgagtacattgtgc

SEQ ID NO: 5799698 - DNA, 14 bp, Homo sapiens
tgagtaccaggggc

SEQ ID NO: 5799699 - DNA, 14 bp, Homo sapiens
tgagtacctgcaaa

SEQ ID NO: 5799700 - DNA, 16 bp, Homo sapiens
tgagtacctgcaaaaa

SEQ ID NO: 5799701 - DNA, 23 bp, Homo sapiens
tgagtacgtgctttgagaaaaca

SEQ ID NO: 5799702 - DNA, 21 bp, Homo sapiens
tgagtactccacactgcacaa

SEQ ID NO: 5799703 - DNA, 19 bp, Homo sapiens
tgagtactctttctctccc

SEQ ID NO: 5799704 - DNA, 19 bp, Homo sapiens
tgagtactggaataaacag

SEQ ID NO: 5799705 - DNA, 20 bp, Homo sapiens
tgagtactggaataaacagt

SEQ ID NO: 5799706 - DNA, 13 bp, Homo sapiens
tgagtactgttaa

SEQ ID NO: 5799707 - DNA, 14 bp, Homo sapiens
tgagtactgttaag

SEQ ID NO: 5799708 - DNA, 20 bp, Homo sapiens
tgagtagagagcaagggaag

SEQ ID NO: 5799709 - DNA, 15 bp, Homo sapiens
tgagtagatattact

SEQ ID NO: 5799710 - DNA, 21 bp, Homo sapiens
tgagtagatccatttccattg

SEQ ID NO: 5799711 - DNA, 15 bp, Homo sapiens
tgagtagatctgctt

SEQ ID NO: 5799712 - DNA, 12 bp, Homo sapiens
tgagtagcatat

SEQ ID NO: 5799713 - DNA, 15 bp, Homo sapiens
tgagtagcatatata

SEQ ID NO: 5799714 - DNA, 14 bp, Homo sapiens
tgagtagctctgcc

SEQ ID NO: 5799715 - DNA, 19 bp, Homo sapiens
tgagtagctgggattacag

SEQ ID NO: 5799716 - DNA, 15 bp, Homo sapiens
tgagtagctgggcct

SEQ ID NO: 5799717 - DNA, 17 bp, Homo sapiens
tgagtagctgggcctgt

SEQ ID NO: 5799718 - DNA, 19 bp, Homo sapiens
tgagtagcttatacaatta

SEQ ID NO: 5799719 - DNA, 21 bp, Homo sapiens
tgagtagctttcatttactga

SEQ ID NO: 5799720 - DNA, 23 bp, Homo sapiens
tgagtaggcggcgatttttgtat

SEQ ID NO: 5799721 - DNA, 13 bp, Homo sapiens
tgagtaggctggg

SEQ ID NO: 5799722 - DNA, 15 bp, Homo sapiens
tgagtaggctgggcc

SEQ ID NO: 5799723 - DNA, 19 bp, Homo sapiens
tgagtaggtctgggatgga

SEQ ID NO: 5799724 - DNA, 21 bp, Homo sapiens
tgagtagtggccactggggtg

SEQ ID NO: 5799725 - DNA, 19 bp, Homo sapiens
tgagtagttgttggtctgt

SEQ ID NO: 5799726 - DNA, 22 bp, Homo sapiens
tgagtataatacattacatgta

SEQ ID NO: 5799727 - DNA, 16 bp, Homo sapiens
tgagtatattataata

SEQ ID NO: 5799728 - DNA, 13 bp, Homo sapiens
tgagtatcataat

SEQ ID NO: 5799729 - DNA, 14 bp, Homo sapiens
tgagtatcataata

SEQ ID NO: 5799730 - DNA, 15 bp, Homo sapiens
tgagtatctcctcgc

SEQ ID NO: 5799731 - DNA, 21 bp, Homo sapiens
tgagtatctcctcgcaagctg

SEQ ID NO: 5799732 - DNA, 16 bp, Homo sapiens
tgagtatctgtgggag

SEQ ID NO: 5799733 - DNA, 15 bp, Homo sapiens
tgagtatgaacttga

SEQ ID NO: 5799734 - DNA, 22 bp, Homo sapiens
tgagtatgccactgcactccag

SEQ ID NO: 5799735 - DNA, 18 bp, Homo sapiens
tgagtatgcttgggccct

SEQ ID NO: 5799736 - DNA, 23 bp, Homo sapiens
tgagtatggagcagcctggagac

SEQ ID NO: 5799737 - DNA, 17 bp, Homo sapiens
tgagtatgtggaaggca

SEQ ID NO: 5799738 - DNA, 22 bp, Homo sapiens
tgagtattcattttgcaacttg

SEQ ID NO: 5799739 - DNA, 20 bp, Homo sapiens
tgagtattccatgagctgct

SEQ ID NO: 5799740 - DNA, 20 bp, Homo sapiens
tgagtattctatgtaaaaat

SEQ ID NO: 5799741 - DNA, 13 bp, Homo sapiens
tgagtattggaag

SEQ ID NO: 5799742 - DNA, 17 bp, Homo sapiens
tgagtatttctgttcct

SEQ ID NO: 5799743 - DNA, 18 bp, Homo sapiens
tgagtatttctgttcctt

SEQ ID NO: 5799744 - DNA, 13 bp, Homo sapiens
tgagtatttgctg

SEQ ID NO: 5799745 - DNA, 14 bp, Homo sapiens
tgagtatttgctgt

SEQ ID NO: 5799746 - DNA, 14 bp, Homo sapiens
tgagtatttggtaa

SEQ ID NO: 5799747 - DNA, 13 bp, Homo sapiens
tgagtcaaatcca

SEQ ID NO: 5799748 - DNA, 17 bp, Homo sapiens
tgagtcaaatccagtgg

SEQ ID NO: 5799749 - DNA, 19 bp, Homo sapiens
tgagtcaaatccagtggtg

SEQ ID NO: 5799750 - DNA, 22 bp, Homo sapiens
tgagtcaaatccagtggtgggt

SEQ ID NO: 5799751 - DNA, 15 bp, Homo sapiens
tgagtcaactggagc

SEQ ID NO: 5799752 - DNA, 16 bp, Homo sapiens
tgagtcaactggagca

SEQ ID NO: 5799753 - DNA, 16 bp, Homo sapiens
tgagtcaatcagcctt

SEQ ID NO: 5799754 - DNA, 13 bp, Homo sapiens
tgagtcaatgtgc

SEQ ID NO: 5799755 - DNA, 13 bp, Homo sapiens
tgagtcacaaaat

SEQ ID NO: 5799756 - DNA, 16 bp, Homo sapiens
tgagtcacaaaataaa

SEQ ID NO: 5799757 - DNA, 23 bp, Homo sapiens
tgagtcacaaagaacatgtagaa

SEQ ID NO: 5799758 - DNA, 23 bp, Homo sapiens
tgagtcacactcagaaaatgggg

SEQ ID NO: 5799759 - DNA, 13 bp, Homo sapiens
tgagtcaccagga

SEQ ID NO: 5799760 - DNA, 21 bp, Homo sapiens
tgagtcacccctctgtccagc

SEQ ID NO: 5799761 - DNA, 14 bp, Homo sapiens
tgagtcacctcctc

SEQ ID NO: 5799762 - DNA, 21 bp, Homo sapiens
tgagtcacgctggggctctct

SEQ ID NO: 5799763 - DNA, 16 bp, Homo sapiens
tgagtcactgagcatc

SEQ ID NO: 5799764 - DNA, 22 bp, Homo sapiens
tgagtcagacacgattgagaac

SEQ ID NO: 5799765 - DNA, 23 bp, Homo sapiens
tgagtcagaggcagaacctagtc

SEQ ID NO: 5799766 - DNA, 20 bp, Homo sapiens
tgagtcagcaccttggccca

SEQ ID NO: 5799767 - DNA, 21 bp, Homo sapiens
tgagtcagcaccttggcccag

SEQ ID NO: 5799768 - DNA, 23 bp, Homo sapiens
tgagtcaggagcttattacagaa

SEQ ID NO: 5799769 - DNA, 22 bp, Homo sapiens
tgagtcaggcaattgattgtga

SEQ ID NO: 5799770 - DNA, 21 bp, Homo sapiens
tgagtcagtcagcgagtgctt

SEQ ID NO: 5799771 - DNA, 16 bp, Homo sapiens
tgagtcagtgatgagg

SEQ ID NO: 5799772 - DNA, 13 bp, Homo sapiens
tgagtcagtgctc

SEQ ID NO: 5799773 - DNA, 18 bp, Homo sapiens
tgagtcatcaaaaagagt

SEQ ID NO: 5799774 - DNA, 15 bp, Homo sapiens
tgagtcatctgttag

SEQ ID NO: 5799775 - DNA, 21 bp, Homo sapiens
tgagtcatgatctccctgccg

SEQ ID NO: 5799776 - DNA, 15 bp, Homo sapiens
tgagtcattgacttc

SEQ ID NO: 5799777 - DNA, 17 bp, Homo sapiens
tgagtcattgacttcat

SEQ ID NO: 5799778 - DNA, 23 bp, Homo sapiens
tgagtcattgtcagaatccacta

SEQ ID NO: 5799779 - DNA, 13 bp, Homo sapiens
tgagtccagaagt

SEQ ID NO: 5799780 - DNA, 12 bp, Homo sapiens
tgagtccagagc

SEQ ID NO: 5799781 - DNA, 19 bp, Homo sapiens
tgagtccagagcttgtgct

SEQ ID NO: 5799782 - DNA, 14 bp, Homo sapiens
tgagtccagctccc

SEQ ID NO: 5799783 - DNA, 20 bp, Homo sapiens
tgagtccagctttccttctg

SEQ ID NO: 5799784 - DNA, 21 bp, Homo sapiens
tgagtccagctttccttctgc

SEQ ID NO: 5799785 - DNA, 22 bp, Homo sapiens
tgagtccagctttccttctgcc

SEQ ID NO: 5799786 - DNA, 13 bp, Homo sapiens
tgagtccagtgtg

SEQ ID NO: 5799787 - DNA, 14 bp, Homo sapiens
tgagtccatgtcct

SEQ ID NO: 5799788 - DNA, 21 bp, Homo sapiens
tgagtccatgtcctatgcctc

SEQ ID NO: 5799789 - DNA, 17 bp, Homo sapiens
tgagtccattctcccag

SEQ ID NO: 5799790 - DNA, 23 bp, Homo sapiens
tgagtcccagagcccgcttttgt

SEQ ID NO: 5799791 - DNA, 21 bp, Homo sapiens
tgagtcccaggagctgcccag

SEQ ID NO: 5799792 - DNA, 20 bp, Homo sapiens
tgagtcccaggctgagcctc

SEQ ID NO: 5799793 - DNA, 13 bp, Homo sapiens
tgagtcccagtgg

SEQ ID NO: 5799794 - DNA, 22 bp, Homo sapiens
tgagtccccattgaggcttggt

SEQ ID NO: 5799795 - DNA, 19 bp, Homo sapiens
tgagtcccctgtttgtttc

SEQ ID NO: 5799796 - DNA, 20 bp, Homo sapiens
tgagtcccctgtttgtttct

SEQ ID NO: 5799797 - DNA, 21 bp, Homo sapiens
tgagtcccctgtttgtttctg

SEQ ID NO: 5799798 - DNA, 14 bp, Homo sapiens
tgagtcccttccag

SEQ ID NO: 5799799 - DNA, 16 bp, Homo sapiens
tgagtcccttccaggc

SEQ ID NO: 5799800 - DNA, 21 bp, Homo sapiens
tgagtcccttccaggccatca

SEQ ID NO: 5799801 - DNA, 18 bp, Homo sapiens
tgagtcccttccagtcat

SEQ ID NO: 5799802 - DNA, 15 bp, Homo sapiens
tgagtccgcctgcgc

SEQ ID NO: 5799803 - DNA, 20 bp, Homo sapiens
tgagtcctcattgttcagaa

SEQ ID NO: 5799804 - DNA, 23 bp, Homo sapiens
tgagtcctccagaactcttcctc

SEQ ID NO: 5799805 - DNA, 15 bp, Homo sapiens
tgagtcctcctcttc

SEQ ID NO: 5799806 - DNA, 17 bp, Homo sapiens
tgagtcctggatgatac

SEQ ID NO: 5799807 - DNA, 21 bp, Homo sapiens
tgagtcctggatgatactaat

SEQ ID NO: 5799808 - DNA, 18 bp, Homo sapiens
tgagtcctggcatgggaa

SEQ ID NO: 5799809 - DNA, 20 bp, Homo sapiens
tgagtcctggtccctctgag

SEQ ID NO: 5799810 - DNA, 23 bp, Homo sapiens
tgagtcctggtccctctgaggca

SEQ ID NO: 5799811 - DNA, 19 bp, Homo sapiens
tgagtcctggtttcctggc

SEQ ID NO: 5799812 - DNA, 14 bp, Homo sapiens
tgagtcctgtctct

SEQ ID NO: 5799813 - DNA, 16 bp, Homo sapiens
tgagtcctgtctctgc

SEQ ID NO: 5799814 - DNA, 12 bp, Homo sapiens
tgagtcctgtta

SEQ ID NO: 5799815 - DNA, 23 bp, Homo sapiens
tgagtcctgttgaagacttcctc

SEQ ID NO: 5799816 - DNA, 18 bp, Homo sapiens
tgagtccttaaacagggc

SEQ ID NO: 5799817 - DNA, 15 bp, Homo sapiens
tgagtccttgaaaat

SEQ ID NO: 5799818 - DNA, 16 bp, Homo sapiens
tgagtccttgaaaata

SEQ ID NO: 5799819 - DNA, 13 bp, Homo sapiens
tgagtcctttcca

SEQ ID NO: 5799820 - DNA, 20 bp, Homo sapiens
tgagtcgagattgcactgct

SEQ ID NO: 5799821 - DNA, 15 bp, Homo sapiens
tgagtcgaggacagg

SEQ ID NO: 5799822 - DNA, 16 bp, Homo sapiens
tgagtcgaggacaggg

SEQ ID NO: 5799823 - DNA, 22 bp, Homo sapiens
tgagtcgattaacctgcatgca

SEQ ID NO: 5799824 - DNA, 14 bp, Homo sapiens
tgagtcggctgggc

SEQ ID NO: 5799825 - DNA, 21 bp, Homo sapiens
tgagtcggctgggcagggccg

SEQ ID NO: 5799826 - DNA, 17 bp, Homo sapiens
tgagtcgtacagaaagc

SEQ ID NO: 5799827 - DNA, 18 bp, Homo sapiens
tgagtcgtcatcactttt

SEQ ID NO: 5799828 - DNA, 17 bp, Homo sapiens
tgagtcgtgacctgcta

SEQ ID NO: 5799829 - DNA, 20 bp, Homo sapiens
tgagtctacctgagcattca

SEQ ID NO: 5799830 - DNA, 19 bp, Homo sapiens
tgagtctagatacagaagc

SEQ ID NO: 5799831 - DNA, 22 bp, Homo sapiens
tgagtctatattatctagcttt

SEQ ID NO: 5799832 - DNA, 16 bp, Homo sapiens
tgagtctatcctagtc

SEQ ID NO: 5799833 - DNA, 14 bp, Homo sapiens
tgagtctatgttca

SEQ ID NO: 5799834 - DNA, 15 bp, Homo sapiens
tgagtctatgttcaa

SEQ ID NO: 5799835 - DNA, 18 bp, Homo sapiens
tgagtctatgttcaaaga

SEQ ID NO: 5799836 - DNA, 16 bp, Homo sapiens
tgagtctcaagggtgg

SEQ ID NO: 5799837 - DNA, 17 bp, Homo sapiens
tgagtctcaagggtggc

SEQ ID NO: 5799838 - DNA, 20 bp, Homo sapiens
tgagtctcaagggtggcagg

SEQ ID NO: 5799839 - DNA, 16 bp, Homo sapiens
tgagtctcccaaggct

SEQ ID NO: 5799840 - DNA, 15 bp, Homo sapiens
tgagtctcctctctg

SEQ ID NO: 5799841 - DNA, 16 bp, Homo sapiens
tgagtctcctctctga

SEQ ID NO: 5799842 - DNA, 17 bp, Homo sapiens
tgagtctcctctctgag

SEQ ID NO: 5799843 - DNA, 12 bp, Homo sapiens
tgagtctctgaa

SEQ ID NO: 5799844 - DNA, 21 bp, Homo sapiens
tgagtctctgaatgaagctga

SEQ ID NO: 5799845 - DNA, 20 bp, Homo sapiens
tgagtctgaaccaatagaaa

SEQ ID NO: 5799846 - DNA, 18 bp, Homo sapiens
tgagtctgaaggctgggt

SEQ ID NO: 5799847 - DNA, 21 bp, Homo sapiens
tgagtctgagtcctgtctctg

SEQ ID NO: 5799848 - DNA, 17 bp, Homo sapiens
tgagtctgcataaactt

SEQ ID NO: 5799849 - DNA, 13 bp, Homo sapiens
tgagtctggactt

SEQ ID NO: 5799850 - DNA, 14 bp, Homo sapiens
tgagtctggcaaac

SEQ ID NO: 5799851 - DNA, 21 bp, Homo sapiens
tgagtctggcaaacatgtgca

SEQ ID NO: 5799852 - DNA, 23 bp, Homo sapiens
tgagtctgggcaatgaaaccaaa

SEQ ID NO: 5799853 - DNA, 13 bp, Homo sapiens
tgagtctgtaatt

SEQ ID NO: 5799854 - DNA, 21 bp, Homo sapiens
tgagtctgtccagataagtta

SEQ ID NO: 5799855 - DNA, 21 bp, Homo sapiens
tgagtctgtgaataaagccac

SEQ ID NO: 5799856 - DNA, 14 bp, Homo sapiens
tgataatgttcatt

SEQ ID NO: 5799857 - DNA, 19 bp, Homo sapiens
tgataatgttcattttgaa

SEQ ID NO: 5799858 - DNA, 16 bp, Homo sapiens
tgataattacaataca

SEQ ID NO: 5799859 - DNA, 19 bp, Homo sapiens
tgataattatttacaaaat

SEQ ID NO: 5799860 - DNA, 17 bp, Homo sapiens
tgataattccagtggtc

SEQ ID NO: 5799861 - DNA, 19 bp, Homo sapiens
tgataattgcattcatctt

SEQ ID NO: 5799862 - DNA, 20 bp, Homo sapiens
tgataattgtgctttacaac

SEQ ID NO: 5799863 - DNA, 20 bp, Homo sapiens
tgataattgtgtagtaatgt

SEQ ID NO: 5799864 - DNA, 15 bp, Homo sapiens
tgataattgtgtatt

SEQ ID NO: 5799865 - DNA, 15 bp, Homo sapiens
tgataattttacaat

SEQ ID NO: 5799866 - DNA, 21 bp, Homo sapiens
tgataattttcctttaatatg

SEQ ID NO: 5799867 - DNA, 19 bp, Homo sapiens
tgataattttgaaatgatt

SEQ ID NO: 5799868 - DNA, 21 bp, Homo sapiens
tgataattttgaaatgattca

SEQ ID NO: 5799869 - DNA, 13 bp, Homo sapiens
tgataattttgct

SEQ ID NO: 5799870 - DNA, 20 bp, Homo sapiens
tgataattttttaattattt

SEQ ID NO: 5799871 - DNA, 19 bp, Homo sapiens
tgatacaaaatgctgaggt

SEQ ID NO: 5799872 - DNA, 19 bp, Homo sapiens
tgatacaaagtacagaaaa

SEQ ID NO: 5799873 - DNA, 14 bp, Homo sapiens
tgatacaacattaa

SEQ ID NO: 5799874 - DNA, 19 bp, Homo sapiens
tgatacaatattgtgcatg

SEQ ID NO: 5799875 - DNA, 20 bp, Homo sapiens
tgatacaatgctgtgcccta

SEQ ID NO: 5799876 - DNA, 18 bp, Homo sapiens
tgatacacaggtgagaaa

SEQ ID NO: 5799877 - DNA, 19 bp, Homo sapiens
tgatacacaggtgagaaag

SEQ ID NO: 5799878 - DNA, 14 bp, Homo sapiens
tgatacactgtatc

SEQ ID NO: 5799879 - DNA, 15 bp, Homo sapiens
tgatacactgtatct

SEQ ID NO: 5799880 - DNA, 20 bp, Homo sapiens
tgatacactgtatctaaaaa

SEQ ID NO: 5799881 - DNA, 21 bp, Homo sapiens
tgatacactgtatctaaaaaa

SEQ ID NO: 5799882 - DNA, 15 bp, Homo sapiens
tgatacagaactctt

SEQ ID NO: 5799883 - DNA, 16 bp, Homo sapiens
tgatacaggcaattca

SEQ ID NO: 5799884 - DNA, 15 bp, Homo sapiens
tgatacagtgttaaa

SEQ ID NO: 5799885 - DNA, 15 bp, Homo sapiens
tgatacagtgttttt

SEQ ID NO: 5799886 - DNA, 14 bp, Homo sapiens
tgatacagttttga

SEQ ID NO: 5799887 - DNA, 22 bp, Homo sapiens
tgatacagttttgagtaaaaag

SEQ ID NO: 5799888 - DNA, 22 bp, Homo sapiens
tgatacataactaaatttgata

SEQ ID NO: 5799889 - DNA, 13 bp, Homo sapiens
tgatacatataat

SEQ ID NO: 5799890 - DNA, 20 bp, Homo sapiens
tgatacattcaaatttgtct

SEQ ID NO: 5799891 - DNA, 12 bp, Homo sapiens
tgatacatttat

SEQ ID NO: 5799892 - DNA, 14 bp, Homo sapiens
tgatacatttttgt

SEQ ID NO: 5799893 - DNA, 22 bp, Homo sapiens
tgataccaaagagacagggccc

SEQ ID NO: 5799894 - DNA, 13 bp, Homo sapiens
tgataccacctgc

SEQ ID NO: 5799895 - DNA, 18 bp, Homo sapiens
tgataccacctttactgt

SEQ ID NO: 5799896 - DNA, 17 bp, Homo sapiens
tgataccagaagggaaa

SEQ ID NO: 5799897 - DNA, 18 bp, Homo sapiens
tgataccagaagggaaag

SEQ ID NO: 5799898 - DNA, 21 bp, Homo sapiens
tgataccagaagggaaagctt

SEQ ID NO: 5799899 - DNA, 18 bp, Homo sapiens
tgataccagcagcaactg

SEQ ID NO: 5799900 - DNA, 15 bp, Homo sapiens
tgatacccaacagtt

SEQ ID NO: 5799901 - DNA, 18 bp, Homo sapiens
tgatacccatagcttcca

SEQ ID NO: 5799902 - DNA, 21 bp, Homo sapiens
tgatacccatagcttccatga

SEQ ID NO: 5799903 - DNA, 19 bp, Homo sapiens
tgatacccccctctgtctt

SEQ ID NO: 5799904 - DNA, 19 bp, Homo sapiens
tgataccctgcttggtcaa

SEQ ID NO: 5799905 - DNA, 17 bp, Homo sapiens
tgatacgatagttacat

SEQ ID NO: 5799906 - DNA, 19 bp, Homo sapiens
tgatacgatagttacataa

SEQ ID NO: 5799907 - DNA, 16 bp, Homo sapiens
tgatacgatgcttcaa

SEQ ID NO: 5799908 - DNA, 15 bp, Homo sapiens
tgatacgtacagcca

SEQ ID NO: 5799909 - DNA, 14 bp, Homo sapiens
tgatacgtgtgtga

SEQ ID NO: 5799910 - DNA, 16 bp, Homo sapiens
tgatacgtgtgtgaag

SEQ ID NO: 5799911 - DNA, 21 bp, Homo sapiens
tgatacgtgttcctataaaat

SEQ ID NO: 5799912 - DNA, 15 bp, Homo sapiens
tgatactaataaact

SEQ ID NO: 5799913 - DNA, 15 bp, Homo sapiens
tgatactacaacttt

SEQ ID NO: 5799914 - DNA, 17 bp, Homo sapiens
tgatactagcatactta

SEQ ID NO: 5799915 - DNA, 22 bp, Homo sapiens
tgatactatctcttgtcatata

SEQ ID NO: 5799916 - DNA, 16 bp, Homo sapiens
tgatactcatttctta

SEQ ID NO: 5799917 - DNA, 13 bp, Homo sapiens
tgatactgaatgc

SEQ ID NO: 5799918 - DNA, 15 bp, Homo sapiens
tgatactgacttttt

SEQ ID NO: 5799919 - DNA, 13 bp, Homo sapiens
tgatactgatgcc

SEQ ID NO: 5799920 - DNA, 14 bp, Homo sapiens
tgatactgcttttc

SEQ ID NO: 5799921 - DNA, 17 bp, Homo sapiens
tgatactgggtctgcga

SEQ ID NO: 5799922 - DNA, 16 bp, Homo sapiens
tgatactgtctaagaa

SEQ ID NO: 5799923 - DNA, 20 bp, Homo sapiens
tgatactgtctctccagtga

SEQ ID NO: 5799924 - DNA, 18 bp, Homo sapiens
tgatactgtctttgcata

SEQ ID NO: 5799925 - DNA, 16 bp, Homo sapiens
tgatactgttgcacgt

SEQ ID NO: 5799926 - DNA, 15 bp, Homo sapiens
tgatactgtttcttg

SEQ ID NO: 5799927 - DNA, 18 bp, Homo sapiens
tgatactgtttcttgcac

SEQ ID NO: 5799928 - DNA, 15 bp, Homo sapiens
tgatacttatatttt

SEQ ID NO: 5799929 - DNA, 14 bp, Homo sapiens
tgatacttcactac

SEQ ID NO: 5799930 - DNA, 13 bp, Homo sapiens
tgatacttcaggt

SEQ ID NO: 5799931 - DNA, 15 bp, Homo sapiens
tgatacttcaggtgc

SEQ ID NO: 5799932 - DNA, 13 bp, Homo sapiens
tgatacttcattt

SEQ ID NO: 5799933 - DNA, 17 bp, Homo sapiens
tgatacttcgacactgt

SEQ ID NO: 5799934 - DNA, 18 bp, Homo sapiens
tgatacttcgacactgtt

SEQ ID NO: 5799935 - DNA, 12 bp, Homo sapiens
tgatacttgtaa

SEQ ID NO: 5799936 - DNA, 22 bp, Homo sapiens
tgatacttgttttcaaaccagt

SEQ ID NO: 5799937 - DNA, 12 bp, Homo sapiens
tgatactttaat

SEQ ID NO: 5799938 - DNA, 12 bp, Homo sapiens
tgatactttagc

SEQ ID NO: 5799939 - DNA, 19 bp, Homo sapiens
tgatactttagccatcata

SEQ ID NO: 5799940 - DNA, 13 bp, Homo sapiens
tgatagaaagaat

SEQ ID NO: 5799941 - DNA, 19 bp, Homo sapiens
tgatagaaagaataaaatg

SEQ ID NO: 5799942 - DNA, 13 bp, Homo sapiens
tgatagaacaaga

SEQ ID NO: 5799943 - DNA, 18 bp, Homo sapiens
tgatagaactgtactgtt

SEQ ID NO: 5799944 - DNA, 22 bp, Homo sapiens
tgatagaactttgatggatttt

SEQ ID NO: 5799945 - DNA, 21 bp, Homo sapiens
tgatagaactttgccagtctt

SEQ ID NO: 5799946 - DNA, 22 bp, Homo sapiens
tgatagaagaaggactgaagaa

SEQ ID NO: 5799947 - DNA, 21 bp, Homo sapiens
tgatagaaggctatggggata

SEQ ID NO: 5799948 - DNA, 16 bp, Homo sapiens
tgatagacttcgaaaa

SEQ ID NO: 5799949 - DNA, 15 bp, Homo sapiens
tgatagaggaagcct

SEQ ID NO: 5799950 - DNA, 17 bp, Homo sapiens
tgatagagtttaacaga

SEQ ID NO: 5799951 - DNA, 18 bp, Homo sapiens
tgatagatttgacctcct

SEQ ID NO: 5799952 - DNA, 19 bp, Homo sapiens
tgatagatttgacctcctc

SEQ ID NO: 5799953 - DNA, 14 bp, Homo sapiens
tgatagattttctg

SEQ ID NO: 5799954 - DNA, 18 bp, Homo sapiens
tgatagcaaatggcctca

SEQ ID NO: 5799955 - DNA, 16 bp, Homo sapiens
tgatagcactggtttg

SEQ ID NO: 5799956 - DNA, 23 bp, Homo sapiens
tgatagcactggtttgtttctca

SEQ ID NO: 5799957 - DNA, 21 bp, Homo sapiens
tgatagcaggtgtaataagac

SEQ ID NO: 5799958 - DNA, 19 bp, Homo sapiens
tgatagcatggggcccctg

SEQ ID NO: 5799959 - DNA, 13 bp, Homo sapiens
tgatagcattgct

SEQ ID NO: 5799960 - DNA, 21 bp, Homo sapiens
tgatagcccctctccccgcag

SEQ ID NO: 5799961 - DNA, 15 bp, Homo sapiens
tgatagcctgttaca

SEQ ID NO: 5799962 - DNA, 22 bp, Homo sapiens
tgatagctactgtagaaaggaa

SEQ ID NO: 5799963 - DNA, 14 bp, Homo sapiens
tgatagctgtttca

SEQ ID NO: 5799964 - DNA, 11 bp, Homo sapiens
tgatagcttta

SEQ ID NO: 5799965 - DNA, 13 bp, Homo sapiens
tgatagctttatt

SEQ ID NO: 5799966 - DNA, 14 bp, Homo sapiens
tgatagctttattt

SEQ ID NO: 5799967 - DNA, 14 bp, Homo sapiens
tgataggaaggaaa

SEQ ID NO: 5799968 - DNA, 21 bp, Homo sapiens
tgataggaatgtgaaagcacg

SEQ ID NO: 5799969 - DNA, 21 bp, Homo sapiens
tgataggacttccttaagcat

SEQ ID NO: 5799970 - DNA, 22 bp, Homo sapiens
tgataggacttccttaagcatg

SEQ ID NO: 5799971 - DNA, 16 bp, Homo sapiens
tgataggagacttgta

SEQ ID NO: 5799972 - DNA, 15 bp, Homo sapiens
tgataggagggggcg

SEQ ID NO: 5799973 - DNA, 18 bp, Homo sapiens
tgataggcaaggatgaaa

SEQ ID NO: 5799974 - DNA, 22 bp, Homo sapiens
tgatagggagttttaaagaaat

SEQ ID NO: 5799975 - DNA, 20 bp, Homo sapiens
tgatagggatacatgctctt

SEQ ID NO: 5799976 - DNA, 19 bp, Homo sapiens
tgatagggtttgtgacagg

SEQ ID NO: 5799977 - DNA, 23 bp, Homo sapiens
tgataggtaaatttttaggcaaa

SEQ ID NO: 5799978 - DNA, 21 bp, Homo sapiens
tgataggtacctgagtgacgg

SEQ ID NO: 5799979 - DNA, 18 bp, Homo sapiens
tgataggtataagtggtg

SEQ ID NO: 5799980 - DNA, 16 bp, Homo sapiens
tgatagtaggccttca

SEQ ID NO: 5799981 - DNA, 15 bp, Homo sapiens
tgatagtagtaaaat

SEQ ID NO: 5799982 - DNA, 19 bp, Homo sapiens
tgatagtagtctttaaaag

SEQ ID NO: 5799983 - DNA, 12 bp, Homo sapiens
tgatagtccttt

SEQ ID NO: 5799984 - DNA, 19 bp, Homo sapiens
tgatagtgcttcttgtaat

SEQ ID NO: 5799985 - DNA, 20 bp, Homo sapiens
tgatagtgcttcttgtaata

SEQ ID NO: 5799986 - DNA, 16 bp, Homo sapiens
tgatagtggtggagtt

SEQ ID NO: 5799987 - DNA, 17 bp, Homo sapiens
tgatagtgtaaacaaat

SEQ ID NO: 5799988 - DNA, 23 bp, Homo sapiens
tgatagtgtaaacaaataataaa

SEQ ID NO: 5799989 - DNA, 22 bp, Homo sapiens
tgatagtgtttcgttaagcagt

SEQ ID NO: 5799990 - DNA, 17 bp, Homo sapiens
tgatagttactgttgtg

SEQ ID NO: 5799991 - DNA, 18 bp, Homo sapiens
tgatagttgattttcaaa

SEQ ID NO: 5799992 - DNA, 14 bp, Homo sapiens
tgatagttgtgtgt

SEQ ID NO: 5799993 - DNA, 16 bp, Homo sapiens
tgatagtttacaaaca

SEQ ID NO: 5799994 - DNA, 21 bp, Homo sapiens
tgatataaagaatgaaagtag

SEQ ID NO: 5799995 - DNA, 14 bp, Homo sapiens
tgatataaataaaa

SEQ ID NO: 5799996 - DNA, 13 bp, Homo sapiens
tgatataataatt

SEQ ID NO: 5799997 - DNA, 18 bp, Homo sapiens
tgatataataattactta

SEQ ID NO: 5799998 - DNA, 15 bp, Homo sapiens
tgatataattactta

SEQ ID NO: 5799999 - DNA, 18 bp, Homo sapiens
tgatataattgtactgtg

SEQ ID NO: 5800000 - DNA, 14 bp, Homo sapiens
tgatatacagacct

SEQ ID NO: 5800001 - DNA, 17 bp, Homo sapiens
tgatatacagacctcca

SEQ ID NO: 5800002 - DNA, 15 bp, Homo sapiens
tgatatacattgtgt

SEQ ID NO: 5800003 - DNA, 19 bp, Homo sapiens
tgatatacattgtgtgaaa

SEQ ID NO: 5800004 - DNA, 16 bp, Homo sapiens
tgatataccaaattaa

SEQ ID NO: 5800005 - DNA, 20 bp, Homo sapiens
tgatataccaaattaaaaaa

SEQ ID NO: 5800006 - DNA, 16 bp, Homo sapiens
tgatatagaagtataa

SEQ ID NO: 5800007 - DNA, 11 bp, Homo sapiens
tgatatagaat

SEQ ID NO: 5800008 - DNA, 14 bp, Homo sapiens
tgatatagaattag

SEQ ID NO: 5800009 - DNA, 18 bp, Homo sapiens
tgatatagataacagatt

SEQ ID NO: 5800010 - DNA, 19 bp, Homo sapiens
tgatataggaaaatacatt

SEQ ID NO: 5800011 - DNA, 20 bp, Homo sapiens
tgatataggaaaatacattg

SEQ ID NO: 5800012 - DNA, 21 bp, Homo sapiens
tgatataggaaaatacattgt

SEQ ID NO: 5800013 - DNA, 20 bp, Homo sapiens
tgatatagtcagctgccttt

SEQ ID NO: 5800014 - DNA, 18 bp, Homo sapiens
tgatatagtgctgtttaa

SEQ ID NO: 5800015 - DNA, 20 bp, Homo sapiens
tgatatataaaccttaaatg

SEQ ID NO: 5800016 - DNA, 18 bp, Homo sapiens
tgatatatatgtataatt

SEQ ID NO: 5800017 - DNA, 20 bp, Homo sapiens
tgatatatatgtataatttc

SEQ ID NO: 5800018 - DNA, 17 bp, Homo sapiens
tgatatatgtatcttta

SEQ ID NO: 5800019 - DNA, 18 bp, Homo sapiens
tgatatatgtattaataa

SEQ ID NO: 5800020 - DNA, 22 bp, Homo sapiens
tgatatatgtatttattgtcat

SEQ ID NO: 5800021 - DNA, 21 bp, Homo sapiens
tgatatatgtgtttttcacat

SEQ ID NO: 5800022 - DNA, 22 bp, Homo sapiens
tgatatatttgttgatattaag

SEQ ID NO: 5800023 - DNA, 17 bp, Homo sapiens
tgatatcacagtctaat

SEQ ID NO: 5800024 - DNA, 19 bp, Homo sapiens
tgatatcacagtctaattt

SEQ ID NO: 5800025 - DNA, 21 bp, Homo sapiens
tgatatccaacagaaagcata

SEQ ID NO: 5800026 - DNA, 20 bp, Homo sapiens
tgatatccatatgaaattca

SEQ ID NO: 5800027 - DNA, 19 bp, Homo sapiens
tgatatccattctttctga

SEQ ID NO: 5800028 - DNA, 13 bp, Homo sapiens
tgatatcccaagt

SEQ ID NO: 5800029 - DNA, 16 bp, Homo sapiens
tgatatcccccagcct

SEQ ID NO: 5800030 - DNA, 16 bp, Homo sapiens
tgatatcgtgaaatcc

SEQ ID NO: 5800031 - DNA, 23 bp, Homo sapiens
tgatatctataaaatagatataa

SEQ ID NO: 5800032 - DNA, 18 bp, Homo sapiens
tgatatctatagtagaca

SEQ ID NO: 5800033 - DNA, 19 bp, Homo sapiens
tgatatctatattctaaag

SEQ ID NO: 5800034 - DNA, 15 bp, Homo sapiens
tgatctgtgtacaat

SEQ ID NO: 5800035 - DNA, 15 bp, Homo sapiens
tgatctgttataggt

SEQ ID NO: 5800036 - DNA, 22 bp, Homo sapiens
tgatctgttcagttaagttctt

SEQ ID NO: 5800037 - DNA, 13 bp, Homo sapiens
tgatctgttgcaa

SEQ ID NO: 5800038 - DNA, 20 bp, Homo sapiens
tgatctgttgtaatatcagt

SEQ ID NO: 5800039 - DNA, 15 bp, Homo sapiens
tgatctgtttttcac

SEQ ID NO: 5800040 - DNA, 17 bp, Homo sapiens
tgatcttaaaataattc

SEQ ID NO: 5800041 - DNA, 11 bp, Homo sapiens
tgatcttaaag

SEQ ID NO: 5800042 - DNA, 18 bp, Homo sapiens
tgatcttaatatatttga

SEQ ID NO: 5800043 - DNA, 21 bp, Homo sapiens
tgatcttaattactttcagaa

SEQ ID NO: 5800044 - DNA, 17 bp, Homo sapiens
tgatcttacctttatga

SEQ ID NO: 5800045 - DNA, 21 bp, Homo sapiens
tgatcttactctactgctgct

SEQ ID NO: 5800046 - DNA, 14 bp, Homo sapiens
tgatcttattgctt

SEQ ID NO: 5800047 - DNA, 16 bp, Homo sapiens
tgatcttattgcttgc

SEQ ID NO: 5800048 - DNA, 16 bp, Homo sapiens
tgatcttatttttcta

SEQ ID NO: 5800049 - DNA, 19 bp, Homo sapiens
tgatcttatttttctaaac

SEQ ID NO: 5800050 - DNA, 14 bp, Homo sapiens
tgatcttcaacaaa

SEQ ID NO: 5800051 - DNA, 16 bp, Homo sapiens
tgatcttcactgtata

SEQ ID NO: 5800052 - DNA, 16 bp, Homo sapiens
tgatcttcctctgcta

SEQ ID NO: 5800053 - DNA, 20 bp, Homo sapiens
tgatcttctttataattcta

SEQ ID NO: 5800054 - DNA, 22 bp, Homo sapiens
tgatcttgagaaccttttcaaa

SEQ ID NO: 5800055 - DNA, 18 bp, Homo sapiens
tgatcttgagatttcttt

SEQ ID NO: 5800056 - DNA, 17 bp, Homo sapiens
tgatcttgcattcattt

SEQ ID NO: 5800057 - DNA, 19 bp, Homo sapiens
tgatcttgcattcattttc

SEQ ID NO: 5800058 - DNA, 21 bp, Homo sapiens
tgatcttgcctgtctggctca

SEQ ID NO: 5800059 - DNA, 18 bp, Homo sapiens
tgatcttggaaaaacagc

SEQ ID NO: 5800060 - DNA, 21 bp, Homo sapiens
tgatcttggcttactgcagcc

SEQ ID NO: 5800061 - DNA, 14 bp, Homo sapiens
tgatcttgtgctat

SEQ ID NO: 5800062 - DNA, 20 bp, Homo sapiens
tgatcttgtgctatgaaaca

SEQ ID NO: 5800063 - DNA, 16 bp, Homo sapiens
tgatcttgtgctcagc

SEQ ID NO: 5800064 - DNA, 12 bp, Homo sapiens
tgatctttcaat

SEQ ID NO: 5800065 - DNA, 21 bp, Homo sapiens
tgatctttcaatatcattact

SEQ ID NO: 5800066 - DNA, 14 bp, Homo sapiens
tgatctttctagag

SEQ ID NO: 5800067 - DNA, 19 bp, Homo sapiens
tgatctttctttcctttct

SEQ ID NO: 5800068 - DNA, 13 bp, Homo sapiens
tgatctttgagcc

SEQ ID NO: 5800069 - DNA, 14 bp, Homo sapiens
tgatctttgagtgt

SEQ ID NO: 5800070 - DNA, 18 bp, Homo sapiens
tgatctttgcagacaggc

SEQ ID NO: 5800071 - DNA, 21 bp, Homo sapiens
tgatctttgcagacaggcaag

SEQ ID NO: 5800072 - DNA, 14 bp, Homo sapiens
tgatctttgtttaa

SEQ ID NO: 5800073 - DNA, 17 bp, Homo sapiens
tgatctttgtttaaatg

SEQ ID NO: 5800074 - DNA, 18 bp, Homo sapiens
tgatctttgtttaaatgc

SEQ ID NO: 5800075 - DNA, 20 bp, Homo sapiens
tgatctttgtttaaatgcca

SEQ ID NO: 5800076 - DNA, 22 bp, Homo sapiens
tgatctttgtttaaatgccaaa

SEQ ID NO: 5800077 - DNA, 23 bp, Homo sapiens
tgatctttgtttaaatgccaaaa

SEQ ID NO: 5800078 - DNA, 14 bp, Homo sapiens
tgatcttttaaagt

SEQ ID NO: 5800079 - DNA, 18 bp, Homo sapiens
tgatcttttaaagtgtta

SEQ ID NO: 5800080 - DNA, 19 bp, Homo sapiens
tgatcttttaaagtgttac

SEQ ID NO: 5800081 - DNA, 18 bp, Homo sapiens
tgatctttttatcatgat

SEQ ID NO: 5800082 - DNA, 15 bp, Homo sapiens
tgatgaaaaatagca

SEQ ID NO: 5800083 - DNA, 15 bp, Homo sapiens
tgatgaaaagattta

SEQ ID NO: 5800084 - DNA, 15 bp, Homo sapiens
tgatgaaaaggtcag

SEQ ID NO: 5800085 - DNA, 15 bp, Homo sapiens
tgatgaaaataaaga

SEQ ID NO: 5800086 - DNA, 14 bp, Homo sapiens
tgatgaaaataata

SEQ ID NO: 5800087 - DNA, 20 bp, Homo sapiens
tgatgaaaataattttccaa

SEQ ID NO: 5800088 - DNA, 18 bp, Homo sapiens
tgatgaaaatatttaaag

SEQ ID NO: 5800089 - DNA, 14 bp, Homo sapiens
tgatgaaacattca

SEQ ID NO: 5800090 - DNA, 23 bp, Homo sapiens
tgatgaaaccttgaagttctgaa

SEQ ID NO: 5800091 - DNA, 24 bp, Homo sapiens
tgatgaaaccttgaagttctgaaa

SEQ ID NO: 5800092 - DNA, 20 bp, Homo sapiens
tgatgaaactcctgattttg

SEQ ID NO: 5800093 - DNA, 22 bp, Homo sapiens
tgatgaaactcctgattttgta

SEQ ID NO: 5800094 - DNA, 19 bp, Homo sapiens
tgatgaaactgtcataatg

SEQ ID NO: 5800095 - DNA, 16 bp, Homo sapiens
tgatgaaattcttgaa

SEQ ID NO: 5800096 - DNA, 17 bp, Homo sapiens
tgatgaaattcttgaag

SEQ ID NO: 5800097 - DNA, 22 bp, Homo sapiens
tgatgaacatattcatgaaatg

SEQ ID NO: 5800098 - DNA, 17 bp, Homo sapiens
tgatgaacttattctgt

SEQ ID NO: 5800099 - DNA, 23 bp, Homo sapiens
tgatgaactttctcttcatactt

SEQ ID NO: 5800100 - DNA, 20 bp, Homo sapiens
tgatgaagaaaagtgggcca

SEQ ID NO: 5800101 - DNA, 13 bp, Homo sapiens
tgatgaagaaatg

SEQ ID NO: 5800102 - DNA, 12 bp, Homo sapiens
tgatgaagaagt

SEQ ID NO: 5800103 - DNA, 24 bp, Homo sapiens
tgatgaagcaaggaagatatacat

SEQ ID NO: 5800104 - DNA, 11 bp, Homo sapiens
tgatgaagccc

SEQ ID NO: 5800105 - DNA, 13 bp, Homo sapiens
tgatgaagcccgt

SEQ ID NO: 5800106 - DNA, 11 bp, Homo sapiens
tgatgaagcct

SEQ ID NO: 5800107 - DNA, 15 bp, Homo sapiens
tgatgaagctgaggc

SEQ ID NO: 5800108 - DNA, 12 bp, Homo sapiens
tgatgaagtata

SEQ ID NO: 5800109 - DNA, 16 bp, Homo sapiens
tgatgaataaaatgtt

SEQ ID NO: 5800110 - DNA, 17 bp, Homo sapiens
tgatgaataaacacttt

SEQ ID NO: 5800111 - DNA, 17 bp, Homo sapiens
tgatgaatcaatgaaaa

SEQ ID NO: 5800112 - DNA, 19 bp, Homo sapiens
tgatgaatcaatgaaaaat

SEQ ID NO: 5800113 - DNA, 14 bp, Homo sapiens
tgatgaatctacat

SEQ ID NO: 5800114 - DNA, 20 bp, Homo sapiens
tgatgaatctacatttgttt

SEQ ID NO: 5800115 - DNA, 12 bp, Homo sapiens
tgatgaatcttg

SEQ ID NO: 5800116 - DNA, 17 bp, Homo sapiens
tgatgaatgtaaagtta

SEQ ID NO: 5800117 - DNA, 18 bp, Homo sapiens
tgatgacaataaagcttg

SEQ ID NO: 5800118 - DNA, 15 bp, Homo sapiens
tgatgacagagcgag

SEQ ID NO: 5800119 - DNA, 19 bp, Homo sapiens
tgatgacataagtcagcaa

SEQ ID NO: 5800120 - DNA, 13 bp, Homo sapiens
tgatgacataata

SEQ ID NO: 5800121 - DNA, 18 bp, Homo sapiens
tgatgacattccaccatt

SEQ ID NO: 5800122 - DNA, 18 bp, Homo sapiens
tgatgaccaattttaact

SEQ ID NO: 5800123 - DNA, 22 bp, Homo sapiens
tgatgacccaggctgcctgagc

SEQ ID NO: 5800124 - DNA, 18 bp, Homo sapiens
tgatgacccccccagctt

SEQ ID NO: 5800125 - DNA, 21 bp, Homo sapiens
tgatgacgggatgctctttaa

SEQ ID NO: 5800126 - DNA, 22 bp, Homo sapiens
tgatgacgggatgctctttaaa

SEQ ID NO: 5800127 - DNA, 22 bp, Homo sapiens
tgatgacgtacaagtagttctg

SEQ ID NO: 5800128 - DNA, 22 bp, Homo sapiens
tgatgactatgctttgctatca

SEQ ID NO: 5800129 - DNA, 18 bp, Homo sapiens
tgatgactcaagattttt

SEQ ID NO: 5800130 - DNA, 15 bp, Homo sapiens
tgatgactcgaaact

SEQ ID NO: 5800131 - DNA, 23 bp, Homo sapiens
tgatgactgaaaatgaactgtaa

SEQ ID NO: 5800132 - DNA, 13 bp, Homo sapiens
tgatgactgcctt

SEQ ID NO: 5800133 - DNA, 14 bp, Homo sapiens
tgatgactgccttg

SEQ ID NO: 5800134 - DNA, 15 bp, Homo sapiens
tgatgactggaattt

SEQ ID NO: 5800135 - DNA, 20 bp, Homo sapiens
tgatgactggaatttttatt

SEQ ID NO: 5800136 - DNA, 23 bp, Homo sapiens
tgatgactggaatttttattatg

SEQ ID NO: 5800137 - DNA, 15 bp, Homo sapiens
tgatgactggcattt

SEQ ID NO: 5800138 - DNA, 17 bp, Homo sapiens
tgatgactggcatttta

SEQ ID NO: 5800139 - DNA, 18 bp, Homo sapiens
tgatgactggcattttat

SEQ ID NO: 5800140 - DNA, 23 bp, Homo sapiens
tgatgacttagcgtcaagacatt

SEQ ID NO: 5800141 - DNA, 18 bp, Homo sapiens
tgatgacttcagtgaaat

SEQ ID NO: 5800142 - DNA, 18 bp, Homo sapiens
tgatgacttgctgtccag

SEQ ID NO: 5800143 - DNA, 15 bp, Homo sapiens
tgatgactttctgtt

SEQ ID NO: 5800144 - DNA, 19 bp, Homo sapiens
tgatgactttctgttttct

SEQ ID NO: 5800145 - DNA, 15 bp, Homo sapiens
tgatgagaatttcta

SEQ ID NO: 5800146 - DNA, 16 bp, Homo sapiens
tgatgagaatttctaa

SEQ ID NO: 5800147 - DNA, 23 bp, Homo sapiens
tgatgagaatttctaaaaagatt

SEQ ID NO: 5800148 - DNA, 17 bp, Homo sapiens
tgatgagacagtgaagt

SEQ ID NO: 5800149 - DNA, 15 bp, Homo sapiens
tgatgagaggaaatc

SEQ ID NO: 5800150 - DNA, 14 bp, Homo sapiens
tgatgagattttta

SEQ ID NO: 5800151 - DNA, 12 bp, Homo sapiens
tgatgagcacat

SEQ ID NO: 5800152 - DNA, 22 bp, Homo sapiens
tgatgagccatattaattgcct

SEQ ID NO: 5800153 - DNA, 24 bp, Homo sapiens
tgatgagctgtgcacaaagtggca

SEQ ID NO: 5800154 - DNA, 21 bp, Homo sapiens
tgatgaggccctccacacctg

SEQ ID NO: 5800155 - DNA, 12 bp, Homo sapiens
tgatgagggaag

SEQ ID NO: 5800156 - DNA, 16 bp, Homo sapiens
tgatgagggcagcagc

SEQ ID NO: 5800157 - DNA, 21 bp, Homo sapiens
tgatgagggcagcagccagcc

SEQ ID NO: 5800158 - DNA, 24 bp, Homo sapiens
tgatgagggcagcagccagccctg

SEQ ID NO: 5800159 - DNA, 22 bp, Homo sapiens
tgatgagggggaattcctggaa

SEQ ID NO: 5800160 - DNA, 23 bp, Homo sapiens
tgatgagggggaattcctggaac

SEQ ID NO: 5800161 - DNA, 22 bp, Homo sapiens
tgatgaggtattttttcctttt

SEQ ID NO: 5800162 - DNA, 21 bp, Homo sapiens
tgatgagtgtaacaagaaagg

SEQ ID NO: 5800163 - DNA, 18 bp, Homo sapiens
tgatgagtttcactgtac

SEQ ID NO: 5800164 - DNA, 18 bp, Homo sapiens
tgatgataatacccacat

SEQ ID NO: 5800165 - DNA, 14 bp, Homo sapiens
tgatgataatgatg

SEQ ID NO: 5800166 - DNA, 15 bp, Homo sapiens
tgatgatagcagaca

SEQ ID NO: 5800167 - DNA, 19 bp, Homo sapiens
tgatgatcactgtgaaaat

SEQ ID NO: 5800168 - DNA, 21 bp, Homo sapiens
tgatgatcagctgtttgtcat

SEQ ID NO: 5800169 - DNA, 18 bp, Homo sapiens
tgatgatcatgatgatga

SEQ ID NO: 5800170 - DNA, 20 bp, Homo sapiens
tgatgatctttgcagacagg

SEQ ID NO: 5800171 - DNA, 15 bp, Homo sapiens
tgatgatgaccaaga

SEQ ID NO: 5800172 - DNA, 14 bp, Homo sapiens
tgatgatgatataa

SEQ ID NO: 5800173 - DNA, 13 bp, Homo sapiens
tgatgatgatgaa

SEQ ID NO: 5800174 - DNA, 16 bp, Homo sapiens
tgatgatgatgataat

SEQ ID NO: 5800175 - DNA, 15 bp, Homo sapiens
tgatgatgatgatga

SEQ ID NO: 5800176 - DNA, 16 bp, Homo sapiens
tgatgatgatgatgaa

SEQ ID NO: 5800177 - DNA, 16 bp, Homo sapiens
tgatgatgatgatgat

SEQ ID NO: 5800178 - DNA, 12 bp, Homo sapiens
tgatgatgctgg

SEQ ID NO: 5800179 - DNA, 14 bp, Homo sapiens
tgatgatgtaattg

SEQ ID NO: 5800180 - DNA, 20 bp, Homo sapiens
tgatgatgtctacagaaaat

SEQ ID NO: 5800181 - DNA, 15 bp, Homo sapiens
tgatgatgtctcttg

SEQ ID NO: 5800182 - DNA, 13 bp, Homo sapiens
tgatgatgtggaa

SEQ ID NO: 5800183 - DNA, 20 bp, Homo sapiens
tgatgatgtgtttaaactga

SEQ ID NO: 5800184 - DNA, 14 bp, Homo sapiens
tgatgatgttctga

SEQ ID NO: 5800185 - DNA, 15 bp, Homo sapiens
tgatgatgttctgaa

SEQ ID NO: 5800186 - DNA, 20 bp, Homo sapiens
tgatgatgttgtaaaatgaa

SEQ ID NO: 5800187 - DNA, 17 bp, Homo sapiens
tgatgattgccaacagt

SEQ ID NO: 5800188 - DNA, 15 bp, Homo sapiens
tgatgatttcagaaa

SEQ ID NO: 5800189 - DNA, 18 bp, Homo sapiens
tgatgattttaacagttt

SEQ ID NO: 5800190 - DNA, 20 bp, Homo sapiens
tgatgattttaacagtttta

SEQ ID NO: 5800191 - DNA, 14 bp, Homo sapiens
tgatgattttgtaa

SEQ ID NO: 5800192 - DNA, 19 bp, Homo sapiens
tgatgattttgtaattctt

SEQ ID NO: 5800193 - DNA, 21 bp, Homo sapiens
tgatgattttgtaattcttat

SEQ ID NO: 5800194 - DNA, 13 bp, Homo sapiens
tgatgcacagaga

SEQ ID NO: 5800195 - DNA, 16 bp, Homo sapiens
tgatgcacagagaagc

SEQ ID NO: 5800196 - DNA, 18 bp, Homo sapiens
tgatgcacagagaagctg

SEQ ID NO: 5800197 - DNA, 15 bp, Homo sapiens
tgatgcacagtatct

SEQ ID NO: 5800198 - DNA, 18 bp, Homo sapiens
tgatgcacagtatctgct

SEQ ID NO: 5800199 - DNA, 11 bp, Homo sapiens
tgatgcagaaa

SEQ ID NO: 5800200 - DNA, 16 bp, Homo sapiens
tgatgcagataaaata

SEQ ID NO: 5800201 - DNA, 16 bp, Homo sapiens
tgatgcagctgttgag

SEQ ID NO: 5800202 - DNA, 18 bp, Homo sapiens
tgatgcaggaagaccaca

SEQ ID NO: 5800203 - DNA, 13 bp, Homo sapiens
tgatgcaggcact

SEQ ID NO: 5800204 - DNA, 15 bp, Homo sapiens
tgatgcagtctcctc

SEQ ID NO: 5800205 - DNA, 21 bp, Homo sapiens
tgatgcagtgccctagaaggg

SEQ ID NO: 5800206 - DNA, 15 bp, Homo sapiens
tgatgcagttttaat

SEQ ID NO: 5800207 - DNA, 18 bp, Homo sapiens
tgatgcatgatgccctcc

SEQ ID NO: 5800208 - DNA, 17 bp, Homo sapiens
tgatgcatgcactgttc

SEQ ID NO: 5800209 - DNA, 14 bp, Homo sapiens
tgatgcatgttact

SEQ ID NO: 5800210 - DNA, 16 bp, Homo sapiens
tgatgcatttccacac

SEQ ID NO: 5800211 - DNA, 14 bp, Homo sapiens
tgatgccaaaaaaa

SEQ ID NO: 5800212 - DNA, 20 bp, Homo sapiens
tgattaaggtctctctttgg

SEQ ID NO: 5800213 - DNA, 23 bp, Homo sapiens
tgattaagtaatgataactggaa

SEQ ID NO: 5800214 - DNA, 14 bp, Homo sapiens
tgattaataaaata

SEQ ID NO: 5800215 - DNA, 17 bp, Homo sapiens
tgattaataagaacttg

SEQ ID NO: 5800216 - DNA, 22 bp, Homo sapiens
tgattaatatgcaagtgaacaa

SEQ ID NO: 5800217 - DNA, 11 bp, Homo sapiens
tgattaatgaa

SEQ ID NO: 5800218 - DNA, 15 bp, Homo sapiens
tgattaatgaagaaa

SEQ ID NO: 5800219 - DNA, 21 bp, Homo sapiens
tgattaatgaagaaagtaaaa

SEQ ID NO: 5800220 - DNA, 14 bp, Homo sapiens
tgattaatgcattt

SEQ ID NO: 5800221 - DNA, 13 bp, Homo sapiens
tgattaatgtact

SEQ ID NO: 5800222 - DNA, 14 bp, Homo sapiens
tgattaatgtactt

SEQ ID NO: 5800223 - DNA, 23 bp, Homo sapiens
tgattaatgtactttttattgca

SEQ ID NO: 5800224 - DNA, 13 bp, Homo sapiens
tgattaatttgag

SEQ ID NO: 5800225 - DNA, 13 bp, Homo sapiens
tgattacacagtt

SEQ ID NO: 5800226 - DNA, 14 bp, Homo sapiens
tgattacacagttg

SEQ ID NO: 5800227 - DNA, 15 bp, Homo sapiens
tgattacatagatca

SEQ ID NO: 5800228 - DNA, 20 bp, Homo sapiens
tgattacctgctgcatgaaa

SEQ ID NO: 5800229 - DNA, 20 bp, Homo sapiens
tgattacgtgtatgtttctt

SEQ ID NO: 5800230 - DNA, 21 bp, Homo sapiens
tgattacgtgtatgtttcttc

SEQ ID NO: 5800231 - DNA, 21 bp, Homo sapiens
tgattactctttgctttgtag

SEQ ID NO: 5800232 - DNA, 22 bp, Homo sapiens
tgattactctttgctttgtagt

SEQ ID NO: 5800233 - DNA, 20 bp, Homo sapiens
tgattactggcctttttcat

SEQ ID NO: 5800234 - DNA, 15 bp, Homo sapiens
tgattactgtcaata

SEQ ID NO: 5800235 - DNA, 16 bp, Homo sapiens
tgattactgtcaataa

SEQ ID NO: 5800236 - DNA, 20 bp, Homo sapiens
tgattagaaaataaactcat

SEQ ID NO: 5800237 - DNA, 13 bp, Homo sapiens
tgattagacagaa

SEQ ID NO: 5800238 - DNA, 23 bp, Homo sapiens
tgattagagctgcataatgtccc

SEQ ID NO: 5800239 - DNA, 14 bp, Homo sapiens
tgattagatcacat

SEQ ID NO: 5800240 - DNA, 18 bp, Homo sapiens
tgattagctttgtgtttg

SEQ ID NO: 5800241 - DNA, 19 bp, Homo sapiens
tgattagctttgtgtttgg

SEQ ID NO: 5800242 - DNA, 14 bp, Homo sapiens
tgattagtaagtct

SEQ ID NO: 5800243 - DNA, 13 bp, Homo sapiens
tgattagttgaaa

SEQ ID NO: 5800244 - DNA, 14 bp, Homo sapiens
tgattagttgaaag

SEQ ID NO: 5800245 - DNA, 15 bp, Homo sapiens
tgattagttgaaagg

SEQ ID NO: 5800246 - DNA, 15 bp, Homo sapiens
tgattataaatgttt

SEQ ID NO: 5800247 - DNA, 20 bp, Homo sapiens
tgattataaatgtttggaaa

SEQ ID NO: 5800248 - DNA, 16 bp, Homo sapiens
tgattataagacaatg

SEQ ID NO: 5800249 - DNA, 23 bp, Homo sapiens
tgattataccactgcactccagc

SEQ ID NO: 5800250 - DNA, 18 bp, Homo sapiens
tgattatataagcaaaat

SEQ ID NO: 5800251 - DNA, 14 bp, Homo sapiens
tgattatattgttt

SEQ ID NO: 5800252 - DNA, 14 bp, Homo sapiens
tgattatcttcagc

SEQ ID NO: 5800253 - DNA, 15 bp, Homo sapiens
tgattatcttcagcc

SEQ ID NO: 5800254 - DNA, 13 bp, Homo sapiens
tgattatcttgaa

SEQ ID NO: 5800255 - DNA, 11 bp, Homo sapiens
tgattatgaaa

SEQ ID NO: 5800256 - DNA, 13 bp, Homo sapiens
tgattatgaaatg

SEQ ID NO: 5800257 - DNA, 19 bp, Homo sapiens
tgattatgaattacatttg

SEQ ID NO: 5800258 - DNA, 17 bp, Homo sapiens
tgattatggacatcgat

SEQ ID NO: 5800259 - DNA, 20 bp, Homo sapiens
tgattattacttctgtttct

SEQ ID NO: 5800260 - DNA, 21 bp, Homo sapiens
tgattattacttctgtttctc

SEQ ID NO: 5800261 - DNA, 21 bp, Homo sapiens
tgattattagttgaccaacta

SEQ ID NO: 5800262 - DNA, 17 bp, Homo sapiens
tgattattatgtttatt

SEQ ID NO: 5800263 - DNA, 21 bp, Homo sapiens
tgattattatgtttattacaa

SEQ ID NO: 5800264 - DNA, 14 bp, Homo sapiens
tgattattcagtgt

SEQ ID NO: 5800265 - DNA, 18 bp, Homo sapiens
tgattattcttcttacat

SEQ ID NO: 5800266 - DNA, 21 bp, Homo sapiens
tgattattcttcttacattat

SEQ ID NO: 5800267 - DNA, 17 bp, Homo sapiens
tgattattgagttctga

SEQ ID NO: 5800268 - DNA, 18 bp, Homo sapiens
tgattattgagttctgaa

SEQ ID NO: 5800269 - DNA, 15 bp, Homo sapiens
tgattattgtattta

SEQ ID NO: 5800270 - DNA, 22 bp, Homo sapiens
tgattatttaaaaagagaaagt

SEQ ID NO: 5800271 - DNA, 16 bp, Homo sapiens
tgattatttatcacat

SEQ ID NO: 5800272 - DNA, 12 bp, Homo sapiens
tgattatttgca

SEQ ID NO: 5800273 - DNA, 13 bp, Homo sapiens
tgattatttgcat

SEQ ID NO: 5800274 - DNA, 15 bp, Homo sapiens
tgattatttgcatgt

SEQ ID NO: 5800275 - DNA, 16 bp, Homo sapiens
tgattattttagctaa

SEQ ID NO: 5800276 - DNA, 18 bp, Homo sapiens
tgattattttcagaagct

SEQ ID NO: 5800277 - DNA, 21 bp, Homo sapiens
tgattattttcagaagctgat

SEQ ID NO: 5800278 - DNA, 23 bp, Homo sapiens
tgattcaaaatatttaaaaatgt

SEQ ID NO: 5800279 - DNA, 10 bp, Homo sapiens
tgattcaaat

SEQ ID NO: 5800280 - DNA, 23 bp, Homo sapiens
tgattcaaatatcaaaaggaaga

SEQ ID NO: 5800281 - DNA, 11 bp, Homo sapiens
tgattcaaatg

SEQ ID NO: 5800282 - DNA, 18 bp, Homo sapiens
tgattcaaatgttacaaa

SEQ ID NO: 5800283 - DNA, 23 bp, Homo sapiens
tgattcaactaaaaaaaaaaaag

SEQ ID NO: 5800284 - DNA, 15 bp, Homo sapiens
tgattcaagaaacag

SEQ ID NO: 5800285 - DNA, 12 bp, Homo sapiens
tgattcaagcca

SEQ ID NO: 5800286 - DNA, 17 bp, Homo sapiens
tgattcaaggcattatt

SEQ ID NO: 5800287 - DNA, 23 bp, Homo sapiens
tgattcaataaaatgcactgacc

SEQ ID NO: 5800288 - DNA, 17 bp, Homo sapiens
tgattcaatctgtaaac

SEQ ID NO: 5800289 - DNA, 23 bp, Homo sapiens
tgattcaatctgtaaactgtgta

SEQ ID NO: 5800290 - DNA, 12 bp, Homo sapiens
tgattcaattca

SEQ ID NO: 5800291 - DNA, 21 bp, Homo sapiens
tgattcaattcaacactccct

SEQ ID NO: 5800292 - DNA, 14 bp, Homo sapiens
tgattcaatttgat

SEQ ID NO: 5800293 - DNA, 16 bp, Homo sapiens
tgattcaatttgatgt

SEQ ID NO: 5800294 - DNA, 16 bp, Homo sapiens
tgattcacatctcatt

SEQ ID NO: 5800295 - DNA, 13 bp, Homo sapiens
tgattcacatgtt

SEQ ID NO: 5800296 - DNA, 19 bp, Homo sapiens
tgattcacatgttttcaaa

SEQ ID NO: 5800297 - DNA, 21 bp, Homo sapiens
tgattcacctcctaaaacaac

SEQ ID NO: 5800298 - DNA, 15 bp, Homo sapiens
tgattcacctcttcc

SEQ ID NO: 5800299 - DNA, 19 bp, Homo sapiens
tgattcactattagagaaa

SEQ ID NO: 5800300 - DNA, 15 bp, Homo sapiens
tgattcactatttaa

SEQ ID NO: 5800301 - DNA, 13 bp, Homo sapiens
tgattcactgcat

SEQ ID NO: 5800302 - DNA, 15 bp, Homo sapiens
tgattcactgtgctt

SEQ ID NO: 5800303 - DNA, 18 bp, Homo sapiens
tgattcagaaaatgttct

SEQ ID NO: 5800304 - DNA, 22 bp, Homo sapiens
tgattcagaaaatgttctgttt

SEQ ID NO: 5800305 - DNA, 15 bp, Homo sapiens
tgattcagacagctg

SEQ ID NO: 5800306 - DNA, 21 bp, Homo sapiens
tgattcagacagctgcctggg

SEQ ID NO: 5800307 - DNA, 23 bp, Homo sapiens
tgattcagacagctgcctgggat

SEQ ID NO: 5800308 - DNA, 20 bp, Homo sapiens
tgattcagactttcacacca

SEQ ID NO: 5800309 - DNA, 17 bp, Homo sapiens
tgattcagcaggccctt

SEQ ID NO: 5800310 - DNA, 16 bp, Homo sapiens
tgattcagcagtgcct

SEQ ID NO: 5800311 - DNA, 13 bp, Homo sapiens
tgattcagcattt

SEQ ID NO: 5800312 - DNA, 20 bp, Homo sapiens
tgattcagcattttttatca

SEQ ID NO: 5800313 - DNA, 16 bp, Homo sapiens
tgattcagccctcaga

SEQ ID NO: 5800314 - DNA, 20 bp, Homo sapiens
tgattcagctcattatgaaa

SEQ ID NO: 5800315 - DNA, 21 bp, Homo sapiens
tgattcaggtgcagaggaagt

SEQ ID NO: 5800316 - DNA, 13 bp, Homo sapiens
tgattcataaaga

SEQ ID NO: 5800317 - DNA, 17 bp, Homo sapiens
tgattcataataaatat

SEQ ID NO: 5800318 - DNA, 16 bp, Homo sapiens
tgattcataatgactt

SEQ ID NO: 5800319 - DNA, 13 bp, Homo sapiens
tgattcatattta

SEQ ID NO: 5800320 - DNA, 14 bp, Homo sapiens
tgattcatctctgg

SEQ ID NO: 5800321 - DNA, 14 bp, Homo sapiens
tgattcatctttca

SEQ ID NO: 5800322 - DNA, 18 bp, Homo sapiens
tgattcattttcctgttc

SEQ ID NO: 5800323 - DNA, 12 bp, Homo sapiens
tgattccaaata

SEQ ID NO: 5800324 - DNA, 13 bp, Homo sapiens
tgattccaaataa

SEQ ID NO: 5800325 - DNA, 16 bp, Homo sapiens
tgattccaaataaaac

SEQ ID NO: 5800326 - DNA, 15 bp, Homo sapiens
tgattccaaatatgt

SEQ ID NO: 5800327 - DNA, 22 bp, Homo sapiens
tgattccactacacctggctga

SEQ ID NO: 5800328 - DNA, 22 bp, Homo sapiens
tgattccactgaaacctctgtt

SEQ ID NO: 5800329 - DNA, 18 bp, Homo sapiens
tgattccatccacctttc

SEQ ID NO: 5800330 - DNA, 13 bp, Homo sapiens
tgattccatctcc

SEQ ID NO: 5800331 - DNA, 13 bp, Homo sapiens
tgattccattcca

SEQ ID NO: 5800332 - DNA, 13 bp, Homo sapiens
tgattcccaactc

SEQ ID NO: 5800333 - DNA, 20 bp, Homo sapiens
tgattcccaactcctttctg

SEQ ID NO: 5800334 - DNA, 15 bp, Homo sapiens
tgattcccaagctct

SEQ ID NO: 5800335 - DNA, 16 bp, Homo sapiens
tgattcccaagctctg

SEQ ID NO: 5800336 - DNA, 22 bp, Homo sapiens
tgattcccaagctctgctcctc

SEQ ID NO: 5800337 - DNA, 23 bp, Homo sapiens
tgattccctcctcgtcagtctct

SEQ ID NO: 5800338 - DNA, 17 bp, Homo sapiens
tgattccctcctgctac

SEQ ID NO: 5800339 - DNA, 15 bp, Homo sapiens
tgattccctgattta

SEQ ID NO: 5800340 - DNA, 16 bp, Homo sapiens
tgattccctgatttaa

SEQ ID NO: 5800341 - DNA, 19 bp, Homo sapiens
tgattcccttgttattcaa

SEQ ID NO: 5800342 - DNA, 19 bp, Homo sapiens
tgattccgcaccctgccta

SEQ ID NO: 5800343 - DNA, 20 bp, Homo sapiens
tgattcctaaggcccagctg

SEQ ID NO: 5800344 - DNA, 23 bp, Homo sapiens
tgattcctaaggcccagctgcca

SEQ ID NO: 5800345 - DNA, 13 bp, Homo sapiens
tgattcctacccc

SEQ ID NO: 5800346 - DNA, 13 bp, Homo sapiens
tgattcctctcat

SEQ ID NO: 5800347 - DNA, 24 bp, Homo sapiens
tgattcctggacatcaccagtcct

SEQ ID NO: 5800348 - DNA, 11 bp, Homo sapiens
tgattcctggc

SEQ ID NO: 5800349 - DNA, 20 bp, Homo sapiens
tgattcctggctctaccctg

SEQ ID NO: 5800350 - DNA, 11 bp, Homo sapiens
tgattcctggt

SEQ ID NO: 5800351 - DNA, 12 bp, Homo sapiens
tgattcctggtt

SEQ ID NO: 5800352 - DNA, 12 bp, Homo sapiens
tgattccttcct

SEQ ID NO: 5800353 - DNA, 19 bp, Homo sapiens
tgattccttcctgttctga

SEQ ID NO: 5800354 - DNA, 19 bp, Homo sapiens
tgattccttgagtttcata

SEQ ID NO: 5800355 - DNA, 13 bp, Homo sapiens
tgattcctttaaa

SEQ ID NO: 5800356 - DNA, 19 bp, Homo sapiens
tgattcctttaaaatatat

SEQ ID NO: 5800357 - DNA, 20 bp, Homo sapiens
tgattcctttgaagaggaaa

SEQ ID NO: 5800358 - DNA, 17 bp, Homo sapiens
tgattccttttttcaaa

SEQ ID NO: 5800359 - DNA, 18 bp, Homo sapiens
tgattcgaatgacactgt

SEQ ID NO: 5800360 - DNA, 18 bp, Homo sapiens
tgattcgaggtcctcctg

SEQ ID NO: 5800361 - DNA, 21 bp, Homo sapiens
tgattcgcccaaagccagaca

SEQ ID NO: 5800362 - DNA, 17 bp, Homo sapiens
tgattcggacggccaat

SEQ ID NO: 5800363 - DNA, 19 bp, Homo sapiens
tgattcggacggccaatgg

SEQ ID NO: 5800364 - DNA, 18 bp, Homo sapiens
tgattcggatttgacaaa

SEQ ID NO: 5800365 - DNA, 19 bp, Homo sapiens
tgattctaatgtcttcatt

SEQ ID NO: 5800366 - DNA, 20 bp, Homo sapiens
tgattctagtacataattga

SEQ ID NO: 5800367 - DNA, 14 bp, Homo sapiens
tgattctatgtaac

SEQ ID NO: 5800368 - DNA, 21 bp, Homo sapiens
tgattctatttatatgtacat

SEQ ID NO: 5800369 - DNA, 22 bp, Homo sapiens
tgattctatttatatgtacatg

SEQ ID NO: 5800370 - DNA, 12 bp, Homo sapiens
tgattctcaggg

SEQ ID NO: 5800371 - DNA, 15 bp, Homo sapiens
tgattctcagggctg

SEQ ID NO: 5800372 - DNA, 15 bp, Homo sapiens
tgattctcatgcctc

SEQ ID NO: 5800373 - DNA, 16 bp, Homo sapiens
tgattctcatgcctca

SEQ ID NO: 5800374 - DNA, 16 bp, Homo sapiens
tgattctcctgcctca

SEQ ID NO: 5800375 - DNA, 23 bp, Homo sapiens
tgattctcctgtcagagatctgg

SEQ ID NO: 5800376 - DNA, 14 bp, Homo sapiens
tgattctccttcag

SEQ ID NO: 5800377 - DNA, 16 bp, Homo sapiens
tgattctctgagtggt

SEQ ID NO: 5800378 - DNA, 14 bp, Homo sapiens
tgattctctgtggt

SEQ ID NO: 5800379 - DNA, 22 bp, Homo sapiens
tgattctcttagacacttttat

SEQ ID NO: 5800380 - DNA, 13 bp, Homo sapiens
tgattctcttagg

SEQ ID NO: 5800381 - DNA, 19 bp, Homo sapiens
tgattctgaagcttatgtt

SEQ ID NO: 5800382 - DNA, 20 bp, Homo sapiens
tgattctgaagcttatgttt

SEQ ID NO: 5800383 - DNA, 21 bp, Homo sapiens
tgattctgaagcttatgtttc

SEQ ID NO: 5800384 - DNA, 14 bp, Homo sapiens
tgattctgaatctg

SEQ ID NO: 5800385 - DNA, 21 bp, Homo sapiens
tgattctgataatgctcactt

SEQ ID NO: 5800386 - DNA, 16 bp, Homo sapiens
tgattctgcagtaaat

SEQ ID NO: 5800387 - DNA, 22 bp, Homo sapiens
tgattctgcagtaaatctttta

SEQ ID NO: 5800388 - DNA, 18 bp, Homo sapiens
tgattctgcttgagaata

SEQ ID NO: 5800389 - DNA, 17 bp, Homo sapiens
tgattctggctttaagc

SEQ ID NO: 5800390 - DNA, 13 bp, Homo sapiens
tgattctgtggct

SEQ ID NO: 5800391 - DNA, 16 bp, Homo sapiens
tgcaaaaataaaagga

SEQ ID NO: 5800392 - DNA, 13 bp, Homo sapiens
tgcaaaaataacc

SEQ ID NO: 5800393 - DNA, 21 bp, Homo sapiens
tgcaaaaatgaattcacccct

SEQ ID NO: 5800394 - DNA, 21 bp, Homo sapiens
tgcaaaaatgagttttcacct

SEQ ID NO: 5800395 - DNA, 20 bp, Homo sapiens
tgcaaaaatttttggattga

SEQ ID NO: 5800396 - DNA, 21 bp, Homo sapiens
tgcaaaacccatatccccggt

SEQ ID NO: 5800397 - DNA, 20 bp, Homo sapiens
tgcaaaaccggcaacctgta

SEQ ID NO: 5800398 - DNA, 21 bp, Homo sapiens
tgcaaaaccggcaacctgtaa

SEQ ID NO: 5800399 - DNA, 17 bp, Homo sapiens
tgcaaaaccttttactg

SEQ ID NO: 5800400 - DNA, 19 bp, Homo sapiens
tgcaaaaccttttactggt

SEQ ID NO: 5800401 - DNA, 13 bp, Homo sapiens
tgcaaaagaagtg

SEQ ID NO: 5800402 - DNA, 22 bp, Homo sapiens
tgcaaaagcaatcatagagaaa

SEQ ID NO: 5800403 - DNA, 19 bp, Homo sapiens
tgcaaaagcagctaaatgt

SEQ ID NO: 5800404 - DNA, 19 bp, Homo sapiens
tgcaaaagccaagaaagta

SEQ ID NO: 5800405 - DNA, 15 bp, Homo sapiens
tgcaaaaggaggtga

SEQ ID NO: 5800406 - DNA, 18 bp, Homo sapiens
tgcaaaaggttaagccat

SEQ ID NO: 5800407 - DNA, 19 bp, Homo sapiens
tgcaaaaggttaagccata

SEQ ID NO: 5800408 - DNA, 20 bp, Homo sapiens
tgcaaaagttctgacttgac

SEQ ID NO: 5800409 - DNA, 15 bp, Homo sapiens
tgcaaaataaatgtt

SEQ ID NO: 5800410 - DNA, 22 bp, Homo sapiens
tgcaaaataagtttttctttaa

SEQ ID NO: 5800411 - DNA, 23 bp, Homo sapiens
tgcaaaatacatgatgatttcag

SEQ ID NO: 5800412 - DNA, 15 bp, Homo sapiens
tgcaaaatagaagaa

SEQ ID NO: 5800413 - DNA, 17 bp, Homo sapiens
tgcaaaatagaagaaga

SEQ ID NO: 5800414 - DNA, 21 bp, Homo sapiens
tgcaaaatagggtaagaagat

SEQ ID NO: 5800415 - DNA, 15 bp, Homo sapiens
tgcaaaatataataa

SEQ ID NO: 5800416 - DNA, 19 bp, Homo sapiens
tgcaaaatattggtattaa

SEQ ID NO: 5800417 - DNA, 12 bp, Homo sapiens
tgcaaaatcact

SEQ ID NO: 5800418 - DNA, 15 bp, Homo sapiens
tgcaaaatcagtttt

SEQ ID NO: 5800419 - DNA, 22 bp, Homo sapiens
tgcaaaatctgttatagcttta

SEQ ID NO: 5800420 - DNA, 18 bp, Homo sapiens
tgcaaaatgaggaatgta

SEQ ID NO: 5800421 - DNA, 21 bp, Homo sapiens
tgcaaaatgaggaatgtatat

SEQ ID NO: 5800422 - DNA, 14 bp, Homo sapiens
tgcaaaatggaaat

SEQ ID NO: 5800423 - DNA, 12 bp, Homo sapiens
tgcaaaatgtct

SEQ ID NO: 5800424 - DNA, 14 bp, Homo sapiens
tgcaaaatgtctgt

SEQ ID NO: 5800425 - DNA, 14 bp, Homo sapiens
tgcaaaatgtcttg

SEQ ID NO: 5800426 - DNA, 22 bp, Homo sapiens
tgcaaaattagtacctcaaagt

SEQ ID NO: 5800427 - DNA, 15 bp, Homo sapiens
tgcaaaattgttttc

SEQ ID NO: 5800428 - DNA, 16 bp, Homo sapiens
tgcaaaattgttttca

SEQ ID NO: 5800429 - DNA, 19 bp, Homo sapiens
tgcaaaattgttttcactt

SEQ ID NO: 5800430 - DNA, 16 bp, Homo sapiens
tgcaaaatttagaaga

SEQ ID NO: 5800431 - DNA, 22 bp, Homo sapiens
tgcaaaatttagaagaaaagtt

SEQ ID NO: 5800432 - DNA, 23 bp, Homo sapiens
tgcaaaatttagaagaaaagtta

SEQ ID NO: 5800433 - DNA, 14 bp, Homo sapiens
tgcaaaatttccag

SEQ ID NO: 5800434 - DNA, 15 bp, Homo sapiens
tgcaaaatttccagt

SEQ ID NO: 5800435 - DNA, 16 bp, Homo sapiens
tgcaaaatttccagta

SEQ ID NO: 5800436 - DNA, 21 bp, Homo sapiens
tgcaaaatttgatgccaggac

SEQ ID NO: 5800437 - DNA, 16 bp, Homo sapiens
tgcaaacaacctgaat

SEQ ID NO: 5800438 - DNA, 19 bp, Homo sapiens
tgcaaacaacctgaatctt

SEQ ID NO: 5800439 - DNA, 21 bp, Homo sapiens
tgcaaacaacctgaatctttt

SEQ ID NO: 5800440 - DNA, 16 bp, Homo sapiens
tgcaaacaactgaaat

SEQ ID NO: 5800441 - DNA, 15 bp, Homo sapiens
tgcaaacacaccttg

SEQ ID NO: 5800442 - DNA, 14 bp, Homo sapiens
tgcaaacactgtgt

SEQ ID NO: 5800443 - DNA, 15 bp, Homo sapiens
tgcaaacactgtgta

SEQ ID NO: 5800444 - DNA, 17 bp, Homo sapiens
tgcaaacagaacagggt

SEQ ID NO: 5800445 - DNA, 16 bp, Homo sapiens
tgcaaacagaagtgca

SEQ ID NO: 5800446 - DNA, 20 bp, Homo sapiens
tgcaaacaggttgttttcta

SEQ ID NO: 5800447 - DNA, 13 bp, Homo sapiens
tgcaaacagtaac

SEQ ID NO: 5800448 - DNA, 12 bp, Homo sapiens
tgcaaacagtgt

SEQ ID NO: 5800449 - DNA, 20 bp, Homo sapiens
tgcaaacataacaaaatcac

SEQ ID NO: 5800450 - DNA, 17 bp, Homo sapiens
tgcaaacatcaacctgg

SEQ ID NO: 5800451 - DNA, 17 bp, Homo sapiens
tgcaaacatggagaaat

SEQ ID NO: 5800452 - DNA, 18 bp, Homo sapiens
tgcaaacatggagaaatc

SEQ ID NO: 5800453 - DNA, 20 bp, Homo sapiens
tgcaaacatggagaaatcta

SEQ ID NO: 5800454 - DNA, 14 bp, Homo sapiens
tgcaaacattacct

SEQ ID NO: 5800455 - DNA, 16 bp, Homo sapiens
tgcaaacattggaaga

SEQ ID NO: 5800456 - DNA, 18 bp, Homo sapiens
tgcaaacattggaagatt

SEQ ID NO: 5800457 - DNA, 22 bp, Homo sapiens
tgcaaaccacttctccatgctg

SEQ ID NO: 5800458 - DNA, 17 bp, Homo sapiens
tgcaaaccgttaggaaa

SEQ ID NO: 5800459 - DNA, 13 bp, Homo sapiens
tgcaaacctgctg

SEQ ID NO: 5800460 - DNA, 18 bp, Homo sapiens
tgcaaaccttcctgggag

SEQ ID NO: 5800461 - DNA, 17 bp, Homo sapiens
tgcaaacgctgcctgcc

SEQ ID NO: 5800462 - DNA, 21 bp, Homo sapiens
tgcaaacgctgcctgccggta

SEQ ID NO: 5800463 - DNA, 17 bp, Homo sapiens
tgcaaactctataaaga

SEQ ID NO: 5800464 - DNA, 18 bp, Homo sapiens
tgcaaactctataaagaa

SEQ ID NO: 5800465 - DNA, 22 bp, Homo sapiens
tgcaaactgggaacccctttcc

SEQ ID NO: 5800466 - DNA, 19 bp, Homo sapiens
tgcaaactgtgcttctcta

SEQ ID NO: 5800467 - DNA, 16 bp, Homo sapiens
tgcaaacttcagagtt

SEQ ID NO: 5800468 - DNA, 20 bp, Homo sapiens
tgcaaacttgtatctgaaga

SEQ ID NO: 5800469 - DNA, 18 bp, Homo sapiens
tgcaaacttttttatatc

SEQ ID NO: 5800470 - DNA, 20 bp, Homo sapiens
tgcaaacttttttatatctt

SEQ ID NO: 5800471 - DNA, 14 bp, Homo sapiens
tgcaaagaaaagaa

SEQ ID NO: 5800472 - DNA, 22 bp, Homo sapiens
tgcaaagaaagaaaaaaaacca

SEQ ID NO: 5800473 - DNA, 15 bp, Homo sapiens
tgcaaagaccacctc

SEQ ID NO: 5800474 - DNA, 16 bp, Homo sapiens
tgcaaagacctacctc

SEQ ID NO: 5800475 - DNA, 13 bp, Homo sapiens
tgcaaagactctg

SEQ ID NO: 5800476 - DNA, 14 bp, Homo sapiens
tgcaaagactctga

SEQ ID NO: 5800477 - DNA, 15 bp, Homo sapiens
tgcaaagactctgag

SEQ ID NO: 5800478 - DNA, 16 bp, Homo sapiens
tgcaaagactctgagc

SEQ ID NO: 5800479 - DNA, 21 bp, Homo sapiens
tgcaaagactctgagccaagg

SEQ ID NO: 5800480 - DNA, 13 bp, Homo sapiens
tgcaaagagaaac

SEQ ID NO: 5800481 - DNA, 15 bp, Homo sapiens
tgcaaagagaaaccg

SEQ ID NO: 5800482 - DNA, 14 bp, Homo sapiens
tgcaaagagacatt

SEQ ID NO: 5800483 - DNA, 13 bp, Homo sapiens
tgcaaagaggcaa

SEQ ID NO: 5800484 - DNA, 19 bp, Homo sapiens
tgcaaagaggcaagaggct

SEQ ID NO: 5800485 - DNA, 12 bp, Homo sapiens
tgcaaagatctg

SEQ ID NO: 5800486 - DNA, 23 bp, Homo sapiens
tgcaaagatgaaggtctgttttg

SEQ ID NO: 5800487 - DNA, 19 bp, Homo sapiens
tgcaaagatgattttgctt

SEQ ID NO: 5800488 - DNA, 17 bp, Homo sapiens
tgcaaagattgcctctt

SEQ ID NO: 5800489 - DNA, 12 bp, Homo sapiens
tgcaaagatttg

SEQ ID NO: 5800490 - DNA, 19 bp, Homo sapiens
tgcaaagcactctctgcag

SEQ ID NO: 5800491 - DNA, 20 bp, Homo sapiens
tgcaaagcactgacttctaa

SEQ ID NO: 5800492 - DNA, 13 bp, Homo sapiens
tgcaaagccaagg

SEQ ID NO: 5800493 - DNA, 16 bp, Homo sapiens
tgcaaagccaaggcag

SEQ ID NO: 5800494 - DNA, 18 bp, Homo sapiens
tgcaaagccagtgctgtc

SEQ ID NO: 5800495 - DNA, 15 bp, Homo sapiens
tgcaaagcctttaaa

SEQ ID NO: 5800496 - DNA, 16 bp, Homo sapiens
tgcaaagcgacagatt

SEQ ID NO: 5800497 - DNA, 21 bp, Homo sapiens
tgcaaagctctgtggccacat

SEQ ID NO: 5800498 - DNA, 10 bp, Homo sapiens
tgcaaagctg

SEQ ID NO: 5800499 - DNA, 22 bp, Homo sapiens
tgcaaagcttttgcctgcaaga

SEQ ID NO: 5800500 - DNA, 19 bp, Homo sapiens
tgcaaaggaaaataatcaa

SEQ ID NO: 5800501 - DNA, 13 bp, Homo sapiens
tgcaaaggaaata

SEQ ID NO: 5800502 - DNA, 13 bp, Homo sapiens
tgcaaaggacaga

SEQ ID NO: 5800503 - DNA, 15 bp, Homo sapiens
tgcaaaggacagatc

SEQ ID NO: 5800504 - DNA, 20 bp, Homo sapiens
tgcaaaggactgtaagcaga

SEQ ID NO: 5800505 - DNA, 20 bp, Homo sapiens
tgcaaaggagaagcacagct

SEQ ID NO: 5800506 - DNA, 16 bp, Homo sapiens
tgcaaaggagggcctc

SEQ ID NO: 5800507 - DNA, 20 bp, Homo sapiens
tgcaaaggagggcctcagag

SEQ ID NO: 5800508 - DNA, 21 bp, Homo sapiens
tgcaaaggagggcctcagaga

SEQ ID NO: 5800509 - DNA, 15 bp, Homo sapiens
tgcaaagggacattg

SEQ ID NO: 5800510 - DNA, 16 bp, Homo sapiens
tgcaaagggacattga

SEQ ID NO: 5800511 - DNA, 17 bp, Homo sapiens
tgcaaagggacattgaa

SEQ ID NO: 5800512 - DNA, 24 bp, Homo sapiens
tgcaaagggattactagagaaaga

SEQ ID NO: 5800513 - DNA, 20 bp, Homo sapiens
tgcaaaggtagggactggag

SEQ ID NO: 5800514 - DNA, 21 bp, Homo sapiens
tgcaaaggtggcaatgcttaa

SEQ ID NO: 5800515 - DNA, 23 bp, Homo sapiens
tgcaaagtacaatgtgtttttct

SEQ ID NO: 5800516 - DNA, 21 bp, Homo sapiens
tgcaaagtacaggtactttgt

SEQ ID NO: 5800517 - DNA, 15 bp, Homo sapiens
tgcaaagtactgtaa

SEQ ID NO: 5800518 - DNA, 15 bp, Homo sapiens
tgcaaagtattgtaa

SEQ ID NO: 5800519 - DNA, 16 bp, Homo sapiens
tgcaaagtattgtaaa

SEQ ID NO: 5800520 - DNA, 17 bp, Homo sapiens
tgcaaagtcaggaatca

SEQ ID NO: 5800521 - DNA, 18 bp, Homo sapiens
tgcaaagtcaggaatcat

SEQ ID NO: 5800522 - DNA, 22 bp, Homo sapiens
tgcaaagtcatgcaaaggctgg

SEQ ID NO: 5800523 - DNA, 22 bp, Homo sapiens
tgcaaagtcgacatactcattt

SEQ ID NO: 5800524 - DNA, 15 bp, Homo sapiens
tgcaaagtcgccagt

SEQ ID NO: 5800525 - DNA, 23 bp, Homo sapiens
tgcaaagtcgccagtcactgctg

SEQ ID NO: 5800526 - DNA, 15 bp, Homo sapiens
tgcaaagtctccaga

SEQ ID NO: 5800527 - DNA, 21 bp, Homo sapiens
tgcaaagtctccagaagaaaa

SEQ ID NO: 5800528 - DNA, 19 bp, Homo sapiens
tgcaaagtggcagggaccg

SEQ ID NO: 5800529 - DNA, 22 bp, Homo sapiens
tgcaaagtgttttctcagaaca

SEQ ID NO: 5800530 - DNA, 22 bp, Homo sapiens
tgcaaagtgttttgtaccagtg

SEQ ID NO: 5800531 - DNA, 14 bp, Homo sapiens
tgcaaagttctgtg

SEQ ID NO: 5800532 - DNA, 19 bp, Homo sapiens
tgcaaagttctgtgtttaa

SEQ ID NO: 5800533 - DNA, 19 bp, Homo sapiens
tgcaaataaagccttttaa

SEQ ID NO: 5800534 - DNA, 14 bp, Homo sapiens
tgcaaataaaggct

SEQ ID NO: 5800535 - DNA, 20 bp, Homo sapiens
tgcaaataaaggctctggaa

SEQ ID NO: 5800536 - DNA, 13 bp, Homo sapiens
tgcaaataaatat

SEQ ID NO: 5800537 - DNA, 18 bp, Homo sapiens
tgcaaataaattatgcaa

SEQ ID NO: 5800538 - DNA, 16 bp, Homo sapiens
tgcaaataagactctt

SEQ ID NO: 5800539 - DNA, 20 bp, Homo sapiens
tgcaaataaggacagcagct

SEQ ID NO: 5800540 - DNA, 23 bp, Homo sapiens
tgcaaataaggacagcagctggt

SEQ ID NO: 5800541 - DNA, 15 bp, Homo sapiens
tgcaaataagtgtat

SEQ ID NO: 5800542 - DNA, 21 bp, Homo sapiens
tgcaaataagtgtattttgaa

SEQ ID NO: 5800543 - DNA, 14 bp, Homo sapiens
tgcaaatagaaaac

SEQ ID NO: 5800544 - DNA, 22 bp, Homo sapiens
tgcaaatagattcagagaaatt

SEQ ID NO: 5800545 - DNA, 20 bp, Homo sapiens
tgcaaatagccttcctgacc

SEQ ID NO: 5800546 - DNA, 19 bp, Homo sapiens
tgcaaataggcagaatgga

SEQ ID NO: 5800547 - DNA, 18 bp, Homo sapiens
tgcaaatagtagacattt

SEQ ID NO: 5800548 - DNA, 15 bp, Homo sapiens
tgcaaatataaacat

SEQ ID NO: 5800549 - DNA, 16 bp, Homo sapiens
tgcaaatataaacatc

SEQ ID NO: 5800550 - DNA, 21 bp, Homo sapiens
tgcaaatatactttacttttt

SEQ ID NO: 5800551 - DNA, 23 bp, Homo sapiens
tgcaaatattagcaaagaagctt

SEQ ID NO: 5800552 - DNA, 21 bp, Homo sapiens
tgcaaatatttttttgtagat

SEQ ID NO: 5800553 - DNA, 19 bp, Homo sapiens
tgcaaatcctatgtgattt

SEQ ID NO: 5800554 - DNA, 14 bp, Homo sapiens
tgcaaatctggctt

SEQ ID NO: 5800555 - DNA, 13 bp, Homo sapiens
tgcaaatgaagga

SEQ ID NO: 5800556 - DNA, 22 bp, Homo sapiens
tgcaaatgaaggaatgcaataa

SEQ ID NO: 5800557 - DNA, 13 bp, Homo sapiens
tgcaaatgaatca

SEQ ID NO: 5800558 - DNA, 14 bp, Homo sapiens
tgcaaatgaatcat

SEQ ID NO: 5800559 - DNA, 16 bp, Homo sapiens
tgcaaatgaatcattg

SEQ ID NO: 5800560 - DNA, 19 bp, Homo sapiens
tgcaaatgaatgcctttca

SEQ ID NO: 5800561 - DNA, 20 bp, Homo sapiens
tgcaaatgaatgcctttcaa

SEQ ID NO: 5800562 - DNA, 21 bp, Homo sapiens
tgcaaatgagctctgaaatct

SEQ ID NO: 5800563 - DNA, 15 bp, Homo sapiens
tgcaaatgcaacaaa

SEQ ID NO: 5800564 - DNA, 17 bp, Homo sapiens
tgcaaatggagataaaa

SEQ ID NO: 5800565 - DNA, 22 bp, Homo sapiens
tgcaaatgtcagatacaatgta

SEQ ID NO: 5800566 - DNA, 18 bp, Homo sapiens
tgcaaatgtcttccaggt

SEQ ID NO: 5800567 - DNA, 22 bp, Homo sapiens
tgcaaattaaaacatatttcat

SEQ ID NO: 5800568 - DNA, 16 bp, Homo sapiens
tgcaattactgcctgc

SEQ ID NO: 5800569 - DNA, 19 bp, Homo sapiens
tgcaattactgcctgcaga

SEQ ID NO: 5800570 - DNA, 23 bp, Homo sapiens
tgcaattaggtttttccttattt

SEQ ID NO: 5800571 - DNA, 23 bp, Homo sapiens
tgcaattattctaattttatata

SEQ ID NO: 5800572 - DNA, 17 bp, Homo sapiens
tgcaattcaaaagttcc

SEQ ID NO: 5800573 - DNA, 18 bp, Homo sapiens
tgcaattcaaaagttcca

SEQ ID NO: 5800574 - DNA, 13 bp, Homo sapiens
tgcaattcaatgc

SEQ ID NO: 5800575 - DNA, 15 bp, Homo sapiens
tgcaattcagtgttc

SEQ ID NO: 5800576 - DNA, 13 bp, Homo sapiens
tgcaattcatgta

SEQ ID NO: 5800577 - DNA, 16 bp, Homo sapiens
tgcaattcatgtaaca

SEQ ID NO: 5800578 - DNA, 19 bp, Homo sapiens
tgcaattccaagaaaatat

SEQ ID NO: 5800579 - DNA, 14 bp, Homo sapiens
tgcaattgagggct

SEQ ID NO: 5800580 - DNA, 14 bp, Homo sapiens
tgcaattgctccca

SEQ ID NO: 5800581 - DNA, 18 bp, Homo sapiens
tgcaattgctcttctcca

SEQ ID NO: 5800582 - DNA, 15 bp, Homo sapiens
tgcaattgcttagga

SEQ ID NO: 5800583 - DNA, 22 bp, Homo sapiens
tgcaattggcaccgaagcccag

SEQ ID NO: 5800584 - DNA, 23 bp, Homo sapiens
tgcaattgtaaacagaaattgca

SEQ ID NO: 5800585 - DNA, 15 bp, Homo sapiens
tgcaattgtacaaaa

SEQ ID NO: 5800586 - DNA, 21 bp, Homo sapiens
tgcaattgtcttttttttcct

SEQ ID NO: 5800587 - DNA, 17 bp, Homo sapiens
tgcaattgtttaagaat

SEQ ID NO: 5800588 - DNA, 18 bp, Homo sapiens
tgcaatttattaaaatga

SEQ ID NO: 5800589 - DNA, 17 bp, Homo sapiens
tgcaatttcaaggttct

SEQ ID NO: 5800590 - DNA, 18 bp, Homo sapiens
tgcaatttcaaggttcta

SEQ ID NO: 5800591 - DNA, 16 bp, Homo sapiens
tgcaatttcccctctg

SEQ ID NO: 5800592 - DNA, 13 bp, Homo sapiens
tgcaatttctgta

SEQ ID NO: 5800593 - DNA, 16 bp, Homo sapiens
tgcaatttctgtacat

SEQ ID NO: 5800594 - DNA, 16 bp, Homo sapiens
tgcaatttcttctgta

SEQ ID NO: 5800595 - DNA, 14 bp, Homo sapiens
tgcaatttgacttg

SEQ ID NO: 5800596 - DNA, 17 bp, Homo sapiens
tgcaatttgagccattt

SEQ ID NO: 5800597 - DNA, 20 bp, Homo sapiens
tgcaatttgagccatttaaa

SEQ ID NO: 5800598 - DNA, 20 bp, Homo sapiens
tgcaatttgataatcagttt

SEQ ID NO: 5800599 - DNA, 17 bp, Homo sapiens
tgcaatttgtaaatatt

SEQ ID NO: 5800600 - DNA, 18 bp, Homo sapiens
tgcaatttgtaaatattg

SEQ ID NO: 5800601 - DNA, 13 bp, Homo sapiens
tgcaatttgtctt

SEQ ID NO: 5800602 - DNA, 14 bp, Homo sapiens
tgcaatttgtcttt

SEQ ID NO: 5800603 - DNA, 17 bp, Homo sapiens
tgcaatttgtctttgga

SEQ ID NO: 5800604 - DNA, 18 bp, Homo sapiens
tgcaatttgtctttggaa

SEQ ID NO: 5800605 - DNA, 19 bp, Homo sapiens
tgcaatttgtctttggaaa

SEQ ID NO: 5800606 - DNA, 17 bp, Homo sapiens
tgcaatttgtttaaaga

SEQ ID NO: 5800607 - DNA, 22 bp, Homo sapiens
tgcaatttgtttaaagaataaa

SEQ ID NO: 5800608 - DNA, 19 bp, Homo sapiens
tgcaatttgtttgtgcttc

SEQ ID NO: 5800609 - DNA, 21 bp, Homo sapiens
tgcaatttgtttgtgcttcta

SEQ ID NO: 5800610 - DNA, 15 bp, Homo sapiens
tgcaattttactgtg

SEQ ID NO: 5800611 - DNA, 19 bp, Homo sapiens
tgcaattttactgtgaaaa

SEQ ID NO: 5800612 - DNA, 22 bp, Homo sapiens
tgcaattttataaggacttcct

SEQ ID NO: 5800613 - DNA, 23 bp, Homo sapiens
tgcaattttctaagcaatttctt

SEQ ID NO: 5800614 - DNA, 17 bp, Homo sapiens
tgcaatttttaaactag

SEQ ID NO: 5800615 - DNA, 19 bp, Homo sapiens
tgcacaaacagaggccgcc

SEQ ID NO: 5800616 - DNA, 20 bp, Homo sapiens
tgcacaaacagaggccgcca

SEQ ID NO: 5800617 - DNA, 20 bp, Homo sapiens
tgcacaaacatagacagatg

SEQ ID NO: 5800618 - DNA, 23 bp, Homo sapiens
tgcacaaacttgtgagcatcaga

SEQ ID NO: 5800619 - DNA, 22 bp, Homo sapiens
tgcacaacagccctgcctgaga

SEQ ID NO: 5800620 - DNA, 16 bp, Homo sapiens
tgcacaactctccaaa

SEQ ID NO: 5800621 - DNA, 14 bp, Homo sapiens
tgcacaagaatgga

SEQ ID NO: 5800622 - DNA, 16 bp, Homo sapiens
tgcacaagaatggatc

SEQ ID NO: 5800623 - DNA, 20 bp, Homo sapiens
tgcacaagaatggatcacaa

SEQ ID NO: 5800624 - DNA, 19 bp, Homo sapiens
tgcacaaggaaataaagcg

SEQ ID NO: 5800625 - DNA, 20 bp, Homo sapiens
tgcacaaggaaataaagcgt

SEQ ID NO: 5800626 - DNA, 23 bp, Homo sapiens
tgcacaaggacattgtatgcagg

SEQ ID NO: 5800627 - DNA, 12 bp, Homo sapiens
tgcacaaggatt

SEQ ID NO: 5800628 - DNA, 15 bp, Homo sapiens
tgcacaaggattgaa

SEQ ID NO: 5800629 - DNA, 18 bp, Homo sapiens
tgcacaaggattgaaaat

SEQ ID NO: 5800630 - DNA, 22 bp, Homo sapiens
tgcacaagttccctggagaaaa

SEQ ID NO: 5800631 - DNA, 21 bp, Homo sapiens
tgcacaataaaaatgtttaac

SEQ ID NO: 5800632 - DNA, 14 bp, Homo sapiens
tgcacaataaacat

SEQ ID NO: 5800633 - DNA, 18 bp, Homo sapiens
tgcacaataactcctccc

SEQ ID NO: 5800634 - DNA, 19 bp, Homo sapiens
tgcacaataactcctccca

SEQ ID NO: 5800635 - DNA, 21 bp, Homo sapiens
tgcacaataactcctcccagg

SEQ ID NO: 5800636 - DNA, 22 bp, Homo sapiens
tgcacaataactcctcccaggg

SEQ ID NO: 5800637 - DNA, 14 bp, Homo sapiens
tgcacaatatttct

SEQ ID NO: 5800638 - DNA, 16 bp, Homo sapiens
tgcacaatatttcttt

SEQ ID NO: 5800639 - DNA, 23 bp, Homo sapiens
tgcacaatcaataaaaatggcat

SEQ ID NO: 5800640 - DNA, 15 bp, Homo sapiens
tgcacaatgaccagc

SEQ ID NO: 5800641 - DNA, 13 bp, Homo sapiens
tgcacaatgggca

SEQ ID NO: 5800642 - DNA, 13 bp, Homo sapiens
tgcacaatttaga

SEQ ID NO: 5800643 - DNA, 18 bp, Homo sapiens
tgcacaatttagaaaaca

SEQ ID NO: 5800644 - DNA, 12 bp, Homo sapiens
tgcacaatttga

SEQ ID NO: 5800645 - DNA, 17 bp, Homo sapiens
tgcacaattttgataaa

SEQ ID NO: 5800646 - DNA, 18 bp, Homo sapiens
tgcacaattttgtcctaa

SEQ ID NO: 5800647 - DNA, 15 bp, Homo sapiens
tgcacacaaacacct

SEQ ID NO: 5800648 - DNA, 17 bp, Homo sapiens
tgcacacaattagattt

SEQ ID NO: 5800649 - DNA, 10 bp, Homo sapiens
tgcacacaca

SEQ ID NO: 5800650 - DNA, 18 bp, Homo sapiens
tgcacacacacacacatg

SEQ ID NO: 5800651 - DNA, 13 bp, Homo sapiens
tgcacacacacag

SEQ ID NO: 5800652 - DNA, 16 bp, Homo sapiens
tgcacacacacagaga

SEQ ID NO: 5800653 - DNA, 17 bp, Homo sapiens
tgcacacacactagcct

SEQ ID NO: 5800654 - DNA, 23 bp, Homo sapiens
tgcacacacagatgcacacacag

SEQ ID NO: 5800655 - DNA, 13 bp, Homo sapiens
tgcacacacagct

SEQ ID NO: 5800656 - DNA, 13 bp, Homo sapiens
tgcacacacatat

SEQ ID NO: 5800657 - DNA, 14 bp, Homo sapiens
tgcacacacatgca

SEQ ID NO: 5800658 - DNA, 14 bp, Homo sapiens
tgcacacacatgga

SEQ ID NO: 5800659 - DNA, 22 bp, Homo sapiens
tgcacacaccagagcccacctt

SEQ ID NO: 5800660 - DNA, 18 bp, Homo sapiens
tgcacacacctgcacacc

SEQ ID NO: 5800661 - DNA, 16 bp, Homo sapiens
tgcacacacctgcctg

SEQ ID NO: 5800662 - DNA, 17 bp, Homo sapiens
tgcacacagaaatatat

SEQ ID NO: 5800663 - DNA, 22 bp, Homo sapiens
tgcacacagaaatatatataca

SEQ ID NO: 5800664 - DNA, 12 bp, Homo sapiens
tgcacacagcac

SEQ ID NO: 5800665 - DNA, 18 bp, Homo sapiens
tgcacacagcggctgcct

SEQ ID NO: 5800666 - DNA, 21 bp, Homo sapiens
tgcacacagctaggcatgcct

SEQ ID NO: 5800667 - DNA, 13 bp, Homo sapiens
tgcacacaggaca

SEQ ID NO: 5800668 - DNA, 17 bp, Homo sapiens
tgcacacaggacagcgg

SEQ ID NO: 5800669 - DNA, 18 bp, Homo sapiens
tgcacacaggagaaaatg

SEQ ID NO: 5800670 - DNA, 13 bp, Homo sapiens
tgcacacagtgac

SEQ ID NO: 5800671 - DNA, 16 bp, Homo sapiens
tgcacacatcaccagg

SEQ ID NO: 5800672 - DNA, 17 bp, Homo sapiens
tgcacacatcatctgta

SEQ ID NO: 5800673 - DNA, 12 bp, Homo sapiens
tgcacacatttt

SEQ ID NO: 5800674 - DNA, 22 bp, Homo sapiens
tgcacaccaaaaaaatacttga

SEQ ID NO: 5800675 - DNA, 20 bp, Homo sapiens
tgcacaccaaattgctgaga

SEQ ID NO: 5800676 - DNA, 22 bp, Homo sapiens
tgcacaccaaattgctgagatg

SEQ ID NO: 5800677 - DNA, 13 bp, Homo sapiens
tgcacaccaaggc

SEQ ID NO: 5800678 - DNA, 22 bp, Homo sapiens
tgcacaccaccctcccgctgca

SEQ ID NO: 5800679 - DNA, 15 bp, Homo sapiens
tgcacaccagagaca

SEQ ID NO: 5800680 - DNA, 12 bp, Homo sapiens
tgcacacccact

SEQ ID NO: 5800681 - DNA, 14 bp, Homo sapiens
tgcacacccactca

SEQ ID NO: 5800682 - DNA, 13 bp, Homo sapiens
tgcacacccactg

SEQ ID NO: 5800683 - DNA, 15 bp, Homo sapiens
tgcacacccactgcc

SEQ ID NO: 5800684 - DNA, 17 bp, Homo sapiens
tgcacacccactgcccc

SEQ ID NO: 5800685 - DNA, 20 bp, Homo sapiens
tgcacacccactgccccgtg

SEQ ID NO: 5800686 - DNA, 20 bp, Homo sapiens
tgcacaccctccagagacaa

SEQ ID NO: 5800687 - DNA, 16 bp, Homo sapiens
tgcacaccctgggcca

SEQ ID NO: 5800688 - DNA, 18 bp, Homo sapiens
tgcacaccgtccctctcc

SEQ ID NO: 5800689 - DNA, 22 bp, Homo sapiens
tgcacaccgtccctctccccgg

SEQ ID NO: 5800690 - DNA, 23 bp, Homo sapiens
tgcacaccgtgtgccatagaatg

SEQ ID NO: 5800691 - DNA, 17 bp, Homo sapiens
tgcacacctttattcag

SEQ ID NO: 5800692 - DNA, 20 bp, Homo sapiens
tgcacaccttttccccagga

SEQ ID NO: 5800693 - DNA, 22 bp, Homo sapiens
tgcacaccttttccccaggagc

SEQ ID NO: 5800694 - DNA, 20 bp, Homo sapiens
tgcacacgcacatagagata

SEQ ID NO: 5800695 - DNA, 15 bp, Homo sapiens
tgcacacggatgcac

SEQ ID NO: 5800696 - DNA, 18 bp, Homo sapiens
tgcacacggcacagagca

SEQ ID NO: 5800697 - DNA, 18 bp, Homo sapiens
tgcacacggctggtcact

SEQ ID NO: 5800698 - DNA, 13 bp, Homo sapiens
tgcacacgggcga

SEQ ID NO: 5800699 - DNA, 15 bp, Homo sapiens
tgcacacgggcgagc

SEQ ID NO: 5800700 - DNA, 13 bp, Homo sapiens
tgcacacgtgtgt

SEQ ID NO: 5800701 - DNA, 16 bp, Homo sapiens
tgcacacgtgtgtatg

SEQ ID NO: 5800702 - DNA, 21 bp, Homo sapiens
tgcacactagcctctccagga

SEQ ID NO: 5800703 - DNA, 16 bp, Homo sapiens
tgcacactccaggcct

SEQ ID NO: 5800704 - DNA, 14 bp, Homo sapiens
tgcacactgagaat

SEQ ID NO: 5800705 - DNA, 16 bp, Homo sapiens
tgcacactgcacattt

SEQ ID NO: 5800706 - DNA, 21 bp, Homo sapiens
tgcacactgtcctattatatt

SEQ ID NO: 5800707 - DNA, 18 bp, Homo sapiens
tgcacactgttggaatgt

SEQ ID NO: 5800708 - DNA, 17 bp, Homo sapiens
tgcacactttggcccag

SEQ ID NO: 5800709 - DNA, 21 bp, Homo sapiens
tgcacactttggcccagggtg

SEQ ID NO: 5800710 - DNA, 12 bp, Homo sapiens
tgcacagaaaac

SEQ ID NO: 5800711 - DNA, 16 bp, Homo sapiens
tgcacagaacaagcca

SEQ ID NO: 5800712 - DNA, 17 bp, Homo sapiens
tgcacagaagggctctt

SEQ ID NO: 5800713 - DNA, 21 bp, Homo sapiens
tgcacagacctcagagatggc

SEQ ID NO: 5800714 - DNA, 13 bp, Homo sapiens
tgcacagagaagc

SEQ ID NO: 5800715 - DNA, 12 bp, Homo sapiens
tgcacagagccc

SEQ ID NO: 5800716 - DNA, 13 bp, Homo sapiens
tgcacagagccca

SEQ ID NO: 5800717 - DNA, 19 bp, Homo sapiens
tgcacagagcccaatgcat

SEQ ID NO: 5800718 - DNA, 12 bp, Homo sapiens
tgcacagagctc

SEQ ID NO: 5800719 - DNA, 14 bp, Homo sapiens
tgcacagagctctc

SEQ ID NO: 5800720 - DNA, 21 bp, Homo sapiens
tgcacagagctctccagctcc

SEQ ID NO: 5800721 - DNA, 20 bp, Homo sapiens
tgcacagagggcgctcctgt

SEQ ID NO: 5800722 - DNA, 18 bp, Homo sapiens
tgcacagagttgttacat

SEQ ID NO: 5800723 - DNA, 20 bp, Homo sapiens
tgcacagagttgttacattt

SEQ ID NO: 5800724 - DNA, 23 bp, Homo sapiens
tgcacagagttgttacattttta

SEQ ID NO: 5800725 - DNA, 15 bp, Homo sapiens
tgcacagatgccatg

SEQ ID NO: 5800726 - DNA, 23 bp, Homo sapiens
tgcacagatgccatggcctgtgc

SEQ ID NO: 5800727 - DNA, 21 bp, Homo sapiens
tgcacagattaaacttcacct

SEQ ID NO: 5800728 - DNA, 19 bp, Homo sapiens
tgcacagattcccaggcca

SEQ ID NO: 5800729 - DNA, 22 bp, Homo sapiens
tgcacagattcccaggccaggg

SEQ ID NO: 5800730 - DNA, 21 bp, Homo sapiens
tgcacagattctttttttctg

SEQ ID NO: 5800731 - DNA, 22 bp, Homo sapiens
tgcacagattgctgaaactgtg

SEQ ID NO: 5800732 - DNA, 22 bp, Homo sapiens
tgcacagcacaaattagttata

SEQ ID NO: 5800733 - DNA, 15 bp, Homo sapiens
tgcacagcatttgct

SEQ ID NO: 5800734 - DNA, 20 bp, Homo sapiens
tgcacagccactccccggca

SEQ ID NO: 5800735 - DNA, 14 bp, Homo sapiens
tgcacagcgcgggc

SEQ ID NO: 5800736 - DNA, 17 bp, Homo sapiens
tgcacagcgcgggcgga

SEQ ID NO: 5800737 - DNA, 18 bp, Homo sapiens
tgcacagcggcccctgca

SEQ ID NO: 5800738 - DNA, 17 bp, Homo sapiens
tgcacagcgtcctgtcc

SEQ ID NO: 5800739 - DNA, 23 bp, Homo sapiens
tgcacagctgcttgtcctgctct

SEQ ID NO: 5800740 - DNA, 11 bp, Homo sapiens
tgcacagctgt

SEQ ID NO: 5800741 - DNA, 15 bp, Homo sapiens
tgcacagctgtttga

SEQ ID NO: 5800742 - DNA, 16 bp, Homo sapiens
tgcacagcttcctgag

SEQ ID NO: 5800743 - DNA, 20 bp, Homo sapiens
tgcacaggaagatattggtg

SEQ ID NO: 5800744 - DNA, 18 bp, Homo sapiens
tgcacaggatgctggcct

SEQ ID NO: 5800745 - DNA, 12 bp, Homo sapiens
tgcacaggcagc

SEQ ID NO: 5800746 - DNA, 23 bp, Homo sapiens
tgcactgaatcgtttcatgtaag

SEQ ID NO: 5800747 - DNA, 10 bp, Homo sapiens
tgcactgaca

SEQ ID NO: 5800748 - DNA, 13 bp, Homo sapiens
tgcactgacaaga

SEQ ID NO: 5800749 - DNA, 12 bp, Homo sapiens
tgcactgacagc

SEQ ID NO: 5800750 - DNA, 14 bp, Homo sapiens
tgcactgacatgtt

SEQ ID NO: 5800751 - DNA, 21 bp, Homo sapiens
tgcactgacatgtttcacaac

SEQ ID NO: 5800752 - DNA, 21 bp, Homo sapiens
tgcactgacattgttggccaa

SEQ ID NO: 5800753 - DNA, 15 bp, Homo sapiens
tgcactgacccttcc

SEQ ID NO: 5800754 - DNA, 16 bp, Homo sapiens
tgcactgacccttcca

SEQ ID NO: 5800755 - DNA, 23 bp, Homo sapiens
tgcactgacccttccagacatac

SEQ ID NO: 5800756 - DNA, 23 bp, Homo sapiens
tgcactgacctgctccgccagga

SEQ ID NO: 5800757 - DNA, 14 bp, Homo sapiens
tgcactgagaacag

SEQ ID NO: 5800758 - DNA, 17 bp, Homo sapiens
tgcactgagagggcaag

SEQ ID NO: 5800759 - DNA, 17 bp, Homo sapiens
tgcactgaggatttctt

SEQ ID NO: 5800760 - DNA, 14 bp, Homo sapiens
tgcactgagggcca

SEQ ID NO: 5800761 - DNA, 19 bp, Homo sapiens
tgcactgagggccacacta

SEQ ID NO: 5800762 - DNA, 16 bp, Homo sapiens
tgcactgaggtttttt

SEQ ID NO: 5800763 - DNA, 23 bp, Homo sapiens
tgcactgagtgaaggaagagaga

SEQ ID NO: 5800764 - DNA, 22 bp, Homo sapiens
tgcactgatatatcatgagtga

SEQ ID NO: 5800765 - DNA, 22 bp, Homo sapiens
tgcactgatcttactctactgc

SEQ ID NO: 5800766 - DNA, 22 bp, Homo sapiens
tgcactgatgctgcccctcatc

SEQ ID NO: 5800767 - DNA, 19 bp, Homo sapiens
tgcactgatgtccctcctt

SEQ ID NO: 5800768 - DNA, 13 bp, Homo sapiens
tgcactgatgttg

SEQ ID NO: 5800769 - DNA, 14 bp, Homo sapiens
tgcactgatgttgt

SEQ ID NO: 5800770 - DNA, 22 bp, Homo sapiens
tgcactgcatgcaaacaagaaa

SEQ ID NO: 5800771 - DNA, 19 bp, Homo sapiens
tgcactgcccatggacagg

SEQ ID NO: 5800772 - DNA, 23 bp, Homo sapiens
tgcactgccctgttcatgtgcct

SEQ ID NO: 5800773 - DNA, 13 bp, Homo sapiens
tgcactgctgttc

SEQ ID NO: 5800774 - DNA, 18 bp, Homo sapiens
tgcactgctgttcctgct

SEQ ID NO: 5800775 - DNA, 18 bp, Homo sapiens
tgcactgctttattttag

SEQ ID NO: 5800776 - DNA, 15 bp, Homo sapiens
tgcactggagccaca

SEQ ID NO: 5800777 - DNA, 18 bp, Homo sapiens
tgcactggagccacaggc

SEQ ID NO: 5800778 - DNA, 15 bp, Homo sapiens
tgcactggagtccag

SEQ ID NO: 5800779 - DNA, 19 bp, Homo sapiens
tgcactggagtccagtctc

SEQ ID NO: 5800780 - DNA, 20 bp, Homo sapiens
tgcactggagtccagtctct

SEQ ID NO: 5800781 - DNA, 12 bp, Homo sapiens
tgcactggccac

SEQ ID NO: 5800782 - DNA, 17 bp, Homo sapiens
tgcactggccccaccct

SEQ ID NO: 5800783 - DNA, 12 bp, Homo sapiens
tgcactggcctg

SEQ ID NO: 5800784 - DNA, 15 bp, Homo sapiens
tgcactgggaaggaa

SEQ ID NO: 5800785 - DNA, 19 bp, Homo sapiens
tgcactgggaaggaaacaa

SEQ ID NO: 5800786 - DNA, 12 bp, Homo sapiens
tgcactgggagg

SEQ ID NO: 5800787 - DNA, 12 bp, Homo sapiens
tgcactgggcag

SEQ ID NO: 5800788 - DNA, 20 bp, Homo sapiens
tgcactgggcaggttcctgg

SEQ ID NO: 5800789 - DNA, 23 bp, Homo sapiens
tgcactgggcaggttcctggggc

SEQ ID NO: 5800790 - DNA, 19 bp, Homo sapiens
tgcactggggcgtttccta

SEQ ID NO: 5800791 - DNA, 22 bp, Homo sapiens
tgcactgggggaacagatgcta

SEQ ID NO: 5800792 - DNA, 15 bp, Homo sapiens
tgcactgggtgtggc

SEQ ID NO: 5800793 - DNA, 16 bp, Homo sapiens
tgcactgggtgtggcc

SEQ ID NO: 5800794 - DNA, 13 bp, Homo sapiens
tgcactgtaaaat

SEQ ID NO: 5800795 - DNA, 15 bp, Homo sapiens
tgcactgtaaatatc

SEQ ID NO: 5800796 - DNA, 17 bp, Homo sapiens
tgcactgtaaatatccc

SEQ ID NO: 5800797 - DNA, 15 bp, Homo sapiens
tgcactgtaatgagg

SEQ ID NO: 5800798 - DNA, 19 bp, Homo sapiens
tgcactgtcactttgctct

SEQ ID NO: 5800799 - DNA, 12 bp, Homo sapiens
tgcactgtccag

SEQ ID NO: 5800800 - DNA, 14 bp, Homo sapiens
tgcactgtcctgct

SEQ ID NO: 5800801 - DNA, 21 bp, Homo sapiens
tgcactgtcctgctccacagt

SEQ ID NO: 5800802 - DNA, 23 bp, Homo sapiens
tgcactgtcctgctccacagtgt

SEQ ID NO: 5800803 - DNA, 12 bp, Homo sapiens
tgcactgtctca

SEQ ID NO: 5800804 - DNA, 11 bp, Homo sapiens
tgcactgtctg

SEQ ID NO: 5800805 - DNA, 17 bp, Homo sapiens
tgcactgtctgtaccta

SEQ ID NO: 5800806 - DNA, 18 bp, Homo sapiens
tgcactgtgcttgctcct

SEQ ID NO: 5800807 - DNA, 15 bp, Homo sapiens
tgcactgtggtttca

SEQ ID NO: 5800808 - DNA, 21 bp, Homo sapiens
tgcactgtggtttcagatgtg

SEQ ID NO: 5800809 - DNA, 17 bp, Homo sapiens
tgcactgtgtgctgact

SEQ ID NO: 5800810 - DNA, 18 bp, Homo sapiens
tgcactgtgtgctgactg

SEQ ID NO: 5800811 - DNA, 13 bp, Homo sapiens
tgcactgttcccc

SEQ ID NO: 5800812 - DNA, 21 bp, Homo sapiens
tgcactgttccccctgtgcag

SEQ ID NO: 5800813 - DNA, 22 bp, Homo sapiens
tgcactgtttatggaaatacca

SEQ ID NO: 5800814 - DNA, 13 bp, Homo sapiens
tgcactgtttgca

SEQ ID NO: 5800815 - DNA, 17 bp, Homo sapiens
tgcacttaaatatcaat

SEQ ID NO: 5800816 - DNA, 18 bp, Homo sapiens
tgcacttaacaagctccc

SEQ ID NO: 5800817 - DNA, 23 bp, Homo sapiens
tgcacttaatattagcttgctta

SEQ ID NO: 5800818 - DNA, 15 bp, Homo sapiens
tgcacttaatggctg

SEQ ID NO: 5800819 - DNA, 16 bp, Homo sapiens
tgcacttacttgctta

SEQ ID NO: 5800820 - DNA, 15 bp, Homo sapiens
tgcacttagccatga

SEQ ID NO: 5800821 - DNA, 20 bp, Homo sapiens
tgcacttatatagcaccttt

SEQ ID NO: 5800822 - DNA, 21 bp, Homo sapiens
tgcacttatctcgaatttgaa

SEQ ID NO: 5800823 - DNA, 20 bp, Homo sapiens
tgcacttatgatttcatgtg

SEQ ID NO: 5800824 - DNA, 18 bp, Homo sapiens
tgcacttatgtacttgat

SEQ ID NO: 5800825 - DNA, 23 bp, Homo sapiens
tgcacttattgaccattttttaa

SEQ ID NO: 5800826 - DNA, 16 bp, Homo sapiens
tgcacttcatcccgga

SEQ ID NO: 5800827 - DNA, 18 bp, Homo sapiens
tgcacttcggataatttt

SEQ ID NO: 5800828 - DNA, 20 bp, Homo sapiens
tgcacttcggataattttca

SEQ ID NO: 5800829 - DNA, 22 bp, Homo sapiens
tgcacttcggataattttcatt

SEQ ID NO: 5800830 - DNA, 13 bp, Homo sapiens
tgcacttctattt

SEQ ID NO: 5800831 - DNA, 16 bp, Homo sapiens
tgcacttctgtaaact

SEQ ID NO: 5800832 - DNA, 13 bp, Homo sapiens
tgcacttctgttc

SEQ ID NO: 5800833 - DNA, 17 bp, Homo sapiens
tgcacttctgttccagg

SEQ ID NO: 5800834 - DNA, 18 bp, Homo sapiens
tgcacttgattcaggagg

SEQ ID NO: 5800835 - DNA, 16 bp, Homo sapiens
tgcacttggcctcagc

SEQ ID NO: 5800836 - DNA, 24 bp, Homo sapiens
tgcacttggcctcagctggctgta

SEQ ID NO: 5800837 - DNA, 14 bp, Homo sapiens
tgcacttggcctct

SEQ ID NO: 5800838 - DNA, 15 bp, Homo sapiens
tgcacttggcctctg

SEQ ID NO: 5800839 - DNA, 15 bp, Homo sapiens
tgcacttggcctctt

SEQ ID NO: 5800840 - DNA, 20 bp, Homo sapiens
tgcacttggcctcttcggga

SEQ ID NO: 5800841 - DNA, 16 bp, Homo sapiens
tgcacttggctgcata

SEQ ID NO: 5800842 - DNA, 17 bp, Homo sapiens
tgcacttggggcacagg

SEQ ID NO: 5800843 - DNA, 19 bp, Homo sapiens
tgcacttgggggctcagca

SEQ ID NO: 5800844 - DNA, 22 bp, Homo sapiens
tgcacttgggggctcagcaagg

SEQ ID NO: 5800845 - DNA, 19 bp, Homo sapiens
tgcactttagacatttttg

SEQ ID NO: 5800846 - DNA, 21 bp, Homo sapiens
tgcactttcagactctctctg

SEQ ID NO: 5800847 - DNA, 17 bp, Homo sapiens
tgcactttccctagaaa

SEQ ID NO: 5800848 - DNA, 18 bp, Homo sapiens
tgcactttccctagaaag

SEQ ID NO: 5800849 - DNA, 21 bp, Homo sapiens
tgcactttcctccacctccca

SEQ ID NO: 5800850 - DNA, 19 bp, Homo sapiens
tgcactttcctttcaataa

SEQ ID NO: 5800851 - DNA, 23 bp, Homo sapiens
tgcactttcctttcaataaagtt

SEQ ID NO: 5800852 - DNA, 22 bp, Homo sapiens
tgcactttctcggtccactctt

SEQ ID NO: 5800853 - DNA, 17 bp, Homo sapiens
tgcactttgctttaata

SEQ ID NO: 5800854 - DNA, 12 bp, Homo sapiens
tgcactttgtaa

SEQ ID NO: 5800855 - DNA, 14 bp, Homo sapiens
tgcactttgtaaat

SEQ ID NO: 5800856 - DNA, 15 bp, Homo sapiens
tgcactttgtaaatt

SEQ ID NO: 5800857 - DNA, 12 bp, Homo sapiens
tgcactttgttc

SEQ ID NO: 5800858 - DNA, 14 bp, Homo sapiens
tgcactttgttctg

SEQ ID NO: 5800859 - DNA, 18 bp, Homo sapiens
tgcactttgttctggctc

SEQ ID NO: 5800860 - DNA, 19 bp, Homo sapiens
tgcacttttagaaatgcat

SEQ ID NO: 5800861 - DNA, 16 bp, Homo sapiens
tgcacttttagccaga

SEQ ID NO: 5800862 - DNA, 20 bp, Homo sapiens
tgcacttttatgaagttttt

SEQ ID NO: 5800863 - DNA, 22 bp, Homo sapiens
tgcacttttatgaagtttttaa

SEQ ID NO: 5800864 - DNA, 14 bp, Homo sapiens
tgcacttttcccca

SEQ ID NO: 5800865 - DNA, 22 bp, Homo sapiens
tgcacttttgaaataaagtatt

SEQ ID NO: 5800866 - DNA, 14 bp, Homo sapiens
tgcacttttgaatg

SEQ ID NO: 5800867 - DNA, 22 bp, Homo sapiens
tgcactttttaagtttgaagag

SEQ ID NO: 5800868 - DNA, 22 bp, Homo sapiens
tgcacttttttgtttgaatgtt

SEQ ID NO: 5800869 - DNA, 12 bp, Homo sapiens
tgcagaaaaaaa

SEQ ID NO: 5800870 - DNA, 21 bp, Homo sapiens
tgcagaaaaaaaaaaagaaac

SEQ ID NO: 5800871 - DNA, 15 bp, Homo sapiens
tgcagaaaaagaaaa

SEQ ID NO: 5800872 - DNA, 22 bp, Homo sapiens
tgcagaaaaagaaaaaaactat

SEQ ID NO: 5800873 - DNA, 17 bp, Homo sapiens
tgcagaaaaagagcttc

SEQ ID NO: 5800874 - DNA, 14 bp, Homo sapiens
tgcagaaaacattg

SEQ ID NO: 5800875 - DNA, 15 bp, Homo sapiens
tgcagaaaacgtggc

SEQ ID NO: 5800876 - DNA, 17 bp, Homo sapiens
tgcagaaaagcacctgc

SEQ ID NO: 5800877 - DNA, 19 bp, Homo sapiens
tgcagaaaagcacctgccg

SEQ ID NO: 5800878 - DNA, 18 bp, Homo sapiens
tgcagaaaagctcagagt

SEQ ID NO: 5800879 - DNA, 15 bp, Homo sapiens
tgcagaaaatattta

SEQ ID NO: 5800880 - DNA, 12 bp, Homo sapiens
tgcagaaagccc

SEQ ID NO: 5800881 - DNA, 15 bp, Homo sapiens
tgcagaaaggagaga

SEQ ID NO: 5800882 - DNA, 17 bp, Homo sapiens
tgcagaaatagacaaaa

SEQ ID NO: 5800883 - DNA, 21 bp, Homo sapiens
tgcagaaatagacaaaaagta

SEQ ID NO: 5800884 - DNA, 16 bp, Homo sapiens
tgcagaacagtgaaag

SEQ ID NO: 5800885 - DNA, 18 bp, Homo sapiens
tgcagaaccacaaacaat

SEQ ID NO: 5800886 - DNA, 16 bp, Homo sapiens
tgcagaaccagcacta

SEQ ID NO: 5800887 - DNA, 21 bp, Homo sapiens
tgcagaaccagtccctctgag

SEQ ID NO: 5800888 - DNA, 21 bp, Homo sapiens
tgcagaacccccaggtggcct

SEQ ID NO: 5800889 - DNA, 23 bp, Homo sapiens
tgcagaacccccaggtggcctgc

SEQ ID NO: 5800890 - DNA, 17 bp, Homo sapiens
tgcagaacgtatttagc

SEQ ID NO: 5800891 - DNA, 19 bp, Homo sapiens
tgcagaacgtatttagcca

SEQ ID NO: 5800892 - DNA, 22 bp, Homo sapiens
tgcagaacgtatttagccatta

SEQ ID NO: 5800893 - DNA, 14 bp, Homo sapiens
tgcagaactaaact

SEQ ID NO: 5800894 - DNA, 22 bp, Homo sapiens
tgcagaacttgaagcctgctcc

SEQ ID NO: 5800895 - DNA, 15 bp, Homo sapiens
tgcagaagaagctgg

SEQ ID NO: 5800896 - DNA, 16 bp, Homo sapiens
tgcagaagaaggcatc

SEQ ID NO: 5800897 - DNA, 17 bp, Homo sapiens
tgcagaagaaggcatcg

SEQ ID NO: 5800898 - DNA, 15 bp, Homo sapiens
tgcagaagacagtat

SEQ ID NO: 5800899 - DNA, 15 bp, Homo sapiens
tgcagaagagggtgt

SEQ ID NO: 5800900 - DNA, 15 bp, Homo sapiens
tgcagaagcaataat

SEQ ID NO: 5800901 - DNA, 14 bp, Homo sapiens
tgcagaagcatatt

SEQ ID NO: 5800902 - DNA, 20 bp, Homo sapiens
tgcagaagctatgtttttaa

SEQ ID NO: 5800903 - DNA, 22 bp, Homo sapiens
tgcagaagctatgtttttaaag

SEQ ID NO: 5800904 - DNA, 15 bp, Homo sapiens
tgcagaaggaaaaat

SEQ ID NO: 5800905 - DNA, 20 bp, Homo sapiens
tgcagaaggaaaaatgtgta

SEQ ID NO: 5800906 - DNA, 15 bp, Homo sapiens
tgcagaaggaaagaa

SEQ ID NO: 5800907 - DNA, 13 bp, Homo sapiens
tgcagaaggaaat

SEQ ID NO: 5800908 - DNA, 15 bp, Homo sapiens
tgcagaaggaaatga

SEQ ID NO: 5800909 - DNA, 21 bp, Homo sapiens
tgcagaaggcaaggccctgcc

SEQ ID NO: 5800910 - DNA, 15 bp, Homo sapiens
tgcagaaggccaaga

SEQ ID NO: 5800911 - DNA, 15 bp, Homo sapiens
tgcagaagggagctg

SEQ ID NO: 5800912 - DNA, 22 bp, Homo sapiens
tgcagaagggagctggctccag

SEQ ID NO: 5800913 - DNA, 20 bp, Homo sapiens
tgcagaagtgcatgaacagg

SEQ ID NO: 5800914 - DNA, 15 bp, Homo sapiens
tgcagaataatggaa

SEQ ID NO: 5800915 - DNA, 12 bp, Homo sapiens
tgcagaatgtaa

SEQ ID NO: 5800916 - DNA, 18 bp, Homo sapiens
tgcagaattttttgagta

SEQ ID NO: 5800917 - DNA, 17 bp, Homo sapiens
tgcagacaaagccctgt

SEQ ID NO: 5800918 - DNA, 20 bp, Homo sapiens
tgcagacaaagccctgtcct

SEQ ID NO: 5800919 - DNA, 14 bp, Homo sapiens
tgcagacaattctc

SEQ ID NO: 5800920 - DNA, 11 bp, Homo sapiens
tgcagacacac

SEQ ID NO: 5800921 - DNA, 14 bp, Homo sapiens
tgcagacacacaac

SEQ ID NO: 5800922 - DNA, 16 bp, Homo sapiens
tgcagacacctggact

SEQ ID NO: 5800923 - DNA, 19 bp, Homo sapiens
tgcagacactcaagagccc

SEQ ID NO: 5800924 - DNA, 19 bp, Homo sapiens
tgcaggtctccacctgcac

SEQ ID NO: 5800925 - DNA, 21 bp, Homo sapiens
tgcaggtctttaaatcatttt

SEQ ID NO: 5800926 - DNA, 16 bp, Homo sapiens
tgcaggtgaacttttt

SEQ ID NO: 5800927 - DNA, 19 bp, Homo sapiens
tgcaggtgagcccatggcc

SEQ ID NO: 5800928 - DNA, 13 bp, Homo sapiens
tgcaggtgcacca

SEQ ID NO: 5800929 - DNA, 13 bp, Homo sapiens
tgcaggtgccaat

SEQ ID NO: 5800930 - DNA, 16 bp, Homo sapiens
tgcaggtgccaatgac

SEQ ID NO: 5800931 - DNA, 12 bp, Homo sapiens
tgcaggtgccca

SEQ ID NO: 5800932 - DNA, 14 bp, Homo sapiens
tgcaggtgcctggc

SEQ ID NO: 5800933 - DNA, 18 bp, Homo sapiens
tgcaggtgcctggcttgc

SEQ ID NO: 5800934 - DNA, 21 bp, Homo sapiens
tgcaggtgctattgttactct

SEQ ID NO: 5800935 - DNA, 22 bp, Homo sapiens
tgcaggtgctattgttactctt

SEQ ID NO: 5800936 - DNA, 11 bp, Homo sapiens
tgcaggtgctg

SEQ ID NO: 5800937 - DNA, 16 bp, Homo sapiens
tgcaggtgctgctgcg

SEQ ID NO: 5800938 - DNA, 13 bp, Homo sapiens
tgcaggtggcaga

SEQ ID NO: 5800939 - DNA, 20 bp, Homo sapiens
tgcaggtggccaagttcctc

SEQ ID NO: 5800940 - DNA, 12 bp, Homo sapiens
tgcaggtgggca

SEQ ID NO: 5800941 - DNA, 21 bp, Homo sapiens
tgcaggtgggcactggagcat

SEQ ID NO: 5800942 - DNA, 18 bp, Homo sapiens
tgcaggtgggctgctgag

SEQ ID NO: 5800943 - DNA, 17 bp, Homo sapiens
tgcaggtgggctgggcc

SEQ ID NO: 5800944 - DNA, 13 bp, Homo sapiens
tgcaggtggggag

SEQ ID NO: 5800945 - DNA, 23 bp, Homo sapiens
tgcaggtgggggttgctgtataa

SEQ ID NO: 5800946 - DNA, 23 bp, Homo sapiens
tgcaggtgtggagagagaggctt

SEQ ID NO: 5800947 - DNA, 18 bp, Homo sapiens
tgcaggttagttacatat

SEQ ID NO: 5800948 - DNA, 22 bp, Homo sapiens
tgcaggttggaactatgcagtg

SEQ ID NO: 5800949 - DNA, 19 bp, Homo sapiens
tgcaggttggaaggggcct

SEQ ID NO: 5800950 - DNA, 23 bp, Homo sapiens
tgcaggttggcaaacgggcttga

SEQ ID NO: 5800951 - DNA, 23 bp, Homo sapiens
tgcaggtttatattgggaagctg

SEQ ID NO: 5800952 - DNA, 14 bp, Homo sapiens
tgcaggtttctatt

SEQ ID NO: 5800953 - DNA, 17 bp, Homo sapiens
tgcaggtttgacacgca

SEQ ID NO: 5800954 - DNA, 21 bp, Homo sapiens
tgcaggtttgtaatgcaaaag

SEQ ID NO: 5800955 - DNA, 13 bp, Homo sapiens
tgcaggttttcta

SEQ ID NO: 5800956 - DNA, 23 bp, Homo sapiens
tgcagtaaagtcttgtctggtga

SEQ ID NO: 5800957 - DNA, 14 bp, Homo sapiens
tgcagtaaatcttt

SEQ ID NO: 5800958 - DNA, 18 bp, Homo sapiens
tgcagtaaccatttaatg

SEQ ID NO: 5800959 - DNA, 21 bp, Homo sapiens
tgcagtaactgttttttaagt

SEQ ID NO: 5800960 - DNA, 14 bp, Homo sapiens
tgcagtaatttctg

SEQ ID NO: 5800961 - DNA, 20 bp, Homo sapiens
tgcagtaatttctgagagct

SEQ ID NO: 5800962 - DNA, 16 bp, Homo sapiens
tgcagtacaggacata

SEQ ID NO: 5800963 - DNA, 13 bp, Homo sapiens
tgcagtacaggca

SEQ ID NO: 5800964 - DNA, 16 bp, Homo sapiens
tgcagtacagtcttat

SEQ ID NO: 5800965 - DNA, 17 bp, Homo sapiens
tgcagtactttgtgcat

SEQ ID NO: 5800966 - DNA, 15 bp, Homo sapiens
tgcagtacttttgtt

SEQ ID NO: 5800967 - DNA, 22 bp, Homo sapiens
tgcagtagctgtggcctcaccc

SEQ ID NO: 5800968 - DNA, 15 bp, Homo sapiens
tgcagtagtctctgt

SEQ ID NO: 5800969 - DNA, 13 bp, Homo sapiens
tgcagtataaaat

SEQ ID NO: 5800970 - DNA, 20 bp, Homo sapiens
tgcagtataattttctaatt

SEQ ID NO: 5800971 - DNA, 14 bp, Homo sapiens
tgcagtatatttct

SEQ ID NO: 5800972 - DNA, 18 bp, Homo sapiens
tgcagtatctcttacatc

SEQ ID NO: 5800973 - DNA, 16 bp, Homo sapiens
tgcagtatgaaaataa

SEQ ID NO: 5800974 - DNA, 18 bp, Homo sapiens
tgcagtattcttgcactg

SEQ ID NO: 5800975 - DNA, 14 bp, Homo sapiens
tgcagtattgccac

SEQ ID NO: 5800976 - DNA, 21 bp, Homo sapiens
tgcagtattttattaaagcaa

SEQ ID NO: 5800977 - DNA, 23 bp, Homo sapiens
tgcagtatttttaaatatgtata

SEQ ID NO: 5800978 - DNA, 17 bp, Homo sapiens
tgcagtcaacagttcaa

SEQ ID NO: 5800979 - DNA, 13 bp, Homo sapiens
tgcagtcacattg

SEQ ID NO: 5800980 - DNA, 19 bp, Homo sapiens
tgcagtcaccctgtggcaa

SEQ ID NO: 5800981 - DNA, 21 bp, Homo sapiens
tgcagtcacgtggaggagcag

SEQ ID NO: 5800982 - DNA, 16 bp, Homo sapiens
tgcagtcactgtgatt

SEQ ID NO: 5800983 - DNA, 17 bp, Homo sapiens
tgcagtcagaagatctt

SEQ ID NO: 5800984 - DNA, 11 bp, Homo sapiens
tgcagtcagac

SEQ ID NO: 5800985 - DNA, 15 bp, Homo sapiens
tgcagtcagactgaa

SEQ ID NO: 5800986 - DNA, 14 bp, Homo sapiens
tgcagtcagcacag

SEQ ID NO: 5800987 - DNA, 16 bp, Homo sapiens
tgcagtcagcacagag

SEQ ID NO: 5800988 - DNA, 19 bp, Homo sapiens
tgcagtcagccaagatctt

SEQ ID NO: 5800989 - DNA, 14 bp, Homo sapiens
tgcagtcagtgtca

SEQ ID NO: 5800990 - DNA, 17 bp, Homo sapiens
tgcagtcatcaacaatg

SEQ ID NO: 5800991 - DNA, 18 bp, Homo sapiens
tgcagtcatcaacaatga

SEQ ID NO: 5800992 - DNA, 13 bp, Homo sapiens
tgcagtcatcttg

SEQ ID NO: 5800993 - DNA, 23 bp, Homo sapiens
tgcagtcatttggtgctctgcta

SEQ ID NO: 5800994 - DNA, 23 bp, Homo sapiens
tgcagtcatttgtggttagaatc

SEQ ID NO: 5800995 - DNA, 19 bp, Homo sapiens
tgcagtccagaataagtgc

SEQ ID NO: 5800996 - DNA, 23 bp, Homo sapiens
tgcagtccagaataagtgctgtt

SEQ ID NO: 5800997 - DNA, 18 bp, Homo sapiens
tgcagtccagtgagaaat

SEQ ID NO: 5800998 - DNA, 20 bp, Homo sapiens
tgcagtccagtgagaaatta

SEQ ID NO: 5800999 - DNA, 23 bp, Homo sapiens
tgcagtcccaagcggtgtctctc

SEQ ID NO: 5801000 - DNA, 14 bp, Homo sapiens
tgcagtcccagtcc

SEQ ID NO: 5801001 - DNA, 20 bp, Homo sapiens
tgcagtccgttgctgaaaat

SEQ ID NO: 5801002 - DNA, 15 bp, Homo sapiens
tgcagtcctccgggg

SEQ ID NO: 5801003 - DNA, 17 bp, Homo sapiens
tgcagtcgcttgccaaa

SEQ ID NO: 5801004 - DNA, 22 bp, Homo sapiens
tgcagtcgcttgccaaagcaga

SEQ ID NO: 5801005 - DNA, 17 bp, Homo sapiens
tgcagtcggcatgccag

SEQ ID NO: 5801006 - DNA, 21 bp, Homo sapiens
tgcagtcggcatgccaggacc

SEQ ID NO: 5801007 - DNA, 17 bp, Homo sapiens
tgcagtctcagaaagcc

SEQ ID NO: 5801008 - DNA, 14 bp, Homo sapiens
tgcagtctcatttc

SEQ ID NO: 5801009 - DNA, 14 bp, Homo sapiens
tgcagtctccgcct

SEQ ID NO: 5801010 - DNA, 17 bp, Homo sapiens
tgcagtctcctctttaa

SEQ ID NO: 5801011 - DNA, 21 bp, Homo sapiens
tgcagtctcctctttaaaaca

SEQ ID NO: 5801012 - DNA, 23 bp, Homo sapiens
tgcagtctctataccaataaagt

SEQ ID NO: 5801013 - DNA, 22 bp, Homo sapiens
tgcagtctctttattttactag

SEQ ID NO: 5801014 - DNA, 13 bp, Homo sapiens
tgcagtctgcaga

SEQ ID NO: 5801015 - DNA, 14 bp, Homo sapiens
tgcagtctgcttct

SEQ ID NO: 5801016 - DNA, 21 bp, Homo sapiens
tgcagtctggctgagccctgc

SEQ ID NO: 5801017 - DNA, 13 bp, Homo sapiens
tgcagtctgggtg

SEQ ID NO: 5801018 - DNA, 19 bp, Homo sapiens
tgcagtctgtattttccac

SEQ ID NO: 5801019 - DNA, 22 bp, Homo sapiens
tgcagtcttagatcatagtttt

SEQ ID NO: 5801020 - DNA, 16 bp, Homo sapiens
tgcagtcttctctctg

SEQ ID NO: 5801021 - DNA, 13 bp, Homo sapiens
tgcagtcttctgg

SEQ ID NO: 5801022 - DNA, 17 bp, Homo sapiens
tgcagtcttctgggctg

SEQ ID NO: 5801023 - DNA, 22 bp, Homo sapiens
tgcagtcttctgggctgcggga

SEQ ID NO: 5801024 - DNA, 23 bp, Homo sapiens
tgcagtctttatttttttcccat

SEQ ID NO: 5801025 - DNA, 14 bp, Homo sapiens
tgcagtctttcccc

SEQ ID NO: 5801026 - DNA, 14 bp, Homo sapiens
tgcagtgaactatt

SEQ ID NO: 5801027 - DNA, 13 bp, Homo sapiens
tgcagtgaattgt

SEQ ID NO: 5801028 - DNA, 14 bp, Homo sapiens
tgcagtgaatttga

SEQ ID NO: 5801029 - DNA, 23 bp, Homo sapiens
tgcagtgacacaatctcggctca

SEQ ID NO: 5801030 - DNA, 21 bp, Homo sapiens
tgcagtgacctgccctacata

SEQ ID NO: 5801031 - DNA, 18 bp, Homo sapiens
tgcagtgacgtgcacctg

SEQ ID NO: 5801032 - DNA, 15 bp, Homo sapiens
tgcagtgagccaaga

SEQ ID NO: 5801033 - DNA, 19 bp, Homo sapiens
tgcagtgagccgagattgt

SEQ ID NO: 5801034 - DNA, 22 bp, Homo sapiens
tgcagtgagtcaagatcacgcc

SEQ ID NO: 5801035 - DNA, 22 bp, Homo sapiens
tgcagtgatacatgtactccag

SEQ ID NO: 5801036 - DNA, 22 bp, Homo sapiens
tgcagtgatatggcagaagaca

SEQ ID NO: 5801037 - DNA, 23 bp, Homo sapiens
tgcagtgatatggcagaagacac

SEQ ID NO: 5801038 - DNA, 17 bp, Homo sapiens
tgcagtgcagtatagaa

SEQ ID NO: 5801039 - DNA, 19 bp, Homo sapiens
tgcagtgccctagaagggg

SEQ ID NO: 5801040 - DNA, 22 bp, Homo sapiens
tgcagtgctcgctgttgctgaa

SEQ ID NO: 5801041 - DNA, 13 bp, Homo sapiens
tgcagtgctgctt

SEQ ID NO: 5801042 - DNA, 16 bp, Homo sapiens
tgcagtgctgctttgc

SEQ ID NO: 5801043 - DNA, 23 bp, Homo sapiens
tgcagtgctgtaatcggctcccg

SEQ ID NO: 5801044 - DNA, 16 bp, Homo sapiens
tgcagtgcttccaagg

SEQ ID NO: 5801045 - DNA, 19 bp, Homo sapiens
tgcagtggacggagagcct

SEQ ID NO: 5801046 - DNA, 23 bp, Homo sapiens
tgcagtggagaagacattctggt

SEQ ID NO: 5801047 - DNA, 13 bp, Homo sapiens
tgcagtggagcag

SEQ ID NO: 5801048 - DNA, 20 bp, Homo sapiens
tgcagtggagggggcaagct

SEQ ID NO: 5801049 - DNA, 14 bp, Homo sapiens
tgcagtggcaaagg

SEQ ID NO: 5801050 - DNA, 19 bp, Homo sapiens
tgcagtggccccatccagc

SEQ ID NO: 5801051 - DNA, 20 bp, Homo sapiens
tgcagtggccccatccagca

SEQ ID NO: 5801052 - DNA, 15 bp, Homo sapiens
tgcagtggcctggcc

SEQ ID NO: 5801053 - DNA, 16 bp, Homo sapiens
tgcagtggcctggccg

SEQ ID NO: 5801054 - DNA, 22 bp, Homo sapiens
tgcagtggcgcgatctcagctc

SEQ ID NO: 5801055 - DNA, 22 bp, Homo sapiens
tgcagtggcgtgatctcagctc

SEQ ID NO: 5801056 - DNA, 17 bp, Homo sapiens
tgcagtggcttttcatg

SEQ ID NO: 5801057 - DNA, 21 bp, Homo sapiens
tgcagtggggtttcgcagcct

SEQ ID NO: 5801058 - DNA, 19 bp, Homo sapiens
tgcagtgggtggggctgta

SEQ ID NO: 5801059 - DNA, 18 bp, Homo sapiens
tgcagtgggttctccaaa

SEQ ID NO: 5801060 - DNA, 19 bp, Homo sapiens
tgcagtggtattaattttg

SEQ ID NO: 5801061 - DNA, 21 bp, Homo sapiens
tgcagtggtgcgatctgggtt

SEQ ID NO: 5801062 - DNA, 17 bp, Homo sapiens
tgcagtggtgtgctctg

SEQ ID NO: 5801063 - DNA, 13 bp, Homo sapiens
tgcagtgtagttt

SEQ ID NO: 5801064 - DNA, 15 bp, Homo sapiens
tgcagtgtcttgtaa

SEQ ID NO: 5801065 - DNA, 19 bp, Homo sapiens
tgcagtgtctttcggaatt

SEQ ID NO: 5801066 - DNA, 14 bp, Homo sapiens
tgcagtgtgaaaag

SEQ ID NO: 5801067 - DNA, 13 bp, Homo sapiens
tgcagtgtgcata

SEQ ID NO: 5801068 - DNA, 12 bp, Homo sapiens
tgcagtgtgctc

SEQ ID NO: 5801069 - DNA, 21 bp, Homo sapiens
tgcagtgtggagttcaccttg

SEQ ID NO: 5801070 - DNA, 22 bp, Homo sapiens
tgcagtgtggcaagcaagagct

SEQ ID NO: 5801071 - DNA, 12 bp, Homo sapiens
tgcagtgttctg

SEQ ID NO: 5801072 - DNA, 21 bp, Homo sapiens
tgcagtgtttccctctgtgtt

SEQ ID NO: 5801073 - DNA, 14 bp, Homo sapiens
tgcagtgttttgca

SEQ ID NO: 5801074 - DNA, 16 bp, Homo sapiens
tgcagttaagctaaag

SEQ ID NO: 5801075 - DNA, 23 bp, Homo sapiens
tgcagttaatacttaacattgat

SEQ ID NO: 5801076 - DNA, 16 bp, Homo sapiens
tgcagttaattcttgc

SEQ ID NO: 5801077 - DNA, 21 bp, Homo sapiens
tgcagttacaaattataatgt

SEQ ID NO: 5801078 - DNA, 16 bp, Homo sapiens
tgcagttacttgaata

SEQ ID NO: 5801079 - DNA, 16 bp, Homo sapiens
tgcagttagcacagag

SEQ ID NO: 5801080 - DNA, 21 bp, Homo sapiens
tgcagttagccccagaaaatg

SEQ ID NO: 5801081 - DNA, 20 bp, Homo sapiens
tgcagttatttaccagaagt

SEQ ID NO: 5801082 - DNA, 22 bp, Homo sapiens
tgcagttatttaccagaagttt

SEQ ID NO: 5801083 - DNA, 20 bp, Homo sapiens
tgcagttcagtttgtctctt

SEQ ID NO: 5801084 - DNA, 13 bp, Homo sapiens
tgcagttcccatc

SEQ ID NO: 5801085 - DNA, 23 bp, Homo sapiens
tgcagttcccctggaagcagtgc

SEQ ID NO: 5801086 - DNA, 14 bp, Homo sapiens
tgcagttcctgagt

SEQ ID NO: 5801087 - DNA, 17 bp, Homo sapiens
tgcagttcctgctgcct

SEQ ID NO: 5801088 - DNA, 19 bp, Homo sapiens
tgcagttcctgctgcctgc

SEQ ID NO: 5801089 - DNA, 12 bp, Homo sapiens
tgcagttcctgg

SEQ ID NO: 5801090 - DNA, 21 bp, Homo sapiens
tgcagttctcacgaaagtatt

SEQ ID NO: 5801091 - DNA, 18 bp, Homo sapiens
tgcagttctgaagaagat

SEQ ID NO: 5801092 - DNA, 14 bp, Homo sapiens
tgcagttctgagca

SEQ ID NO: 5801093 - DNA, 17 bp, Homo sapiens
tgcagttcttgtggaag

SEQ ID NO: 5801094 - DNA, 20 bp, Homo sapiens
tgcagttctttggctgaaag

SEQ ID NO: 5801095 - DNA, 17 bp, Homo sapiens
tgcagttgaattcagtg

SEQ ID NO: 5801096 - DNA, 20 bp, Homo sapiens
tgcagttgaattcagtgggt

SEQ ID NO: 5801097 - DNA, 17 bp, Homo sapiens
tgcagttgacagcaggt

SEQ ID NO: 5801098 - DNA, 16 bp, Homo sapiens
tgcagttgactttctc

SEQ ID NO: 5801099 - DNA, 17 bp, Homo sapiens
tgcagttgataagagga

SEQ ID NO: 5801100 - DNA, 15 bp, Homo sapiens
tgcattcttctctgt

SEQ ID NO: 5801101 - DNA, 20 bp, Homo sapiens
tgcattcttggttggctggc

SEQ ID NO: 5801102 - DNA, 22 bp, Homo sapiens
tgcattctttatagtgaagtgt

SEQ ID NO: 5801103 - DNA, 15 bp, Homo sapiens
tgcattctttggtaa

SEQ ID NO: 5801104 - DNA, 16 bp, Homo sapiens
tgcattctttggtaat

SEQ ID NO: 5801105 - DNA, 16 bp, Homo sapiens
tgcattcttttaaaag

SEQ ID NO: 5801106 - DNA, 22 bp, Homo sapiens
tgcattcttttaaaagacaaga

SEQ ID NO: 5801107 - DNA, 20 bp, Homo sapiens
tgcattcttttaaagtttta

SEQ ID NO: 5801108 - DNA, 13 bp, Homo sapiens
tgcattgaacaca

SEQ ID NO: 5801109 - DNA, 17 bp, Homo sapiens
tgcattgaacacaaact

SEQ ID NO: 5801110 - DNA, 18 bp, Homo sapiens
tgcattgaacacaaactg

SEQ ID NO: 5801111 - DNA, 23 bp, Homo sapiens
tgcattgaacacaaactgtaaat

SEQ ID NO: 5801112 - DNA, 17 bp, Homo sapiens
tgcattgaatactctga

SEQ ID NO: 5801113 - DNA, 14 bp, Homo sapiens
tgcattgaatatat

SEQ ID NO: 5801114 - DNA, 22 bp, Homo sapiens
tgcattgaatttagtcattatt

SEQ ID NO: 5801115 - DNA, 22 bp, Homo sapiens
tgcattgaccgcgactaatttc

SEQ ID NO: 5801116 - DNA, 14 bp, Homo sapiens
tgcattgactttca

SEQ ID NO: 5801117 - DNA, 17 bp, Homo sapiens
tgcattgactttcccca

SEQ ID NO: 5801118 - DNA, 14 bp, Homo sapiens
tgcattgagaagga

SEQ ID NO: 5801119 - DNA, 19 bp, Homo sapiens
tgcattgagctgcctccag

SEQ ID NO: 5801120 - DNA, 13 bp, Homo sapiens
tgcattgatattg

SEQ ID NO: 5801121 - DNA, 17 bp, Homo sapiens
tgcattgatattgtgaa

SEQ ID NO: 5801122 - DNA, 15 bp, Homo sapiens
tgcattgatggtttt

SEQ ID NO: 5801123 - DNA, 16 bp, Homo sapiens
tgcattgcctgtaaca

SEQ ID NO: 5801124 - DNA, 18 bp, Homo sapiens
tgcattgcctgtaacaat

SEQ ID NO: 5801125 - DNA, 12 bp, Homo sapiens
tgcattgccttg

SEQ ID NO: 5801126 - DNA, 15 bp, Homo sapiens
tgcattgctagataa

SEQ ID NO: 5801127 - DNA, 16 bp, Homo sapiens
tgcattgctagataaa

SEQ ID NO: 5801128 - DNA, 17 bp, Homo sapiens
tgcattgctagataaaa

SEQ ID NO: 5801129 - DNA, 18 bp, Homo sapiens
tgcattgctagataaaag

SEQ ID NO: 5801130 - DNA, 20 bp, Homo sapiens
tgcattgctctggatctgtt

SEQ ID NO: 5801131 - DNA, 11 bp, Homo sapiens
tgcattgctgg

SEQ ID NO: 5801132 - DNA, 15 bp, Homo sapiens
tgcattgctggacta

SEQ ID NO: 5801133 - DNA, 15 bp, Homo sapiens
tgcattgctggtaga

SEQ ID NO: 5801134 - DNA, 14 bp, Homo sapiens
tgcattgctgtgtg

SEQ ID NO: 5801135 - DNA, 15 bp, Homo sapiens
tgcattgctgtgtga

SEQ ID NO: 5801136 - DNA, 17 bp, Homo sapiens
tgcattggaactggagg

SEQ ID NO: 5801137 - DNA, 18 bp, Homo sapiens
tgcattggaactggaggc

SEQ ID NO: 5801138 - DNA, 12 bp, Homo sapiens
tgcattggccct

SEQ ID NO: 5801139 - DNA, 13 bp, Homo sapiens
tgcattggcctct

SEQ ID NO: 5801140 - DNA, 14 bp, Homo sapiens
tgcattggcctctg

SEQ ID NO: 5801141 - DNA, 14 bp, Homo sapiens
tgcattggcctggc

SEQ ID NO: 5801142 - DNA, 15 bp, Homo sapiens
tgcattggcctggcc

SEQ ID NO: 5801143 - DNA, 18 bp, Homo sapiens
tgcattggcctggcctcc

SEQ ID NO: 5801144 - DNA, 18 bp, Homo sapiens
tgcattggggttcctctg

SEQ ID NO: 5801145 - DNA, 22 bp, Homo sapiens
tgcattggggttcctctgtaca

SEQ ID NO: 5801146 - DNA, 16 bp, Homo sapiens
tgcattggttttccat

SEQ ID NO: 5801147 - DNA, 16 bp, Homo sapiens
tgcattgtaaacataa

SEQ ID NO: 5801148 - DNA, 22 bp, Homo sapiens
tgcattgtaatcatcatagaag

SEQ ID NO: 5801149 - DNA, 18 bp, Homo sapiens
tgcattgtatcgatgtta

SEQ ID NO: 5801150 - DNA, 11 bp, Homo sapiens
tgcattgtctg

SEQ ID NO: 5801151 - DNA, 13 bp, Homo sapiens
tgcattgtctgca

SEQ ID NO: 5801152 - DNA, 20 bp, Homo sapiens
tgcattgtctgcaatggtga

SEQ ID NO: 5801153 - DNA, 18 bp, Homo sapiens
tgcattgtctttaatata

SEQ ID NO: 5801154 - DNA, 13 bp, Homo sapiens
tgcattgtgcttc

SEQ ID NO: 5801155 - DNA, 15 bp, Homo sapiens
tgcattgtgcttctt

SEQ ID NO: 5801156 - DNA, 19 bp, Homo sapiens
tgcattgttagcactaggc

SEQ ID NO: 5801157 - DNA, 23 bp, Homo sapiens
tgcattgttggctatttgaaata

SEQ ID NO: 5801158 - DNA, 19 bp, Homo sapiens
tgcattgttgtaaagtatt

SEQ ID NO: 5801159 - DNA, 13 bp, Homo sapiens
tgcattgtttctg

SEQ ID NO: 5801160 - DNA, 17 bp, Homo sapiens
tgcatttaaaacagaca

SEQ ID NO: 5801161 - DNA, 20 bp, Homo sapiens
tgcatttaaaacagacactg

SEQ ID NO: 5801162 - DNA, 22 bp, Homo sapiens
tgcatttaaaacagacactggc

SEQ ID NO: 5801163 - DNA, 20 bp, Homo sapiens
tgcatttaaaataccactgt

SEQ ID NO: 5801164 - DNA, 18 bp, Homo sapiens
tgcatttaaactcatttg

SEQ ID NO: 5801165 - DNA, 17 bp, Homo sapiens
tgcatttaaagtattct

SEQ ID NO: 5801166 - DNA, 16 bp, Homo sapiens
tgcatttaagaacaga

SEQ ID NO: 5801167 - DNA, 16 bp, Homo sapiens
tgcatttaagttgtaa

SEQ ID NO: 5801168 - DNA, 23 bp, Homo sapiens
tgcatttaagttgtaaacgtctt

SEQ ID NO: 5801169 - DNA, 12 bp, Homo sapiens
tgcatttaataa

SEQ ID NO: 5801170 - DNA, 14 bp, Homo sapiens
tgcatttaataaag

SEQ ID NO: 5801171 - DNA, 15 bp, Homo sapiens
tgcatttaattctga

SEQ ID NO: 5801172 - DNA, 21 bp, Homo sapiens
tgcatttagcatgagttctgc

SEQ ID NO: 5801173 - DNA, 19 bp, Homo sapiens
tgcatttagcttctttccc

SEQ ID NO: 5801174 - DNA, 22 bp, Homo sapiens
tgcatttatagatcatttctag

SEQ ID NO: 5801175 - DNA, 14 bp, Homo sapiens
tgcatttatatgta

SEQ ID NO: 5801176 - DNA, 16 bp, Homo sapiens
tgcatttatgcatgag

SEQ ID NO: 5801177 - DNA, 19 bp, Homo sapiens
tgcatttattgcagtttat

SEQ ID NO: 5801178 - DNA, 12 bp, Homo sapiens
tgcatttcaaat

SEQ ID NO: 5801179 - DNA, 14 bp, Homo sapiens
tgcatttcaaatgt

SEQ ID NO: 5801180 - DNA, 12 bp, Homo sapiens
tgcatttcaagc

SEQ ID NO: 5801181 - DNA, 23 bp, Homo sapiens
tgcatttcaatttcaatggtgtt

SEQ ID NO: 5801182 - DNA, 18 bp, Homo sapiens
tgcatttcacctgtgaca

SEQ ID NO: 5801183 - DNA, 19 bp, Homo sapiens
tgcatttcacctgtgacaa

SEQ ID NO: 5801184 - DNA, 13 bp, Homo sapiens
tgcatttcagaat

SEQ ID NO: 5801185 - DNA, 14 bp, Homo sapiens
tgcatttcatatta

SEQ ID NO: 5801186 - DNA, 17 bp, Homo sapiens
tgcatttcatattattt

SEQ ID NO: 5801187 - DNA, 19 bp, Homo sapiens
tgcatttcatattatttta

SEQ ID NO: 5801188 - DNA, 16 bp, Homo sapiens
tgcatttccagaaatc

SEQ ID NO: 5801189 - DNA, 17 bp, Homo sapiens
tgcatttccagaaatct

SEQ ID NO: 5801190 - DNA, 20 bp, Homo sapiens
tgcatttcctcgcagcctct

SEQ ID NO: 5801191 - DNA, 22 bp, Homo sapiens
tgcatttcctgtgtttgtcctg

SEQ ID NO: 5801192 - DNA, 24 bp, Homo sapiens
tgcatttctggaccctccacttca

SEQ ID NO: 5801193 - DNA, 13 bp, Homo sapiens
tgcatttctgtat

SEQ ID NO: 5801194 - DNA, 15 bp, Homo sapiens
tgcatttctgtattt

SEQ ID NO: 5801195 - DNA, 19 bp, Homo sapiens
tgcatttgaaaattttgat

SEQ ID NO: 5801196 - DNA, 17 bp, Homo sapiens
tgcatttgagagaagcc

SEQ ID NO: 5801197 - DNA, 22 bp, Homo sapiens
tgcatttgagagaagccacgct

SEQ ID NO: 5801198 - DNA, 21 bp, Homo sapiens
tgcatttgaggtctgttcttt

SEQ ID NO: 5801199 - DNA, 18 bp, Homo sapiens
tgcatttgatttgtttag

SEQ ID NO: 5801200 - DNA, 23 bp, Homo sapiens
tgcatttgctgttgtttctataa

SEQ ID NO: 5801201 - DNA, 22 bp, Homo sapiens
tgcatttgggtggtttttattt

SEQ ID NO: 5801202 - DNA, 16 bp, Homo sapiens
tgcatttgtaaatgct

SEQ ID NO: 5801203 - DNA, 16 bp, Homo sapiens
tgcatttgtctattct

SEQ ID NO: 5801204 - DNA, 19 bp, Homo sapiens
tgcatttgtctattctcca

SEQ ID NO: 5801205 - DNA, 20 bp, Homo sapiens
tgcatttgtctattctccag

SEQ ID NO: 5801206 - DNA, 13 bp, Homo sapiens
tgcatttgtggga

SEQ ID NO: 5801207 - DNA, 22 bp, Homo sapiens
tgcatttgtggtaatctacacc

SEQ ID NO: 5801208 - DNA, 19 bp, Homo sapiens
tgcatttgtgtctgcctgc

SEQ ID NO: 5801209 - DNA, 13 bp, Homo sapiens
tgcatttgtttat

SEQ ID NO: 5801210 - DNA, 21 bp, Homo sapiens
tgcatttgtttatgtaatttc

SEQ ID NO: 5801211 - DNA, 21 bp, Homo sapiens
tgcatttgtttgctgaaattt

SEQ ID NO: 5801212 - DNA, 21 bp, Homo sapiens
tgcatttgttttgtttacaga

SEQ ID NO: 5801213 - DNA, 21 bp, Homo sapiens
tgcattttaaagttaaacatt

SEQ ID NO: 5801214 - DNA, 16 bp, Homo sapiens
tgcattttaaatgtct

SEQ ID NO: 5801215 - DNA, 18 bp, Homo sapiens
tgcattttaaatgtctat

SEQ ID NO: 5801216 - DNA, 16 bp, Homo sapiens
tgcattttacacatgt

SEQ ID NO: 5801217 - DNA, 20 bp, Homo sapiens
tgcattttacagtatcttca

SEQ ID NO: 5801218 - DNA, 23 bp, Homo sapiens
tgcattttcaagatacatttcat

SEQ ID NO: 5801219 - DNA, 13 bp, Homo sapiens
tgcattttcctct

SEQ ID NO: 5801220 - DNA, 13 bp, Homo sapiens
tgcattttctcag

SEQ ID NO: 5801221 - DNA, 16 bp, Homo sapiens
tgcattttctcaggca

SEQ ID NO: 5801222 - DNA, 17 bp, Homo sapiens
tgcattttctgatgtat

SEQ ID NO: 5801223 - DNA, 18 bp, Homo sapiens
tgcattttctgatgtatt

SEQ ID NO: 5801224 - DNA, 13 bp, Homo sapiens
tgcattttcttca

SEQ ID NO: 5801225 - DNA, 15 bp, Homo sapiens
tgcattttcttcact

SEQ ID NO: 5801226 - DNA, 16 bp, Homo sapiens
tgcattttcttgtatg

SEQ ID NO: 5801227 - DNA, 18 bp, Homo sapiens
tgcattttgagtgtttat

SEQ ID NO: 5801228 - DNA, 15 bp, Homo sapiens
tgcattttgctattg

SEQ ID NO: 5801229 - DNA, 18 bp, Homo sapiens
tgcattttgctattgtaa

SEQ ID NO: 5801230 - DNA, 20 bp, Homo sapiens
tgcattttgctattgtaaat

SEQ ID NO: 5801231 - DNA, 22 bp, Homo sapiens
tgcattttgctattgtaaatat

SEQ ID NO: 5801232 - DNA, 20 bp, Homo sapiens
tgcattttgtagcctctctt

SEQ ID NO: 5801233 - DNA, 16 bp, Homo sapiens
tgcattttgtgtgatg

SEQ ID NO: 5801234 - DNA, 23 bp, Homo sapiens
tgcattttgtttggtattgtatt

SEQ ID NO: 5801235 - DNA, 20 bp, Homo sapiens
tgcatttttatcatgtaaca

SEQ ID NO: 5801236 - DNA, 21 bp, Homo sapiens
tgcatttttattaaagcattt

SEQ ID NO: 5801237 - DNA, 13 bp, Homo sapiens
tgcatttttgtat

SEQ ID NO: 5801238 - DNA, 17 bp, Homo sapiens
tgcatttttgtgaaatg

SEQ ID NO: 5801239 - DNA, 17 bp, Homo sapiens
tgcatttttgttttgaa

SEQ ID NO: 5801240 - DNA, 18 bp, Homo sapiens
tgcatttttgttttgaaa

SEQ ID NO: 5801241 - DNA, 20 bp, Homo sapiens
tgcatttttttagtttgttt

SEQ ID NO: 5801242 - DNA, 22 bp, Homo sapiens
tgcatttttttagtttgttttt

SEQ ID NO: 5801243 - DNA, 14 bp, Homo sapiens
tgcatttttttcct

SEQ ID NO: 5801244 - DNA, 16 bp, Homo sapiens
tgcatttttttccttt

SEQ ID NO: 5801245 - DNA, 19 bp, Homo sapiens
tgcattttttttttcattg

SEQ ID NO: 5801246 - DNA, 19 bp, Homo sapiens
tgccaaaaaaaaaagaagt

SEQ ID NO: 5801247 - DNA, 22 bp, Homo sapiens
tgccaaaaactaaaattcaaca

SEQ ID NO: 5801248 - DNA, 20 bp, Homo sapiens
tgccaaaaaggatacataat

SEQ ID NO: 5801249 - DNA, 14 bp, Homo sapiens
tgccaaaaccacat

SEQ ID NO: 5801250 - DNA, 14 bp, Homo sapiens
tgccaaaaccaggc

SEQ ID NO: 5801251 - DNA, 15 bp, Homo sapiens
tgccaaaaccaggcc

SEQ ID NO: 5801252 - DNA, 18 bp, Homo sapiens
tgccaaaaccaggcctct

SEQ ID NO: 5801253 - DNA, 17 bp, Homo sapiens
tgccaaaacccagctgc

SEQ ID NO: 5801254 - DNA, 21 bp, Homo sapiens
tgccaaaacccagctgcaccc

SEQ ID NO: 5801255 - DNA, 14 bp, Homo sapiens
tgccaaaataaagt

SEQ ID NO: 5801256 - DNA, 22 bp, Homo sapiens
tgccaaaataaagtctgtcatg

SEQ ID NO: 5801257 - DNA, 12 bp, Homo sapiens
tgccaaaataat

SEQ ID NO: 5801258 - DNA, 22 bp, Homo sapiens
tgccaaaataccactagtggaa

SEQ ID NO: 5801259 - DNA, 21 bp, Homo sapiens
tgccaaaatgtcaatttttaa

SEQ ID NO: 5801260 - DNA, 23 bp, Homo sapiens
tgccaaacatcagtcaattgctt

SEQ ID NO: 5801261 - DNA, 17 bp, Homo sapiens
tgccaaacctcctgtca

SEQ ID NO: 5801262 - DNA, 23 bp, Homo sapiens
tgccaaacctcctgtcagtgagg

SEQ ID NO: 5801263 - DNA, 22 bp, Homo sapiens
tgccaaagaggggtcaccaggg

SEQ ID NO: 5801264 - DNA, 13 bp, Homo sapiens
tgccaaagatagc

SEQ ID NO: 5801265 - DNA, 14 bp, Homo sapiens
tgccaaagatagca

SEQ ID NO: 5801266 - DNA, 21 bp, Homo sapiens
tgccaaagatagcagaagagt

SEQ ID NO: 5801267 - DNA, 17 bp, Homo sapiens
tgccaaagatgtttgaa

SEQ ID NO: 5801268 - DNA, 20 bp, Homo sapiens
tgccaaagcaaaagaagtaa

SEQ ID NO: 5801269 - DNA, 15 bp, Homo sapiens
tgccaaagcaggtca

SEQ ID NO: 5801270 - DNA, 16 bp, Homo sapiens
tgccaaagcctggggc

SEQ ID NO: 5801271 - DNA, 21 bp, Homo sapiens
tgccaaagctagggtggccct

SEQ ID NO: 5801272 - DNA, 12 bp, Homo sapiens
tgccaaagctgc

SEQ ID NO: 5801273 - DNA, 16 bp, Homo sapiens
tgccaaagctgctttc

SEQ ID NO: 5801274 - DNA, 19 bp, Homo sapiens
tgccaaagctggctttttg

SEQ ID NO: 5801275 - DNA, 13 bp, Homo sapiens
tgccaaagtagtc

SEQ ID NO: 5801276 - DNA, 17 bp, Homo sapiens
tgccaaagtgcctggga

SEQ ID NO: 5801277 - DNA, 16 bp, Homo sapiens
tgccaaataaaatgtt

SEQ ID NO: 5801278 - DNA, 19 bp, Homo sapiens
tgccaggaacccttaaaca

SEQ ID NO: 5801279 - DNA, 14 bp, Homo sapiens
tgccaggaacctgt

SEQ ID NO: 5801280 - DNA, 21 bp, Homo sapiens
tgccaggaacctgtcctaagg

SEQ ID NO: 5801281 - DNA, 22 bp, Homo sapiens
tgccaggaacctgtcctaagga

SEQ ID NO: 5801282 - DNA, 15 bp, Homo sapiens
tgccaggaagggcca

SEQ ID NO: 5801283 - DNA, 15 bp, Homo sapiens
tgccaggacacctgc

SEQ ID NO: 5801284 - DNA, 17 bp, Homo sapiens
tgccaggacacctgccc

SEQ ID NO: 5801285 - DNA, 17 bp, Homo sapiens
tgccaggacagctgcag

SEQ ID NO: 5801286 - DNA, 16 bp, Homo sapiens
tgccaggacagctggc

SEQ ID NO: 5801287 - DNA, 17 bp, Homo sapiens
tgccaggacagctggct

SEQ ID NO: 5801288 - DNA, 20 bp, Homo sapiens
tgccaggacagctggctgct

SEQ ID NO: 5801289 - DNA, 13 bp, Homo sapiens
tgccaggaccagc

SEQ ID NO: 5801290 - DNA, 18 bp, Homo sapiens
tgccaggacccgccagcc

SEQ ID NO: 5801291 - DNA, 21 bp, Homo sapiens
tgccaggacccgccagccccg

SEQ ID NO: 5801292 - DNA, 12 bp, Homo sapiens
tgccaggactcc

SEQ ID NO: 5801293 - DNA, 16 bp, Homo sapiens
tgccaggactccccag

SEQ ID NO: 5801294 - DNA, 13 bp, Homo sapiens
tgccaggactctc

SEQ ID NO: 5801295 - DNA, 15 bp, Homo sapiens
tgccaggactctctt

SEQ ID NO: 5801296 - DNA, 18 bp, Homo sapiens
tgccaggactgtgactca

SEQ ID NO: 5801297 - DNA, 20 bp, Homo sapiens
tgccaggagatggaatatca

SEQ ID NO: 5801298 - DNA, 20 bp, Homo sapiens
tgccaggagatggccccaac

SEQ ID NO: 5801299 - DNA, 18 bp, Homo sapiens
tgccaggagcaatgggac

SEQ ID NO: 5801300 - DNA, 19 bp, Homo sapiens
tgccaggagcaatgggact

SEQ ID NO: 5801301 - DNA, 19 bp, Homo sapiens
tgccaggagcacggctctg

SEQ ID NO: 5801302 - DNA, 16 bp, Homo sapiens
tgccaggagcagcctc

SEQ ID NO: 5801303 - DNA, 17 bp, Homo sapiens
tgccaggagcagcctcc

SEQ ID NO: 5801304 - DNA, 16 bp, Homo sapiens
tgccaggaggcggcag

SEQ ID NO: 5801305 - DNA, 14 bp, Homo sapiens
tgccaggagggcac

SEQ ID NO: 5801306 - DNA, 21 bp, Homo sapiens
tgccaggagggcacagcaggg

SEQ ID NO: 5801307 - DNA, 19 bp, Homo sapiens
tgccaggattggcacaagc

SEQ ID NO: 5801308 - DNA, 21 bp, Homo sapiens
tgccaggattggcacaagctc

SEQ ID NO: 5801309 - DNA, 17 bp, Homo sapiens
tgccaggcacaggcagg

SEQ ID NO: 5801310 - DNA, 21 bp, Homo sapiens
tgccaggcacaggcagggcag

SEQ ID NO: 5801311 - DNA, 18 bp, Homo sapiens
tgccaggcacctggcctg

SEQ ID NO: 5801312 - DNA, 22 bp, Homo sapiens
tgccaggcacctggcctgctgg

SEQ ID NO: 5801313 - DNA, 20 bp, Homo sapiens
tgccaggcagaaaactggca

SEQ ID NO: 5801314 - DNA, 15 bp, Homo sapiens
tgccaggcagctgca

SEQ ID NO: 5801315 - DNA, 21 bp, Homo sapiens
tgccaggcccatctcaggtgc

SEQ ID NO: 5801316 - DNA, 11 bp, Homo sapiens
tgccaggcccc

SEQ ID NO: 5801317 - DNA, 21 bp, Homo sapiens
tgccaggcccccaccacacat

SEQ ID NO: 5801318 - DNA, 22 bp, Homo sapiens
tgccaggcccccaccacacatc

SEQ ID NO: 5801319 - DNA, 16 bp, Homo sapiens
tgccaggcctccctcg

SEQ ID NO: 5801320 - DNA, 14 bp, Homo sapiens
tgccaggcggccct

SEQ ID NO: 5801321 - DNA, 15 bp, Homo sapiens
tgccaggcggccctg

SEQ ID NO: 5801322 - DNA, 18 bp, Homo sapiens
tgccaggcggccctgggg

SEQ ID NO: 5801323 - DNA, 19 bp, Homo sapiens
tgccaggcggccctgggga

SEQ ID NO: 5801324 - DNA, 21 bp, Homo sapiens
tgccaggcggccctggggagg

SEQ ID NO: 5801325 - DNA, 21 bp, Homo sapiens
tgccaggcgttggtgccactt

SEQ ID NO: 5801326 - DNA, 15 bp, Homo sapiens
tgccaggctcaacaa

SEQ ID NO: 5801327 - DNA, 19 bp, Homo sapiens
tgccaggctcccactgccc

SEQ ID NO: 5801328 - DNA, 15 bp, Homo sapiens
tgccaggctctccct

SEQ ID NO: 5801329 - DNA, 14 bp, Homo sapiens
tgccaggctgcagg

SEQ ID NO: 5801330 - DNA, 15 bp, Homo sapiens
tgccaggctgcaggg

SEQ ID NO: 5801331 - DNA, 17 bp, Homo sapiens
tgccaggctgcagggac

SEQ ID NO: 5801332 - DNA, 19 bp, Homo sapiens
tgccaggctgcagggacag

SEQ ID NO: 5801333 - DNA, 23 bp, Homo sapiens
tgccaggctgcgtccctccgagc

SEQ ID NO: 5801334 - DNA, 15 bp, Homo sapiens
tgccaggctgggagg

SEQ ID NO: 5801335 - DNA, 17 bp, Homo sapiens
tgccaggctgggaggct

SEQ ID NO: 5801336 - DNA, 21 bp, Homo sapiens
tgccaggctgtaagcattctg

SEQ ID NO: 5801337 - DNA, 14 bp, Homo sapiens
tgccaggctgtgct

SEQ ID NO: 5801338 - DNA, 15 bp, Homo sapiens
tgccaggctgtgcta

SEQ ID NO: 5801339 - DNA, 13 bp, Homo sapiens
tgccaggcttgcc

SEQ ID NO: 5801340 - DNA, 19 bp, Homo sapiens
tgccagggaactggcctgc

SEQ ID NO: 5801341 - DNA, 18 bp, Homo sapiens
tgccagggaagacagagc

SEQ ID NO: 5801342 - DNA, 12 bp, Homo sapiens
tgccagggagct

SEQ ID NO: 5801343 - DNA, 16 bp, Homo sapiens
tgccagggatggcagt

SEQ ID NO: 5801344 - DNA, 18 bp, Homo sapiens
tgccagggatgggcagcc

SEQ ID NO: 5801345 - DNA, 21 bp, Homo sapiens
tgccagggatgggcagcccaa

SEQ ID NO: 5801346 - DNA, 22 bp, Homo sapiens
tgccagggcaatgatgaatgag

SEQ ID NO: 5801347 - DNA, 11 bp, Homo sapiens
tgccagggcag

SEQ ID NO: 5801348 - DNA, 21 bp, Homo sapiens
tgccagggcaggctacccctt

SEQ ID NO: 5801349 - DNA, 22 bp, Homo sapiens
tgccagggcaggctaccccttc

SEQ ID NO: 5801350 - DNA, 13 bp, Homo sapiens
tgccagggcaggg

SEQ ID NO: 5801351 - DNA, 15 bp, Homo sapiens
tgccagggcagggtc

SEQ ID NO: 5801352 - DNA, 22 bp, Homo sapiens
tgccagggcccaccccagcctc

SEQ ID NO: 5801353 - DNA, 21 bp, Homo sapiens
tgccagggcccctctccccag

SEQ ID NO: 5801354 - DNA, 20 bp, Homo sapiens
tgccagggctctgggggcag

SEQ ID NO: 5801355 - DNA, 21 bp, Homo sapiens
tgccagggctctgggggcaga

SEQ ID NO: 5801356 - DNA, 13 bp, Homo sapiens
tgccaggggctct

SEQ ID NO: 5801357 - DNA, 14 bp, Homo sapiens
tgccaggggctctg

SEQ ID NO: 5801358 - DNA, 18 bp, Homo sapiens
tgccaggggctctgtggc

SEQ ID NO: 5801359 - DNA, 20 bp, Homo sapiens
tgccaggggctctgtggcaa

SEQ ID NO: 5801360 - DNA, 15 bp, Homo sapiens
tgccagggggtttga

SEQ ID NO: 5801361 - DNA, 16 bp, Homo sapiens
tgccaggggtaacctg

SEQ ID NO: 5801362 - DNA, 20 bp, Homo sapiens
tgccagggtgggctggggac

SEQ ID NO: 5801363 - DNA, 21 bp, Homo sapiens
tgccagggtgggctggggact

SEQ ID NO: 5801364 - DNA, 22 bp, Homo sapiens
tgccagggtgggctggggactc

SEQ ID NO: 5801365 - DNA, 23 bp, Homo sapiens
tgccagggtttcgagaagctgct

SEQ ID NO: 5801366 - DNA, 14 bp, Homo sapiens
tgccaggtggctca

SEQ ID NO: 5801367 - DNA, 18 bp, Homo sapiens
tgccaggttaggaaggca

SEQ ID NO: 5801368 - DNA, 15 bp, Homo sapiens
tgccaggttgcagct

SEQ ID NO: 5801369 - DNA, 17 bp, Homo sapiens
tgccaggttgcagctgc

SEQ ID NO: 5801370 - DNA, 18 bp, Homo sapiens
tgccaggttgcagctgct

SEQ ID NO: 5801371 - DNA, 24 bp, Homo sapiens
tgccaggttgcagctgctcttgca

SEQ ID NO: 5801372 - DNA, 19 bp, Homo sapiens
tgccaggtttttggtctga

SEQ ID NO: 5801373 - DNA, 24 bp, Homo sapiens
tgccaggtttttggtctgacccac

SEQ ID NO: 5801374 - DNA, 17 bp, Homo sapiens
tgccagtaacaggctca

SEQ ID NO: 5801375 - DNA, 21 bp, Homo sapiens
tgccagtaacgcgtcttcctg

SEQ ID NO: 5801376 - DNA, 22 bp, Homo sapiens
tgccagtaccagccccaccctg

SEQ ID NO: 5801377 - DNA, 19 bp, Homo sapiens
tgccagtagtaccttgttt

SEQ ID NO: 5801378 - DNA, 18 bp, Homo sapiens
tgccagtatataagctgt

SEQ ID NO: 5801379 - DNA, 13 bp, Homo sapiens
tgccagtattttt

SEQ ID NO: 5801380 - DNA, 18 bp, Homo sapiens
tgccagtatttttaaagg

SEQ ID NO: 5801381 - DNA, 23 bp, Homo sapiens
tgccagtcaccccggccacctgc

SEQ ID NO: 5801382 - DNA, 17 bp, Homo sapiens
tgccagtccccctgccc

SEQ ID NO: 5801383 - DNA, 20 bp, Homo sapiens
tgccagtccccctgccccag

SEQ ID NO: 5801384 - DNA, 17 bp, Homo sapiens
tgccagtcctagctgca

SEQ ID NO: 5801385 - DNA, 13 bp, Homo sapiens
tgccagtcctcct

SEQ ID NO: 5801386 - DNA, 14 bp, Homo sapiens
tgccagtcctcctc

SEQ ID NO: 5801387 - DNA, 13 bp, Homo sapiens
tgccagtcctggg

SEQ ID NO: 5801388 - DNA, 14 bp, Homo sapiens
tgccagtcctgtcc

SEQ ID NO: 5801389 - DNA, 18 bp, Homo sapiens
tgccagtcgcgctgcctg

SEQ ID NO: 5801390 - DNA, 18 bp, Homo sapiens
tgccagtcgggagagcca

SEQ ID NO: 5801391 - DNA, 15 bp, Homo sapiens
tgccagtctcattgt

SEQ ID NO: 5801392 - DNA, 21 bp, Homo sapiens
tgccagtctcattttcatctt

SEQ ID NO: 5801393 - DNA, 17 bp, Homo sapiens
tgccagtgaagacttct

SEQ ID NO: 5801394 - DNA, 22 bp, Homo sapiens
tgccagtgaagtccttcagtga

SEQ ID NO: 5801395 - DNA, 16 bp, Homo sapiens
tgccagtgacacttcc

SEQ ID NO: 5801396 - DNA, 16 bp, Homo sapiens
tgccagtgacagacag

SEQ ID NO: 5801397 - DNA, 16 bp, Homo sapiens
tgccagtgactgctgc

SEQ ID NO: 5801398 - DNA, 21 bp, Homo sapiens
tgccagtgactgctgcgctgt

SEQ ID NO: 5801399 - DNA, 20 bp, Homo sapiens
tgccagtgcactccggcctg

SEQ ID NO: 5801400 - DNA, 14 bp, Homo sapiens
tgccagtgcagcca

SEQ ID NO: 5801401 - DNA, 16 bp, Homo sapiens
tgccagtgcagccact

SEQ ID NO: 5801402 - DNA, 16 bp, Homo sapiens
tgccagtgccagggtg

SEQ ID NO: 5801403 - DNA, 15 bp, Homo sapiens
tgccagtgcctgggt

SEQ ID NO: 5801404 - DNA, 23 bp, Homo sapiens
tgccagtgccttacctcctgccc

SEQ ID NO: 5801405 - DNA, 13 bp, Homo sapiens
tgccagtggagac

SEQ ID NO: 5801406 - DNA, 16 bp, Homo sapiens
tgccagtggggcctga

SEQ ID NO: 5801407 - DNA, 16 bp, Homo sapiens
tgccagtggtggaggt

SEQ ID NO: 5801408 - DNA, 18 bp, Homo sapiens
tgccagtggtggaggtgg

SEQ ID NO: 5801409 - DNA, 19 bp, Homo sapiens
tgccagtggtggaggtggg

SEQ ID NO: 5801410 - DNA, 16 bp, Homo sapiens
tgccagtgtcctgagc

SEQ ID NO: 5801411 - DNA, 15 bp, Homo sapiens
tgccagtgtctttct

SEQ ID NO: 5801412 - DNA, 16 bp, Homo sapiens
tgccagtgtctttctt

SEQ ID NO: 5801413 - DNA, 13 bp, Homo sapiens
tgccagtgtgctg

SEQ ID NO: 5801414 - DNA, 19 bp, Homo sapiens
tgccagtgtgctgatgggc

SEQ ID NO: 5801415 - DNA, 18 bp, Homo sapiens
tgccagttacttgcttta

SEQ ID NO: 5801416 - DNA, 19 bp, Homo sapiens
tgccagttacttgggcttc

SEQ ID NO: 5801417 - DNA, 15 bp, Homo sapiens
tgccagttgaagtga

SEQ ID NO: 5801418 - DNA, 14 bp, Homo sapiens
tgccagttgggctc

SEQ ID NO: 5801419 - DNA, 15 bp, Homo sapiens
tgccagttgtcctcc

SEQ ID NO: 5801420 - DNA, 18 bp, Homo sapiens
tgccagtttaaaaagatg

SEQ ID NO: 5801421 - DNA, 21 bp, Homo sapiens
tgccagttttattttctaaat

SEQ ID NO: 5801422 - DNA, 16 bp, Homo sapiens
tgccagttttccctgg

SEQ ID NO: 5801423 - DNA, 23 bp, Homo sapiens
tgccagttttccgaagtctctga

SEQ ID NO: 5801424 - DNA, 16 bp, Homo sapiens
tgccataaaacattaa

SEQ ID NO: 5801425 - DNA, 17 bp, Homo sapiens
tgccataaaattgcagt

SEQ ID NO: 5801426 - DNA, 19 bp, Homo sapiens
tgccataaatatttctcaa

SEQ ID NO: 5801427 - DNA, 14 bp, Homo sapiens
tgccataaccacat

SEQ ID NO: 5801428 - DNA, 14 bp, Homo sapiens
tgccataatatgat

SEQ ID NO: 5801429 - DNA, 18 bp, Homo sapiens
tgccataatatgatgcaa

SEQ ID NO: 5801430 - DNA, 18 bp, Homo sapiens
tgccataatcagaacaca

SEQ ID NO: 5801431 - DNA, 22 bp, Homo sapiens
tgccatacatcagttattcatt

SEQ ID NO: 5801432 - DNA, 23 bp, Homo sapiens
tgccatacatgttattgttttca

SEQ ID NO: 5801433 - DNA, 18 bp, Homo sapiens
tgccataccgctggggaa

SEQ ID NO: 5801434 - DNA, 20 bp, Homo sapiens
tgccataccttctcccaggc

SEQ ID NO: 5801435 - DNA, 12 bp, Homo sapiens
tgccatactaat

SEQ ID NO: 5801436 - DNA, 16 bp, Homo sapiens
tgccatactaatgatg

SEQ ID NO: 5801437 - DNA, 18 bp, Homo sapiens
tgccatactaatgatgag

SEQ ID NO: 5801438 - DNA, 18 bp, Homo sapiens
tgccatacttgttctgta

SEQ ID NO: 5801439 - DNA, 14 bp, Homo sapiens
tgccatagagtaca

SEQ ID NO: 5801440 - DNA, 18 bp, Homo sapiens
tgccatagagtacactgc

SEQ ID NO: 5801441 - DNA, 18 bp, Homo sapiens
tgccatagagtttaacac

SEQ ID NO: 5801442 - DNA, 17 bp, Homo sapiens
tgccatagcagtgctag

SEQ ID NO: 5801443 - DNA, 20 bp, Homo sapiens
tgccatagcataatatgaag

SEQ ID NO: 5801444 - DNA, 16 bp, Homo sapiens
tgccatagccaggagc

SEQ ID NO: 5801445 - DNA, 15 bp, Homo sapiens
tgccatagggaccaa

SEQ ID NO: 5801446 - DNA, 23 bp, Homo sapiens
tgccatagggtctgcagcctgct

SEQ ID NO: 5801447 - DNA, 24 bp, Homo sapiens
tgccatagtcaaagagagttttta

SEQ ID NO: 5801448 - DNA, 16 bp, Homo sapiens
tgccatagtcacatgg

SEQ ID NO: 5801449 - DNA, 21 bp, Homo sapiens
tgccatatataacagatacat

SEQ ID NO: 5801450 - DNA, 18 bp, Homo sapiens
tgccatattaaaatctga

SEQ ID NO: 5801451 - DNA, 22 bp, Homo sapiens
tgccatattctggttcttgaaa

SEQ ID NO: 5801452 - DNA, 15 bp, Homo sapiens
tgccatattctgttg

SEQ ID NO: 5801453 - DNA, 21 bp, Homo sapiens
tgccatattctgttggccagt

SEQ ID NO: 5801454 - DNA, 19 bp, Homo sapiens
tgccatattgcacatgtct

SEQ ID NO: 5801455 - DNA, 18 bp, Homo sapiens
tgcccagcaggcccagca

SEQ ID NO: 5801456 - DNA, 17 bp, Homo sapiens
tgcccagccacccctca

SEQ ID NO: 5801457 - DNA, 17 bp, Homo sapiens
tgcccagccactccaag

SEQ ID NO: 5801458 - DNA, 21 bp, Homo sapiens
tgcccagccagccacccctgc

SEQ ID NO: 5801459 - DNA, 18 bp, Homo sapiens
tgcccagcccctcctccc

SEQ ID NO: 5801460 - DNA, 13 bp, Homo sapiens
tgcccagcccctg

SEQ ID NO: 5801461 - DNA, 15 bp, Homo sapiens
tgcccagcccctgcc

SEQ ID NO: 5801462 - DNA, 17 bp, Homo sapiens
tgcccagcccctgcccc

SEQ ID NO: 5801463 - DNA, 19 bp, Homo sapiens
tgcccagcccctgccccta

SEQ ID NO: 5801464 - DNA, 19 bp, Homo sapiens
tgcccagcccctggtggtg

SEQ ID NO: 5801465 - DNA, 17 bp, Homo sapiens
tgcccagccccttctga

SEQ ID NO: 5801466 - DNA, 22 bp, Homo sapiens
tgcccagccccttttctctgct

SEQ ID NO: 5801467 - DNA, 23 bp, Homo sapiens
tgcccagccccttttctctgctc

SEQ ID NO: 5801468 - DNA, 11 bp, Homo sapiens
tgcccagccct

SEQ ID NO: 5801469 - DNA, 12 bp, Homo sapiens
tgcccagccctc

SEQ ID NO: 5801470 - DNA, 14 bp, Homo sapiens
tgcccagccctctg

SEQ ID NO: 5801471 - DNA, 21 bp, Homo sapiens
tgcccagccctctgtggccag

SEQ ID NO: 5801472 - DNA, 17 bp, Homo sapiens
tgcccagccctggccca

SEQ ID NO: 5801473 - DNA, 20 bp, Homo sapiens
tgcccagccctggcccaggt

SEQ ID NO: 5801474 - DNA, 21 bp, Homo sapiens
tgcccagccctggcccaggtg

SEQ ID NO: 5801475 - DNA, 23 bp, Homo sapiens
tgcccagccctggcccaggtgcc

SEQ ID NO: 5801476 - DNA, 16 bp, Homo sapiens
tgcccagccgggcaca

SEQ ID NO: 5801477 - DNA, 16 bp, Homo sapiens
tgcccagcctctttcc

SEQ ID NO: 5801478 - DNA, 21 bp, Homo sapiens
tgcccagcctggatgccatcc

SEQ ID NO: 5801479 - DNA, 12 bp, Homo sapiens
tgcccagcctgt

SEQ ID NO: 5801480 - DNA, 20 bp, Homo sapiens
tgcccagcggctcttcctgg

SEQ ID NO: 5801481 - DNA, 20 bp, Homo sapiens
tgcccagctagctgcagagc

SEQ ID NO: 5801482 - DNA, 20 bp, Homo sapiens
tgcccagctatacctgtgcc

SEQ ID NO: 5801483 - DNA, 21 bp, Homo sapiens
tgcccagctatacctgtgcct

SEQ ID NO: 5801484 - DNA, 22 bp, Homo sapiens
tgcccagctatacctgtgcctc

SEQ ID NO: 5801485 - DNA, 21 bp, Homo sapiens
tgcccagctcagtcttcccta

SEQ ID NO: 5801486 - DNA, 14 bp, Homo sapiens
tgcccagctctctg

SEQ ID NO: 5801487 - DNA, 15 bp, Homo sapiens
tgcccagctctctga

SEQ ID NO: 5801488 - DNA, 16 bp, Homo sapiens
tgcccagctctctgac

SEQ ID NO: 5801489 - DNA, 12 bp, Homo sapiens
tgcccagctctg

SEQ ID NO: 5801490 - DNA, 13 bp, Homo sapiens
tgcccagctgtgc

SEQ ID NO: 5801491 - DNA, 18 bp, Homo sapiens
tgcccagctgtgctggga

SEQ ID NO: 5801492 - DNA, 21 bp, Homo sapiens
tgcccagcttcgtcagctcca

SEQ ID NO: 5801493 - DNA, 23 bp, Homo sapiens
tgcccagcttcgtcagctccagc

SEQ ID NO: 5801494 - DNA, 18 bp, Homo sapiens
tgcccagcttgggcccag

SEQ ID NO: 5801495 - DNA, 20 bp, Homo sapiens
tgcccagcttgggcccagct

SEQ ID NO: 5801496 - DNA, 19 bp, Homo sapiens
tgcccagcttttcattgct

SEQ ID NO: 5801497 - DNA, 22 bp, Homo sapiens
tgcccaggaaaggacggctgag

SEQ ID NO: 5801498 - DNA, 23 bp, Homo sapiens
tgcccaggaactcgcacctgtgc

SEQ ID NO: 5801499 - DNA, 20 bp, Homo sapiens
tgcccaggaagtaattttct

SEQ ID NO: 5801500 - DNA, 16 bp, Homo sapiens
tgcccaggagagccag

SEQ ID NO: 5801501 - DNA, 18 bp, Homo sapiens
tgcccaggagagccagcc

SEQ ID NO: 5801502 - DNA, 21 bp, Homo sapiens
tgcccaggagagccagccctc

SEQ ID NO: 5801503 - DNA, 12 bp, Homo sapiens
tgcccaggagca

SEQ ID NO: 5801504 - DNA, 15 bp, Homo sapiens
tgcccaggcaaggaa

SEQ ID NO: 5801505 - DNA, 15 bp, Homo sapiens
tgcccaggcactgca

SEQ ID NO: 5801506 - DNA, 14 bp, Homo sapiens
tgcccaggcaggtc

SEQ ID NO: 5801507 - DNA, 15 bp, Homo sapiens
tgcccaggcaggtct

SEQ ID NO: 5801508 - DNA, 16 bp, Homo sapiens
tgcccaggcaggtctt

SEQ ID NO: 5801509 - DNA, 16 bp, Homo sapiens
tgcccaggcagtcttt

SEQ ID NO: 5801510 - DNA, 16 bp, Homo sapiens
tgcccaggccacagcc

SEQ ID NO: 5801511 - DNA, 14 bp, Homo sapiens
tgcccaggcccctg

SEQ ID NO: 5801512 - DNA, 20 bp, Homo sapiens
tgcccaggccggccagcctc

SEQ ID NO: 5801513 - DNA, 18 bp, Homo sapiens
tgcccaggcctatctgga

SEQ ID NO: 5801514 - DNA, 20 bp, Homo sapiens
tgcccaggcctctcggtgct

SEQ ID NO: 5801515 - DNA, 20 bp, Homo sapiens
tgcccaggctagagtgcagt

SEQ ID NO: 5801516 - DNA, 13 bp, Homo sapiens
tgcccaggctctg

SEQ ID NO: 5801517 - DNA, 14 bp, Homo sapiens
tgcccaggctctgc

SEQ ID NO: 5801518 - DNA, 16 bp, Homo sapiens
tgcccaggctctgctg

SEQ ID NO: 5801519 - DNA, 18 bp, Homo sapiens
tgcccaggctctgctgac

SEQ ID NO: 5801520 - DNA, 11 bp, Homo sapiens
tgcccaggctg

SEQ ID NO: 5801521 - DNA, 12 bp, Homo sapiens
tgcccaggctgg

SEQ ID NO: 5801522 - DNA, 20 bp, Homo sapiens
tgcccaggctggagtacaat

SEQ ID NO: 5801523 - DNA, 20 bp, Homo sapiens
tgcccaggctggagtgcaat

SEQ ID NO: 5801524 - DNA, 13 bp, Homo sapiens
tgcccaggctggc

SEQ ID NO: 5801525 - DNA, 15 bp, Homo sapiens
tgcccaggctggcct

SEQ ID NO: 5801526 - DNA, 16 bp, Homo sapiens
tgcccaggctggcctg

SEQ ID NO: 5801527 - DNA, 20 bp, Homo sapiens
tgcccaggctggcgtgcagt

SEQ ID NO: 5801528 - DNA, 14 bp, Homo sapiens
tgcccagggaataa

SEQ ID NO: 5801529 - DNA, 16 bp, Homo sapiens
tgcccagggctcagcc

SEQ ID NO: 5801530 - DNA, 19 bp, Homo sapiens
tgcccagggctcagcctgg

SEQ ID NO: 5801531 - DNA, 14 bp, Homo sapiens
tgcccaggggagcc

SEQ ID NO: 5801532 - DNA, 15 bp, Homo sapiens
tgcccaggggagccc

SEQ ID NO: 5801533 - DNA, 16 bp, Homo sapiens
tgcccaggggagccct

SEQ ID NO: 5801534 - DNA, 16 bp, Homo sapiens
tgcccaggggtgcccc

SEQ ID NO: 5801535 - DNA, 22 bp, Homo sapiens
tgcccaggggtgccccctcctc

SEQ ID NO: 5801536 - DNA, 21 bp, Homo sapiens
tgcccagggtcagtgtatcta

SEQ ID NO: 5801537 - DNA, 20 bp, Homo sapiens
tgcccagggtcctgtgcctg

SEQ ID NO: 5801538 - DNA, 23 bp, Homo sapiens
tgcccagggtggctgccagccca

SEQ ID NO: 5801539 - DNA, 17 bp, Homo sapiens
tgcccaggtatcctggg

SEQ ID NO: 5801540 - DNA, 19 bp, Homo sapiens
tgcccaggtatcctggggg

SEQ ID NO: 5801541 - DNA, 13 bp, Homo sapiens
tgcccaggtcacc

SEQ ID NO: 5801542 - DNA, 15 bp, Homo sapiens
tgcccaggtgaggga

SEQ ID NO: 5801543 - DNA, 19 bp, Homo sapiens
tgcccaggtgagggaagga

SEQ ID NO: 5801544 - DNA, 20 bp, Homo sapiens
tgcccaggtggcctcctggc

SEQ ID NO: 5801545 - DNA, 18 bp, Homo sapiens
tgcccagtaaaatttcag

SEQ ID NO: 5801546 - DNA, 22 bp, Homo sapiens
tgcccagtcatgacatttctca

SEQ ID NO: 5801547 - DNA, 16 bp, Homo sapiens
tgcccagtctggaaga

SEQ ID NO: 5801548 - DNA, 14 bp, Homo sapiens
tgcccagtctttca

SEQ ID NO: 5801549 - DNA, 17 bp, Homo sapiens
tgcccagtctttcatgt

SEQ ID NO: 5801550 - DNA, 15 bp, Homo sapiens
tgcccagtgagccct

SEQ ID NO: 5801551 - DNA, 19 bp, Homo sapiens
tgcccagtgagccctgctc

SEQ ID NO: 5801552 - DNA, 17 bp, Homo sapiens
tgcccagtgatggcatt

SEQ ID NO: 5801553 - DNA, 20 bp, Homo sapiens
tgcccagtgcaaaccacttc

SEQ ID NO: 5801554 - DNA, 18 bp, Homo sapiens
tgcccagtggagcctgcc

SEQ ID NO: 5801555 - DNA, 12 bp, Homo sapiens
tgcccagtgttg

SEQ ID NO: 5801556 - DNA, 20 bp, Homo sapiens
tgcccagttaatcttgcttt

SEQ ID NO: 5801557 - DNA, 21 bp, Homo sapiens
tgcccagttattcttaagtaa

SEQ ID NO: 5801558 - DNA, 16 bp, Homo sapiens
tgcccagtttctgcct

SEQ ID NO: 5801559 - DNA, 19 bp, Homo sapiens
tgcccagtttctgcctctg

SEQ ID NO: 5801560 - DNA, 15 bp, Homo sapiens
tgcccatactgagcc

SEQ ID NO: 5801561 - DNA, 16 bp, Homo sapiens
tgcccatactgagcct

SEQ ID NO: 5801562 - DNA, 17 bp, Homo sapiens
tgcccatcaagtgcagt

SEQ ID NO: 5801563 - DNA, 14 bp, Homo sapiens
tgcccatcatctct

SEQ ID NO: 5801564 - DNA, 18 bp, Homo sapiens
tgcccatcatctctgcct

SEQ ID NO: 5801565 - DNA, 19 bp, Homo sapiens
tgcccatcatctctgcctt

SEQ ID NO: 5801566 - DNA, 22 bp, Homo sapiens
tgcccatcatgtggccccaccc

SEQ ID NO: 5801567 - DNA, 12 bp, Homo sapiens
tgcccatcccac

SEQ ID NO: 5801568 - DNA, 16 bp, Homo sapiens
tgcccatcccacccca

SEQ ID NO: 5801569 - DNA, 19 bp, Homo sapiens
tgcccatcccaccccatga

SEQ ID NO: 5801570 - DNA, 16 bp, Homo sapiens
tgcccatcccagtccc

SEQ ID NO: 5801571 - DNA, 22 bp, Homo sapiens
tgcccatcccagtccctcgccg

SEQ ID NO: 5801572 - DNA, 18 bp, Homo sapiens
tgcccatccgtctgtctg

SEQ ID NO: 5801573 - DNA, 11 bp, Homo sapiens
tgcccatcctc

SEQ ID NO: 5801574 - DNA, 14 bp, Homo sapiens
tgcccatcctgcca

SEQ ID NO: 5801575 - DNA, 16 bp, Homo sapiens
tgcccatcctgtctgt

SEQ ID NO: 5801576 - DNA, 17 bp, Homo sapiens
tgcccatgaacaagtta

SEQ ID NO: 5801577 - DNA, 16 bp, Homo sapiens
tgcccatgagcaagcc

SEQ ID NO: 5801578 - DNA, 18 bp, Homo sapiens
tgcccatgagcaagccta

SEQ ID NO: 5801579 - DNA, 15 bp, Homo sapiens
tgcccatgccaccgc

SEQ ID NO: 5801580 - DNA, 20 bp, Homo sapiens
tgcccatgctgggagcccac

SEQ ID NO: 5801581 - DNA, 14 bp, Homo sapiens
tgcccatgctgggc

SEQ ID NO: 5801582 - DNA, 17 bp, Homo sapiens
tgcccatgctgggctcc

SEQ ID NO: 5801583 - DNA, 17 bp, Homo sapiens
tgcccatgggcactgct

SEQ ID NO: 5801584 - DNA, 22 bp, Homo sapiens
tgcccatgtccagagggactgg

SEQ ID NO: 5801585 - DNA, 19 bp, Homo sapiens
tgcccatgtgtacattctg

SEQ ID NO: 5801586 - DNA, 13 bp, Homo sapiens
tgcccatgtgtat

SEQ ID NO: 5801587 - DNA, 18 bp, Homo sapiens
tgcccatgtgtcccctca

SEQ ID NO: 5801588 - DNA, 19 bp, Homo sapiens
tgcccatgtgtcccctcac

SEQ ID NO: 5801589 - DNA, 13 bp, Homo sapiens
tgcccatgtttca

SEQ ID NO: 5801590 - DNA, 16 bp, Homo sapiens
tgcccattagagaagt

SEQ ID NO: 5801591 - DNA, 18 bp, Homo sapiens
tgcccattcaccaaaatt

SEQ ID NO: 5801592 - DNA, 18 bp, Homo sapiens
tgcccattccccagcctc

SEQ ID NO: 5801593 - DNA, 13 bp, Homo sapiens
tgcccattcctgc

SEQ ID NO: 5801594 - DNA, 16 bp, Homo sapiens
tgcccattcctgcctg

SEQ ID NO: 5801595 - DNA, 18 bp, Homo sapiens
tgcccattcctgcctggt

SEQ ID NO: 5801596 - DNA, 16 bp, Homo sapiens
tgcccattctcttagt

SEQ ID NO: 5801597 - DNA, 17 bp, Homo sapiens
tgcccattcttttcact

SEQ ID NO: 5801598 - DNA, 18 bp, Homo sapiens
tgcccattcttttcactt

SEQ ID NO: 5801599 - DNA, 16 bp, Homo sapiens
tgcccatttcacacaa

SEQ ID NO: 5801600 - DNA, 22 bp, Homo sapiens
tgcccatttcatattctttcaa

SEQ ID NO: 5801601 - DNA, 14 bp, Homo sapiens
tgcccattttgaat

SEQ ID NO: 5801602 - DNA, 20 bp, Homo sapiens
tgccccaaacaaatatgcaa

SEQ ID NO: 5801603 - DNA, 18 bp, Homo sapiens
tgccccaaactttctcat

SEQ ID NO: 5801604 - DNA, 21 bp, Homo sapiens
tgccccaaataacttcagtcc

SEQ ID NO: 5801605 - DNA, 22 bp, Homo sapiens
tgccccaaataacttcagtcct

SEQ ID NO: 5801606 - DNA, 19 bp, Homo sapiens
tgccccaactccttccagc

SEQ ID NO: 5801607 - DNA, 20 bp, Homo sapiens
tgccccaactccttccagct

SEQ ID NO: 5801608 - DNA, 22 bp, Homo sapiens
tgccccaactccttccagctag

SEQ ID NO: 5801609 - DNA, 23 bp, Homo sapiens
tgccccaagaggctagccccagg

SEQ ID NO: 5801610 - DNA, 14 bp, Homo sapiens
tgccccaagcagcc

SEQ ID NO: 5801611 - DNA, 17 bp, Homo sapiens
tgccccaagcagccagc

SEQ ID NO: 5801612 - DNA, 11 bp, Homo sapiens
tgccccaagga

SEQ ID NO: 5801613 - DNA, 19 bp, Homo sapiens
tgccccaaggccccaggga

SEQ ID NO: 5801614 - DNA, 20 bp, Homo sapiens
tgccccaaggccccagggac

SEQ ID NO: 5801615 - DNA, 12 bp, Homo sapiens
tgccccaagggg

SEQ ID NO: 5801616 - DNA, 20 bp, Homo sapiens
tgccccaagtggtgagcaag

SEQ ID NO: 5801617 - DNA, 16 bp, Homo sapiens
tgccccacacaggcct

SEQ ID NO: 5801618 - DNA, 22 bp, Homo sapiens
tgccccacacccagccagctcc

SEQ ID NO: 5801619 - DNA, 15 bp, Homo sapiens
tgccccacacggact

SEQ ID NO: 5801620 - DNA, 22 bp, Homo sapiens
tgccccacacggactcccgggc

SEQ ID NO: 5801621 - DNA, 13 bp, Homo sapiens
tgccccacaggcc

SEQ ID NO: 5801622 - DNA, 17 bp, Homo sapiens
tgccccacaggccacac

SEQ ID NO: 5801623 - DNA, 20 bp, Homo sapiens
tgccccacaggccacacgct

SEQ ID NO: 5801624 - DNA, 22 bp, Homo sapiens
tgccccacaggccacacgctgc

SEQ ID NO: 5801625 - DNA, 18 bp, Homo sapiens
tgccccacatccccacct

SEQ ID NO: 5801626 - DNA, 12 bp, Homo sapiens
tgccccacatgc

SEQ ID NO: 5801627 - DNA, 13 bp, Homo sapiens
tgccccacatgca

SEQ ID NO: 5801628 - DNA, 19 bp, Homo sapiens
tgccccaccacgcatgctc

SEQ ID NO: 5801629 - DNA, 15 bp, Homo sapiens
tgccccaccactccc

SEQ ID NO: 5801630 - DNA, 22 bp, Homo sapiens
tgccccaccactccccaacccc

SEQ ID NO: 5801631 - DNA, 12 bp, Homo sapiens
tgccccaccagc

SEQ ID NO: 5801632 - DNA, 15 bp, Homo sapiens
tgccccaccagccac

SEQ ID NO: 5801633 - DNA, 23 bp, Homo sapiens
tgccctcttactgttttgaggaa

SEQ ID NO: 5801634 - DNA, 17 bp, Homo sapiens
tgccctcttctccttgc

SEQ ID NO: 5801635 - DNA, 16 bp, Homo sapiens
tgccctgacctcccag

SEQ ID NO: 5801636 - DNA, 18 bp, Homo sapiens
tgccctgacctcccagcc

SEQ ID NO: 5801637 - DNA, 21 bp, Homo sapiens
tgccctgacctcccagcccta

SEQ ID NO: 5801638 - DNA, 11 bp, Homo sapiens
tgccctgagaa

SEQ ID NO: 5801639 - DNA, 15 bp, Homo sapiens
tgccctgagaagctg

SEQ ID NO: 5801640 - DNA, 12 bp, Homo sapiens
tgccctgagccc

SEQ ID NO: 5801641 - DNA, 18 bp, Homo sapiens
tgccctgaggagggccct

SEQ ID NO: 5801642 - DNA, 19 bp, Homo sapiens
tgccctgaggagggccctg

SEQ ID NO: 5801643 - DNA, 23 bp, Homo sapiens
tgccctgaggagggccctgagga

SEQ ID NO: 5801644 - DNA, 13 bp, Homo sapiens
tgccctgaggggc

SEQ ID NO: 5801645 - DNA, 15 bp, Homo sapiens
tgccctgaggggcct

SEQ ID NO: 5801646 - DNA, 18 bp, Homo sapiens
tgccctgaggggcctgcc

SEQ ID NO: 5801647 - DNA, 22 bp, Homo sapiens
tgccctgagtggatctccaagg

SEQ ID NO: 5801648 - DNA, 16 bp, Homo sapiens
tgccctgcaccttggg

SEQ ID NO: 5801649 - DNA, 18 bp, Homo sapiens
tgccctgcaccttgggca

SEQ ID NO: 5801650 - DNA, 22 bp, Homo sapiens
tgccctgcacgtcatgggaggg

SEQ ID NO: 5801651 - DNA, 13 bp, Homo sapiens
tgccctgcagagc

SEQ ID NO: 5801652 - DNA, 14 bp, Homo sapiens
tgccctgcagagca

SEQ ID NO: 5801653 - DNA, 20 bp, Homo sapiens
tgccctgcagagcaataaca

SEQ ID NO: 5801654 - DNA, 21 bp, Homo sapiens
tgccctgcagagcaataacac

SEQ ID NO: 5801655 - DNA, 17 bp, Homo sapiens
tgccctgcatgctgccc

SEQ ID NO: 5801656 - DNA, 15 bp, Homo sapiens
tgccctgccaagcct

SEQ ID NO: 5801657 - DNA, 19 bp, Homo sapiens
tgccctgccaagcctggag

SEQ ID NO: 5801658 - DNA, 20 bp, Homo sapiens
tgccctgccacctgtctgtc

SEQ ID NO: 5801659 - DNA, 21 bp, Homo sapiens
tgccctgccacctgtctgtct

SEQ ID NO: 5801660 - DNA, 13 bp, Homo sapiens
tgccctgccagct

SEQ ID NO: 5801661 - DNA, 17 bp, Homo sapiens
tgccctgccagctgcag

SEQ ID NO: 5801662 - DNA, 23 bp, Homo sapiens
tgccctgccagctgcagcctggt

SEQ ID NO: 5801663 - DNA, 13 bp, Homo sapiens
tgccctgccaggc

SEQ ID NO: 5801664 - DNA, 14 bp, Homo sapiens
tgccctgccaggct

SEQ ID NO: 5801665 - DNA, 20 bp, Homo sapiens
tgccctgccaggctgtcagc

SEQ ID NO: 5801666 - DNA, 21 bp, Homo sapiens
tgccctgcccaacctctgtgg

SEQ ID NO: 5801667 - DNA, 14 bp, Homo sapiens
tgccctgcccaagt

SEQ ID NO: 5801668 - DNA, 15 bp, Homo sapiens
tgccctgcccacctg

SEQ ID NO: 5801669 - DNA, 11 bp, Homo sapiens
tgccctgcccc

SEQ ID NO: 5801670 - DNA, 17 bp, Homo sapiens
tgccctgccccctggct

SEQ ID NO: 5801671 - DNA, 16 bp, Homo sapiens
tgccctgccctagctc

SEQ ID NO: 5801672 - DNA, 14 bp, Homo sapiens
tgccctgccctcac

SEQ ID NO: 5801673 - DNA, 18 bp, Homo sapiens
tgccctgccctgccacct

SEQ ID NO: 5801674 - DNA, 15 bp, Homo sapiens
tgccctgccctggcc

SEQ ID NO: 5801675 - DNA, 21 bp, Homo sapiens
tgccctgccgtggtggcagct

SEQ ID NO: 5801676 - DNA, 13 bp, Homo sapiens
tgccctgcctcag

SEQ ID NO: 5801677 - DNA, 12 bp, Homo sapiens
tgccctgcctga

SEQ ID NO: 5801678 - DNA, 17 bp, Homo sapiens
tgccctgcctgagggcc

SEQ ID NO: 5801679 - DNA, 13 bp, Homo sapiens
tgccctgcctgca

SEQ ID NO: 5801680 - DNA, 15 bp, Homo sapiens
tgccctgcctgccca

SEQ ID NO: 5801681 - DNA, 17 bp, Homo sapiens
tgccctgcctgcccact

SEQ ID NO: 5801682 - DNA, 14 bp, Homo sapiens
tgccctgcctgggc

SEQ ID NO: 5801683 - DNA, 11 bp, Homo sapiens
tgccctgcctt

SEQ ID NO: 5801684 - DNA, 13 bp, Homo sapiens
tgccctgccttga

SEQ ID NO: 5801685 - DNA, 22 bp, Homo sapiens
tgccctgccttgaacaacccaa

SEQ ID NO: 5801686 - DNA, 21 bp, Homo sapiens
tgccctgccttgccgctcccc

SEQ ID NO: 5801687 - DNA, 16 bp, Homo sapiens
tgccctgccttgctgc

SEQ ID NO: 5801688 - DNA, 17 bp, Homo sapiens
tgccctgccttgctgcc

SEQ ID NO: 5801689 - DNA, 18 bp, Homo sapiens
tgccctgccttgctgcct

SEQ ID NO: 5801690 - DNA, 19 bp, Homo sapiens
tgccctgccttgtccctct

SEQ ID NO: 5801691 - DNA, 19 bp, Homo sapiens
tgccctgcgggtcacagga

SEQ ID NO: 5801692 - DNA, 15 bp, Homo sapiens
tgccctgctcctaag

SEQ ID NO: 5801693 - DNA, 15 bp, Homo sapiens
tgccctgctctgccc

SEQ ID NO: 5801694 - DNA, 15 bp, Homo sapiens
tgccctgctctgggg

SEQ ID NO: 5801695 - DNA, 22 bp, Homo sapiens
tgccctgctgagtcccaggctg

SEQ ID NO: 5801696 - DNA, 13 bp, Homo sapiens
tgccctgctgcca

SEQ ID NO: 5801697 - DNA, 15 bp, Homo sapiens
tgccctgctgccaca

SEQ ID NO: 5801698 - DNA, 23 bp, Homo sapiens
tgccctgctgccgcctcccagcc

SEQ ID NO: 5801699 - DNA, 20 bp, Homo sapiens
tgccctgctggcctgtctcc

SEQ ID NO: 5801700 - DNA, 15 bp, Homo sapiens
tgccctggaccagcc

SEQ ID NO: 5801701 - DNA, 21 bp, Homo sapiens
tgccctggagcctcagcagca

SEQ ID NO: 5801702 - DNA, 19 bp, Homo sapiens
tgccctggaggctgacaca

SEQ ID NO: 5801703 - DNA, 16 bp, Homo sapiens
tgccctggcccagcct

SEQ ID NO: 5801704 - DNA, 18 bp, Homo sapiens
tgccctggcccagcctgt

SEQ ID NO: 5801705 - DNA, 24 bp, Homo sapiens
tgccctggcccagcctgtggcctc

SEQ ID NO: 5801706 - DNA, 16 bp, Homo sapiens
tgccctggccctgagg

SEQ ID NO: 5801707 - DNA, 17 bp, Homo sapiens
tgccctggccctgaggt

SEQ ID NO: 5801708 - DNA, 11 bp, Homo sapiens
tgccctggcct

SEQ ID NO: 5801709 - DNA, 13 bp, Homo sapiens
tgccctggcctac

SEQ ID NO: 5801710 - DNA, 13 bp, Homo sapiens
tgccctgggaggc

SEQ ID NO: 5801711 - DNA, 18 bp, Homo sapiens
tgccctgggaggcagtga

SEQ ID NO: 5801712 - DNA, 22 bp, Homo sapiens
tgccctgggccaaaaccaatgc

SEQ ID NO: 5801713 - DNA, 17 bp, Homo sapiens
tgccctgggccaggcag

SEQ ID NO: 5801714 - DNA, 21 bp, Homo sapiens
tgccctgggccaggcaggcga

SEQ ID NO: 5801715 - DNA, 20 bp, Homo sapiens
tgccctgggcgagcccctcc

SEQ ID NO: 5801716 - DNA, 14 bp, Homo sapiens
tgccctgggctcct

SEQ ID NO: 5801717 - DNA, 15 bp, Homo sapiens
tgccctgggctgcct

SEQ ID NO: 5801718 - DNA, 15 bp, Homo sapiens
tgccctggggagaaa

SEQ ID NO: 5801719 - DNA, 21 bp, Homo sapiens
tgccctggggctgatctcagg

SEQ ID NO: 5801720 - DNA, 22 bp, Homo sapiens
tgccctgggggataccagctga

SEQ ID NO: 5801721 - DNA, 17 bp, Homo sapiens
tgccctgggggccgtgc

SEQ ID NO: 5801722 - DNA, 20 bp, Homo sapiens
tgccctgggtcacctagctg

SEQ ID NO: 5801723 - DNA, 19 bp, Homo sapiens
tgccctgggtcctgcctgc

SEQ ID NO: 5801724 - DNA, 18 bp, Homo sapiens
tgccctgggttcttccac

SEQ ID NO: 5801725 - DNA, 18 bp, Homo sapiens
tgccctggtccagggaag

SEQ ID NO: 5801726 - DNA, 21 bp, Homo sapiens
tgccctggtccagggaagctg

SEQ ID NO: 5801727 - DNA, 19 bp, Homo sapiens
tgccctggtgaatcacctg

SEQ ID NO: 5801728 - DNA, 23 bp, Homo sapiens
tgccctggtgaatcacctggctg

SEQ ID NO: 5801729 - DNA, 14 bp, Homo sapiens
tgccctggtgctgc

SEQ ID NO: 5801730 - DNA, 17 bp, Homo sapiens
tgccctggtgctgccac

SEQ ID NO: 5801731 - DNA, 20 bp, Homo sapiens
tgccctggtgctgccacact

SEQ ID NO: 5801732 - DNA, 16 bp, Homo sapiens
tgccctggtggccctc

SEQ ID NO: 5801733 - DNA, 22 bp, Homo sapiens
tgccctggtttcactggcccaa

SEQ ID NO: 5801734 - DNA, 12 bp, Homo sapiens
tgccctgtacct

SEQ ID NO: 5801735 - DNA, 23 bp, Homo sapiens
tgccctgtatataatactaaagt

SEQ ID NO: 5801736 - DNA, 22 bp, Homo sapiens
tgccctgtccactctgctcagg

SEQ ID NO: 5801737 - DNA, 21 bp, Homo sapiens
tgccctgtccctagctcacac

SEQ ID NO: 5801738 - DNA, 18 bp, Homo sapiens
tgccctgtccctgtcccc

SEQ ID NO: 5801739 - DNA, 21 bp, Homo sapiens
tgccctgtcctccagcttccc

SEQ ID NO: 5801740 - DNA, 19 bp, Homo sapiens
tgccctgtggacaggatga

SEQ ID NO: 5801741 - DNA, 13 bp, Homo sapiens
tgccctgtgggac

SEQ ID NO: 5801742 - DNA, 22 bp, Homo sapiens
tgccctgtgggaccccaggccc

SEQ ID NO: 5801743 - DNA, 23 bp, Homo sapiens
tgccctgtgggaccccaggccca

SEQ ID NO: 5801744 - DNA, 14 bp, Homo sapiens
tgccctgtgggaga

SEQ ID NO: 5801745 - DNA, 15 bp, Homo sapiens
tgccctgtgggcccc

SEQ ID NO: 5801746 - DNA, 18 bp, Homo sapiens
tgccctgtgggcccccaa

SEQ ID NO: 5801747 - DNA, 13 bp, Homo sapiens
tgccctgtgtact

SEQ ID NO: 5801748 - DNA, 20 bp, Homo sapiens
tgccctgtgtacttcccggg

SEQ ID NO: 5801749 - DNA, 12 bp, Homo sapiens
tgccctgtgtgt

SEQ ID NO: 5801750 - DNA, 20 bp, Homo sapiens
tgccctgttaaaagatgaaa

SEQ ID NO: 5801751 - DNA, 18 bp, Homo sapiens
tgccctgttagctttcca

SEQ ID NO: 5801752 - DNA, 20 bp, Homo sapiens
tgccctgttcatgtgcctct

SEQ ID NO: 5801753 - DNA, 17 bp, Homo sapiens
tgccctgttctctacca

SEQ ID NO: 5801754 - DNA, 18 bp, Homo sapiens
tgccctgttctcttcaca

SEQ ID NO: 5801755 - DNA, 18 bp, Homo sapiens
tgccctgttgggggcttc

SEQ ID NO: 5801756 - DNA, 20 bp, Homo sapiens
tgccctgttgtgtatagatg

SEQ ID NO: 5801757 - DNA, 15 bp, Homo sapiens
tgcccttaaatcata

SEQ ID NO: 5801758 - DNA, 22 bp, Homo sapiens
tgcccttaatatccctggagtt

SEQ ID NO: 5801759 - DNA, 21 bp, Homo sapiens
tgcccttacacgtgcgtgtga

SEQ ID NO: 5801760 - DNA, 13 bp, Homo sapiens
tgcccttaggcca

SEQ ID NO: 5801761 - DNA, 12 bp, Homo sapiens
tgcccttccccc

SEQ ID NO: 5801762 - DNA, 21 bp, Homo sapiens
tgcccttccccctgcaaaaag

SEQ ID NO: 5801763 - DNA, 14 bp, Homo sapiens
tgcccttccccctt

SEQ ID NO: 5801764 - DNA, 23 bp, Homo sapiens
tgcccttccccctttctctgcct

SEQ ID NO: 5801765 - DNA, 15 bp, Homo sapiens
tgcccttccctctgg

SEQ ID NO: 5801766 - DNA, 16 bp, Homo sapiens
tgcccttccctctggg

SEQ ID NO: 5801767 - DNA, 13 bp, Homo sapiens
tgcccttccctgt

SEQ ID NO: 5801768 - DNA, 18 bp, Homo sapiens
tgcccttcctcagtttaa

SEQ ID NO: 5801769 - DNA, 15 bp, Homo sapiens
tgcccttcctccagg

SEQ ID NO: 5801770 - DNA, 13 bp, Homo sapiens
tgcccttcctcct

SEQ ID NO: 5801771 - DNA, 18 bp, Homo sapiens
tgcccttcgctgccagga

SEQ ID NO: 5801772 - DNA, 19 bp, Homo sapiens
tgcccttcgctgccaggac

SEQ ID NO: 5801773 - DNA, 21 bp, Homo sapiens
tgcccttcgctgccaggacac

SEQ ID NO: 5801774 - DNA, 20 bp, Homo sapiens
tgcccttctatactttctca

SEQ ID NO: 5801775 - DNA, 19 bp, Homo sapiens
tgcccttctcaagacttta

SEQ ID NO: 5801776 - DNA, 17 bp, Homo sapiens
tgcccttctctgcctcc

SEQ ID NO: 5801777 - DNA, 17 bp, Homo sapiens
tgcccttcttccattcc

SEQ ID NO: 5801778 - DNA, 14 bp, Homo sapiens
tgcccttctttcta

SEQ ID NO: 5801779 - DNA, 21 bp, Homo sapiens
tgcccttctttctaccctgct

SEQ ID NO: 5801780 - DNA, 16 bp, Homo sapiens
tgcccttgcagggtgg

SEQ ID NO: 5801781 - DNA, 21 bp, Homo sapiens
tgcccttgcagggtgggtgag

SEQ ID NO: 5801782 - DNA, 17 bp, Homo sapiens
tgcccttgccctgacct

SEQ ID NO: 5801783 - DNA, 19 bp, Homo sapiens
tgcccttgccctgacctcc

SEQ ID NO: 5801784 - DNA, 18 bp, Homo sapiens
tgcccttgctccagcctg

SEQ ID NO: 5801785 - DNA, 12 bp, Homo sapiens
tgcccttgctgg

SEQ ID NO: 5801786 - DNA, 13 bp, Homo sapiens
tgcccttgctggg

SEQ ID NO: 5801787 - DNA, 15 bp, Homo sapiens
tgcccttgctgggcc

SEQ ID NO: 5801788 - DNA, 21 bp, Homo sapiens
tgcccttgctgggcctggggg

SEQ ID NO: 5801789 - DNA, 22 bp, Homo sapiens
tgcccttggcaccaccagggtg

SEQ ID NO: 5801790 - DNA, 13 bp, Homo sapiens
tgcccttgggcca

SEQ ID NO: 5801791 - DNA, 22 bp, Homo sapiens
tgcccttggtagcagcctgggg

SEQ ID NO: 5801792 - DNA, 18 bp, Homo sapiens
tgcccttggtttctgggg

SEQ ID NO: 5801793 - DNA, 20 bp, Homo sapiens
tgcccttggtttctgggggc

SEQ ID NO: 5801794 - DNA, 16 bp, Homo sapiens
tgcccttgtcccactc

SEQ ID NO: 5801795 - DNA, 14 bp, Homo sapiens
tgcccttgtctgag

SEQ ID NO: 5801796 - DNA, 17 bp, Homo sapiens
tgcccttgttgcctgca

SEQ ID NO: 5801797 - DNA, 19 bp, Homo sapiens
tgcccttgttgcctgcacc

SEQ ID NO: 5801798 - DNA, 23 bp, Homo sapiens
tgcccttgtttggggcaggagta

SEQ ID NO: 5801799 - DNA, 24 bp, Homo sapiens
tgcccttgtttggggcaggagtag

SEQ ID NO: 5801800 - DNA, 13 bp, Homo sapiens
tgccctttcaaag

SEQ ID NO: 5801801 - DNA, 13 bp, Homo sapiens
tgccctttcctgg

SEQ ID NO: 5801802 - DNA, 20 bp, Homo sapiens
tgccctttggggttgcccag

SEQ ID NO: 5801803 - DNA, 17 bp, Homo sapiens
tgccctttgtcctcctg

SEQ ID NO: 5801804 - DNA, 19 bp, Homo sapiens
tgccctttgtcctcctgct

SEQ ID NO: 5801805 - DNA, 16 bp, Homo sapiens
tgcccttttcaggaag

SEQ ID NO: 5801806 - DNA, 19 bp, Homo sapiens
tgcccttttcctgggcctt

SEQ ID NO: 5801807 - DNA, 21 bp, Homo sapiens
tgcccttttcctgggccttct

SEQ ID NO: 5801808 - DNA, 23 bp, Homo sapiens
tgcccttttcctgggccttctca

SEQ ID NO: 5801809 - DNA, 18 bp, Homo sapiens
tgcccttttgcccactgt

SEQ ID NO: 5801810 - DNA, 17 bp, Homo sapiens
tgcctaccagtcgccct

SEQ ID NO: 5801811 - DNA, 21 bp, Homo sapiens
tgcctaccagtcgccctctgt

SEQ ID NO: 5801812 - DNA, 21 bp, Homo sapiens
tgcctacgttggtgcaagtgt

SEQ ID NO: 5801813 - DNA, 17 bp, Homo sapiens
tgcctactatgtgcgag

SEQ ID NO: 5801814 - DNA, 15 bp, Homo sapiens
tgcctactctttgtt

SEQ ID NO: 5801815 - DNA, 20 bp, Homo sapiens
tgcctactctttgttttctt

SEQ ID NO: 5801816 - DNA, 24 bp, Homo sapiens
tgcctactgttactctaaatagaa

SEQ ID NO: 5801817 - DNA, 14 bp, Homo sapiens
tgcctacttttctt

SEQ ID NO: 5801818 - DNA, 20 bp, Homo sapiens
tgcctacttttggcctcatc

SEQ ID NO: 5801819 - DNA, 13 bp, Homo sapiens
tgcctagaaacaa

SEQ ID NO: 5801820 - DNA, 19 bp, Homo sapiens
tgcctagaaacaacactgt

SEQ ID NO: 5801821 - DNA, 18 bp, Homo sapiens
tgcctagaaacagacctg

SEQ ID NO: 5801822 - DNA, 16 bp, Homo sapiens
tgcctagaaacagtgt

SEQ ID NO: 5801823 - DNA, 15 bp, Homo sapiens
tgcctagaaagcaat

SEQ ID NO: 5801824 - DNA, 18 bp, Homo sapiens
tgcctagaaatatctttc

SEQ ID NO: 5801825 - DNA, 13 bp, Homo sapiens
tgcctagaatctt

SEQ ID NO: 5801826 - DNA, 15 bp, Homo sapiens
tgcctagaatcttta

SEQ ID NO: 5801827 - DNA, 22 bp, Homo sapiens
tgcctagacttcccaacagcct

SEQ ID NO: 5801828 - DNA, 13 bp, Homo sapiens
tgcctagagtgta

SEQ ID NO: 5801829 - DNA, 22 bp, Homo sapiens
tgcctagagtgtagcctaaagg

SEQ ID NO: 5801830 - DNA, 20 bp, Homo sapiens
tgcctagcaagctggcctct

SEQ ID NO: 5801831 - DNA, 19 bp, Homo sapiens
tgcctagcactcacatgct

SEQ ID NO: 5801832 - DNA, 19 bp, Homo sapiens
tgcctagcagagtgctggc

SEQ ID NO: 5801833 - DNA, 23 bp, Homo sapiens
tgcctagcatggggtcagcccca

SEQ ID NO: 5801834 - DNA, 17 bp, Homo sapiens
tgcctagctcttgggcc

SEQ ID NO: 5801835 - DNA, 18 bp, Homo sapiens
tgcctagctcttgggcct

SEQ ID NO: 5801836 - DNA, 20 bp, Homo sapiens
tgcctagctcttgggcctga

SEQ ID NO: 5801837 - DNA, 23 bp, Homo sapiens
tgcctagctcttgggcctgacct

SEQ ID NO: 5801838 - DNA, 17 bp, Homo sapiens
tgcctaggaattcccag

SEQ ID NO: 5801839 - DNA, 12 bp, Homo sapiens
tgcctaggagct

SEQ ID NO: 5801840 - DNA, 19 bp, Homo sapiens
tgcctaggagctggctggc

SEQ ID NO: 5801841 - DNA, 23 bp, Homo sapiens
tgcctaggagctggctggcaggt

SEQ ID NO: 5801842 - DNA, 21 bp, Homo sapiens
tgcctaggaggccttctcgca

SEQ ID NO: 5801843 - DNA, 18 bp, Homo sapiens
tgcctaggaggctggcca

SEQ ID NO: 5801844 - DNA, 20 bp, Homo sapiens
tgcctaggattcacacccca

SEQ ID NO: 5801845 - DNA, 16 bp, Homo sapiens
tgcctaggccagctcc

SEQ ID NO: 5801846 - DNA, 17 bp, Homo sapiens
tgcctaggccagctcct

SEQ ID NO: 5801847 - DNA, 21 bp, Homo sapiens
tgcctagggttgcttgggcca

SEQ ID NO: 5801848 - DNA, 19 bp, Homo sapiens
tgcctaggtcccccaagca

SEQ ID NO: 5801849 - DNA, 19 bp, Homo sapiens
tgcctaggttggtttcccc

SEQ ID NO: 5801850 - DNA, 20 bp, Homo sapiens
tgcctaggttggtttcccct

SEQ ID NO: 5801851 - DNA, 15 bp, Homo sapiens
tgcctaggtttttcc

SEQ ID NO: 5801852 - DNA, 21 bp, Homo sapiens
tgcctagtcgggacttgtaac

SEQ ID NO: 5801853 - DNA, 24 bp, Homo sapiens
tgcctagtcgggacttgtaacata

SEQ ID NO: 5801854 - DNA, 20 bp, Homo sapiens
tgcctagtgggagttaggac

SEQ ID NO: 5801855 - DNA, 16 bp, Homo sapiens
tgcctagtttttagta

SEQ ID NO: 5801856 - DNA, 20 bp, Homo sapiens
tgcctataaaatgcccattt

SEQ ID NO: 5801857 - DNA, 13 bp, Homo sapiens
tgcctataaagga

SEQ ID NO: 5801858 - DNA, 14 bp, Homo sapiens
tgcctataaattta

SEQ ID NO: 5801859 - DNA, 17 bp, Homo sapiens
tgcctataagccaaaat

SEQ ID NO: 5801860 - DNA, 20 bp, Homo sapiens
tgcctataagccaaaattaa

SEQ ID NO: 5801861 - DNA, 14 bp, Homo sapiens
tgcctataatactt

SEQ ID NO: 5801862 - DNA, 20 bp, Homo sapiens
tgcctataatcttatacaac

SEQ ID NO: 5801863 - DNA, 14 bp, Homo sapiens
tgcctatagtccca

SEQ ID NO: 5801864 - DNA, 17 bp, Homo sapiens
tgcctatagtcccagct

SEQ ID NO: 5801865 - DNA, 18 bp, Homo sapiens
tgcctatatatgtaaata

SEQ ID NO: 5801866 - DNA, 16 bp, Homo sapiens
tgcctatatctgagag

SEQ ID NO: 5801867 - DNA, 20 bp, Homo sapiens
tgcctatatctgagagacct

SEQ ID NO: 5801868 - DNA, 20 bp, Homo sapiens
tgcctatatgagaagaatag

SEQ ID NO: 5801869 - DNA, 15 bp, Homo sapiens
tgcctatattaaagg

SEQ ID NO: 5801870 - DNA, 16 bp, Homo sapiens
tgcctatattatcata

SEQ ID NO: 5801871 - DNA, 15 bp, Homo sapiens
tgcctatatttataa

SEQ ID NO: 5801872 - DNA, 15 bp, Homo sapiens
tgcctatccatcctg

SEQ ID NO: 5801873 - DNA, 17 bp, Homo sapiens
tgcctatccatcctgcg

SEQ ID NO: 5801874 - DNA, 14 bp, Homo sapiens
tgcctatcctctgt

SEQ ID NO: 5801875 - DNA, 17 bp, Homo sapiens
tgcctatctgcctggag

SEQ ID NO: 5801876 - DNA, 19 bp, Homo sapiens
tgcctatctgcctggaggc

SEQ ID NO: 5801877 - DNA, 18 bp, Homo sapiens
tgcctatctttaaacatt

SEQ ID NO: 5801878 - DNA, 18 bp, Homo sapiens
tgcctatgaacagaccat

SEQ ID NO: 5801879 - DNA, 19 bp, Homo sapiens
tgcctatgatactgtctct

SEQ ID NO: 5801880 - DNA, 23 bp, Homo sapiens
tgcctatgatactgtctctccag

SEQ ID NO: 5801881 - DNA, 22 bp, Homo sapiens
tgcctatgcactgaagagctct

SEQ ID NO: 5801882 - DNA, 23 bp, Homo sapiens
tgcctatgcactgaagagctctt

SEQ ID NO: 5801883 - DNA, 17 bp, Homo sapiens
tgcctattgctagagct

SEQ ID NO: 5801884 - DNA, 18 bp, Homo sapiens
tgcctatttactggaaac

SEQ ID NO: 5801885 - DNA, 21 bp, Homo sapiens
tgcctatttactggaaacctg

SEQ ID NO: 5801886 - DNA, 19 bp, Homo sapiens
tgcctatttattcattcag

SEQ ID NO: 5801887 - DNA, 18 bp, Homo sapiens
tgcctatttcccccttca

SEQ ID NO: 5801888 - DNA, 17 bp, Homo sapiens
tgcctatttgtgtggac

SEQ ID NO: 5801889 - DNA, 23 bp, Homo sapiens
tgcctcaaattagaatagaactt

SEQ ID NO: 5801890 - DNA, 20 bp, Homo sapiens
tgcctcaacagcaggaggca

SEQ ID NO: 5801891 - DNA, 17 bp, Homo sapiens
tgcctcaactccaggat

SEQ ID NO: 5801892 - DNA, 18 bp, Homo sapiens
tgcctcaactccaggatt

SEQ ID NO: 5801893 - DNA, 13 bp, Homo sapiens
tgcctcaagaaca

SEQ ID NO: 5801894 - DNA, 14 bp, Homo sapiens
tgcctcaagagaag

SEQ ID NO: 5801895 - DNA, 15 bp, Homo sapiens
tgcctcaagaggaat

SEQ ID NO: 5801896 - DNA, 17 bp, Homo sapiens
tgcctcaagaggaatga

SEQ ID NO: 5801897 - DNA, 18 bp, Homo sapiens
tgcctcaagaggaatgaa

SEQ ID NO: 5801898 - DNA, 19 bp, Homo sapiens
tgcctcaagccccagagtg

SEQ ID NO: 5801899 - DNA, 17 bp, Homo sapiens
tgcctcaagttccatgc

SEQ ID NO: 5801900 - DNA, 13 bp, Homo sapiens
tgcctcaatgcca

SEQ ID NO: 5801901 - DNA, 15 bp, Homo sapiens
tgcctcaatgccagt

SEQ ID NO: 5801902 - DNA, 16 bp, Homo sapiens
tgcctcaatgccagta

SEQ ID NO: 5801903 - DNA, 22 bp, Homo sapiens
tgcctcaatgtgaatcagaccc

SEQ ID NO: 5801904 - DNA, 24 bp, Homo sapiens
tgcctcaatgtgaatcagacccta

SEQ ID NO: 5801905 - DNA, 19 bp, Homo sapiens
tgcctcaatgtgaccaggg

SEQ ID NO: 5801906 - DNA, 19 bp, Homo sapiens
tgcctcacaaatgctgtgg

SEQ ID NO: 5801907 - DNA, 16 bp, Homo sapiens
tgcctcacatctccct

SEQ ID NO: 5801908 - DNA, 13 bp, Homo sapiens
tgcctcacccaca

SEQ ID NO: 5801909 - DNA, 20 bp, Homo sapiens
tgcctcacccaccctttttt

SEQ ID NO: 5801910 - DNA, 23 bp, Homo sapiens
tgcctcacccacccttttttaaa

SEQ ID NO: 5801911 - DNA, 15 bp, Homo sapiens
tgcctcaccgcttcc

SEQ ID NO: 5801912 - DNA, 14 bp, Homo sapiens
tgcctcacctcgaa

SEQ ID NO: 5801913 - DNA, 16 bp, Homo sapiens
tgcctcacctcgaaag

SEQ ID NO: 5801914 - DNA, 14 bp, Homo sapiens
tgcctcaccttcca

SEQ ID NO: 5801915 - DNA, 15 bp, Homo sapiens
tgcctcaccttccaa

SEQ ID NO: 5801916 - DNA, 15 bp, Homo sapiens
tgcctcaccttgggg

SEQ ID NO: 5801917 - DNA, 16 bp, Homo sapiens
tgcctcacgagatttg

SEQ ID NO: 5801918 - DNA, 16 bp, Homo sapiens
tgcctcactcctccgt

SEQ ID NO: 5801919 - DNA, 21 bp, Homo sapiens
tgcctcactcctccgtgagca

SEQ ID NO: 5801920 - DNA, 15 bp, Homo sapiens
tgcctcactgtgacc

SEQ ID NO: 5801921 - DNA, 22 bp, Homo sapiens
tgcctcactgtgacctgctcct

SEQ ID NO: 5801922 - DNA, 12 bp, Homo sapiens
tgcctcagaacg

SEQ ID NO: 5801923 - DNA, 22 bp, Homo sapiens
tgcctcagacgttgcctgagaa

SEQ ID NO: 5801924 - DNA, 14 bp, Homo sapiens
tgcctcagagacca

SEQ ID NO: 5801925 - DNA, 19 bp, Homo sapiens
tgcctcagagaccagggct

SEQ ID NO: 5801926 - DNA, 15 bp, Homo sapiens
tgcctcagccagccc

SEQ ID NO: 5801927 - DNA, 17 bp, Homo sapiens
tgcctcagccagccctg

SEQ ID NO: 5801928 - DNA, 20 bp, Homo sapiens
tgcctcagccagccctggag

SEQ ID NO: 5801929 - DNA, 14 bp, Homo sapiens
tgcctcagccaggc

SEQ ID NO: 5801930 - DNA, 11 bp, Homo sapiens
tgcctcagcct

SEQ ID NO: 5801931 - DNA, 12 bp, Homo sapiens
tgcctcagcctc

SEQ ID NO: 5801932 - DNA, 15 bp, Homo sapiens
tgcctcagcctccca

SEQ ID NO: 5801933 - DNA, 15 bp, Homo sapiens
tgcctcagcctcctg

SEQ ID NO: 5801934 - DNA, 16 bp, Homo sapiens
tgcctcagcctcctga

SEQ ID NO: 5801935 - DNA, 18 bp, Homo sapiens
tgcctcagcctcctgaac

SEQ ID NO: 5801936 - DNA, 12 bp, Homo sapiens
tgcctcagcctt

SEQ ID NO: 5801937 - DNA, 13 bp, Homo sapiens
tgcctcagccttc

SEQ ID NO: 5801938 - DNA, 19 bp, Homo sapiens
tgcctcagccttctgagta

SEQ ID NO: 5801939 - DNA, 13 bp, Homo sapiens
tgcctcagcgctg

SEQ ID NO: 5801940 - DNA, 19 bp, Homo sapiens
tgcctcagcgctgcccaca

SEQ ID NO: 5801941 - DNA, 13 bp, Homo sapiens
tgcctcagctatg

SEQ ID NO: 5801942 - DNA, 22 bp, Homo sapiens
tgcctcagctgacccggcctct

SEQ ID NO: 5801943 - DNA, 18 bp, Homo sapiens
tgcctcagctgctcgcac

SEQ ID NO: 5801944 - DNA, 15 bp, Homo sapiens
tgcctcagcttcccc

SEQ ID NO: 5801945 - DNA, 18 bp, Homo sapiens
tgcctcagcttccccagt

SEQ ID NO: 5801946 - DNA, 20 bp, Homo sapiens
tgcctcaggaccttttggtc

SEQ ID NO: 5801947 - DNA, 12 bp, Homo sapiens
tgcctcaggcca

SEQ ID NO: 5801948 - DNA, 16 bp, Homo sapiens
tgcctcaggccagggc

SEQ ID NO: 5801949 - DNA, 20 bp, Homo sapiens
tgcctcaggccagggctcac

SEQ ID NO: 5801950 - DNA, 19 bp, Homo sapiens
tgcctcagggccaagccgg

SEQ ID NO: 5801951 - DNA, 12 bp, Homo sapiens
tgcctcaggttc

SEQ ID NO: 5801952 - DNA, 14 bp, Homo sapiens
tgcctcaggttcct

SEQ ID NO: 5801953 - DNA, 18 bp, Homo sapiens
tgcctcagtaaaatgaac

SEQ ID NO: 5801954 - DNA, 17 bp, Homo sapiens
tgcctcagtgctgcaat

SEQ ID NO: 5801955 - DNA, 23 bp, Homo sapiens
tgcctcagtggcagcatcctcca

SEQ ID NO: 5801956 - DNA, 13 bp, Homo sapiens
tgcctcagtttcc

SEQ ID NO: 5801957 - DNA, 15 bp, Homo sapiens
tgcctcagttttcct

SEQ ID NO: 5801958 - DNA, 19 bp, Homo sapiens
tgcctcagttttccttctg

SEQ ID NO: 5801959 - DNA, 18 bp, Homo sapiens
tgcctcatagcatagcca

SEQ ID NO: 5801960 - DNA, 22 bp, Homo sapiens
tgcctcatagcatagccagcat

SEQ ID NO: 5801961 - DNA, 18 bp, Homo sapiens
tgcctcatattgtcctct

SEQ ID NO: 5801962 - DNA, 15 bp, Homo sapiens
tgcctcatcctcctc

SEQ ID NO: 5801963 - DNA, 14 bp, Homo sapiens
tgcctcatgaacac

SEQ ID NO: 5801964 - DNA, 19 bp, Homo sapiens
tgcctcatgaccctcctgt

SEQ ID NO: 5801965 - DNA, 22 bp, Homo sapiens
tgcctcatttagagaggaaaag

SEQ ID NO: 5801966 - DNA, 14 bp, Homo sapiens
tgcctcatttattt

SEQ ID NO: 5801967 - DNA, 19 bp, Homo sapiens
tgcctcattttgcttccca

SEQ ID NO: 5801968 - DNA, 14 bp, Homo sapiens
tgcctccaacccag

SEQ ID NO: 5801969 - DNA, 22 bp, Homo sapiens
tgcctccaagaggaacctctga

SEQ ID NO: 5801970 - DNA, 23 bp, Homo sapiens
tgcctccaagcggccctgtgtgt

SEQ ID NO: 5801971 - DNA, 14 bp, Homo sapiens
tgcctccaatgtgg

SEQ ID NO: 5801972 - DNA, 21 bp, Homo sapiens
tgcctccacatgctgcctggc

SEQ ID NO: 5801973 - DNA, 21 bp, Homo sapiens
tgcctccaccaccactggcca

SEQ ID NO: 5801974 - DNA, 23 bp, Homo sapiens
tgcctccaccaccactggccacc

SEQ ID NO: 5801975 - DNA, 18 bp, Homo sapiens
tgcctccaccccccagaa

SEQ ID NO: 5801976 - DNA, 19 bp, Homo sapiens
tgcctccacccgtcctccc

SEQ ID NO: 5801977 - DNA, 22 bp, Homo sapiens
tgcctccacccgtcctccctca

SEQ ID NO: 5801978 - DNA, 14 bp, Homo sapiens
tgcctccaccctcc

SEQ ID NO: 5801979 - DNA, 17 bp, Homo sapiens
tgcctccaccctctgag

SEQ ID NO: 5801980 - DNA, 20 bp, Homo sapiens
tgcctccaccgagccagctt

SEQ ID NO: 5801981 - DNA, 18 bp, Homo sapiens
tgcctccaccgctgccta

SEQ ID NO: 5801982 - DNA, 20 bp, Homo sapiens
tgcctccaccgctgcctaag

SEQ ID NO: 5801983 - DNA, 11 bp, Homo sapiens
tgcctccacct

SEQ ID NO: 5801984 - DNA, 16 bp, Homo sapiens
tgcctccactcccact

SEQ ID NO: 5801985 - DNA, 19 bp, Homo sapiens
tgcctccactcccacttcc

SEQ ID NO: 5801986 - DNA, 20 bp, Homo sapiens
tgcctccactcccacttccc

SEQ ID NO: 5801987 - DNA, 21 bp, Homo sapiens
tgcctggttctaggctgctgc

SEQ ID NO: 5801988 - DNA, 18 bp, Homo sapiens
tgcctggtttgatttttt

SEQ ID NO: 5801989 - DNA, 15 bp, Homo sapiens
tgcctggttttattt

SEQ ID NO: 5801990 - DNA, 14 bp, Homo sapiens
tgcctggttttgat

SEQ ID NO: 5801991 - DNA, 17 bp, Homo sapiens
tgcctgtaatcccagaa

SEQ ID NO: 5801992 - DNA, 19 bp, Homo sapiens
tgcctgtaatcccagaact

SEQ ID NO: 5801993 - DNA, 17 bp, Homo sapiens
tgcctgtaatcccagca

SEQ ID NO: 5801994 - DNA, 19 bp, Homo sapiens
tgcctgtaatcccagcact

SEQ ID NO: 5801995 - DNA, 16 bp, Homo sapiens
tgcctgtaatcttttt

SEQ ID NO: 5801996 - DNA, 16 bp, Homo sapiens
tgcctgtacaggaagg

SEQ ID NO: 5801997 - DNA, 19 bp, Homo sapiens
tgcctgtactcgcttgtgc

SEQ ID NO: 5801998 - DNA, 16 bp, Homo sapiens
tgcctgtagagccagc

SEQ ID NO: 5801999 - DNA, 19 bp, Homo sapiens
tgcctgtagagccagcctt

SEQ ID NO: 5802000 - DNA, 21 bp, Homo sapiens
tgcctgtagccccagtgacag

SEQ ID NO: 5802001 - DNA, 22 bp, Homo sapiens
tgcctgtagccccagtgacagc

SEQ ID NO: 5802002 - DNA, 17 bp, Homo sapiens
tgcctgtagtctcagct

SEQ ID NO: 5802003 - DNA, 23 bp, Homo sapiens
tgcctgtagttaggaaataaaac

SEQ ID NO: 5802004 - DNA, 22 bp, Homo sapiens
tgcctgtatcttttattttcct

SEQ ID NO: 5802005 - DNA, 14 bp, Homo sapiens
tgcctgtattttcg

SEQ ID NO: 5802006 - DNA, 15 bp, Homo sapiens
tgcctgtcaccccag

SEQ ID NO: 5802007 - DNA, 17 bp, Homo sapiens
tgcctgtcacctgggag

SEQ ID NO: 5802008 - DNA, 15 bp, Homo sapiens
tgcctgtcactactg

SEQ ID NO: 5802009 - DNA, 16 bp, Homo sapiens
tgcctgtcactactgg

SEQ ID NO: 5802010 - DNA, 22 bp, Homo sapiens
tgcctgtcaggctctggccctt

SEQ ID NO: 5802011 - DNA, 20 bp, Homo sapiens
tgcctgtcagtttcatggag

SEQ ID NO: 5802012 - DNA, 19 bp, Homo sapiens
tgcctgtcccacccccacc

SEQ ID NO: 5802013 - DNA, 23 bp, Homo sapiens
tgcctgtccccaaacaggacagc

SEQ ID NO: 5802014 - DNA, 19 bp, Homo sapiens
tgcctgtcctagtctcctt

SEQ ID NO: 5802015 - DNA, 16 bp, Homo sapiens
tgcctgtcctgaaagc

SEQ ID NO: 5802016 - DNA, 20 bp, Homo sapiens
tgcctgtcgctttcccttgg

SEQ ID NO: 5802017 - DNA, 22 bp, Homo sapiens
tgcctgtctcctttgcaggctc

SEQ ID NO: 5802018 - DNA, 16 bp, Homo sapiens
tgcctgtctggtgcct

SEQ ID NO: 5802019 - DNA, 22 bp, Homo sapiens
tgcctgtcttgagtagacttgg

SEQ ID NO: 5802020 - DNA, 21 bp, Homo sapiens
tgcctgtgaactgaactctga

SEQ ID NO: 5802021 - DNA, 16 bp, Homo sapiens
tgcctgtgagccagtc

SEQ ID NO: 5802022 - DNA, 14 bp, Homo sapiens
tgcctgtgaggcag

SEQ ID NO: 5802023 - DNA, 16 bp, Homo sapiens
tgcctgtgaggcaggg

SEQ ID NO: 5802024 - DNA, 17 bp, Homo sapiens
tgcctgtgaggcagggg

SEQ ID NO: 5802025 - DNA, 23 bp, Homo sapiens
tgcctgtgcatgacctgatcatt

SEQ ID NO: 5802026 - DNA, 16 bp, Homo sapiens
tgcctgtgccaataaa

SEQ ID NO: 5802027 - DNA, 14 bp, Homo sapiens
tgcctgtgccaccc

SEQ ID NO: 5802028 - DNA, 12 bp, Homo sapiens
tgcctgtgccag

SEQ ID NO: 5802029 - DNA, 17 bp, Homo sapiens
tgcctgtgccatgccca

SEQ ID NO: 5802030 - DNA, 13 bp, Homo sapiens
tgcctgtgcccgc

SEQ ID NO: 5802031 - DNA, 14 bp, Homo sapiens
tgcctgtgcccgca

SEQ ID NO: 5802032 - DNA, 19 bp, Homo sapiens
tgcctgtgcccgctgcgct

SEQ ID NO: 5802033 - DNA, 15 bp, Homo sapiens
tgcctgtgcctgcca

SEQ ID NO: 5802034 - DNA, 13 bp, Homo sapiens
tgcctgtgctcct

SEQ ID NO: 5802035 - DNA, 14 bp, Homo sapiens
tgcctgtgctcctg

SEQ ID NO: 5802036 - DNA, 16 bp, Homo sapiens
tgcctgtgctcctgcc

SEQ ID NO: 5802037 - DNA, 19 bp, Homo sapiens
tgcctgtgctcctgcccag

SEQ ID NO: 5802038 - DNA, 22 bp, Homo sapiens
tgcctgtggaagagtgtgtgtg

SEQ ID NO: 5802039 - DNA, 19 bp, Homo sapiens
tgcctgtggaatctggagt

SEQ ID NO: 5802040 - DNA, 22 bp, Homo sapiens
tgcctgtggagacagccctgcc

SEQ ID NO: 5802041 - DNA, 14 bp, Homo sapiens
tgcctgtggcccct

SEQ ID NO: 5802042 - DNA, 11 bp, Homo sapiens
tgcctgtggcg

SEQ ID NO: 5802043 - DNA, 14 bp, Homo sapiens
tgcctgtgggaggg

SEQ ID NO: 5802044 - DNA, 16 bp, Homo sapiens
tgcctgtgggaggggg

SEQ ID NO: 5802045 - DNA, 23 bp, Homo sapiens
tgcctgtgggggtccatttgggt

SEQ ID NO: 5802046 - DNA, 21 bp, Homo sapiens
tgcctgtggtgaagtgtggct

SEQ ID NO: 5802047 - DNA, 21 bp, Homo sapiens
tgcctgtggtgaggtcctgtc

SEQ ID NO: 5802048 - DNA, 19 bp, Homo sapiens
tgcctgtgtccatgcgctc

SEQ ID NO: 5802049 - DNA, 21 bp, Homo sapiens
tgcctgtgtgacatcagtggc

SEQ ID NO: 5802050 - DNA, 15 bp, Homo sapiens
tgcctgtgtgagcat

SEQ ID NO: 5802051 - DNA, 17 bp, Homo sapiens
tgcctgtgtgagcatct

SEQ ID NO: 5802052 - DNA, 19 bp, Homo sapiens
tgcctgtgtgcgagtctga

SEQ ID NO: 5802053 - DNA, 16 bp, Homo sapiens
tgcctgtgtgctccgg

SEQ ID NO: 5802054 - DNA, 17 bp, Homo sapiens
tgcctgttaagtctgag

SEQ ID NO: 5802055 - DNA, 16 bp, Homo sapiens
tgcctgttcagctcca

SEQ ID NO: 5802056 - DNA, 21 bp, Homo sapiens
tgcctgttcagctccagctca

SEQ ID NO: 5802057 - DNA, 12 bp, Homo sapiens
tgcctgttcagt

SEQ ID NO: 5802058 - DNA, 13 bp, Homo sapiens
tgcctgttcagtt

SEQ ID NO: 5802059 - DNA, 17 bp, Homo sapiens
tgcctgttcagttacag

SEQ ID NO: 5802060 - DNA, 14 bp, Homo sapiens
tgcctgttcccatt

SEQ ID NO: 5802061 - DNA, 20 bp, Homo sapiens
tgcctgttcctcccaagagg

SEQ ID NO: 5802062 - DNA, 18 bp, Homo sapiens
tgcctgttctccagatgg

SEQ ID NO: 5802063 - DNA, 14 bp, Homo sapiens
tgcctgttgatcta

SEQ ID NO: 5802064 - DNA, 15 bp, Homo sapiens
tgcctgttggctgct

SEQ ID NO: 5802065 - DNA, 21 bp, Homo sapiens
tgcctgttggctgctgcggct

SEQ ID NO: 5802066 - DNA, 17 bp, Homo sapiens
tgcctgttgggccagga

SEQ ID NO: 5802067 - DNA, 12 bp, Homo sapiens
tgcctgtttccc

SEQ ID NO: 5802068 - DNA, 15 bp, Homo sapiens
tgccttaaaaccaaa

SEQ ID NO: 5802069 - DNA, 16 bp, Homo sapiens
tgccttaaaaccaaag

SEQ ID NO: 5802070 - DNA, 17 bp, Homo sapiens
tgccttaaaaggagaga

SEQ ID NO: 5802071 - DNA, 14 bp, Homo sapiens
tgccttaaaatgga

SEQ ID NO: 5802072 - DNA, 20 bp, Homo sapiens
tgccttaaaatggaattgaa

SEQ ID NO: 5802073 - DNA, 17 bp, Homo sapiens
tgccttaaacacacatt

SEQ ID NO: 5802074 - DNA, 18 bp, Homo sapiens
tgccttaaacctacctcc

SEQ ID NO: 5802075 - DNA, 19 bp, Homo sapiens
tgccttaaataaaactgca

SEQ ID NO: 5802076 - DNA, 16 bp, Homo sapiens
tgccttaaccttctgg

SEQ ID NO: 5802077 - DNA, 16 bp, Homo sapiens
tgccttaactggagcc

SEQ ID NO: 5802078 - DNA, 14 bp, Homo sapiens
tgccttaagcagaa

SEQ ID NO: 5802079 - DNA, 15 bp, Homo sapiens
tgccttaagcagaac

SEQ ID NO: 5802080 - DNA, 21 bp, Homo sapiens
tgccttaagcagaacaaatgt

SEQ ID NO: 5802081 - DNA, 23 bp, Homo sapiens
tgccttaagcagaacaaatgtgt

SEQ ID NO: 5802082 - DNA, 14 bp, Homo sapiens
tgccttaaggtata

SEQ ID NO: 5802083 - DNA, 19 bp, Homo sapiens
tgccttaagttttagtctt

SEQ ID NO: 5802084 - DNA, 20 bp, Homo sapiens
tgccttaataaaaaatgaaa

SEQ ID NO: 5802085 - DNA, 20 bp, Homo sapiens
tgccttaatttagaaactga

SEQ ID NO: 5802086 - DNA, 17 bp, Homo sapiens
tgccttacatcttttct

SEQ ID NO: 5802087 - DNA, 22 bp, Homo sapiens
tgccttaccaagttgtgctttt

SEQ ID NO: 5802088 - DNA, 20 bp, Homo sapiens
tgccttaccctcatgttctt

SEQ ID NO: 5802089 - DNA, 14 bp, Homo sapiens
tgccttacctcctg

SEQ ID NO: 5802090 - DNA, 15 bp, Homo sapiens
tgccttaccttcact

SEQ ID NO: 5802091 - DNA, 17 bp, Homo sapiens
tgccttactattgtatt

SEQ ID NO: 5802092 - DNA, 20 bp, Homo sapiens
tgccttactggtttccccag

SEQ ID NO: 5802093 - DNA, 22 bp, Homo sapiens
tgccttagaaacacataaatta

SEQ ID NO: 5802094 - DNA, 23 bp, Homo sapiens
tgccttagaaatgtaaactgcca

SEQ ID NO: 5802095 - DNA, 17 bp, Homo sapiens
tgccttagaacctttct

SEQ ID NO: 5802096 - DNA, 15 bp, Homo sapiens
tgccttagagccagg

SEQ ID NO: 5802097 - DNA, 14 bp, Homo sapiens
tgccttagaggagc

SEQ ID NO: 5802098 - DNA, 14 bp, Homo sapiens
tgccttagcttcag

SEQ ID NO: 5802099 - DNA, 17 bp, Homo sapiens
tgccttagcttcaggaa

SEQ ID NO: 5802100 - DNA, 19 bp, Homo sapiens
tgccttaggaatactgttt

SEQ ID NO: 5802101 - DNA, 21 bp, Homo sapiens
tgccttagggtttgcagagtg

SEQ ID NO: 5802102 - DNA, 12 bp, Homo sapiens
tgccttatatta

SEQ ID NO: 5802103 - DNA, 15 bp, Homo sapiens
tgccttatctcttct

SEQ ID NO: 5802104 - DNA, 16 bp, Homo sapiens
tgccttatctgttcct

SEQ ID NO: 5802105 - DNA, 16 bp, Homo sapiens
tgccttatcttgaaaa

SEQ ID NO: 5802106 - DNA, 18 bp, Homo sapiens
tgccttatggaacactct

SEQ ID NO: 5802107 - DNA, 21 bp, Homo sapiens
tgccttatggaacactctgag

SEQ ID NO: 5802108 - DNA, 18 bp, Homo sapiens
tgccttattacataactg

SEQ ID NO: 5802109 - DNA, 15 bp, Homo sapiens
tgccttattatttct

SEQ ID NO: 5802110 - DNA, 15 bp, Homo sapiens
tgccttatttctcat

SEQ ID NO: 5802111 - DNA, 17 bp, Homo sapiens
tgccttatttgtctgta

SEQ ID NO: 5802112 - DNA, 17 bp, Homo sapiens
tgccttatttttgaatt

SEQ ID NO: 5802113 - DNA, 22 bp, Homo sapiens
tgccttcaaaaatgtgctgcct

SEQ ID NO: 5802114 - DNA, 18 bp, Homo sapiens
tgccttcaaaatgctgct

SEQ ID NO: 5802115 - DNA, 14 bp, Homo sapiens
tgccttcactgggc

SEQ ID NO: 5802116 - DNA, 16 bp, Homo sapiens
tgccttcactgggcca

SEQ ID NO: 5802117 - DNA, 18 bp, Homo sapiens
tgccttcactgggccagt

SEQ ID NO: 5802118 - DNA, 23 bp, Homo sapiens
tgccttcagctgttgcagatgaa

SEQ ID NO: 5802119 - DNA, 13 bp, Homo sapiens
tgccttcaggaat

SEQ ID NO: 5802120 - DNA, 17 bp, Homo sapiens
tgccttcaggcttctgt

SEQ ID NO: 5802121 - DNA, 17 bp, Homo sapiens
tgccttcagtaggaaca

SEQ ID NO: 5802122 - DNA, 18 bp, Homo sapiens
tgccttcagtcttggtaa

SEQ ID NO: 5802123 - DNA, 16 bp, Homo sapiens
tgccttcataaattat

SEQ ID NO: 5802124 - DNA, 21 bp, Homo sapiens
tgccttcataaattatttcta

SEQ ID NO: 5802125 - DNA, 18 bp, Homo sapiens
tgccttcatcttcactgc

SEQ ID NO: 5802126 - DNA, 17 bp, Homo sapiens
tgccttcattacctttt

SEQ ID NO: 5802127 - DNA, 22 bp, Homo sapiens
tgccttcattgaggaaggaaat

SEQ ID NO: 5802128 - DNA, 20 bp, Homo sapiens
tgccttccaaacctgagaat

SEQ ID NO: 5802129 - DNA, 21 bp, Homo sapiens
tgccttccaccctgccctggc

SEQ ID NO: 5802130 - DNA, 13 bp, Homo sapiens
tgccttccacgct

SEQ ID NO: 5802131 - DNA, 14 bp, Homo sapiens
tgccttccacgctg

SEQ ID NO: 5802132 - DNA, 20 bp, Homo sapiens
tgccttccacgctgtctcca

SEQ ID NO: 5802133 - DNA, 22 bp, Homo sapiens
tgccttccacgctgtctccaga

SEQ ID NO: 5802134 - DNA, 23 bp, Homo sapiens
tgccttccacgctgtctccagac

SEQ ID NO: 5802135 - DNA, 15 bp, Homo sapiens
tgccttccagatcct

SEQ ID NO: 5802136 - DNA, 22 bp, Homo sapiens
tgccttccagatcctctctggg

SEQ ID NO: 5802137 - DNA, 21 bp, Homo sapiens
tgccttccaggcgtagggcca

SEQ ID NO: 5802138 - DNA, 14 bp, Homo sapiens
tgccttccataatt

SEQ ID NO: 5802139 - DNA, 21 bp, Homo sapiens
tgccttccataattatgacag

SEQ ID NO: 5802140 - DNA, 12 bp, Homo sapiens
tgccttcccctt

SEQ ID NO: 5802141 - DNA, 13 bp, Homo sapiens
tgccttccctagc

SEQ ID NO: 5802142 - DNA, 18 bp, Homo sapiens
tgccttcccttctctggt

SEQ ID NO: 5802143 - DNA, 22 bp, Homo sapiens
tgccttcccttctctggtctcc

SEQ ID NO: 5802144 - DNA, 20 bp, Homo sapiens
tgccttccgacaccactggg

SEQ ID NO: 5802145 - DNA, 22 bp, Homo sapiens
tgccttccgacaccactgggaa

SEQ ID NO: 5802146 - DNA, 23 bp, Homo sapiens
tgccttccgacaccactgggaac

SEQ ID NO: 5802147 - DNA, 14 bp, Homo sapiens
tgccttcctaagcc

SEQ ID NO: 5802148 - DNA, 19 bp, Homo sapiens
tgccttcctaagcctgtgg

SEQ ID NO: 5802149 - DNA, 21 bp, Homo sapiens
tgccttcctaagcctgtggct

SEQ ID NO: 5802150 - DNA, 15 bp, Homo sapiens
tgccttcctcctggg

SEQ ID NO: 5802151 - DNA, 16 bp, Homo sapiens
tgccttcctcctgggc

SEQ ID NO: 5802152 - DNA, 20 bp, Homo sapiens
tgccttcctcgtgcagagct

SEQ ID NO: 5802153 - DNA, 22 bp, Homo sapiens
tgccttcctcgtgcagagctgg

SEQ ID NO: 5802154 - DNA, 12 bp, Homo sapiens
tgccttcctctg

SEQ ID NO: 5802155 - DNA, 15 bp, Homo sapiens
tgccttcctctgagg

SEQ ID NO: 5802156 - DNA, 19 bp, Homo sapiens
tgccttcctctgaggacag

SEQ ID NO: 5802157 - DNA, 16 bp, Homo sapiens
tgccttcctgtttaaa

SEQ ID NO: 5802158 - DNA, 18 bp, Homo sapiens
tgccttcctttctccagg

SEQ ID NO: 5802159 - DNA, 23 bp, Homo sapiens
tgccttcctttctccaggaccaa

SEQ ID NO: 5802160 - DNA, 13 bp, Homo sapiens
tgccttcgcttct

SEQ ID NO: 5802161 - DNA, 14 bp, Homo sapiens
tgccttcgcttctt

SEQ ID NO: 5802162 - DNA, 16 bp, Homo sapiens
tgccttcgggaaaatt

SEQ ID NO: 5802163 - DNA, 18 bp, Homo sapiens
tgccttcgggaaaattca

SEQ ID NO: 5802164 - DNA, 15 bp, Homo sapiens
tgcggcaccgcccac

SEQ ID NO: 5802165 - DNA, 11 bp, Homo sapiens
tgcggcaggag

SEQ ID NO: 5802166 - DNA, 15 bp, Homo sapiens
tgcggcaggagcagg

SEQ ID NO: 5802167 - DNA, 20 bp, Homo sapiens
tgcggcaggagcaggaacag

SEQ ID NO: 5802168 - DNA, 23 bp, Homo sapiens
tgcggcaggttcacaggcgaggc

SEQ ID NO: 5802169 - DNA, 17 bp, Homo sapiens
tgcggcattaaagccat

SEQ ID NO: 5802170 - DNA, 13 bp, Homo sapiens
tgcggccaccacc

SEQ ID NO: 5802171 - DNA, 15 bp, Homo sapiens
tgcggccaggcctgc

SEQ ID NO: 5802172 - DNA, 18 bp, Homo sapiens
tgcggccaggcctgcggg

SEQ ID NO: 5802173 - DNA, 21 bp, Homo sapiens
tgcggcccagccatgggccct

SEQ ID NO: 5802174 - DNA, 15 bp, Homo sapiens
tgcggcccagcccgg

SEQ ID NO: 5802175 - DNA, 16 bp, Homo sapiens
tgcggccccaggaggg

SEQ ID NO: 5802176 - DNA, 16 bp, Homo sapiens
tgcggcccctcccccg

SEQ ID NO: 5802177 - DNA, 14 bp, Homo sapiens
tgcggccgggctgc

SEQ ID NO: 5802178 - DNA, 17 bp, Homo sapiens
tgcggccgggctgccct

SEQ ID NO: 5802179 - DNA, 18 bp, Homo sapiens
tgcggccgggctgccctt

SEQ ID NO: 5802180 - DNA, 19 bp, Homo sapiens
tgcggccgtcaccccgcca

SEQ ID NO: 5802181 - DNA, 13 bp, Homo sapiens
tgcggcctcacca

SEQ ID NO: 5802182 - DNA, 14 bp, Homo sapiens
tgcggcctcaccag

SEQ ID NO: 5802183 - DNA, 23 bp, Homo sapiens
tgcggcctcaccaggcccacgag

SEQ ID NO: 5802184 - DNA, 17 bp, Homo sapiens
tgcggccttccaccggg

SEQ ID NO: 5802185 - DNA, 17 bp, Homo sapiens
tgcggcgcgggcccctc

SEQ ID NO: 5802186 - DNA, 18 bp, Homo sapiens
tgcggcgtacaggctggc

SEQ ID NO: 5802187 - DNA, 14 bp, Homo sapiens
tgcggcgtggagac

SEQ ID NO: 5802188 - DNA, 21 bp, Homo sapiens
tgcggcgtggagactggcagg

SEQ ID NO: 5802189 - DNA, 22 bp, Homo sapiens
tgcggcgtggagactggcaggc

SEQ ID NO: 5802190 - DNA, 19 bp, Homo sapiens
tgcggctcagccttgcaca

SEQ ID NO: 5802191 - DNA, 15 bp, Homo sapiens
tgcggctccagccca

SEQ ID NO: 5802192 - DNA, 20 bp, Homo sapiens
tgcggctccagcccagcccg

SEQ ID NO: 5802193 - DNA, 13 bp, Homo sapiens
tgcggctcctcag

SEQ ID NO: 5802194 - DNA, 15 bp, Homo sapiens
tgcggctcctcaggg

SEQ ID NO: 5802195 - DNA, 12 bp, Homo sapiens
tgcggctctgga

SEQ ID NO: 5802196 - DNA, 15 bp, Homo sapiens
tgcggctgaactgag

SEQ ID NO: 5802197 - DNA, 17 bp, Homo sapiens
tgcggctgcctgccccc

SEQ ID NO: 5802198 - DNA, 14 bp, Homo sapiens
tgcggctggccatg

SEQ ID NO: 5802199 - DNA, 22 bp, Homo sapiens
tgcggctggccatggagaaagc

SEQ ID NO: 5802200 - DNA, 13 bp, Homo sapiens
tgcggctgtgcag

SEQ ID NO: 5802201 - DNA, 21 bp, Homo sapiens
tgcggctgtgcagcctgtcct

SEQ ID NO: 5802202 - DNA, 12 bp, Homo sapiens
tgcggctgtgtg

SEQ ID NO: 5802203 - DNA, 14 bp, Homo sapiens
tgcggctgtgtgtg

SEQ ID NO: 5802204 - DNA, 18 bp, Homo sapiens
tgcggcttccgagggcac

SEQ ID NO: 5802205 - DNA, 20 bp, Homo sapiens
tgcggcttccgagggcacta

SEQ ID NO: 5802206 - DNA, 14 bp, Homo sapiens
tgcggctttaaact

SEQ ID NO: 5802207 - DNA, 23 bp, Homo sapiens
tgcggctttatcattcctttcca

SEQ ID NO: 5802208 - DNA, 21 bp, Homo sapiens
tgcggctttctctgcctctgg

SEQ ID NO: 5802209 - DNA, 15 bp, Homo sapiens
tgcgggaaattcagt

SEQ ID NO: 5802210 - DNA, 12 bp, Homo sapiens
tgcgggagccag

SEQ ID NO: 5802211 - DNA, 20 bp, Homo sapiens
tgcgggaggccctggccctt

SEQ ID NO: 5802212 - DNA, 16 bp, Homo sapiens
tgcgggcacaataaat

SEQ ID NO: 5802213 - DNA, 16 bp, Homo sapiens
tgcgggccagggtcct

SEQ ID NO: 5802214 - DNA, 17 bp, Homo sapiens
tgcgggccaggtctggc

SEQ ID NO: 5802215 - DNA, 15 bp, Homo sapiens
tgcgggcctggccct

SEQ ID NO: 5802216 - DNA, 22 bp, Homo sapiens
tgcgggcctggccctcactcaa

SEQ ID NO: 5802217 - DNA, 12 bp, Homo sapiens
tgcgggctccct

SEQ ID NO: 5802218 - DNA, 18 bp, Homo sapiens
tgcgggctccctcctctg

SEQ ID NO: 5802219 - DNA, 12 bp, Homo sapiens
tgcgggctcgcc

SEQ ID NO: 5802220 - DNA, 14 bp, Homo sapiens
tgcgggctgggcag

SEQ ID NO: 5802221 - DNA, 17 bp, Homo sapiens
tgcgggctgggcagctg

SEQ ID NO: 5802222 - DNA, 17 bp, Homo sapiens
tgcgggcttttccccgg

SEQ ID NO: 5802223 - DNA, 16 bp, Homo sapiens
tgcggggcagcagggg

SEQ ID NO: 5802224 - DNA, 13 bp, Homo sapiens
tgcggggcagggc

SEQ ID NO: 5802225 - DNA, 14 bp, Homo sapiens
tgcggggccaccca

SEQ ID NO: 5802226 - DNA, 21 bp, Homo sapiens
tgcggggcctgaggcaagcca

SEQ ID NO: 5802227 - DNA, 21 bp, Homo sapiens
tgcggggcggcatccgagccc

SEQ ID NO: 5802228 - DNA, 14 bp, Homo sapiens
tgcggggcgggcac

SEQ ID NO: 5802229 - DNA, 22 bp, Homo sapiens
tgcggggcttttaaaaggaaaa

SEQ ID NO: 5802230 - DNA, 15 bp, Homo sapiens
tgcgggggagcaggc

SEQ ID NO: 5802231 - DNA, 17 bp, Homo sapiens
tgcgggggagctggaaa

SEQ ID NO: 5802232 - DNA, 14 bp, Homo sapiens
tgcgggggcaggcc

SEQ ID NO: 5802233 - DNA, 23 bp, Homo sapiens
tgcggggggtgtcttccctgcct

SEQ ID NO: 5802234 - DNA, 15 bp, Homo sapiens
tgcggggtgggggca

SEQ ID NO: 5802235 - DNA, 14 bp, Homo sapiens
tgcgggtctgtcag

SEQ ID NO: 5802236 - DNA, 18 bp, Homo sapiens
tgcgggtgaacaaagcag

SEQ ID NO: 5802237 - DNA, 21 bp, Homo sapiens
tgcgggtgaacaaagcagcca

SEQ ID NO: 5802238 - DNA, 16 bp, Homo sapiens
tgcggtaggtgctggc

SEQ ID NO: 5802239 - DNA, 14 bp, Homo sapiens
tgcggtatacattt

SEQ ID NO: 5802240 - DNA, 17 bp, Homo sapiens
tgcggtatccgccccca

SEQ ID NO: 5802241 - DNA, 14 bp, Homo sapiens
tgcggtcactcagg

SEQ ID NO: 5802242 - DNA, 22 bp, Homo sapiens
tgcggtcaggctgggcagcccc

SEQ ID NO: 5802243 - DNA, 14 bp, Homo sapiens
tgcggtccacccag

SEQ ID NO: 5802244 - DNA, 15 bp, Homo sapiens
tgcggtgaggcaggg

SEQ ID NO: 5802245 - DNA, 16 bp, Homo sapiens
tgcggtgaggcagggg

SEQ ID NO: 5802246 - DNA, 23 bp, Homo sapiens
tgcggtgcctcatgcctgtaatc

SEQ ID NO: 5802247 - DNA, 21 bp, Homo sapiens
tgcggtgctatctcccccagc

SEQ ID NO: 5802248 - DNA, 21 bp, Homo sapiens
tgcggtggctcacgcctgtaa

SEQ ID NO: 5802249 - DNA, 15 bp, Homo sapiens
tgcggtgtctgcagc

SEQ ID NO: 5802250 - DNA, 21 bp, Homo sapiens
tgcggtgtctgcagctcctgg

SEQ ID NO: 5802251 - DNA, 21 bp, Homo sapiens
tgcggttaattttgaagtgct

SEQ ID NO: 5802252 - DNA, 20 bp, Homo sapiens
tgcggttagaatcccatgga

SEQ ID NO: 5802253 - DNA, 22 bp, Homo sapiens
tgcggttataaaaaatggttca

SEQ ID NO: 5802254 - DNA, 14 bp, Homo sapiens
tgcggttgggaggc

SEQ ID NO: 5802255 - DNA, 20 bp, Homo sapiens
tgcggtttccaaggtgcaca

SEQ ID NO: 5802256 - DNA, 14 bp, Homo sapiens
tgcgtaaatcaact

SEQ ID NO: 5802257 - DNA, 16 bp, Homo sapiens
tgcgtaaccctcgccc

SEQ ID NO: 5802258 - DNA, 16 bp, Homo sapiens
tgcgtaactggctgtg

SEQ ID NO: 5802259 - DNA, 17 bp, Homo sapiens
tgcgtaaggatgtgtga

SEQ ID NO: 5802260 - DNA, 14 bp, Homo sapiens
tgcgtactccactg

SEQ ID NO: 5802261 - DNA, 21 bp, Homo sapiens
tgcgtacttgtaatatgtata

SEQ ID NO: 5802262 - DNA, 22 bp, Homo sapiens
tgcgtatatgtgcgtctctctt

SEQ ID NO: 5802263 - DNA, 20 bp, Homo sapiens
tgcgtatgccaccaacttac

SEQ ID NO: 5802264 - DNA, 22 bp, Homo sapiens
tgcgtatgtaaacattcatatt

SEQ ID NO: 5802265 - DNA, 20 bp, Homo sapiens
tgcgtattctgtggccgcca

SEQ ID NO: 5802266 - DNA, 19 bp, Homo sapiens
tgcgtcagaccagtactgg

SEQ ID NO: 5802267 - DNA, 13 bp, Homo sapiens
tgcgtcaggagca

SEQ ID NO: 5802268 - DNA, 14 bp, Homo sapiens
tgcgtcaggagcag

SEQ ID NO: 5802269 - DNA, 19 bp, Homo sapiens
tgcgtcaggagcagcatca

SEQ ID NO: 5802270 - DNA, 13 bp, Homo sapiens
tgcgtccaccagg

SEQ ID NO: 5802271 - DNA, 14 bp, Homo sapiens
tgcgtccaccctga

SEQ ID NO: 5802272 - DNA, 12 bp, Homo sapiens
tgcgtcccaaga

SEQ ID NO: 5802273 - DNA, 13 bp, Homo sapiens
tgcgtcccagcct

SEQ ID NO: 5802274 - DNA, 13 bp, Homo sapiens
tgcgtcccagctg

SEQ ID NO: 5802275 - DNA, 14 bp, Homo sapiens
tgcgtcccagctga

SEQ ID NO: 5802276 - DNA, 18 bp, Homo sapiens
tgcgtcccagctgaaggc

SEQ ID NO: 5802277 - DNA, 13 bp, Homo sapiens
tgcgtccccactc

SEQ ID NO: 5802278 - DNA, 15 bp, Homo sapiens
tgcgtccccactccc

SEQ ID NO: 5802279 - DNA, 23 bp, Homo sapiens
tgcgtccccccccaacctttccc

SEQ ID NO: 5802280 - DNA, 19 bp, Homo sapiens
tgcgtccctgctcagccca

SEQ ID NO: 5802281 - DNA, 23 bp, Homo sapiens
tgcgtcccttctctttggggctc

SEQ ID NO: 5802282 - DNA, 14 bp, Homo sapiens
tgcgtcctcatttc

SEQ ID NO: 5802283 - DNA, 14 bp, Homo sapiens
tgcgtcctcctcac

SEQ ID NO: 5802284 - DNA, 22 bp, Homo sapiens
tgcgtcctcctcacctcatgcc

SEQ ID NO: 5802285 - DNA, 18 bp, Homo sapiens
tgcgtcctgacgccctgc

SEQ ID NO: 5802286 - DNA, 16 bp, Homo sapiens
tgcgtcggtcctggtg

SEQ ID NO: 5802287 - DNA, 20 bp, Homo sapiens
tgcgtctccagtcatctgta

SEQ ID NO: 5802288 - DNA, 21 bp, Homo sapiens
tgcgtctctctttctccctca

SEQ ID NO: 5802289 - DNA, 22 bp, Homo sapiens
tgcgtctctgtcgtggacacgc

SEQ ID NO: 5802290 - DNA, 13 bp, Homo sapiens
tgcgtctgaggcc

SEQ ID NO: 5802291 - DNA, 21 bp, Homo sapiens
tgcgtctggaggggcccctgc

SEQ ID NO: 5802292 - DNA, 21 bp, Homo sapiens
tgcgtctgtgtgtgcctgtgt

SEQ ID NO: 5802293 - DNA, 23 bp, Homo sapiens
tgcgtctgtgtgtgcctgtgtgc

SEQ ID NO: 5802294 - DNA, 16 bp, Homo sapiens
tgcgtcttggtgtaat

SEQ ID NO: 5802295 - DNA, 19 bp, Homo sapiens
tgcgtcttgtgaaattgtg

SEQ ID NO: 5802296 - DNA, 14 bp, Homo sapiens
tgcgtcttttttct

SEQ ID NO: 5802297 - DNA, 15 bp, Homo sapiens
tgcgtgacaataaaa

SEQ ID NO: 5802298 - DNA, 22 bp, Homo sapiens
tgcgtgacactctccttgcagt

SEQ ID NO: 5802299 - DNA, 23 bp, Homo sapiens
tgcgtgaccggcccgccaccttg

SEQ ID NO: 5802300 - DNA, 21 bp, Homo sapiens
tgcgtgactattttttaataa

SEQ ID NO: 5802301 - DNA, 22 bp, Homo sapiens
tgcgtgactattttttaataaa

SEQ ID NO: 5802302 - DNA, 23 bp, Homo sapiens
tgcgtgactattttttaataaaa

SEQ ID NO: 5802303 - DNA, 22 bp, Homo sapiens
tgcgtgatggctatgccttgca

SEQ ID NO: 5802304 - DNA, 23 bp, Homo sapiens
tgcgtgcacatatgggtgctggc

SEQ ID NO: 5802305 - DNA, 15 bp, Homo sapiens
tgcgtgcataccact

SEQ ID NO: 5802306 - DNA, 17 bp, Homo sapiens
tgcgtgcccctgctgct

SEQ ID NO: 5802307 - DNA, 12 bp, Homo sapiens
tgcgtgctgtct

SEQ ID NO: 5802308 - DNA, 18 bp, Homo sapiens
tgcgtgctttatttatgg

SEQ ID NO: 5802309 - DNA, 15 bp, Homo sapiens
tgcgtggaaaaagac

SEQ ID NO: 5802310 - DNA, 16 bp, Homo sapiens
tgcgtggaagtgttcc

SEQ ID NO: 5802311 - DNA, 17 bp, Homo sapiens
tgcgtggaagtgttcct

SEQ ID NO: 5802312 - DNA, 20 bp, Homo sapiens
tgcgtggaagtgttcctgtc

SEQ ID NO: 5802313 - DNA, 17 bp, Homo sapiens
tgcgtggacagtcaggg

SEQ ID NO: 5802314 - DNA, 18 bp, Homo sapiens
tgcgtggactctgcacat

SEQ ID NO: 5802315 - DNA, 22 bp, Homo sapiens
tgcgtggactctgcacatgtct

SEQ ID NO: 5802316 - DNA, 15 bp, Homo sapiens
tgcgtggatcaagct

SEQ ID NO: 5802317 - DNA, 19 bp, Homo sapiens
tgcgtggcatagcccagac

SEQ ID NO: 5802318 - DNA, 24 bp, Homo sapiens
tgcgtggccacgggggcagtgtga

SEQ ID NO: 5802319 - DNA, 16 bp, Homo sapiens
tgcgtggcctgagtcc

SEQ ID NO: 5802320 - DNA, 12 bp, Homo sapiens
tgcgtggctccc

SEQ ID NO: 5802321 - DNA, 20 bp, Homo sapiens
tgcgtggcttccctgtccca

SEQ ID NO: 5802322 - DNA, 22 bp, Homo sapiens
tgcgtggcttccctgtcccagt

SEQ ID NO: 5802323 - DNA, 12 bp, Homo sapiens
tgcgtgggaggc

SEQ ID NO: 5802324 - DNA, 11 bp, Homo sapiens
tgcgtgggcag

SEQ ID NO: 5802325 - DNA, 15 bp, Homo sapiens
tgcgtgggcagagga

SEQ ID NO: 5802326 - DNA, 14 bp, Homo sapiens
tgcgtgggtgtgtg

SEQ ID NO: 5802327 - DNA, 19 bp, Homo sapiens
tgcgtggtggtccctgggt

SEQ ID NO: 5802328 - DNA, 16 bp, Homo sapiens
tgcgtgtatatgtgct

SEQ ID NO: 5802329 - DNA, 22 bp, Homo sapiens
tgcgtgtctctgccatgtggca

SEQ ID NO: 5802330 - DNA, 16 bp, Homo sapiens
tgcgtgtctgtttcct

SEQ ID NO: 5802331 - DNA, 18 bp, Homo sapiens
tgcgtgtgagtgtgtgtg

SEQ ID NO: 5802332 - DNA, 18 bp, Homo sapiens
tgcgtgtgcgtgcatgtg

SEQ ID NO: 5802333 - DNA, 17 bp, Homo sapiens
tgcgtgtggccctgtgg

SEQ ID NO: 5802334 - DNA, 17 bp, Homo sapiens
tgcgtgtggcgtggccc

SEQ ID NO: 5802335 - DNA, 23 bp, Homo sapiens
tgcgtgtgggaggctggggaccc

SEQ ID NO: 5802336 - DNA, 12 bp, Homo sapiens
tgcgtgtgtaga

SEQ ID NO: 5802337 - DNA, 14 bp, Homo sapiens
tgcgtgtgtagagt

SEQ ID NO: 5802338 - DNA, 13 bp, Homo sapiens
tgcgtgtgtatat

SEQ ID NO: 5802339 - DNA, 15 bp, Homo sapiens
tgcgtgtgtcaggga

SEQ ID NO: 5802340 - DNA, 16 bp, Homo sapiens
tgcgtgtgtctgtgtt

SEQ ID NO: 5802341 - DNA, 23 bp, Homo sapiens
tgcgtgttagtgtgtgtgcatgt

SEQ ID NO: 5802342 - DNA, 22 bp, Homo sapiens
tgctcagccttgctgctctgcg

SEQ ID NO: 5802343 - DNA, 17 bp, Homo sapiens
tgctcagctctgggcca

SEQ ID NO: 5802344 - DNA, 21 bp, Homo sapiens
tgctcagctctggtccaggcc

SEQ ID NO: 5802345 - DNA, 14 bp, Homo sapiens
tgctcagctgtggc

SEQ ID NO: 5802346 - DNA, 15 bp, Homo sapiens
tgctcagctgtggct

SEQ ID NO: 5802347 - DNA, 20 bp, Homo sapiens
tgctcagcttctccaacaat

SEQ ID NO: 5802348 - DNA, 20 bp, Homo sapiens
tgctcaggagacctggagga

SEQ ID NO: 5802349 - DNA, 13 bp, Homo sapiens
tgctcaggcctca

SEQ ID NO: 5802350 - DNA, 20 bp, Homo sapiens
tgctcaggcctcacctccca

SEQ ID NO: 5802351 - DNA, 23 bp, Homo sapiens
tgctcaggcctcacctcccaggg

SEQ ID NO: 5802352 - DNA, 23 bp, Homo sapiens
tgctcaggcctcacctggcttcc

SEQ ID NO: 5802353 - DNA, 17 bp, Homo sapiens
tgctcaggcctccctag

SEQ ID NO: 5802354 - DNA, 18 bp, Homo sapiens
tgctcaggcctccctagc

SEQ ID NO: 5802355 - DNA, 18 bp, Homo sapiens
tgctcaggctgcagctgg

SEQ ID NO: 5802356 - DNA, 21 bp, Homo sapiens
tgctcaggctgcagctggaca

SEQ ID NO: 5802357 - DNA, 23 bp, Homo sapiens
tgctcaggctgcagctggacaga

SEQ ID NO: 5802358 - DNA, 15 bp, Homo sapiens
tgctcaggctggtct

SEQ ID NO: 5802359 - DNA, 16 bp, Homo sapiens
tgctcagggaaatggc

SEQ ID NO: 5802360 - DNA, 18 bp, Homo sapiens
tgctcagggaaatggcct

SEQ ID NO: 5802361 - DNA, 19 bp, Homo sapiens
tgctcagggaaatggcctt

SEQ ID NO: 5802362 - DNA, 21 bp, Homo sapiens
tgctcagggaaatggccttcc

SEQ ID NO: 5802363 - DNA, 22 bp, Homo sapiens
tgctcagggaaatggccttccc

SEQ ID NO: 5802364 - DNA, 23 bp, Homo sapiens
tgctcagggaaatggccttcccg

SEQ ID NO: 5802365 - DNA, 12 bp, Homo sapiens
tgctcagggccg

SEQ ID NO: 5802366 - DNA, 17 bp, Homo sapiens
tgctcaggggccctgga

SEQ ID NO: 5802367 - DNA, 18 bp, Homo sapiens
tgctcaggggccctggag

SEQ ID NO: 5802368 - DNA, 17 bp, Homo sapiens
tgctcaggtaaatctta

SEQ ID NO: 5802369 - DNA, 17 bp, Homo sapiens
tgctcaggtacttgtaa

SEQ ID NO: 5802370 - DNA, 17 bp, Homo sapiens
tgctcaggtgcaagtgc

SEQ ID NO: 5802371 - DNA, 12 bp, Homo sapiens
tgctcaggtgct

SEQ ID NO: 5802372 - DNA, 16 bp, Homo sapiens
tgctcaggtgctatgt

SEQ ID NO: 5802373 - DNA, 23 bp, Homo sapiens
tgctcaggtgctatgtcccaaga

SEQ ID NO: 5802374 - DNA, 17 bp, Homo sapiens
tgctcaggtgctggggc

SEQ ID NO: 5802375 - DNA, 19 bp, Homo sapiens
tgctcagtacctgtgttga

SEQ ID NO: 5802376 - DNA, 12 bp, Homo sapiens
tgctcagtgcct

SEQ ID NO: 5802377 - DNA, 14 bp, Homo sapiens
tgctcagtgcctcc

SEQ ID NO: 5802378 - DNA, 15 bp, Homo sapiens
tgctcagtgcctcct

SEQ ID NO: 5802379 - DNA, 19 bp, Homo sapiens
tgctcagtgcttgggctcc

SEQ ID NO: 5802380 - DNA, 22 bp, Homo sapiens
tgctcagtgcttgggctccacg

SEQ ID NO: 5802381 - DNA, 23 bp, Homo sapiens
tgctcagtgcttgggctccacgg

SEQ ID NO: 5802382 - DNA, 19 bp, Homo sapiens
tgctcagtggatcacacac

SEQ ID NO: 5802383 - DNA, 15 bp, Homo sapiens
tgctcagtgtccagc

SEQ ID NO: 5802384 - DNA, 18 bp, Homo sapiens
tgctcagtgtccagcttc

SEQ ID NO: 5802385 - DNA, 19 bp, Homo sapiens
tgctcagtgtccagcttcc

SEQ ID NO: 5802386 - DNA, 20 bp, Homo sapiens
tgctcagtgtccagcttcca

SEQ ID NO: 5802387 - DNA, 15 bp, Homo sapiens
tgctcagtgtttcat

SEQ ID NO: 5802388 - DNA, 20 bp, Homo sapiens
tgctcagtgtttttgtgaat

SEQ ID NO: 5802389 - DNA, 17 bp, Homo sapiens
tgctcagttcagaatca

SEQ ID NO: 5802390 - DNA, 14 bp, Homo sapiens
tgctcagttccaat

SEQ ID NO: 5802391 - DNA, 12 bp, Homo sapiens
tgctcagttgct

SEQ ID NO: 5802392 - DNA, 16 bp, Homo sapiens
tgctcagttgtagaat

SEQ ID NO: 5802393 - DNA, 20 bp, Homo sapiens
tgctcagttgtagaatgtat

SEQ ID NO: 5802394 - DNA, 22 bp, Homo sapiens
tgctcataactagagtatgtgt

SEQ ID NO: 5802395 - DNA, 19 bp, Homo sapiens
tgctcatacacagttaaat

SEQ ID NO: 5802396 - DNA, 22 bp, Homo sapiens
tgctcatacacagttaaataaa

SEQ ID NO: 5802397 - DNA, 13 bp, Homo sapiens
tgctcataggacc

SEQ ID NO: 5802398 - DNA, 22 bp, Homo sapiens
tgctcatatttcccatgatttc

SEQ ID NO: 5802399 - DNA, 14 bp, Homo sapiens
tgctcatcacccag

SEQ ID NO: 5802400 - DNA, 19 bp, Homo sapiens
tgctcatcacccagtcctg

SEQ ID NO: 5802401 - DNA, 21 bp, Homo sapiens
tgctcatcacccagtcctggc

SEQ ID NO: 5802402 - DNA, 20 bp, Homo sapiens
tgctcatcatattccaaccc

SEQ ID NO: 5802403 - DNA, 17 bp, Homo sapiens
tgctcatccactctact

SEQ ID NO: 5802404 - DNA, 14 bp, Homo sapiens
tgctcatcggagac

SEQ ID NO: 5802405 - DNA, 15 bp, Homo sapiens
tgctcatctacacat

SEQ ID NO: 5802406 - DNA, 15 bp, Homo sapiens
tgctcatctgatatt

SEQ ID NO: 5802407 - DNA, 13 bp, Homo sapiens
tgctcatctgctg

SEQ ID NO: 5802408 - DNA, 18 bp, Homo sapiens
tgctcatctgctggtccg

SEQ ID NO: 5802409 - DNA, 17 bp, Homo sapiens
tgctcatctgtacatac

SEQ ID NO: 5802410 - DNA, 16 bp, Homo sapiens
tgctcatctgttgtag

SEQ ID NO: 5802411 - DNA, 13 bp, Homo sapiens
tgctcatgctgct

SEQ ID NO: 5802412 - DNA, 14 bp, Homo sapiens
tgctcatggaattg

SEQ ID NO: 5802413 - DNA, 22 bp, Homo sapiens
tgctcatggtccccatggcatg

SEQ ID NO: 5802414 - DNA, 23 bp, Homo sapiens
tgctcatgtccctgtccccaggc

SEQ ID NO: 5802415 - DNA, 16 bp, Homo sapiens
tgctcatgtgtgtggt

SEQ ID NO: 5802416 - DNA, 15 bp, Homo sapiens
tgctcattaaactga

SEQ ID NO: 5802417 - DNA, 21 bp, Homo sapiens
tgctcattccatgactctgcc

SEQ ID NO: 5802418 - DNA, 22 bp, Homo sapiens
tgctcattcctcacgcccttca

SEQ ID NO: 5802419 - DNA, 19 bp, Homo sapiens
tgctcattctaatgatggc

SEQ ID NO: 5802420 - DNA, 22 bp, Homo sapiens
tgctcattcttcagttctctac

SEQ ID NO: 5802421 - DNA, 20 bp, Homo sapiens
tgctcattcttgaggagcat

SEQ ID NO: 5802422 - DNA, 16 bp, Homo sapiens
tgctcattgctttcta

SEQ ID NO: 5802423 - DNA, 23 bp, Homo sapiens
tgctcattgtataagccccgagg

SEQ ID NO: 5802424 - DNA, 15 bp, Homo sapiens
tgctcattgtggcca

SEQ ID NO: 5802425 - DNA, 12 bp, Homo sapiens
tgctcatttaag

SEQ ID NO: 5802426 - DNA, 18 bp, Homo sapiens
tgctcatttaagtttcaa

SEQ ID NO: 5802427 - DNA, 17 bp, Homo sapiens
tgctcattttctttagg

SEQ ID NO: 5802428 - DNA, 22 bp, Homo sapiens
tgctcattttttttttatcaga

SEQ ID NO: 5802429 - DNA, 19 bp, Homo sapiens
tgctccaaagtagaactct

SEQ ID NO: 5802430 - DNA, 21 bp, Homo sapiens
tgctccaacagacaccctcca

SEQ ID NO: 5802431 - DNA, 18 bp, Homo sapiens
tgctccaagattctagat

SEQ ID NO: 5802432 - DNA, 15 bp, Homo sapiens
tgctccaagggacag

SEQ ID NO: 5802433 - DNA, 20 bp, Homo sapiens
tgctccaagggacaggtggg

SEQ ID NO: 5802434 - DNA, 23 bp, Homo sapiens
tgctccaagttgagactcggccg

SEQ ID NO: 5802435 - DNA, 13 bp, Homo sapiens
tgctccaataaag

SEQ ID NO: 5802436 - DNA, 23 bp, Homo sapiens
tgctccaataaaggaacataaag

SEQ ID NO: 5802437 - DNA, 15 bp, Homo sapiens
tgctccaatctctgg

SEQ ID NO: 5802438 - DNA, 20 bp, Homo sapiens
tgctccaatctgtcacataa

SEQ ID NO: 5802439 - DNA, 16 bp, Homo sapiens
tgctccacactcagaa

SEQ ID NO: 5802440 - DNA, 19 bp, Homo sapiens
tgctccacactcagaaaat

SEQ ID NO: 5802441 - DNA, 20 bp, Homo sapiens
tgctccacactcagaaaatt

SEQ ID NO: 5802442 - DNA, 15 bp, Homo sapiens
tgctccaccacatcc

SEQ ID NO: 5802443 - DNA, 16 bp, Homo sapiens
tgctccaccccactca

SEQ ID NO: 5802444 - DNA, 22 bp, Homo sapiens
tgctccacccttggcctgtctc

SEQ ID NO: 5802445 - DNA, 23 bp, Homo sapiens
tgctccaccttgaacctgtcacc

SEQ ID NO: 5802446 - DNA, 20 bp, Homo sapiens
tgctccacgaagccttaagc

SEQ ID NO: 5802447 - DNA, 12 bp, Homo sapiens
tgctccagaaga

SEQ ID NO: 5802448 - DNA, 20 bp, Homo sapiens
tgctccagaatttggaaatc

SEQ ID NO: 5802449 - DNA, 21 bp, Homo sapiens
tgctccagacctgatcctgga

SEQ ID NO: 5802450 - DNA, 23 bp, Homo sapiens
tgctccagacctgcccctccctc

SEQ ID NO: 5802451 - DNA, 13 bp, Homo sapiens
tgctccagattct

SEQ ID NO: 5802452 - DNA, 23 bp, Homo sapiens
tgctccagcaacacagcctgggc

SEQ ID NO: 5802453 - DNA, 23 bp, Homo sapiens
tgctccagcaactgcccttccag

SEQ ID NO: 5802454 - DNA, 18 bp, Homo sapiens
tgctccagcagcacacct

SEQ ID NO: 5802455 - DNA, 23 bp, Homo sapiens
tgctccagcagcacacctcagcc

SEQ ID NO: 5802456 - DNA, 18 bp, Homo sapiens
tgctccagcagtgctggg

SEQ ID NO: 5802457 - DNA, 18 bp, Homo sapiens
tgctccagccaacccctg

SEQ ID NO: 5802458 - DNA, 11 bp, Homo sapiens
tgctccagccc

SEQ ID NO: 5802459 - DNA, 13 bp, Homo sapiens
tgctccagcctct

SEQ ID NO: 5802460 - DNA, 15 bp, Homo sapiens
tgctccagcctctgc

SEQ ID NO: 5802461 - DNA, 16 bp, Homo sapiens
tgctccagcctctgcc

SEQ ID NO: 5802462 - DNA, 17 bp, Homo sapiens
tgctccagcctctgccg

SEQ ID NO: 5802463 - DNA, 13 bp, Homo sapiens
tgctccagcctga

SEQ ID NO: 5802464 - DNA, 16 bp, Homo sapiens
tgctccagcctgacaa

SEQ ID NO: 5802465 - DNA, 13 bp, Homo sapiens
tgctccagctctg

SEQ ID NO: 5802466 - DNA, 16 bp, Homo sapiens
tgctccagctgtcgtc

SEQ ID NO: 5802467 - DNA, 20 bp, Homo sapiens
tgctccagctgttcagctgg

SEQ ID NO: 5802468 - DNA, 12 bp, Homo sapiens
tgctccaggcag

SEQ ID NO: 5802469 - DNA, 14 bp, Homo sapiens
tgctccaggcaggc

SEQ ID NO: 5802470 - DNA, 22 bp, Homo sapiens
tgctccaggcaggctaaggcgt

SEQ ID NO: 5802471 - DNA, 17 bp, Homo sapiens
tgctccaggcatcactg

SEQ ID NO: 5802472 - DNA, 16 bp, Homo sapiens
tgctccaggcttcctg

SEQ ID NO: 5802473 - DNA, 21 bp, Homo sapiens
tgctccaggcttcctgcccta

SEQ ID NO: 5802474 - DNA, 17 bp, Homo sapiens
tgctccagggtcaggcg

SEQ ID NO: 5802475 - DNA, 18 bp, Homo sapiens
tgctccagggtcttgggc

SEQ ID NO: 5802476 - DNA, 23 bp, Homo sapiens
tgctccagggtcttgggctactg

SEQ ID NO: 5802477 - DNA, 16 bp, Homo sapiens
tgctccagtgggcagg

SEQ ID NO: 5802478 - DNA, 17 bp, Homo sapiens
tgctccagtgttttctt

SEQ ID NO: 5802479 - DNA, 19 bp, Homo sapiens
tgctccagtgttttcttgt

SEQ ID NO: 5802480 - DNA, 19 bp, Homo sapiens
tgctccataccttttctct

SEQ ID NO: 5802481 - DNA, 20 bp, Homo sapiens
tgctccataccttttctctt

SEQ ID NO: 5802482 - DNA, 18 bp, Homo sapiens
tgctccatagacatcagt

SEQ ID NO: 5802483 - DNA, 22 bp, Homo sapiens
tgctccatccccctgcctccca

SEQ ID NO: 5802484 - DNA, 23 bp, Homo sapiens
tgctccatgcagatctagccagg

SEQ ID NO: 5802485 - DNA, 22 bp, Homo sapiens
tgctccatgggcacctctgctg

SEQ ID NO: 5802486 - DNA, 22 bp, Homo sapiens
tgctccatgtttccaccaaatg

SEQ ID NO: 5802487 - DNA, 15 bp, Homo sapiens
tgctccattcctgag

SEQ ID NO: 5802488 - DNA, 14 bp, Homo sapiens
tgctccattttctt

SEQ ID NO: 5802489 - DNA, 17 bp, Homo sapiens
tgctccattttcttgtc

SEQ ID NO: 5802490 - DNA, 17 bp, Homo sapiens
tgctcccaaaacatttt

SEQ ID NO: 5802491 - DNA, 22 bp, Homo sapiens
tgctcccaaatgcagcttcagg

SEQ ID NO: 5802492 - DNA, 23 bp, Homo sapiens
tgctcccaagcaaaggaaatgca

SEQ ID NO: 5802493 - DNA, 12 bp, Homo sapiens
tgctcccaagcc

SEQ ID NO: 5802494 - DNA, 19 bp, Homo sapiens
tgctcccacacttgtgcca

SEQ ID NO: 5802495 - DNA, 20 bp, Homo sapiens
tgctcccacacttgtgccag

SEQ ID NO: 5802496 - DNA, 15 bp, Homo sapiens
tgctcccacagaagg

SEQ ID NO: 5802497 - DNA, 18 bp, Homo sapiens
tgctcccaccaccagtga

SEQ ID NO: 5802498 - DNA, 14 bp, Homo sapiens
tgctcccaccccag

SEQ ID NO: 5802499 - DNA, 18 bp, Homo sapiens
tgctcccacctcctgaca

SEQ ID NO: 5802500 - DNA, 23 bp, Homo sapiens
tgctcccacctcctgacaccctt

SEQ ID NO: 5802501 - DNA, 17 bp, Homo sapiens
tgctcccacctggctct

SEQ ID NO: 5802502 - DNA, 17 bp, Homo sapiens
tgctcccacgcctgctt

SEQ ID NO: 5802503 - DNA, 19 bp, Homo sapiens
tgctcccacgcctgcttct

SEQ ID NO: 5802504 - DNA, 21 bp, Homo sapiens
tgctcccagatgccttctaga

SEQ ID NO: 5802505 - DNA, 15 bp, Homo sapiens
tgctcccagcagccc

SEQ ID NO: 5802506 - DNA, 12 bp, Homo sapiens
tgctcccagcct

SEQ ID NO: 5802507 - DNA, 13 bp, Homo sapiens
tgctcccagcctg

SEQ ID NO: 5802508 - DNA, 23 bp, Homo sapiens
tgctcccagctctctctcctgga

SEQ ID NO: 5802509 - DNA, 17 bp, Homo sapiens
tgctcccagctgtgctg

SEQ ID NO: 5802510 - DNA, 20 bp, Homo sapiens
tgctcccagctgtgctgtgg

SEQ ID NO: 5802511 - DNA, 17 bp, Homo sapiens
tgctcccagtcctgcct

SEQ ID NO: 5802512 - DNA, 18 bp, Homo sapiens
tgctcccagtcctgcctg

SEQ ID NO: 5802513 - DNA, 19 bp, Homo sapiens
tgctcccagtcctgcctga

SEQ ID NO: 5802514 - DNA, 14 bp, Homo sapiens
tgctcccagtgcca

SEQ ID NO: 5802515 - DNA, 17 bp, Homo sapiens
tgctcccatcattcctt

SEQ ID NO: 5802516 - DNA, 22 bp, Homo sapiens
tgctcccatcattccttctggc

SEQ ID NO: 5802517 - DNA, 13 bp, Homo sapiens
tgctcttaattgc

SEQ ID NO: 5802518 - DNA, 15 bp, Homo sapiens
tgctcttaattgcca

SEQ ID NO: 5802519 - DNA, 19 bp, Homo sapiens
tgctcttactacactgagg

SEQ ID NO: 5802520 - DNA, 20 bp, Homo sapiens
tgctcttactacactgagga

SEQ ID NO: 5802521 - DNA, 21 bp, Homo sapiens
tgctcttactacactgaggag

SEQ ID NO: 5802522 - DNA, 22 bp, Homo sapiens
tgctcttacttcccccaccctg

SEQ ID NO: 5802523 - DNA, 18 bp, Homo sapiens
tgctcttagtgcccgcct

SEQ ID NO: 5802524 - DNA, 17 bp, Homo sapiens
tgctcttatattttcat

SEQ ID NO: 5802525 - DNA, 14 bp, Homo sapiens
tgctcttatttcat

SEQ ID NO: 5802526 - DNA, 18 bp, Homo sapiens
tgctcttcaaaataaaac

SEQ ID NO: 5802527 - DNA, 18 bp, Homo sapiens
tgctcttcagatgccact

SEQ ID NO: 5802528 - DNA, 14 bp, Homo sapiens
tgctcttcataata

SEQ ID NO: 5802529 - DNA, 17 bp, Homo sapiens
tgctcttcatcccattc

SEQ ID NO: 5802530 - DNA, 18 bp, Homo sapiens
tgctcttccatttcttcc

SEQ ID NO: 5802531 - DNA, 17 bp, Homo sapiens
tgctcttcctcatctca

SEQ ID NO: 5802532 - DNA, 15 bp, Homo sapiens
tgctcttcctctggt

SEQ ID NO: 5802533 - DNA, 21 bp, Homo sapiens
tgctcttcctctggtttctgt

SEQ ID NO: 5802534 - DNA, 17 bp, Homo sapiens
tgctcttctacactagg

SEQ ID NO: 5802535 - DNA, 13 bp, Homo sapiens
tgctcttctctta

SEQ ID NO: 5802536 - DNA, 23 bp, Homo sapiens
tgctcttctgtggaccactgcat

SEQ ID NO: 5802537 - DNA, 15 bp, Homo sapiens
tgctcttctttctga

SEQ ID NO: 5802538 - DNA, 16 bp, Homo sapiens
tgctcttgaaatattc

SEQ ID NO: 5802539 - DNA, 22 bp, Homo sapiens
tgctcttgaactcctgacctca

SEQ ID NO: 5802540 - DNA, 17 bp, Homo sapiens
tgctcttgatgcctggc

SEQ ID NO: 5802541 - DNA, 14 bp, Homo sapiens
tgctcttgcctgca

SEQ ID NO: 5802542 - DNA, 17 bp, Homo sapiens
tgctcttgcctgcaccc

SEQ ID NO: 5802543 - DNA, 17 bp, Homo sapiens
tgctcttggaaagctga

SEQ ID NO: 5802544 - DNA, 21 bp, Homo sapiens
tgctcttggctggacccagcc

SEQ ID NO: 5802545 - DNA, 14 bp, Homo sapiens
tgctcttgtcccac

SEQ ID NO: 5802546 - DNA, 16 bp, Homo sapiens
tgctcttgtcccacgt

SEQ ID NO: 5802547 - DNA, 23 bp, Homo sapiens
tgctcttgtcccacgtgtcttcc

SEQ ID NO: 5802548 - DNA, 22 bp, Homo sapiens
tgctcttgtgatgtttgctcag

SEQ ID NO: 5802549 - DNA, 21 bp, Homo sapiens
tgctcttgtttcactccacca

SEQ ID NO: 5802550 - DNA, 15 bp, Homo sapiens
tgctcttgtttttat

SEQ ID NO: 5802551 - DNA, 16 bp, Homo sapiens
tgctctttaaataata

SEQ ID NO: 5802552 - DNA, 23 bp, Homo sapiens
tgctctttagatgcaagtggctg

SEQ ID NO: 5802553 - DNA, 20 bp, Homo sapiens
tgctctttcaccctgccacc

SEQ ID NO: 5802554 - DNA, 18 bp, Homo sapiens
tgctctttcacctgggtg

SEQ ID NO: 5802555 - DNA, 17 bp, Homo sapiens
tgctctttccacttgcc

SEQ ID NO: 5802556 - DNA, 22 bp, Homo sapiens
tgctctttccacttgccctgtg

SEQ ID NO: 5802557 - DNA, 16 bp, Homo sapiens
tgctctttcccaggac

SEQ ID NO: 5802558 - DNA, 14 bp, Homo sapiens
tgctctttcctgcc

SEQ ID NO: 5802559 - DNA, 13 bp, Homo sapiens
tgctctttctctg

SEQ ID NO: 5802560 - DNA, 18 bp, Homo sapiens
tgctctttctctgccagt

SEQ ID NO: 5802561 - DNA, 20 bp, Homo sapiens
tgctctttggcctgatgacc

SEQ ID NO: 5802562 - DNA, 23 bp, Homo sapiens
tgctctttggcctgatgaccaat

SEQ ID NO: 5802563 - DNA, 21 bp, Homo sapiens
tgctctttgtagctaacagtg

SEQ ID NO: 5802564 - DNA, 14 bp, Homo sapiens
tgctctttgttttg

SEQ ID NO: 5802565 - DNA, 23 bp, Homo sapiens
tgctcttttaagcagtctcactg

SEQ ID NO: 5802566 - DNA, 13 bp, Homo sapiens
tgctcttttcctg

SEQ ID NO: 5802567 - DNA, 20 bp, Homo sapiens
tgctcttttcctggtgctct

SEQ ID NO: 5802568 - DNA, 20 bp, Homo sapiens
tgctcttttggtggggagca

SEQ ID NO: 5802569 - DNA, 14 bp, Homo sapiens
tgctgaaaaagaaa

SEQ ID NO: 5802570 - DNA, 15 bp, Homo sapiens
tgctgaaaaagaaaa

SEQ ID NO: 5802571 - DNA, 18 bp, Homo sapiens
tgctgaaaaagaaaaaaa

SEQ ID NO: 5802572 - DNA, 19 bp, Homo sapiens
tgctgaaaaagaaaaaaat

SEQ ID NO: 5802573 - DNA, 21 bp, Homo sapiens
tgctgaaaaagaaaaaaatga

SEQ ID NO: 5802574 - DNA, 20 bp, Homo sapiens
tgctgaaaacattacatgct

SEQ ID NO: 5802575 - DNA, 23 bp, Homo sapiens
tgctgaaaaccatctggcctggc

SEQ ID NO: 5802576 - DNA, 14 bp, Homo sapiens
tgctgaaaatgatt

SEQ ID NO: 5802577 - DNA, 16 bp, Homo sapiens
tgctgaaacaatgcct

SEQ ID NO: 5802578 - DNA, 19 bp, Homo sapiens
tgctgaaacacctcccagg

SEQ ID NO: 5802579 - DNA, 20 bp, Homo sapiens
tgctgaaacacctcccaggg

SEQ ID NO: 5802580 - DNA, 15 bp, Homo sapiens
tgctgaaacaggaga

SEQ ID NO: 5802581 - DNA, 16 bp, Homo sapiens
tgctgaaaccaagggg

SEQ ID NO: 5802582 - DNA, 12 bp, Homo sapiens
tgctgaaagact

SEQ ID NO: 5802583 - DNA, 16 bp, Homo sapiens
tgctgaaagatatgta

SEQ ID NO: 5802584 - DNA, 18 bp, Homo sapiens
tgctgaaagtcctgcttt

SEQ ID NO: 5802585 - DNA, 21 bp, Homo sapiens
tgctgaaagtcctgctttcct

SEQ ID NO: 5802586 - DNA, 16 bp, Homo sapiens
tgctgaaataaactag

SEQ ID NO: 5802587 - DNA, 13 bp, Homo sapiens
tgctgaaatctat

SEQ ID NO: 5802588 - DNA, 17 bp, Homo sapiens
tgctgaaattttatatg

SEQ ID NO: 5802589 - DNA, 18 bp, Homo sapiens
tgctgaacaaaaaataaa

SEQ ID NO: 5802590 - DNA, 23 bp, Homo sapiens
tgctgaacaaggggcctccaacc

SEQ ID NO: 5802591 - DNA, 14 bp, Homo sapiens
tgctgaacacacac

SEQ ID NO: 5802592 - DNA, 18 bp, Homo sapiens
tgctgaacacagtgtctg

SEQ ID NO: 5802593 - DNA, 22 bp, Homo sapiens
tgctgaacacagtgtctgttca

SEQ ID NO: 5802594 - DNA, 23 bp, Homo sapiens
tgctgaacacagtgtctgttcag

SEQ ID NO: 5802595 - DNA, 18 bp, Homo sapiens
tgctgaacaggaaagagc

SEQ ID NO: 5802596 - DNA, 14 bp, Homo sapiens
tgctgaacattgga

SEQ ID NO: 5802597 - DNA, 19 bp, Homo sapiens
tgctgaacgacagtcccag

SEQ ID NO: 5802598 - DNA, 16 bp, Homo sapiens
tgctgaacgcagaaga

SEQ ID NO: 5802599 - DNA, 17 bp, Homo sapiens
tgctgaacgcagaagaa

SEQ ID NO: 5802600 - DNA, 22 bp, Homo sapiens
tgctgaactaagttttgtgtgt

SEQ ID NO: 5802601 - DNA, 11 bp, Homo sapiens
tgctgaagctg

SEQ ID NO: 5802602 - DNA, 13 bp, Homo sapiens
tgctgaagcttat

SEQ ID NO: 5802603 - DNA, 18 bp, Homo sapiens
tgctgaagcttattaatg

SEQ ID NO: 5802604 - DNA, 19 bp, Homo sapiens
tgctgaagcttattaatgc

SEQ ID NO: 5802605 - DNA, 21 bp, Homo sapiens
tgctgaaggagaaaaagacag

SEQ ID NO: 5802606 - DNA, 13 bp, Homo sapiens
tgctgaaggctcg

SEQ ID NO: 5802607 - DNA, 21 bp, Homo sapiens
tgctgaagggagggggctggc

SEQ ID NO: 5802608 - DNA, 15 bp, Homo sapiens
tgctgaaggtccagg

SEQ ID NO: 5802609 - DNA, 11 bp, Homo sapiens
tgctgaagtac

SEQ ID NO: 5802610 - DNA, 15 bp, Homo sapiens
tgctgaagtctcccc

SEQ ID NO: 5802611 - DNA, 16 bp, Homo sapiens
tgctgaagtctccccg

SEQ ID NO: 5802612 - DNA, 18 bp, Homo sapiens
tgctgaatatacagcagg

SEQ ID NO: 5802613 - DNA, 17 bp, Homo sapiens
tgctgaatatctgttca

SEQ ID NO: 5802614 - DNA, 20 bp, Homo sapiens
tgctgaatccacctcggagc

SEQ ID NO: 5802615 - DNA, 21 bp, Homo sapiens
tgctgaatcccatcaggctgt

SEQ ID NO: 5802616 - DNA, 17 bp, Homo sapiens
tgctgaatgcagggaat

SEQ ID NO: 5802617 - DNA, 15 bp, Homo sapiens
tgctgaatgccccct

SEQ ID NO: 5802618 - DNA, 17 bp, Homo sapiens
tgctgaatggttttcaa

SEQ ID NO: 5802619 - DNA, 20 bp, Homo sapiens
tgctgaatgtcattatttga

SEQ ID NO: 5802620 - DNA, 18 bp, Homo sapiens
tgctgaatgttgggactg

SEQ ID NO: 5802621 - DNA, 13 bp, Homo sapiens
tgctgaattattt

SEQ ID NO: 5802622 - DNA, 22 bp, Homo sapiens
tgctgaattattttgttgtgat

SEQ ID NO: 5802623 - DNA, 11 bp, Homo sapiens
tgctgaattca

SEQ ID NO: 5802624 - DNA, 14 bp, Homo sapiens
tgctgaattttcac

SEQ ID NO: 5802625 - DNA, 16 bp, Homo sapiens
tgctgacaacttagct

SEQ ID NO: 5802626 - DNA, 23 bp, Homo sapiens
tgctgacagacacaggcccggct

SEQ ID NO: 5802627 - DNA, 15 bp, Homo sapiens
tgctgacagctgacc

SEQ ID NO: 5802628 - DNA, 16 bp, Homo sapiens
tgctgacagctgctcc

SEQ ID NO: 5802629 - DNA, 21 bp, Homo sapiens
tgctgacaggatgtggcactg

SEQ ID NO: 5802630 - DNA, 22 bp, Homo sapiens
tgctgacaggatgtggcactgc

SEQ ID NO: 5802631 - DNA, 23 bp, Homo sapiens
tgctgacatggctttgctttgtg

SEQ ID NO: 5802632 - DNA, 14 bp, Homo sapiens
tgctgaccaaatgg

SEQ ID NO: 5802633 - DNA, 21 bp, Homo sapiens
tgctgaccaaatggccagttt

SEQ ID NO: 5802634 - DNA, 18 bp, Homo sapiens
tgctgaccaattgtgctg

SEQ ID NO: 5802635 - DNA, 18 bp, Homo sapiens
tgctgaccagctggagtg

SEQ ID NO: 5802636 - DNA, 21 bp, Homo sapiens
tgctgaccagctggagtgagg

SEQ ID NO: 5802637 - DNA, 17 bp, Homo sapiens
tgctgacccaacagcct

SEQ ID NO: 5802638 - DNA, 14 bp, Homo sapiens
tgctgacccaccaa

SEQ ID NO: 5802639 - DNA, 15 bp, Homo sapiens
tgctgacccatgggc

SEQ ID NO: 5802640 - DNA, 21 bp, Homo sapiens
tgctgacccatgggcaggaga

SEQ ID NO: 5802641 - DNA, 23 bp, Homo sapiens
tgctgacccatgggcaggagact

SEQ ID NO: 5802642 - DNA, 14 bp, Homo sapiens
tgctgaccccagga

SEQ ID NO: 5802643 - DNA, 18 bp, Homo sapiens
tgctgaccccaggaagtg

SEQ ID NO: 5802644 - DNA, 21 bp, Homo sapiens
tgctgaccccaggtcagccct

SEQ ID NO: 5802645 - DNA, 23 bp, Homo sapiens
tgctgaccccaggtcagccctgt

SEQ ID NO: 5802646 - DNA, 15 bp, Homo sapiens
tgctgacccctgtgt

SEQ ID NO: 5802647 - DNA, 15 bp, Homo sapiens
tgctgaccctcctgt

SEQ ID NO: 5802648 - DNA, 20 bp, Homo sapiens
tgctgaccggaatggtcaaa

SEQ ID NO: 5802649 - DNA, 19 bp, Homo sapiens
tgctgacctcacctggtcc

SEQ ID NO: 5802650 - DNA, 20 bp, Homo sapiens
tgctgacctcacctggtcct

SEQ ID NO: 5802651 - DNA, 21 bp, Homo sapiens
tgctgacctcacctggtcctc

SEQ ID NO: 5802652 - DNA, 19 bp, Homo sapiens
tgctgacctcactgtcctg

SEQ ID NO: 5802653 - DNA, 16 bp, Homo sapiens
tgctgacctccacagc

SEQ ID NO: 5802654 - DNA, 14 bp, Homo sapiens
tgctgacctgtgca

SEQ ID NO: 5802655 - DNA, 15 bp, Homo sapiens
tgctgacggccaggg

SEQ ID NO: 5802656 - DNA, 20 bp, Homo sapiens
tgctgacggccagggagaag

SEQ ID NO: 5802657 - DNA, 22 bp, Homo sapiens
tgctgacggccagggagaagct

SEQ ID NO: 5802658 - DNA, 20 bp, Homo sapiens
tgctgacgggacccacatgc

SEQ ID NO: 5802659 - DNA, 21 bp, Homo sapiens
tgctgactaactataagcatg

SEQ ID NO: 5802660 - DNA, 22 bp, Homo sapiens
tgctgactccatatggaggcct

SEQ ID NO: 5802661 - DNA, 14 bp, Homo sapiens
tgctgactctctga

SEQ ID NO: 5802662 - DNA, 23 bp, Homo sapiens
tgctgactctctgagctggggag

SEQ ID NO: 5802663 - DNA, 14 bp, Homo sapiens
tgctgactgaggcc

SEQ ID NO: 5802664 - DNA, 18 bp, Homo sapiens
tgctgactggcttcagca

SEQ ID NO: 5802665 - DNA, 22 bp, Homo sapiens
tgctgactgtactcctcccagg

SEQ ID NO: 5802666 - DNA, 22 bp, Homo sapiens
tgctgactgtagctttggaagt

SEQ ID NO: 5802667 - DNA, 19 bp, Homo sapiens
tgctgactgtttcattcac

SEQ ID NO: 5802668 - DNA, 16 bp, Homo sapiens
tgctgactgttttctc

SEQ ID NO: 5802669 - DNA, 21 bp, Homo sapiens
tgctgactgttttctcttgag

SEQ ID NO: 5802670 - DNA, 13 bp, Homo sapiens
tgctgacttagaa

SEQ ID NO: 5802671 - DNA, 17 bp, Homo sapiens
tgctgacttagcctcct

SEQ ID NO: 5802672 - DNA, 16 bp, Homo sapiens
tgctgacttcccaagc

SEQ ID NO: 5802673 - DNA, 18 bp, Homo sapiens
tgctgagaacctggcctt

SEQ ID NO: 5802674 - DNA, 20 bp, Homo sapiens
tgctgagaacctggccttca

SEQ ID NO: 5802675 - DNA, 21 bp, Homo sapiens
tgctgagaacctggccttcag

SEQ ID NO: 5802676 - DNA, 14 bp, Homo sapiens
tgctgagaagcttt

SEQ ID NO: 5802677 - DNA, 17 bp, Homo sapiens
tgctgagaagcttttga

SEQ ID NO: 5802678 - DNA, 15 bp, Homo sapiens
tgctgagacatccct

SEQ ID NO: 5802679 - DNA, 19 bp, Homo sapiens
tgctgagacatccctcatc

SEQ ID NO: 5802680 - DNA, 23 bp, Homo sapiens
tgctgagacgccacggagggctg

SEQ ID NO: 5802681 - DNA, 13 bp, Homo sapiens
tgctgagacttac

SEQ ID NO: 5802682 - DNA, 14 bp, Homo sapiens
tgctgagagaaata

SEQ ID NO: 5802683 - DNA, 18 bp, Homo sapiens
tgctgagagacccaagga

SEQ ID NO: 5802684 - DNA, 22 bp, Homo sapiens
tgctgagagacctcagggatgg

SEQ ID NO: 5802685 - DNA, 14 bp, Homo sapiens
tgctgagagccccc

SEQ ID NO: 5802686 - DNA, 21 bp, Homo sapiens
tgctgagaggcaccagtccag

SEQ ID NO: 5802687 - DNA, 20 bp, Homo sapiens
tgctgagatacatacagaat

SEQ ID NO: 5802688 - DNA, 14 bp, Homo sapiens
tgctgagatcctgg

SEQ ID NO: 5802689 - DNA, 16 bp, Homo sapiens
tgctgagattacaggt

SEQ ID NO: 5802690 - DNA, 16 bp, Homo sapiens
tgctgagattcttcag

SEQ ID NO: 5802691 - DNA, 14 bp, Homo sapiens
tgctgagcaaagtt

SEQ ID NO: 5802692 - DNA, 15 bp, Homo sapiens
tgctgagcacagaga

SEQ ID NO: 5802693 - DNA, 13 bp, Homo sapiens
tgctgctgtaaat

SEQ ID NO: 5802694 - DNA, 23 bp, Homo sapiens
tgctgctgtaactgctgagccac

SEQ ID NO: 5802695 - DNA, 16 bp, Homo sapiens
tgctgctgtacaactt

SEQ ID NO: 5802696 - DNA, 18 bp, Homo sapiens
tgctgctgtacaacttct

SEQ ID NO: 5802697 - DNA, 19 bp, Homo sapiens
tgctgctgtgaatctgaaa

SEQ ID NO: 5802698 - DNA, 13 bp, Homo sapiens
tgctgctgtgcag

SEQ ID NO: 5802699 - DNA, 18 bp, Homo sapiens
tgctgctgtgcagcatgg

SEQ ID NO: 5802700 - DNA, 15 bp, Homo sapiens
tgctgctgtgcctgc

SEQ ID NO: 5802701 - DNA, 13 bp, Homo sapiens
tgctgctgtgcgt

SEQ ID NO: 5802702 - DNA, 19 bp, Homo sapiens
tgctgctgtgcgtggaaaa

SEQ ID NO: 5802703 - DNA, 14 bp, Homo sapiens
tgctgctgtggaaa

SEQ ID NO: 5802704 - DNA, 18 bp, Homo sapiens
tgctgctgtggagtgagg

SEQ ID NO: 5802705 - DNA, 13 bp, Homo sapiens
tgctgctgtggca

SEQ ID NO: 5802706 - DNA, 11 bp, Homo sapiens
tgctgctgttc

SEQ ID NO: 5802707 - DNA, 15 bp, Homo sapiens
tgctgctgttctgtg

SEQ ID NO: 5802708 - DNA, 17 bp, Homo sapiens
tgctgctgttctgtgta

SEQ ID NO: 5802709 - DNA, 19 bp, Homo sapiens
tgctgcttaagtgcatgca

SEQ ID NO: 5802710 - DNA, 18 bp, Homo sapiens
tgctgcttacactccagg

SEQ ID NO: 5802711 - DNA, 11 bp, Homo sapiens
tgctgcttcca

SEQ ID NO: 5802712 - DNA, 20 bp, Homo sapiens
tgctgcttccctctgcctgt

SEQ ID NO: 5802713 - DNA, 20 bp, Homo sapiens
tgctgcttccggtagggagg

SEQ ID NO: 5802714 - DNA, 13 bp, Homo sapiens
tgctgcttctccc

SEQ ID NO: 5802715 - DNA, 20 bp, Homo sapiens
tgctgcttctcccaggcaag

SEQ ID NO: 5802716 - DNA, 16 bp, Homo sapiens
tgctgcttctccctgg

SEQ ID NO: 5802717 - DNA, 17 bp, Homo sapiens
tgctgcttctgggcctg

SEQ ID NO: 5802718 - DNA, 16 bp, Homo sapiens
tgctgcttgtgacctt

SEQ ID NO: 5802719 - DNA, 19 bp, Homo sapiens
tgctgcttgtgaccttgac

SEQ ID NO: 5802720 - DNA, 22 bp, Homo sapiens
tgctgcttgtgcctcccttccc

SEQ ID NO: 5802721 - DNA, 14 bp, Homo sapiens
tgctgctttccaac

SEQ ID NO: 5802722 - DNA, 14 bp, Homo sapiens
tgctgctttgatat

SEQ ID NO: 5802723 - DNA, 17 bp, Homo sapiens
tgctgctttgcacacac

SEQ ID NO: 5802724 - DNA, 14 bp, Homo sapiens
tgctgctttgcttc

SEQ ID NO: 5802725 - DNA, 20 bp, Homo sapiens
tgctgctttggttaatctct

SEQ ID NO: 5802726 - DNA, 19 bp, Homo sapiens
tgctgctttgtccaggtga

SEQ ID NO: 5802727 - DNA, 15 bp, Homo sapiens
tgctgctttgttttc

SEQ ID NO: 5802728 - DNA, 17 bp, Homo sapiens
tgctgcttttccttggg

SEQ ID NO: 5802729 - DNA, 16 bp, Homo sapiens
tgctgcttttgagcct

SEQ ID NO: 5802730 - DNA, 17 bp, Homo sapiens
tgctgcttttgagcctc

SEQ ID NO: 5802731 - DNA, 17 bp, Homo sapiens
tgctgctttttggcaca

SEQ ID NO: 5802732 - DNA, 15 bp, Homo sapiens
tgctggaaaactgcc

SEQ ID NO: 5802733 - DNA, 19 bp, Homo sapiens
tgctggaaaactgccacaa

SEQ ID NO: 5802734 - DNA, 18 bp, Homo sapiens
tgctggaaaataatactg

SEQ ID NO: 5802735 - DNA, 14 bp, Homo sapiens
tgctggaaaatcat

SEQ ID NO: 5802736 - DNA, 16 bp, Homo sapiens
tgctggaaaccacact

SEQ ID NO: 5802737 - DNA, 17 bp, Homo sapiens
tgctggaaataaaacag

SEQ ID NO: 5802738 - DNA, 20 bp, Homo sapiens
tgctggaaataaaacagctg

SEQ ID NO: 5802739 - DNA, 13 bp, Homo sapiens
tgctggaaatgga

SEQ ID NO: 5802740 - DNA, 16 bp, Homo sapiens
tgctggaacacagggg

SEQ ID NO: 5802741 - DNA, 17 bp, Homo sapiens
tgctggaacacaggggc

SEQ ID NO: 5802742 - DNA, 19 bp, Homo sapiens
tgctggaacacaggggcct

SEQ ID NO: 5802743 - DNA, 21 bp, Homo sapiens
tgctggaacacaggggccttt

SEQ ID NO: 5802744 - DNA, 19 bp, Homo sapiens
tgctggaagaactgcatgg

SEQ ID NO: 5802745 - DNA, 19 bp, Homo sapiens
tgctggaagctgtcaggct

SEQ ID NO: 5802746 - DNA, 14 bp, Homo sapiens
tgctggaaggggca

SEQ ID NO: 5802747 - DNA, 20 bp, Homo sapiens
tgctggaaggggcagcagga

SEQ ID NO: 5802748 - DNA, 20 bp, Homo sapiens
tgctggaagtctccatgaag

SEQ ID NO: 5802749 - DNA, 16 bp, Homo sapiens
tgctggacaggtctgg

SEQ ID NO: 5802750 - DNA, 19 bp, Homo sapiens
tgctggacaggtctgggag

SEQ ID NO: 5802751 - DNA, 19 bp, Homo sapiens
tgctggacatgagatggag

SEQ ID NO: 5802752 - DNA, 23 bp, Homo sapiens
tgctggacatgagatggagaggc

SEQ ID NO: 5802753 - DNA, 15 bp, Homo sapiens
tgctggaccagctgg

SEQ ID NO: 5802754 - DNA, 16 bp, Homo sapiens
tgctggaccagctggc

SEQ ID NO: 5802755 - DNA, 20 bp, Homo sapiens
tgctggacggggactgggga

SEQ ID NO: 5802756 - DNA, 22 bp, Homo sapiens
tgctggactagcaaaggaaaat

SEQ ID NO: 5802757 - DNA, 14 bp, Homo sapiens
tgctggactgtcat

SEQ ID NO: 5802758 - DNA, 15 bp, Homo sapiens
tgctggactgtcata

SEQ ID NO: 5802759 - DNA, 17 bp, Homo sapiens
tgctggactgttccagg

SEQ ID NO: 5802760 - DNA, 21 bp, Homo sapiens
tgctggactgttccaggccct

SEQ ID NO: 5802761 - DNA, 18 bp, Homo sapiens
tgctggactttaaaaaaa

SEQ ID NO: 5802762 - DNA, 20 bp, Homo sapiens
tgctggactttaaaaaaaca

SEQ ID NO: 5802763 - DNA, 16 bp, Homo sapiens
tgctggagaaaccttc

SEQ ID NO: 5802764 - DNA, 21 bp, Homo sapiens
tgctggagaaaccttcactcc

SEQ ID NO: 5802765 - DNA, 18 bp, Homo sapiens
tgctggagaaagccacgc

SEQ ID NO: 5802766 - DNA, 18 bp, Homo sapiens
tgctggagaaatcttgaa

SEQ ID NO: 5802767 - DNA, 13 bp, Homo sapiens
tgctggagactcc

SEQ ID NO: 5802768 - DNA, 22 bp, Homo sapiens
tgctggagagtagacatccccc

SEQ ID NO: 5802769 - DNA, 16 bp, Homo sapiens
tgctggagcactgggc

SEQ ID NO: 5802770 - DNA, 10 bp, Homo sapiens
tgctggagcc

SEQ ID NO: 5802771 - DNA, 19 bp, Homo sapiens
tgctggagccactaactag

SEQ ID NO: 5802772 - DNA, 16 bp, Homo sapiens
tgctggagcctgtgta

SEQ ID NO: 5802773 - DNA, 17 bp, Homo sapiens
tgctggagcctgtgtaa

SEQ ID NO: 5802774 - DNA, 13 bp, Homo sapiens
tgctggagctctg

SEQ ID NO: 5802775 - DNA, 18 bp, Homo sapiens
tgctggaggaggggaagc

SEQ ID NO: 5802776 - DNA, 20 bp, Homo sapiens
tgctggaggaggggaagctg

SEQ ID NO: 5802777 - DNA, 21 bp, Homo sapiens
tgctggaggaggggaagctgg

SEQ ID NO: 5802778 - DNA, 19 bp, Homo sapiens
tgctggaggcagcgctggt

SEQ ID NO: 5802779 - DNA, 20 bp, Homo sapiens
tgctggaggcagcgctggtc

SEQ ID NO: 5802780 - DNA, 20 bp, Homo sapiens
tgctggaggggacgctggct

SEQ ID NO: 5802781 - DNA, 13 bp, Homo sapiens
tgctggaggggtg

SEQ ID NO: 5802782 - DNA, 22 bp, Homo sapiens
tgctggaggggtggcccagagc

SEQ ID NO: 5802783 - DNA, 23 bp, Homo sapiens
tgctggaggggtggcccagagcc

SEQ ID NO: 5802784 - DNA, 15 bp, Homo sapiens
tgctggagtacccag

SEQ ID NO: 5802785 - DNA, 21 bp, Homo sapiens
tgctggagtacccagcctatc

SEQ ID NO: 5802786 - DNA, 17 bp, Homo sapiens
tgctggagtcatgtgcc

SEQ ID NO: 5802787 - DNA, 18 bp, Homo sapiens
tgctggagtctggcttta

SEQ ID NO: 5802788 - DNA, 14 bp, Homo sapiens
tgctggagtgcagt

SEQ ID NO: 5802789 - DNA, 19 bp, Homo sapiens
tgctggagtgcagtggcac

SEQ ID NO: 5802790 - DNA, 17 bp, Homo sapiens
tgctggatattttcaaa

SEQ ID NO: 5802791 - DNA, 19 bp, Homo sapiens
tgctggatccggtctgcct

SEQ ID NO: 5802792 - DNA, 17 bp, Homo sapiens
tgctggatgacttgaga

SEQ ID NO: 5802793 - DNA, 19 bp, Homo sapiens
tgctggatgacttgagatg

SEQ ID NO: 5802794 - DNA, 18 bp, Homo sapiens
tgctggatgtctgccaat

SEQ ID NO: 5802795 - DNA, 22 bp, Homo sapiens
tgctggattgtccttggaggaa

SEQ ID NO: 5802796 - DNA, 20 bp, Homo sapiens
tgctggcaaatccaggctgg

SEQ ID NO: 5802797 - DNA, 18 bp, Homo sapiens
tgctggcacatttcccca

SEQ ID NO: 5802798 - DNA, 13 bp, Homo sapiens
tgctggcacctca

SEQ ID NO: 5802799 - DNA, 16 bp, Homo sapiens
tgctggcagggccagg

SEQ ID NO: 5802800 - DNA, 19 bp, Homo sapiens
tgctggcagggccagggca

SEQ ID NO: 5802801 - DNA, 23 bp, Homo sapiens
tgctggcagggccagggcaatgc

SEQ ID NO: 5802802 - DNA, 14 bp, Homo sapiens
tgctggcagggcct

SEQ ID NO: 5802803 - DNA, 15 bp, Homo sapiens
tgctggcagggcctg

SEQ ID NO: 5802804 - DNA, 20 bp, Homo sapiens
tgctggcatcaggtctgggc

SEQ ID NO: 5802805 - DNA, 13 bp, Homo sapiens
tgctggcatgtct

SEQ ID NO: 5802806 - DNA, 13 bp, Homo sapiens
tgctggccaaata

SEQ ID NO: 5802807 - DNA, 14 bp, Homo sapiens
tgctggccagcacc

SEQ ID NO: 5802808 - DNA, 18 bp, Homo sapiens
tgctggccagcaccctct

SEQ ID NO: 5802809 - DNA, 17 bp, Homo sapiens
tgctggccagcctgggg

SEQ ID NO: 5802810 - DNA, 21 bp, Homo sapiens
tgctggccagcctggggcctg

SEQ ID NO: 5802811 - DNA, 22 bp, Homo sapiens
tgctggccagcctggggcctgg

SEQ ID NO: 5802812 - DNA, 23 bp, Homo sapiens
tgctggccagcctggggcctggc

SEQ ID NO: 5802813 - DNA, 21 bp, Homo sapiens
tgctggccatgaatctctgcc

SEQ ID NO: 5802814 - DNA, 12 bp, Homo sapiens
tgctggccatgg

SEQ ID NO: 5802815 - DNA, 17 bp, Homo sapiens
tgctggcccacagctct

SEQ ID NO: 5802816 - DNA, 19 bp, Homo sapiens
tgctggcccacagctctgc

SEQ ID NO: 5802817 - DNA, 14 bp, Homo sapiens
tgctggcccaccca

SEQ ID NO: 5802818 - DNA, 17 bp, Homo sapiens
tgctggcccagcatgga

SEQ ID NO: 5802819 - DNA, 12 bp, Homo sapiens
tgctggcccagg

SEQ ID NO: 5802820 - DNA, 16 bp, Homo sapiens
tgctggcccagggccc

SEQ ID NO: 5802821 - DNA, 14 bp, Homo sapiens
tgctggccccagcc

SEQ ID NO: 5802822 - DNA, 18 bp, Homo sapiens
tgctggccccgcccctgc

SEQ ID NO: 5802823 - DNA, 12 bp, Homo sapiens
tgctggcccctc

SEQ ID NO: 5802824 - DNA, 13 bp, Homo sapiens
tgctggcccctca

SEQ ID NO: 5802825 - DNA, 20 bp, Homo sapiens
tgctggcccctcacctgggc

SEQ ID NO: 5802826 - DNA, 24 bp, Homo sapiens
tgctggcccctcacctgggcacct

SEQ ID NO: 5802827 - DNA, 16 bp, Homo sapiens
tgctggccggacaccc

SEQ ID NO: 5802828 - DNA, 16 bp, Homo sapiens
tgctggccgggcacag

SEQ ID NO: 5802829 - DNA, 23 bp, Homo sapiens
tgctggcctcccaataaagctgg

SEQ ID NO: 5802830 - DNA, 21 bp, Homo sapiens
tgctggcctccctccgtccct

SEQ ID NO: 5802831 - DNA, 22 bp, Homo sapiens
tgctggcctccctccgtccctc

SEQ ID NO: 5802832 - DNA, 21 bp, Homo sapiens
tgctggcctctctgacatatg

SEQ ID NO: 5802833 - DNA, 12 bp, Homo sapiens
tgctggcctctt

SEQ ID NO: 5802834 - DNA, 14 bp, Homo sapiens
tgctggcctcttgg

SEQ ID NO: 5802835 - DNA, 19 bp, Homo sapiens
tgctggcctcttggcacct

SEQ ID NO: 5802836 - DNA, 19 bp, Homo sapiens
tgctggcctgactggttgt

SEQ ID NO: 5802837 - DNA, 23 bp, Homo sapiens
tgctggcctgcgcctgcacctgc

SEQ ID NO: 5802838 - DNA, 15 bp, Homo sapiens
tgctggcctgctctt

SEQ ID NO: 5802839 - DNA, 18 bp, Homo sapiens
tgctggcctggatctccc

SEQ ID NO: 5802840 - DNA, 13 bp, Homo sapiens
tgctggcctgtgg

SEQ ID NO: 5802841 - DNA, 17 bp, Homo sapiens
tgctggcctgtggcagg

SEQ ID NO: 5802842 - DNA, 24 bp, Homo sapiens
tgctggcctgtggcaggcctagga

SEQ ID NO: 5802843 - DNA, 23 bp, Homo sapiens
tgctggccttggtatgtgccagg

SEQ ID NO: 5802844 - DNA, 18 bp, Homo sapiens
tgctggcgacactcaggg

SEQ ID NO: 5802845 - DNA, 17 bp, Homo sapiens
tgctggcggacgcagct

SEQ ID NO: 5802846 - DNA, 17 bp, Homo sapiens
tgctggcggcgcagagg

SEQ ID NO: 5802847 - DNA, 19 bp, Homo sapiens
tgctggctcacagtacagc

SEQ ID NO: 5802848 - DNA, 14 bp, Homo sapiens
tgctggctcaggag

SEQ ID NO: 5802849 - DNA, 17 bp, Homo sapiens
tgctggctcaggaggag

SEQ ID NO: 5802850 - DNA, 19 bp, Homo sapiens
tgctggctccacgccctgg

SEQ ID NO: 5802851 - DNA, 20 bp, Homo sapiens
tgctggctccacgccctggg

SEQ ID NO: 5802852 - DNA, 23 bp, Homo sapiens
tgctggctccacgccctggggag

SEQ ID NO: 5802853 - DNA, 15 bp, Homo sapiens
tgctggctcccaggg

SEQ ID NO: 5802854 - DNA, 18 bp, Homo sapiens
tgctggctcccagggcca

SEQ ID NO: 5802855 - DNA, 17 bp, Homo sapiens
tgctggctcccatctcc

SEQ ID NO: 5802856 - DNA, 17 bp, Homo sapiens
tgctggctctgagaatc

SEQ ID NO: 5802857 - DNA, 18 bp, Homo sapiens
tgctggctctgagaatca

SEQ ID NO: 5802858 - DNA, 13 bp, Homo sapiens
tgctggctgaaga

SEQ ID NO: 5802859 - DNA, 19 bp, Homo sapiens
tgctggctgacctgggccc

SEQ ID NO: 5802860 - DNA, 22 bp, Homo sapiens
tgctggctgatgggtggacctg

SEQ ID NO: 5802861 - DNA, 21 bp, Homo sapiens
tgctggctgccttagaacctt

SEQ ID NO: 5802862 - DNA, 18 bp, Homo sapiens
tgctggctgctggcccac

SEQ ID NO: 5802863 - DNA, 20 bp, Homo sapiens
tgctggctgctggcccacag

SEQ ID NO: 5802864 - DNA, 12 bp, Homo sapiens
tgctggctgggg

SEQ ID NO: 5802865 - DNA, 13 bp, Homo sapiens
tgctggctggggc

SEQ ID NO: 5802866 - DNA, 22 bp, Homo sapiens
tgctggctggggccggggctgc

SEQ ID NO: 5802867 - DNA, 21 bp, Homo sapiens
tgctggctggtgcctgagccc

SEQ ID NO: 5802868 - DNA, 16 bp, Homo sapiens
tgctggctggttagag

SEQ ID NO: 5802869 - DNA, 18 bp, Homo sapiens
tgctggctgttggctggg

SEQ ID NO: 5802870 - DNA, 12 bp, Homo sapiens
tgcttcaaggat

SEQ ID NO: 5802871 - DNA, 19 bp, Homo sapiens
tgcttcaaggatcctgagc

SEQ ID NO: 5802872 - DNA, 21 bp, Homo sapiens
tgcttcaaggatcctgagcca

SEQ ID NO: 5802873 - DNA, 19 bp, Homo sapiens
tgcttcaagtgttgctctt

SEQ ID NO: 5802874 - DNA, 22 bp, Homo sapiens
tgcttcaagtgttgctcttgga

SEQ ID NO: 5802875 - DNA, 23 bp, Homo sapiens
tgcttcaatacccaaatcctctc

SEQ ID NO: 5802876 - DNA, 18 bp, Homo sapiens
tgcttcaattaaaattac

SEQ ID NO: 5802877 - DNA, 23 bp, Homo sapiens
tgcttcaattaataaaaaatgga

SEQ ID NO: 5802878 - DNA, 15 bp, Homo sapiens
tgcttcaatttcaaa

SEQ ID NO: 5802879 - DNA, 19 bp, Homo sapiens
tgcttcaatttcaaacttt

SEQ ID NO: 5802880 - DNA, 15 bp, Homo sapiens
tgcttcacaaaatgc

SEQ ID NO: 5802881 - DNA, 15 bp, Homo sapiens
tgcttcacaacccat

SEQ ID NO: 5802882 - DNA, 15 bp, Homo sapiens
tgcttcacacaaagt

SEQ ID NO: 5802883 - DNA, 22 bp, Homo sapiens
tgcttcacacaaagtgaaatta

SEQ ID NO: 5802884 - DNA, 17 bp, Homo sapiens
tgcttcacacccctcag

SEQ ID NO: 5802885 - DNA, 18 bp, Homo sapiens
tgcttcacacccctcagc

SEQ ID NO: 5802886 - DNA, 20 bp, Homo sapiens
tgcttcacacccctcagcgc

SEQ ID NO: 5802887 - DNA, 20 bp, Homo sapiens
tgcttcacagtagagccagc

SEQ ID NO: 5802888 - DNA, 21 bp, Homo sapiens
tgcttcacggactctttgctg

SEQ ID NO: 5802889 - DNA, 23 bp, Homo sapiens
tgcttcacggactctttgctgtt

SEQ ID NO: 5802890 - DNA, 14 bp, Homo sapiens
tgcttcactaggga

SEQ ID NO: 5802891 - DNA, 21 bp, Homo sapiens
tgcttcactttccttctctgt

SEQ ID NO: 5802892 - DNA, 14 bp, Homo sapiens
tgcttcagagtttg

SEQ ID NO: 5802893 - DNA, 17 bp, Homo sapiens
tgcttcagagtttgtgt

SEQ ID NO: 5802894 - DNA, 20 bp, Homo sapiens
tgcttcagagtttgtgtgta

SEQ ID NO: 5802895 - DNA, 22 bp, Homo sapiens
tgcttcagagtttgtgtgtatt

SEQ ID NO: 5802896 - DNA, 20 bp, Homo sapiens
tgcttcagatgtggagccag

SEQ ID NO: 5802897 - DNA, 13 bp, Homo sapiens
tgcttcagcctcc

SEQ ID NO: 5802898 - DNA, 22 bp, Homo sapiens
tgcttcagcctgaggctgagac

SEQ ID NO: 5802899 - DNA, 21 bp, Homo sapiens
tgcttcagtcatcagccagca

SEQ ID NO: 5802900 - DNA, 16 bp, Homo sapiens
tgcttcagtgaacata

SEQ ID NO: 5802901 - DNA, 16 bp, Homo sapiens
tgcttcagtggagaat

SEQ ID NO: 5802902 - DNA, 16 bp, Homo sapiens
tgcttcatacagggat

SEQ ID NO: 5802903 - DNA, 21 bp, Homo sapiens
tgcttcatagctggttcctgc

SEQ ID NO: 5802904 - DNA, 21 bp, Homo sapiens
tgcttcatagtattggagcac

SEQ ID NO: 5802905 - DNA, 11 bp, Homo sapiens
tgcttcatatc

SEQ ID NO: 5802906 - DNA, 13 bp, Homo sapiens
tgcttcatatctc

SEQ ID NO: 5802907 - DNA, 18 bp, Homo sapiens
tgcttcatatctctccct

SEQ ID NO: 5802908 - DNA, 17 bp, Homo sapiens
tgcttcatcattccctc

SEQ ID NO: 5802909 - DNA, 23 bp, Homo sapiens
tgcttcatcattccctctcatct

SEQ ID NO: 5802910 - DNA, 17 bp, Homo sapiens
tgcttcatccaatgtga

SEQ ID NO: 5802911 - DNA, 19 bp, Homo sapiens
tgcttcatccaatgtgaag

SEQ ID NO: 5802912 - DNA, 18 bp, Homo sapiens
tgcttcatcttcccaggt

SEQ ID NO: 5802913 - DNA, 15 bp, Homo sapiens
tgcttcatgtgtccc

SEQ ID NO: 5802914 - DNA, 21 bp, Homo sapiens
tgcttcatgtgtcccagaaga

SEQ ID NO: 5802915 - DNA, 18 bp, Homo sapiens
tgcttcattaaaacaaga

SEQ ID NO: 5802916 - DNA, 19 bp, Homo sapiens
tgcttcattattcaagaat

SEQ ID NO: 5802917 - DNA, 23 bp, Homo sapiens
tgcttcattattcaagaatgaaa

SEQ ID NO: 5802918 - DNA, 18 bp, Homo sapiens
tgcttcattctttgcagg

SEQ ID NO: 5802919 - DNA, 16 bp, Homo sapiens
tgcttcattgaaagct

SEQ ID NO: 5802920 - DNA, 15 bp, Homo sapiens
tgcttcattttggag

SEQ ID NO: 5802921 - DNA, 13 bp, Homo sapiens
tgcttcatttttg

SEQ ID NO: 5802922 - DNA, 17 bp, Homo sapiens
tgcttcatttttgtaat

SEQ ID NO: 5802923 - DNA, 17 bp, Homo sapiens
tgcttccaacaaggaca

SEQ ID NO: 5802924 - DNA, 13 bp, Homo sapiens
tgcttccaagccc

SEQ ID NO: 5802925 - DNA, 14 bp, Homo sapiens
tgcttccaagccct

SEQ ID NO: 5802926 - DNA, 17 bp, Homo sapiens
tgcttccaatcttgctt

SEQ ID NO: 5802927 - DNA, 11 bp, Homo sapiens
tgcttccacct

SEQ ID NO: 5802928 - DNA, 16 bp, Homo sapiens
tgcttccacctcaccc

SEQ ID NO: 5802929 - DNA, 16 bp, Homo sapiens
tgcttccactcagggc

SEQ ID NO: 5802930 - DNA, 14 bp, Homo sapiens
tgcttccagaaaca

SEQ ID NO: 5802931 - DNA, 11 bp, Homo sapiens
tgcttccagga

SEQ ID NO: 5802932 - DNA, 15 bp, Homo sapiens
tgcttccaggctggg

SEQ ID NO: 5802933 - DNA, 18 bp, Homo sapiens
tgcttccaggtatgggac

SEQ ID NO: 5802934 - DNA, 21 bp, Homo sapiens
tgcttccagttggactgtggc

SEQ ID NO: 5802935 - DNA, 21 bp, Homo sapiens
tgcttccattaacaaatgctc

SEQ ID NO: 5802936 - DNA, 22 bp, Homo sapiens
tgcttccattaacaaatgctct

SEQ ID NO: 5802937 - DNA, 16 bp, Homo sapiens
tgcttcccaaatacat

SEQ ID NO: 5802938 - DNA, 14 bp, Homo sapiens
tgcttcccactggg

SEQ ID NO: 5802939 - DNA, 16 bp, Homo sapiens
tgcttcccactggggc

SEQ ID NO: 5802940 - DNA, 15 bp, Homo sapiens
tgcttcccagagaag

SEQ ID NO: 5802941 - DNA, 16 bp, Homo sapiens
tgcttcccagagaagc

SEQ ID NO: 5802942 - DNA, 22 bp, Homo sapiens
tgcttcccagaggagcagctct

SEQ ID NO: 5802943 - DNA, 18 bp, Homo sapiens
tgcttcccagagggagca

SEQ ID NO: 5802944 - DNA, 14 bp, Homo sapiens
tgcttcccatccta

SEQ ID NO: 5802945 - DNA, 15 bp, Homo sapiens
tgcttcccatcctac

SEQ ID NO: 5802946 - DNA, 19 bp, Homo sapiens
tgcttcccatctgaagagt

SEQ ID NO: 5802947 - DNA, 15 bp, Homo sapiens
tgcttcccattgagt

SEQ ID NO: 5802948 - DNA, 14 bp, Homo sapiens
tgcttcccccaccc

SEQ ID NO: 5802949 - DNA, 17 bp, Homo sapiens
tgcttcccccacttcac

SEQ ID NO: 5802950 - DNA, 13 bp, Homo sapiens
tgcttccccctcc

SEQ ID NO: 5802951 - DNA, 23 bp, Homo sapiens
tgcttccccctccccctcctgct

SEQ ID NO: 5802952 - DNA, 15 bp, Homo sapiens
tgcttccccgtgcat

SEQ ID NO: 5802953 - DNA, 23 bp, Homo sapiens
tgcttccccgtgcatgatttact

SEQ ID NO: 5802954 - DNA, 15 bp, Homo sapiens
tgcttcccctccagg

SEQ ID NO: 5802955 - DNA, 17 bp, Homo sapiens
tgcttccccttcctaag

SEQ ID NO: 5802956 - DNA, 13 bp, Homo sapiens
tgcttccctagga

SEQ ID NO: 5802957 - DNA, 13 bp, Homo sapiens
tgcttccctctgc

SEQ ID NO: 5802958 - DNA, 14 bp, Homo sapiens
tgcttccctgcagc

SEQ ID NO: 5802959 - DNA, 16 bp, Homo sapiens
tgcttccctgcagctg

SEQ ID NO: 5802960 - DNA, 16 bp, Homo sapiens
tgcttccctttcctga

SEQ ID NO: 5802961 - DNA, 18 bp, Homo sapiens
tgcttccgagacaccaca

SEQ ID NO: 5802962 - DNA, 14 bp, Homo sapiens
tgcttccgccactc

SEQ ID NO: 5802963 - DNA, 21 bp, Homo sapiens
tgcttccgcctttccggggct

SEQ ID NO: 5802964 - DNA, 22 bp, Homo sapiens
tgcttccggtagggaggcagcc

SEQ ID NO: 5802965 - DNA, 13 bp, Homo sapiens
tgcttccgttcct

SEQ ID NO: 5802966 - DNA, 13 bp, Homo sapiens
tgcttcctaactt

SEQ ID NO: 5802967 - DNA, 16 bp, Homo sapiens
tgcttcctaacttatt

SEQ ID NO: 5802968 - DNA, 11 bp, Homo sapiens
tgcttcctaca

SEQ ID NO: 5802969 - DNA, 14 bp, Homo sapiens
tgcttcctacaaag

SEQ ID NO: 5802970 - DNA, 18 bp, Homo sapiens
tgcttcctataattttga

SEQ ID NO: 5802971 - DNA, 19 bp, Homo sapiens
tgcttcctataattttgat

SEQ ID NO: 5802972 - DNA, 21 bp, Homo sapiens
tgcttcctcagggcccagcag

SEQ ID NO: 5802973 - DNA, 15 bp, Homo sapiens
tgcttcctcccaaca

SEQ ID NO: 5802974 - DNA, 18 bp, Homo sapiens
tgcttcctcctcaggccc

SEQ ID NO: 5802975 - DNA, 12 bp, Homo sapiens
tgcttcctcctg

SEQ ID NO: 5802976 - DNA, 13 bp, Homo sapiens
tgcttcctctgaa

SEQ ID NO: 5802977 - DNA, 19 bp, Homo sapiens
tgcttcctgaaagctgttg

SEQ ID NO: 5802978 - DNA, 20 bp, Homo sapiens
tgcttcctgaaagctgttgg

SEQ ID NO: 5802979 - DNA, 18 bp, Homo sapiens
tgcttcctgaaataaaca

SEQ ID NO: 5802980 - DNA, 19 bp, Homo sapiens
tgcttcctgaaataaacac

SEQ ID NO: 5802981 - DNA, 20 bp, Homo sapiens
tgcttcctgaaataaacact

SEQ ID NO: 5802982 - DNA, 22 bp, Homo sapiens
tgcttcctgaaataaacactgg

SEQ ID NO: 5802983 - DNA, 13 bp, Homo sapiens
tgcttcctgatta

SEQ ID NO: 5802984 - DNA, 22 bp, Homo sapiens
tgcttcctgtcttatcctccac

SEQ ID NO: 5802985 - DNA, 14 bp, Homo sapiens
tgcttccttcagtt

SEQ ID NO: 5802986 - DNA, 19 bp, Homo sapiens
tgcttccttggttcatgct

SEQ ID NO: 5802987 - DNA, 20 bp, Homo sapiens
tgcttccttggttcatgctt

SEQ ID NO: 5802988 - DNA, 16 bp, Homo sapiens
tgcttcctttctctcc

SEQ ID NO: 5802989 - DNA, 13 bp, Homo sapiens
tgcttcctttctt

SEQ ID NO: 5802990 - DNA, 14 bp, Homo sapiens
tgcttccttttcag

SEQ ID NO: 5802991 - DNA, 16 bp, Homo sapiens
tgcttcgagccaactc

SEQ ID NO: 5802992 - DNA, 18 bp, Homo sapiens
tgcttcgggcccttccca

SEQ ID NO: 5802993 - DNA, 16 bp, Homo sapiens
tgcttcgttttctaaa

SEQ ID NO: 5802994 - DNA, 16 bp, Homo sapiens
tgcttctaaaacaata

SEQ ID NO: 5802995 - DNA, 17 bp, Homo sapiens
tgcttctaaaacaataa

SEQ ID NO: 5802996 - DNA, 20 bp, Homo sapiens
tgcttctaaaacaataaaga

SEQ ID NO: 5802997 - DNA, 20 bp, Homo sapiens
tgcttctaagggatccagag

SEQ ID NO: 5802998 - DNA, 19 bp, Homo sapiens
tgcttctaagtaaatacaa

SEQ ID NO: 5802999 - DNA, 22 bp, Homo sapiens
tgcttctaagtaaatacaattt

SEQ ID NO: 5803000 - DNA, 23 bp, Homo sapiens
tgcttctacggccatgagactga

SEQ ID NO: 5803001 - DNA, 23 bp, Homo sapiens
tgcttctactccatggtgaactg

SEQ ID NO: 5803002 - DNA, 16 bp, Homo sapiens
tgcttctactgtgaca

SEQ ID NO: 5803003 - DNA, 12 bp, Homo sapiens
tgcttctacttt

SEQ ID NO: 5803004 - DNA, 19 bp, Homo sapiens
tgcttctagaaactctggc

SEQ ID NO: 5803005 - DNA, 15 bp, Homo sapiens
tgcttctagtatttt

SEQ ID NO: 5803006 - DNA, 19 bp, Homo sapiens
tgcttctagttctgccagg

SEQ ID NO: 5803007 - DNA, 18 bp, Homo sapiens
tgcttctatcagactcag

SEQ ID NO: 5803008 - DNA, 22 bp, Homo sapiens
tgcttctcacactggaggagca

SEQ ID NO: 5803009 - DNA, 21 bp, Homo sapiens
tgcttctcaccacgggaaagc

SEQ ID NO: 5803010 - DNA, 21 bp, Homo sapiens
tgcttctcagccccgggcctg

SEQ ID NO: 5803011 - DNA, 19 bp, Homo sapiens
tgcttctcatagccccggt

SEQ ID NO: 5803012 - DNA, 18 bp, Homo sapiens
tgcttctcatcccaacct

SEQ ID NO: 5803013 - DNA, 24 bp, Homo sapiens
tgcttctccaaaaatctgcctggg

SEQ ID NO: 5803014 - DNA, 14 bp, Homo sapiens
tgcttctccacctc

SEQ ID NO: 5803015 - DNA, 15 bp, Homo sapiens
tgcttctccacctcc

SEQ ID NO: 5803016 - DNA, 13 bp, Homo sapiens
tgcttctccagcc

SEQ ID NO: 5803017 - DNA, 17 bp, Homo sapiens
tgcttctcccaggcaag

SEQ ID NO: 5803018 - DNA, 21 bp, Homo sapiens
tgcttctcccaggcaaggctg

SEQ ID NO: 5803019 - DNA, 12 bp, Homo sapiens
tgcttctcccat

SEQ ID NO: 5803020 - DNA, 16 bp, Homo sapiens
tgcttctcccatttcc

SEQ ID NO: 5803021 - DNA, 17 bp, Homo sapiens
tgcttctcccatttcct

SEQ ID NO: 5803022 - DNA, 21 bp, Homo sapiens
tgcttctcccatttcctgatc

SEQ ID NO: 5803023 - DNA, 13 bp, Homo sapiens
tgcttctccccag

SEQ ID NO: 5803024 - DNA, 20 bp, Homo sapiens
tgcttctcccgccattggcc

SEQ ID NO: 5803025 - DNA, 16 bp, Homo sapiens
tgcttctccctggctg

SEQ ID NO: 5803026 - DNA, 18 bp, Homo sapiens
tgcttctcctcccagcgt

SEQ ID NO: 5803027 - DNA, 18 bp, Homo sapiens
tgcttctcggaggccagg

SEQ ID NO: 5803028 - DNA, 23 bp, Homo sapiens
tgcttctcggaggccaggccctc

SEQ ID NO: 5803029 - DNA, 21 bp, Homo sapiens
tgcttctcggggtccagtgca

SEQ ID NO: 5803030 - DNA, 16 bp, Homo sapiens
tgcttctctaaaacag

SEQ ID NO: 5803031 - DNA, 14 bp, Homo sapiens
tgcttctctacaga

SEQ ID NO: 5803032 - DNA, 21 bp, Homo sapiens
tgcttctctagctctctaggc

SEQ ID NO: 5803033 - DNA, 22 bp, Homo sapiens
tgcttctctagctctctaggcc

SEQ ID NO: 5803034 - DNA, 19 bp, Homo sapiens
tgcttctctcagccagctg

SEQ ID NO: 5803035 - DNA, 15 bp, Homo sapiens
tgcttctctctctct

SEQ ID NO: 5803036 - DNA, 21 bp, Homo sapiens
tgcttctctgacttctgcctg

SEQ ID NO: 5803037 - DNA, 23 bp, Homo sapiens
tgcttctctgacttctgcctgga

SEQ ID NO: 5803038 - DNA, 14 bp, Homo sapiens
tgcttctcttcttt

SEQ ID NO: 5803039 - DNA, 23 bp, Homo sapiens
tgcttctcttctttattgcacta

SEQ ID NO: 5803040 - DNA, 16 bp, Homo sapiens
tgcttctctttataga

SEQ ID NO: 5803041 - DNA, 16 bp, Homo sapiens
tgcttctctttgtgca

SEQ ID NO: 5803042 - DNA, 19 bp, Homo sapiens
tgcttctgaactcaagctg

SEQ ID NO: 5803043 - DNA, 13 bp, Homo sapiens
tgcttctgaatca

SEQ ID NO: 5803044 - DNA, 16 bp, Homo sapiens
tgcttctgatttagca

SEQ ID NO: 5803045 - DNA, 21 bp, Homo sapiens
tgcttctgcagcaactcccac

SEQ ID NO: 5803046 - DNA, 16 bp, Homo sapiens
tgcttctgcccacacc

SEQ ID NO: 5803047 - DNA, 19 bp, Homo sapiens
tgcttttaaaattttaagc

SEQ ID NO: 5803048 - DNA, 17 bp, Homo sapiens
tgcttttaactctagaa

SEQ ID NO: 5803049 - DNA, 13 bp, Homo sapiens
tgcttttaccatg

SEQ ID NO: 5803050 - DNA, 13 bp, Homo sapiens
tgcttttagaaaa

SEQ ID NO: 5803051 - DNA, 23 bp, Homo sapiens
tgcttttaggagaattcacagaa

SEQ ID NO: 5803052 - DNA, 17 bp, Homo sapiens
tgcttttagtaaaaaca

SEQ ID NO: 5803053 - DNA, 18 bp, Homo sapiens
tgcttttagtaaaaacat

SEQ ID NO: 5803054 - DNA, 12 bp, Homo sapiens
tgcttttatatc

SEQ ID NO: 5803055 - DNA, 18 bp, Homo sapiens
tgcttttatatggcccag

SEQ ID NO: 5803056 - DNA, 23 bp, Homo sapiens
tgcttttatatggcccagccttg

SEQ ID NO: 5803057 - DNA, 22 bp, Homo sapiens
tgcttttcaaaccagagaaagg

SEQ ID NO: 5803058 - DNA, 18 bp, Homo sapiens
tgcttttcactgctgcaa

SEQ ID NO: 5803059 - DNA, 17 bp, Homo sapiens
tgcttttcactttctgt

SEQ ID NO: 5803060 - DNA, 13 bp, Homo sapiens
tgcttttcatcac

SEQ ID NO: 5803061 - DNA, 23 bp, Homo sapiens
tgcttttcatgtagaactcagca

SEQ ID NO: 5803062 - DNA, 22 bp, Homo sapiens
tgcttttccataaccaacattt

SEQ ID NO: 5803063 - DNA, 14 bp, Homo sapiens
tgcttttccatcta

SEQ ID NO: 5803064 - DNA, 18 bp, Homo sapiens
tgcttttccatctaaaat

SEQ ID NO: 5803065 - DNA, 15 bp, Homo sapiens
tgcttttcctctgcc

SEQ ID NO: 5803066 - DNA, 23 bp, Homo sapiens
tgcttttctccaatatcagtgct

SEQ ID NO: 5803067 - DNA, 16 bp, Homo sapiens
tgcttttctgccctgg

SEQ ID NO: 5803068 - DNA, 18 bp, Homo sapiens
tgcttttctgccctggct

SEQ ID NO: 5803069 - DNA, 15 bp, Homo sapiens
tgcttttctgtcctg

SEQ ID NO: 5803070 - DNA, 13 bp, Homo sapiens
tgcttttctgttt

SEQ ID NO: 5803071 - DNA, 16 bp, Homo sapiens
tgcttttcttcctagt

SEQ ID NO: 5803072 - DNA, 17 bp, Homo sapiens
tgcttttcttttctaac

SEQ ID NO: 5803073 - DNA, 15 bp, Homo sapiens
tgcttttgaaaaaca

SEQ ID NO: 5803074 - DNA, 15 bp, Homo sapiens
tgcttttgaaaagtt

SEQ ID NO: 5803075 - DNA, 14 bp, Homo sapiens
tgcttttgagcctc

SEQ ID NO: 5803076 - DNA, 16 bp, Homo sapiens
tgcttttgagcctcag

SEQ ID NO: 5803077 - DNA, 22 bp, Homo sapiens
tgcttttgcacaccttttcccc

SEQ ID NO: 5803078 - DNA, 23 bp, Homo sapiens
tgcttttgcatttctcttcctaa

SEQ ID NO: 5803079 - DNA, 12 bp, Homo sapiens
tgcttttgccca

SEQ ID NO: 5803080 - DNA, 19 bp, Homo sapiens
tgcttttgctaataccaaa

SEQ ID NO: 5803081 - DNA, 14 bp, Homo sapiens
tgcttttgctgctg

SEQ ID NO: 5803082 - DNA, 19 bp, Homo sapiens
tgcttttgctgctgcttaa

SEQ ID NO: 5803083 - DNA, 15 bp, Homo sapiens
tgcttttgctggggt

SEQ ID NO: 5803084 - DNA, 19 bp, Homo sapiens
tgcttttggcaaaactcta

SEQ ID NO: 5803085 - DNA, 15 bp, Homo sapiens
tgcttttggcagaga

SEQ ID NO: 5803086 - DNA, 17 bp, Homo sapiens
tgcttttggcggggagg

SEQ ID NO: 5803087 - DNA, 16 bp, Homo sapiens
tgcttttggggaatga

SEQ ID NO: 5803088 - DNA, 15 bp, Homo sapiens
tgcttttggggctct

SEQ ID NO: 5803089 - DNA, 19 bp, Homo sapiens
tgcttttgggggtcagcat

SEQ ID NO: 5803090 - DNA, 18 bp, Homo sapiens
tgcttttggtctgtgtga

SEQ ID NO: 5803091 - DNA, 19 bp, Homo sapiens
tgcttttgtatatcctata

SEQ ID NO: 5803092 - DNA, 16 bp, Homo sapiens
tgcttttgtgagaaag

SEQ ID NO: 5803093 - DNA, 12 bp, Homo sapiens
tgcttttgtgtc

SEQ ID NO: 5803094 - DNA, 15 bp, Homo sapiens
tgcttttgtgtccca

SEQ ID NO: 5803095 - DNA, 23 bp, Homo sapiens
tgcttttgttccaatgtcaatgt

SEQ ID NO: 5803096 - DNA, 16 bp, Homo sapiens
tgcttttgttgtgact

SEQ ID NO: 5803097 - DNA, 17 bp, Homo sapiens
tgcttttgttgtgactt

SEQ ID NO: 5803098 - DNA, 17 bp, Homo sapiens
tgcttttgtttcttaag

SEQ ID NO: 5803099 - DNA, 13 bp, Homo sapiens
tgcttttgttttt

SEQ ID NO: 5803100 - DNA, 22 bp, Homo sapiens
tgctttttaaactgatgtatag

SEQ ID NO: 5803101 - DNA, 15 bp, Homo sapiens
tgctttttcaccaga

SEQ ID NO: 5803102 - DNA, 17 bp, Homo sapiens
tgctttttctcaaaatg

SEQ ID NO: 5803103 - DNA, 17 bp, Homo sapiens
tgctttttctgcgcttc

SEQ ID NO: 5803104 - DNA, 14 bp, Homo sapiens
tgctttttcttgtt

SEQ ID NO: 5803105 - DNA, 13 bp, Homo sapiens
tgctttttctttc

SEQ ID NO: 5803106 - DNA, 20 bp, Homo sapiens
tgctttttgaaatgaaattt

SEQ ID NO: 5803107 - DNA, 17 bp, Homo sapiens
tgctttttgagtttcat

SEQ ID NO: 5803108 - DNA, 20 bp, Homo sapiens
tgctttttgagtttcatgtt

SEQ ID NO: 5803109 - DNA, 21 bp, Homo sapiens
tgctttttgcgtacacagaga

SEQ ID NO: 5803110 - DNA, 23 bp, Homo sapiens
tgctttttgtcatgttatgcagt

SEQ ID NO: 5803111 - DNA, 14 bp, Homo sapiens
tgcttttttaaata

SEQ ID NO: 5803112 - DNA, 13 bp, Homo sapiens
tgcttttttagat

SEQ ID NO: 5803113 - DNA, 13 bp, Homo sapiens
tgcttttttgtat

SEQ ID NO: 5803114 - DNA, 17 bp, Homo sapiens
tgcttttttgttttggc

SEQ ID NO: 5803115 - DNA, 13 bp, Homo sapiens
tgctttttttgaa

SEQ ID NO: 5803116 - DNA, 13 bp, Homo sapiens
tggaaaaaaaaaa

SEQ ID NO: 5803117 - DNA, 19 bp, Homo sapiens
tggaaaaaaaaaaaaacta

SEQ ID NO: 5803118 - DNA, 16 bp, Homo sapiens
tggaaaaaaaaaaaag

SEQ ID NO: 5803119 - DNA, 20 bp, Homo sapiens
tggaaaaaaaaaaaagagga

SEQ ID NO: 5803120 - DNA, 17 bp, Homo sapiens
tggaaaaaaaaaaatat

SEQ ID NO: 5803121 - DNA, 15 bp, Homo sapiens
tggaaaaaaaaaaca

SEQ ID NO: 5803122 - DNA, 15 bp, Homo sapiens
tggaaaaaaaaaact

SEQ ID NO: 5803123 - DNA, 19 bp, Homo sapiens
tggaaaaaaaatatatata

SEQ ID NO: 5803124 - DNA, 20 bp, Homo sapiens
tggaaaaaaacataaaaagc

SEQ ID NO: 5803125 - DNA, 21 bp, Homo sapiens
tggaaaaaaattctgatacat

SEQ ID NO: 5803126 - DNA, 21 bp, Homo sapiens
tggaaaaaagagaaaaaccaa

SEQ ID NO: 5803127 - DNA, 21 bp, Homo sapiens
tggaaaaaagattctgtctta

SEQ ID NO: 5803128 - DNA, 22 bp, Homo sapiens
tggaaaaaatgatgttcattta

SEQ ID NO: 5803129 - DNA, 20 bp, Homo sapiens
tggaaaaaccacccccaaat

SEQ ID NO: 5803130 - DNA, 23 bp, Homo sapiens
tggaaaaacttgctcccaggagg

SEQ ID NO: 5803131 - DNA, 16 bp, Homo sapiens
tggaaaaagaaagaaa

SEQ ID NO: 5803132 - DNA, 21 bp, Homo sapiens
tggaaaaagaaagaaacactc

SEQ ID NO: 5803133 - DNA, 12 bp, Homo sapiens
tggaaaaagaat

SEQ ID NO: 5803134 - DNA, 11 bp, Homo sapiens
tggaaaaagac

SEQ ID NO: 5803135 - DNA, 14 bp, Homo sapiens
tggaaaaagcgctg

SEQ ID NO: 5803136 - DNA, 17 bp, Homo sapiens
tggaaaaagtgatggag

SEQ ID NO: 5803137 - DNA, 12 bp, Homo sapiens
tggaaaaataaa

SEQ ID NO: 5803138 - DNA, 13 bp, Homo sapiens
tggaaaaatagta

SEQ ID NO: 5803139 - DNA, 15 bp, Homo sapiens
tggaaaaatagtaaa

SEQ ID NO: 5803140 - DNA, 13 bp, Homo sapiens
tggaaaaatcaca

SEQ ID NO: 5803141 - DNA, 13 bp, Homo sapiens
tggaaaaatccag

SEQ ID NO: 5803142 - DNA, 13 bp, Homo sapiens
tggaaaaatcttt

SEQ ID NO: 5803143 - DNA, 22 bp, Homo sapiens
tggaaaaatgaactgtattatt

SEQ ID NO: 5803144 - DNA, 18 bp, Homo sapiens
tggaaaaatgagagaagg

SEQ ID NO: 5803145 - DNA, 11 bp, Homo sapiens
tggaaaaatgg

SEQ ID NO: 5803146 - DNA, 16 bp, Homo sapiens
tggaaaaatggttgat

SEQ ID NO: 5803147 - DNA, 21 bp, Homo sapiens
tggaaaaatggttgatggaaa

SEQ ID NO: 5803148 - DNA, 14 bp, Homo sapiens
tggaaaaatgtttg

SEQ ID NO: 5803149 - DNA, 19 bp, Homo sapiens
tggaaaaattaagttgttg

SEQ ID NO: 5803150 - DNA, 18 bp, Homo sapiens
tggaaaaattgacaaaaa

SEQ ID NO: 5803151 - DNA, 22 bp, Homo sapiens
tggaaaacaaaccatctctagt

SEQ ID NO: 5803152 - DNA, 21 bp, Homo sapiens
tggaaaacaaagccaaacaaa

SEQ ID NO: 5803153 - DNA, 18 bp, Homo sapiens
tggaaaacagaacactta

SEQ ID NO: 5803154 - DNA, 19 bp, Homo sapiens
tggaaaacagaacacttat

SEQ ID NO: 5803155 - DNA, 21 bp, Homo sapiens
tggaaaacagcgaacagcctt

SEQ ID NO: 5803156 - DNA, 22 bp, Homo sapiens
tggaaaacatatgaaatataaa

SEQ ID NO: 5803157 - DNA, 21 bp, Homo sapiens
tggaaaacatttcaagtttac

SEQ ID NO: 5803158 - DNA, 16 bp, Homo sapiens
tggaaaaccaaactag

SEQ ID NO: 5803159 - DNA, 9 bp, Homo sapiens
tggaaaact

SEQ ID NO: 5803160 - DNA, 15 bp, Homo sapiens
tggaaaactgccaca

SEQ ID NO: 5803161 - DNA, 15 bp, Homo sapiens
tggaaaactgtgttg

SEQ ID NO: 5803162 - DNA, 20 bp, Homo sapiens
tggaaaactgtgttgccaca

SEQ ID NO: 5803163 - DNA, 20 bp, Homo sapiens
tggaaaacttgtgcccttgt

SEQ ID NO: 5803164 - DNA, 12 bp, Homo sapiens
tggaaaagaaac

SEQ ID NO: 5803165 - DNA, 13 bp, Homo sapiens
tggaaaagaaatc

SEQ ID NO: 5803166 - DNA, 15 bp, Homo sapiens
tggaaaagaactgtt

SEQ ID NO: 5803167 - DNA, 16 bp, Homo sapiens
tggaaaagaagaaact

SEQ ID NO: 5803168 - DNA, 21 bp, Homo sapiens
tggaaaagaagaaactttgcc

SEQ ID NO: 5803169 - DNA, 22 bp, Homo sapiens
tggaaaagaagaaactttgcct

SEQ ID NO: 5803170 - DNA, 14 bp, Homo sapiens
tggaaaagaataca

SEQ ID NO: 5803171 - DNA, 19 bp, Homo sapiens
tggaaaagaatacagaaag

SEQ ID NO: 5803172 - DNA, 18 bp, Homo sapiens
tggaaaagaatccctgca

SEQ ID NO: 5803173 - DNA, 12 bp, Homo sapiens
tggaaaagacag

SEQ ID NO: 5803174 - DNA, 21 bp, Homo sapiens
tggaaaagcaacttcatttga

SEQ ID NO: 5803175 - DNA, 19 bp, Homo sapiens
tggaaaagccaagaggctg

SEQ ID NO: 5803176 - DNA, 21 bp, Homo sapiens
tggaaaagcccagtgacctga

SEQ ID NO: 5803177 - DNA, 23 bp, Homo sapiens
tggaaaagcccagtgacctgacc

SEQ ID NO: 5803178 - DNA, 15 bp, Homo sapiens
tggaaaagccttctt

SEQ ID NO: 5803179 - DNA, 16 bp, Homo sapiens
tggaaaagccttctta

SEQ ID NO: 5803180 - DNA, 20 bp, Homo sapiens
tggaaaaggaagactagagg

SEQ ID NO: 5803181 - DNA, 15 bp, Homo sapiens
tggaaaagggaaatg

SEQ ID NO: 5803182 - DNA, 19 bp, Homo sapiens
tggaaaagggtcttgggaa

SEQ ID NO: 5803183 - DNA, 21 bp, Homo sapiens
tggaaaagggtcttgggaaat

SEQ ID NO: 5803184 - DNA, 21 bp, Homo sapiens
tggaaaaggtgaaaatgtttt

SEQ ID NO: 5803185 - DNA, 17 bp, Homo sapiens
tggaaaagtcacacaga

SEQ ID NO: 5803186 - DNA, 11 bp, Homo sapiens
tggaaaataaa

SEQ ID NO: 5803187 - DNA, 15 bp, Homo sapiens
tggaaaataaattat

SEQ ID NO: 5803188 - DNA, 23 bp, Homo sapiens
tggaaaataagacaatagtattt

SEQ ID NO: 5803189 - DNA, 14 bp, Homo sapiens
tggaaaataataaa

SEQ ID NO: 5803190 - DNA, 15 bp, Homo sapiens
tggaaaataataaaa

SEQ ID NO: 5803191 - DNA, 20 bp, Homo sapiens
tggaaaataataaaagaatc

SEQ ID NO: 5803192 - DNA, 21 bp, Homo sapiens
tggaaaataatttagtggatg

SEQ ID NO: 5803193 - DNA, 21 bp, Homo sapiens
tggaaaatacctaattgtgga

SEQ ID NO: 5803194 - DNA, 16 bp, Homo sapiens
tggaaaatataatgat

SEQ ID NO: 5803195 - DNA, 19 bp, Homo sapiens
tggaaaatatacaagtaaa

SEQ ID NO: 5803196 - DNA, 20 bp, Homo sapiens
tggaaaatatacaagtaaat

SEQ ID NO: 5803197 - DNA, 14 bp, Homo sapiens
tggaaaatcagtga

SEQ ID NO: 5803198 - DNA, 15 bp, Homo sapiens
tggaaaatcagtgac

SEQ ID NO: 5803199 - DNA, 12 bp, Homo sapiens
tggaaaatgatc

SEQ ID NO: 5803200 - DNA, 18 bp, Homo sapiens
tggaaaatgccatgaatt

SEQ ID NO: 5803201 - DNA, 13 bp, Homo sapiens
tggaaaatgtata

SEQ ID NO: 5803202 - DNA, 20 bp, Homo sapiens
tggaaaattaattctaaact

SEQ ID NO: 5803203 - DNA, 21 bp, Homo sapiens
tggaaaattaattctaaactt

SEQ ID NO: 5803204 - DNA, 20 bp, Homo sapiens
tggaaaattttctccttggt

SEQ ID NO: 5803205 - DNA, 20 bp, Homo sapiens
tggaaacaaagtggaaggaa

SEQ ID NO: 5803206 - DNA, 21 bp, Homo sapiens
tggaaacaaagtggaaggaaa

SEQ ID NO: 5803207 - DNA, 22 bp, Homo sapiens
tggaaacaaagtggaaggaaag

SEQ ID NO: 5803208 - DNA, 23 bp, Homo sapiens
tggaaacaaagtggaaggaaaga

SEQ ID NO: 5803209 - DNA, 24 bp, Homo sapiens
tggaaacaaagtggaaggaaagat

SEQ ID NO: 5803210 - DNA, 23 bp, Homo sapiens
tggaaacaagtgaccccagggcc

SEQ ID NO: 5803211 - DNA, 16 bp, Homo sapiens
tggaaacactgatttt

SEQ ID NO: 5803212 - DNA, 16 bp, Homo sapiens
tggaaacagaagacaa

SEQ ID NO: 5803213 - DNA, 22 bp, Homo sapiens
tggaaacagaagacaaaattgt

SEQ ID NO: 5803214 - DNA, 18 bp, Homo sapiens
tggaaacagacagggaga

SEQ ID NO: 5803215 - DNA, 19 bp, Homo sapiens
tggaaacagaggtaaaaaa

SEQ ID NO: 5803216 - DNA, 22 bp, Homo sapiens
tggaaacagaggtaaaaaaaag

SEQ ID NO: 5803217 - DNA, 13 bp, Homo sapiens
tggaaacagcatg

SEQ ID NO: 5803218 - DNA, 15 bp, Homo sapiens
tggaaacagcatgaa

SEQ ID NO: 5803219 - DNA, 19 bp, Homo sapiens
tggaaacagcatgaataaa

SEQ ID NO: 5803220 - DNA, 17 bp, Homo sapiens
tggaaacagctcgactt

SEQ ID NO: 5803221 - DNA, 16 bp, Homo sapiens
tggaaacatctgattt

SEQ ID NO: 5803222 - DNA, 20 bp, Homo sapiens
tggaaacatctgatttctga

SEQ ID NO: 5803223 - DNA, 16 bp, Homo sapiens
tggaaacattacagtt

SEQ ID NO: 5803224 - DNA, 18 bp, Homo sapiens
tggaaacattcaggagct

SEQ ID NO: 5803225 - DNA, 20 bp, Homo sapiens
tggaagctgtttggaaaaga

SEQ ID NO: 5803226 - DNA, 18 bp, Homo sapiens
tggaagcttgttttccag

SEQ ID NO: 5803227 - DNA, 20 bp, Homo sapiens
tggaagctttgtagaaatta

SEQ ID NO: 5803228 - DNA, 19 bp, Homo sapiens
tggaagctttgtcccctgc

SEQ ID NO: 5803229 - DNA, 13 bp, Homo sapiens
tggaaggaaaaca

SEQ ID NO: 5803230 - DNA, 20 bp, Homo sapiens
tggaaggaacatggagctgt

SEQ ID NO: 5803231 - DNA, 14 bp, Homo sapiens
tggaaggaatcaaa

SEQ ID NO: 5803232 - DNA, 14 bp, Homo sapiens
tggaaggacacagt

SEQ ID NO: 5803233 - DNA, 22 bp, Homo sapiens
tggaaggaccacattttatatt

SEQ ID NO: 5803234 - DNA, 16 bp, Homo sapiens
tggaaggaccctgtgc

SEQ ID NO: 5803235 - DNA, 15 bp, Homo sapiens
tggaaggagacacag

SEQ ID NO: 5803236 - DNA, 19 bp, Homo sapiens
tggaaggagacacagatgt

SEQ ID NO: 5803237 - DNA, 21 bp, Homo sapiens
tggaaggagacacagatgttc

SEQ ID NO: 5803238 - DNA, 14 bp, Homo sapiens
tggaaggagagagg

SEQ ID NO: 5803239 - DNA, 13 bp, Homo sapiens
tggaaggagaggg

SEQ ID NO: 5803240 - DNA, 18 bp, Homo sapiens
tggaaggagcacatacta

SEQ ID NO: 5803241 - DNA, 20 bp, Homo sapiens
tggaaggagcacatactacc

SEQ ID NO: 5803242 - DNA, 14 bp, Homo sapiens
tggaaggagcagaa

SEQ ID NO: 5803243 - DNA, 15 bp, Homo sapiens
tggaaggagcctgcg

SEQ ID NO: 5803244 - DNA, 21 bp, Homo sapiens
tggaaggagcctgcggctgct

SEQ ID NO: 5803245 - DNA, 17 bp, Homo sapiens
tggaaggaggcctccac

SEQ ID NO: 5803246 - DNA, 23 bp, Homo sapiens
tggaaggatctgctgaggcccag

SEQ ID NO: 5803247 - DNA, 19 bp, Homo sapiens
tggaaggcaagccaggctc

SEQ ID NO: 5803248 - DNA, 14 bp, Homo sapiens
tggaaggcagacag

SEQ ID NO: 5803249 - DNA, 15 bp, Homo sapiens
tggaaggcagagaaa

SEQ ID NO: 5803250 - DNA, 15 bp, Homo sapiens
tggaaggcagggaca

SEQ ID NO: 5803251 - DNA, 15 bp, Homo sapiens
tggaaggcagggcag

SEQ ID NO: 5803252 - DNA, 16 bp, Homo sapiens
tggaaggcagggcaga

SEQ ID NO: 5803253 - DNA, 17 bp, Homo sapiens
tggaaggcagggcagag

SEQ ID NO: 5803254 - DNA, 16 bp, Homo sapiens
tggaaggccccttccc

SEQ ID NO: 5803255 - DNA, 19 bp, Homo sapiens
tggaaggccccttccctgg

SEQ ID NO: 5803256 - DNA, 16 bp, Homo sapiens
tggaaggctgaggcag

SEQ ID NO: 5803257 - DNA, 13 bp, Homo sapiens
tggaaggctggct

SEQ ID NO: 5803258 - DNA, 15 bp, Homo sapiens
tggaaggctggctga

SEQ ID NO: 5803259 - DNA, 14 bp, Homo sapiens
tggaagggaaaaaa

SEQ ID NO: 5803260 - DNA, 15 bp, Homo sapiens
tggaagggaaaaaaa

SEQ ID NO: 5803261 - DNA, 16 bp, Homo sapiens
tggaagggaagtgaga

SEQ ID NO: 5803262 - DNA, 20 bp, Homo sapiens
tggaagggaggaaggccttt

SEQ ID NO: 5803263 - DNA, 16 bp, Homo sapiens
tggaagggaggagcag

SEQ ID NO: 5803264 - DNA, 12 bp, Homo sapiens
tggaagggcagg

SEQ ID NO: 5803265 - DNA, 17 bp, Homo sapiens
tggaagggcaggagctc

SEQ ID NO: 5803266 - DNA, 20 bp, Homo sapiens
tggaagggcaggagctcaca

SEQ ID NO: 5803267 - DNA, 20 bp, Homo sapiens
tggaagggccaatggagaaa

SEQ ID NO: 5803268 - DNA, 18 bp, Homo sapiens
tggaagggccggcttctg

SEQ ID NO: 5803269 - DNA, 13 bp, Homo sapiens
tggaagggctggg

SEQ ID NO: 5803270 - DNA, 15 bp, Homo sapiens
tggaagggctgggtg

SEQ ID NO: 5803271 - DNA, 18 bp, Homo sapiens
tggaaggggcagccctga

SEQ ID NO: 5803272 - DNA, 14 bp, Homo sapiens
tggaaggggccttg

SEQ ID NO: 5803273 - DNA, 16 bp, Homo sapiens
tggaaggggccttgct

SEQ ID NO: 5803274 - DNA, 18 bp, Homo sapiens
tggaaggggccttgctga

SEQ ID NO: 5803275 - DNA, 20 bp, Homo sapiens
tggaagggtccaccctagcc

SEQ ID NO: 5803276 - DNA, 15 bp, Homo sapiens
tggaagggtttgtgg

SEQ ID NO: 5803277 - DNA, 17 bp, Homo sapiens
tggaagggtttgtggct

SEQ ID NO: 5803278 - DNA, 19 bp, Homo sapiens
tggaaggtagagcccactg

SEQ ID NO: 5803279 - DNA, 20 bp, Homo sapiens
tggaaggtagagcccactgc

SEQ ID NO: 5803280 - DNA, 15 bp, Homo sapiens
tggaaggtctattgg

SEQ ID NO: 5803281 - DNA, 19 bp, Homo sapiens
tggaaggtctattggccaa

SEQ ID NO: 5803282 - DNA, 21 bp, Homo sapiens
tggaaggtcttttgagggcta

SEQ ID NO: 5803283 - DNA, 15 bp, Homo sapiens
tggaaggtgatgggg

SEQ ID NO: 5803284 - DNA, 12 bp, Homo sapiens
tggaaggtgcca

SEQ ID NO: 5803285 - DNA, 14 bp, Homo sapiens
tggaaggtgccaga

SEQ ID NO: 5803286 - DNA, 20 bp, Homo sapiens
tggaaggtggaagttgcagt

SEQ ID NO: 5803287 - DNA, 20 bp, Homo sapiens
tggaaggttcaggggccgct

SEQ ID NO: 5803288 - DNA, 21 bp, Homo sapiens
tggaaggtttgtatattgtca

SEQ ID NO: 5803289 - DNA, 15 bp, Homo sapiens
tggaagtaaaggcat

SEQ ID NO: 5803290 - DNA, 20 bp, Homo sapiens
tggaagtaaaggcattccac

SEQ ID NO: 5803291 - DNA, 21 bp, Homo sapiens
tggaagtagttctatgaatat

SEQ ID NO: 5803292 - DNA, 17 bp, Homo sapiens
tggaagtatacctggct

SEQ ID NO: 5803293 - DNA, 13 bp, Homo sapiens
tggaagtatagat

SEQ ID NO: 5803294 - DNA, 19 bp, Homo sapiens
tggaagtcaaataaatgtt

SEQ ID NO: 5803295 - DNA, 21 bp, Homo sapiens
tggaagtcacctttctgggct

SEQ ID NO: 5803296 - DNA, 22 bp, Homo sapiens
tggaagtcagtacgatcaagtt

SEQ ID NO: 5803297 - DNA, 14 bp, Homo sapiens
tggaagtcatgagc

SEQ ID NO: 5803298 - DNA, 17 bp, Homo sapiens
tggaagtccctcagagg

SEQ ID NO: 5803299 - DNA, 19 bp, Homo sapiens
tggaagtcgtttcaggaca

SEQ ID NO: 5803300 - DNA, 16 bp, Homo sapiens
tggaagtctacctgct

SEQ ID NO: 5803301 - DNA, 24 bp, Homo sapiens
tggaagtctacctgctggacagcc

SEQ ID NO: 5803302 - DNA, 22 bp, Homo sapiens
tggaagtctccatgaagagctt

SEQ ID NO: 5803303 - DNA, 16 bp, Homo sapiens
tggaagtctgcgccct

SEQ ID NO: 5803304 - DNA, 18 bp, Homo sapiens
tggaagtgaaaactttgt

SEQ ID NO: 5803305 - DNA, 15 bp, Homo sapiens
tggaagtgactttgg

SEQ ID NO: 5803306 - DNA, 17 bp, Homo sapiens
tggaagtgactttggct

SEQ ID NO: 5803307 - DNA, 16 bp, Homo sapiens
tggaagtgaggcattg

SEQ ID NO: 5803308 - DNA, 19 bp, Homo sapiens
tggaagtgagggtcagaga

SEQ ID NO: 5803309 - DNA, 17 bp, Homo sapiens
tggaagtgcatctactt

SEQ ID NO: 5803310 - DNA, 15 bp, Homo sapiens
tggaagtgcccagcc

SEQ ID NO: 5803311 - DNA, 17 bp, Homo sapiens
tggaagtggcagtgaaa

SEQ ID NO: 5803312 - DNA, 20 bp, Homo sapiens
tggaagtgggccagtcctgg

SEQ ID NO: 5803313 - DNA, 16 bp, Homo sapiens
tggaagtggttctatg

SEQ ID NO: 5803314 - DNA, 22 bp, Homo sapiens
tggaagtgtatttattttacag

SEQ ID NO: 5803315 - DNA, 19 bp, Homo sapiens
tggaagtgtgacttcttac

SEQ ID NO: 5803316 - DNA, 13 bp, Homo sapiens
tggaagtgtgggt

SEQ ID NO: 5803317 - DNA, 14 bp, Homo sapiens
tggaagtgtgggtc

SEQ ID NO: 5803318 - DNA, 20 bp, Homo sapiens
tggaagtgtgggtctgtgtg

SEQ ID NO: 5803319 - DNA, 21 bp, Homo sapiens
tggaagtgtgggtctgtgtgt

SEQ ID NO: 5803320 - DNA, 21 bp, Homo sapiens
tggaagtgtgtgatctgtggg

SEQ ID NO: 5803321 - DNA, 18 bp, Homo sapiens
tggaagtgtgtgtggcag

SEQ ID NO: 5803322 - DNA, 22 bp, Homo sapiens
tggaagtgtgtgtttcttgctt

SEQ ID NO: 5803323 - DNA, 17 bp, Homo sapiens
tggaagtgttcaagaaa

SEQ ID NO: 5803324 - DNA, 20 bp, Homo sapiens
tggaagtgttcctgtctcaa

SEQ ID NO: 5803325 - DNA, 21 bp, Homo sapiens
tggaagtgtttcaaaaaatta

SEQ ID NO: 5803326 - DNA, 18 bp, Homo sapiens
tggaagttattaacttta

SEQ ID NO: 5803327 - DNA, 16 bp, Homo sapiens
tggaagttgcatggca

SEQ ID NO: 5803328 - DNA, 21 bp, Homo sapiens
tggaagttggggcactgggcg

SEQ ID NO: 5803329 - DNA, 23 bp, Homo sapiens
tggaagttggggcactgggcgtc

SEQ ID NO: 5803330 - DNA, 20 bp, Homo sapiens
tggaagttgtcctttctgat

SEQ ID NO: 5803331 - DNA, 15 bp, Homo sapiens
tggaagttgtggata

SEQ ID NO: 5803332 - DNA, 19 bp, Homo sapiens
tggaagtttagctctgaga

SEQ ID NO: 5803333 - DNA, 16 bp, Homo sapiens
tggaagtttgtgttct

SEQ ID NO: 5803334 - DNA, 19 bp, Homo sapiens
tggaagtttgtgttctgtt

SEQ ID NO: 5803335 - DNA, 23 bp, Homo sapiens
tggaagtttgtgttctgtttgtt

SEQ ID NO: 5803336 - DNA, 16 bp, Homo sapiens
tggaagttttacttga

SEQ ID NO: 5803337 - DNA, 15 bp, Homo sapiens
tggaagttttcagga

SEQ ID NO: 5803338 - DNA, 20 bp, Homo sapiens
tggaagttttgctagtgtgc

SEQ ID NO: 5803339 - DNA, 15 bp, Homo sapiens
tggaataaaaggctt

SEQ ID NO: 5803340 - DNA, 23 bp, Homo sapiens
tggaataaaatataaaactgaaa

SEQ ID NO: 5803341 - DNA, 21 bp, Homo sapiens
tggaataaaatatttttttca

SEQ ID NO: 5803342 - DNA, 13 bp, Homo sapiens
tggaataaacagt

SEQ ID NO: 5803343 - DNA, 21 bp, Homo sapiens
tggaataaacatctgtgtctg

SEQ ID NO: 5803344 - DNA, 18 bp, Homo sapiens
tggaataaacattaattt

SEQ ID NO: 5803345 - DNA, 13 bp, Homo sapiens
tggaataaagatg

SEQ ID NO: 5803346 - DNA, 17 bp, Homo sapiens
tggaataaagttgcaga

SEQ ID NO: 5803347 - DNA, 20 bp, Homo sapiens
tggaataaatccttcgtcct

SEQ ID NO: 5803348 - DNA, 23 bp, Homo sapiens
tggaataaattatggcatttcta

SEQ ID NO: 5803349 - DNA, 13 bp, Homo sapiens
tggaataacatat

SEQ ID NO: 5803350 - DNA, 21 bp, Homo sapiens
tggaataagccttcgaaaaga

SEQ ID NO: 5803351 - DNA, 17 bp, Homo sapiens
tggaataaggagaatga

SEQ ID NO: 5803352 - DNA, 15 bp, Homo sapiens
tggaataagtgtaca

SEQ ID NO: 5803353 - DNA, 19 bp, Homo sapiens
tggaataatatgatgccac

SEQ ID NO: 5803354 - DNA, 15 bp, Homo sapiens
tggaataatttctat

SEQ ID NO: 5803355 - DNA, 17 bp, Homo sapiens
tggaataatttctatta

SEQ ID NO: 5803356 - DNA, 14 bp, Homo sapiens
tggaataatttgta

SEQ ID NO: 5803357 - DNA, 15 bp, Homo sapiens
tggaatacacatgca

SEQ ID NO: 5803358 - DNA, 22 bp, Homo sapiens
tggaatacagtgttattttctt

SEQ ID NO: 5803359 - DNA, 15 bp, Homo sapiens
tggaatacatgaaat

SEQ ID NO: 5803360 - DNA, 13 bp, Homo sapiens
tggaatagatgtc

SEQ ID NO: 5803361 - DNA, 14 bp, Homo sapiens
tggaataggaataa

SEQ ID NO: 5803362 - DNA, 19 bp, Homo sapiens
tggaatagtatcctccagg

SEQ ID NO: 5803363 - DNA, 20 bp, Homo sapiens
tggaatagtatcctccaggt

SEQ ID NO: 5803364 - DNA, 21 bp, Homo sapiens
tggaatagtatcctccaggtt

SEQ ID NO: 5803365 - DNA, 13 bp, Homo sapiens
tggaatagttttt

SEQ ID NO: 5803366 - DNA, 15 bp, Homo sapiens
tggaatataaaacag

SEQ ID NO: 5803367 - DNA, 16 bp, Homo sapiens
tggaatataaatagct

SEQ ID NO: 5803368 - DNA, 21 bp, Homo sapiens
tggaatataaggaaagcaata

SEQ ID NO: 5803369 - DNA, 22 bp, Homo sapiens
tggaatatacatgtaaaaatgt

SEQ ID NO: 5803370 - DNA, 16 bp, Homo sapiens
tggaatatataaccag

SEQ ID NO: 5803371 - DNA, 15 bp, Homo sapiens
tggaatatcatctgt

SEQ ID NO: 5803372 - DNA, 12 bp, Homo sapiens
tggaatattaaa

SEQ ID NO: 5803373 - DNA, 23 bp, Homo sapiens
tggaatattcccctatctctaga

SEQ ID NO: 5803374 - DNA, 14 bp, Homo sapiens
tggaatattgtttc

SEQ ID NO: 5803375 - DNA, 14 bp, Homo sapiens
tggaatatttgaat

SEQ ID NO: 5803376 - DNA, 14 bp, Homo sapiens
tggaatattttatc

SEQ ID NO: 5803377 - DNA, 19 bp, Homo sapiens
tggaatattttatcctgta

SEQ ID NO: 5803378 - DNA, 21 bp, Homo sapiens
tggaatattttatcctgtatt

SEQ ID NO: 5803379 - DNA, 19 bp, Homo sapiens
tggaatcaaggaatcctga

SEQ ID NO: 5803380 - DNA, 20 bp, Homo sapiens
tggaatcaatttcccagaag

SEQ ID NO: 5803381 - DNA, 23 bp, Homo sapiens
tggaatcaatttcccagaaggga

SEQ ID NO: 5803382 - DNA, 13 bp, Homo sapiens
tggaatcacagcc

SEQ ID NO: 5803383 - DNA, 16 bp, Homo sapiens
tggaatcacctggagg

SEQ ID NO: 5803384 - DNA, 13 bp, Homo sapiens
tggaatcactgta

SEQ ID NO: 5803385 - DNA, 15 bp, Homo sapiens
tggaatcagagattt

SEQ ID NO: 5803386 - DNA, 18 bp, Homo sapiens
tggaatcagagatttttg

SEQ ID NO: 5803387 - DNA, 14 bp, Homo sapiens
tggaatcagtattt

SEQ ID NO: 5803388 - DNA, 18 bp, Homo sapiens
tggaatcagtatttcctt

SEQ ID NO: 5803389 - DNA, 18 bp, Homo sapiens
tggaatcattgtccagag

SEQ ID NO: 5803390 - DNA, 15 bp, Homo sapiens
tggaatccagaagga

SEQ ID NO: 5803391 - DNA, 20 bp, Homo sapiens
tggaatcccacttatcaaat

SEQ ID NO: 5803392 - DNA, 18 bp, Homo sapiens
tggaatcgatttcctccc

SEQ ID NO: 5803393 - DNA, 18 bp, Homo sapiens
tggaatctactagaacct

SEQ ID NO: 5803394 - DNA, 16 bp, Homo sapiens
tggaatctagaagaaa

SEQ ID NO: 5803395 - DNA, 19 bp, Homo sapiens
tggaatctagaagaaatga

SEQ ID NO: 5803396 - DNA, 21 bp, Homo sapiens
tggaatctagaagaaatgaaa

SEQ ID NO: 5803397 - DNA, 22 bp, Homo sapiens
tggaatctagaagaaatgaaat

SEQ ID NO: 5803398 - DNA, 16 bp, Homo sapiens
tggaatctagccgatg

SEQ ID NO: 5803399 - DNA, 14 bp, Homo sapiens
tggaatctgaggca

SEQ ID NO: 5803400 - DNA, 16 bp, Homo sapiens
tggaatctgaggcatc

SEQ ID NO: 5803401 - DNA, 23 bp, Homo sapiens
tggaatctgaggcatcctctgac

SEQ ID NO: 5803402 - DNA, 19 bp, Homo sapiens
tggactgcatggggaggca

SEQ ID NO: 5803403 - DNA, 22 bp, Homo sapiens
tggactgcatggggaggcagca

SEQ ID NO: 5803404 - DNA, 15 bp, Homo sapiens
tggactgcgctggac

SEQ ID NO: 5803405 - DNA, 23 bp, Homo sapiens
tggactgctacctttcaaagctt

SEQ ID NO: 5803406 - DNA, 23 bp, Homo sapiens
tggactggaggcccctggagcca

SEQ ID NO: 5803407 - DNA, 19 bp, Homo sapiens
tggactggaggctgggtgg

SEQ ID NO: 5803408 - DNA, 17 bp, Homo sapiens
tggactggaggtgggca

SEQ ID NO: 5803409 - DNA, 14 bp, Homo sapiens
tggactggcccctg

SEQ ID NO: 5803410 - DNA, 15 bp, Homo sapiens
tggactggcccctgg

SEQ ID NO: 5803411 - DNA, 17 bp, Homo sapiens
tggactggcccctgggt

SEQ ID NO: 5803412 - DNA, 22 bp, Homo sapiens
tggactggcgttcacctccctg

SEQ ID NO: 5803413 - DNA, 19 bp, Homo sapiens
tggactggctagagtcctc

SEQ ID NO: 5803414 - DNA, 19 bp, Homo sapiens
tggactggctgtgcccctg

SEQ ID NO: 5803415 - DNA, 16 bp, Homo sapiens
tggactgggaggaggg

SEQ ID NO: 5803416 - DNA, 13 bp, Homo sapiens
tggactgggaggt

SEQ ID NO: 5803417 - DNA, 15 bp, Homo sapiens
tggactgggtgccac

SEQ ID NO: 5803418 - DNA, 19 bp, Homo sapiens
tggactgggtgggccccac

SEQ ID NO: 5803419 - DNA, 21 bp, Homo sapiens
tggactgggttgcgtcctgac

SEQ ID NO: 5803420 - DNA, 23 bp, Homo sapiens
tggactgggttttgtctctgcat

SEQ ID NO: 5803421 - DNA, 12 bp, Homo sapiens
tggactgtagaa

SEQ ID NO: 5803422 - DNA, 21 bp, Homo sapiens
tggactgtcatagaaattaca

SEQ ID NO: 5803423 - DNA, 12 bp, Homo sapiens
tggactgtcctg

SEQ ID NO: 5803424 - DNA, 22 bp, Homo sapiens
tggactgtcctgaggagccctg

SEQ ID NO: 5803425 - DNA, 16 bp, Homo sapiens
tggactgtctgatcag

SEQ ID NO: 5803426 - DNA, 14 bp, Homo sapiens
tggactgtctttat

SEQ ID NO: 5803427 - DNA, 15 bp, Homo sapiens
tggactgtgatgcca

SEQ ID NO: 5803428 - DNA, 11 bp, Homo sapiens
tggactgtgcc

SEQ ID NO: 5803429 - DNA, 20 bp, Homo sapiens
tggactgtggcacttgcctg

SEQ ID NO: 5803430 - DNA, 21 bp, Homo sapiens
tggactgtggcacttgcctgg

SEQ ID NO: 5803431 - DNA, 13 bp, Homo sapiens
tggactgtggcct

SEQ ID NO: 5803432 - DNA, 17 bp, Homo sapiens
tggactgtggcctcagg

SEQ ID NO: 5803433 - DNA, 16 bp, Homo sapiens
tggactgtggtgactt

SEQ ID NO: 5803434 - DNA, 12 bp, Homo sapiens
tggactgtgtcc

SEQ ID NO: 5803435 - DNA, 15 bp, Homo sapiens
tggactgtgtgctca

SEQ ID NO: 5803436 - DNA, 18 bp, Homo sapiens
tggactgttcaagcaaaa

SEQ ID NO: 5803437 - DNA, 18 bp, Homo sapiens
tggactgttcacggcaga

SEQ ID NO: 5803438 - DNA, 17 bp, Homo sapiens
tggactgttccaggccc

SEQ ID NO: 5803439 - DNA, 16 bp, Homo sapiens
tggactgttccctgag

SEQ ID NO: 5803440 - DNA, 17 bp, Homo sapiens
tggactgttccctgagg

SEQ ID NO: 5803441 - DNA, 14 bp, Homo sapiens
tggacttacaaaat

SEQ ID NO: 5803442 - DNA, 15 bp, Homo sapiens
tggacttagaaagca

SEQ ID NO: 5803443 - DNA, 16 bp, Homo sapiens
tggacttagaaagcag

SEQ ID NO: 5803444 - DNA, 15 bp, Homo sapiens
tggacttagctctga

SEQ ID NO: 5803445 - DNA, 13 bp, Homo sapiens
tggacttaggaag

SEQ ID NO: 5803446 - DNA, 18 bp, Homo sapiens
tggacttatttcttcaaa

SEQ ID NO: 5803447 - DNA, 14 bp, Homo sapiens
tggacttatttttg

SEQ ID NO: 5803448 - DNA, 23 bp, Homo sapiens
tggacttcacataagctcagaat

SEQ ID NO: 5803449 - DNA, 17 bp, Homo sapiens
tggacttcagtgtgtgt

SEQ ID NO: 5803450 - DNA, 14 bp, Homo sapiens
tggacttcctgggg

SEQ ID NO: 5803451 - DNA, 15 bp, Homo sapiens
tggacttcctggggc

SEQ ID NO: 5803452 - DNA, 19 bp, Homo sapiens
tggacttcctgggtcgagt

SEQ ID NO: 5803453 - DNA, 15 bp, Homo sapiens
tggacttcctgtcat

SEQ ID NO: 5803454 - DNA, 11 bp, Homo sapiens
tggacttctga

SEQ ID NO: 5803455 - DNA, 19 bp, Homo sapiens
tggacttctggatgcccat

SEQ ID NO: 5803456 - DNA, 13 bp, Homo sapiens
tggacttctggga

SEQ ID NO: 5803457 - DNA, 15 bp, Homo sapiens
tggacttctgtgggc

SEQ ID NO: 5803458 - DNA, 20 bp, Homo sapiens
tggacttcttttactcatga

SEQ ID NO: 5803459 - DNA, 16 bp, Homo sapiens
tggacttgagaaagat

SEQ ID NO: 5803460 - DNA, 18 bp, Homo sapiens
tggacttgaggattttga

SEQ ID NO: 5803461 - DNA, 19 bp, Homo sapiens
tggacttggatcttccctt

SEQ ID NO: 5803462 - DNA, 14 bp, Homo sapiens
tggacttggggcct

SEQ ID NO: 5803463 - DNA, 23 bp, Homo sapiens
tggacttggtacagttgcaggag

SEQ ID NO: 5803464 - DNA, 18 bp, Homo sapiens
tggacttggtcttgaagt

SEQ ID NO: 5803465 - DNA, 22 bp, Homo sapiens
tggacttgtatagtgagagagg

SEQ ID NO: 5803466 - DNA, 18 bp, Homo sapiens
tggacttgtatatttgta

SEQ ID NO: 5803467 - DNA, 14 bp, Homo sapiens
tggacttgtatgct

SEQ ID NO: 5803468 - DNA, 19 bp, Homo sapiens
tggacttgtccaattaatg

SEQ ID NO: 5803469 - DNA, 20 bp, Homo sapiens
tggacttgtcctcagcagct

SEQ ID NO: 5803470 - DNA, 17 bp, Homo sapiens
tggacttgtgattggct

SEQ ID NO: 5803471 - DNA, 13 bp, Homo sapiens
tggacttgtttta

SEQ ID NO: 5803472 - DNA, 16 bp, Homo sapiens
tggacttgttttaacg

SEQ ID NO: 5803473 - DNA, 23 bp, Homo sapiens
tggactttcaaaattaaatctgt

SEQ ID NO: 5803474 - DNA, 22 bp, Homo sapiens
tggactttctctaataataaat

SEQ ID NO: 5803475 - DNA, 23 bp, Homo sapiens
tggactttctctaataataaata

SEQ ID NO: 5803476 - DNA, 17 bp, Homo sapiens
tggactttgcacacttt

SEQ ID NO: 5803477 - DNA, 23 bp, Homo sapiens
tggactttgcttcccctccagga

SEQ ID NO: 5803478 - DNA, 15 bp, Homo sapiens
tggactttggaagca

SEQ ID NO: 5803479 - DNA, 22 bp, Homo sapiens
tggactttggaaggaggtgcct

SEQ ID NO: 5803480 - DNA, 23 bp, Homo sapiens
tggactttggtactgctgtcttc

SEQ ID NO: 5803481 - DNA, 12 bp, Homo sapiens
tggactttgtta

SEQ ID NO: 5803482 - DNA, 22 bp, Homo sapiens
tggactttgttagtttctccaa

SEQ ID NO: 5803483 - DNA, 21 bp, Homo sapiens
tggacttttgttcatgggaga

SEQ ID NO: 5803484 - DNA, 18 bp, Homo sapiens
tggagaaaaagatatgct

SEQ ID NO: 5803485 - DNA, 21 bp, Homo sapiens
tggagaaaaattacagatcat

SEQ ID NO: 5803486 - DNA, 21 bp, Homo sapiens
tggagaaaagcacttaaagtt

SEQ ID NO: 5803487 - DNA, 11 bp, Homo sapiens
tggagaaaatg

SEQ ID NO: 5803488 - DNA, 13 bp, Homo sapiens
tggagaaaatgaa

SEQ ID NO: 5803489 - DNA, 14 bp, Homo sapiens
tggagaaaatgctt

SEQ ID NO: 5803490 - DNA, 14 bp, Homo sapiens
tggagaaaatggac

SEQ ID NO: 5803491 - DNA, 17 bp, Homo sapiens
tggagaaaatgggcggg

SEQ ID NO: 5803492 - DNA, 22 bp, Homo sapiens
tggagaaaatgggtttattcac

SEQ ID NO: 5803493 - DNA, 18 bp, Homo sapiens
tggagaaaattggaactc

SEQ ID NO: 5803494 - DNA, 21 bp, Homo sapiens
tggagaaacaacaaataagtc

SEQ ID NO: 5803495 - DNA, 18 bp, Homo sapiens
tggagaaacaggcccaga

SEQ ID NO: 5803496 - DNA, 20 bp, Homo sapiens
tggagaaacaggctctgaga

SEQ ID NO: 5803497 - DNA, 16 bp, Homo sapiens
tggagaaaccctgtct

SEQ ID NO: 5803498 - DNA, 20 bp, Homo sapiens
tggagaaaccttcactccag

SEQ ID NO: 5803499 - DNA, 11 bp, Homo sapiens
tggagaaagaa

SEQ ID NO: 5803500 - DNA, 18 bp, Homo sapiens
tggagaaagaagtggaga

SEQ ID NO: 5803501 - DNA, 19 bp, Homo sapiens
tggagaaagaagtggagac

SEQ ID NO: 5803502 - DNA, 14 bp, Homo sapiens
tggagaaagagctg

SEQ ID NO: 5803503 - DNA, 16 bp, Homo sapiens
tggagaaagagctgcc

SEQ ID NO: 5803504 - DNA, 18 bp, Homo sapiens
tggagaaagagctgcctg

SEQ ID NO: 5803505 - DNA, 19 bp, Homo sapiens
tggagaaagagctgcctgg

SEQ ID NO: 5803506 - DNA, 14 bp, Homo sapiens
tggagaaagcactg

SEQ ID NO: 5803507 - DNA, 18 bp, Homo sapiens
tggagaaagccacgccct

SEQ ID NO: 5803508 - DNA, 23 bp, Homo sapiens
tggagaaagccacgccctccctg

SEQ ID NO: 5803509 - DNA, 15 bp, Homo sapiens
tggagaaaggagtga

SEQ ID NO: 5803510 - DNA, 18 bp, Homo sapiens
tggagaaaggatggcagc

SEQ ID NO: 5803511 - DNA, 14 bp, Homo sapiens
tggagaaagtaagt

SEQ ID NO: 5803512 - DNA, 18 bp, Homo sapiens
tggagaaagtaagtcttt

SEQ ID NO: 5803513 - DNA, 21 bp, Homo sapiens
tggagaaataaaaatacctct

SEQ ID NO: 5803514 - DNA, 14 bp, Homo sapiens
tggagaaatattta

SEQ ID NO: 5803515 - DNA, 15 bp, Homo sapiens
tggagaaatgaaaag

SEQ ID NO: 5803516 - DNA, 17 bp, Homo sapiens
tggagaaatgaagcaga

SEQ ID NO: 5803517 - DNA, 19 bp, Homo sapiens
tggagaaatgaagcagagg

SEQ ID NO: 5803518 - DNA, 11 bp, Homo sapiens
tggagaaatta

SEQ ID NO: 5803519 - DNA, 19 bp, Homo sapiens
tggagaacaacaaggacaa

SEQ ID NO: 5803520 - DNA, 11 bp, Homo sapiens
tggagaacagt

SEQ ID NO: 5803521 - DNA, 15 bp, Homo sapiens
tggagaacagtggtt

SEQ ID NO: 5803522 - DNA, 22 bp, Homo sapiens
tggagaaccagggctcttctca

SEQ ID NO: 5803523 - DNA, 20 bp, Homo sapiens
tggagaacgccagtctccca

SEQ ID NO: 5803524 - DNA, 19 bp, Homo sapiens
tggagaactagaacctgga

SEQ ID NO: 5803525 - DNA, 17 bp, Homo sapiens
tggagaactcatttcaa

SEQ ID NO: 5803526 - DNA, 18 bp, Homo sapiens
tggagaactcatttcaag

SEQ ID NO: 5803527 - DNA, 15 bp, Homo sapiens
tggagaactcctagg

SEQ ID NO: 5803528 - DNA, 22 bp, Homo sapiens
tggagaactttccatctgcttg

SEQ ID NO: 5803529 - DNA, 17 bp, Homo sapiens
tggagaagaatggcttt

SEQ ID NO: 5803530 - DNA, 17 bp, Homo sapiens
tggagaagatcgcatgg

SEQ ID NO: 5803531 - DNA, 21 bp, Homo sapiens
tggagaagctccctgaagtaa

SEQ ID NO: 5803532 - DNA, 14 bp, Homo sapiens
tggagaagctgcag

SEQ ID NO: 5803533 - DNA, 11 bp, Homo sapiens
tggagaaggaa

SEQ ID NO: 5803534 - DNA, 14 bp, Homo sapiens
tggagaaggaaaag

SEQ ID NO: 5803535 - DNA, 15 bp, Homo sapiens
tggagaaggaaaagg

SEQ ID NO: 5803536 - DNA, 18 bp, Homo sapiens
tggagaaggaaaaggctg

SEQ ID NO: 5803537 - DNA, 14 bp, Homo sapiens
tggagaaggcctgg

SEQ ID NO: 5803538 - DNA, 13 bp, Homo sapiens
tggagaagggagg

SEQ ID NO: 5803539 - DNA, 22 bp, Homo sapiens
tggagaagggttctgccctgcc

SEQ ID NO: 5803540 - DNA, 15 bp, Homo sapiens
tggagaagtctcagc

SEQ ID NO: 5803541 - DNA, 18 bp, Homo sapiens
tggagaagtgggtgggga

SEQ ID NO: 5803542 - DNA, 22 bp, Homo sapiens
tggagaagtgggtggggacaga

SEQ ID NO: 5803543 - DNA, 13 bp, Homo sapiens
tggagaagtgtgt

SEQ ID NO: 5803544 - DNA, 14 bp, Homo sapiens
tggagaagtgtgtt

SEQ ID NO: 5803545 - DNA, 18 bp, Homo sapiens
tggagaagtgtgttctga

SEQ ID NO: 5803546 - DNA, 21 bp, Homo sapiens
tggagaagttccctgaacctt

SEQ ID NO: 5803547 - DNA, 17 bp, Homo sapiens
tggagaagttgtgaaag

SEQ ID NO: 5803548 - DNA, 13 bp, Homo sapiens
tggagaatactgc

SEQ ID NO: 5803549 - DNA, 13 bp, Homo sapiens
tggagaatacttt

SEQ ID NO: 5803550 - DNA, 21 bp, Homo sapiens
tggagaatactttgcttcata

SEQ ID NO: 5803551 - DNA, 23 bp, Homo sapiens
tggagaatcacaggctgggctgg

SEQ ID NO: 5803552 - DNA, 20 bp, Homo sapiens
tggagaatctcaacatgtct

SEQ ID NO: 5803553 - DNA, 16 bp, Homo sapiens
tggagaatctgagggc

SEQ ID NO: 5803554 - DNA, 17 bp, Homo sapiens
tggagaatctgagggca

SEQ ID NO: 5803555 - DNA, 22 bp, Homo sapiens
tggagaatgcaccatactcatg

SEQ ID NO: 5803556 - DNA, 17 bp, Homo sapiens
tggagaatgccagccca

SEQ ID NO: 5803557 - DNA, 22 bp, Homo sapiens
tggagaatgtatcagccagcct

SEQ ID NO: 5803558 - DNA, 18 bp, Homo sapiens
tggagaattaaaactttg

SEQ ID NO: 5803559 - DNA, 11 bp, Homo sapiens
tggagaattgt

SEQ ID NO: 5803560 - DNA, 22 bp, Homo sapiens
tggagaatttttactggggatt

SEQ ID NO: 5803561 - DNA, 14 bp, Homo sapiens
tggagacaaggata

SEQ ID NO: 5803562 - DNA, 14 bp, Homo sapiens
tggagacaaggtgc

SEQ ID NO: 5803563 - DNA, 16 bp, Homo sapiens
tggagacaaggtgcta

SEQ ID NO: 5803564 - DNA, 20 bp, Homo sapiens
tggagacaaggtgctaacat

SEQ ID NO: 5803565 - DNA, 18 bp, Homo sapiens
tggagacaataaacagct

SEQ ID NO: 5803566 - DNA, 19 bp, Homo sapiens
tggagacaatgtctgcagc

SEQ ID NO: 5803567 - DNA, 12 bp, Homo sapiens
tggagacaccac

SEQ ID NO: 5803568 - DNA, 16 bp, Homo sapiens
tggagacaccaccacc

SEQ ID NO: 5803569 - DNA, 20 bp, Homo sapiens
tggagacaccctctgggggt

SEQ ID NO: 5803570 - DNA, 17 bp, Homo sapiens
tggagacagcagtttcc

SEQ ID NO: 5803571 - DNA, 19 bp, Homo sapiens
tggagacagccccagagca

SEQ ID NO: 5803572 - DNA, 21 bp, Homo sapiens
tggagacagccccagagcagg

SEQ ID NO: 5803573 - DNA, 22 bp, Homo sapiens
tggagacagggtctcgctctgt

SEQ ID NO: 5803574 - DNA, 19 bp, Homo sapiens
tggagacaggtgcgcccct

SEQ ID NO: 5803575 - DNA, 22 bp, Homo sapiens
tggagacagtcctttcccacca

SEQ ID NO: 5803576 - DNA, 15 bp, Homo sapiens
tggagacattcctgg

SEQ ID NO: 5803577 - DNA, 20 bp, Homo sapiens
tggagacattcctgggcaca

SEQ ID NO: 5803578 - DNA, 13 bp, Homo sapiens
tggagaccaccag

SEQ ID NO: 5803579 - DNA, 20 bp, Homo sapiens
tggagaccagaacagcatgg

SEQ ID NO: 5803580 - DNA, 22 bp, Homo sapiens
tggccatgatgtccttggactc

SEQ ID NO: 5803581 - DNA, 21 bp, Homo sapiens
tggccatgccctagaccctcc

SEQ ID NO: 5803582 - DNA, 14 bp, Homo sapiens
tggccatgcctcag

SEQ ID NO: 5803583 - DNA, 18 bp, Homo sapiens
tggccatgcctcagccct

SEQ ID NO: 5803584 - DNA, 20 bp, Homo sapiens
tggccatgcctcagccctga

SEQ ID NO: 5803585 - DNA, 12 bp, Homo sapiens
tggccatgctca

SEQ ID NO: 5803586 - DNA, 17 bp, Homo sapiens
tggccatgctcctcttc

SEQ ID NO: 5803587 - DNA, 14 bp, Homo sapiens
tggccatgctgtcc

SEQ ID NO: 5803588 - DNA, 16 bp, Homo sapiens
tggccatgctgtccct

SEQ ID NO: 5803589 - DNA, 18 bp, Homo sapiens
tggccatgctgtccctgc

SEQ ID NO: 5803590 - DNA, 15 bp, Homo sapiens
tggccatgcttcttg

SEQ ID NO: 5803591 - DNA, 19 bp, Homo sapiens
tggccatgcttcttgcccc

SEQ ID NO: 5803592 - DNA, 16 bp, Homo sapiens
tggccatggagaaagc

SEQ ID NO: 5803593 - DNA, 17 bp, Homo sapiens
tggccatggagaaagct

SEQ ID NO: 5803594 - DNA, 18 bp, Homo sapiens
tggccatggagaaagctg

SEQ ID NO: 5803595 - DNA, 18 bp, Homo sapiens
tggccatggcctctgcaa

SEQ ID NO: 5803596 - DNA, 15 bp, Homo sapiens
tggccatggggccct

SEQ ID NO: 5803597 - DNA, 18 bp, Homo sapiens
tggccatggggccctccc

SEQ ID NO: 5803598 - DNA, 20 bp, Homo sapiens
tggccatggtccccaagacc

SEQ ID NO: 5803599 - DNA, 19 bp, Homo sapiens
tggccatgtcacctggctg

SEQ ID NO: 5803600 - DNA, 19 bp, Homo sapiens
tggccatgttatgctggtg

SEQ ID NO: 5803601 - DNA, 13 bp, Homo sapiens
tggccattcttat

SEQ ID NO: 5803602 - DNA, 20 bp, Homo sapiens
tggccattctttttttcttg

SEQ ID NO: 5803603 - DNA, 22 bp, Homo sapiens
tggccattctttttttcttggc

SEQ ID NO: 5803604 - DNA, 19 bp, Homo sapiens
tggccattgagctgtttcc

SEQ ID NO: 5803605 - DNA, 20 bp, Homo sapiens
tggccattggctagaatcag

SEQ ID NO: 5803606 - DNA, 19 bp, Homo sapiens
tggccatttagccaccatc

SEQ ID NO: 5803607 - DNA, 20 bp, Homo sapiens
tggccatttgctagttctgc

SEQ ID NO: 5803608 - DNA, 14 bp, Homo sapiens
tggccatttgcttt

SEQ ID NO: 5803609 - DNA, 16 bp, Homo sapiens
tggccattttaaaatg

SEQ ID NO: 5803610 - DNA, 16 bp, Homo sapiens
tggccattttcttgcc

SEQ ID NO: 5803611 - DNA, 17 bp, Homo sapiens
tggccattttcttgcct

SEQ ID NO: 5803612 - DNA, 20 bp, Homo sapiens
tggccattttcttgcctgag

SEQ ID NO: 5803613 - DNA, 17 bp, Homo sapiens
tggccatttttctgggg

SEQ ID NO: 5803614 - DNA, 12 bp, Homo sapiens
tggcccaagaga

SEQ ID NO: 5803615 - DNA, 14 bp, Homo sapiens
tggcccaagctggg

SEQ ID NO: 5803616 - DNA, 17 bp, Homo sapiens
tggcccaaggctggcag

SEQ ID NO: 5803617 - DNA, 23 bp, Homo sapiens
tggcccaaggctggcaggtcaac

SEQ ID NO: 5803618 - DNA, 20 bp, Homo sapiens
tggcccaagtgaagcatggc

SEQ ID NO: 5803619 - DNA, 19 bp, Homo sapiens
tggcccaagtggcagagct

SEQ ID NO: 5803620 - DNA, 22 bp, Homo sapiens
tggcccaagtttctaagggagg

SEQ ID NO: 5803621 - DNA, 13 bp, Homo sapiens
tggcccacacaga

SEQ ID NO: 5803622 - DNA, 16 bp, Homo sapiens
tggcccacagctctgc

SEQ ID NO: 5803623 - DNA, 21 bp, Homo sapiens
tggcccaccagagcctccctc

SEQ ID NO: 5803624 - DNA, 19 bp, Homo sapiens
tggcccaccaggcccccct

SEQ ID NO: 5803625 - DNA, 12 bp, Homo sapiens
tggcccaccccc

SEQ ID NO: 5803626 - DNA, 21 bp, Homo sapiens
tggcccaccccccagcctcca

SEQ ID NO: 5803627 - DNA, 12 bp, Homo sapiens
tggcccacccct

SEQ ID NO: 5803628 - DNA, 13 bp, Homo sapiens
tggcccacccctc

SEQ ID NO: 5803629 - DNA, 14 bp, Homo sapiens
tggcccacccctct

SEQ ID NO: 5803630 - DNA, 16 bp, Homo sapiens
tggcccaccgtggcac

SEQ ID NO: 5803631 - DNA, 20 bp, Homo sapiens
tggcccacgcctgtaatccc

SEQ ID NO: 5803632 - DNA, 18 bp, Homo sapiens
tggcccactgctggctgc

SEQ ID NO: 5803633 - DNA, 17 bp, Homo sapiens
tggcccagaaacaacag

SEQ ID NO: 5803634 - DNA, 21 bp, Homo sapiens
tggcccagaaagcctctctct

SEQ ID NO: 5803635 - DNA, 23 bp, Homo sapiens
tggcccagaaagcctctctctcc

SEQ ID NO: 5803636 - DNA, 18 bp, Homo sapiens
tggcccagaattgcattc

SEQ ID NO: 5803637 - DNA, 14 bp, Homo sapiens
tggcccagagaggt

SEQ ID NO: 5803638 - DNA, 22 bp, Homo sapiens
tggcccagagccatactgcgtc

SEQ ID NO: 5803639 - DNA, 18 bp, Homo sapiens
tggcccagcacgagcctg

SEQ ID NO: 5803640 - DNA, 11 bp, Homo sapiens
tggcccagcag

SEQ ID NO: 5803641 - DNA, 21 bp, Homo sapiens
tggcccagcagcggcccagat

SEQ ID NO: 5803642 - DNA, 22 bp, Homo sapiens
tggcccagcagcggcccagatt

SEQ ID NO: 5803643 - DNA, 18 bp, Homo sapiens
tggcccagcagcttggct

SEQ ID NO: 5803644 - DNA, 21 bp, Homo sapiens
tggcccagcagcttggctgag

SEQ ID NO: 5803645 - DNA, 20 bp, Homo sapiens
tggcccagcaggcaggcact

SEQ ID NO: 5803646 - DNA, 22 bp, Homo sapiens
tggcccagccaaaccctgtctg

SEQ ID NO: 5803647 - DNA, 16 bp, Homo sapiens
tggcccagccactgca

SEQ ID NO: 5803648 - DNA, 17 bp, Homo sapiens
tggcccagccactgcag

SEQ ID NO: 5803649 - DNA, 12 bp, Homo sapiens
tggcccagccag

SEQ ID NO: 5803650 - DNA, 14 bp, Homo sapiens
tggcccagccagcc

SEQ ID NO: 5803651 - DNA, 15 bp, Homo sapiens
tggcccagccagcca

SEQ ID NO: 5803652 - DNA, 14 bp, Homo sapiens
tggcccagccatgg

SEQ ID NO: 5803653 - DNA, 18 bp, Homo sapiens
tggcccagccatggctgg

SEQ ID NO: 5803654 - DNA, 18 bp, Homo sapiens
tggcccagccggcctctc

SEQ ID NO: 5803655 - DNA, 23 bp, Homo sapiens
tggcccagccggcctctctggcc

SEQ ID NO: 5803656 - DNA, 14 bp, Homo sapiens
tggcccagcctgga

SEQ ID NO: 5803657 - DNA, 16 bp, Homo sapiens
tggcccagcctggagc

SEQ ID NO: 5803658 - DNA, 19 bp, Homo sapiens
tggcccagcctggagccgt

SEQ ID NO: 5803659 - DNA, 22 bp, Homo sapiens
tggcccagcctgtggcctcagc

SEQ ID NO: 5803660 - DNA, 14 bp, Homo sapiens
tggcccagcggccc

SEQ ID NO: 5803661 - DNA, 12 bp, Homo sapiens
tggcccagctcc

SEQ ID NO: 5803662 - DNA, 13 bp, Homo sapiens
tggcccagctccc

SEQ ID NO: 5803663 - DNA, 13 bp, Homo sapiens
tggcccagctcct

SEQ ID NO: 5803664 - DNA, 16 bp, Homo sapiens
tggcccagctcctcac

SEQ ID NO: 5803665 - DNA, 15 bp, Homo sapiens
tggcccaggaaaaac

SEQ ID NO: 5803666 - DNA, 16 bp, Homo sapiens
tggcccaggaattaga

SEQ ID NO: 5803667 - DNA, 22 bp, Homo sapiens
tggcccaggaattagagaagct

SEQ ID NO: 5803668 - DNA, 19 bp, Homo sapiens
tggcccaggagctctgcgc

SEQ ID NO: 5803669 - DNA, 14 bp, Homo sapiens
tggcccaggagttt

SEQ ID NO: 5803670 - DNA, 13 bp, Homo sapiens
tggcccaggcagc

SEQ ID NO: 5803671 - DNA, 15 bp, Homo sapiens
tggcccaggcagcct

SEQ ID NO: 5803672 - DNA, 12 bp, Homo sapiens
tggcccaggccc

SEQ ID NO: 5803673 - DNA, 23 bp, Homo sapiens
tggcccaggccgggaagagccac

SEQ ID NO: 5803674 - DNA, 20 bp, Homo sapiens
tggcccaggccttgctgact

SEQ ID NO: 5803675 - DNA, 22 bp, Homo sapiens
tggcccaggccttgctgactct

SEQ ID NO: 5803676 - DNA, 14 bp, Homo sapiens
tggcccagggcatc

SEQ ID NO: 5803677 - DNA, 19 bp, Homo sapiens
tggcccagggcatctggga

SEQ ID NO: 5803678 - DNA, 15 bp, Homo sapiens
tggcccagggcccag

SEQ ID NO: 5803679 - DNA, 16 bp, Homo sapiens
tggcccagggcccaga

SEQ ID NO: 5803680 - DNA, 17 bp, Homo sapiens
tggcccagggcccagag

SEQ ID NO: 5803681 - DNA, 22 bp, Homo sapiens
tggcccagggcccagagcccag

SEQ ID NO: 5803682 - DNA, 12 bp, Homo sapiens
tggcccaggggg

SEQ ID NO: 5803683 - DNA, 20 bp, Homo sapiens
tggcccagggggcctggagc

SEQ ID NO: 5803684 - DNA, 21 bp, Homo sapiens
tggcccagggggcttcctgag

SEQ ID NO: 5803685 - DNA, 19 bp, Homo sapiens
tggcccaggggtcccctgg

SEQ ID NO: 5803686 - DNA, 13 bp, Homo sapiens
tggcccagggtgt

SEQ ID NO: 5803687 - DNA, 17 bp, Homo sapiens
tggcccaggtgagtcct

SEQ ID NO: 5803688 - DNA, 21 bp, Homo sapiens
tggcccagtgcaatctgtcca

SEQ ID NO: 5803689 - DNA, 15 bp, Homo sapiens
tggcccagtgccagc

SEQ ID NO: 5803690 - DNA, 18 bp, Homo sapiens
tggcccagtgccagcaag

SEQ ID NO: 5803691 - DNA, 12 bp, Homo sapiens
tggcccagtgtc

SEQ ID NO: 5803692 - DNA, 13 bp, Homo sapiens
tggcccagtgtca

SEQ ID NO: 5803693 - DNA, 20 bp, Homo sapiens
tggcccatagaaacatgaca

SEQ ID NO: 5803694 - DNA, 24 bp, Homo sapiens
tggcccatagaaacatgacactga

SEQ ID NO: 5803695 - DNA, 12 bp, Homo sapiens
tggcccatcagt

SEQ ID NO: 5803696 - DNA, 23 bp, Homo sapiens
tggcccatcagtgtacccccgcc

SEQ ID NO: 5803697 - DNA, 19 bp, Homo sapiens
tggcccatcccccctcacc

SEQ ID NO: 5803698 - DNA, 22 bp, Homo sapiens
tggcccatcccccctcaccagg

SEQ ID NO: 5803699 - DNA, 23 bp, Homo sapiens
tggcccatcccgccttctccagg

SEQ ID NO: 5803700 - DNA, 16 bp, Homo sapiens
tggcccatctcagcct

SEQ ID NO: 5803701 - DNA, 18 bp, Homo sapiens
tggcccatctcagcctcc

SEQ ID NO: 5803702 - DNA, 21 bp, Homo sapiens
tggcccatgtatggccaggaa

SEQ ID NO: 5803703 - DNA, 21 bp, Homo sapiens
tggcccattctacttgctctg

SEQ ID NO: 5803704 - DNA, 22 bp, Homo sapiens
tggcccattctacttgctctgg

SEQ ID NO: 5803705 - DNA, 14 bp, Homo sapiens
tggccccaaatgtt

SEQ ID NO: 5803706 - DNA, 23 bp, Homo sapiens
tggccccaactattaaagtgcca

SEQ ID NO: 5803707 - DNA, 20 bp, Homo sapiens
tggccccaagggcaaaattc

SEQ ID NO: 5803708 - DNA, 22 bp, Homo sapiens
tggccccaccctcgtggacacc

SEQ ID NO: 5803709 - DNA, 22 bp, Homo sapiens
tggccccaccctgggccctggg

SEQ ID NO: 5803710 - DNA, 20 bp, Homo sapiens
tggccccaccgagctggagc

SEQ ID NO: 5803711 - DNA, 12 bp, Homo sapiens
tggccccagagg

SEQ ID NO: 5803712 - DNA, 15 bp, Homo sapiens
tggccccagaggacc

SEQ ID NO: 5803713 - DNA, 13 bp, Homo sapiens
tggccccagcaca

SEQ ID NO: 5803714 - DNA, 14 bp, Homo sapiens
tggccccagcacag

SEQ ID NO: 5803715 - DNA, 17 bp, Homo sapiens
tggccccagcacagctt

SEQ ID NO: 5803716 - DNA, 18 bp, Homo sapiens
tggccccagcacagcttg

SEQ ID NO: 5803717 - DNA, 14 bp, Homo sapiens
tggccccagccccc

SEQ ID NO: 5803718 - DNA, 13 bp, Homo sapiens
tggccccagccct

SEQ ID NO: 5803719 - DNA, 21 bp, Homo sapiens
tggccccagccctgctgggga

SEQ ID NO: 5803720 - DNA, 18 bp, Homo sapiens
tggccccagcctggccca

SEQ ID NO: 5803721 - DNA, 19 bp, Homo sapiens
tggccccagcctggcccag

SEQ ID NO: 5803722 - DNA, 21 bp, Homo sapiens
tggccccagcctggcccagct

SEQ ID NO: 5803723 - DNA, 20 bp, Homo sapiens
tggccccagctggctgggtc

SEQ ID NO: 5803724 - DNA, 18 bp, Homo sapiens
tggccccagctgtgactg

SEQ ID NO: 5803725 - DNA, 15 bp, Homo sapiens
tggccccaggacctg

SEQ ID NO: 5803726 - DNA, 20 bp, Homo sapiens
tggccccaggacctggctgc

SEQ ID NO: 5803727 - DNA, 15 bp, Homo sapiens
tggccccaggctgtc

SEQ ID NO: 5803728 - DNA, 14 bp, Homo sapiens
tggccccagggcac

SEQ ID NO: 5803729 - DNA, 18 bp, Homo sapiens
tggccccagggcaccctg

SEQ ID NO: 5803730 - DNA, 14 bp, Homo sapiens
tggccccaggtgcc

SEQ ID NO: 5803731 - DNA, 18 bp, Homo sapiens
tggccccaggtgccacca

SEQ ID NO: 5803732 - DNA, 12 bp, Homo sapiens
tggccccagtga

SEQ ID NO: 5803733 - DNA, 13 bp, Homo sapiens
tggccccagtgac

SEQ ID NO: 5803734 - DNA, 22 bp, Homo sapiens
tggccccagtgcggttcctcat

SEQ ID NO: 5803735 - DNA, 23 bp, Homo sapiens
tggcccccaaaatctgtcactac

SEQ ID NO: 5803736 - DNA, 13 bp, Homo sapiens
tggcccccaataa

SEQ ID NO: 5803737 - DNA, 18 bp, Homo sapiens
tggcccccaataaaggca

SEQ ID NO: 5803738 - DNA, 17 bp, Homo sapiens
tggcccccacagcgctc

SEQ ID NO: 5803739 - DNA, 15 bp, Homo sapiens
tggcccccacccacc

SEQ ID NO: 5803740 - DNA, 16 bp, Homo sapiens
tggcccccacccacct

SEQ ID NO: 5803741 - DNA, 17 bp, Homo sapiens
tggcccccacccacctt

SEQ ID NO: 5803742 - DNA, 22 bp, Homo sapiens
tggcccccacccaccttccttg

SEQ ID NO: 5803743 - DNA, 20 bp, Homo sapiens
tggcccccactggctgtggg

SEQ ID NO: 5803744 - DNA, 21 bp, Homo sapiens
tggcccccactggctgtgggc

SEQ ID NO: 5803745 - DNA, 12 bp, Homo sapiens
tggcccccagct

SEQ ID NO: 5803746 - DNA, 15 bp, Homo sapiens
tggcccccagctggt

SEQ ID NO: 5803747 - DNA, 21 bp, Homo sapiens
tggcccccaggattcccccag

SEQ ID NO: 5803748 - DNA, 19 bp, Homo sapiens
tggcccccatcagccctgc

SEQ ID NO: 5803749 - DNA, 20 bp, Homo sapiens
tggcccccatcagccctgct

SEQ ID NO: 5803750 - DNA, 21 bp, Homo sapiens
tggcccccatcagccctgcta

SEQ ID NO: 5803751 - DNA, 14 bp, Homo sapiens
tggccccccactcc

SEQ ID NO: 5803752 - DNA, 16 bp, Homo sapiens
tggccccccagcgcag

SEQ ID NO: 5803753 - DNA, 16 bp, Homo sapiens
tggcccccccagcccc

SEQ ID NO: 5803754 - DNA, 12 bp, Homo sapiens
tggcccccctcc

SEQ ID NO: 5803755 - DNA, 15 bp, Homo sapiens
tggcccccctccagg

SEQ ID NO: 5803756 - DNA, 23 bp, Homo sapiens
tggcccccctccaggcatgctgg

SEQ ID NO: 5803757 - DNA, 22 bp, Homo sapiens
tggcctgatcagaccacggctc

SEQ ID NO: 5803758 - DNA, 22 bp, Homo sapiens
tggcctgatcagcaggagccaa

SEQ ID NO: 5803759 - DNA, 15 bp, Homo sapiens
tggcctgcaaactgg

SEQ ID NO: 5803760 - DNA, 18 bp, Homo sapiens
tggcctgcaaactgggaa

SEQ ID NO: 5803761 - DNA, 23 bp, Homo sapiens
tggcctgcacggtgggccttgct

SEQ ID NO: 5803762 - DNA, 16 bp, Homo sapiens
tggcctgcactaattt

SEQ ID NO: 5803763 - DNA, 20 bp, Homo sapiens
tggcctgcagccacatggga

SEQ ID NO: 5803764 - DNA, 17 bp, Homo sapiens
tggcctgcataggctcc

SEQ ID NO: 5803765 - DNA, 23 bp, Homo sapiens
tggcctgcataggctccttcctg

SEQ ID NO: 5803766 - DNA, 17 bp, Homo sapiens
tggcctgccagacactg

SEQ ID NO: 5803767 - DNA, 17 bp, Homo sapiens
tggcctgccaggctcct

SEQ ID NO: 5803768 - DNA, 12 bp, Homo sapiens
tggcctgcccag

SEQ ID NO: 5803769 - DNA, 20 bp, Homo sapiens
tggcctgcctcccagccctg

SEQ ID NO: 5803770 - DNA, 19 bp, Homo sapiens
tggcctgcggccgggctgc

SEQ ID NO: 5803771 - DNA, 20 bp, Homo sapiens
tggcctgctaaggtcttgga

SEQ ID NO: 5803772 - DNA, 13 bp, Homo sapiens
tggcctgctagcg

SEQ ID NO: 5803773 - DNA, 13 bp, Homo sapiens
tggcctgctggga

SEQ ID NO: 5803774 - DNA, 15 bp, Homo sapiens
tggcctgctgggaac

SEQ ID NO: 5803775 - DNA, 20 bp, Homo sapiens
tggcctgctgggctctccac

SEQ ID NO: 5803776 - DNA, 13 bp, Homo sapiens
tggcctggactgt

SEQ ID NO: 5803777 - DNA, 23 bp, Homo sapiens
tggcctggagaggacggccctgc

SEQ ID NO: 5803778 - DNA, 11 bp, Homo sapiens
tggcctggagc

SEQ ID NO: 5803779 - DNA, 16 bp, Homo sapiens
tggcctggagcaggcc

SEQ ID NO: 5803780 - DNA, 18 bp, Homo sapiens
tggcctggaggctcagcc

SEQ ID NO: 5803781 - DNA, 19 bp, Homo sapiens
tggcctggagggactttta

SEQ ID NO: 5803782 - DNA, 22 bp, Homo sapiens
tggcctggaggtggggttggga

SEQ ID NO: 5803783 - DNA, 12 bp, Homo sapiens
tggcctggatct

SEQ ID NO: 5803784 - DNA, 15 bp, Homo sapiens
tggcctggatgcaca

SEQ ID NO: 5803785 - DNA, 20 bp, Homo sapiens
tggcctggatgcacagtgcc

SEQ ID NO: 5803786 - DNA, 22 bp, Homo sapiens
tggcctggatgcacagtgcctg

SEQ ID NO: 5803787 - DNA, 23 bp, Homo sapiens
tggcctggatgcacagtgcctga

SEQ ID NO: 5803788 - DNA, 21 bp, Homo sapiens
tggcctggattcacgccctct

SEQ ID NO: 5803789 - DNA, 12 bp, Homo sapiens
tggcctggcaca

SEQ ID NO: 5803790 - DNA, 16 bp, Homo sapiens
tggcctggcacacatc

SEQ ID NO: 5803791 - DNA, 13 bp, Homo sapiens
tggcctggccaga

SEQ ID NO: 5803792 - DNA, 16 bp, Homo sapiens
tggcctggccagacca

SEQ ID NO: 5803793 - DNA, 20 bp, Homo sapiens
tggcctggccagtgccctga

SEQ ID NO: 5803794 - DNA, 21 bp, Homo sapiens
tggcctggcccctcagggtcc

SEQ ID NO: 5803795 - DNA, 19 bp, Homo sapiens
tggcctggccctcctggct

SEQ ID NO: 5803796 - DNA, 18 bp, Homo sapiens
tggcctggccctgccctg

SEQ ID NO: 5803797 - DNA, 13 bp, Homo sapiens
tggcctggccggc

SEQ ID NO: 5803798 - DNA, 13 bp, Homo sapiens
tggcctggcctcc

SEQ ID NO: 5803799 - DNA, 15 bp, Homo sapiens
tggcctggcctccag

SEQ ID NO: 5803800 - DNA, 16 bp, Homo sapiens
tggcctggcctggccc

SEQ ID NO: 5803801 - DNA, 15 bp, Homo sapiens
tggcctggctctcct

SEQ ID NO: 5803802 - DNA, 16 bp, Homo sapiens
tggcctggctctcctg

SEQ ID NO: 5803803 - DNA, 15 bp, Homo sapiens
tggcctggctgcctg

SEQ ID NO: 5803804 - DNA, 16 bp, Homo sapiens
tggcctggctgcctgg

SEQ ID NO: 5803805 - DNA, 15 bp, Homo sapiens
tggcctgggaaaagg

SEQ ID NO: 5803806 - DNA, 17 bp, Homo sapiens
tggcctgggagagctgg

SEQ ID NO: 5803807 - DNA, 11 bp, Homo sapiens
tggcctgggca

SEQ ID NO: 5803808 - DNA, 21 bp, Homo sapiens
tggcctgggccacacctgagc

SEQ ID NO: 5803809 - DNA, 24 bp, Homo sapiens
tggcctgggccgtatctccggctc

SEQ ID NO: 5803810 - DNA, 17 bp, Homo sapiens
tggcctgggcctcctca

SEQ ID NO: 5803811 - DNA, 20 bp, Homo sapiens
tggcctggggctgccgtgca

SEQ ID NO: 5803812 - DNA, 19 bp, Homo sapiens
tggcctgggggaggtcaga

SEQ ID NO: 5803813 - DNA, 18 bp, Homo sapiens
tggcctggggtgcatctc

SEQ ID NO: 5803814 - DNA, 20 bp, Homo sapiens
tggcctgggtcccagggctg

SEQ ID NO: 5803815 - DNA, 17 bp, Homo sapiens
tggcctgggtcctcggc

SEQ ID NO: 5803816 - DNA, 20 bp, Homo sapiens
tggcctgggtcctcggccct

SEQ ID NO: 5803817 - DNA, 21 bp, Homo sapiens
tggcctgggtcctcggccctg

SEQ ID NO: 5803818 - DNA, 18 bp, Homo sapiens
tggcctgggtgggcagga

SEQ ID NO: 5803819 - DNA, 21 bp, Homo sapiens
tggcctgggtggggcagggcc

SEQ ID NO: 5803820 - DNA, 21 bp, Homo sapiens
tggcctggtatggctgcagtc

SEQ ID NO: 5803821 - DNA, 14 bp, Homo sapiens
tggcctggtccagg

SEQ ID NO: 5803822 - DNA, 17 bp, Homo sapiens
tggcctggtccctggtc

SEQ ID NO: 5803823 - DNA, 19 bp, Homo sapiens
tggcctggtccctggtcct

SEQ ID NO: 5803824 - DNA, 18 bp, Homo sapiens
tggcctggttgtttccgt

SEQ ID NO: 5803825 - DNA, 20 bp, Homo sapiens
tggcctggtttcctcgagag

SEQ ID NO: 5803826 - DNA, 15 bp, Homo sapiens
tggcctgtagagttg

SEQ ID NO: 5803827 - DNA, 18 bp, Homo sapiens
tggcctgtagagttgctg

SEQ ID NO: 5803828 - DNA, 22 bp, Homo sapiens
tggcctgtccacctgtgctgct

SEQ ID NO: 5803829 - DNA, 20 bp, Homo sapiens
tggcctgtccctagggctct

SEQ ID NO: 5803830 - DNA, 10 bp, Homo sapiens
tggcctgtga

SEQ ID NO: 5803831 - DNA, 13 bp, Homo sapiens
tggcctgtgagca

SEQ ID NO: 5803832 - DNA, 19 bp, Homo sapiens
tggcctgtgagcaagagcc

SEQ ID NO: 5803833 - DNA, 23 bp, Homo sapiens
tggcctgtgagcaagagccaggg

SEQ ID NO: 5803834 - DNA, 15 bp, Homo sapiens
tggcctgtgagtctc

SEQ ID NO: 5803835 - DNA, 21 bp, Homo sapiens
tggcctgtgccagcaccacag

SEQ ID NO: 5803836 - DNA, 22 bp, Homo sapiens
tggcctgtgcgatcccacccgt

SEQ ID NO: 5803837 - DNA, 12 bp, Homo sapiens
tggcctgtgctg

SEQ ID NO: 5803838 - DNA, 14 bp, Homo sapiens
tggcctgtgctggg

SEQ ID NO: 5803839 - DNA, 16 bp, Homo sapiens
tggcctgtgctgggcc

SEQ ID NO: 5803840 - DNA, 20 bp, Homo sapiens
tggcctgtgctgggccagtg

SEQ ID NO: 5803841 - DNA, 20 bp, Homo sapiens
tggcctgtgcttggaggcct

SEQ ID NO: 5803842 - DNA, 13 bp, Homo sapiens
tggcctgtggcac

SEQ ID NO: 5803843 - DNA, 17 bp, Homo sapiens
tggcctgtggcacagcc

SEQ ID NO: 5803844 - DNA, 18 bp, Homo sapiens
tggcctgtggcacagccc

SEQ ID NO: 5803845 - DNA, 17 bp, Homo sapiens
tggcctgtggctgtcgg

SEQ ID NO: 5803846 - DNA, 14 bp, Homo sapiens
tggcctgtgtccag

SEQ ID NO: 5803847 - DNA, 15 bp, Homo sapiens
tggcctgtgtccagc

SEQ ID NO: 5803848 - DNA, 16 bp, Homo sapiens
tggcctgtgtccagca

SEQ ID NO: 5803849 - DNA, 19 bp, Homo sapiens
tggcctgtgtccagcagct

SEQ ID NO: 5803850 - DNA, 22 bp, Homo sapiens
tggcctgtgtccagcagctgcg

SEQ ID NO: 5803851 - DNA, 21 bp, Homo sapiens
tggcctgtgtcccatgaccca

SEQ ID NO: 5803852 - DNA, 12 bp, Homo sapiens
tggcctgttcaa

SEQ ID NO: 5803853 - DNA, 18 bp, Homo sapiens
tggcctgttccctagaga

SEQ ID NO: 5803854 - DNA, 19 bp, Homo sapiens
tggcctgttccctagagag

SEQ ID NO: 5803855 - DNA, 13 bp, Homo sapiens
tggcctgttctgt

SEQ ID NO: 5803856 - DNA, 21 bp, Homo sapiens
tggcctgtttctgcagccctt

SEQ ID NO: 5803857 - DNA, 19 bp, Homo sapiens
tggccttaaaaggggccca

SEQ ID NO: 5803858 - DNA, 17 bp, Homo sapiens
tggccttaaagagggac

SEQ ID NO: 5803859 - DNA, 16 bp, Homo sapiens
tggccttaactggccc

SEQ ID NO: 5803860 - DNA, 22 bp, Homo sapiens
tggccttaactggccctcgggc

SEQ ID NO: 5803861 - DNA, 14 bp, Homo sapiens
tggccttaagaact

SEQ ID NO: 5803862 - DNA, 15 bp, Homo sapiens
tggccttacactgaa

SEQ ID NO: 5803863 - DNA, 20 bp, Homo sapiens
tggccttatgagctcagcct

SEQ ID NO: 5803864 - DNA, 18 bp, Homo sapiens
tggccttccatttatatg

SEQ ID NO: 5803865 - DNA, 16 bp, Homo sapiens
tggccttccccagcct

SEQ ID NO: 5803866 - DNA, 18 bp, Homo sapiens
tggccttccccagcctct

SEQ ID NO: 5803867 - DNA, 22 bp, Homo sapiens
tggccttccccttttgcctggc

SEQ ID NO: 5803868 - DNA, 23 bp, Homo sapiens
tggccttcccgccggaggccagc

SEQ ID NO: 5803869 - DNA, 16 bp, Homo sapiens
tggccttcctgcccta

SEQ ID NO: 5803870 - DNA, 20 bp, Homo sapiens
tggccttcgattttaaatat

SEQ ID NO: 5803871 - DNA, 20 bp, Homo sapiens
tggccttcggcctccatcct

SEQ ID NO: 5803872 - DNA, 22 bp, Homo sapiens
tggccttcggcctccatcctga

SEQ ID NO: 5803873 - DNA, 16 bp, Homo sapiens
tggccttcgtctccat

SEQ ID NO: 5803874 - DNA, 22 bp, Homo sapiens
tggccttcgtctccatctctgg

SEQ ID NO: 5803875 - DNA, 15 bp, Homo sapiens
tggccttctcagcct

SEQ ID NO: 5803876 - DNA, 11 bp, Homo sapiens
tggccttctcc

SEQ ID NO: 5803877 - DNA, 19 bp, Homo sapiens
tggccttctcccctcttct

SEQ ID NO: 5803878 - DNA, 20 bp, Homo sapiens
tggccttctcccctcttctg

SEQ ID NO: 5803879 - DNA, 22 bp, Homo sapiens
tggccttctcccctcttctgag

SEQ ID NO: 5803880 - DNA, 23 bp, Homo sapiens
tggccttctgctgcccaggccac

SEQ ID NO: 5803881 - DNA, 15 bp, Homo sapiens
tggccttgaagtgtt

SEQ ID NO: 5803882 - DNA, 20 bp, Homo sapiens
tggccttgaagtgttttcat

SEQ ID NO: 5803883 - DNA, 16 bp, Homo sapiens
tggccttgagtctctg

SEQ ID NO: 5803884 - DNA, 23 bp, Homo sapiens
tggccttggaatatggccaaggc

SEQ ID NO: 5803885 - DNA, 18 bp, Homo sapiens
tggccttgggatccaggc

SEQ ID NO: 5803886 - DNA, 16 bp, Homo sapiens
tggccttggggccaga

SEQ ID NO: 5803887 - DNA, 17 bp, Homo sapiens
tggccttggggccagac

SEQ ID NO: 5803888 - DNA, 20 bp, Homo sapiens
tggccttggggccagactgg

SEQ ID NO: 5803889 - DNA, 20 bp, Homo sapiens
tggccttggtatgtgccagg

SEQ ID NO: 5803890 - DNA, 19 bp, Homo sapiens
tggccttggttcctccagc

SEQ ID NO: 5803891 - DNA, 23 bp, Homo sapiens
tggccttgtcaggacccaggccg

SEQ ID NO: 5803892 - DNA, 19 bp, Homo sapiens
tggccttgtggtccaaata

SEQ ID NO: 5803893 - DNA, 21 bp, Homo sapiens
tggccttgtggtccaaatagg

SEQ ID NO: 5803894 - DNA, 14 bp, Homo sapiens
tggccttgttctgt

SEQ ID NO: 5803895 - DNA, 22 bp, Homo sapiens
tggcctttaagcctgcattctt

SEQ ID NO: 5803896 - DNA, 23 bp, Homo sapiens
tggcctttaagcctgcattctta

SEQ ID NO: 5803897 - DNA, 15 bp, Homo sapiens
tggcctttacagaaa

SEQ ID NO: 5803898 - DNA, 18 bp, Homo sapiens
tggcctttatgttctttc

SEQ ID NO: 5803899 - DNA, 24 bp, Homo sapiens
tggcctttcaggtccaggccagtg

SEQ ID NO: 5803900 - DNA, 23 bp, Homo sapiens
tggcctttcctagctagagaagg

SEQ ID NO: 5803901 - DNA, 12 bp, Homo sapiens
tggcctttcctg

SEQ ID NO: 5803902 - DNA, 17 bp, Homo sapiens
tggcctttcctggaagc

SEQ ID NO: 5803903 - DNA, 18 bp, Homo sapiens
tggcctttccttccctct

SEQ ID NO: 5803904 - DNA, 16 bp, Homo sapiens
tggcctttgcgctcct

SEQ ID NO: 5803905 - DNA, 17 bp, Homo sapiens
tggcctttggacccagg

SEQ ID NO: 5803906 - DNA, 18 bp, Homo sapiens
tggcctttggacccaggg

SEQ ID NO: 5803907 - DNA, 12 bp, Homo sapiens
tggcctttgtaa

SEQ ID NO: 5803908 - DNA, 15 bp, Homo sapiens
tggcctttgtaagac

SEQ ID NO: 5803909 - DNA, 17 bp, Homo sapiens
tggcctttgtaagtgca

SEQ ID NO: 5803910 - DNA, 18 bp, Homo sapiens
tggcctttgtaagtgcag

SEQ ID NO: 5803911 - DNA, 20 bp, Homo sapiens
tggcctttgtaagtgcagga

SEQ ID NO: 5803912 - DNA, 17 bp, Homo sapiens
tggccttttccattcgc

SEQ ID NO: 5803913 - DNA, 16 bp, Homo sapiens
tggccttttcctattt

SEQ ID NO: 5803914 - DNA, 13 bp, Homo sapiens
tggccttttgata

SEQ ID NO: 5803915 - DNA, 16 bp, Homo sapiens
tggcctttttcattta

SEQ ID NO: 5803916 - DNA, 20 bp, Homo sapiens
tggcctttttcatttatcta

SEQ ID NO: 5803917 - DNA, 19 bp, Homo sapiens
tggccttttttataactaa

SEQ ID NO: 5803918 - DNA, 15 bp, Homo sapiens
tggcgacactcaggg

SEQ ID NO: 5803919 - DNA, 16 bp, Homo sapiens
tggcgaccaccaaagt

SEQ ID NO: 5803920 - DNA, 17 bp, Homo sapiens
tggcgaccaccaaagtc

SEQ ID NO: 5803921 - DNA, 15 bp, Homo sapiens
tggcgactctgcaga

SEQ ID NO: 5803922 - DNA, 18 bp, Homo sapiens
tggcgagatactgcatgt

SEQ ID NO: 5803923 - DNA, 22 bp, Homo sapiens
tggcgagccatttgtcccaagt

SEQ ID NO: 5803924 - DNA, 23 bp, Homo sapiens
tggcgagccatttgtcccaagtg

SEQ ID NO: 5803925 - DNA, 14 bp, Homo sapiens
tggcgagcccttag

SEQ ID NO: 5803926 - DNA, 17 bp, Homo sapiens
tggcgagcccttagcct

SEQ ID NO: 5803927 - DNA, 19 bp, Homo sapiens
tggcgagtcattaaactta

SEQ ID NO: 5803928 - DNA, 19 bp, Homo sapiens
tggcgagtccagacaccat

SEQ ID NO: 5803929 - DNA, 22 bp, Homo sapiens
tggcgagttctctttggaaata

SEQ ID NO: 5803930 - DNA, 18 bp, Homo sapiens
tggcgatatgagagggat

SEQ ID NO: 5803931 - DNA, 16 bp, Homo sapiens
tggcgatgccagccaa

SEQ ID NO: 5803932 - DNA, 13 bp, Homo sapiens
tggcgatgtgtta

SEQ ID NO: 5803933 - DNA, 21 bp, Homo sapiens
tggctgtaaggctctagatca

SEQ ID NO: 5803934 - DNA, 16 bp, Homo sapiens
tggctgtaatcatttg

SEQ ID NO: 5803935 - DNA, 17 bp, Homo sapiens
tggctgtagatcccaag

SEQ ID NO: 5803936 - DNA, 22 bp, Homo sapiens
tggctgtatggaaatgcaccct

SEQ ID NO: 5803937 - DNA, 17 bp, Homo sapiens
tggctgtcagcaggaag

SEQ ID NO: 5803938 - DNA, 22 bp, Homo sapiens
tggctgtcaggacaccagcctg

SEQ ID NO: 5803939 - DNA, 19 bp, Homo sapiens
tggctgtccaaccagactt

SEQ ID NO: 5803940 - DNA, 17 bp, Homo sapiens
tggctgtccagtgccca

SEQ ID NO: 5803941 - DNA, 18 bp, Homo sapiens
tggctgtccagtgcccat

SEQ ID NO: 5803942 - DNA, 23 bp, Homo sapiens
tggctgtccagtgcccattcctc

SEQ ID NO: 5803943 - DNA, 16 bp, Homo sapiens
tggctgtcccctgcaa

SEQ ID NO: 5803944 - DNA, 18 bp, Homo sapiens
tggctgtcccctgcaagt

SEQ ID NO: 5803945 - DNA, 11 bp, Homo sapiens
tggctgtccct

SEQ ID NO: 5803946 - DNA, 14 bp, Homo sapiens
tggctgtccctgtg

SEQ ID NO: 5803947 - DNA, 18 bp, Homo sapiens
tggctgtccttccccttc

SEQ ID NO: 5803948 - DNA, 16 bp, Homo sapiens
tggctgtctagaatgt

SEQ ID NO: 5803949 - DNA, 19 bp, Homo sapiens
tggctgtctagaatgtgga

SEQ ID NO: 5803950 - DNA, 15 bp, Homo sapiens
tggctgtctctgtcc

SEQ ID NO: 5803951 - DNA, 22 bp, Homo sapiens
tggctgtctgaccagagaatgc

SEQ ID NO: 5803952 - DNA, 13 bp, Homo sapiens
tggctgtctgcct

SEQ ID NO: 5803953 - DNA, 23 bp, Homo sapiens
tggctgtctggatccttcccaag

SEQ ID NO: 5803954 - DNA, 20 bp, Homo sapiens
tggctgtgagacgaggcagg

SEQ ID NO: 5803955 - DNA, 23 bp, Homo sapiens
tggctgtgcaatttctgtacatt

SEQ ID NO: 5803956 - DNA, 14 bp, Homo sapiens
tggctgtgcccagc

SEQ ID NO: 5803957 - DNA, 22 bp, Homo sapiens
tggctgtgcccagcaggcccag

SEQ ID NO: 5803958 - DNA, 14 bp, Homo sapiens
tggctgtgcctccc

SEQ ID NO: 5803959 - DNA, 14 bp, Homo sapiens
tggctgtgcctctg

SEQ ID NO: 5803960 - DNA, 13 bp, Homo sapiens
tggctgtgcctgc

SEQ ID NO: 5803961 - DNA, 15 bp, Homo sapiens
tggctgtgcctgctt

SEQ ID NO: 5803962 - DNA, 16 bp, Homo sapiens
tggctgtggaggcctg

SEQ ID NO: 5803963 - DNA, 13 bp, Homo sapiens
tggctgtggcaca

SEQ ID NO: 5803964 - DNA, 16 bp, Homo sapiens
tggctgtggcacagac

SEQ ID NO: 5803965 - DNA, 23 bp, Homo sapiens
tggctgtggcacagacttctgga

SEQ ID NO: 5803966 - DNA, 19 bp, Homo sapiens
tggctgtggcatttccaaa

SEQ ID NO: 5803967 - DNA, 15 bp, Homo sapiens
tggctgtgggctccc

SEQ ID NO: 5803968 - DNA, 23 bp, Homo sapiens
tggctgtggggctaggggctggg

SEQ ID NO: 5803969 - DNA, 23 bp, Homo sapiens
tggctgtggtcagcagatgccag

SEQ ID NO: 5803970 - DNA, 23 bp, Homo sapiens
tggctgtggttcctaagcctgtt

SEQ ID NO: 5803971 - DNA, 15 bp, Homo sapiens
tggctgtgtctaaac

SEQ ID NO: 5803972 - DNA, 14 bp, Homo sapiens
tggctgtgtctccc

SEQ ID NO: 5803973 - DNA, 17 bp, Homo sapiens
tggctgtgtctctcccc

SEQ ID NO: 5803974 - DNA, 14 bp, Homo sapiens
tggctgtgtgacag

SEQ ID NO: 5803975 - DNA, 15 bp, Homo sapiens
tggctgtgtgacaga

SEQ ID NO: 5803976 - DNA, 22 bp, Homo sapiens
tggctgtgttcgggggagcaga

SEQ ID NO: 5803977 - DNA, 21 bp, Homo sapiens
tggctgtgtttgcagcctgct

SEQ ID NO: 5803978 - DNA, 23 bp, Homo sapiens
tggctgttatctgtctttatgat

SEQ ID NO: 5803979 - DNA, 15 bp, Homo sapiens
tggctgttcatgctc

SEQ ID NO: 5803980 - DNA, 14 bp, Homo sapiens
tggctgttccagac

SEQ ID NO: 5803981 - DNA, 17 bp, Homo sapiens
tggctgttccagactca

SEQ ID NO: 5803982 - DNA, 13 bp, Homo sapiens
tggctgttgagat

SEQ ID NO: 5803983 - DNA, 23 bp, Homo sapiens
tggctgttgagatgtgctttgct

SEQ ID NO: 5803984 - DNA, 17 bp, Homo sapiens
tggctgttgagggccac

SEQ ID NO: 5803985 - DNA, 20 bp, Homo sapiens
tggctgttggcccctctgct

SEQ ID NO: 5803986 - DNA, 15 bp, Homo sapiens
tggctgttggctggg

SEQ ID NO: 5803987 - DNA, 18 bp, Homo sapiens
tggctgttttccctctgc

SEQ ID NO: 5803988 - DNA, 21 bp, Homo sapiens
tggctgttttccctctgctgc

SEQ ID NO: 5803989 - DNA, 18 bp, Homo sapiens
tggcttaaaaaaaactct

SEQ ID NO: 5803990 - DNA, 19 bp, Homo sapiens
tggcttaaaaaaaactctt

SEQ ID NO: 5803991 - DNA, 23 bp, Homo sapiens
tggcttaaaaacttccatcccta

SEQ ID NO: 5803992 - DNA, 22 bp, Homo sapiens
tggcttaaacaacacctcctcc

SEQ ID NO: 5803993 - DNA, 21 bp, Homo sapiens
tggcttaaagcatcctcctcc

SEQ ID NO: 5803994 - DNA, 17 bp, Homo sapiens
tggcttaaagggatgga

SEQ ID NO: 5803995 - DNA, 13 bp, Homo sapiens
tggcttaaagtga

SEQ ID NO: 5803996 - DNA, 16 bp, Homo sapiens
tggcttaaagtgaagg

SEQ ID NO: 5803997 - DNA, 18 bp, Homo sapiens
tggcttaaagtgaaggaa

SEQ ID NO: 5803998 - DNA, 17 bp, Homo sapiens
tggcttaagtgagcaga

SEQ ID NO: 5803999 - DNA, 14 bp, Homo sapiens
tggcttaatgttta

SEQ ID NO: 5804000 - DNA, 15 bp, Homo sapiens
tggcttaatgtttat

SEQ ID NO: 5804001 - DNA, 21 bp, Homo sapiens
tggcttacaaattctacagca

SEQ ID NO: 5804002 - DNA, 17 bp, Homo sapiens
tggcttacatttgaata

SEQ ID NO: 5804003 - DNA, 21 bp, Homo sapiens
tggcttacctgacctcttgct

SEQ ID NO: 5804004 - DNA, 13 bp, Homo sapiens
tggcttacctggc

SEQ ID NO: 5804005 - DNA, 14 bp, Homo sapiens
tggcttacctggcc

SEQ ID NO: 5804006 - DNA, 15 bp, Homo sapiens
tggcttacctggccc

SEQ ID NO: 5804007 - DNA, 17 bp, Homo sapiens
tggcttacctggcccat

SEQ ID NO: 5804008 - DNA, 17 bp, Homo sapiens
tggcttagaaggcactg

SEQ ID NO: 5804009 - DNA, 22 bp, Homo sapiens
tggcttagctgccatcttgctt

SEQ ID NO: 5804010 - DNA, 23 bp, Homo sapiens
tggcttaggatcgacaagaagtt

SEQ ID NO: 5804011 - DNA, 15 bp, Homo sapiens
tggcttataaatgtg

SEQ ID NO: 5804012 - DNA, 18 bp, Homo sapiens
tggcttataattctttca

SEQ ID NO: 5804013 - DNA, 15 bp, Homo sapiens
tggcttatccagctg

SEQ ID NO: 5804014 - DNA, 13 bp, Homo sapiens
tggcttatttcta

SEQ ID NO: 5804015 - DNA, 18 bp, Homo sapiens
tggcttcaaaaagccaca

SEQ ID NO: 5804016 - DNA, 21 bp, Homo sapiens
tggcttcaaggatggagatgg

SEQ ID NO: 5804017 - DNA, 18 bp, Homo sapiens
tggcttcaagttgtaaaa

SEQ ID NO: 5804018 - DNA, 19 bp, Homo sapiens
tggcttcaccaagaagcaa

SEQ ID NO: 5804019 - DNA, 21 bp, Homo sapiens
tggcttcaccaagaagcaaag

SEQ ID NO: 5804020 - DNA, 22 bp, Homo sapiens
tggcttcacggaagagccttgc

SEQ ID NO: 5804021 - DNA, 23 bp, Homo sapiens
tggcttcacggaagagccttgcg

SEQ ID NO: 5804022 - DNA, 14 bp, Homo sapiens
tggcttcactcctg

SEQ ID NO: 5804023 - DNA, 23 bp, Homo sapiens
tggcttcactcctgctgtaaatt

SEQ ID NO: 5804024 - DNA, 16 bp, Homo sapiens
tggcttcagaaatgga

SEQ ID NO: 5804025 - DNA, 20 bp, Homo sapiens
tggcttcagcccccaccagg

SEQ ID NO: 5804026 - DNA, 23 bp, Homo sapiens
tggcttcagcccccaccagggga

SEQ ID NO: 5804027 - DNA, 14 bp, Homo sapiens
tggcttcagcccct

SEQ ID NO: 5804028 - DNA, 15 bp, Homo sapiens
tggcttcagcccctg

SEQ ID NO: 5804029 - DNA, 16 bp, Homo sapiens
tggcttcagcccctgg

SEQ ID NO: 5804030 - DNA, 12 bp, Homo sapiens
tggcttcagctc

SEQ ID NO: 5804031 - DNA, 13 bp, Homo sapiens
tggcttcagctcc

SEQ ID NO: 5804032 - DNA, 14 bp, Homo sapiens
tggcttcagctcca

SEQ ID NO: 5804033 - DNA, 21 bp, Homo sapiens
tggcttcagctccagcccctt

SEQ ID NO: 5804034 - DNA, 12 bp, Homo sapiens
tggcttcaggag

SEQ ID NO: 5804035 - DNA, 13 bp, Homo sapiens
tggcttcaggagg

SEQ ID NO: 5804036 - DNA, 22 bp, Homo sapiens
tggcttcatggcagtaattctc

SEQ ID NO: 5804037 - DNA, 12 bp, Homo sapiens
tggcttcatgtg

SEQ ID NO: 5804038 - DNA, 12 bp, Homo sapiens
tggcttcatttt

SEQ ID NO: 5804039 - DNA, 17 bp, Homo sapiens
tggcttccagaaggcag

SEQ ID NO: 5804040 - DNA, 18 bp, Homo sapiens
tggcttccagcgggccct

SEQ ID NO: 5804041 - DNA, 16 bp, Homo sapiens
tggcttccatgatggt

SEQ ID NO: 5804042 - DNA, 13 bp, Homo sapiens
tggcttcccagga

SEQ ID NO: 5804043 - DNA, 18 bp, Homo sapiens
tggcttcccaggaccctg

SEQ ID NO: 5804044 - DNA, 14 bp, Homo sapiens
tggcttcccatccc

SEQ ID NO: 5804045 - DNA, 21 bp, Homo sapiens
tggcttcccatccccagcgat

SEQ ID NO: 5804046 - DNA, 22 bp, Homo sapiens
tggcttcccatctgtggttttc

SEQ ID NO: 5804047 - DNA, 15 bp, Homo sapiens
tggcttcccatgtct

SEQ ID NO: 5804048 - DNA, 14 bp, Homo sapiens
tggcttccccactc

SEQ ID NO: 5804049 - DNA, 15 bp, Homo sapiens
tggcttccccttcag

SEQ ID NO: 5804050 - DNA, 19 bp, Homo sapiens
tggcttccccttcagacct

SEQ ID NO: 5804051 - DNA, 21 bp, Homo sapiens
tggcttccccttggcctctct

SEQ ID NO: 5804052 - DNA, 22 bp, Homo sapiens
tggcttcccgctcagccctccc

SEQ ID NO: 5804053 - DNA, 10 bp, Homo sapiens
tggcttccct

SEQ ID NO: 5804054 - DNA, 21 bp, Homo sapiens
tggcttccctaaactgcagcc

SEQ ID NO: 5804055 - DNA, 15 bp, Homo sapiens
tggcttccctggaag

SEQ ID NO: 5804056 - DNA, 16 bp, Homo sapiens
tggcttccctggaagc

SEQ ID NO: 5804057 - DNA, 14 bp, Homo sapiens
tggcttcctcactc

SEQ ID NO: 5804058 - DNA, 11 bp, Homo sapiens
tggcttcctcc

SEQ ID NO: 5804059 - DNA, 16 bp, Homo sapiens
tggcttcctccgtctg

SEQ ID NO: 5804060 - DNA, 13 bp, Homo sapiens
tggcttcctcctg

SEQ ID NO: 5804061 - DNA, 16 bp, Homo sapiens
tggcttcctctgctgc

SEQ ID NO: 5804062 - DNA, 18 bp, Homo sapiens
tggcttcctctgctgcat

SEQ ID NO: 5804063 - DNA, 20 bp, Homo sapiens
tggcttcctctgctgcatcc

SEQ ID NO: 5804064 - DNA, 13 bp, Homo sapiens
tggcttcctgaga

SEQ ID NO: 5804065 - DNA, 11 bp, Homo sapiens
tggcttcctgg

SEQ ID NO: 5804066 - DNA, 23 bp, Homo sapiens
tggcttcgaggagataaactgaa

SEQ ID NO: 5804067 - DNA, 23 bp, Homo sapiens
tggcttcggagggccgcagggcc

SEQ ID NO: 5804068 - DNA, 22 bp, Homo sapiens
tggcttctcatacgtccaccat

SEQ ID NO: 5804069 - DNA, 13 bp, Homo sapiens
tggcttctccagg

SEQ ID NO: 5804070 - DNA, 20 bp, Homo sapiens
tggcttctccagggaattct

SEQ ID NO: 5804071 - DNA, 19 bp, Homo sapiens
tggcttctcccaacactct

SEQ ID NO: 5804072 - DNA, 18 bp, Homo sapiens
tggcttctcctttggcat

SEQ ID NO: 5804073 - DNA, 20 bp, Homo sapiens
tggcttctctctctctttga

SEQ ID NO: 5804074 - DNA, 16 bp, Homo sapiens
tggcttctctcttttc

SEQ ID NO: 5804075 - DNA, 15 bp, Homo sapiens
tggcttctctgagga

SEQ ID NO: 5804076 - DNA, 18 bp, Homo sapiens
tggcttctctgaggaagc

SEQ ID NO: 5804077 - DNA, 22 bp, Homo sapiens
tggcttctctgccctgccctgg

SEQ ID NO: 5804078 - DNA, 13 bp, Homo sapiens
tggcttctctgtc

SEQ ID NO: 5804079 - DNA, 13 bp, Homo sapiens
tggcttctctgtt

SEQ ID NO: 5804080 - DNA, 14 bp, Homo sapiens
tggcttctgcagga

SEQ ID NO: 5804081 - DNA, 19 bp, Homo sapiens
tggcttctgcttgtcatcc

SEQ ID NO: 5804082 - DNA, 15 bp, Homo sapiens
tggcttctggcacct

SEQ ID NO: 5804083 - DNA, 16 bp, Homo sapiens
tggcttctggccagga

SEQ ID NO: 5804084 - DNA, 18 bp, Homo sapiens
tggcttctggccaggaag

SEQ ID NO: 5804085 - DNA, 14 bp, Homo sapiens
tggcttctgtgatg

SEQ ID NO: 5804086 - DNA, 16 bp, Homo sapiens
tggcttctgtttctag

SEQ ID NO: 5804087 - DNA, 15 bp, Homo sapiens
tggcttcttatcctt

SEQ ID NO: 5804088 - DNA, 19 bp, Homo sapiens
tggcttctttgctttctcg

SEQ ID NO: 5804089 - DNA, 16 bp, Homo sapiens
tggcttcttttcgttt

SEQ ID NO: 5804090 - DNA, 12 bp, Homo sapiens
tggcttgacatg

SEQ ID NO: 5804091 - DNA, 15 bp, Homo sapiens
tggcttgacatgtgc

SEQ ID NO: 5804092 - DNA, 17 bp, Homo sapiens
tggcttgacatgtgcaa

SEQ ID NO: 5804093 - DNA, 19 bp, Homo sapiens
tggcttgactcaggattta

SEQ ID NO: 5804094 - DNA, 15 bp, Homo sapiens
tggcttgagaaatat

SEQ ID NO: 5804095 - DNA, 16 bp, Homo sapiens
tggcttgagcccagga

SEQ ID NO: 5804096 - DNA, 16 bp, Homo sapiens
tggcttgccccaggac

SEQ ID NO: 5804097 - DNA, 21 bp, Homo sapiens
tggcttgccccaggactctgg

SEQ ID NO: 5804098 - DNA, 15 bp, Homo sapiens
tggcttgcctggtgg

SEQ ID NO: 5804099 - DNA, 12 bp, Homo sapiens
tggcttgctcca

SEQ ID NO: 5804100 - DNA, 18 bp, Homo sapiens
tggcttgctccagggtct

SEQ ID NO: 5804101 - DNA, 19 bp, Homo sapiens
tggcttgctccagggtctt

SEQ ID NO: 5804102 - DNA, 14 bp, Homo sapiens
tggcttgctgtggc

SEQ ID NO: 5804103 - DNA, 12 bp, Homo sapiens
tggcttgctgtt

SEQ ID NO: 5804104 - DNA, 11 bp, Homo sapiens
tggcttgctta

SEQ ID NO: 5804105 - DNA, 15 bp, Homo sapiens
tggcttggagcagag

SEQ ID NO: 5804106 - DNA, 14 bp, Homo sapiens
tggcttggagtggc

SEQ ID NO: 5804107 - DNA, 23 bp, Homo sapiens
tggcttggattaatattcatagt

SEQ ID NO: 5804108 - DNA, 18 bp, Homo sapiens
tggcttggcatctgtgtg

SEQ ID NO: 5804109 - DNA, 18 bp, Homo sapiens
tggcttgggactaaatgc

SEQ ID NO: 5804110 - DNA, 18 bp, Homo sapiens
tggcttgggctggtcaga

SEQ ID NO: 5804111 - DNA, 23 bp, Homo sapiens
tggcttggggtcaagaaacagcc

SEQ ID NO: 5804112 - DNA, 21 bp, Homo sapiens
tgggacctgccctccctcagc

SEQ ID NO: 5804113 - DNA, 19 bp, Homo sapiens
tgggacctgcttcattcaa

SEQ ID NO: 5804114 - DNA, 11 bp, Homo sapiens
tgggacctggc

SEQ ID NO: 5804115 - DNA, 13 bp, Homo sapiens
tgggacctggtgg

SEQ ID NO: 5804116 - DNA, 18 bp, Homo sapiens
tgggacctgtggctgtcg

SEQ ID NO: 5804117 - DNA, 13 bp, Homo sapiens
tgggacggaccag

SEQ ID NO: 5804118 - DNA, 18 bp, Homo sapiens
tgggacggaccagcatct

SEQ ID NO: 5804119 - DNA, 14 bp, Homo sapiens
tgggacggtgccca

SEQ ID NO: 5804120 - DNA, 17 bp, Homo sapiens
tgggacgtagagcacag

SEQ ID NO: 5804121 - DNA, 16 bp, Homo sapiens
tgggacgtggctcagc

SEQ ID NO: 5804122 - DNA, 18 bp, Homo sapiens
tgggactaaatgccctgc

SEQ ID NO: 5804123 - DNA, 17 bp, Homo sapiens
tgggactacaggcatgc

SEQ ID NO: 5804124 - DNA, 20 bp, Homo sapiens
tgggactacaggcgcccgcc

SEQ ID NO: 5804125 - DNA, 21 bp, Homo sapiens
tgggactagaggaacgtgcca

SEQ ID NO: 5804126 - DNA, 20 bp, Homo sapiens
tgggactatgcttttctcaa

SEQ ID NO: 5804127 - DNA, 17 bp, Homo sapiens
tgggactcagccttcag

SEQ ID NO: 5804128 - DNA, 18 bp, Homo sapiens
tgggactcatccttgccc

SEQ ID NO: 5804129 - DNA, 17 bp, Homo sapiens
tgggactcattgtagaa

SEQ ID NO: 5804130 - DNA, 15 bp, Homo sapiens
tgggactccaggtct

SEQ ID NO: 5804131 - DNA, 20 bp, Homo sapiens
tgggactccatgctccttga

SEQ ID NO: 5804132 - DNA, 15 bp, Homo sapiens
tgggactcccagcag

SEQ ID NO: 5804133 - DNA, 17 bp, Homo sapiens
tgggactcccagcagag

SEQ ID NO: 5804134 - DNA, 13 bp, Homo sapiens
tgggactcctggt

SEQ ID NO: 5804135 - DNA, 19 bp, Homo sapiens
tgggactcctggtgcccct

SEQ ID NO: 5804136 - DNA, 19 bp, Homo sapiens
tgggactcggtgagccggg

SEQ ID NO: 5804137 - DNA, 20 bp, Homo sapiens
tgggactctcctcctcccct

SEQ ID NO: 5804138 - DNA, 13 bp, Homo sapiens
tgggactcttccc

SEQ ID NO: 5804139 - DNA, 19 bp, Homo sapiens
tgggactcttccctgggaa

SEQ ID NO: 5804140 - DNA, 15 bp, Homo sapiens
tgggactgactttcc

SEQ ID NO: 5804141 - DNA, 16 bp, Homo sapiens
tgggactgagaaggct

SEQ ID NO: 5804142 - DNA, 15 bp, Homo sapiens
tgggactgagtgctg

SEQ ID NO: 5804143 - DNA, 15 bp, Homo sapiens
tgggactgatgtcat

SEQ ID NO: 5804144 - DNA, 17 bp, Homo sapiens
tgggactgctaaataaa

SEQ ID NO: 5804145 - DNA, 18 bp, Homo sapiens
tgggactgctaaataaaa

SEQ ID NO: 5804146 - DNA, 16 bp, Homo sapiens
tgggactgctcaggct

SEQ ID NO: 5804147 - DNA, 18 bp, Homo sapiens
tgggactgctgcttctta

SEQ ID NO: 5804148 - DNA, 20 bp, Homo sapiens
tgggactggagtcagatgag

SEQ ID NO: 5804149 - DNA, 18 bp, Homo sapiens
tgggactgggagggccca

SEQ ID NO: 5804150 - DNA, 19 bp, Homo sapiens
tgggactgggtttggaccc

SEQ ID NO: 5804151 - DNA, 18 bp, Homo sapiens
tgggactggtgggggttc

SEQ ID NO: 5804152 - DNA, 15 bp, Homo sapiens
tgggactgtacacac

SEQ ID NO: 5804153 - DNA, 21 bp, Homo sapiens
tgggactgtacacactttatt

SEQ ID NO: 5804154 - DNA, 22 bp, Homo sapiens
tgggactgtacacactttattt

SEQ ID NO: 5804155 - DNA, 17 bp, Homo sapiens
tgggactgtcttgagaa

SEQ ID NO: 5804156 - DNA, 15 bp, Homo sapiens
tgggactgtgcctgg

SEQ ID NO: 5804157 - DNA, 16 bp, Homo sapiens
tgggactgtgcctggc

SEQ ID NO: 5804158 - DNA, 17 bp, Homo sapiens
tgggactgtgcctggct

SEQ ID NO: 5804159 - DNA, 18 bp, Homo sapiens
tgggactgtgcctggctc

SEQ ID NO: 5804160 - DNA, 23 bp, Homo sapiens
tgggactgtgcctggctccctga

SEQ ID NO: 5804161 - DNA, 16 bp, Homo sapiens
tgggactgtggtgact

SEQ ID NO: 5804162 - DNA, 14 bp, Homo sapiens
tgggacttaactcc

SEQ ID NO: 5804163 - DNA, 17 bp, Homo sapiens
tgggacttccttgctct

SEQ ID NO: 5804164 - DNA, 20 bp, Homo sapiens
tgggacttccttgctctccc

SEQ ID NO: 5804165 - DNA, 21 bp, Homo sapiens
tgggacttctacccagatgga

SEQ ID NO: 5804166 - DNA, 23 bp, Homo sapiens
tgggacttcttacccaaagcaca

SEQ ID NO: 5804167 - DNA, 20 bp, Homo sapiens
tgggacttgaacaaagacat

SEQ ID NO: 5804168 - DNA, 15 bp, Homo sapiens
tgggacttggagagc

SEQ ID NO: 5804169 - DNA, 16 bp, Homo sapiens
tgggacttgggagctg

SEQ ID NO: 5804170 - DNA, 17 bp, Homo sapiens
tgggactttcccaccca

SEQ ID NO: 5804171 - DNA, 13 bp, Homo sapiens
tgggacttttctt

SEQ ID NO: 5804172 - DNA, 21 bp, Homo sapiens
tgggagaaaacgccagtgtgt

SEQ ID NO: 5804173 - DNA, 15 bp, Homo sapiens
tgggagaaaatcatc

SEQ ID NO: 5804174 - DNA, 13 bp, Homo sapiens
tgggagaaagacc

SEQ ID NO: 5804175 - DNA, 15 bp, Homo sapiens
tgggagaaatgaaaa

SEQ ID NO: 5804176 - DNA, 16 bp, Homo sapiens
tgggagaaatgaaaaa

SEQ ID NO: 5804177 - DNA, 21 bp, Homo sapiens
tgggagaaccaaaaagaggct

SEQ ID NO: 5804178 - DNA, 22 bp, Homo sapiens
tgggagaaccaaaaagaggcta

SEQ ID NO: 5804179 - DNA, 23 bp, Homo sapiens
tgggagaactaacagaggagaaa

SEQ ID NO: 5804180 - DNA, 21 bp, Homo sapiens
tgggagaactttgtacagtgg

SEQ ID NO: 5804181 - DNA, 15 bp, Homo sapiens
tgggagaagagaacc

SEQ ID NO: 5804182 - DNA, 22 bp, Homo sapiens
tgggagaagccgcagggacaga

SEQ ID NO: 5804183 - DNA, 18 bp, Homo sapiens
tgggagaaggactatcaa

SEQ ID NO: 5804184 - DNA, 14 bp, Homo sapiens
tgggagaagggaca

SEQ ID NO: 5804185 - DNA, 16 bp, Homo sapiens
tgggagaagggacagc

SEQ ID NO: 5804186 - DNA, 19 bp, Homo sapiens
tgggagaaggtctccaagg

SEQ ID NO: 5804187 - DNA, 19 bp, Homo sapiens
tgggagaaggtgcttgggc

SEQ ID NO: 5804188 - DNA, 23 bp, Homo sapiens
tgggagaatcagcagaacctgta

SEQ ID NO: 5804189 - DNA, 19 bp, Homo sapiens
tgggagaatgtcagtatgt

SEQ ID NO: 5804190 - DNA, 22 bp, Homo sapiens
tgggagaatgtcagtatgtgga

SEQ ID NO: 5804191 - DNA, 18 bp, Homo sapiens
tgggagaatgtcagttca

SEQ ID NO: 5804192 - DNA, 22 bp, Homo sapiens
tgggagacaagaaatccctgtt

SEQ ID NO: 5804193 - DNA, 17 bp, Homo sapiens
tgggagacaaggaacca

SEQ ID NO: 5804194 - DNA, 21 bp, Homo sapiens
tgggagacaattagcagaatg

SEQ ID NO: 5804195 - DNA, 15 bp, Homo sapiens
tgggagacagcagcc

SEQ ID NO: 5804196 - DNA, 22 bp, Homo sapiens
tgggagacatggaccagcatct

SEQ ID NO: 5804197 - DNA, 20 bp, Homo sapiens
tgggagaccggcctgccagg

SEQ ID NO: 5804198 - DNA, 19 bp, Homo sapiens
tgggagacctgttggcctg

SEQ ID NO: 5804199 - DNA, 23 bp, Homo sapiens
tgggagacctgttggcctgtggg

SEQ ID NO: 5804200 - DNA, 18 bp, Homo sapiens
tgggagactgctgagtca

SEQ ID NO: 5804201 - DNA, 21 bp, Homo sapiens
tgggagagaagagaatgcaca

SEQ ID NO: 5804202 - DNA, 19 bp, Homo sapiens
tgggagagaatatttcaaa

SEQ ID NO: 5804203 - DNA, 14 bp, Homo sapiens
tgggagagacttgt

SEQ ID NO: 5804204 - DNA, 21 bp, Homo sapiens
tgggagagacttgttttggat

SEQ ID NO: 5804205 - DNA, 21 bp, Homo sapiens
tgggagagagacgtgtacata

SEQ ID NO: 5804206 - DNA, 20 bp, Homo sapiens
tgggagagcaggaatgaaaa

SEQ ID NO: 5804207 - DNA, 16 bp, Homo sapiens
tgggagagccagctct

SEQ ID NO: 5804208 - DNA, 14 bp, Homo sapiens
tgggagagcccctg

SEQ ID NO: 5804209 - DNA, 15 bp, Homo sapiens
tgggagagcccctgg

SEQ ID NO: 5804210 - DNA, 18 bp, Homo sapiens
tgggagagcccctggggc

SEQ ID NO: 5804211 - DNA, 23 bp, Homo sapiens
tgggagagcccctggggcctaga

SEQ ID NO: 5804212 - DNA, 13 bp, Homo sapiens
tgggagagcctgg

SEQ ID NO: 5804213 - DNA, 15 bp, Homo sapiens
tgggagagcctggca

SEQ ID NO: 5804214 - DNA, 18 bp, Homo sapiens
tgggagagctggtggtgc

SEQ ID NO: 5804215 - DNA, 20 bp, Homo sapiens
tgggagaggacagggacttc

SEQ ID NO: 5804216 - DNA, 14 bp, Homo sapiens
tgggagaggcagaa

SEQ ID NO: 5804217 - DNA, 16 bp, Homo sapiens
tgggagaggcagaaag

SEQ ID NO: 5804218 - DNA, 15 bp, Homo sapiens
tgggagaggcagccc

SEQ ID NO: 5804219 - DNA, 17 bp, Homo sapiens
tgggagagggagcaagc

SEQ ID NO: 5804220 - DNA, 17 bp, Homo sapiens
tgggagaggtgccagca

SEQ ID NO: 5804221 - DNA, 22 bp, Homo sapiens
tgggagaggtgccagcaactga

SEQ ID NO: 5804222 - DNA, 16 bp, Homo sapiens
tgggagagtcaggcag

SEQ ID NO: 5804223 - DNA, 14 bp, Homo sapiens
tgggagagtccagg

SEQ ID NO: 5804224 - DNA, 18 bp, Homo sapiens
tgggagagtccaggcctg

SEQ ID NO: 5804225 - DNA, 13 bp, Homo sapiens
tgggagagttgga

SEQ ID NO: 5804226 - DNA, 14 bp, Homo sapiens
tgggagatgaaaac

SEQ ID NO: 5804227 - DNA, 15 bp, Homo sapiens
tgggagatgaaaacc

SEQ ID NO: 5804228 - DNA, 17 bp, Homo sapiens
tgggagatgcagctgga

SEQ ID NO: 5804229 - DNA, 15 bp, Homo sapiens
tgggagatgctctct

SEQ ID NO: 5804230 - DNA, 13 bp, Homo sapiens
tgggagatggagg

SEQ ID NO: 5804231 - DNA, 22 bp, Homo sapiens
tgggagatggcagcagtgaagc

SEQ ID NO: 5804232 - DNA, 14 bp, Homo sapiens
tgggagatgttaga

SEQ ID NO: 5804233 - DNA, 23 bp, Homo sapiens
tgggagattatcagtagaaagag

SEQ ID NO: 5804234 - DNA, 20 bp, Homo sapiens
tgggagcaaaataaggaaga

SEQ ID NO: 5804235 - DNA, 21 bp, Homo sapiens
tgggagcaaaataaggaagag

SEQ ID NO: 5804236 - DNA, 15 bp, Homo sapiens
tgggagcaagttgca

SEQ ID NO: 5804237 - DNA, 21 bp, Homo sapiens
tgggagcaagttgcagtcttt

SEQ ID NO: 5804238 - DNA, 22 bp, Homo sapiens
tgggagcacatagccctgttga

SEQ ID NO: 5804239 - DNA, 13 bp, Homo sapiens
tgggagcactgga

SEQ ID NO: 5804240 - DNA, 23 bp, Homo sapiens
tgggagcactggagtgcagggag

SEQ ID NO: 5804241 - DNA, 15 bp, Homo sapiens
tgggagcagaaacag

SEQ ID NO: 5804242 - DNA, 21 bp, Homo sapiens
tgggagcagaaacagccattg

SEQ ID NO: 5804243 - DNA, 13 bp, Homo sapiens
tgggagcagcttc

SEQ ID NO: 5804244 - DNA, 22 bp, Homo sapiens
tgggagcagcttcttgggctga

SEQ ID NO: 5804245 - DNA, 11 bp, Homo sapiens
tgggagcagga

SEQ ID NO: 5804246 - DNA, 13 bp, Homo sapiens
tgggagcaggaga

SEQ ID NO: 5804247 - DNA, 22 bp, Homo sapiens
tgggagcaggagattgagaagg

SEQ ID NO: 5804248 - DNA, 23 bp, Homo sapiens
tgggagcaggagattgagaagga

SEQ ID NO: 5804249 - DNA, 14 bp, Homo sapiens
tgggagcagtccat

SEQ ID NO: 5804250 - DNA, 23 bp, Homo sapiens
tgggagccaatactgagtgcctg

SEQ ID NO: 5804251 - DNA, 12 bp, Homo sapiens
tgggagccactg

SEQ ID NO: 5804252 - DNA, 16 bp, Homo sapiens
tgggagccactgccac

SEQ ID NO: 5804253 - DNA, 20 bp, Homo sapiens
tgggagccacttctccccag

SEQ ID NO: 5804254 - DNA, 10 bp, Homo sapiens
tgggagccag

SEQ ID NO: 5804255 - DNA, 13 bp, Homo sapiens
tgggagccagcct

SEQ ID NO: 5804256 - DNA, 12 bp, Homo sapiens
tgggagccagct

SEQ ID NO: 5804257 - DNA, 11 bp, Homo sapiens
tgggagccagg

SEQ ID NO: 5804258 - DNA, 13 bp, Homo sapiens
tgggagccaggac

SEQ ID NO: 5804259 - DNA, 12 bp, Homo sapiens
tgggagccaggg

SEQ ID NO: 5804260 - DNA, 19 bp, Homo sapiens
tgggagcccagagggtggc

SEQ ID NO: 5804261 - DNA, 14 bp, Homo sapiens
tgggagccccaggg

SEQ ID NO: 5804262 - DNA, 23 bp, Homo sapiens
tgggagccccagggtcttcccta

SEQ ID NO: 5804263 - DNA, 23 bp, Homo sapiens
tgggagccctgccgaggtgtggc

SEQ ID NO: 5804264 - DNA, 18 bp, Homo sapiens
tgggagccgcagagcctg

SEQ ID NO: 5804265 - DNA, 14 bp, Homo sapiens
tgggagccgggtct

SEQ ID NO: 5804266 - DNA, 18 bp, Homo sapiens
tgggagccgggtctgcct

SEQ ID NO: 5804267 - DNA, 13 bp, Homo sapiens
tgggagcctagct

SEQ ID NO: 5804268 - DNA, 18 bp, Homo sapiens
tgggagcctagctcctgc

SEQ ID NO: 5804269 - DNA, 23 bp, Homo sapiens
tgggagcctcataaagatggctt

SEQ ID NO: 5804270 - DNA, 17 bp, Homo sapiens
tgggagcctgaggcagg

SEQ ID NO: 5804271 - DNA, 18 bp, Homo sapiens
tgggagcctgaggcagga

SEQ ID NO: 5804272 - DNA, 20 bp, Homo sapiens
tgggagcctggttcagacac

SEQ ID NO: 5804273 - DNA, 19 bp, Homo sapiens
tgggagccttttgacagct

SEQ ID NO: 5804274 - DNA, 14 bp, Homo sapiens
tgggagctcagctc

SEQ ID NO: 5804275 - DNA, 19 bp, Homo sapiens
tgggagctcagctcgctgc

SEQ ID NO: 5804276 - DNA, 13 bp, Homo sapiens
tgggagctcctct

SEQ ID NO: 5804277 - DNA, 18 bp, Homo sapiens
tgggagctcctctcctgg

SEQ ID NO: 5804278 - DNA, 17 bp, Homo sapiens
tgggagctgaaaaatca

SEQ ID NO: 5804279 - DNA, 15 bp, Homo sapiens
tgggagctgagctgg

SEQ ID NO: 5804280 - DNA, 18 bp, Homo sapiens
tgggagctgagctggaag

SEQ ID NO: 5804281 - DNA, 21 bp, Homo sapiens
tgggagctgagctggaagggg

SEQ ID NO: 5804282 - DNA, 20 bp, Homo sapiens
tgggagctgaggccacactc

SEQ ID NO: 5804283 - DNA, 23 bp, Homo sapiens
tgggagctgctgggtggcagggg

SEQ ID NO: 5804284 - DNA, 18 bp, Homo sapiens
tgggagctggagtccact

SEQ ID NO: 5804285 - DNA, 16 bp, Homo sapiens
tgggagctgtcaagca

SEQ ID NO: 5804286 - DNA, 17 bp, Homo sapiens
tgggagctgtcaggcag

SEQ ID NO: 5804287 - DNA, 21 bp, Homo sapiens
tgggagcttcttccgtttctt

SEQ ID NO: 5804288 - DNA, 19 bp, Homo sapiens
tgggagctttaaagagcag

SEQ ID NO: 5804289 - DNA, 18 bp, Homo sapiens
tgggcagcccagagagac

SEQ ID NO: 5804290 - DNA, 13 bp, Homo sapiens
tgggcagccccac

SEQ ID NO: 5804291 - DNA, 20 bp, Homo sapiens
tgggcagccccagagagagg

SEQ ID NO: 5804292 - DNA, 20 bp, Homo sapiens
tgggcagcgcccttcctctc

SEQ ID NO: 5804293 - DNA, 21 bp, Homo sapiens
tgggcagctatccagtgactt

SEQ ID NO: 5804294 - DNA, 13 bp, Homo sapiens
tgggcagctcctc

SEQ ID NO: 5804295 - DNA, 16 bp, Homo sapiens
tgggcagctcctccct

SEQ ID NO: 5804296 - DNA, 17 bp, Homo sapiens
tgggcagctgaacagtg

SEQ ID NO: 5804297 - DNA, 13 bp, Homo sapiens
tgggcagctgagg

SEQ ID NO: 5804298 - DNA, 14 bp, Homo sapiens
tgggcagctgcctc

SEQ ID NO: 5804299 - DNA, 15 bp, Homo sapiens
tgggcagctgcctcc

SEQ ID NO: 5804300 - DNA, 17 bp, Homo sapiens
tgggcagctgcctcccc

SEQ ID NO: 5804301 - DNA, 15 bp, Homo sapiens
tgggcagctgggccc

SEQ ID NO: 5804302 - DNA, 14 bp, Homo sapiens
tgggcagctgtcat

SEQ ID NO: 5804303 - DNA, 19 bp, Homo sapiens
tgggcagctgtcccttgct

SEQ ID NO: 5804304 - DNA, 19 bp, Homo sapiens
tgggcagcttagggccctg

SEQ ID NO: 5804305 - DNA, 21 bp, Homo sapiens
tgggcagcttagggccctgga

SEQ ID NO: 5804306 - DNA, 16 bp, Homo sapiens
tgggcagcttgagagg

SEQ ID NO: 5804307 - DNA, 17 bp, Homo sapiens
tgggcagcttgggctgg

SEQ ID NO: 5804308 - DNA, 20 bp, Homo sapiens
tgggcagcttgggctggcgg

SEQ ID NO: 5804309 - DNA, 13 bp, Homo sapiens
tgggcaggaaaag

SEQ ID NO: 5804310 - DNA, 21 bp, Homo sapiens
tgggcaggaccctgctgactc

SEQ ID NO: 5804311 - DNA, 22 bp, Homo sapiens
tgggcaggaggaaaaggcttgg

SEQ ID NO: 5804312 - DNA, 20 bp, Homo sapiens
tgggcaggaggccccaggct

SEQ ID NO: 5804313 - DNA, 13 bp, Homo sapiens
tgggcaggaggga

SEQ ID NO: 5804314 - DNA, 22 bp, Homo sapiens
tgggcaggagtcaccatgcaag

SEQ ID NO: 5804315 - DNA, 19 bp, Homo sapiens
tgggcaggatctcaagcca

SEQ ID NO: 5804316 - DNA, 12 bp, Homo sapiens
tgggcaggcaga

SEQ ID NO: 5804317 - DNA, 23 bp, Homo sapiens
tgggcaggcggtccccatcccca

SEQ ID NO: 5804318 - DNA, 23 bp, Homo sapiens
tgggcagggaaggaatcctggtg

SEQ ID NO: 5804319 - DNA, 23 bp, Homo sapiens
tgggcagggacccggggtctcct

SEQ ID NO: 5804320 - DNA, 13 bp, Homo sapiens
tgggcagggagcg

SEQ ID NO: 5804321 - DNA, 21 bp, Homo sapiens
tgggcagggaggcaccattca

SEQ ID NO: 5804322 - DNA, 17 bp, Homo sapiens
tgggcagggaggggctg

SEQ ID NO: 5804323 - DNA, 18 bp, Homo sapiens
tgggcagggaggggctgg

SEQ ID NO: 5804324 - DNA, 21 bp, Homo sapiens
tgggcagggcagggcagcctg

SEQ ID NO: 5804325 - DNA, 12 bp, Homo sapiens
tgggcagggccc

SEQ ID NO: 5804326 - DNA, 13 bp, Homo sapiens
tgggcagggccct

SEQ ID NO: 5804327 - DNA, 14 bp, Homo sapiens
tgggcagggccctg

SEQ ID NO: 5804328 - DNA, 16 bp, Homo sapiens
tgggcagggccctgtg

SEQ ID NO: 5804329 - DNA, 13 bp, Homo sapiens
tgggcagggccgc

SEQ ID NO: 5804330 - DNA, 18 bp, Homo sapiens
tgggcagggccgcagggc

SEQ ID NO: 5804331 - DNA, 20 bp, Homo sapiens
tgggcagggccgcagggcgc

SEQ ID NO: 5804332 - DNA, 13 bp, Homo sapiens
tgggcagggcctg

SEQ ID NO: 5804333 - DNA, 13 bp, Homo sapiens
tgggcagggctgg

SEQ ID NO: 5804334 - DNA, 14 bp, Homo sapiens
tgggcagggctggg

SEQ ID NO: 5804335 - DNA, 15 bp, Homo sapiens
tgggcagggctggga

SEQ ID NO: 5804336 - DNA, 21 bp, Homo sapiens
tgggcagggtctctgctccag

SEQ ID NO: 5804337 - DNA, 21 bp, Homo sapiens
tgggcagggtctgtttggact

SEQ ID NO: 5804338 - DNA, 12 bp, Homo sapiens
tgggcagggtga

SEQ ID NO: 5804339 - DNA, 17 bp, Homo sapiens
tgggcaggtcctgggga

SEQ ID NO: 5804340 - DNA, 20 bp, Homo sapiens
tgggcaggtcctggggaggc

SEQ ID NO: 5804341 - DNA, 21 bp, Homo sapiens
tgggcaggtcctggggaggct

SEQ ID NO: 5804342 - DNA, 15 bp, Homo sapiens
tgggcaggtggccac

SEQ ID NO: 5804343 - DNA, 19 bp, Homo sapiens
tgggcaggtggcctctgct

SEQ ID NO: 5804344 - DNA, 24 bp, Homo sapiens
tgggcaggtggcctctgctggtct

SEQ ID NO: 5804345 - DNA, 15 bp, Homo sapiens
tgggcaggtgggagc

SEQ ID NO: 5804346 - DNA, 14 bp, Homo sapiens
tgggcaggtggtgg

SEQ ID NO: 5804347 - DNA, 16 bp, Homo sapiens
tgggcaggtggtggca

SEQ ID NO: 5804348 - DNA, 16 bp, Homo sapiens
tgggcaggttcctggg

SEQ ID NO: 5804349 - DNA, 17 bp, Homo sapiens
tgggcagtcaccaccca

SEQ ID NO: 5804350 - DNA, 18 bp, Homo sapiens
tgggcagtctttcttgaa

SEQ ID NO: 5804351 - DNA, 15 bp, Homo sapiens
tgggcagtgccagcc

SEQ ID NO: 5804352 - DNA, 17 bp, Homo sapiens
tgggcagtgccccaggg

SEQ ID NO: 5804353 - DNA, 19 bp, Homo sapiens
tgggcagtgccccagggag

SEQ ID NO: 5804354 - DNA, 23 bp, Homo sapiens
tgggcagtgccccagggagtcca

SEQ ID NO: 5804355 - DNA, 15 bp, Homo sapiens
tgggcagtgcctcct

SEQ ID NO: 5804356 - DNA, 16 bp, Homo sapiens
tgggcagtgcctcctg

SEQ ID NO: 5804357 - DNA, 19 bp, Homo sapiens
tgggcagtgcctcctggga

SEQ ID NO: 5804358 - DNA, 17 bp, Homo sapiens
tgggcagtgtggcctct

SEQ ID NO: 5804359 - DNA, 17 bp, Homo sapiens
tgggcagttacatgcat

SEQ ID NO: 5804360 - DNA, 18 bp, Homo sapiens
tgggcagttctcccaggg

SEQ ID NO: 5804361 - DNA, 19 bp, Homo sapiens
tgggcagttctcccaggga

SEQ ID NO: 5804362 - DNA, 22 bp, Homo sapiens
tgggcagttctcccagggagtg

SEQ ID NO: 5804363 - DNA, 16 bp, Homo sapiens
tgggcagttttttgaa

SEQ ID NO: 5804364 - DNA, 21 bp, Homo sapiens
tgggcatactaataaagtatg

SEQ ID NO: 5804365 - DNA, 19 bp, Homo sapiens
tgggcatactttctctcta

SEQ ID NO: 5804366 - DNA, 17 bp, Homo sapiens
tgggcatagtggcactt

SEQ ID NO: 5804367 - DNA, 15 bp, Homo sapiens
tgggcatcaaagatg

SEQ ID NO: 5804368 - DNA, 15 bp, Homo sapiens
tgggcatcagcagca

SEQ ID NO: 5804369 - DNA, 15 bp, Homo sapiens
tgggcatccacccag

SEQ ID NO: 5804370 - DNA, 19 bp, Homo sapiens
tgggcatccacccagtgct

SEQ ID NO: 5804371 - DNA, 22 bp, Homo sapiens
tgggcatcccagcttgcccccg

SEQ ID NO: 5804372 - DNA, 16 bp, Homo sapiens
tgggcatccccagccc

SEQ ID NO: 5804373 - DNA, 20 bp, Homo sapiens
tgggcatccccagccccctg

SEQ ID NO: 5804374 - DNA, 21 bp, Homo sapiens
tgggcatccccagccccctgg

SEQ ID NO: 5804375 - DNA, 16 bp, Homo sapiens
tgggcatccctcctgg

SEQ ID NO: 5804376 - DNA, 20 bp, Homo sapiens
tgggcatccctcctggtacc

SEQ ID NO: 5804377 - DNA, 16 bp, Homo sapiens
tgggcatctggccctg

SEQ ID NO: 5804378 - DNA, 18 bp, Homo sapiens
tgggcatctggccctgct

SEQ ID NO: 5804379 - DNA, 19 bp, Homo sapiens
tgggcatgagctgctgtgc

SEQ ID NO: 5804380 - DNA, 23 bp, Homo sapiens
tgggcatgaggggttcctcccct

SEQ ID NO: 5804381 - DNA, 19 bp, Homo sapiens
tgggcatgccatgtctgag

SEQ ID NO: 5804382 - DNA, 15 bp, Homo sapiens
tgggcatggcagggc

SEQ ID NO: 5804383 - DNA, 12 bp, Homo sapiens
tgggcatggccg

SEQ ID NO: 5804384 - DNA, 20 bp, Homo sapiens
tgggcatggggtgggcctct

SEQ ID NO: 5804385 - DNA, 21 bp, Homo sapiens
tgggcatggtaccagccctgg

SEQ ID NO: 5804386 - DNA, 12 bp, Homo sapiens
tgggcatggtgc

SEQ ID NO: 5804387 - DNA, 16 bp, Homo sapiens
tgggcatgtccccagt

SEQ ID NO: 5804388 - DNA, 17 bp, Homo sapiens
tgggcatgtgggcttca

SEQ ID NO: 5804389 - DNA, 23 bp, Homo sapiens
tgggcattagcaaggcagagcct

SEQ ID NO: 5804390 - DNA, 22 bp, Homo sapiens
tgggcattagtgtccccccttg

SEQ ID NO: 5804391 - DNA, 13 bp, Homo sapiens
tgggcattcaaat

SEQ ID NO: 5804392 - DNA, 14 bp, Homo sapiens
tgggcattcaaatg

SEQ ID NO: 5804393 - DNA, 13 bp, Homo sapiens
tgggcattgcttt

SEQ ID NO: 5804394 - DNA, 14 bp, Homo sapiens
tgggcattgctttc

SEQ ID NO: 5804395 - DNA, 20 bp, Homo sapiens
tgggcattgctttccactga

SEQ ID NO: 5804396 - DNA, 14 bp, Homo sapiens
tgggcattgggctg

SEQ ID NO: 5804397 - DNA, 18 bp, Homo sapiens
tgggcattgggctgacac

SEQ ID NO: 5804398 - DNA, 19 bp, Homo sapiens
tgggcattgggctgacacc

SEQ ID NO: 5804399 - DNA, 16 bp, Homo sapiens
tgggcatttattttat

SEQ ID NO: 5804400 - DNA, 17 bp, Homo sapiens
tgggcatttattttata

SEQ ID NO: 5804401 - DNA, 22 bp, Homo sapiens
tgggcatttcacgaactgttca

SEQ ID NO: 5804402 - DNA, 15 bp, Homo sapiens
tgggcatttggtgag

SEQ ID NO: 5804403 - DNA, 23 bp, Homo sapiens
tgggcatttggtgagagtcaaag

SEQ ID NO: 5804404 - DNA, 20 bp, Homo sapiens
tgggcattttcctcctctgc

SEQ ID NO: 5804405 - DNA, 22 bp, Homo sapiens
tgggcattttcctcctctgcct

SEQ ID NO: 5804406 - DNA, 18 bp, Homo sapiens
tgggcattttgacaacat

SEQ ID NO: 5804407 - DNA, 22 bp, Homo sapiens
tgggccaaaagggcagccaggg

SEQ ID NO: 5804408 - DNA, 23 bp, Homo sapiens
tgggccaacaaagaacactaact

SEQ ID NO: 5804409 - DNA, 16 bp, Homo sapiens
tgggccaagagccgcc

SEQ ID NO: 5804410 - DNA, 18 bp, Homo sapiens
tgggccaagccagctgcc

SEQ ID NO: 5804411 - DNA, 19 bp, Homo sapiens
tgggccaagccagctgcct

SEQ ID NO: 5804412 - DNA, 15 bp, Homo sapiens
tgggccaagccaggg

SEQ ID NO: 5804413 - DNA, 19 bp, Homo sapiens
tgggccaagccagggatgg

SEQ ID NO: 5804414 - DNA, 14 bp, Homo sapiens
tgggccaaggactc

SEQ ID NO: 5804415 - DNA, 20 bp, Homo sapiens
tgggccaagtcaaagacatt

SEQ ID NO: 5804416 - DNA, 19 bp, Homo sapiens
tgggccaagtccactgtcc

SEQ ID NO: 5804417 - DNA, 21 bp, Homo sapiens
tgggccaagtccactgtcctc

SEQ ID NO: 5804418 - DNA, 22 bp, Homo sapiens
tgggccaatcactgagtttgtg

SEQ ID NO: 5804419 - DNA, 17 bp, Homo sapiens
tgggccacaaggaaaga

SEQ ID NO: 5804420 - DNA, 15 bp, Homo sapiens
tgggccacaggggac

SEQ ID NO: 5804421 - DNA, 14 bp, Homo sapiens
tgggccaccaggga

SEQ ID NO: 5804422 - DNA, 15 bp, Homo sapiens
tgggccaccagggat

SEQ ID NO: 5804423 - DNA, 15 bp, Homo sapiens
tgggccacccaccag

SEQ ID NO: 5804424 - DNA, 23 bp, Homo sapiens
tgggccaccgccttgcccagcct

SEQ ID NO: 5804425 - DNA, 18 bp, Homo sapiens
tgggccacctcctacccc

SEQ ID NO: 5804426 - DNA, 16 bp, Homo sapiens
tgggccacgattttaa

SEQ ID NO: 5804427 - DNA, 18 bp, Homo sapiens
tgggccacgattttaaaa

SEQ ID NO: 5804428 - DNA, 22 bp, Homo sapiens
tgggccacggctgagccttcag

SEQ ID NO: 5804429 - DNA, 18 bp, Homo sapiens
tgggccactcctcttcac

SEQ ID NO: 5804430 - DNA, 14 bp, Homo sapiens
tgggccactctccc

SEQ ID NO: 5804431 - DNA, 18 bp, Homo sapiens
tgggccactctcccctcc

SEQ ID NO: 5804432 - DNA, 20 bp, Homo sapiens
tgggccactgccagcagctg

SEQ ID NO: 5804433 - DNA, 15 bp, Homo sapiens
tgggccactgccctc

SEQ ID NO: 5804434 - DNA, 15 bp, Homo sapiens
tgggccactggggac

SEQ ID NO: 5804435 - DNA, 14 bp, Homo sapiens
tgggccagccacag

SEQ ID NO: 5804436 - DNA, 18 bp, Homo sapiens
tgggccagccacagagca

SEQ ID NO: 5804437 - DNA, 14 bp, Homo sapiens
tgggccagcccctc

SEQ ID NO: 5804438 - DNA, 15 bp, Homo sapiens
tgggccagcccctcc

SEQ ID NO: 5804439 - DNA, 16 bp, Homo sapiens
tgggccagcccctccc

SEQ ID NO: 5804440 - DNA, 23 bp, Homo sapiens
tgggccagcccctcccaccacag

SEQ ID NO: 5804441 - DNA, 21 bp, Homo sapiens
tgggccagccgattcctccag

SEQ ID NO: 5804442 - DNA, 14 bp, Homo sapiens
tgggccagcctagc

SEQ ID NO: 5804443 - DNA, 18 bp, Homo sapiens
tgggccagcctagccctt

SEQ ID NO: 5804444 - DNA, 21 bp, Homo sapiens
tgggccagcctcagctcagcc

SEQ ID NO: 5804445 - DNA, 23 bp, Homo sapiens
tgggccagcctcagctcagcctc

SEQ ID NO: 5804446 - DNA, 19 bp, Homo sapiens
tgggccagcggggctgctc

SEQ ID NO: 5804447 - DNA, 19 bp, Homo sapiens
tgggccagctgtcgcatct

SEQ ID NO: 5804448 - DNA, 18 bp, Homo sapiens
tgggccagcttttcaaac

SEQ ID NO: 5804449 - DNA, 14 bp, Homo sapiens
tgggccaggacagg

SEQ ID NO: 5804450 - DNA, 18 bp, Homo sapiens
tgggccaggacaggcccg

SEQ ID NO: 5804451 - DNA, 18 bp, Homo sapiens
tgggccaggagcctcctg

SEQ ID NO: 5804452 - DNA, 12 bp, Homo sapiens
tgggccaggcag

SEQ ID NO: 5804453 - DNA, 21 bp, Homo sapiens
tgggccaggcagagaacagaa

SEQ ID NO: 5804454 - DNA, 14 bp, Homo sapiens
tgggccaggcaggc

SEQ ID NO: 5804455 - DNA, 20 bp, Homo sapiens
tgggccagggctgccctgag

SEQ ID NO: 5804456 - DNA, 13 bp, Homo sapiens
tgggccagggtct

SEQ ID NO: 5804457 - DNA, 19 bp, Homo sapiens
tgggccagggtctgtgtga

SEQ ID NO: 5804458 - DNA, 15 bp, Homo sapiens
tgggccagtcctggt

SEQ ID NO: 5804459 - DNA, 13 bp, Homo sapiens
tgggccagtggca

SEQ ID NO: 5804460 - DNA, 16 bp, Homo sapiens
tgggccagtggcactc

SEQ ID NO: 5804461 - DNA, 19 bp, Homo sapiens
tgggccagtggcactctgt

SEQ ID NO: 5804462 - DNA, 15 bp, Homo sapiens
tgggccatactggcc

SEQ ID NO: 5804463 - DNA, 21 bp, Homo sapiens
tgggccatgaaccaaatggtt

SEQ ID NO: 5804464 - DNA, 18 bp, Homo sapiens
tgggccatgttgtgcctc

SEQ ID NO: 5804465 - DNA, 12 bp, Homo sapiens
tgggccattacc

SEQ ID NO: 5804466 - DNA, 17 bp, Homo sapiens
tggggacatgggtcgcc

SEQ ID NO: 5804467 - DNA, 18 bp, Homo sapiens
tggggaccaaaggtcagg

SEQ ID NO: 5804468 - DNA, 16 bp, Homo sapiens
tggggaccacagaggc

SEQ ID NO: 5804469 - DNA, 18 bp, Homo sapiens
tggggaccacagaggctg

SEQ ID NO: 5804470 - DNA, 14 bp, Homo sapiens
tggggaccagagct

SEQ ID NO: 5804471 - DNA, 22 bp, Homo sapiens
tggggacccaaaccccctgcag

SEQ ID NO: 5804472 - DNA, 14 bp, Homo sapiens
tggggacccagact

SEQ ID NO: 5804473 - DNA, 13 bp, Homo sapiens
tggggacccaggc

SEQ ID NO: 5804474 - DNA, 21 bp, Homo sapiens
tggggacccaggctccgccct

SEQ ID NO: 5804475 - DNA, 22 bp, Homo sapiens
tggggacccaggctccgccctt

SEQ ID NO: 5804476 - DNA, 19 bp, Homo sapiens
tggggaccccaacctcaga

SEQ ID NO: 5804477 - DNA, 14 bp, Homo sapiens
tggggaccccaccc

SEQ ID NO: 5804478 - DNA, 19 bp, Homo sapiens
tggggaccccacccctcat

SEQ ID NO: 5804479 - DNA, 14 bp, Homo sapiens
tggggaccccactt

SEQ ID NO: 5804480 - DNA, 20 bp, Homo sapiens
tggggacccgctgggggctg

SEQ ID NO: 5804481 - DNA, 21 bp, Homo sapiens
tggggacccgctgggggctgg

SEQ ID NO: 5804482 - DNA, 13 bp, Homo sapiens
tggggacctcagg

SEQ ID NO: 5804483 - DNA, 14 bp, Homo sapiens
tggggacctcaggc

SEQ ID NO: 5804484 - DNA, 16 bp, Homo sapiens
tggggacctcaggcct

SEQ ID NO: 5804485 - DNA, 17 bp, Homo sapiens
tggggacctcaggcctg

SEQ ID NO: 5804486 - DNA, 19 bp, Homo sapiens
tggggacctgatggagagt

SEQ ID NO: 5804487 - DNA, 14 bp, Homo sapiens
tggggacctggggt

SEQ ID NO: 5804488 - DNA, 18 bp, Homo sapiens
tggggacctggtaccctc

SEQ ID NO: 5804489 - DNA, 19 bp, Homo sapiens
tggggaccttggcagtgtg

SEQ ID NO: 5804490 - DNA, 17 bp, Homo sapiens
tggggacgccaaggagg

SEQ ID NO: 5804491 - DNA, 21 bp, Homo sapiens
tggggacgctccgctgccgtg

SEQ ID NO: 5804492 - DNA, 16 bp, Homo sapiens
tggggacggagcactg

SEQ ID NO: 5804493 - DNA, 14 bp, Homo sapiens
tggggacggggctc

SEQ ID NO: 5804494 - DNA, 23 bp, Homo sapiens
tggggacggggctcccctggaca

SEQ ID NO: 5804495 - DNA, 21 bp, Homo sapiens
tggggacgggggctgcttctc

SEQ ID NO: 5804496 - DNA, 21 bp, Homo sapiens
tggggacgtcctgccacctgg

SEQ ID NO: 5804497 - DNA, 19 bp, Homo sapiens
tggggacgtgaacgtttta

SEQ ID NO: 5804498 - DNA, 17 bp, Homo sapiens
tggggacgtgtgtcctt

SEQ ID NO: 5804499 - DNA, 21 bp, Homo sapiens
tggggacgttgctgagccagc

SEQ ID NO: 5804500 - DNA, 16 bp, Homo sapiens
tggggactcaggacca

SEQ ID NO: 5804501 - DNA, 22 bp, Homo sapiens
tggggactcaggaccagatgtc

SEQ ID NO: 5804502 - DNA, 22 bp, Homo sapiens
tggggactccggctgtgctggg

SEQ ID NO: 5804503 - DNA, 17 bp, Homo sapiens
tggggactctggcacag

SEQ ID NO: 5804504 - DNA, 23 bp, Homo sapiens
tggggactgctacctctgagaag

SEQ ID NO: 5804505 - DNA, 16 bp, Homo sapiens
tggggactgggcacag

SEQ ID NO: 5804506 - DNA, 21 bp, Homo sapiens
tggggacttctggggacagac

SEQ ID NO: 5804507 - DNA, 16 bp, Homo sapiens
tggggacttgtgtctg

SEQ ID NO: 5804508 - DNA, 20 bp, Homo sapiens
tggggagaaagaggggcctg

SEQ ID NO: 5804509 - DNA, 11 bp, Homo sapiens
tggggagaaat

SEQ ID NO: 5804510 - DNA, 23 bp, Homo sapiens
tggggagaaataaattttgtttc

SEQ ID NO: 5804511 - DNA, 16 bp, Homo sapiens
tggggagaaataattg

SEQ ID NO: 5804512 - DNA, 17 bp, Homo sapiens
tggggagacacctcaga

SEQ ID NO: 5804513 - DNA, 18 bp, Homo sapiens
tggggagacacctcagag

SEQ ID NO: 5804514 - DNA, 20 bp, Homo sapiens
tggggagacacctcagagcc

SEQ ID NO: 5804515 - DNA, 17 bp, Homo sapiens
tggggagactgggctga

SEQ ID NO: 5804516 - DNA, 20 bp, Homo sapiens
tggggagacttggggccagc

SEQ ID NO: 5804517 - DNA, 23 bp, Homo sapiens
tggggagagagcccttcccaggg

SEQ ID NO: 5804518 - DNA, 12 bp, Homo sapiens
tggggagagctg

SEQ ID NO: 5804519 - DNA, 15 bp, Homo sapiens
tggggagaggaaaga

SEQ ID NO: 5804520 - DNA, 20 bp, Homo sapiens
tggggagaggaactccttgg

SEQ ID NO: 5804521 - DNA, 22 bp, Homo sapiens
tggggagagttgtgatggaggg

SEQ ID NO: 5804522 - DNA, 20 bp, Homo sapiens
tggggagcacttgcgtcctg

SEQ ID NO: 5804523 - DNA, 13 bp, Homo sapiens
tggggagcagagt

SEQ ID NO: 5804524 - DNA, 23 bp, Homo sapiens
tggggagcagagtataggatgga

SEQ ID NO: 5804525 - DNA, 21 bp, Homo sapiens
tggggagcaggaggccaataa

SEQ ID NO: 5804526 - DNA, 22 bp, Homo sapiens
tggggagcaggaggccaataaa

SEQ ID NO: 5804527 - DNA, 19 bp, Homo sapiens
tggggagcagttttcccct

SEQ ID NO: 5804528 - DNA, 16 bp, Homo sapiens
tggggagccaacagaa

SEQ ID NO: 5804529 - DNA, 10 bp, Homo sapiens
tggggagccc

SEQ ID NO: 5804530 - DNA, 20 bp, Homo sapiens
tggggagccctattgctgct

SEQ ID NO: 5804531 - DNA, 16 bp, Homo sapiens
tggggagcggagcttg

SEQ ID NO: 5804532 - DNA, 23 bp, Homo sapiens
tggggagcggagcttggccctgc

SEQ ID NO: 5804533 - DNA, 13 bp, Homo sapiens
tggggagctcctg

SEQ ID NO: 5804534 - DNA, 19 bp, Homo sapiens
tggggagctcctgggaccc

SEQ ID NO: 5804535 - DNA, 18 bp, Homo sapiens
tggggagctctggaggtg

SEQ ID NO: 5804536 - DNA, 11 bp, Homo sapiens
tggggagctgg

SEQ ID NO: 5804537 - DNA, 14 bp, Homo sapiens
tggggaggaagaag

SEQ ID NO: 5804538 - DNA, 12 bp, Homo sapiens
tggggaggacaa

SEQ ID NO: 5804539 - DNA, 12 bp, Homo sapiens
tggggaggagga

SEQ ID NO: 5804540 - DNA, 15 bp, Homo sapiens
tggggaggaggaagc

SEQ ID NO: 5804541 - DNA, 17 bp, Homo sapiens
tggggaggaggaagccg

SEQ ID NO: 5804542 - DNA, 13 bp, Homo sapiens
tggggaggaggag

SEQ ID NO: 5804543 - DNA, 23 bp, Homo sapiens
tggggaggagttgtctgtcctgg

SEQ ID NO: 5804544 - DNA, 21 bp, Homo sapiens
tggggaggcaggcattcctga

SEQ ID NO: 5804545 - DNA, 22 bp, Homo sapiens
tggggaggccatttgctgccct

SEQ ID NO: 5804546 - DNA, 17 bp, Homo sapiens
tggggaggcccaaatga

SEQ ID NO: 5804547 - DNA, 17 bp, Homo sapiens
tggggaggccctgcctg

SEQ ID NO: 5804548 - DNA, 14 bp, Homo sapiens
tggggaggcctcac

SEQ ID NO: 5804549 - DNA, 22 bp, Homo sapiens
tggggaggcggacgttccagcc

SEQ ID NO: 5804550 - DNA, 23 bp, Homo sapiens
tggggaggcggacgttccagccg

SEQ ID NO: 5804551 - DNA, 20 bp, Homo sapiens
tggggaggctgaggcaggag

SEQ ID NO: 5804552 - DNA, 23 bp, Homo sapiens
tggggaggctgcactggagccac

SEQ ID NO: 5804553 - DNA, 13 bp, Homo sapiens
tggggagggagag

SEQ ID NO: 5804554 - DNA, 17 bp, Homo sapiens
tggggagggagagatct

SEQ ID NO: 5804555 - DNA, 18 bp, Homo sapiens
tggggagggaggggaaat

SEQ ID NO: 5804556 - DNA, 21 bp, Homo sapiens
tggggagggaggggaaatgta

SEQ ID NO: 5804557 - DNA, 21 bp, Homo sapiens
tggggagggatgaagggcgag

SEQ ID NO: 5804558 - DNA, 22 bp, Homo sapiens
tggggagggattctggttccag

SEQ ID NO: 5804559 - DNA, 17 bp, Homo sapiens
tggggagggcaggtcca

SEQ ID NO: 5804560 - DNA, 24 bp, Homo sapiens
tggggagggcaggtccagctctgt

SEQ ID NO: 5804561 - DNA, 18 bp, Homo sapiens
tggggagggcctctggac

SEQ ID NO: 5804562 - DNA, 21 bp, Homo sapiens
tggggagggctgcagtcacat

SEQ ID NO: 5804563 - DNA, 14 bp, Homo sapiens
tggggaggggagag

SEQ ID NO: 5804564 - DNA, 17 bp, Homo sapiens
tggggaggggcctggcc

SEQ ID NO: 5804565 - DNA, 15 bp, Homo sapiens
tggggaggggcgctg

SEQ ID NO: 5804566 - DNA, 19 bp, Homo sapiens
tggggaggggcgctggccc

SEQ ID NO: 5804567 - DNA, 20 bp, Homo sapiens
tggggaggggcgctggccca

SEQ ID NO: 5804568 - DNA, 21 bp, Homo sapiens
tggggaggggcgctggcccag

SEQ ID NO: 5804569 - DNA, 23 bp, Homo sapiens
tggggaggggcgctggcccagcc

SEQ ID NO: 5804570 - DNA, 14 bp, Homo sapiens
tggggaggggctct

SEQ ID NO: 5804571 - DNA, 14 bp, Homo sapiens
tggggagggggaag

SEQ ID NO: 5804572 - DNA, 14 bp, Homo sapiens
tggggaggggtgga

SEQ ID NO: 5804573 - DNA, 12 bp, Homo sapiens
tggggagggtga

SEQ ID NO: 5804574 - DNA, 21 bp, Homo sapiens
tggggagggtgacccacagct

SEQ ID NO: 5804575 - DNA, 15 bp, Homo sapiens
tggggagggtgggcg

SEQ ID NO: 5804576 - DNA, 17 bp, Homo sapiens
tggggaggtggcactag

SEQ ID NO: 5804577 - DNA, 21 bp, Homo sapiens
tggggaggtggcactagggat

SEQ ID NO: 5804578 - DNA, 18 bp, Homo sapiens
tggggaggtgggaggcca

SEQ ID NO: 5804579 - DNA, 20 bp, Homo sapiens
tggggaggtgggaggccagg

SEQ ID NO: 5804580 - DNA, 21 bp, Homo sapiens
tggggagtattatggaaatcc

SEQ ID NO: 5804581 - DNA, 17 bp, Homo sapiens
tggggagtgggggtggg

SEQ ID NO: 5804582 - DNA, 19 bp, Homo sapiens
tggggagtggttaggcagc

SEQ ID NO: 5804583 - DNA, 20 bp, Homo sapiens
tggggagttataaaaataca

SEQ ID NO: 5804584 - DNA, 18 bp, Homo sapiens
tggggagtttagggtggg

SEQ ID NO: 5804585 - DNA, 16 bp, Homo sapiens
tggggataaaatgact

SEQ ID NO: 5804586 - DNA, 14 bp, Homo sapiens
tggggataaagaca

SEQ ID NO: 5804587 - DNA, 18 bp, Homo sapiens
tggggataataatactga

SEQ ID NO: 5804588 - DNA, 23 bp, Homo sapiens
tggggatagaggaaagggatggt

SEQ ID NO: 5804589 - DNA, 18 bp, Homo sapiens
tggggatagatgtgtgga

SEQ ID NO: 5804590 - DNA, 22 bp, Homo sapiens
tggggatagtccttcctggcat

SEQ ID NO: 5804591 - DNA, 17 bp, Homo sapiens
tggggatagtctgggtc

SEQ ID NO: 5804592 - DNA, 18 bp, Homo sapiens
tggggatcaaagttctgc

SEQ ID NO: 5804593 - DNA, 15 bp, Homo sapiens
tggggatcacagaga

SEQ ID NO: 5804594 - DNA, 18 bp, Homo sapiens
tggggatccccgcctggc

SEQ ID NO: 5804595 - DNA, 21 bp, Homo sapiens
tggggatccccgcctggccag

SEQ ID NO: 5804596 - DNA, 22 bp, Homo sapiens
tggggatccccgcctggccagg

SEQ ID NO: 5804597 - DNA, 14 bp, Homo sapiens
tggggatctggggg

SEQ ID NO: 5804598 - DNA, 15 bp, Homo sapiens
tggggatgagaaagg

SEQ ID NO: 5804599 - DNA, 13 bp, Homo sapiens
tggggatgagaca

SEQ ID NO: 5804600 - DNA, 15 bp, Homo sapiens
tggggatgaggtcac

SEQ ID NO: 5804601 - DNA, 14 bp, Homo sapiens
tggggatggagaat

SEQ ID NO: 5804602 - DNA, 18 bp, Homo sapiens
tggggatggagaatgcca

SEQ ID NO: 5804603 - DNA, 13 bp, Homo sapiens
tggggatggccag

SEQ ID NO: 5804604 - DNA, 14 bp, Homo sapiens
tggggatggccagg

SEQ ID NO: 5804605 - DNA, 14 bp, Homo sapiens
tggggatgggaggg

SEQ ID NO: 5804606 - DNA, 19 bp, Homo sapiens
tggggatggggacaaagaa

SEQ ID NO: 5804607 - DNA, 20 bp, Homo sapiens
tggggatggggttgggctct

SEQ ID NO: 5804608 - DNA, 17 bp, Homo sapiens
tggggatggtgatggag

SEQ ID NO: 5804609 - DNA, 19 bp, Homo sapiens
tggggatgtaaccaagctg

SEQ ID NO: 5804610 - DNA, 14 bp, Homo sapiens
tggggatgtgggag

SEQ ID NO: 5804611 - DNA, 13 bp, Homo sapiens
tggggattcagat

SEQ ID NO: 5804612 - DNA, 18 bp, Homo sapiens
tggggattcagatttctc

SEQ ID NO: 5804613 - DNA, 20 bp, Homo sapiens
tggggattcagatttctctt

SEQ ID NO: 5804614 - DNA, 20 bp, Homo sapiens
tggggattcaggggctttgg

SEQ ID NO: 5804615 - DNA, 20 bp, Homo sapiens
tggggattcttaaagttgaa

SEQ ID NO: 5804616 - DNA, 20 bp, Homo sapiens
tggggattcttgaacttgaa

SEQ ID NO: 5804617 - DNA, 16 bp, Homo sapiens
tggggattgggaggga

SEQ ID NO: 5804618 - DNA, 15 bp, Homo sapiens
tggggatttctccca

SEQ ID NO: 5804619 - DNA, 19 bp, Homo sapiens
tggggcaacgacggtttca

SEQ ID NO: 5804620 - DNA, 16 bp, Homo sapiens
tggggcaagatccagg

SEQ ID NO: 5804621 - DNA, 12 bp, Homo sapiens
tggggcaagcca

SEQ ID NO: 5804622 - DNA, 14 bp, Homo sapiens
tggggcaagccagg

SEQ ID NO: 5804623 - DNA, 23 bp, Homo sapiens
tggggcaagccagggcccagagc

SEQ ID NO: 5804624 - DNA, 15 bp, Homo sapiens
tggggcaagcctgag

SEQ ID NO: 5804625 - DNA, 22 bp, Homo sapiens
tggggcaagcctgagtggtgag

SEQ ID NO: 5804626 - DNA, 12 bp, Homo sapiens
tggggcaaggct

SEQ ID NO: 5804627 - DNA, 15 bp, Homo sapiens
tggggcaagtcatgt

SEQ ID NO: 5804628 - DNA, 19 bp, Homo sapiens
tggggcaagtccctgactc

SEQ ID NO: 5804629 - DNA, 20 bp, Homo sapiens
tggggcaatagggttaaatg

SEQ ID NO: 5804630 - DNA, 16 bp, Homo sapiens
tggggcaatggggaga

SEQ ID NO: 5804631 - DNA, 16 bp, Homo sapiens
tggggcacagatgcct

SEQ ID NO: 5804632 - DNA, 17 bp, Homo sapiens
tggggcacagtccagga

SEQ ID NO: 5804633 - DNA, 18 bp, Homo sapiens
tggggcacagtccaggaa

SEQ ID NO: 5804634 - DNA, 19 bp, Homo sapiens
tggggcacggctctggggt

SEQ ID NO: 5804635 - DNA, 19 bp, Homo sapiens
tggggcagaaatctgagga

SEQ ID NO: 5804636 - DNA, 12 bp, Homo sapiens
tggggcagacac

SEQ ID NO: 5804637 - DNA, 14 bp, Homo sapiens
tggggcagagcctc

SEQ ID NO: 5804638 - DNA, 15 bp, Homo sapiens
tggggcagagcctcc

SEQ ID NO: 5804639 - DNA, 14 bp, Homo sapiens
tggggcagagcttc

SEQ ID NO: 5804640 - DNA, 15 bp, Homo sapiens
tggggcagagcttct

SEQ ID NO: 5804641 - DNA, 19 bp, Homo sapiens
tggggcagagcttgtagcc

SEQ ID NO: 5804642 - DNA, 23 bp, Homo sapiens
tggggcagagcttgtagccctgg

SEQ ID NO: 5804643 - DNA, 20 bp, Homo sapiens
tgggtacttgtggacacagc

SEQ ID NO: 5804644 - DNA, 23 bp, Homo sapiens
tgggtacttgtggacacagctct

SEQ ID NO: 5804645 - DNA, 15 bp, Homo sapiens
tgggtactttctgaa

SEQ ID NO: 5804646 - DNA, 16 bp, Homo sapiens
tgggtactttctgaaa

SEQ ID NO: 5804647 - DNA, 21 bp, Homo sapiens
tgggtagaaagagatacagag

SEQ ID NO: 5804648 - DNA, 23 bp, Homo sapiens
tgggtagaagccacccttccctg

SEQ ID NO: 5804649 - DNA, 17 bp, Homo sapiens
tgggtagacacacatga

SEQ ID NO: 5804650 - DNA, 19 bp, Homo sapiens
tgggtaggagcccttctct

SEQ ID NO: 5804651 - DNA, 14 bp, Homo sapiens
tgggtaggcaggtg

SEQ ID NO: 5804652 - DNA, 22 bp, Homo sapiens
tgggtaggcaggtgtcttggac

SEQ ID NO: 5804653 - DNA, 15 bp, Homo sapiens
tgggtaggccccaca

SEQ ID NO: 5804654 - DNA, 22 bp, Homo sapiens
tgggtaggccccacaaggcctg

SEQ ID NO: 5804655 - DNA, 13 bp, Homo sapiens
tgggtagggcaga

SEQ ID NO: 5804656 - DNA, 24 bp, Homo sapiens
tgggtaggtggttcgtgctgtgct

SEQ ID NO: 5804657 - DNA, 14 bp, Homo sapiens
tgggtataaaagat

SEQ ID NO: 5804658 - DNA, 18 bp, Homo sapiens
tgggtatagatgttgcta

SEQ ID NO: 5804659 - DNA, 20 bp, Homo sapiens
tgggtatagttcatgtctgc

SEQ ID NO: 5804660 - DNA, 14 bp, Homo sapiens
tgggtatcaagaca

SEQ ID NO: 5804661 - DNA, 21 bp, Homo sapiens
tgggtatcaccactggagatc

SEQ ID NO: 5804662 - DNA, 22 bp, Homo sapiens
tgggtatcaccactggagatca

SEQ ID NO: 5804663 - DNA, 13 bp, Homo sapiens
tgggtatcccacc

SEQ ID NO: 5804664 - DNA, 18 bp, Homo sapiens
tgggtatcccacctccag

SEQ ID NO: 5804665 - DNA, 22 bp, Homo sapiens
tgggtatcccacctccagccca

SEQ ID NO: 5804666 - DNA, 13 bp, Homo sapiens
tgggtatcccctg

SEQ ID NO: 5804667 - DNA, 21 bp, Homo sapiens
tgggtatgaactaaaaagaga

SEQ ID NO: 5804668 - DNA, 17 bp, Homo sapiens
tgggtatgctcaggtca

SEQ ID NO: 5804669 - DNA, 22 bp, Homo sapiens
tgggtatgctcaggtcaactga

SEQ ID NO: 5804670 - DNA, 17 bp, Homo sapiens
tgggtatgtgtaggcag

SEQ ID NO: 5804671 - DNA, 22 bp, Homo sapiens
tgggtattaaacttgtcagaat

SEQ ID NO: 5804672 - DNA, 21 bp, Homo sapiens
tgggtatttattctctattta

SEQ ID NO: 5804673 - DNA, 21 bp, Homo sapiens
tgggtatttcttatttgaaag

SEQ ID NO: 5804674 - DNA, 18 bp, Homo sapiens
tgggtattttataatgtt

SEQ ID NO: 5804675 - DNA, 19 bp, Homo sapiens
tgggtattttgtcagtttt

SEQ ID NO: 5804676 - DNA, 15 bp, Homo sapiens
tgggtcaaaagagcc

SEQ ID NO: 5804677 - DNA, 18 bp, Homo sapiens
tgggtcaaaagagccctg

SEQ ID NO: 5804678 - DNA, 17 bp, Homo sapiens
tgggtcaactccaaggc

SEQ ID NO: 5804679 - DNA, 19 bp, Homo sapiens
tgggtcaacttgacaccac

SEQ ID NO: 5804680 - DNA, 20 bp, Homo sapiens
tgggtcaacttgacaccact

SEQ ID NO: 5804681 - DNA, 19 bp, Homo sapiens
tgggtcaaggacagggctg

SEQ ID NO: 5804682 - DNA, 22 bp, Homo sapiens
tgggtcaaggacagggctgagc

SEQ ID NO: 5804683 - DNA, 19 bp, Homo sapiens
tgggtcaatggaataataa

SEQ ID NO: 5804684 - DNA, 19 bp, Homo sapiens
tgggtcacacacggaggca

SEQ ID NO: 5804685 - DNA, 21 bp, Homo sapiens
tgggtcacagagtgagactcc

SEQ ID NO: 5804686 - DNA, 16 bp, Homo sapiens
tgggtcacaggaagga

SEQ ID NO: 5804687 - DNA, 17 bp, Homo sapiens
tgggtcacatccatccc

SEQ ID NO: 5804688 - DNA, 19 bp, Homo sapiens
tgggtcaccagacggggct

SEQ ID NO: 5804689 - DNA, 15 bp, Homo sapiens
tgggtcacctagctg

SEQ ID NO: 5804690 - DNA, 18 bp, Homo sapiens
tgggtcaccttcctgggc

SEQ ID NO: 5804691 - DNA, 9 bp, Homo sapiens
tgggtcaga

SEQ ID NO: 5804692 - DNA, 17 bp, Homo sapiens
tgggtcagaaccctgcc

SEQ ID NO: 5804693 - DNA, 17 bp, Homo sapiens
tgggtcagacccatctc

SEQ ID NO: 5804694 - DNA, 23 bp, Homo sapiens
tgggtcagatttatttgtttgat

SEQ ID NO: 5804695 - DNA, 15 bp, Homo sapiens
tgggtcagcccagca

SEQ ID NO: 5804696 - DNA, 17 bp, Homo sapiens
tgggtcagcccagcacc

SEQ ID NO: 5804697 - DNA, 20 bp, Homo sapiens
tgggtcagcccagcacctgc

SEQ ID NO: 5804698 - DNA, 15 bp, Homo sapiens
tgggtcagggccaga

SEQ ID NO: 5804699 - DNA, 21 bp, Homo sapiens
tgggtcagggggagtctttgc

SEQ ID NO: 5804700 - DNA, 21 bp, Homo sapiens
tgggtcagggtgtgaggccac

SEQ ID NO: 5804701 - DNA, 13 bp, Homo sapiens
tgggtcaggttct

SEQ ID NO: 5804702 - DNA, 15 bp, Homo sapiens
tgggtcagtggccag

SEQ ID NO: 5804703 - DNA, 19 bp, Homo sapiens
tgggtcagtggccaggtgc

SEQ ID NO: 5804704 - DNA, 22 bp, Homo sapiens
tgggtcagtgtgccaccctctg

SEQ ID NO: 5804705 - DNA, 17 bp, Homo sapiens
tgggtcatcccagcacc

SEQ ID NO: 5804706 - DNA, 15 bp, Homo sapiens
tgggtcatgggcctg

SEQ ID NO: 5804707 - DNA, 20 bp, Homo sapiens
tgggtcatgggcctgtgggg

SEQ ID NO: 5804708 - DNA, 19 bp, Homo sapiens
tgggtcattgacctctcag

SEQ ID NO: 5804709 - DNA, 22 bp, Homo sapiens
tgggtcattgacctctcagggc

SEQ ID NO: 5804710 - DNA, 13 bp, Homo sapiens
tgggtcattttta

SEQ ID NO: 5804711 - DNA, 18 bp, Homo sapiens
tgggtccaaataaaaact

SEQ ID NO: 5804712 - DNA, 15 bp, Homo sapiens
tgggtccaagagaca

SEQ ID NO: 5804713 - DNA, 16 bp, Homo sapiens
tgggtccaagagacat

SEQ ID NO: 5804714 - DNA, 15 bp, Homo sapiens
tgggtccaccatgca

SEQ ID NO: 5804715 - DNA, 13 bp, Homo sapiens
tgggtccagaaga

SEQ ID NO: 5804716 - DNA, 12 bp, Homo sapiens
tgggtccaggaa

SEQ ID NO: 5804717 - DNA, 14 bp, Homo sapiens
tgggtccaggagga

SEQ ID NO: 5804718 - DNA, 21 bp, Homo sapiens
tgggtccaggcctactcctgt

SEQ ID NO: 5804719 - DNA, 23 bp, Homo sapiens
tgggtccaggcctactcctgtct

SEQ ID NO: 5804720 - DNA, 20 bp, Homo sapiens
tgggtccaggcctggccatg

SEQ ID NO: 5804721 - DNA, 21 bp, Homo sapiens
tgggtccagggcctgacaccc

SEQ ID NO: 5804722 - DNA, 22 bp, Homo sapiens
tgggtccaggggagggaaaagc

SEQ ID NO: 5804723 - DNA, 20 bp, Homo sapiens
tgggtccaggggatgggagg

SEQ ID NO: 5804724 - DNA, 19 bp, Homo sapiens
tgggtccaggggcccctcc

SEQ ID NO: 5804725 - DNA, 20 bp, Homo sapiens
tgggtccaggggtctgtctg

SEQ ID NO: 5804726 - DNA, 22 bp, Homo sapiens
tgggtcccacttcccctcctac

SEQ ID NO: 5804727 - DNA, 14 bp, Homo sapiens
tgggtcccagcctg

SEQ ID NO: 5804728 - DNA, 13 bp, Homo sapiens
tgggtcccaggac

SEQ ID NO: 5804729 - DNA, 14 bp, Homo sapiens
tgggtcccagggct

SEQ ID NO: 5804730 - DNA, 18 bp, Homo sapiens
tgggtcccagggctggcc

SEQ ID NO: 5804731 - DNA, 19 bp, Homo sapiens
tgggtcccagggctggccc

SEQ ID NO: 5804732 - DNA, 20 bp, Homo sapiens
tgggtcccagggctggccct

SEQ ID NO: 5804733 - DNA, 12 bp, Homo sapiens
tgggtccccctc

SEQ ID NO: 5804734 - DNA, 19 bp, Homo sapiens
tgggtcccggctctgtggg

SEQ ID NO: 5804735 - DNA, 21 bp, Homo sapiens
tgggtcccgggtgccccccat

SEQ ID NO: 5804736 - DNA, 23 bp, Homo sapiens
tgggtccctaagcacaataaaag

SEQ ID NO: 5804737 - DNA, 20 bp, Homo sapiens
tgggtccctcggagctgcca

SEQ ID NO: 5804738 - DNA, 18 bp, Homo sapiens
tgggtccctgctcccctt

SEQ ID NO: 5804739 - DNA, 19 bp, Homo sapiens
tgggtccctgggaaagagg

SEQ ID NO: 5804740 - DNA, 16 bp, Homo sapiens
tgggtcccttgctgca

SEQ ID NO: 5804741 - DNA, 15 bp, Homo sapiens
tgggtccgagaggga

SEQ ID NO: 5804742 - DNA, 22 bp, Homo sapiens
tgggtccgcatccctgcttctg

SEQ ID NO: 5804743 - DNA, 17 bp, Homo sapiens
tgggtcctagcccttcc

SEQ ID NO: 5804744 - DNA, 18 bp, Homo sapiens
tgggtcctagcccttccc

SEQ ID NO: 5804745 - DNA, 18 bp, Homo sapiens
tgggtcctcacatctttc

SEQ ID NO: 5804746 - DNA, 15 bp, Homo sapiens
tgggtcctccaaaga

SEQ ID NO: 5804747 - DNA, 14 bp, Homo sapiens
tgggtcctcggccc

SEQ ID NO: 5804748 - DNA, 16 bp, Homo sapiens
tgggtcctcggcccat

SEQ ID NO: 5804749 - DNA, 22 bp, Homo sapiens
tgggtcctcgggcccctgagcc

SEQ ID NO: 5804750 - DNA, 21 bp, Homo sapiens
tgggtcctctgcttcctgagc

SEQ ID NO: 5804751 - DNA, 14 bp, Homo sapiens
tgggtcctgccagc

SEQ ID NO: 5804752 - DNA, 13 bp, Homo sapiens
tgggtcctgcctg

SEQ ID NO: 5804753 - DNA, 15 bp, Homo sapiens
tgggtcctgctgctc

SEQ ID NO: 5804754 - DNA, 14 bp, Homo sapiens
tgggtcctgggcag

SEQ ID NO: 5804755 - DNA, 15 bp, Homo sapiens
tgggtccttcctgaa

SEQ ID NO: 5804756 - DNA, 20 bp, Homo sapiens
tgggtccttgatgccagagg

SEQ ID NO: 5804757 - DNA, 21 bp, Homo sapiens
tgggtccttgatgccagaggg

SEQ ID NO: 5804758 - DNA, 22 bp, Homo sapiens
tgggtcgcccacgggtgtggct

SEQ ID NO: 5804759 - DNA, 16 bp, Homo sapiens
tgggtcgcccatgaga

SEQ ID NO: 5804760 - DNA, 15 bp, Homo sapiens
tgggtcgcccctcct

SEQ ID NO: 5804761 - DNA, 17 bp, Homo sapiens
tgggtcgcccctcctcg

SEQ ID NO: 5804762 - DNA, 16 bp, Homo sapiens
tgggtcgccctggact

SEQ ID NO: 5804763 - DNA, 18 bp, Homo sapiens
tgggtcgggacagaccag

SEQ ID NO: 5804764 - DNA, 14 bp, Homo sapiens
tgggtcgggagagg

SEQ ID NO: 5804765 - DNA, 19 bp, Homo sapiens
tgggtcgggagaggggacg

SEQ ID NO: 5804766 - DNA, 17 bp, Homo sapiens
tgggtctattccagctc

SEQ ID NO: 5804767 - DNA, 18 bp, Homo sapiens
tgggtctcaccggctctc

SEQ ID NO: 5804768 - DNA, 12 bp, Homo sapiens
tgggtctcactc

SEQ ID NO: 5804769 - DNA, 18 bp, Homo sapiens
tgggtctcactcctgagt

SEQ ID NO: 5804770 - DNA, 19 bp, Homo sapiens
tgggtctccattctgtgtg

SEQ ID NO: 5804771 - DNA, 22 bp, Homo sapiens
tgggtctcgctttgttgcccag

SEQ ID NO: 5804772 - DNA, 15 bp, Homo sapiens
tgggtctctctccat

SEQ ID NO: 5804773 - DNA, 12 bp, Homo sapiens
tgggtctctgga

SEQ ID NO: 5804774 - DNA, 17 bp, Homo sapiens
tgggtctctgggcacag

SEQ ID NO: 5804775 - DNA, 14 bp, Homo sapiens
tgggtctctgggga

SEQ ID NO: 5804776 - DNA, 15 bp, Homo sapiens
tgggtctctggggac

SEQ ID NO: 5804777 - DNA, 14 bp, Homo sapiens
tgggtctgaaagga

SEQ ID NO: 5804778 - DNA, 16 bp, Homo sapiens
tgggtctgacctggtg

SEQ ID NO: 5804779 - DNA, 14 bp, Homo sapiens
tgggtctgagctgg

SEQ ID NO: 5804780 - DNA, 16 bp, Homo sapiens
tgggtctgagctggac

SEQ ID NO: 5804781 - DNA, 17 bp, Homo sapiens
tgggtctgaggcccctg

SEQ ID NO: 5804782 - DNA, 20 bp, Homo sapiens
tgggtctgaggcccctgcct

SEQ ID NO: 5804783 - DNA, 19 bp, Homo sapiens
tgggtctgatattaatcaa

SEQ ID NO: 5804784 - DNA, 21 bp, Homo sapiens
tgggtctgatattaatcaaaa

SEQ ID NO: 5804785 - DNA, 14 bp, Homo sapiens
tgggtctgcagctg

SEQ ID NO: 5804786 - DNA, 18 bp, Homo sapiens
tgggtctggatgggagga

SEQ ID NO: 5804787 - DNA, 21 bp, Homo sapiens
tgggtctggctagagggccca

SEQ ID NO: 5804788 - DNA, 21 bp, Homo sapiens
tgggtctgggagtcacacagt

SEQ ID NO: 5804789 - DNA, 23 bp, Homo sapiens
tgggtctgggatatggctgccca

SEQ ID NO: 5804790 - DNA, 19 bp, Homo sapiens
tgggtctggggacaggccc

SEQ ID NO: 5804791 - DNA, 20 bp, Homo sapiens
tgggtctgtgtctcttttct

SEQ ID NO: 5804792 - DNA, 12 bp, Homo sapiens
tgggtctgtgtg

SEQ ID NO: 5804793 - DNA, 13 bp, Homo sapiens
tgggtctgtgtgt

SEQ ID NO: 5804794 - DNA, 14 bp, Homo sapiens
tgggtctgttttcc

SEQ ID NO: 5804795 - DNA, 22 bp, Homo sapiens
tgggtctgttttcctttctcac

SEQ ID NO: 5804796 - DNA, 15 bp, Homo sapiens
tgggtgaaaccacat

SEQ ID NO: 5804797 - DNA, 20 bp, Homo sapiens
tgggtgaagtgcctgctggg

SEQ ID NO: 5804798 - DNA, 13 bp, Homo sapiens
tgggtgacagagc

SEQ ID NO: 5804799 - DNA, 12 bp, Homo sapiens
tgggtgacattt

SEQ ID NO: 5804800 - DNA, 13 bp, Homo sapiens
tgggtgagaacaa

SEQ ID NO: 5804801 - DNA, 14 bp, Homo sapiens
tgggtgagagagac

SEQ ID NO: 5804802 - DNA, 19 bp, Homo sapiens
tgggtgagatgctggagaa

SEQ ID NO: 5804803 - DNA, 13 bp, Homo sapiens
tgggtgagctctc

SEQ ID NO: 5804804 - DNA, 14 bp, Homo sapiens
tgggtgaggaaatc

SEQ ID NO: 5804805 - DNA, 17 bp, Homo sapiens
tgggtgaggctgggcag

SEQ ID NO: 5804806 - DNA, 13 bp, Homo sapiens
tgggtgatcagaa

SEQ ID NO: 5804807 - DNA, 20 bp, Homo sapiens
tgggtgattcctaagccact

SEQ ID NO: 5804808 - DNA, 19 bp, Homo sapiens
tgggtgattcctcccagga

SEQ ID NO: 5804809 - DNA, 22 bp, Homo sapiens
tgggtgcagctgggcttggcct

SEQ ID NO: 5804810 - DNA, 22 bp, Homo sapiens
tgggtgccatgtggagtggaca

SEQ ID NO: 5804811 - DNA, 15 bp, Homo sapiens
tgggtgcccacagcc

SEQ ID NO: 5804812 - DNA, 23 bp, Homo sapiens
tgggtgcccacagcccgcatgca

SEQ ID NO: 5804813 - DNA, 15 bp, Homo sapiens
tgggtgccccaggga

SEQ ID NO: 5804814 - DNA, 15 bp, Homo sapiens
tgggtgccctctcca

SEQ ID NO: 5804815 - DNA, 12 bp, Homo sapiens
tgggtgccctga

SEQ ID NO: 5804816 - DNA, 16 bp, Homo sapiens
tgggtgcctaggcctg

SEQ ID NO: 5804817 - DNA, 17 bp, Homo sapiens
tgggtgcctaggcctgg

SEQ ID NO: 5804818 - DNA, 18 bp, Homo sapiens
tgggtgcctcctccccag

SEQ ID NO: 5804819 - DNA, 21 bp, Homo sapiens
tgggtgcctcctccccaggtg

SEQ ID NO: 5804820 - DNA, 18 bp, Homo sapiens
tggtaaatactgtgaaat

SEQ ID NO: 5804821 - DNA, 14 bp, Homo sapiens
tggtaaattgtaaa

SEQ ID NO: 5804822 - DNA, 16 bp, Homo sapiens
tggtaaatttccccaa

SEQ ID NO: 5804823 - DNA, 19 bp, Homo sapiens
tggtaaatttccccaacag

SEQ ID NO: 5804824 - DNA, 18 bp, Homo sapiens
tggtaaatttttgaaaaa

SEQ ID NO: 5804825 - DNA, 16 bp, Homo sapiens
tggtaacaagaggagc

SEQ ID NO: 5804826 - DNA, 23 bp, Homo sapiens
tggtaacaagaggagcaggaagc

SEQ ID NO: 5804827 - DNA, 13 bp, Homo sapiens
tggtaacagctat

SEQ ID NO: 5804828 - DNA, 18 bp, Homo sapiens
tggtaacagttcatgttt

SEQ ID NO: 5804829 - DNA, 18 bp, Homo sapiens
tggtaaccagccacagta

SEQ ID NO: 5804830 - DNA, 20 bp, Homo sapiens
tggtaacgaatttaaaatgt

SEQ ID NO: 5804831 - DNA, 21 bp, Homo sapiens
tggtaacgaatttaaaatgta

SEQ ID NO: 5804832 - DNA, 24 bp, Homo sapiens
tggtaacgaatttaaaatgtagtt

SEQ ID NO: 5804833 - DNA, 20 bp, Homo sapiens
tggtaacgctctatctggtt

SEQ ID NO: 5804834 - DNA, 20 bp, Homo sapiens
tggtaactgcacctgggcag

SEQ ID NO: 5804835 - DNA, 17 bp, Homo sapiens
tggtaactgccagcctt

SEQ ID NO: 5804836 - DNA, 17 bp, Homo sapiens
tggtaacttctttgaag

SEQ ID NO: 5804837 - DNA, 18 bp, Homo sapiens
tggtaactttatttaaaa

SEQ ID NO: 5804838 - DNA, 20 bp, Homo sapiens
tggtaactttgcaggcggcc

SEQ ID NO: 5804839 - DNA, 12 bp, Homo sapiens
tggtaacttttg

SEQ ID NO: 5804840 - DNA, 18 bp, Homo sapiens
tggtaacttttgtagtct

SEQ ID NO: 5804841 - DNA, 14 bp, Homo sapiens
tggtaacttttgtg

SEQ ID NO: 5804842 - DNA, 24 bp, Homo sapiens
tggtaacttttgtgaattaggctg

SEQ ID NO: 5804843 - DNA, 13 bp, Homo sapiens
tggtaagaaaaag

SEQ ID NO: 5804844 - DNA, 17 bp, Homo sapiens
tggtaagaaaaagcaaa

SEQ ID NO: 5804845 - DNA, 23 bp, Homo sapiens
tggtaagaaaaagcaaaaggcat

SEQ ID NO: 5804846 - DNA, 15 bp, Homo sapiens
tggtaagacctctga

SEQ ID NO: 5804847 - DNA, 14 bp, Homo sapiens
tggtaagagaatgt

SEQ ID NO: 5804848 - DNA, 21 bp, Homo sapiens
tggtaagagtcacaatttgca

SEQ ID NO: 5804849 - DNA, 19 bp, Homo sapiens
tggtaagagttaaagagta

SEQ ID NO: 5804850 - DNA, 17 bp, Homo sapiens
tggtaagatgactctga

SEQ ID NO: 5804851 - DNA, 19 bp, Homo sapiens
tggtaagatgactctgaga

SEQ ID NO: 5804852 - DNA, 18 bp, Homo sapiens
tggtaagatgtcttgaaa

SEQ ID NO: 5804853 - DNA, 12 bp, Homo sapiens
tggtaagattgt

SEQ ID NO: 5804854 - DNA, 13 bp, Homo sapiens
tggtaagcagagg

SEQ ID NO: 5804855 - DNA, 16 bp, Homo sapiens
tggtaagcgatttgaa

SEQ ID NO: 5804856 - DNA, 17 bp, Homo sapiens
tggtaagctatgtccca

SEQ ID NO: 5804857 - DNA, 15 bp, Homo sapiens
tggtaagctctggct

SEQ ID NO: 5804858 - DNA, 19 bp, Homo sapiens
tggtaagcttccaggaaaa

SEQ ID NO: 5804859 - DNA, 20 bp, Homo sapiens
tggtaagcttccaggaaaaa

SEQ ID NO: 5804860 - DNA, 19 bp, Homo sapiens
tggtaaggcctctggactg

SEQ ID NO: 5804861 - DNA, 13 bp, Homo sapiens
tggtaagggaaaa

SEQ ID NO: 5804862 - DNA, 21 bp, Homo sapiens
tggtaagggaccttcagggag

SEQ ID NO: 5804863 - DNA, 14 bp, Homo sapiens
tggtaagtggcttt

SEQ ID NO: 5804864 - DNA, 16 bp, Homo sapiens
tggtaataagggaaaa

SEQ ID NO: 5804865 - DNA, 15 bp, Homo sapiens
tggtaatagaatagc

SEQ ID NO: 5804866 - DNA, 21 bp, Homo sapiens
tggtaatcccctaaaataaca

SEQ ID NO: 5804867 - DNA, 18 bp, Homo sapiens
tggtaatcctcttctaaa

SEQ ID NO: 5804868 - DNA, 15 bp, Homo sapiens
tggtaatcttgctct

SEQ ID NO: 5804869 - DNA, 17 bp, Homo sapiens
tggtaatctttacctgt

SEQ ID NO: 5804870 - DNA, 17 bp, Homo sapiens
tggtaatgacagatgca

SEQ ID NO: 5804871 - DNA, 10 bp, Homo sapiens
tggtaattat

SEQ ID NO: 5804872 - DNA, 14 bp, Homo sapiens
tggtaattgtacta

SEQ ID NO: 5804873 - DNA, 19 bp, Homo sapiens
tggtaatttagtgtatatg

SEQ ID NO: 5804874 - DNA, 15 bp, Homo sapiens
tggtaatttctactt

SEQ ID NO: 5804875 - DNA, 13 bp, Homo sapiens
tggtaatttttgt

SEQ ID NO: 5804876 - DNA, 17 bp, Homo sapiens
tggtaatttttgtacat

SEQ ID NO: 5804877 - DNA, 15 bp, Homo sapiens
tggtacaaaaataaa

SEQ ID NO: 5804878 - DNA, 18 bp, Homo sapiens
tggtacaaaaataaattt

SEQ ID NO: 5804879 - DNA, 19 bp, Homo sapiens
tggtacaaaaataaattta

SEQ ID NO: 5804880 - DNA, 15 bp, Homo sapiens
tggtacaaatgtgat

SEQ ID NO: 5804881 - DNA, 20 bp, Homo sapiens
tggtacaaattgttcatgtt

SEQ ID NO: 5804882 - DNA, 20 bp, Homo sapiens
tggtacaacggaggcctgcg

SEQ ID NO: 5804883 - DNA, 18 bp, Homo sapiens
tggtacaatctggctcac

SEQ ID NO: 5804884 - DNA, 19 bp, Homo sapiens
tggtacaatctggctcact

SEQ ID NO: 5804885 - DNA, 14 bp, Homo sapiens
tggtacacatgtgt

SEQ ID NO: 5804886 - DNA, 16 bp, Homo sapiens
tggtacacatgtgtta

SEQ ID NO: 5804887 - DNA, 11 bp, Homo sapiens
tggtacagaga

SEQ ID NO: 5804888 - DNA, 13 bp, Homo sapiens
tggtacagagaag

SEQ ID NO: 5804889 - DNA, 15 bp, Homo sapiens
tggtacagagaagcc

SEQ ID NO: 5804890 - DNA, 20 bp, Homo sapiens
tggtacagcagggtcttgct

SEQ ID NO: 5804891 - DNA, 19 bp, Homo sapiens
tggtacagttgcaggagcg

SEQ ID NO: 5804892 - DNA, 19 bp, Homo sapiens
tggtacataggcttctatt

SEQ ID NO: 5804893 - DNA, 14 bp, Homo sapiens
tggtacatctacct

SEQ ID NO: 5804894 - DNA, 23 bp, Homo sapiens
tggtacatgcctgtaatcccagc

SEQ ID NO: 5804895 - DNA, 15 bp, Homo sapiens
tggtacatggtgttt

SEQ ID NO: 5804896 - DNA, 18 bp, Homo sapiens
tggtacatggtgtttgtg

SEQ ID NO: 5804897 - DNA, 17 bp, Homo sapiens
tggtacatgtcttccat

SEQ ID NO: 5804898 - DNA, 23 bp, Homo sapiens
tggtaccaggcccgcactggggg

SEQ ID NO: 5804899 - DNA, 18 bp, Homo sapiens
tggtaccaggtctcctcc

SEQ ID NO: 5804900 - DNA, 22 bp, Homo sapiens
tggtacccagccatctgcccag

SEQ ID NO: 5804901 - DNA, 15 bp, Homo sapiens
tggtacccccccttt

SEQ ID NO: 5804902 - DNA, 18 bp, Homo sapiens
tggtacccccccttttct

SEQ ID NO: 5804903 - DNA, 17 bp, Homo sapiens
tggtacccccttctggg

SEQ ID NO: 5804904 - DNA, 20 bp, Homo sapiens
tggtacccccttctgggcat

SEQ ID NO: 5804905 - DNA, 15 bp, Homo sapiens
tggtaccctggcaga

SEQ ID NO: 5804906 - DNA, 15 bp, Homo sapiens
tggtacctatttgac

SEQ ID NO: 5804907 - DNA, 14 bp, Homo sapiens
tggtacctgccctc

SEQ ID NO: 5804908 - DNA, 12 bp, Homo sapiens
tggtacctggac

SEQ ID NO: 5804909 - DNA, 15 bp, Homo sapiens
tggtaccttcagccc

SEQ ID NO: 5804910 - DNA, 17 bp, Homo sapiens
tggtaccttcagccctg

SEQ ID NO: 5804911 - DNA, 19 bp, Homo sapiens
tggtaccttcagccctggc

SEQ ID NO: 5804912 - DNA, 21 bp, Homo sapiens
tggtaccttcagccctggcca

SEQ ID NO: 5804913 - DNA, 19 bp, Homo sapiens
tggtacctttctagcctta

SEQ ID NO: 5804914 - DNA, 20 bp, Homo sapiens
tggtacctttctagccttag

SEQ ID NO: 5804915 - DNA, 19 bp, Homo sapiens
tggtacgaatctcatccct

SEQ ID NO: 5804916 - DNA, 20 bp, Homo sapiens
tggtacgtgaccctctgctg

SEQ ID NO: 5804917 - DNA, 16 bp, Homo sapiens
tggtactaactttcct

SEQ ID NO: 5804918 - DNA, 15 bp, Homo sapiens
tggtactaaggagaa

SEQ ID NO: 5804919 - DNA, 19 bp, Homo sapiens
tggtactaatgaaatttac

SEQ ID NO: 5804920 - DNA, 16 bp, Homo sapiens
tggtactaccccagcc

SEQ ID NO: 5804921 - DNA, 19 bp, Homo sapiens
tggtactcccccagccctc

SEQ ID NO: 5804922 - DNA, 19 bp, Homo sapiens
tggtactctaatcagtcct

SEQ ID NO: 5804923 - DNA, 15 bp, Homo sapiens
tggtactctgtgaaa

SEQ ID NO: 5804924 - DNA, 18 bp, Homo sapiens
tggtactgtagcagggga

SEQ ID NO: 5804925 - DNA, 20 bp, Homo sapiens
tggtacttacccttctacaa

SEQ ID NO: 5804926 - DNA, 17 bp, Homo sapiens
tggtacttattactgct

SEQ ID NO: 5804927 - DNA, 22 bp, Homo sapiens
tggtacttcctctgtgaactgt

SEQ ID NO: 5804928 - DNA, 22 bp, Homo sapiens
tggtacttgagggatgcccgct

SEQ ID NO: 5804929 - DNA, 19 bp, Homo sapiens
tggtacttgctgctatttt

SEQ ID NO: 5804930 - DNA, 15 bp, Homo sapiens
tggtacttggcacca

SEQ ID NO: 5804931 - DNA, 22 bp, Homo sapiens
tggtacttggcaccaataaagg

SEQ ID NO: 5804932 - DNA, 24 bp, Homo sapiens
tggtacttgtttcaccatacttca

SEQ ID NO: 5804933 - DNA, 21 bp, Homo sapiens
tggtactttattcttgctggg

SEQ ID NO: 5804934 - DNA, 15 bp, Homo sapiens
tggtactttctgtac

SEQ ID NO: 5804935 - DNA, 16 bp, Homo sapiens
tggtactttgcagctg

SEQ ID NO: 5804936 - DNA, 19 bp, Homo sapiens
tggtacttttatgatgtat

SEQ ID NO: 5804937 - DNA, 21 bp, Homo sapiens
tggtacttttatgatgtatat

SEQ ID NO: 5804938 - DNA, 23 bp, Homo sapiens
tggtacttttatgatgtatattt

SEQ ID NO: 5804939 - DNA, 20 bp, Homo sapiens
tggtagaaaaaggggcctga

SEQ ID NO: 5804940 - DNA, 21 bp, Homo sapiens
tggtagaaaatgcaccaaata

SEQ ID NO: 5804941 - DNA, 16 bp, Homo sapiens
tggtagaatcattttt

SEQ ID NO: 5804942 - DNA, 20 bp, Homo sapiens
tggtagaattggagagtaaa

SEQ ID NO: 5804943 - DNA, 22 bp, Homo sapiens
tggtagacgagctgtctgctgc

SEQ ID NO: 5804944 - DNA, 15 bp, Homo sapiens
tggtagactaggttt

SEQ ID NO: 5804945 - DNA, 12 bp, Homo sapiens
tggtagagagag

SEQ ID NO: 5804946 - DNA, 13 bp, Homo sapiens
tggtagaggcctg

SEQ ID NO: 5804947 - DNA, 18 bp, Homo sapiens
tggtagatgttcttttct

SEQ ID NO: 5804948 - DNA, 15 bp, Homo sapiens
tggtagattaaatat

SEQ ID NO: 5804949 - DNA, 17 bp, Homo sapiens
tggtagattaaatatag

SEQ ID NO: 5804950 - DNA, 15 bp, Homo sapiens
tggtagcaaattttg

SEQ ID NO: 5804951 - DNA, 16 bp, Homo sapiens
tggtagcactttaaaa

SEQ ID NO: 5804952 - DNA, 19 bp, Homo sapiens
tggtagcagataaagacag

SEQ ID NO: 5804953 - DNA, 14 bp, Homo sapiens
tggtagcagcaggc

SEQ ID NO: 5804954 - DNA, 21 bp, Homo sapiens
tggtagcataaataaaactga

SEQ ID NO: 5804955 - DNA, 16 bp, Homo sapiens
tggtagcatgaccttt

SEQ ID NO: 5804956 - DNA, 12 bp, Homo sapiens
tggtagcatttt

SEQ ID NO: 5804957 - DNA, 19 bp, Homo sapiens
tggtagcattttaaacaaa

SEQ ID NO: 5804958 - DNA, 20 bp, Homo sapiens
tggtagccatcaagcacttc

SEQ ID NO: 5804959 - DNA, 22 bp, Homo sapiens
tggtagctagtgatttacacag

SEQ ID NO: 5804960 - DNA, 19 bp, Homo sapiens
tggtagctctgaagggagg

SEQ ID NO: 5804961 - DNA, 18 bp, Homo sapiens
tggtagctctgagccctc

SEQ ID NO: 5804962 - DNA, 20 bp, Homo sapiens
tggtagctgggaaagcataa

SEQ ID NO: 5804963 - DNA, 20 bp, Homo sapiens
tggtagcttttactttttat

SEQ ID NO: 5804964 - DNA, 20 bp, Homo sapiens
tggtagcttttcccttcttt

SEQ ID NO: 5804965 - DNA, 21 bp, Homo sapiens
tggtagcttttcccttctttt

SEQ ID NO: 5804966 - DNA, 20 bp, Homo sapiens
tggtaggaactgctgggctt

SEQ ID NO: 5804967 - DNA, 17 bp, Homo sapiens
tggtaggaagcctgagg

SEQ ID NO: 5804968 - DNA, 20 bp, Homo sapiens
tggtaggaatgcttccgaga

SEQ ID NO: 5804969 - DNA, 17 bp, Homo sapiens
tggtaggactgtagaaa

SEQ ID NO: 5804970 - DNA, 22 bp, Homo sapiens
tggtaggagttttgttccagag

SEQ ID NO: 5804971 - DNA, 16 bp, Homo sapiens
tggtaggcatttccta

SEQ ID NO: 5804972 - DNA, 18 bp, Homo sapiens
tggtaggccttttaacat

SEQ ID NO: 5804973 - DNA, 16 bp, Homo sapiens
tggtaggggagggcag

SEQ ID NO: 5804974 - DNA, 17 bp, Homo sapiens
tggtaggggagggcagg

SEQ ID NO: 5804975 - DNA, 23 bp, Homo sapiens
tggtaggggagggcaggcttggg

SEQ ID NO: 5804976 - DNA, 14 bp, Homo sapiens
tggtaggggcaggg

SEQ ID NO: 5804977 - DNA, 19 bp, Homo sapiens
tggtagggggaaaatgtgt

SEQ ID NO: 5804978 - DNA, 13 bp, Homo sapiens
tggtaggtctgga

SEQ ID NO: 5804979 - DNA, 19 bp, Homo sapiens
tggtagtaaaacacagagg

SEQ ID NO: 5804980 - DNA, 18 bp, Homo sapiens
tggtagtacccagggcca

SEQ ID NO: 5804981 - DNA, 21 bp, Homo sapiens
tggtagtatcaacttcccagt

SEQ ID NO: 5804982 - DNA, 15 bp, Homo sapiens
tggtagtatctcgta

SEQ ID NO: 5804983 - DNA, 16 bp, Homo sapiens
tggtagtatctcgtaa

SEQ ID NO: 5804984 - DNA, 18 bp, Homo sapiens
tggtagtcctcccaagct

SEQ ID NO: 5804985 - DNA, 20 bp, Homo sapiens
tggtagtcctcccaagctgt

SEQ ID NO: 5804986 - DNA, 21 bp, Homo sapiens
tggtagtcctcccaagctgtg

SEQ ID NO: 5804987 - DNA, 22 bp, Homo sapiens
tggtagtctaaccaaatgcatc

SEQ ID NO: 5804988 - DNA, 22 bp, Homo sapiens
tggtagtggaatagtgaatact

SEQ ID NO: 5804989 - DNA, 20 bp, Homo sapiens
tggtagtggttgtatctgtg

SEQ ID NO: 5804990 - DNA, 21 bp, Homo sapiens
tggtagtgtagctgtgtggct

SEQ ID NO: 5804991 - DNA, 18 bp, Homo sapiens
tggtagttagtagcatgt

SEQ ID NO: 5804992 - DNA, 14 bp, Homo sapiens
tggtagttctgtgc

SEQ ID NO: 5804993 - DNA, 12 bp, Homo sapiens
tggtagtttaaa

SEQ ID NO: 5804994 - DNA, 13 bp, Homo sapiens
tggtagtttaaaa

SEQ ID NO: 5804995 - DNA, 14 bp, Homo sapiens
tggtagtttctgtg

SEQ ID NO: 5804996 - DNA, 15 bp, Homo sapiens
tggtagtttctgtgg

SEQ ID NO: 5804997 - DNA, 21 bp, Homo sapiens
tggtgatcctctattttgtga

SEQ ID NO: 5804998 - DNA, 21 bp, Homo sapiens
tggtgatctgtagacttctgg

SEQ ID NO: 5804999 - DNA, 13 bp, Homo sapiens
tggtgatgactta

SEQ ID NO: 5805000 - DNA, 18 bp, Homo sapiens
tggtgatgcaagtcacta

SEQ ID NO: 5805001 - DNA, 14 bp, Homo sapiens
tggtgatgcagtct

SEQ ID NO: 5805002 - DNA, 14 bp, Homo sapiens
tggtgatgtaaaaa

SEQ ID NO: 5805003 - DNA, 15 bp, Homo sapiens
tggtgatgtgcctgt

SEQ ID NO: 5805004 - DNA, 19 bp, Homo sapiens
tggtgattaaggtcctgct

SEQ ID NO: 5805005 - DNA, 17 bp, Homo sapiens
tggtgattcctgggaag

SEQ ID NO: 5805006 - DNA, 12 bp, Homo sapiens
tggtgattttaa

SEQ ID NO: 5805007 - DNA, 15 bp, Homo sapiens
tggtgattttaaatg

SEQ ID NO: 5805008 - DNA, 16 bp, Homo sapiens
tggtgattttaaatgt

SEQ ID NO: 5805009 - DNA, 18 bp, Homo sapiens
tggtgattttaaatgtgt

SEQ ID NO: 5805010 - DNA, 19 bp, Homo sapiens
tggtgattttaaatgtgtg

SEQ ID NO: 5805011 - DNA, 13 bp, Homo sapiens
tggtgcaaaaaaa

SEQ ID NO: 5805012 - DNA, 11 bp, Homo sapiens
tggtgcaaaga

SEQ ID NO: 5805013 - DNA, 14 bp, Homo sapiens
tggtgcaaatccta

SEQ ID NO: 5805014 - DNA, 16 bp, Homo sapiens
tggtgcaaattcagaa

SEQ ID NO: 5805015 - DNA, 18 bp, Homo sapiens
tggtgcaaattcagaact

SEQ ID NO: 5805016 - DNA, 21 bp, Homo sapiens
tggtgcaagtagcacatggtt

SEQ ID NO: 5805017 - DNA, 19 bp, Homo sapiens
tggtgcaagttgaggactt

SEQ ID NO: 5805018 - DNA, 17 bp, Homo sapiens
tggtgcaattaactctg

SEQ ID NO: 5805019 - DNA, 19 bp, Homo sapiens
tggtgcacagattgctgaa

SEQ ID NO: 5805020 - DNA, 18 bp, Homo sapiens
tggtgcacaggtttgttt

SEQ ID NO: 5805021 - DNA, 23 bp, Homo sapiens
tggtgcacaggtttgttttttca

SEQ ID NO: 5805022 - DNA, 15 bp, Homo sapiens
tggtgcacagtgatt

SEQ ID NO: 5805023 - DNA, 16 bp, Homo sapiens
tggtgcacgcctgagc

SEQ ID NO: 5805024 - DNA, 17 bp, Homo sapiens
tggtgcactttgtaaat

SEQ ID NO: 5805025 - DNA, 13 bp, Homo sapiens
tggtgcagacaga

SEQ ID NO: 5805026 - DNA, 22 bp, Homo sapiens
tggtgcagacagaagtctcctc

SEQ ID NO: 5805027 - DNA, 17 bp, Homo sapiens
tggtgcagagaagctgg

SEQ ID NO: 5805028 - DNA, 19 bp, Homo sapiens
tggtgcagaggtgagcaga

SEQ ID NO: 5805029 - DNA, 14 bp, Homo sapiens
tggtgcagccccag

SEQ ID NO: 5805030 - DNA, 15 bp, Homo sapiens
tggtgcagccttccc

SEQ ID NO: 5805031 - DNA, 18 bp, Homo sapiens
tggtgcagccttcccctc

SEQ ID NO: 5805032 - DNA, 19 bp, Homo sapiens
tggtgcagccttcccctcc

SEQ ID NO: 5805033 - DNA, 17 bp, Homo sapiens
tggtgcaggatggcttt

SEQ ID NO: 5805034 - DNA, 17 bp, Homo sapiens
tggtgcagggcctccat

SEQ ID NO: 5805035 - DNA, 23 bp, Homo sapiens
tggtgcaggtagacctgtctcct

SEQ ID NO: 5805036 - DNA, 15 bp, Homo sapiens
tggtgcaggtctcca

SEQ ID NO: 5805037 - DNA, 14 bp, Homo sapiens
tggtgcagtaacca

SEQ ID NO: 5805038 - DNA, 17 bp, Homo sapiens
tggtgcatagcagatgg

SEQ ID NO: 5805039 - DNA, 20 bp, Homo sapiens
tggtgcataggtctggaagg

SEQ ID NO: 5805040 - DNA, 17 bp, Homo sapiens
tggtgcatgcagttgat

SEQ ID NO: 5805041 - DNA, 13 bp, Homo sapiens
tggtgcatgggct

SEQ ID NO: 5805042 - DNA, 14 bp, Homo sapiens
tggtgcatgttctt

SEQ ID NO: 5805043 - DNA, 10 bp, Homo sapiens
tggtgcatta

SEQ ID NO: 5805044 - DNA, 11 bp, Homo sapiens
tggtgcattcg

SEQ ID NO: 5805045 - DNA, 16 bp, Homo sapiens
tggtgcattctgtttc

SEQ ID NO: 5805046 - DNA, 15 bp, Homo sapiens
tggtgcattgctgtg

SEQ ID NO: 5805047 - DNA, 16 bp, Homo sapiens
tggtgcattgctgtgt

SEQ ID NO: 5805048 - DNA, 20 bp, Homo sapiens
tggtgcattgttatttaata

SEQ ID NO: 5805049 - DNA, 19 bp, Homo sapiens
tggtgccaaatagccccag

SEQ ID NO: 5805050 - DNA, 20 bp, Homo sapiens
tggtgccaatggaacctcct

SEQ ID NO: 5805051 - DNA, 15 bp, Homo sapiens
tggtgccaatttcaa

SEQ ID NO: 5805052 - DNA, 18 bp, Homo sapiens
tggtgccacaaataaaat

SEQ ID NO: 5805053 - DNA, 20 bp, Homo sapiens
tggtgccacaaataaaatgg

SEQ ID NO: 5805054 - DNA, 10 bp, Homo sapiens
tggtgccacc

SEQ ID NO: 5805055 - DNA, 15 bp, Homo sapiens
tggtgccagggtggg

SEQ ID NO: 5805056 - DNA, 23 bp, Homo sapiens
tggtgccagggtgggtgtccatg

SEQ ID NO: 5805057 - DNA, 21 bp, Homo sapiens
tggtgccatccccagggggca

SEQ ID NO: 5805058 - DNA, 15 bp, Homo sapiens
tggtgcccacagcag

SEQ ID NO: 5805059 - DNA, 18 bp, Homo sapiens
tggtgcccaccagctggc

SEQ ID NO: 5805060 - DNA, 22 bp, Homo sapiens
tggtgcccagactcaaggcctc

SEQ ID NO: 5805061 - DNA, 17 bp, Homo sapiens
tggtgcccatcctcccg

SEQ ID NO: 5805062 - DNA, 20 bp, Homo sapiens
tggtgccccacctgcctggt

SEQ ID NO: 5805063 - DNA, 22 bp, Homo sapiens
tggtgccccacctgcctggtgc

SEQ ID NO: 5805064 - DNA, 18 bp, Homo sapiens
tggtgccccaggaccagc

SEQ ID NO: 5805065 - DNA, 23 bp, Homo sapiens
tggtgcccccagacagctgctca

SEQ ID NO: 5805066 - DNA, 15 bp, Homo sapiens
tggtgcccctcgcca

SEQ ID NO: 5805067 - DNA, 17 bp, Homo sapiens
tggtgcccctgctcact

SEQ ID NO: 5805068 - DNA, 23 bp, Homo sapiens
tggtgcccctgctcactgggccc

SEQ ID NO: 5805069 - DNA, 14 bp, Homo sapiens
tggtgccctcgcct

SEQ ID NO: 5805070 - DNA, 16 bp, Homo sapiens
tggtgccctgctttca

SEQ ID NO: 5805071 - DNA, 19 bp, Homo sapiens
tggtgccctgctttcagat

SEQ ID NO: 5805072 - DNA, 20 bp, Homo sapiens
tggtgccctgctttcagata

SEQ ID NO: 5805073 - DNA, 20 bp, Homo sapiens
tggtgccctggcccagcctg

SEQ ID NO: 5805074 - DNA, 21 bp, Homo sapiens
tggtgccctggcccagcctgt

SEQ ID NO: 5805075 - DNA, 20 bp, Homo sapiens
tggtgccctggtggcctgcc

SEQ ID NO: 5805076 - DNA, 18 bp, Homo sapiens
tggtgcccttccctggag

SEQ ID NO: 5805077 - DNA, 13 bp, Homo sapiens
tggtgcccttgga

SEQ ID NO: 5805078 - DNA, 16 bp, Homo sapiens
tggtgccgaagtgttt

SEQ ID NO: 5805079 - DNA, 21 bp, Homo sapiens
tggtgcctatctgcctggagg

SEQ ID NO: 5805080 - DNA, 22 bp, Homo sapiens
tggtgcctcactgggggctttg

SEQ ID NO: 5805081 - DNA, 18 bp, Homo sapiens
tggtgcctctcttggctc

SEQ ID NO: 5805082 - DNA, 21 bp, Homo sapiens
tggtgcctctggaggcctctg

SEQ ID NO: 5805083 - DNA, 14 bp, Homo sapiens
tggtgcctctgtgc

SEQ ID NO: 5805084 - DNA, 10 bp, Homo sapiens
tggtgcctga

SEQ ID NO: 5805085 - DNA, 19 bp, Homo sapiens
tggtgcctgaagaccccag

SEQ ID NO: 5805086 - DNA, 13 bp, Homo sapiens
tggtgcctgagag

SEQ ID NO: 5805087 - DNA, 17 bp, Homo sapiens
tggtgcctgagaggcag

SEQ ID NO: 5805088 - DNA, 19 bp, Homo sapiens
tggtgcctgagaggcaggc

SEQ ID NO: 5805089 - DNA, 17 bp, Homo sapiens
tggtgcctgagcccctc

SEQ ID NO: 5805090 - DNA, 14 bp, Homo sapiens
tggtgcctgccacc

SEQ ID NO: 5805091 - DNA, 22 bp, Homo sapiens
tggtgcctggcctggcacacat

SEQ ID NO: 5805092 - DNA, 24 bp, Homo sapiens
tggtgcctggcctggcacacatca

SEQ ID NO: 5805093 - DNA, 11 bp, Homo sapiens
tggtgccttca

SEQ ID NO: 5805094 - DNA, 14 bp, Homo sapiens
tggtgcgacccccc

SEQ ID NO: 5805095 - DNA, 15 bp, Homo sapiens
tggtgcgacccccca

SEQ ID NO: 5805096 - DNA, 17 bp, Homo sapiens
tggtgcgaccccccacc

SEQ ID NO: 5805097 - DNA, 22 bp, Homo sapiens
tggtgcggctggccatggagaa

SEQ ID NO: 5805098 - DNA, 16 bp, Homo sapiens
tggtgcgggcctggcc

SEQ ID NO: 5805099 - DNA, 19 bp, Homo sapiens
tggtgcggtaggtgctggc

SEQ ID NO: 5805100 - DNA, 22 bp, Homo sapiens
tggtgcgtttataattggctta

SEQ ID NO: 5805101 - DNA, 19 bp, Homo sapiens
tggtgctaaagattgttaa

SEQ ID NO: 5805102 - DNA, 15 bp, Homo sapiens
tggtgctaaaggagg

SEQ ID NO: 5805103 - DNA, 17 bp, Homo sapiens
tggtgctaatattttat

SEQ ID NO: 5805104 - DNA, 21 bp, Homo sapiens
tggtgctaatattttatttga

SEQ ID NO: 5805105 - DNA, 16 bp, Homo sapiens
tggtgctacgcctgca

SEQ ID NO: 5805106 - DNA, 23 bp, Homo sapiens
tggtgctataggctggagaagct

SEQ ID NO: 5805107 - DNA, 16 bp, Homo sapiens
tggtgctatttaacat

SEQ ID NO: 5805108 - DNA, 13 bp, Homo sapiens
tggtgctatttga

SEQ ID NO: 5805109 - DNA, 15 bp, Homo sapiens
tggtgctatttgaag

SEQ ID NO: 5805110 - DNA, 16 bp, Homo sapiens
tggtgctatttgaaga

SEQ ID NO: 5805111 - DNA, 20 bp, Homo sapiens
tggtgctatttgaagaaaaa

SEQ ID NO: 5805112 - DNA, 22 bp, Homo sapiens
tggtgctatttgaagaaaaaaa

SEQ ID NO: 5805113 - DNA, 21 bp, Homo sapiens
tggtgctcaccatgcttccag

SEQ ID NO: 5805114 - DNA, 17 bp, Homo sapiens
tggtgctcacgtgtcct

SEQ ID NO: 5805115 - DNA, 11 bp, Homo sapiens
tggtgctcagt

SEQ ID NO: 5805116 - DNA, 14 bp, Homo sapiens
tggtgctcatttca

SEQ ID NO: 5805117 - DNA, 14 bp, Homo sapiens
tggtgctcctgccc

SEQ ID NO: 5805118 - DNA, 15 bp, Homo sapiens
tggtgctcctgccca

SEQ ID NO: 5805119 - DNA, 20 bp, Homo sapiens
tggtgctcctgcccagccac

SEQ ID NO: 5805120 - DNA, 15 bp, Homo sapiens
tggtgctctctgcca

SEQ ID NO: 5805121 - DNA, 22 bp, Homo sapiens
tggtgctctgtgttcccagagg

SEQ ID NO: 5805122 - DNA, 15 bp, Homo sapiens
tggtgctcttgcttt

SEQ ID NO: 5805123 - DNA, 13 bp, Homo sapiens
tggtgctgacctc

SEQ ID NO: 5805124 - DNA, 15 bp, Homo sapiens
tggtgctgagaagct

SEQ ID NO: 5805125 - DNA, 20 bp, Homo sapiens
tggtgctgcacccctggtgt

SEQ ID NO: 5805126 - DNA, 16 bp, Homo sapiens
tggtgctgccgagggc

SEQ ID NO: 5805127 - DNA, 12 bp, Homo sapiens
tggtgctggata

SEQ ID NO: 5805128 - DNA, 18 bp, Homo sapiens
tggtgctggatattttca

SEQ ID NO: 5805129 - DNA, 19 bp, Homo sapiens
tggtgctgggactgagcca

SEQ ID NO: 5805130 - DNA, 21 bp, Homo sapiens
tggtgctgggactgagccagt

SEQ ID NO: 5805131 - DNA, 23 bp, Homo sapiens
tggtgctgtcttttgttctctga

SEQ ID NO: 5805132 - DNA, 12 bp, Homo sapiens
tggtgctgtggc

SEQ ID NO: 5805133 - DNA, 14 bp, Homo sapiens
tggtgctgtgtgcc

SEQ ID NO: 5805134 - DNA, 17 bp, Homo sapiens
tggtgctgtgtgcccca

SEQ ID NO: 5805135 - DNA, 19 bp, Homo sapiens
tggtgctgtgtgccccact

SEQ ID NO: 5805136 - DNA, 23 bp, Homo sapiens
tggtgctgtgtgccccactccag

SEQ ID NO: 5805137 - DNA, 11 bp, Homo sapiens
tggtgctgttg

SEQ ID NO: 5805138 - DNA, 13 bp, Homo sapiens
tggtgctgtttaa

SEQ ID NO: 5805139 - DNA, 16 bp, Homo sapiens
tggtgcttaagttcca

SEQ ID NO: 5805140 - DNA, 11 bp, Homo sapiens
tggtgcttcag

SEQ ID NO: 5805141 - DNA, 16 bp, Homo sapiens
tggtgcttcagccctg

SEQ ID NO: 5805142 - DNA, 18 bp, Homo sapiens
tggtgcttcagccctggc

SEQ ID NO: 5805143 - DNA, 23 bp, Homo sapiens
tggtgcttcccccacccctccac

SEQ ID NO: 5805144 - DNA, 14 bp, Homo sapiens
tggtgcttgactct

SEQ ID NO: 5805145 - DNA, 22 bp, Homo sapiens
tggtgcttgggagagtcaggca

SEQ ID NO: 5805146 - DNA, 18 bp, Homo sapiens
tggtggaaaaaacatttt

SEQ ID NO: 5805147 - DNA, 18 bp, Homo sapiens
tggtggaagaggggacag

SEQ ID NO: 5805148 - DNA, 15 bp, Homo sapiens
tggtggaagtcttgg

SEQ ID NO: 5805149 - DNA, 15 bp, Homo sapiens
tggtggaattcctct

SEQ ID NO: 5805150 - DNA, 19 bp, Homo sapiens
tggtggacagacccagggt

SEQ ID NO: 5805151 - DNA, 20 bp, Homo sapiens
tggtggacagacccagggtg

SEQ ID NO: 5805152 - DNA, 22 bp, Homo sapiens
tggtggacagacccagggtggt

SEQ ID NO: 5805153 - DNA, 22 bp, Homo sapiens
tggtggacagggcccccggcca

SEQ ID NO: 5805154 - DNA, 19 bp, Homo sapiens
tggtggaccacaggcatct

SEQ ID NO: 5805155 - DNA, 17 bp, Homo sapiens
tggtggagccagggcct

SEQ ID NO: 5805156 - DNA, 18 bp, Homo sapiens
tggtggagccagggcctc

SEQ ID NO: 5805157 - DNA, 14 bp, Homo sapiens
tggtggaggagctg

SEQ ID NO: 5805158 - DNA, 18 bp, Homo sapiens
tggtggaggagctgaggg

SEQ ID NO: 5805159 - DNA, 16 bp, Homo sapiens
tggtggaggaggagga

SEQ ID NO: 5805160 - DNA, 20 bp, Homo sapiens
tggtggaggattgctgccag

SEQ ID NO: 5805161 - DNA, 20 bp, Homo sapiens
tggtggagggcacttcaggt

SEQ ID NO: 5805162 - DNA, 12 bp, Homo sapiens
tggtggaggggc

SEQ ID NO: 5805163 - DNA, 23 bp, Homo sapiens
tggtggagtgagagcctttgcct

SEQ ID NO: 5805164 - DNA, 15 bp, Homo sapiens
tggtggatgtaaata

SEQ ID NO: 5805165 - DNA, 21 bp, Homo sapiens
tggtggattgttctagtactg

SEQ ID NO: 5805166 - DNA, 19 bp, Homo sapiens
tggtggcaacattcattgc

SEQ ID NO: 5805167 - DNA, 18 bp, Homo sapiens
tggtggcaaccccagacc

SEQ ID NO: 5805168 - DNA, 17 bp, Homo sapiens
tggtggcactgagcccc

SEQ ID NO: 5805169 - DNA, 19 bp, Homo sapiens
tggtggcactgagcccccc

SEQ ID NO: 5805170 - DNA, 21 bp, Homo sapiens
tggtggcagaatgaaaatcag

SEQ ID NO: 5805171 - DNA, 15 bp, Homo sapiens
tggtggcagagtgga

SEQ ID NO: 5805172 - DNA, 12 bp, Homo sapiens
tggtggcagctc

SEQ ID NO: 5805173 - DNA, 19 bp, Homo sapiens
tggtggcagctcacctctc

SEQ ID NO: 5805174 - DNA, 19 bp, Homo sapiens
tggtggcagtggaggtggg

SEQ ID NO: 5805175 - DNA, 16 bp, Homo sapiens
tggtttttaattttgt

SEQ ID NO: 5805176 - DNA, 20 bp, Homo sapiens
tggtttttactgctctgaga

SEQ ID NO: 5805177 - DNA, 19 bp, Homo sapiens
tggtttttataatattcat

SEQ ID NO: 5805178 - DNA, 17 bp, Homo sapiens
tggtttttatttctcct

SEQ ID NO: 5805179 - DNA, 14 bp, Homo sapiens
tggtttttcagctc

SEQ ID NO: 5805180 - DNA, 13 bp, Homo sapiens
tggtttttctcat

SEQ ID NO: 5805181 - DNA, 20 bp, Homo sapiens
tggtttttctgttccctgct

SEQ ID NO: 5805182 - DNA, 20 bp, Homo sapiens
tggtttttgctctactttat

SEQ ID NO: 5805183 - DNA, 19 bp, Homo sapiens
tggtttttggctctttcag

SEQ ID NO: 5805184 - DNA, 15 bp, Homo sapiens
tggtttttgttgagt

SEQ ID NO: 5805185 - DNA, 15 bp, Homo sapiens
tggttttttttctaa

SEQ ID NO: 5805186 - DNA, 20 bp, Homo sapiens
tggtttttttttttcttaaa

SEQ ID NO: 5805187 - DNA, 21 bp, Homo sapiens
tggtttttttttttttttaaa

SEQ ID NO: 5805188 - DNA, 20 bp, Homo sapiens
tgtaaaaaaaaaaaagttat

SEQ ID NO: 5805189 - DNA, 18 bp, Homo sapiens
tgtaaaaaaaaatgcctt

SEQ ID NO: 5805190 - DNA, 12 bp, Homo sapiens
tgtaaaaaaagc

SEQ ID NO: 5805191 - DNA, 15 bp, Homo sapiens
tgtaaaaaaagcaaa

SEQ ID NO: 5805192 - DNA, 20 bp, Homo sapiens
tgtaaaaaacaaaaaaaaca

SEQ ID NO: 5805193 - DNA, 20 bp, Homo sapiens
tgtaaaaaacaaacatttga

SEQ ID NO: 5805194 - DNA, 13 bp, Homo sapiens
tgtaaaaaagaaa

SEQ ID NO: 5805195 - DNA, 18 bp, Homo sapiens
tgtaaaaaagaaaaaact

SEQ ID NO: 5805196 - DNA, 17 bp, Homo sapiens
tgtaaaaaagaaaaaca

SEQ ID NO: 5805197 - DNA, 14 bp, Homo sapiens
tgtaaaaaagattt

SEQ ID NO: 5805198 - DNA, 13 bp, Homo sapiens
tgtaaaaaagtgt

SEQ ID NO: 5805199 - DNA, 18 bp, Homo sapiens
tgtaaaaaatggaaaaaa

SEQ ID NO: 5805200 - DNA, 14 bp, Homo sapiens
tgtaaaaaatgtaa

SEQ ID NO: 5805201 - DNA, 17 bp, Homo sapiens
tgtaaaaaattcacata

SEQ ID NO: 5805202 - DNA, 13 bp, Homo sapiens
tgtaaaaacaaaa

SEQ ID NO: 5805203 - DNA, 19 bp, Homo sapiens
tgtaaaaacagcattgctt

SEQ ID NO: 5805204 - DNA, 20 bp, Homo sapiens
tgtaaaaacagcattgcttt

SEQ ID NO: 5805205 - DNA, 23 bp, Homo sapiens
tgtaaaaacagcattgctttctg

SEQ ID NO: 5805206 - DNA, 17 bp, Homo sapiens
tgtaaaaactgaagaat

SEQ ID NO: 5805207 - DNA, 22 bp, Homo sapiens
tgtaaaaactgaagaattttga

SEQ ID NO: 5805208 - DNA, 16 bp, Homo sapiens
tgtaaaaagaaattgt

SEQ ID NO: 5805209 - DNA, 20 bp, Homo sapiens
tgtaaaaagcctccttgtgc

SEQ ID NO: 5805210 - DNA, 20 bp, Homo sapiens
tgtaaaaaggaatatgaaag

SEQ ID NO: 5805211 - DNA, 14 bp, Homo sapiens
tgtaaaaagggaaa

SEQ ID NO: 5805212 - DNA, 20 bp, Homo sapiens
tgtaaaaagtagattaaaat

SEQ ID NO: 5805213 - DNA, 19 bp, Homo sapiens
tgtaaaaatactgtttcac

SEQ ID NO: 5805214 - DNA, 11 bp, Homo sapiens
tgtaaaaatat

SEQ ID NO: 5805215 - DNA, 16 bp, Homo sapiens
tgtaaaaatatatatg

SEQ ID NO: 5805216 - DNA, 13 bp, Homo sapiens
tgtaaaaatcact

SEQ ID NO: 5805217 - DNA, 18 bp, Homo sapiens
tgtaaaaatccttttgaa

SEQ ID NO: 5805218 - DNA, 12 bp, Homo sapiens
tgtaaaaatctt

SEQ ID NO: 5805219 - DNA, 11 bp, Homo sapiens
tgtaaaaatga

SEQ ID NO: 5805220 - DNA, 17 bp, Homo sapiens
tgtaaaaatgagaacat

SEQ ID NO: 5805221 - DNA, 14 bp, Homo sapiens
tgtaaaaatgcttc

SEQ ID NO: 5805222 - DNA, 13 bp, Homo sapiens
tgtaaaacaaaaa

SEQ ID NO: 5805223 - DNA, 16 bp, Homo sapiens
tgtaaaacaatgccat

SEQ ID NO: 5805224 - DNA, 22 bp, Homo sapiens
tgtaaaacaatgccatgaacaa

SEQ ID NO: 5805225 - DNA, 13 bp, Homo sapiens
tgtaaaacaggta

SEQ ID NO: 5805226 - DNA, 19 bp, Homo sapiens
tgtaaaacatttattttga

SEQ ID NO: 5805227 - DNA, 19 bp, Homo sapiens
tgtaaaaccctttaaatgt

SEQ ID NO: 5805228 - DNA, 20 bp, Homo sapiens
tgtaaaaccctttaaatgta

SEQ ID NO: 5805229 - DNA, 18 bp, Homo sapiens
tgtaaaacctgtcaatga

SEQ ID NO: 5805230 - DNA, 18 bp, Homo sapiens
tgtaaaactccattcata

SEQ ID NO: 5805231 - DNA, 14 bp, Homo sapiens
tgtaaaactcgctt

SEQ ID NO: 5805232 - DNA, 13 bp, Homo sapiens
tgtaaaactgtga

SEQ ID NO: 5805233 - DNA, 16 bp, Homo sapiens
tgtaaaactgtgacat

SEQ ID NO: 5805234 - DNA, 15 bp, Homo sapiens
tgtaaaacttctgct

SEQ ID NO: 5805235 - DNA, 14 bp, Homo sapiens
tgtaaaactttatt

SEQ ID NO: 5805236 - DNA, 16 bp, Homo sapiens
tgtaaaactttatttt

SEQ ID NO: 5805237 - DNA, 18 bp, Homo sapiens
tgtaaaactttattttat

SEQ ID NO: 5805238 - DNA, 23 bp, Homo sapiens
tgtaaaactttattttatataat

SEQ ID NO: 5805239 - DNA, 19 bp, Homo sapiens
tgtaaaagaacagtaaaca

SEQ ID NO: 5805240 - DNA, 13 bp, Homo sapiens
tgtaaaagacact

SEQ ID NO: 5805241 - DNA, 20 bp, Homo sapiens
tgtaaaagacactggtgtat

SEQ ID NO: 5805242 - DNA, 14 bp, Homo sapiens
tgtaaaagagctgt

SEQ ID NO: 5805243 - DNA, 15 bp, Homo sapiens
tgtaaaagagctgtt

SEQ ID NO: 5805244 - DNA, 15 bp, Homo sapiens
tgtaaaagatgcaga

SEQ ID NO: 5805245 - DNA, 19 bp, Homo sapiens
tgtaaaagcaacatcagct

SEQ ID NO: 5805246 - DNA, 22 bp, Homo sapiens
tgtaaaagcaacatcagcttga

SEQ ID NO: 5805247 - DNA, 12 bp, Homo sapiens
tgtaaaagcaag

SEQ ID NO: 5805248 - DNA, 19 bp, Homo sapiens
tgtaaaagcattttgtaat

SEQ ID NO: 5805249 - DNA, 16 bp, Homo sapiens
tgtaaaaggattatta

SEQ ID NO: 5805250 - DNA, 21 bp, Homo sapiens
tgtaaaaggccaaacctctgt

SEQ ID NO: 5805251 - DNA, 22 bp, Homo sapiens
tgtaaaagtactctgaaaagca

SEQ ID NO: 5805252 - DNA, 19 bp, Homo sapiens
tgtaaaagtgtacagactc

SEQ ID NO: 5805253 - DNA, 18 bp, Homo sapiens
tgtaaaagttactaatat

SEQ ID NO: 5805254 - DNA, 14 bp, Homo sapiens
tgtaaaagttataa

SEQ ID NO: 5805255 - DNA, 20 bp, Homo sapiens
tgtaaaagttataataactg

SEQ ID NO: 5805256 - DNA, 23 bp, Homo sapiens
tgtaaaagttataataactgaac

SEQ ID NO: 5805257 - DNA, 18 bp, Homo sapiens
tgtaaaataaaaccacca

SEQ ID NO: 5805258 - DNA, 15 bp, Homo sapiens
tgtaaaataaaggct

SEQ ID NO: 5805259 - DNA, 14 bp, Homo sapiens
tgtaaaataagtat

SEQ ID NO: 5805260 - DNA, 14 bp, Homo sapiens
tgtaaaatactatt

SEQ ID NO: 5805261 - DNA, 14 bp, Homo sapiens
tgtaaaatagcttg

SEQ ID NO: 5805262 - DNA, 21 bp, Homo sapiens
tgtaaaatagcttgtatagtg

SEQ ID NO: 5805263 - DNA, 15 bp, Homo sapiens
tgtaaaatatgtaaa

SEQ ID NO: 5805264 - DNA, 17 bp, Homo sapiens
tgtaaaatatttataaa

SEQ ID NO: 5805265 - DNA, 19 bp, Homo sapiens
tgtaaaatatttataaatg

SEQ ID NO: 5805266 - DNA, 15 bp, Homo sapiens
tgtaaaatccacagc

SEQ ID NO: 5805267 - DNA, 22 bp, Homo sapiens
tgtaaaatcttgcagttttgta

SEQ ID NO: 5805268 - DNA, 15 bp, Homo sapiens
tgtaaaatcttgtca

SEQ ID NO: 5805269 - DNA, 18 bp, Homo sapiens
tgtaaaatcttgtcatgt

SEQ ID NO: 5805270 - DNA, 20 bp, Homo sapiens
tgtaaaatcttgtcatgtgt

SEQ ID NO: 5805271 - DNA, 22 bp, Homo sapiens
tgtaaaatctttctttcttaga

SEQ ID NO: 5805272 - DNA, 17 bp, Homo sapiens
tgtaaaatgaattgaaa

SEQ ID NO: 5805273 - DNA, 19 bp, Homo sapiens
tgtaaaatgacaatcatgt

SEQ ID NO: 5805274 - DNA, 21 bp, Homo sapiens
tgtaaaatgacaatcatgtgt

SEQ ID NO: 5805275 - DNA, 14 bp, Homo sapiens
tgtaaaatgagttt

SEQ ID NO: 5805276 - DNA, 20 bp, Homo sapiens
tgtaaaatgcacccatcagt

SEQ ID NO: 5805277 - DNA, 22 bp, Homo sapiens
tgtaaaatgcagtccagaataa

SEQ ID NO: 5805278 - DNA, 23 bp, Homo sapiens
tgtaaaatgcagtccagaataag

SEQ ID NO: 5805279 - DNA, 12 bp, Homo sapiens
tgtaaaatggtg

SEQ ID NO: 5805280 - DNA, 14 bp, Homo sapiens
tgtaaaatgtatta

SEQ ID NO: 5805281 - DNA, 15 bp, Homo sapiens
tgtaaaatgtattat

SEQ ID NO: 5805282 - DNA, 19 bp, Homo sapiens
tgtaaaatgtattatgtcc

SEQ ID NO: 5805283 - DNA, 17 bp, Homo sapiens
tgtaaaatgttgaataa

SEQ ID NO: 5805284 - DNA, 12 bp, Homo sapiens
tgtaaaatgttt

SEQ ID NO: 5805285 - DNA, 11 bp, Homo sapiens
tgtaaaattaa

SEQ ID NO: 5805286 - DNA, 14 bp, Homo sapiens
tgtaaaattaatgt

SEQ ID NO: 5805287 - DNA, 21 bp, Homo sapiens
tgtaaaattaatgtaataaag

SEQ ID NO: 5805288 - DNA, 15 bp, Homo sapiens
tgtaaaattccatgg

SEQ ID NO: 5805289 - DNA, 20 bp, Homo sapiens
tgtaaaattggattattact

SEQ ID NO: 5805290 - DNA, 18 bp, Homo sapiens
tgtaaaatttatttatat

SEQ ID NO: 5805291 - DNA, 16 bp, Homo sapiens
tgtaaaatttgtttag

SEQ ID NO: 5805292 - DNA, 21 bp, Homo sapiens
tgtaaacaaaatttagttttt

SEQ ID NO: 5805293 - DNA, 15 bp, Homo sapiens
tgtaaacaaactctt

SEQ ID NO: 5805294 - DNA, 17 bp, Homo sapiens
tgtaaacagaaattgca

SEQ ID NO: 5805295 - DNA, 18 bp, Homo sapiens
tgtaaacagaaattgcaa

SEQ ID NO: 5805296 - DNA, 14 bp, Homo sapiens
tgtaaacagaataa

SEQ ID NO: 5805297 - DNA, 14 bp, Homo sapiens
tgtaaacagtgcct

SEQ ID NO: 5805298 - DNA, 16 bp, Homo sapiens
tgtaaacagtgcctgc

SEQ ID NO: 5805299 - DNA, 17 bp, Homo sapiens
tgtaaacatcataaata

SEQ ID NO: 5805300 - DNA, 22 bp, Homo sapiens
tgtaaacatgtgttttaattcc

SEQ ID NO: 5805301 - DNA, 22 bp, Homo sapiens
tgtaaacattcatatttgcaat

SEQ ID NO: 5805302 - DNA, 14 bp, Homo sapiens
tgtaaaccaaagcc

SEQ ID NO: 5805303 - DNA, 23 bp, Homo sapiens
tgtaaaccacaaggctgttgcat

SEQ ID NO: 5805304 - DNA, 22 bp, Homo sapiens
tgtaaaccataggtaatgatta

SEQ ID NO: 5805305 - DNA, 22 bp, Homo sapiens
tgtaaaccatcgcgtgcaatga

SEQ ID NO: 5805306 - DNA, 16 bp, Homo sapiens
tgtaaaccattgtaac

SEQ ID NO: 5805307 - DNA, 21 bp, Homo sapiens
tgtaaaccattgtaactatta

SEQ ID NO: 5805308 - DNA, 16 bp, Homo sapiens
tgtaaacctaattgtg

SEQ ID NO: 5805309 - DNA, 16 bp, Homo sapiens
tgtaaacggtgctatt

SEQ ID NO: 5805310 - DNA, 22 bp, Homo sapiens
tgtaaactaaagtgtgctttat

SEQ ID NO: 5805311 - DNA, 13 bp, Homo sapiens
tgtaaactataaa

SEQ ID NO: 5805312 - DNA, 21 bp, Homo sapiens
tgtaaactataaactactgta

SEQ ID NO: 5805313 - DNA, 23 bp, Homo sapiens
tgtaaactataaactactgtaat

SEQ ID NO: 5805314 - DNA, 22 bp, Homo sapiens
tgtaaactcaaaacttaacata

SEQ ID NO: 5805315 - DNA, 22 bp, Homo sapiens
tgtaaactctatcagcattgtt

SEQ ID NO: 5805316 - DNA, 16 bp, Homo sapiens
tgtaaactcttcacct

SEQ ID NO: 5805317 - DNA, 14 bp, Homo sapiens
tgtaaactgatgtt

SEQ ID NO: 5805318 - DNA, 18 bp, Homo sapiens
tgtaaactgtactagtct

SEQ ID NO: 5805319 - DNA, 15 bp, Homo sapiens
tgtaaactgtgcacc

SEQ ID NO: 5805320 - DNA, 14 bp, Homo sapiens
tgtaaactgtgtat

SEQ ID NO: 5805321 - DNA, 22 bp, Homo sapiens
tgtaaactgtgtattccaagac

SEQ ID NO: 5805322 - DNA, 15 bp, Homo sapiens
tgtaaactgttgttt

SEQ ID NO: 5805323 - DNA, 19 bp, Homo sapiens
tgtaaactgtttctttaaa

SEQ ID NO: 5805324 - DNA, 22 bp, Homo sapiens
tgtaaactgtttctttaaaatt

SEQ ID NO: 5805325 - DNA, 13 bp, Homo sapiens
tgtaaacttctga

SEQ ID NO: 5805326 - DNA, 15 bp, Homo sapiens
tgtaaacttctgaag

SEQ ID NO: 5805327 - DNA, 14 bp, Homo sapiens
tgtaaacttgaaag

SEQ ID NO: 5805328 - DNA, 17 bp, Homo sapiens
tgtaaactttaacttcc

SEQ ID NO: 5805329 - DNA, 13 bp, Homo sapiens
tgtaaactttgaa

SEQ ID NO: 5805330 - DNA, 17 bp, Homo sapiens
tgtaaactttgaaatat

SEQ ID NO: 5805331 - DNA, 23 bp, Homo sapiens
tgtaaactttgcttctccaaata

SEQ ID NO: 5805332 - DNA, 13 bp, Homo sapiens
tgtaaactttttg

SEQ ID NO: 5805333 - DNA, 15 bp, Homo sapiens
tgtaaagaaaaatat

SEQ ID NO: 5805334 - DNA, 14 bp, Homo sapiens
tgtaaagaaagaga

SEQ ID NO: 5805335 - DNA, 22 bp, Homo sapiens
tgtaaagaagggatattaagaa

SEQ ID NO: 5805336 - DNA, 15 bp, Homo sapiens
tgtaaagaataaatg

SEQ ID NO: 5805337 - DNA, 23 bp, Homo sapiens
tgtaaagacagagtgaatttcag

SEQ ID NO: 5805338 - DNA, 21 bp, Homo sapiens
tgtaaagactgagcagaactg

SEQ ID NO: 5805339 - DNA, 19 bp, Homo sapiens
tgtaaagagaccatcttct

SEQ ID NO: 5805340 - DNA, 19 bp, Homo sapiens
tgtaaagagtggagcaaat

SEQ ID NO: 5805341 - DNA, 16 bp, Homo sapiens
tgtaaagatgaatgtc

SEQ ID NO: 5805342 - DNA, 11 bp, Homo sapiens
tgtaaagcaaa

SEQ ID NO: 5805343 - DNA, 15 bp, Homo sapiens
tgtaaagcaataaaa

SEQ ID NO: 5805344 - DNA, 12 bp, Homo sapiens
tgtaaagcattc

SEQ ID NO: 5805345 - DNA, 18 bp, Homo sapiens
tgtaaagccaacaccctg

SEQ ID NO: 5805346 - DNA, 20 bp, Homo sapiens
tgtaaagcgggaaggacatt

SEQ ID NO: 5805347 - DNA, 16 bp, Homo sapiens
tgtaaagctaaaataa

SEQ ID NO: 5805348 - DNA, 21 bp, Homo sapiens
tgtaaagctaaaataaagaaa

SEQ ID NO: 5805349 - DNA, 14 bp, Homo sapiens
tgtaaagctggccc

SEQ ID NO: 5805350 - DNA, 22 bp, Homo sapiens
tgtaaaggagggagatctttcc

SEQ ID NO: 5805351 - DNA, 21 bp, Homo sapiens
tgtaaaggagtcaaaactaca

SEQ ID NO: 5805352 - DNA, 17 bp, Homo sapiens
tgtaaaggtaggtgcat

SEQ ID NO: 5805353 - DNA, 17 bp, Homo sapiens
tgtaataaaaagcctct

SEQ ID NO: 5805354 - DNA, 21 bp, Homo sapiens
tgtaataaaaatttgtttaaa

SEQ ID NO: 5805355 - DNA, 12 bp, Homo sapiens
tgtaataaaagg

SEQ ID NO: 5805356 - DNA, 22 bp, Homo sapiens
tgtaataaacaggtttttagtt

SEQ ID NO: 5805357 - DNA, 16 bp, Homo sapiens
tgtaataaactctcta

SEQ ID NO: 5805358 - DNA, 15 bp, Homo sapiens
tgtaataaactttaa

SEQ ID NO: 5805359 - DNA, 17 bp, Homo sapiens
tgtaataaactttaata

SEQ ID NO: 5805360 - DNA, 16 bp, Homo sapiens
tgtaataaaggtcttt

SEQ ID NO: 5805361 - DNA, 16 bp, Homo sapiens
tgtaataaagtatata

SEQ ID NO: 5805362 - DNA, 16 bp, Homo sapiens
tgtaataaagtgtttt

SEQ ID NO: 5805363 - DNA, 12 bp, Homo sapiens
tgtaataaatat

SEQ ID NO: 5805364 - DNA, 13 bp, Homo sapiens
tgtaataaatatg

SEQ ID NO: 5805365 - DNA, 14 bp, Homo sapiens
tgtaataaatatga

SEQ ID NO: 5805366 - DNA, 15 bp, Homo sapiens
tgtaataaatatgag

SEQ ID NO: 5805367 - DNA, 14 bp, Homo sapiens
tgtaataaatatgt

SEQ ID NO: 5805368 - DNA, 21 bp, Homo sapiens
tgtaataaatatgtttcacac

SEQ ID NO: 5805369 - DNA, 12 bp, Homo sapiens
tgtaataaatgt

SEQ ID NO: 5805370 - DNA, 14 bp, Homo sapiens
tgtaataaatgtat

SEQ ID NO: 5805371 - DNA, 15 bp, Homo sapiens
tgtaataaatgtatt

SEQ ID NO: 5805372 - DNA, 12 bp, Homo sapiens
tgtaataaattc

SEQ ID NO: 5805373 - DNA, 12 bp, Homo sapiens
tgtaataacatt

SEQ ID NO: 5805374 - DNA, 14 bp, Homo sapiens
tgtaataactgtga

SEQ ID NO: 5805375 - DNA, 12 bp, Homo sapiens
tgtaataagaca

SEQ ID NO: 5805376 - DNA, 14 bp, Homo sapiens
tgtaataagacata

SEQ ID NO: 5805377 - DNA, 15 bp, Homo sapiens
tgtaataagacataa

SEQ ID NO: 5805378 - DNA, 18 bp, Homo sapiens
tgtaataagacataacgt

SEQ ID NO: 5805379 - DNA, 13 bp, Homo sapiens
tgtaataagcaat

SEQ ID NO: 5805380 - DNA, 20 bp, Homo sapiens
tgtaataagcacttgcctgg

SEQ ID NO: 5805381 - DNA, 19 bp, Homo sapiens
tgtaataataaagaatagc

SEQ ID NO: 5805382 - DNA, 14 bp, Homo sapiens
tgtaataatacctc

SEQ ID NO: 5805383 - DNA, 16 bp, Homo sapiens
tgtaataatacctcaa

SEQ ID NO: 5805384 - DNA, 21 bp, Homo sapiens
tgtaataatacctcaatgttt

SEQ ID NO: 5805385 - DNA, 17 bp, Homo sapiens
tgtaataatattttaga

SEQ ID NO: 5805386 - DNA, 18 bp, Homo sapiens
tgtaataatattttagaa

SEQ ID NO: 5805387 - DNA, 14 bp, Homo sapiens
tgtaataatcattt

SEQ ID NO: 5805388 - DNA, 18 bp, Homo sapiens
tgtaataatcattttaga

SEQ ID NO: 5805389 - DNA, 12 bp, Homo sapiens
tgtaataatgga

SEQ ID NO: 5805390 - DNA, 21 bp, Homo sapiens
tgtaataatgtaacatgattt

SEQ ID NO: 5805391 - DNA, 16 bp, Homo sapiens
tgtaataatgtacaga

SEQ ID NO: 5805392 - DNA, 13 bp, Homo sapiens
tgtaataatgtga

SEQ ID NO: 5805393 - DNA, 14 bp, Homo sapiens
tgtaataatgttat

SEQ ID NO: 5805394 - DNA, 16 bp, Homo sapiens
tgtaatacacatatct

SEQ ID NO: 5805395 - DNA, 21 bp, Homo sapiens
tgtaatacctgattgatcaca

SEQ ID NO: 5805396 - DNA, 16 bp, Homo sapiens
tgtaatacttaaataa

SEQ ID NO: 5805397 - DNA, 19 bp, Homo sapiens
tgtaatagtggctttcatt

SEQ ID NO: 5805398 - DNA, 23 bp, Homo sapiens
tgtaatagttcagtagaattacc

SEQ ID NO: 5805399 - DNA, 16 bp, Homo sapiens
tgtaatataaagtatt

SEQ ID NO: 5805400 - DNA, 22 bp, Homo sapiens
tgtaatataaatttaagcaaac

SEQ ID NO: 5805401 - DNA, 18 bp, Homo sapiens
tgtaatataatgtatttt

SEQ ID NO: 5805402 - DNA, 19 bp, Homo sapiens
tgtaatataccagcttgta

SEQ ID NO: 5805403 - DNA, 20 bp, Homo sapiens
tgtaatatactgagctgcta

SEQ ID NO: 5805404 - DNA, 17 bp, Homo sapiens
tgtaatatattgtacaa

SEQ ID NO: 5805405 - DNA, 18 bp, Homo sapiens
tgtaatatattgtacaaa

SEQ ID NO: 5805406 - DNA, 13 bp, Homo sapiens
tgtaatatcagtt

SEQ ID NO: 5805407 - DNA, 16 bp, Homo sapiens
tgtaatatcagttaca

SEQ ID NO: 5805408 - DNA, 15 bp, Homo sapiens
tgtaatatcatttca

SEQ ID NO: 5805409 - DNA, 15 bp, Homo sapiens
tgtaatatcatttta

SEQ ID NO: 5805410 - DNA, 19 bp, Homo sapiens
tgtaatatcattttataga

SEQ ID NO: 5805411 - DNA, 14 bp, Homo sapiens
tgtaatatctttaa

SEQ ID NO: 5805412 - DNA, 23 bp, Homo sapiens
tgtaatatctttaaatgatgtac

SEQ ID NO: 5805413 - DNA, 14 bp, Homo sapiens
tgtaatatgacaga

SEQ ID NO: 5805414 - DNA, 16 bp, Homo sapiens
tgtaatatgacagata

SEQ ID NO: 5805415 - DNA, 17 bp, Homo sapiens
tgtaatatgacagataa

SEQ ID NO: 5805416 - DNA, 14 bp, Homo sapiens
tgtaatatgatttt

SEQ ID NO: 5805417 - DNA, 15 bp, Homo sapiens
tgtaatatgatttta

SEQ ID NO: 5805418 - DNA, 17 bp, Homo sapiens
tgtaatatggaaatctt

SEQ ID NO: 5805419 - DNA, 12 bp, Homo sapiens
tgtaatattaaa

SEQ ID NO: 5805420 - DNA, 21 bp, Homo sapiens
tgtaatattaaaaagaagttt

SEQ ID NO: 5805421 - DNA, 23 bp, Homo sapiens
tgtaatattaaaaagaagtttct

SEQ ID NO: 5805422 - DNA, 14 bp, Homo sapiens
tgtaatattctgtt

SEQ ID NO: 5805423 - DNA, 19 bp, Homo sapiens
tgtaatatttacaatgtat

SEQ ID NO: 5805424 - DNA, 22 bp, Homo sapiens
tgtaatatttacataaagactg

SEQ ID NO: 5805425 - DNA, 17 bp, Homo sapiens
tgtaatatttcttcaaa

SEQ ID NO: 5805426 - DNA, 19 bp, Homo sapiens
tgtaatatttcttcaagtg

SEQ ID NO: 5805427 - DNA, 21 bp, Homo sapiens
tgtaatatttcttcaagtgag

SEQ ID NO: 5805428 - DNA, 13 bp, Homo sapiens
tgtaatatttgaa

SEQ ID NO: 5805429 - DNA, 14 bp, Homo sapiens
tgtaatattttgta

SEQ ID NO: 5805430 - DNA, 22 bp, Homo sapiens
tgtaatatttttatatacagag

SEQ ID NO: 5805431 - DNA, 20 bp, Homo sapiens
tgtaatcaaaaggaggaatt

SEQ ID NO: 5805432 - DNA, 19 bp, Homo sapiens
tgtaatcaaacttctaggt

SEQ ID NO: 5805433 - DNA, 14 bp, Homo sapiens
tgtaatcaacatgg

SEQ ID NO: 5805434 - DNA, 14 bp, Homo sapiens
tgtaatcaagaaaa

SEQ ID NO: 5805435 - DNA, 16 bp, Homo sapiens
tgtaatcaataaacga

SEQ ID NO: 5805436 - DNA, 23 bp, Homo sapiens
tgtaatcaatatcccaacattct

SEQ ID NO: 5805437 - DNA, 16 bp, Homo sapiens
tgtaatcatgtacttt

SEQ ID NO: 5805438 - DNA, 21 bp, Homo sapiens
tgtaatcatttcttgggccct

SEQ ID NO: 5805439 - DNA, 14 bp, Homo sapiens
tgtaatcatttgtt

SEQ ID NO: 5805440 - DNA, 12 bp, Homo sapiens
tgtaatccagca

SEQ ID NO: 5805441 - DNA, 20 bp, Homo sapiens
tgtaatccaggggtgtagat

SEQ ID NO: 5805442 - DNA, 13 bp, Homo sapiens
tgtaatcccagaa

SEQ ID NO: 5805443 - DNA, 21 bp, Homo sapiens
tgtaatcccagcactttggga

SEQ ID NO: 5805444 - DNA, 22 bp, Homo sapiens
tgtaatcccagcactttgggag

SEQ ID NO: 5805445 - DNA, 15 bp, Homo sapiens
tgtaatcccagctac

SEQ ID NO: 5805446 - DNA, 21 bp, Homo sapiens
tgtaatcccagctactcgaga

SEQ ID NO: 5805447 - DNA, 19 bp, Homo sapiens
tgtaatcccagctactcgg

SEQ ID NO: 5805448 - DNA, 22 bp, Homo sapiens
tgtaatcccagctacttgggag

SEQ ID NO: 5805449 - DNA, 17 bp, Homo sapiens
tgtaatcccagctattt

SEQ ID NO: 5805450 - DNA, 13 bp, Homo sapiens
tgtaatcccagta

SEQ ID NO: 5805451 - DNA, 18 bp, Homo sapiens
tgtaatcccagtactttg

SEQ ID NO: 5805452 - DNA, 22 bp, Homo sapiens
tgtaatcctcagctgacacata

SEQ ID NO: 5805453 - DNA, 12 bp, Homo sapiens
tgtaatcctgta

SEQ ID NO: 5805454 - DNA, 15 bp, Homo sapiens
tgtaatcgtgctatt

SEQ ID NO: 5805455 - DNA, 16 bp, Homo sapiens
tgtaatcgtgctattt

SEQ ID NO: 5805456 - DNA, 20 bp, Homo sapiens
tgtaatctaagtatatgtga

SEQ ID NO: 5805457 - DNA, 15 bp, Homo sapiens
tgtaatctaccagtg

SEQ ID NO: 5805458 - DNA, 17 bp, Homo sapiens
tgtaatctaccagtggt

SEQ ID NO: 5805459 - DNA, 22 bp, Homo sapiens
tgtaatctagttgtcaataaat

SEQ ID NO: 5805460 - DNA, 22 bp, Homo sapiens
tgtaatctgcaaaatgtagaaa

SEQ ID NO: 5805461 - DNA, 19 bp, Homo sapiens
tgtaatctgctttgttaat

SEQ ID NO: 5805462 - DNA, 14 bp, Homo sapiens
tgtaatcttaaaag

SEQ ID NO: 5805463 - DNA, 19 bp, Homo sapiens
tgtaatcttgttgataaaa

SEQ ID NO: 5805464 - DNA, 15 bp, Homo sapiens
tgtaatctttttctc

SEQ ID NO: 5805465 - DNA, 17 bp, Homo sapiens
tgtaatctttttctcca

SEQ ID NO: 5805466 - DNA, 11 bp, Homo sapiens
tgtaatgaaaa

SEQ ID NO: 5805467 - DNA, 12 bp, Homo sapiens
tgtaatgaaaac

SEQ ID NO: 5805468 - DNA, 17 bp, Homo sapiens
tgtaatgaaaaccacat

SEQ ID NO: 5805469 - DNA, 18 bp, Homo sapiens
tgtaatgaaaatgaatat

SEQ ID NO: 5805470 - DNA, 21 bp, Homo sapiens
tgtaatgaaaatgaatatcta

SEQ ID NO: 5805471 - DNA, 14 bp, Homo sapiens
tgtaatgaatacct

SEQ ID NO: 5805472 - DNA, 17 bp, Homo sapiens
tgtaatgagaacttcaa

SEQ ID NO: 5805473 - DNA, 13 bp, Homo sapiens
tgtaatgagcacc

SEQ ID NO: 5805474 - DNA, 19 bp, Homo sapiens
tgtaatgaggaaaaaatgg

SEQ ID NO: 5805475 - DNA, 13 bp, Homo sapiens
tgtaatgatcttg

SEQ ID NO: 5805476 - DNA, 17 bp, Homo sapiens
tgtaatgcaaaaggctg

SEQ ID NO: 5805477 - DNA, 12 bp, Homo sapiens
tgtaatgcacaa

SEQ ID NO: 5805478 - DNA, 14 bp, Homo sapiens
tgtaatgcacaatt

SEQ ID NO: 5805479 - DNA, 16 bp, Homo sapiens
tgtaatgcacaattta

SEQ ID NO: 5805480 - DNA, 17 bp, Homo sapiens
tgtaatgcacaatttag

SEQ ID NO: 5805481 - DNA, 23 bp, Homo sapiens
tgtaatgcacaatttagaaaaca

SEQ ID NO: 5805482 - DNA, 14 bp, Homo sapiens
tgtaatgcactcct

SEQ ID NO: 5805483 - DNA, 15 bp, Homo sapiens
tgtaatgctgcctca

SEQ ID NO: 5805484 - DNA, 16 bp, Homo sapiens
tgtaatgctgcctcag

SEQ ID NO: 5805485 - DNA, 16 bp, Homo sapiens
tgtaatgcttccaatc

SEQ ID NO: 5805486 - DNA, 22 bp, Homo sapiens
tgtaatggagcatcaagccact

SEQ ID NO: 5805487 - DNA, 17 bp, Homo sapiens
tgtaatggcagttatat

SEQ ID NO: 5805488 - DNA, 23 bp, Homo sapiens
tgtaatggcagttatattttgca

SEQ ID NO: 5805489 - DNA, 19 bp, Homo sapiens
tgtaatggtactgactttg

SEQ ID NO: 5805490 - DNA, 20 bp, Homo sapiens
tgtaatggtatcttaaagtg

SEQ ID NO: 5805491 - DNA, 16 bp, Homo sapiens
tgtaatggtgcttatt

SEQ ID NO: 5805492 - DNA, 17 bp, Homo sapiens
tgtaatggttgggacca

SEQ ID NO: 5805493 - DNA, 12 bp, Homo sapiens
tgtaatgtaaat

SEQ ID NO: 5805494 - DNA, 14 bp, Homo sapiens
tgtaatgtaaataa

SEQ ID NO: 5805495 - DNA, 14 bp, Homo sapiens
tgtaatgtaactgc

SEQ ID NO: 5805496 - DNA, 18 bp, Homo sapiens
tgtaatgtaactgctctt

SEQ ID NO: 5805497 - DNA, 13 bp, Homo sapiens
tgtaatgtacaat

SEQ ID NO: 5805498 - DNA, 14 bp, Homo sapiens
tgtaatgtacaatt

SEQ ID NO: 5805499 - DNA, 14 bp, Homo sapiens
tgtaatgtatctta

SEQ ID NO: 5805500 - DNA, 12 bp, Homo sapiens
tgtaatgtcaga

SEQ ID NO: 5805501 - DNA, 13 bp, Homo sapiens
tgtaatgtcagac

SEQ ID NO: 5805502 - DNA, 22 bp, Homo sapiens
tgtaatgtcagactttgctgca

SEQ ID NO: 5805503 - DNA, 20 bp, Homo sapiens
tgtaatgtcttgagctctat

SEQ ID NO: 5805504 - DNA, 20 bp, Homo sapiens
tgtaatgtgacttcatgcta

SEQ ID NO: 5805505 - DNA, 19 bp, Homo sapiens
tgtaatgtgtgaaaaagat

SEQ ID NO: 5805506 - DNA, 15 bp, Homo sapiens
tgtaatgttaatatt

SEQ ID NO: 5805507 - DNA, 19 bp, Homo sapiens
tgtaatgttactgatcatg

SEQ ID NO: 5805508 - DNA, 13 bp, Homo sapiens
tgtaatgttttct

SEQ ID NO: 5805509 - DNA, 21 bp, Homo sapiens
tgtaatgtttttatttcaatt

SEQ ID NO: 5805510 - DNA, 22 bp, Homo sapiens
tgtaatgtttttatttcaattg

SEQ ID NO: 5805511 - DNA, 13 bp, Homo sapiens
tgtaattaaaact

SEQ ID NO: 5805512 - DNA, 14 bp, Homo sapiens
tgtaattaaaagca

SEQ ID NO: 5805513 - DNA, 16 bp, Homo sapiens
tgtaattaaaagcaaa

SEQ ID NO: 5805514 - DNA, 20 bp, Homo sapiens
tgtaattaaaagcaaatcat

SEQ ID NO: 5805515 - DNA, 19 bp, Homo sapiens
tgtaattaaactagtttaa

SEQ ID NO: 5805516 - DNA, 15 bp, Homo sapiens
tgtaattaaattctg

SEQ ID NO: 5805517 - DNA, 17 bp, Homo sapiens
tgtaattaagtactatg

SEQ ID NO: 5805518 - DNA, 18 bp, Homo sapiens
tgtaattaagtactatgt

SEQ ID NO: 5805519 - DNA, 19 bp, Homo sapiens
tgtaattaagtactatgta

SEQ ID NO: 5805520 - DNA, 14 bp, Homo sapiens
tgtaattaagtgca

SEQ ID NO: 5805521 - DNA, 15 bp, Homo sapiens
tgtaattaatatctt

SEQ ID NO: 5805522 - DNA, 13 bp, Homo sapiens
tgtaattacaact

SEQ ID NO: 5805523 - DNA, 22 bp, Homo sapiens
tgtaattacttatccctgccca

SEQ ID NO: 5805524 - DNA, 21 bp, Homo sapiens
tgtaattagtgccacttaatg

SEQ ID NO: 5805525 - DNA, 16 bp, Homo sapiens
tgtaattataagctga

SEQ ID NO: 5805526 - DNA, 21 bp, Homo sapiens
tgtaattatatatactatatt

SEQ ID NO: 5805527 - DNA, 15 bp, Homo sapiens
tgtaattatatctga

SEQ ID NO: 5805528 - DNA, 22 bp, Homo sapiens
tgtaattatgaggtgaaacaat

SEQ ID NO: 5805529 - DNA, 19 bp, Homo sapiens
tgtaattatgtaaataact

SEQ ID NO: 5805530 - DNA, 16 bp, Homo sapiens
tgtaattatgttttca

SEQ ID NO: 5805531 - DNA, 12 bp, Homo sapiens
tgtaattattgt

SEQ ID NO: 5805532 - DNA, 15 bp, Homo sapiens
tgtaattatttgaat

SEQ ID NO: 5805533 - DNA, 18 bp, Homo sapiens
tgtagaaacacagcctat

SEQ ID NO: 5805534 - DNA, 21 bp, Homo sapiens
tgtagaaacacagttttgaaa

SEQ ID NO: 5805535 - DNA, 15 bp, Homo sapiens
tgtagaaacacataa

SEQ ID NO: 5805536 - DNA, 15 bp, Homo sapiens
tgtagaaacatttag

SEQ ID NO: 5805537 - DNA, 22 bp, Homo sapiens
tgtagaaaccagctcatgtgta

SEQ ID NO: 5805538 - DNA, 17 bp, Homo sapiens
tgtagaaagctaataca

SEQ ID NO: 5805539 - DNA, 18 bp, Homo sapiens
tgtagaaagctaatacaa

SEQ ID NO: 5805540 - DNA, 21 bp, Homo sapiens
tgtagaaaggggagaatgtca

SEQ ID NO: 5805541 - DNA, 21 bp, Homo sapiens
tgtagaaaggttgattctcat

SEQ ID NO: 5805542 - DNA, 13 bp, Homo sapiens
tgtagaaagtgag

SEQ ID NO: 5805543 - DNA, 20 bp, Homo sapiens
tgtagaaatctgtaattcta

SEQ ID NO: 5805544 - DNA, 13 bp, Homo sapiens
tgtagaaatggtt

SEQ ID NO: 5805545 - DNA, 14 bp, Homo sapiens
tgtagaacactaat

SEQ ID NO: 5805546 - DNA, 19 bp, Homo sapiens
tgtagaacactaattcata

SEQ ID NO: 5805547 - DNA, 17 bp, Homo sapiens
tgtagaactcagcagtt

SEQ ID NO: 5805548 - DNA, 15 bp, Homo sapiens
tgtagaactgatttt

SEQ ID NO: 5805549 - DNA, 13 bp, Homo sapiens
tgtagaactgccc

SEQ ID NO: 5805550 - DNA, 19 bp, Homo sapiens
tgtagaactgttcatttcc

SEQ ID NO: 5805551 - DNA, 22 bp, Homo sapiens
tgtagaactgttcatttccacc

SEQ ID NO: 5805552 - DNA, 16 bp, Homo sapiens
tgtagaacttgaacta

SEQ ID NO: 5805553 - DNA, 19 bp, Homo sapiens
tgtagaagaagtgaacact

SEQ ID NO: 5805554 - DNA, 20 bp, Homo sapiens
tgtagaagaagtgaacactt

SEQ ID NO: 5805555 - DNA, 15 bp, Homo sapiens
tgtagaagcatggtg

SEQ ID NO: 5805556 - DNA, 13 bp, Homo sapiens
tgtagaagcattc

SEQ ID NO: 5805557 - DNA, 21 bp, Homo sapiens
tgtagaaggagacagagctgg

SEQ ID NO: 5805558 - DNA, 17 bp, Homo sapiens
tgtagaaggagccttgt

SEQ ID NO: 5805559 - DNA, 12 bp, Homo sapiens
tgtagaaggagt

SEQ ID NO: 5805560 - DNA, 13 bp, Homo sapiens
tgtagaaggcaca

SEQ ID NO: 5805561 - DNA, 21 bp, Homo sapiens
tgtagaagtcacattcctgaa

SEQ ID NO: 5805562 - DNA, 15 bp, Homo sapiens
tgtagaataaatggt

SEQ ID NO: 5805563 - DNA, 22 bp, Homo sapiens
tgtagaatctcttcatgcttga

SEQ ID NO: 5805564 - DNA, 14 bp, Homo sapiens
tgtagaatgctgta

SEQ ID NO: 5805565 - DNA, 15 bp, Homo sapiens
tgtagaatgctgtag

SEQ ID NO: 5805566 - DNA, 19 bp, Homo sapiens
tgtagaatgtattgtacct

SEQ ID NO: 5805567 - DNA, 16 bp, Homo sapiens
tgtagaattgttatag

SEQ ID NO: 5805568 - DNA, 14 bp, Homo sapiens
tgtagacaaaactt

SEQ ID NO: 5805569 - DNA, 20 bp, Homo sapiens
tgtagacaaaacttataatt

SEQ ID NO: 5805570 - DNA, 14 bp, Homo sapiens
tgtagacaaagtga

SEQ ID NO: 5805571 - DNA, 15 bp, Homo sapiens
tgtagacaaagtgaa

SEQ ID NO: 5805572 - DNA, 14 bp, Homo sapiens
tgtagacactctga

SEQ ID NO: 5805573 - DNA, 18 bp, Homo sapiens
tgtagacactctgacaag

SEQ ID NO: 5805574 - DNA, 21 bp, Homo sapiens
tgtagacactctgacaagctg

SEQ ID NO: 5805575 - DNA, 18 bp, Homo sapiens
tgtagacagatatttcaa

SEQ ID NO: 5805576 - DNA, 21 bp, Homo sapiens
tgtagacatgcccaaaactta

SEQ ID NO: 5805577 - DNA, 21 bp, Homo sapiens
tgtagacattatcttttggct

SEQ ID NO: 5805578 - DNA, 13 bp, Homo sapiens
tgtagacattgta

SEQ ID NO: 5805579 - DNA, 14 bp, Homo sapiens
tgtagacattgtaa

SEQ ID NO: 5805580 - DNA, 14 bp, Homo sapiens
tgtagacattttga

SEQ ID NO: 5805581 - DNA, 21 bp, Homo sapiens
tgtagaccactgtcctggctg

SEQ ID NO: 5805582 - DNA, 18 bp, Homo sapiens
tgtagacctgagctggga

SEQ ID NO: 5805583 - DNA, 12 bp, Homo sapiens
tgtagacgatat

SEQ ID NO: 5805584 - DNA, 16 bp, Homo sapiens
tgtagacggaacagtg

SEQ ID NO: 5805585 - DNA, 12 bp, Homo sapiens
tgtagactatat

SEQ ID NO: 5805586 - DNA, 15 bp, Homo sapiens
tgtagactatataca

SEQ ID NO: 5805587 - DNA, 17 bp, Homo sapiens
tgtagactatatacatg

SEQ ID NO: 5805588 - DNA, 19 bp, Homo sapiens
tgtagactatatacatgtg

SEQ ID NO: 5805589 - DNA, 21 bp, Homo sapiens
tgtagactatatacatgtgtg

SEQ ID NO: 5805590 - DNA, 22 bp, Homo sapiens
tgtagactatatacatgtgtgt

SEQ ID NO: 5805591 - DNA, 21 bp, Homo sapiens
tgtagactctaagatacactg

SEQ ID NO: 5805592 - DNA, 12 bp, Homo sapiens
tgtagactctga

SEQ ID NO: 5805593 - DNA, 21 bp, Homo sapiens
tgtagactcttgctcctgctt

SEQ ID NO: 5805594 - DNA, 22 bp, Homo sapiens
tgtagactgatgttttagcatt

SEQ ID NO: 5805595 - DNA, 20 bp, Homo sapiens
tgtagactggccatgcaagt

SEQ ID NO: 5805596 - DNA, 22 bp, Homo sapiens
tgtagactgtaactttttttca

SEQ ID NO: 5805597 - DNA, 14 bp, Homo sapiens
tgtagactgtggct

SEQ ID NO: 5805598 - DNA, 16 bp, Homo sapiens
tgtagactgtttcaca

SEQ ID NO: 5805599 - DNA, 13 bp, Homo sapiens
tgtagagaaaagg

SEQ ID NO: 5805600 - DNA, 21 bp, Homo sapiens
tgtagagacgaggtcttgtga

SEQ ID NO: 5805601 - DNA, 20 bp, Homo sapiens
tgtagagagagctgtattaa

SEQ ID NO: 5805602 - DNA, 18 bp, Homo sapiens
tgtagagccagggtctca

SEQ ID NO: 5805603 - DNA, 14 bp, Homo sapiens
tgtagagcttctgg

SEQ ID NO: 5805604 - DNA, 18 bp, Homo sapiens
tgtagaggagaaactgga

SEQ ID NO: 5805605 - DNA, 20 bp, Homo sapiens
tgtagagtggcgattgaatg

SEQ ID NO: 5805606 - DNA, 13 bp, Homo sapiens
tgtagagtgggag

SEQ ID NO: 5805607 - DNA, 14 bp, Homo sapiens
tgtagagtgggagc

SEQ ID NO: 5805608 - DNA, 12 bp, Homo sapiens
tgtagagttaag

SEQ ID NO: 5805609 - DNA, 14 bp, Homo sapiens
tgtagagttaagaa

SEQ ID NO: 5805610 - DNA, 15 bp, Homo sapiens
tgtagagttaagaag

SEQ ID NO: 5805611 - DNA, 17 bp, Homo sapiens
tgtagagttaagaagct

SEQ ID NO: 5805612 - DNA, 19 bp, Homo sapiens
tgtagagttaagaagctgt

SEQ ID NO: 5805613 - DNA, 15 bp, Homo sapiens
tgtagagttgctgag

SEQ ID NO: 5805614 - DNA, 20 bp, Homo sapiens
tgtagagttgctgagagggc

SEQ ID NO: 5805615 - DNA, 14 bp, Homo sapiens
tgtagataatactg

SEQ ID NO: 5805616 - DNA, 21 bp, Homo sapiens
tgtagatacaatcagctgctt

SEQ ID NO: 5805617 - DNA, 18 bp, Homo sapiens
tgtagataccgagaatga

SEQ ID NO: 5805618 - DNA, 18 bp, Homo sapiens
tgtagatattatgtatag

SEQ ID NO: 5805619 - DNA, 20 bp, Homo sapiens
tgtagatattatgtatagaa

SEQ ID NO: 5805620 - DNA, 21 bp, Homo sapiens
tgtagatattgttttctgtaa

SEQ ID NO: 5805621 - DNA, 17 bp, Homo sapiens
tgtagatatttggctta

SEQ ID NO: 5805622 - DNA, 13 bp, Homo sapiens
tgtagatcaggtt

SEQ ID NO: 5805623 - DNA, 22 bp, Homo sapiens
tgtagatcccaagatgactggg

SEQ ID NO: 5805624 - DNA, 18 bp, Homo sapiens
tgtagatctccatgcttt

SEQ ID NO: 5805625 - DNA, 13 bp, Homo sapiens
tgtagatgaaaaa

SEQ ID NO: 5805626 - DNA, 20 bp, Homo sapiens
tgtagatgaaaaagcatgta

SEQ ID NO: 5805627 - DNA, 22 bp, Homo sapiens
tgtagatgaaaaagcatgtaca

SEQ ID NO: 5805628 - DNA, 20 bp, Homo sapiens
tgtagatgaacatctctgtt

SEQ ID NO: 5805629 - DNA, 22 bp, Homo sapiens
tgtagatgaacttgagctctgt

SEQ ID NO: 5805630 - DNA, 19 bp, Homo sapiens
tgtagatgcagaaaaagaa

SEQ ID NO: 5805631 - DNA, 19 bp, Homo sapiens
tgtagatgctaacgtgtca

SEQ ID NO: 5805632 - DNA, 19 bp, Homo sapiens
tgtagatggaaaaacttgt

SEQ ID NO: 5805633 - DNA, 13 bp, Homo sapiens
tgtagatggagtt

SEQ ID NO: 5805634 - DNA, 14 bp, Homo sapiens
tgtagatgggcatt

SEQ ID NO: 5805635 - DNA, 20 bp, Homo sapiens
tgtagatgggggaactgtga

SEQ ID NO: 5805636 - DNA, 16 bp, Homo sapiens
tgtagatgtagcattg

SEQ ID NO: 5805637 - DNA, 17 bp, Homo sapiens
tgtagatgtagcattgt

SEQ ID NO: 5805638 - DNA, 22 bp, Homo sapiens
tgtagatgtagcattgttccac

SEQ ID NO: 5805639 - DNA, 14 bp, Homo sapiens
tgtagatgtatgca

SEQ ID NO: 5805640 - DNA, 18 bp, Homo sapiens
tgtagatgtatgcacaca

SEQ ID NO: 5805641 - DNA, 16 bp, Homo sapiens
tgtagattcaggtaat

SEQ ID NO: 5805642 - DNA, 17 bp, Homo sapiens
tgtagattcccttgcac

SEQ ID NO: 5805643 - DNA, 15 bp, Homo sapiens
tgtagattctgtgga

SEQ ID NO: 5805644 - DNA, 22 bp, Homo sapiens
tgtagattgattgtattgttga

SEQ ID NO: 5805645 - DNA, 15 bp, Homo sapiens
tgtagattgcgtgga

SEQ ID NO: 5805646 - DNA, 22 bp, Homo sapiens
tgtagatttagtgtaataagac

SEQ ID NO: 5805647 - DNA, 15 bp, Homo sapiens
tgtagatttatttca

SEQ ID NO: 5805648 - DNA, 12 bp, Homo sapiens
tgtagatttgaa

SEQ ID NO: 5805649 - DNA, 16 bp, Homo sapiens
tgtagatttgattttt

SEQ ID NO: 5805650 - DNA, 21 bp, Homo sapiens
tgtagattttgttatgttcaa

SEQ ID NO: 5805651 - DNA, 13 bp, Homo sapiens
tgtagcaaatttg

SEQ ID NO: 5805652 - DNA, 14 bp, Homo sapiens
tgtagcaaccattt

SEQ ID NO: 5805653 - DNA, 20 bp, Homo sapiens
tgtagcaactacagtctaaa

SEQ ID NO: 5805654 - DNA, 15 bp, Homo sapiens
tgtagcaatatattt

SEQ ID NO: 5805655 - DNA, 17 bp, Homo sapiens
tgtagcaatcagatttt

SEQ ID NO: 5805656 - DNA, 19 bp, Homo sapiens
tgtagcaatggccagagcc

SEQ ID NO: 5805657 - DNA, 18 bp, Homo sapiens
tgtagcacaaagagggag

SEQ ID NO: 5805658 - DNA, 22 bp, Homo sapiens
tgtagcacaatcctattactct

SEQ ID NO: 5805659 - DNA, 23 bp, Homo sapiens
tgtagcacggagtgttggggctg

SEQ ID NO: 5805660 - DNA, 16 bp, Homo sapiens
tgtagcactgacagat

SEQ ID NO: 5805661 - DNA, 14 bp, Homo sapiens
tgtagcactgaggg

SEQ ID NO: 5805662 - DNA, 20 bp, Homo sapiens
tgtagcacttacgtaaaaca

SEQ ID NO: 5805663 - DNA, 21 bp, Homo sapiens
tgtagcacttacgtaaaacat

SEQ ID NO: 5805664 - DNA, 19 bp, Homo sapiens
tgtagcacttactggtagg

SEQ ID NO: 5805665 - DNA, 14 bp, Homo sapiens
tgtagcagaaacca

SEQ ID NO: 5805666 - DNA, 12 bp, Homo sapiens
tgtagcagaaag

SEQ ID NO: 5805667 - DNA, 17 bp, Homo sapiens
tgtagcaggtgtaaccg

SEQ ID NO: 5805668 - DNA, 16 bp, Homo sapiens
tgtagcaggtttcact

SEQ ID NO: 5805669 - DNA, 18 bp, Homo sapiens
tgtagcaggtttcactat

SEQ ID NO: 5805670 - DNA, 14 bp, Homo sapiens
tgtagcatataaat

SEQ ID NO: 5805671 - DNA, 20 bp, Homo sapiens
tgtagcatattttctccgaa

SEQ ID NO: 5805672 - DNA, 15 bp, Homo sapiens
tgtagcattaaatat

SEQ ID NO: 5805673 - DNA, 18 bp, Homo sapiens
tgtagcattaaatataaa

SEQ ID NO: 5805674 - DNA, 16 bp, Homo sapiens
tgtagcattgttccac

SEQ ID NO: 5805675 - DNA, 18 bp, Homo sapiens
tgtagcatttttctaata

SEQ ID NO: 5805676 - DNA, 17 bp, Homo sapiens
tgtagccacaccaggat

SEQ ID NO: 5805677 - DNA, 19 bp, Homo sapiens
tgtagccacagctgctgtt

SEQ ID NO: 5805678 - DNA, 19 bp, Homo sapiens
tgtagccacccaactttgt

SEQ ID NO: 5805679 - DNA, 18 bp, Homo sapiens
tgtagccacctccttggc

SEQ ID NO: 5805680 - DNA, 20 bp, Homo sapiens
tgtagccactagtaagtaat

SEQ ID NO: 5805681 - DNA, 15 bp, Homo sapiens
tgtagccagccgggg

SEQ ID NO: 5805682 - DNA, 15 bp, Homo sapiens
tgtagccagctgtgc

SEQ ID NO: 5805683 - DNA, 22 bp, Homo sapiens
tgtagccatgaccttacatttc

SEQ ID NO: 5805684 - DNA, 17 bp, Homo sapiens
tgtagccatggctcagg

SEQ ID NO: 5805685 - DNA, 19 bp, Homo sapiens
tgtagccatggctcaggca

SEQ ID NO: 5805686 - DNA, 22 bp, Homo sapiens
tgtagcccactctgctcgcctt

SEQ ID NO: 5805687 - DNA, 17 bp, Homo sapiens
tgtagccccaagaaggc

SEQ ID NO: 5805688 - DNA, 22 bp, Homo sapiens
tgtagccccaagaaggctgggg

SEQ ID NO: 5805689 - DNA, 17 bp, Homo sapiens
tgtagccccctggcctc

SEQ ID NO: 5805690 - DNA, 18 bp, Homo sapiens
tgtagccccctggcctct

SEQ ID NO: 5805691 - DNA, 19 bp, Homo sapiens
tgtagccccctggcctctg

SEQ ID NO: 5805692 - DNA, 20 bp, Homo sapiens
tgtagccccctggcctctgt

SEQ ID NO: 5805693 - DNA, 20 bp, Homo sapiens
tgtagccccttttctttggg

SEQ ID NO: 5805694 - DNA, 13 bp, Homo sapiens
tgtagccctggat

SEQ ID NO: 5805695 - DNA, 14 bp, Homo sapiens
tgtagccctggccc

SEQ ID NO: 5805696 - DNA, 19 bp, Homo sapiens
tgtagccctggcccggtcc

SEQ ID NO: 5805697 - DNA, 19 bp, Homo sapiens
tgtagcctaaagaccattt

SEQ ID NO: 5805698 - DNA, 15 bp, Homo sapiens
tgtagcctaaagggc

SEQ ID NO: 5805699 - DNA, 16 bp, Homo sapiens
tgtagcctaaagggca

SEQ ID NO: 5805700 - DNA, 17 bp, Homo sapiens
tgtagcctaaagggcag

SEQ ID NO: 5805701 - DNA, 19 bp, Homo sapiens
tgtagcctaatattcatgc

SEQ ID NO: 5805702 - DNA, 20 bp, Homo sapiens
tgtagcctaatattcatgct

SEQ ID NO: 5805703 - DNA, 23 bp, Homo sapiens
tgtagcctaatattcatgctgcc

SEQ ID NO: 5805704 - DNA, 19 bp, Homo sapiens
tgtagcctacagacatgga

SEQ ID NO: 5805705 - DNA, 14 bp, Homo sapiens
tgtagcctctcttt

SEQ ID NO: 5805706 - DNA, 16 bp, Homo sapiens
tgtagcctctctttgt

SEQ ID NO: 5805707 - DNA, 21 bp, Homo sapiens
tgtagcctgcgtcatggctca

SEQ ID NO: 5805708 - DNA, 23 bp, Homo sapiens
tgtagcctggatattattcttgt

SEQ ID NO: 5805709 - DNA, 18 bp, Homo sapiens
tgtagcctggtctgtgca

SEQ ID NO: 5805710 - DNA, 19 bp, Homo sapiens
tgtatatatgtgtgtttaa

SEQ ID NO: 5805711 - DNA, 14 bp, Homo sapiens
tgtatatattatat

SEQ ID NO: 5805712 - DNA, 20 bp, Homo sapiens
tgtatatattatatatacat

SEQ ID NO: 5805713 - DNA, 21 bp, Homo sapiens
tgtatatattatatatacatt

SEQ ID NO: 5805714 - DNA, 22 bp, Homo sapiens
tgtatatattatatatacatta

SEQ ID NO: 5805715 - DNA, 14 bp, Homo sapiens
tgtatatatttaaa

SEQ ID NO: 5805716 - DNA, 18 bp, Homo sapiens
tgtatatatttcctatat

SEQ ID NO: 5805717 - DNA, 21 bp, Homo sapiens
tgtatatattttatatgttca

SEQ ID NO: 5805718 - DNA, 17 bp, Homo sapiens
tgtatatatttttctta

SEQ ID NO: 5805719 - DNA, 13 bp, Homo sapiens
tgtatatcactaa

SEQ ID NO: 5805720 - DNA, 14 bp, Homo sapiens
tgtatatcactaaa

SEQ ID NO: 5805721 - DNA, 17 bp, Homo sapiens
tgtatatcactaaaagc

SEQ ID NO: 5805722 - DNA, 15 bp, Homo sapiens
tgtatatcagctcta

SEQ ID NO: 5805723 - DNA, 16 bp, Homo sapiens
tgtatatcagctctaa

SEQ ID NO: 5805724 - DNA, 17 bp, Homo sapiens
tgtatatcatgaagcct

SEQ ID NO: 5805725 - DNA, 16 bp, Homo sapiens
tgtatatcattctaca

SEQ ID NO: 5805726 - DNA, 18 bp, Homo sapiens
tgtatatcattctacaga

SEQ ID NO: 5805727 - DNA, 21 bp, Homo sapiens
tgtatatcattctacagaata

SEQ ID NO: 5805728 - DNA, 18 bp, Homo sapiens
tgtatatcctttctaaca

SEQ ID NO: 5805729 - DNA, 18 bp, Homo sapiens
tgtatatctcttggaaaa

SEQ ID NO: 5805730 - DNA, 21 bp, Homo sapiens
tgtatatctcttggaaaataa

SEQ ID NO: 5805731 - DNA, 18 bp, Homo sapiens
tgtatatgaacttaacat

SEQ ID NO: 5805732 - DNA, 18 bp, Homo sapiens
tgtatatgacatttaaat

SEQ ID NO: 5805733 - DNA, 14 bp, Homo sapiens
tgtatatgactgca

SEQ ID NO: 5805734 - DNA, 17 bp, Homo sapiens
tgtatatgactgcattt

SEQ ID NO: 5805735 - DNA, 13 bp, Homo sapiens
tgtatatgatcta

SEQ ID NO: 5805736 - DNA, 17 bp, Homo sapiens
tgtatatgattctctgt

SEQ ID NO: 5805737 - DNA, 19 bp, Homo sapiens
tgtatatgattctctgtgg

SEQ ID NO: 5805738 - DNA, 22 bp, Homo sapiens
tgtatatggtattgtgagatga

SEQ ID NO: 5805739 - DNA, 14 bp, Homo sapiens
tgtatatgtaaatt

SEQ ID NO: 5805740 - DNA, 16 bp, Homo sapiens
tgtatatgtaaattac

SEQ ID NO: 5805741 - DNA, 17 bp, Homo sapiens
tgtatatgtataaatta

SEQ ID NO: 5805742 - DNA, 17 bp, Homo sapiens
tgtatatgtattccctt

SEQ ID NO: 5805743 - DNA, 16 bp, Homo sapiens
tgtatatgtcaaaaat

SEQ ID NO: 5805744 - DNA, 14 bp, Homo sapiens
tgtatatgtctaga

SEQ ID NO: 5805745 - DNA, 15 bp, Homo sapiens
tgtatatgtgatttt

SEQ ID NO: 5805746 - DNA, 19 bp, Homo sapiens
tgtatatgtgcttgtgctc

SEQ ID NO: 5805747 - DNA, 17 bp, Homo sapiens
tgtatatgttggtttaa

SEQ ID NO: 5805748 - DNA, 18 bp, Homo sapiens
tgtatatgtttatacaca

SEQ ID NO: 5805749 - DNA, 14 bp, Homo sapiens
tgtatattacaatg

SEQ ID NO: 5805750 - DNA, 18 bp, Homo sapiens
tgtatattacacatttgt

SEQ ID NO: 5805751 - DNA, 13 bp, Homo sapiens
tgtatattactga

SEQ ID NO: 5805752 - DNA, 16 bp, Homo sapiens
tgtatattatcttctg

SEQ ID NO: 5805753 - DNA, 17 bp, Homo sapiens
tgtatattatcttctgg

SEQ ID NO: 5805754 - DNA, 13 bp, Homo sapiens
tgtatattattgc

SEQ ID NO: 5805755 - DNA, 23 bp, Homo sapiens
tgtatattattgctatatttgct

SEQ ID NO: 5805756 - DNA, 14 bp, Homo sapiens
tgtatattatttct

SEQ ID NO: 5805757 - DNA, 16 bp, Homo sapiens
tgtatattatttctag

SEQ ID NO: 5805758 - DNA, 22 bp, Homo sapiens
tgtatattatttctaggaagaa

SEQ ID NO: 5805759 - DNA, 21 bp, Homo sapiens
tgtatattatttggcagtttg

SEQ ID NO: 5805760 - DNA, 17 bp, Homo sapiens
tgtatattccatgtata

SEQ ID NO: 5805761 - DNA, 15 bp, Homo sapiens
tgtatattgggctca

SEQ ID NO: 5805762 - DNA, 20 bp, Homo sapiens
tgtatattgggtgtagattt

SEQ ID NO: 5805763 - DNA, 22 bp, Homo sapiens
tgtatattgggtgtagatttct

SEQ ID NO: 5805764 - DNA, 17 bp, Homo sapiens
tgtatattggtgtatat

SEQ ID NO: 5805765 - DNA, 14 bp, Homo sapiens
tgtatattgtaatt

SEQ ID NO: 5805766 - DNA, 20 bp, Homo sapiens
tgtatattgtggatgtgttc

SEQ ID NO: 5805767 - DNA, 18 bp, Homo sapiens
tgtatatttaaaagaaag

SEQ ID NO: 5805768 - DNA, 15 bp, Homo sapiens
tgtatatttaaggta

SEQ ID NO: 5805769 - DNA, 16 bp, Homo sapiens
tgtatatttaggaaaa

SEQ ID NO: 5805770 - DNA, 14 bp, Homo sapiens
tgtatatttatgac

SEQ ID NO: 5805771 - DNA, 20 bp, Homo sapiens
tgtatatttattcataatga

SEQ ID NO: 5805772 - DNA, 22 bp, Homo sapiens
tgtatatttattcataatgaat

SEQ ID NO: 5805773 - DNA, 16 bp, Homo sapiens
tgtatatttgaaactg

SEQ ID NO: 5805774 - DNA, 12 bp, Homo sapiens
tgtatatttgct

SEQ ID NO: 5805775 - DNA, 14 bp, Homo sapiens
tgtatatttgctgc

SEQ ID NO: 5805776 - DNA, 15 bp, Homo sapiens
tgtatatttgctgca

SEQ ID NO: 5805777 - DNA, 16 bp, Homo sapiens
tgtatatttgctgcaa

SEQ ID NO: 5805778 - DNA, 19 bp, Homo sapiens
tgtatatttgctgcaaaga

SEQ ID NO: 5805779 - DNA, 21 bp, Homo sapiens
tgtatatttgctgcaaagaga

SEQ ID NO: 5805780 - DNA, 14 bp, Homo sapiens
tgtatatttgcttc

SEQ ID NO: 5805781 - DNA, 16 bp, Homo sapiens
tgtatatttgcttcaa

SEQ ID NO: 5805782 - DNA, 18 bp, Homo sapiens
tgtatatttgtaaagcta

SEQ ID NO: 5805783 - DNA, 15 bp, Homo sapiens
tgtatatttgtatat

SEQ ID NO: 5805784 - DNA, 19 bp, Homo sapiens
tgtatatttgtatattaca

SEQ ID NO: 5805785 - DNA, 17 bp, Homo sapiens
tgtatatttgtatgata

SEQ ID NO: 5805786 - DNA, 21 bp, Homo sapiens
tgtatatttgtgatagcactt

SEQ ID NO: 5805787 - DNA, 22 bp, Homo sapiens
tgtatatttgtgatagcacttt

SEQ ID NO: 5805788 - DNA, 23 bp, Homo sapiens
tgtatattttaatagaattttta

SEQ ID NO: 5805789 - DNA, 19 bp, Homo sapiens
tgtatatttttatattgtt

SEQ ID NO: 5805790 - DNA, 22 bp, Homo sapiens
tgtatatttttatctatataaa

SEQ ID NO: 5805791 - DNA, 19 bp, Homo sapiens
tgtatatttttgtatgtca

SEQ ID NO: 5805792 - DNA, 15 bp, Homo sapiens
tgtatcaaaatgctc

SEQ ID NO: 5805793 - DNA, 21 bp, Homo sapiens
tgtatcaaactcgtctgatgt

SEQ ID NO: 5805794 - DNA, 22 bp, Homo sapiens
tgtatcaaactcgtctgatgtt

SEQ ID NO: 5805795 - DNA, 13 bp, Homo sapiens
tgtatcaaactgc

SEQ ID NO: 5805796 - DNA, 14 bp, Homo sapiens
tgtatcaaactgct

SEQ ID NO: 5805797 - DNA, 17 bp, Homo sapiens
tgtatcaaatctgtata

SEQ ID NO: 5805798 - DNA, 23 bp, Homo sapiens
tgtatcaaattatttttaagttt

SEQ ID NO: 5805799 - DNA, 22 bp, Homo sapiens
tgtatcacaaagctgtgaaatg

SEQ ID NO: 5805800 - DNA, 17 bp, Homo sapiens
tgtatcaccctcagctg

SEQ ID NO: 5805801 - DNA, 22 bp, Homo sapiens
tgtatcaccctcagctggcgga

SEQ ID NO: 5805802 - DNA, 20 bp, Homo sapiens
tgtatcagaaatgaaacaga

SEQ ID NO: 5805803 - DNA, 21 bp, Homo sapiens
tgtatcagagttgcttttcta

SEQ ID NO: 5805804 - DNA, 15 bp, Homo sapiens
tgtatcagccagcct

SEQ ID NO: 5805805 - DNA, 19 bp, Homo sapiens
tgtatcagccagccttccc

SEQ ID NO: 5805806 - DNA, 20 bp, Homo sapiens
tgtatcagctctctgctggg

SEQ ID NO: 5805807 - DNA, 14 bp, Homo sapiens
tgtatcaggtcagg

SEQ ID NO: 5805808 - DNA, 19 bp, Homo sapiens
tgtatcagtggatttccca

SEQ ID NO: 5805809 - DNA, 14 bp, Homo sapiens
tgtatcagtgtcct

SEQ ID NO: 5805810 - DNA, 19 bp, Homo sapiens
tgtatcagtgtcctttcca

SEQ ID NO: 5805811 - DNA, 20 bp, Homo sapiens
tgtatcagtgtcctttccag

SEQ ID NO: 5805812 - DNA, 15 bp, Homo sapiens
tgtatcagtgtttat

SEQ ID NO: 5805813 - DNA, 16 bp, Homo sapiens
tgtatcataattacca

SEQ ID NO: 5805814 - DNA, 12 bp, Homo sapiens
tgtatcattaaa

SEQ ID NO: 5805815 - DNA, 17 bp, Homo sapiens
tgtatcattaaaatata

SEQ ID NO: 5805816 - DNA, 12 bp, Homo sapiens
tgtatcatttca

SEQ ID NO: 5805817 - DNA, 16 bp, Homo sapiens
tgtatcatttcatgct

SEQ ID NO: 5805818 - DNA, 20 bp, Homo sapiens
tgtatcatttttgtgcacag

SEQ ID NO: 5805819 - DNA, 22 bp, Homo sapiens
tgtatccaacaagccagaatca

SEQ ID NO: 5805820 - DNA, 18 bp, Homo sapiens
tgtatccaaggaaacatt

SEQ ID NO: 5805821 - DNA, 16 bp, Homo sapiens
tgtatccagaggaatt

SEQ ID NO: 5805822 - DNA, 19 bp, Homo sapiens
tgtatccagtgatgtgctg

SEQ ID NO: 5805823 - DNA, 22 bp, Homo sapiens
tgtatccatccatggggctgat

SEQ ID NO: 5805824 - DNA, 13 bp, Homo sapiens
tgtatccattatc

SEQ ID NO: 5805825 - DNA, 17 bp, Homo sapiens
tgtatccattatcatgt

SEQ ID NO: 5805826 - DNA, 19 bp, Homo sapiens
tgtatccattatcatgtgt

SEQ ID NO: 5805827 - DNA, 22 bp, Homo sapiens
tgtatccattctacctgtcctc

SEQ ID NO: 5805828 - DNA, 14 bp, Homo sapiens
tgtatccatttaaa

SEQ ID NO: 5805829 - DNA, 15 bp, Homo sapiens
tgtatcccatgagcc

SEQ ID NO: 5805830 - DNA, 23 bp, Homo sapiens
tgtatcccatgagcctcagcatc

SEQ ID NO: 5805831 - DNA, 21 bp, Homo sapiens
tgtatccccctgtagcagcat

SEQ ID NO: 5805832 - DNA, 19 bp, Homo sapiens
tgtatccgactctaagctg

SEQ ID NO: 5805833 - DNA, 18 bp, Homo sapiens
tgtatccgtgaattgctt

SEQ ID NO: 5805834 - DNA, 22 bp, Homo sapiens
tgtatcctccctggcagacaca

SEQ ID NO: 5805835 - DNA, 17 bp, Homo sapiens
tgtatcctggaacaata

SEQ ID NO: 5805836 - DNA, 18 bp, Homo sapiens
tgtatcctggaacaatat

SEQ ID NO: 5805837 - DNA, 16 bp, Homo sapiens
tgtatcctggccctgg

SEQ ID NO: 5805838 - DNA, 19 bp, Homo sapiens
tgtatcctggccctggggg

SEQ ID NO: 5805839 - DNA, 12 bp, Homo sapiens
tgtatcctgggg

SEQ ID NO: 5805840 - DNA, 22 bp, Homo sapiens
tgtatcctttatttctgataag

SEQ ID NO: 5805841 - DNA, 20 bp, Homo sapiens
tgtatcgggaagatttctaa

SEQ ID NO: 5805842 - DNA, 15 bp, Homo sapiens
tgtatcgtatagctg

SEQ ID NO: 5805843 - DNA, 16 bp, Homo sapiens
tgtatcgtggagaaac

SEQ ID NO: 5805844 - DNA, 22 bp, Homo sapiens
tgtatcgtggagaaacaagaga

SEQ ID NO: 5805845 - DNA, 20 bp, Homo sapiens
tgtatctaaaaaataactgt

SEQ ID NO: 5805846 - DNA, 21 bp, Homo sapiens
tgtatctaaaaaataactgtg

SEQ ID NO: 5805847 - DNA, 15 bp, Homo sapiens
tgtatctaagaataa

SEQ ID NO: 5805848 - DNA, 20 bp, Homo sapiens
tgtatctacatcttttttca

SEQ ID NO: 5805849 - DNA, 21 bp, Homo sapiens
tgtatctacattaaaatgaca

SEQ ID NO: 5805850 - DNA, 16 bp, Homo sapiens
tgtatctagaaagaga

SEQ ID NO: 5805851 - DNA, 15 bp, Homo sapiens
tgtatctagcttctt

SEQ ID NO: 5805852 - DNA, 18 bp, Homo sapiens
tgtatctatgcattttct

SEQ ID NO: 5805853 - DNA, 19 bp, Homo sapiens
tgtatctatgcattttctg

SEQ ID NO: 5805854 - DNA, 24 bp, Homo sapiens
tgtatctatgttgcatgataaaca

SEQ ID NO: 5805855 - DNA, 15 bp, Homo sapiens
tgtatctatttgtac

SEQ ID NO: 5805856 - DNA, 21 bp, Homo sapiens
tgtatctatttttttttcttt

SEQ ID NO: 5805857 - DNA, 18 bp, Homo sapiens
tgtatctcatactgtctg

SEQ ID NO: 5805858 - DNA, 24 bp, Homo sapiens
tgtatctcatactgtctgggatta

SEQ ID NO: 5805859 - DNA, 17 bp, Homo sapiens
tgtatctctgaagcatg

SEQ ID NO: 5805860 - DNA, 19 bp, Homo sapiens
tgtatctctgaagcatgtt

SEQ ID NO: 5805861 - DNA, 22 bp, Homo sapiens
tgtatctctgaagcatgtttca

SEQ ID NO: 5805862 - DNA, 20 bp, Homo sapiens
tgtatctgaactcacagact

SEQ ID NO: 5805863 - DNA, 21 bp, Homo sapiens
tgtatctgaactcacagactg

SEQ ID NO: 5805864 - DNA, 18 bp, Homo sapiens
tgtatctgaaggagattt

SEQ ID NO: 5805865 - DNA, 17 bp, Homo sapiens
tgtatctgacatatttc

SEQ ID NO: 5805866 - DNA, 19 bp, Homo sapiens
tgtatctgacatatttcat

SEQ ID NO: 5805867 - DNA, 12 bp, Homo sapiens
tgtatctgagtt

SEQ ID NO: 5805868 - DNA, 20 bp, Homo sapiens
tgtatctgatagctctttgg

SEQ ID NO: 5805869 - DNA, 18 bp, Homo sapiens
tgtatctgcaggcagaca

SEQ ID NO: 5805870 - DNA, 20 bp, Homo sapiens
tgtatctgtctactttctct

SEQ ID NO: 5805871 - DNA, 21 bp, Homo sapiens
tgtatctgtctactttctctt

SEQ ID NO: 5805872 - DNA, 22 bp, Homo sapiens
tgtatctgtctactttctcttg

SEQ ID NO: 5805873 - DNA, 19 bp, Homo sapiens
tgtatctgtctttccactc

SEQ ID NO: 5805874 - DNA, 13 bp, Homo sapiens
tgtatctgtgaag

SEQ ID NO: 5805875 - DNA, 14 bp, Homo sapiens
tgtatctgtgcttt

SEQ ID NO: 5805876 - DNA, 12 bp, Homo sapiens
tgtatcttaaag

SEQ ID NO: 5805877 - DNA, 15 bp, Homo sapiens
tgtatcttaaaggac

SEQ ID NO: 5805878 - DNA, 11 bp, Homo sapiens
tgtatcttaag

SEQ ID NO: 5805879 - DNA, 21 bp, Homo sapiens
tgtatcttccatatttggaag

SEQ ID NO: 5805880 - DNA, 12 bp, Homo sapiens
tgtatcttcctt

SEQ ID NO: 5805881 - DNA, 16 bp, Homo sapiens
tgtatcttgatgttta

SEQ ID NO: 5805882 - DNA, 17 bp, Homo sapiens
tgtatcttgatgtttag

SEQ ID NO: 5805883 - DNA, 21 bp, Homo sapiens
tgtatcttggggcaagactgc

SEQ ID NO: 5805884 - DNA, 21 bp, Homo sapiens
tgtatcttgggggacagggct

SEQ ID NO: 5805885 - DNA, 22 bp, Homo sapiens
tgtatcttgtctgagactgcat

SEQ ID NO: 5805886 - DNA, 22 bp, Homo sapiens
tgtatttttctacattattgct

SEQ ID NO: 5805887 - DNA, 18 bp, Homo sapiens
tgtatttttcttgctgtt

SEQ ID NO: 5805888 - DNA, 23 bp, Homo sapiens
tgtatttttcttgctgttcagtg

SEQ ID NO: 5805889 - DNA, 16 bp, Homo sapiens
tgtatttttgaataaa

SEQ ID NO: 5805890 - DNA, 22 bp, Homo sapiens
tgtatttttgattgttatgtaa

SEQ ID NO: 5805891 - DNA, 16 bp, Homo sapiens
tgtatttttgtaaata

SEQ ID NO: 5805892 - DNA, 21 bp, Homo sapiens
tgtatttttgtaattcctcta

SEQ ID NO: 5805893 - DNA, 19 bp, Homo sapiens
tgtatttttgtatgtggca

SEQ ID NO: 5805894 - DNA, 14 bp, Homo sapiens
tgtatttttgttgc

SEQ ID NO: 5805895 - DNA, 16 bp, Homo sapiens
tgtattttttaaagct

SEQ ID NO: 5805896 - DNA, 19 bp, Homo sapiens
tgtattttttaattgattt

SEQ ID NO: 5805897 - DNA, 21 bp, Homo sapiens
tgtattttttcttgcattgac

SEQ ID NO: 5805898 - DNA, 17 bp, Homo sapiens
tgtattttttgtttgta

SEQ ID NO: 5805899 - DNA, 20 bp, Homo sapiens
tgtattttttgtttgtattg

SEQ ID NO: 5805900 - DNA, 17 bp, Homo sapiens
tgtcaaaaagcaactga

SEQ ID NO: 5805901 - DNA, 21 bp, Homo sapiens
tgtcaaaaagggcttgaggtg

SEQ ID NO: 5805902 - DNA, 16 bp, Homo sapiens
tgtcaaaaatcaatat

SEQ ID NO: 5805903 - DNA, 20 bp, Homo sapiens
tgtcaaaaattttgaatgta

SEQ ID NO: 5805904 - DNA, 22 bp, Homo sapiens
tgtcaaaaattttgaatgtaca

SEQ ID NO: 5805905 - DNA, 14 bp, Homo sapiens
tgtcaaaacactgt

SEQ ID NO: 5805906 - DNA, 15 bp, Homo sapiens
tgtcaaaacactgtg

SEQ ID NO: 5805907 - DNA, 17 bp, Homo sapiens
tgtcaaaacactgtgga

SEQ ID NO: 5805908 - DNA, 17 bp, Homo sapiens
tgtcaaaactccactca

SEQ ID NO: 5805909 - DNA, 13 bp, Homo sapiens
tgtcaaaactggt

SEQ ID NO: 5805910 - DNA, 12 bp, Homo sapiens
tgtcaaaagtag

SEQ ID NO: 5805911 - DNA, 20 bp, Homo sapiens
tgtcaaaagtagaactttgt

SEQ ID NO: 5805912 - DNA, 15 bp, Homo sapiens
tgtcaaaataatttt

SEQ ID NO: 5805913 - DNA, 21 bp, Homo sapiens
tgtcaaacaaagccagaagct

SEQ ID NO: 5805914 - DNA, 22 bp, Homo sapiens
tgtcaaacaaagccagaagctg

SEQ ID NO: 5805915 - DNA, 13 bp, Homo sapiens
tgtcaaacaaata

SEQ ID NO: 5805916 - DNA, 21 bp, Homo sapiens
tgtcaaacagtgccaaatgct

SEQ ID NO: 5805917 - DNA, 12 bp, Homo sapiens
tgtcaaacatta

SEQ ID NO: 5805918 - DNA, 18 bp, Homo sapiens
tgtcaaacgtgcccccca

SEQ ID NO: 5805919 - DNA, 23 bp, Homo sapiens
tgtcaaagaagcttccacaaaat

SEQ ID NO: 5805920 - DNA, 12 bp, Homo sapiens
tgtcaaagaagg

SEQ ID NO: 5805921 - DNA, 17 bp, Homo sapiens
tgtcaaagagagggctt

SEQ ID NO: 5805922 - DNA, 15 bp, Homo sapiens
tgtcaaagtgaaaga

SEQ ID NO: 5805923 - DNA, 17 bp, Homo sapiens
tgtcaaagtgaaagaca

SEQ ID NO: 5805924 - DNA, 17 bp, Homo sapiens
tgtcaaataaacactgt

SEQ ID NO: 5805925 - DNA, 18 bp, Homo sapiens
tgtcaaataaacactgtg

SEQ ID NO: 5805926 - DNA, 19 bp, Homo sapiens
tgtcaaatatttagatgta

SEQ ID NO: 5805927 - DNA, 15 bp, Homo sapiens
tgtcaaatccatgtg

SEQ ID NO: 5805928 - DNA, 22 bp, Homo sapiens
tgtcaaatcgatggcctggcct

SEQ ID NO: 5805929 - DNA, 16 bp, Homo sapiens
tgtcaaatgaactttt

SEQ ID NO: 5805930 - DNA, 17 bp, Homo sapiens
tgtcaaatgatgtgcaa

SEQ ID NO: 5805931 - DNA, 18 bp, Homo sapiens
tgtcaaatgatgtgcaaa

SEQ ID NO: 5805932 - DNA, 19 bp, Homo sapiens
tgtcaaatgatgtgcaaaa

SEQ ID NO: 5805933 - DNA, 13 bp, Homo sapiens
tgtcaaatggatg

SEQ ID NO: 5805934 - DNA, 15 bp, Homo sapiens
tgtcaaatggtattt

SEQ ID NO: 5805935 - DNA, 22 bp, Homo sapiens
tgtcaaatggtattttttgtga

SEQ ID NO: 5805936 - DNA, 12 bp, Homo sapiens
tgtcaaatgttt

SEQ ID NO: 5805937 - DNA, 17 bp, Homo sapiens
tgtcaaatgtttcctta

SEQ ID NO: 5805938 - DNA, 21 bp, Homo sapiens
tgtcaaattgtgcaaaatatt

SEQ ID NO: 5805939 - DNA, 19 bp, Homo sapiens
tgtcaaattttcaaataat

SEQ ID NO: 5805940 - DNA, 23 bp, Homo sapiens
tgtcaacaaaaagacatggaagg

SEQ ID NO: 5805941 - DNA, 16 bp, Homo sapiens
tgtcaacaaagtgctt

SEQ ID NO: 5805942 - DNA, 16 bp, Homo sapiens
tgtcaacacaaactgg

SEQ ID NO: 5805943 - DNA, 19 bp, Homo sapiens
tgtcaacacaaagacacag

SEQ ID NO: 5805944 - DNA, 18 bp, Homo sapiens
tgtcaacacaaagacatg

SEQ ID NO: 5805945 - DNA, 22 bp, Homo sapiens
tgtcaacacaaagacatggaag

SEQ ID NO: 5805946 - DNA, 20 bp, Homo sapiens
tgtcaacactatataaataa

SEQ ID NO: 5805947 - DNA, 17 bp, Homo sapiens
tgtcaacatgaacaaat

SEQ ID NO: 5805948 - DNA, 19 bp, Homo sapiens
tgtcaacatgcattgccat

SEQ ID NO: 5805949 - DNA, 20 bp, Homo sapiens
tgtcaacatgcattgccatg

SEQ ID NO: 5805950 - DNA, 15 bp, Homo sapiens
tgtcaaccagacaga

SEQ ID NO: 5805951 - DNA, 23 bp, Homo sapiens
tgtcaaccagacagagggtcaca

SEQ ID NO: 5805952 - DNA, 18 bp, Homo sapiens
tgtcaacctgaattaaag

SEQ ID NO: 5805953 - DNA, 19 bp, Homo sapiens
tgtcaacctgaattaaagt

SEQ ID NO: 5805954 - DNA, 22 bp, Homo sapiens
tgtcaaccttgtgtgagtgtga

SEQ ID NO: 5805955 - DNA, 15 bp, Homo sapiens
tgtcaactaaatgag

SEQ ID NO: 5805956 - DNA, 15 bp, Homo sapiens
tgtcaacttcaacat

SEQ ID NO: 5805957 - DNA, 21 bp, Homo sapiens
tgtcaacttcagttgaaaaga

SEQ ID NO: 5805958 - DNA, 20 bp, Homo sapiens
tgtcaacttcccatctggct

SEQ ID NO: 5805959 - DNA, 14 bp, Homo sapiens
tgtcaacttctggc

SEQ ID NO: 5805960 - DNA, 15 bp, Homo sapiens
tgtcaacttctggct

SEQ ID NO: 5805961 - DNA, 15 bp, Homo sapiens
tgtcaactttatgca

SEQ ID NO: 5805962 - DNA, 17 bp, Homo sapiens
tgtcaactttcatttga

SEQ ID NO: 5805963 - DNA, 16 bp, Homo sapiens
tgtcaacttttgacta

SEQ ID NO: 5805964 - DNA, 19 bp, Homo sapiens
tgtcaagaagatgatcaga

SEQ ID NO: 5805965 - DNA, 15 bp, Homo sapiens
tgtcaagacagggaa

SEQ ID NO: 5805966 - DNA, 14 bp, Homo sapiens
tgtcaagacatttc

SEQ ID NO: 5805967 - DNA, 15 bp, Homo sapiens
tgtcaagagagagtc

SEQ ID NO: 5805968 - DNA, 14 bp, Homo sapiens
tgtcaagagccaag

SEQ ID NO: 5805969 - DNA, 22 bp, Homo sapiens
tgtcaagagtagttatataatt

SEQ ID NO: 5805970 - DNA, 19 bp, Homo sapiens
tgtcaagcatattggaaag

SEQ ID NO: 5805971 - DNA, 15 bp, Homo sapiens
tgtcaagccataatt

SEQ ID NO: 5805972 - DNA, 18 bp, Homo sapiens
tgtcaagccatttttaca

SEQ ID NO: 5805973 - DNA, 20 bp, Homo sapiens
tgtcaagccccattccctct

SEQ ID NO: 5805974 - DNA, 16 bp, Homo sapiens
tgtcaagcctgtgcaa

SEQ ID NO: 5805975 - DNA, 22 bp, Homo sapiens
tgtcaagcctgtggatgatttt

SEQ ID NO: 5805976 - DNA, 15 bp, Homo sapiens
tgtcaagcttactac

SEQ ID NO: 5805977 - DNA, 19 bp, Homo sapiens
tgtcaaggaagacttttgg

SEQ ID NO: 5805978 - DNA, 21 bp, Homo sapiens
tgtcaaggaatgttatcagta

SEQ ID NO: 5805979 - DNA, 18 bp, Homo sapiens
tgtcaaggctgcttagaa

SEQ ID NO: 5805980 - DNA, 21 bp, Homo sapiens
tgtcaagggcagctttgctca

SEQ ID NO: 5805981 - DNA, 15 bp, Homo sapiens
tgtcaaggggcccta

SEQ ID NO: 5805982 - DNA, 16 bp, Homo sapiens
tgtcaaggtgctgttg

SEQ ID NO: 5805983 - DNA, 15 bp, Homo sapiens
tgtcaagtacaagca

SEQ ID NO: 5805984 - DNA, 21 bp, Homo sapiens
tgtcaagtcccccagcagaac

SEQ ID NO: 5805985 - DNA, 17 bp, Homo sapiens
tgtcaagtctctgctgg

SEQ ID NO: 5805986 - DNA, 14 bp, Homo sapiens
tgtcaagtgcctgc

SEQ ID NO: 5805987 - DNA, 17 bp, Homo sapiens
tgtcaagtggcaaagct

SEQ ID NO: 5805988 - DNA, 21 bp, Homo sapiens
tgtcaagtggcagctcagcca

SEQ ID NO: 5805989 - DNA, 18 bp, Homo sapiens
tgtcaagttaacaaggaa

SEQ ID NO: 5805990 - DNA, 15 bp, Homo sapiens
tgtcaagttgtgctt

SEQ ID NO: 5805991 - DNA, 19 bp, Homo sapiens
tgtcaagtttttatacctg

SEQ ID NO: 5805992 - DNA, 12 bp, Homo sapiens
tgtcaataaaca

SEQ ID NO: 5805993 - DNA, 17 bp, Homo sapiens
tgtcaataaagctgtgc

SEQ ID NO: 5805994 - DNA, 20 bp, Homo sapiens
tgtcaataaatgacacccag

SEQ ID NO: 5805995 - DNA, 14 bp, Homo sapiens
tgtcaataaatgtt

SEQ ID NO: 5805996 - DNA, 16 bp, Homo sapiens
tgtcaataaatgttga

SEQ ID NO: 5805997 - DNA, 15 bp, Homo sapiens
tgtcaataactttat

SEQ ID NO: 5805998 - DNA, 15 bp, Homo sapiens
tgtcaatatatagag

SEQ ID NO: 5805999 - DNA, 14 bp, Homo sapiens
tgtcaatattaaat

SEQ ID NO: 5806000 - DNA, 19 bp, Homo sapiens
tgtcaatattaaatacaga

SEQ ID NO: 5806001 - DNA, 15 bp, Homo sapiens
tgtcaatcaagatgg

SEQ ID NO: 5806002 - DNA, 22 bp, Homo sapiens
tgtcaatcatatttaaagggaa

SEQ ID NO: 5806003 - DNA, 17 bp, Homo sapiens
tgtcaatgattattttc

SEQ ID NO: 5806004 - DNA, 16 bp, Homo sapiens
tgtcaatgatttgtca

SEQ ID NO: 5806005 - DNA, 23 bp, Homo sapiens
tgtcaatgcagttgtctctgttt

SEQ ID NO: 5806006 - DNA, 17 bp, Homo sapiens
tgtcaatgctatggact

SEQ ID NO: 5806007 - DNA, 12 bp, Homo sapiens
tgtcaatgtgtg

SEQ ID NO: 5806008 - DNA, 13 bp, Homo sapiens
tgtcaatgtgtgc

SEQ ID NO: 5806009 - DNA, 15 bp, Homo sapiens
tgtcaattacaggaa

SEQ ID NO: 5806010 - DNA, 21 bp, Homo sapiens
tgtcaattacaggaagtactg

SEQ ID NO: 5806011 - DNA, 18 bp, Homo sapiens
tgtcaattcataaaaaca

SEQ ID NO: 5806012 - DNA, 13 bp, Homo sapiens
tgtcaattgatat

SEQ ID NO: 5806013 - DNA, 21 bp, Homo sapiens
tgtcaattgatatttctgtgt

SEQ ID NO: 5806014 - DNA, 19 bp, Homo sapiens
tgtcaatttatgaatataa

SEQ ID NO: 5806015 - DNA, 21 bp, Homo sapiens
tgtcaatttggtttagaatgc

SEQ ID NO: 5806016 - DNA, 22 bp, Homo sapiens
tgtcaatttgtatatcatgaaa

SEQ ID NO: 5806017 - DNA, 19 bp, Homo sapiens
tgtcacaaattgatcaaga

SEQ ID NO: 5806018 - DNA, 22 bp, Homo sapiens
tgtcacaacatggtgctacttc

SEQ ID NO: 5806019 - DNA, 23 bp, Homo sapiens
tgtcacaagtggtgtttattgca

SEQ ID NO: 5806020 - DNA, 11 bp, Homo sapiens
tgtcacaataa

SEQ ID NO: 5806021 - DNA, 13 bp, Homo sapiens
tgtcacaataaag

SEQ ID NO: 5806022 - DNA, 19 bp, Homo sapiens
tgtcacaataaatggccag

SEQ ID NO: 5806023 - DNA, 16 bp, Homo sapiens
tgtcacaataaatgta

SEQ ID NO: 5806024 - DNA, 14 bp, Homo sapiens
tgtcacaatcctaa

SEQ ID NO: 5806025 - DNA, 21 bp, Homo sapiens
tgtcacaatgagattgaattt

SEQ ID NO: 5806026 - DNA, 20 bp, Homo sapiens
tgtcacacaaactgatgatg

SEQ ID NO: 5806027 - DNA, 20 bp, Homo sapiens
tgtcacacaacactgatgtg

SEQ ID NO: 5806028 - DNA, 14 bp, Homo sapiens
tgtcacacactgga

SEQ ID NO: 5806029 - DNA, 15 bp, Homo sapiens
tgtcacacactggac

SEQ ID NO: 5806030 - DNA, 16 bp, Homo sapiens
tgtcacacactggacc

SEQ ID NO: 5806031 - DNA, 17 bp, Homo sapiens
tgtcacacactggaccc

SEQ ID NO: 5806032 - DNA, 17 bp, Homo sapiens
tgtcacacactttggct

SEQ ID NO: 5806033 - DNA, 14 bp, Homo sapiens
tgtcacaccagcca

SEQ ID NO: 5806034 - DNA, 15 bp, Homo sapiens
tgtcacaccagccat

SEQ ID NO: 5806035 - DNA, 16 bp, Homo sapiens
tgtcacacccatggcc

SEQ ID NO: 5806036 - DNA, 18 bp, Homo sapiens
tgtcacactgtggcctga

SEQ ID NO: 5806037 - DNA, 17 bp, Homo sapiens
tgtcacacttgtttctt

SEQ ID NO: 5806038 - DNA, 18 bp, Homo sapiens
tgtcacagaaatcagagg

SEQ ID NO: 5806039 - DNA, 13 bp, Homo sapiens
tgtcacagaggca

SEQ ID NO: 5806040 - DNA, 14 bp, Homo sapiens
tgtcacagctcttg

SEQ ID NO: 5806041 - DNA, 18 bp, Homo sapiens
tgtcacagctcttgtttg

SEQ ID NO: 5806042 - DNA, 15 bp, Homo sapiens
tgtcacaggcaggtc

SEQ ID NO: 5806043 - DNA, 16 bp, Homo sapiens
tgtcacaggcaggtcc

SEQ ID NO: 5806044 - DNA, 15 bp, Homo sapiens
tgtcacaggctgggt

SEQ ID NO: 5806045 - DNA, 17 bp, Homo sapiens
tgtcacagggactgaaa

SEQ ID NO: 5806046 - DNA, 12 bp, Homo sapiens
tgtcacagggcc

SEQ ID NO: 5806047 - DNA, 16 bp, Homo sapiens
tgtcacaggttttcag

SEQ ID NO: 5806048 - DNA, 16 bp, Homo sapiens
tgtcacagtaaaaata

SEQ ID NO: 5806049 - DNA, 17 bp, Homo sapiens
tgtcacagtaaaaataa

SEQ ID NO: 5806050 - DNA, 18 bp, Homo sapiens
tgtcacagtttgttcagt

SEQ ID NO: 5806051 - DNA, 15 bp, Homo sapiens
tgtcacatcaagcat

SEQ ID NO: 5806052 - DNA, 21 bp, Homo sapiens
tgtcacatcacgaaggaaaac

SEQ ID NO: 5806053 - DNA, 15 bp, Homo sapiens
tgtcacatctcaggg

SEQ ID NO: 5806054 - DNA, 22 bp, Homo sapiens
tgtcacatctcagggaactgac

SEQ ID NO: 5806055 - DNA, 22 bp, Homo sapiens
tgtcacatgacatccacatgca

SEQ ID NO: 5806056 - DNA, 23 bp, Homo sapiens
tgtcacatgacatccacatgcac

SEQ ID NO: 5806057 - DNA, 20 bp, Homo sapiens
tgtcacatggtgcccctagc

SEQ ID NO: 5806058 - DNA, 21 bp, Homo sapiens
tgtcacatggtgcccctagct

SEQ ID NO: 5806059 - DNA, 11 bp, Homo sapiens
tgtcacattcc

SEQ ID NO: 5806060 - DNA, 14 bp, Homo sapiens
tgtcacattgcatt

SEQ ID NO: 5806061 - DNA, 23 bp, Homo sapiens
tgtcacatttttcttgttttgtc

SEQ ID NO: 5806062 - DNA, 14 bp, Homo sapiens
tgtcaccaaggaaa

SEQ ID NO: 5806063 - DNA, 15 bp, Homo sapiens
tgtcaccaaggaaac

SEQ ID NO: 5806064 - DNA, 15 bp, Homo sapiens
tgtccagggcttcag

SEQ ID NO: 5806065 - DNA, 16 bp, Homo sapiens
tgtccaggtaggaaac

SEQ ID NO: 5806066 - DNA, 17 bp, Homo sapiens
tgtccaggtcacaggca

SEQ ID NO: 5806067 - DNA, 18 bp, Homo sapiens
tgtccaggtcacaggcat

SEQ ID NO: 5806068 - DNA, 11 bp, Homo sapiens
tgtccaggtct

SEQ ID NO: 5806069 - DNA, 20 bp, Homo sapiens
tgtccaggtctagaaggcca

SEQ ID NO: 5806070 - DNA, 16 bp, Homo sapiens
tgtccaggtgagaaca

SEQ ID NO: 5806071 - DNA, 20 bp, Homo sapiens
tgtccaggtgagaacatcca

SEQ ID NO: 5806072 - DNA, 20 bp, Homo sapiens
tgtccaggttgatcttgaac

SEQ ID NO: 5806073 - DNA, 21 bp, Homo sapiens
tgtccagtaagatcactgttt

SEQ ID NO: 5806074 - DNA, 22 bp, Homo sapiens
tgtccagtaagatcactgttta

SEQ ID NO: 5806075 - DNA, 20 bp, Homo sapiens
tgtccagtcatcctgccctg

SEQ ID NO: 5806076 - DNA, 22 bp, Homo sapiens
tgtccagtcatcctgccctgca

SEQ ID NO: 5806077 - DNA, 17 bp, Homo sapiens
tgtccagtccagtgatg

SEQ ID NO: 5806078 - DNA, 13 bp, Homo sapiens
tgtccagtgagca

SEQ ID NO: 5806079 - DNA, 14 bp, Homo sapiens
tgtccagtgcccat

SEQ ID NO: 5806080 - DNA, 16 bp, Homo sapiens
tgtccagtgcccattc

SEQ ID NO: 5806081 - DNA, 17 bp, Homo sapiens
tgtccagtgcccattcc

SEQ ID NO: 5806082 - DNA, 12 bp, Homo sapiens
tgtccagtgcct

SEQ ID NO: 5806083 - DNA, 17 bp, Homo sapiens
tgtccagtgcctacatc

SEQ ID NO: 5806084 - DNA, 15 bp, Homo sapiens
tgtccagtggagggc

SEQ ID NO: 5806085 - DNA, 23 bp, Homo sapiens
tgtccagtgggtaggttggactg

SEQ ID NO: 5806086 - DNA, 22 bp, Homo sapiens
tgtccagttcaggaatttttgt

SEQ ID NO: 5806087 - DNA, 17 bp, Homo sapiens
tgtccagttcccagaag

SEQ ID NO: 5806088 - DNA, 14 bp, Homo sapiens
tgtccatactaaca

SEQ ID NO: 5806089 - DNA, 19 bp, Homo sapiens
tgtccatagatataaagcc

SEQ ID NO: 5806090 - DNA, 20 bp, Homo sapiens
tgtccatatcagacctctga

SEQ ID NO: 5806091 - DNA, 23 bp, Homo sapiens
tgtccatatcagacctctgatcc

SEQ ID NO: 5806092 - DNA, 19 bp, Homo sapiens
tgtccatcagattctgtga

SEQ ID NO: 5806093 - DNA, 20 bp, Homo sapiens
tgtccatcatattaaaaata

SEQ ID NO: 5806094 - DNA, 16 bp, Homo sapiens
tgtccatcccttttcc

SEQ ID NO: 5806095 - DNA, 17 bp, Homo sapiens
tgtccatcccttttcct

SEQ ID NO: 5806096 - DNA, 15 bp, Homo sapiens
tgtccatcctcctct

SEQ ID NO: 5806097 - DNA, 16 bp, Homo sapiens
tgtccatcctcctctc

SEQ ID NO: 5806098 - DNA, 17 bp, Homo sapiens
tgtccatcctcctctcc

SEQ ID NO: 5806099 - DNA, 19 bp, Homo sapiens
tgtccatcctcctctccat

SEQ ID NO: 5806100 - DNA, 14 bp, Homo sapiens
tgtccatctgtctg

SEQ ID NO: 5806101 - DNA, 15 bp, Homo sapiens
tgtccatctgtctgt

SEQ ID NO: 5806102 - DNA, 18 bp, Homo sapiens
tgtccatgaaaaacagca

SEQ ID NO: 5806103 - DNA, 20 bp, Homo sapiens
tgtccatgatgtccttgtta

SEQ ID NO: 5806104 - DNA, 14 bp, Homo sapiens
tgtccatgcctaca

SEQ ID NO: 5806105 - DNA, 18 bp, Homo sapiens
tgtccatgcgctcagggc

SEQ ID NO: 5806106 - DNA, 16 bp, Homo sapiens
tgtccatggcctttct

SEQ ID NO: 5806107 - DNA, 17 bp, Homo sapiens
tgtccatggcctttcta

SEQ ID NO: 5806108 - DNA, 16 bp, Homo sapiens
tgtccatgtgaaattt

SEQ ID NO: 5806109 - DNA, 13 bp, Homo sapiens
tgtccatgtgtgt

SEQ ID NO: 5806110 - DNA, 14 bp, Homo sapiens
tgtccattattcat

SEQ ID NO: 5806111 - DNA, 16 bp, Homo sapiens
tgtccattcactttca

SEQ ID NO: 5806112 - DNA, 15 bp, Homo sapiens
tgtccattgacatgt

SEQ ID NO: 5806113 - DNA, 18 bp, Homo sapiens
tgtccattgacatgtaca

SEQ ID NO: 5806114 - DNA, 19 bp, Homo sapiens
tgtccattgacatgtacag

SEQ ID NO: 5806115 - DNA, 20 bp, Homo sapiens
tgtccattgacatgtacaga

SEQ ID NO: 5806116 - DNA, 16 bp, Homo sapiens
tgtccattgccacggc

SEQ ID NO: 5806117 - DNA, 17 bp, Homo sapiens
tgtccattgccacggcc

SEQ ID NO: 5806118 - DNA, 23 bp, Homo sapiens
tgtccattgtaaatctgaagaaa

SEQ ID NO: 5806119 - DNA, 17 bp, Homo sapiens
tgtccattgtccaatcc

SEQ ID NO: 5806120 - DNA, 14 bp, Homo sapiens
tgtccatttaaaaa

SEQ ID NO: 5806121 - DNA, 12 bp, Homo sapiens
tgtccatttcaa

SEQ ID NO: 5806122 - DNA, 14 bp, Homo sapiens
tgtccatttgtccc

SEQ ID NO: 5806123 - DNA, 15 bp, Homo sapiens
tgtccattttgtgaa

SEQ ID NO: 5806124 - DNA, 21 bp, Homo sapiens
tgtccattttgtgaagccctg

SEQ ID NO: 5806125 - DNA, 23 bp, Homo sapiens
tgtcccaaaaagaaaggagggga

SEQ ID NO: 5806126 - DNA, 13 bp, Homo sapiens
tgtcccaaataaa

SEQ ID NO: 5806127 - DNA, 16 bp, Homo sapiens
tgtcccaacttgtaaa

SEQ ID NO: 5806128 - DNA, 19 bp, Homo sapiens
tgtcccaagccgggagcca

SEQ ID NO: 5806129 - DNA, 16 bp, Homo sapiens
tgtcccaagctcccaa

SEQ ID NO: 5806130 - DNA, 22 bp, Homo sapiens
tgtcccaagctcccaagagctt

SEQ ID NO: 5806131 - DNA, 15 bp, Homo sapiens
tgtcccaaggagctg

SEQ ID NO: 5806132 - DNA, 16 bp, Homo sapiens
tgtcccaaggagctga

SEQ ID NO: 5806133 - DNA, 16 bp, Homo sapiens
tgtcccaaggaggggg

SEQ ID NO: 5806134 - DNA, 22 bp, Homo sapiens
tgtcccaatcttaccagatgct

SEQ ID NO: 5806135 - DNA, 15 bp, Homo sapiens
tgtcccacaaaatat

SEQ ID NO: 5806136 - DNA, 17 bp, Homo sapiens
tgtcccacagcttgggg

SEQ ID NO: 5806137 - DNA, 22 bp, Homo sapiens
tgtcccacatggccatcttctt

SEQ ID NO: 5806138 - DNA, 20 bp, Homo sapiens
tgtcccaccaactctgcact

SEQ ID NO: 5806139 - DNA, 20 bp, Homo sapiens
tgtcccaccacagtccctca

SEQ ID NO: 5806140 - DNA, 11 bp, Homo sapiens
tgtcccaccca

SEQ ID NO: 5806141 - DNA, 14 bp, Homo sapiens
tgtcccacccacac

SEQ ID NO: 5806142 - DNA, 22 bp, Homo sapiens
tgtcccacccccagcagctcac

SEQ ID NO: 5806143 - DNA, 12 bp, Homo sapiens
tgtcccacccct

SEQ ID NO: 5806144 - DNA, 18 bp, Homo sapiens
tgtcccaccgggagcctc

SEQ ID NO: 5806145 - DNA, 12 bp, Homo sapiens
tgtcccacctgg

SEQ ID NO: 5806146 - DNA, 15 bp, Homo sapiens
tgtcccacctggctc

SEQ ID NO: 5806147 - DNA, 16 bp, Homo sapiens
tgtcccacctggctcc

SEQ ID NO: 5806148 - DNA, 21 bp, Homo sapiens
tgtcccacgtgtcttccactt

SEQ ID NO: 5806149 - DNA, 22 bp, Homo sapiens
tgtcccacgtgtcttccacttt

SEQ ID NO: 5806150 - DNA, 22 bp, Homo sapiens
tgtcccactacatctgggactg

SEQ ID NO: 5806151 - DNA, 15 bp, Homo sapiens
tgtcccactatctgg

SEQ ID NO: 5806152 - DNA, 16 bp, Homo sapiens
tgtcccactatctggg

SEQ ID NO: 5806153 - DNA, 15 bp, Homo sapiens
tgtcccactggctcc

SEQ ID NO: 5806154 - DNA, 22 bp, Homo sapiens
tgtcccacttctcatcttaaaa

SEQ ID NO: 5806155 - DNA, 16 bp, Homo sapiens
tgtcccagaattttct

SEQ ID NO: 5806156 - DNA, 23 bp, Homo sapiens
tgtcccagaggttatctgcctgg

SEQ ID NO: 5806157 - DNA, 22 bp, Homo sapiens
tgtcccagatgctgtcattagt

SEQ ID NO: 5806158 - DNA, 23 bp, Homo sapiens
tgtcccagcagaagagggaggct

SEQ ID NO: 5806159 - DNA, 15 bp, Homo sapiens
tgtcccagccacgca

SEQ ID NO: 5806160 - DNA, 20 bp, Homo sapiens
tgtcccagccacgcagggcc

SEQ ID NO: 5806161 - DNA, 13 bp, Homo sapiens
tgtcccagccagt

SEQ ID NO: 5806162 - DNA, 22 bp, Homo sapiens
tgtcccagccccggcaagccac

SEQ ID NO: 5806163 - DNA, 16 bp, Homo sapiens
tgtcccagcctggggc

SEQ ID NO: 5806164 - DNA, 17 bp, Homo sapiens
tgtcccagcctggggct

SEQ ID NO: 5806165 - DNA, 23 bp, Homo sapiens
tgtcccagcctggggctccctct

SEQ ID NO: 5806166 - DNA, 14 bp, Homo sapiens
tgtcccagctacca

SEQ ID NO: 5806167 - DNA, 18 bp, Homo sapiens
tgtcccagctaccaagtc

SEQ ID NO: 5806168 - DNA, 18 bp, Homo sapiens
tgtcccaggactcaccct

SEQ ID NO: 5806169 - DNA, 19 bp, Homo sapiens
tgtcccaggatggtcccag

SEQ ID NO: 5806170 - DNA, 13 bp, Homo sapiens
tgtcccaggcatg

SEQ ID NO: 5806171 - DNA, 18 bp, Homo sapiens
tgtcccaggcatgcagct

SEQ ID NO: 5806172 - DNA, 24 bp, Homo sapiens
tgtcccaggcatgcagctgcctgg

SEQ ID NO: 5806173 - DNA, 21 bp, Homo sapiens
tgtcccaggggtctccctgag

SEQ ID NO: 5806174 - DNA, 14 bp, Homo sapiens
tgtcccaggtcctc

SEQ ID NO: 5806175 - DNA, 16 bp, Homo sapiens
tgtcccaggtcctcac

SEQ ID NO: 5806176 - DNA, 21 bp, Homo sapiens
tgtcccagtcccagcctctgg

SEQ ID NO: 5806177 - DNA, 13 bp, Homo sapiens
tgtcccagtgctc

SEQ ID NO: 5806178 - DNA, 23 bp, Homo sapiens
tgtcccagtgctcaccagccctg

SEQ ID NO: 5806179 - DNA, 14 bp, Homo sapiens
tgtcccagtgtctg

SEQ ID NO: 5806180 - DNA, 23 bp, Homo sapiens
tgtcccagtgtctggcccagcca

SEQ ID NO: 5806181 - DNA, 18 bp, Homo sapiens
tgtcccagtttcccactc

SEQ ID NO: 5806182 - DNA, 19 bp, Homo sapiens
tgtcccatccccaggtccc

SEQ ID NO: 5806183 - DNA, 16 bp, Homo sapiens
tgtcccatccttccca

SEQ ID NO: 5806184 - DNA, 21 bp, Homo sapiens
tgtcccatcggagtgcggacc

SEQ ID NO: 5806185 - DNA, 12 bp, Homo sapiens
tgtcccatctct

SEQ ID NO: 5806186 - DNA, 14 bp, Homo sapiens
tgtcccatctgccc

SEQ ID NO: 5806187 - DNA, 16 bp, Homo sapiens
tgtcccatctgccctc

SEQ ID NO: 5806188 - DNA, 20 bp, Homo sapiens
tgtcccatctggtcatttgg

SEQ ID NO: 5806189 - DNA, 16 bp, Homo sapiens
tgtcccatgacccacc

SEQ ID NO: 5806190 - DNA, 18 bp, Homo sapiens
tgtcccatgacccacccc

SEQ ID NO: 5806191 - DNA, 19 bp, Homo sapiens
tgtcccatgacccacccct

SEQ ID NO: 5806192 - DNA, 20 bp, Homo sapiens
tgtcccatgacccacccctg

SEQ ID NO: 5806193 - DNA, 17 bp, Homo sapiens
tgtcccatggacactcc

SEQ ID NO: 5806194 - DNA, 19 bp, Homo sapiens
tgtcccatggacactccag

SEQ ID NO: 5806195 - DNA, 19 bp, Homo sapiens
tgtcccatgggctctggcc

SEQ ID NO: 5806196 - DNA, 20 bp, Homo sapiens
tgtcccatgggctctggccc

SEQ ID NO: 5806197 - DNA, 14 bp, Homo sapiens
tgtcccatggggaa

SEQ ID NO: 5806198 - DNA, 23 bp, Homo sapiens
tgtcccatggggaaaccctggag

SEQ ID NO: 5806199 - DNA, 22 bp, Homo sapiens
tgtcccatgtgagctgctgcca

SEQ ID NO: 5806200 - DNA, 17 bp, Homo sapiens
tgtcccattccctggga

SEQ ID NO: 5806201 - DNA, 15 bp, Homo sapiens
tgtcccattctagat

SEQ ID NO: 5806202 - DNA, 21 bp, Homo sapiens
tgtcccattctagatcctgca

SEQ ID NO: 5806203 - DNA, 23 bp, Homo sapiens
tgtcccattctagatcctgcacc

SEQ ID NO: 5806204 - DNA, 17 bp, Homo sapiens
tgtcccatttccttgga

SEQ ID NO: 5806205 - DNA, 20 bp, Homo sapiens
tgtcccatttccttggaggc

SEQ ID NO: 5806206 - DNA, 19 bp, Homo sapiens
tgtccccaaatccgaacct

SEQ ID NO: 5806207 - DNA, 21 bp, Homo sapiens
tgtccccaagacacttcccct

SEQ ID NO: 5806208 - DNA, 20 bp, Homo sapiens
tgtccccaatgctgtacctg

SEQ ID NO: 5806209 - DNA, 23 bp, Homo sapiens
tgtccccaatgctgtacctggct

SEQ ID NO: 5806210 - DNA, 11 bp, Homo sapiens
tgtccccacac

SEQ ID NO: 5806211 - DNA, 12 bp, Homo sapiens
tgtccccacact

SEQ ID NO: 5806212 - DNA, 16 bp, Homo sapiens
tgtccccacactccta

SEQ ID NO: 5806213 - DNA, 14 bp, Homo sapiens
tgtccccaccatct

SEQ ID NO: 5806214 - DNA, 21 bp, Homo sapiens
tgtccccaccatctgctgtct

SEQ ID NO: 5806215 - DNA, 13 bp, Homo sapiens
tgtccccaccgca

SEQ ID NO: 5806216 - DNA, 19 bp, Homo sapiens
tgtccccaccgcagacagg

SEQ ID NO: 5806217 - DNA, 21 bp, Homo sapiens
tgtccccacgtatgtcggcac

SEQ ID NO: 5806218 - DNA, 13 bp, Homo sapiens
tgtccccagacca

SEQ ID NO: 5806219 - DNA, 21 bp, Homo sapiens
tgtccccagaccaaccctggg

SEQ ID NO: 5806220 - DNA, 14 bp, Homo sapiens
tgtccccagagaca

SEQ ID NO: 5806221 - DNA, 12 bp, Homo sapiens
tgtccccagcag

SEQ ID NO: 5806222 - DNA, 16 bp, Homo sapiens
tgtccccagcccactg

SEQ ID NO: 5806223 - DNA, 21 bp, Homo sapiens
tgtccccagccctgtcctggt

SEQ ID NO: 5806224 - DNA, 13 bp, Homo sapiens
tgtccccaggcct

SEQ ID NO: 5806225 - DNA, 14 bp, Homo sapiens
tgtccccaggtcct

SEQ ID NO: 5806226 - DNA, 18 bp, Homo sapiens
tgtccccaggtcctgtct

SEQ ID NO: 5806227 - DNA, 17 bp, Homo sapiens
tgtccccagtccccagc

SEQ ID NO: 5806228 - DNA, 19 bp, Homo sapiens
tgtccccataagacaaaca

SEQ ID NO: 5806229 - DNA, 14 bp, Homo sapiens
tgtccccatagctg

SEQ ID NO: 5806230 - DNA, 14 bp, Homo sapiens
tgtccccattctat

SEQ ID NO: 5806231 - DNA, 22 bp, Homo sapiens
tgtccccattctataaattcaa

SEQ ID NO: 5806232 - DNA, 13 bp, Homo sapiens
tgtcccccaactt

SEQ ID NO: 5806233 - DNA, 16 bp, Homo sapiens
tgtcccccaacttgag

SEQ ID NO: 5806234 - DNA, 20 bp, Homo sapiens
tgtcccccacctcttttcct

SEQ ID NO: 5806235 - DNA, 21 bp, Homo sapiens
tgtcccccacctcttttccta

SEQ ID NO: 5806236 - DNA, 24 bp, Homo sapiens
tgtcccccactctctcacccacca

SEQ ID NO: 5806237 - DNA, 13 bp, Homo sapiens
tgtcccccagctc

SEQ ID NO: 5806238 - DNA, 16 bp, Homo sapiens
tgtcccccagctctgg

SEQ ID NO: 5806239 - DNA, 21 bp, Homo sapiens
tgtccccccaaaattcatgtg

SEQ ID NO: 5806240 - DNA, 16 bp, Homo sapiens
tgtcccccctgtggtc

SEQ ID NO: 5806241 - DNA, 18 bp, Homo sapiens
tgtccttaacccacctct

SEQ ID NO: 5806242 - DNA, 19 bp, Homo sapiens
tgtccttaacccacctctc

SEQ ID NO: 5806243 - DNA, 17 bp, Homo sapiens
tgtccttactcagagct

SEQ ID NO: 5806244 - DNA, 12 bp, Homo sapiens
tgtccttagaac

SEQ ID NO: 5806245 - DNA, 16 bp, Homo sapiens
tgtccttcagagctct

SEQ ID NO: 5806246 - DNA, 18 bp, Homo sapiens
tgtccttccatcttcaca

SEQ ID NO: 5806247 - DNA, 16 bp, Homo sapiens
tgtccttcccacggcc

SEQ ID NO: 5806248 - DNA, 12 bp, Homo sapiens
tgtccttccccc

SEQ ID NO: 5806249 - DNA, 12 bp, Homo sapiens
tgtccttcccct

SEQ ID NO: 5806250 - DNA, 14 bp, Homo sapiens
tgtccttccccttc

SEQ ID NO: 5806251 - DNA, 14 bp, Homo sapiens
tgtccttccctgca

SEQ ID NO: 5806252 - DNA, 16 bp, Homo sapiens
tgtccttccctgcatt

SEQ ID NO: 5806253 - DNA, 16 bp, Homo sapiens
tgtccttccctgccac

SEQ ID NO: 5806254 - DNA, 14 bp, Homo sapiens
tgtccttcctccac

SEQ ID NO: 5806255 - DNA, 21 bp, Homo sapiens
tgtccttctcaggctggcatc

SEQ ID NO: 5806256 - DNA, 15 bp, Homo sapiens
tgtccttctcctctt

SEQ ID NO: 5806257 - DNA, 20 bp, Homo sapiens
tgtccttcttcctcaagtct

SEQ ID NO: 5806258 - DNA, 19 bp, Homo sapiens
tgtccttgcacctgagcct

SEQ ID NO: 5806259 - DNA, 20 bp, Homo sapiens
tgtccttgcacctgagcctg

SEQ ID NO: 5806260 - DNA, 15 bp, Homo sapiens
tgtccttgcacctgc

SEQ ID NO: 5806261 - DNA, 17 bp, Homo sapiens
tgtccttgcagacagaa

SEQ ID NO: 5806262 - DNA, 16 bp, Homo sapiens
tgtccttgccccactc

SEQ ID NO: 5806263 - DNA, 20 bp, Homo sapiens
tgtccttgccccactcctct

SEQ ID NO: 5806264 - DNA, 18 bp, Homo sapiens
tgtccttggacctagagg

SEQ ID NO: 5806265 - DNA, 14 bp, Homo sapiens
tgtccttggggaca

SEQ ID NO: 5806266 - DNA, 23 bp, Homo sapiens
tgtccttgtggtctttgctgctg

SEQ ID NO: 5806267 - DNA, 21 bp, Homo sapiens
tgtccttgttcatggagagct

SEQ ID NO: 5806268 - DNA, 19 bp, Homo sapiens
tgtcctttaaaaaagaaaa

SEQ ID NO: 5806269 - DNA, 17 bp, Homo sapiens
tgtcctttatgtattct

SEQ ID NO: 5806270 - DNA, 19 bp, Homo sapiens
tgtcctttatgtattctct

SEQ ID NO: 5806271 - DNA, 21 bp, Homo sapiens
tgtcctttatgtattctcttc

SEQ ID NO: 5806272 - DNA, 12 bp, Homo sapiens
tgtcctttcccc

SEQ ID NO: 5806273 - DNA, 22 bp, Homo sapiens
tgtcctttcccctctctgcccc

SEQ ID NO: 5806274 - DNA, 14 bp, Homo sapiens
tgtcctttccctgg

SEQ ID NO: 5806275 - DNA, 19 bp, Homo sapiens
tgtcctttccctggagtca

SEQ ID NO: 5806276 - DNA, 12 bp, Homo sapiens
tgtcctttcctt

SEQ ID NO: 5806277 - DNA, 18 bp, Homo sapiens
tgtcctttctagagcact

SEQ ID NO: 5806278 - DNA, 14 bp, Homo sapiens
tgtcctttctcaga

SEQ ID NO: 5806279 - DNA, 15 bp, Homo sapiens
tgtcctttctccagg

SEQ ID NO: 5806280 - DNA, 17 bp, Homo sapiens
tgtcctttctccaggcc

SEQ ID NO: 5806281 - DNA, 14 bp, Homo sapiens
tgtcctttgagaaa

SEQ ID NO: 5806282 - DNA, 22 bp, Homo sapiens
tgtcctttgagaaagaaataat

SEQ ID NO: 5806283 - DNA, 17 bp, Homo sapiens
tgtcctttgaggcccca

SEQ ID NO: 5806284 - DNA, 20 bp, Homo sapiens
tgtcctttgaggccccaact

SEQ ID NO: 5806285 - DNA, 14 bp, Homo sapiens
tgtccttttaggaa

SEQ ID NO: 5806286 - DNA, 20 bp, Homo sapiens
tgtccttttatttctccatc

SEQ ID NO: 5806287 - DNA, 22 bp, Homo sapiens
tgtccttttcataggtctgaaa

SEQ ID NO: 5806288 - DNA, 21 bp, Homo sapiens
tgtccttttctcccatttctt

SEQ ID NO: 5806289 - DNA, 15 bp, Homo sapiens
tgtcctttttcactt

SEQ ID NO: 5806290 - DNA, 20 bp, Homo sapiens
tgtcctttttcactttgaaa

SEQ ID NO: 5806291 - DNA, 23 bp, Homo sapiens
tgtcctttttcactttgaaaagt

SEQ ID NO: 5806292 - DNA, 15 bp, Homo sapiens
tgtcctttttcctct

SEQ ID NO: 5806293 - DNA, 22 bp, Homo sapiens
tgtcgaaggggaggcacacttt

SEQ ID NO: 5806294 - DNA, 21 bp, Homo sapiens
tgtcgagagctggccaaagag

SEQ ID NO: 5806295 - DNA, 22 bp, Homo sapiens
tgtcgatgtaggcattctggag

SEQ ID NO: 5806296 - DNA, 22 bp, Homo sapiens
tgtcgattaaaatcactctcag

SEQ ID NO: 5806297 - DNA, 23 bp, Homo sapiens
tgtcgattagactggacagcttg

SEQ ID NO: 5806298 - DNA, 13 bp, Homo sapiens
tgtcgcacaatgt

SEQ ID NO: 5806299 - DNA, 23 bp, Homo sapiens
tgtcgccacacgcctctgtgtac

SEQ ID NO: 5806300 - DNA, 17 bp, Homo sapiens
tgtcgcccacccagctg

SEQ ID NO: 5806301 - DNA, 13 bp, Homo sapiens
tgtcgcccaggct

SEQ ID NO: 5806302 - DNA, 22 bp, Homo sapiens
tgtcgcccaggctggagggcag

SEQ ID NO: 5806303 - DNA, 14 bp, Homo sapiens
tgtcgcccagtctg

SEQ ID NO: 5806304 - DNA, 17 bp, Homo sapiens
tgtcgcccagtgccctg

SEQ ID NO: 5806305 - DNA, 16 bp, Homo sapiens
tgtcgccccaggccct

SEQ ID NO: 5806306 - DNA, 17 bp, Homo sapiens
tgtcgccccaggccctc

SEQ ID NO: 5806307 - DNA, 15 bp, Homo sapiens
tgtcgcccttctccc

SEQ ID NO: 5806308 - DNA, 14 bp, Homo sapiens
tgtcgccgtccctc

SEQ ID NO: 5806309 - DNA, 21 bp, Homo sapiens
tgtcgcctctcactctggcag

SEQ ID NO: 5806310 - DNA, 13 bp, Homo sapiens
tgtcgcctctgca

SEQ ID NO: 5806311 - DNA, 12 bp, Homo sapiens
tgtcgcctgccc

SEQ ID NO: 5806312 - DNA, 14 bp, Homo sapiens
tgtcgcctgccccc

SEQ ID NO: 5806313 - DNA, 24 bp, Homo sapiens
tgtcgcctgcccccagcactcctc

SEQ ID NO: 5806314 - DNA, 22 bp, Homo sapiens
tgtcgcctgcggactccatggc

SEQ ID NO: 5806315 - DNA, 21 bp, Homo sapiens
tgtcgcgcgtctcccatcctg

SEQ ID NO: 5806316 - DNA, 14 bp, Homo sapiens
tgtcgcgctcagca

SEQ ID NO: 5806317 - DNA, 21 bp, Homo sapiens
tgtcgcgtctcattttgtcca

SEQ ID NO: 5806318 - DNA, 14 bp, Homo sapiens
tgtcgctcaggctg

SEQ ID NO: 5806319 - DNA, 18 bp, Homo sapiens
tgtcgctcaggctggagt

SEQ ID NO: 5806320 - DNA, 14 bp, Homo sapiens
tgtcgctcatgtgt

SEQ ID NO: 5806321 - DNA, 16 bp, Homo sapiens
tgtcgctcatgtgtgc

SEQ ID NO: 5806322 - DNA, 19 bp, Homo sapiens
tgtcgctctgctggcctgg

SEQ ID NO: 5806323 - DNA, 12 bp, Homo sapiens
tgtcgctgcttc

SEQ ID NO: 5806324 - DNA, 15 bp, Homo sapiens
tgtcgctgcttcgtg

SEQ ID NO: 5806325 - DNA, 18 bp, Homo sapiens
tgtcgctgggctgtgggt

SEQ ID NO: 5806326 - DNA, 16 bp, Homo sapiens
tgtcgctgggtcctct

SEQ ID NO: 5806327 - DNA, 18 bp, Homo sapiens
tgtcgctgggtcctctgc

SEQ ID NO: 5806328 - DNA, 14 bp, Homo sapiens
tgtcggagaggctg

SEQ ID NO: 5806329 - DNA, 20 bp, Homo sapiens
tgtcggagaggctgtctggg

SEQ ID NO: 5806330 - DNA, 16 bp, Homo sapiens
tgtcggaggaaagaca

SEQ ID NO: 5806331 - DNA, 16 bp, Homo sapiens
tgtcggatcctgtgag

SEQ ID NO: 5806332 - DNA, 19 bp, Homo sapiens
tgtcggccacaccccagac

SEQ ID NO: 5806333 - DNA, 22 bp, Homo sapiens
tgtcggccccaccagtgcctct

SEQ ID NO: 5806334 - DNA, 18 bp, Homo sapiens
tgtcgggaccacatctgt

SEQ ID NO: 5806335 - DNA, 19 bp, Homo sapiens
tgtcgggcaccagccagcg

SEQ ID NO: 5806336 - DNA, 19 bp, Homo sapiens
tgtcggggaagatgaaacc

SEQ ID NO: 5806337 - DNA, 17 bp, Homo sapiens
tgtcggggctgacctct

SEQ ID NO: 5806338 - DNA, 18 bp, Homo sapiens
tgtcgggggcccaagtgg

SEQ ID NO: 5806339 - DNA, 20 bp, Homo sapiens
tgtcggggggcgagggaggg

SEQ ID NO: 5806340 - DNA, 18 bp, Homo sapiens
tgtcggggtcaagctgga

SEQ ID NO: 5806341 - DNA, 22 bp, Homo sapiens
tgtcggggttggggtgggaggg

SEQ ID NO: 5806342 - DNA, 17 bp, Homo sapiens
tgtcggtggctgccttt

SEQ ID NO: 5806343 - DNA, 16 bp, Homo sapiens
tgtcggtgtgctgtca

SEQ ID NO: 5806344 - DNA, 16 bp, Homo sapiens
tgtcgtaggtaaacta

SEQ ID NO: 5806345 - DNA, 22 bp, Homo sapiens
tgtcgtatttggcacacagcag

SEQ ID NO: 5806346 - DNA, 18 bp, Homo sapiens
tgtcgtccccagaccagt

SEQ ID NO: 5806347 - DNA, 15 bp, Homo sapiens
tgtcgtctctcccac

SEQ ID NO: 5806348 - DNA, 21 bp, Homo sapiens
tgtcgtctctcccaccccctc

SEQ ID NO: 5806349 - DNA, 13 bp, Homo sapiens
tgtcgtctgactc

SEQ ID NO: 5806350 - DNA, 14 bp, Homo sapiens
tgtcgtctgactct

SEQ ID NO: 5806351 - DNA, 19 bp, Homo sapiens
tgtcgtctgactctgggtt

SEQ ID NO: 5806352 - DNA, 12 bp, Homo sapiens
tgtcgtctgtga

SEQ ID NO: 5806353 - DNA, 17 bp, Homo sapiens
tgtcgtctgtgaatgct

SEQ ID NO: 5806354 - DNA, 21 bp, Homo sapiens
tgtcgtcttgaacgagcagcc

SEQ ID NO: 5806355 - DNA, 20 bp, Homo sapiens
tgtcgtggactccagctcta

SEQ ID NO: 5806356 - DNA, 14 bp, Homo sapiens
tgtcgtgggatggc

SEQ ID NO: 5806357 - DNA, 17 bp, Homo sapiens
tgtcgtggtagcagatg

SEQ ID NO: 5806358 - DNA, 19 bp, Homo sapiens
tgtcgtggttcttaaatgt

SEQ ID NO: 5806359 - DNA, 15 bp, Homo sapiens
tgtcgtgtttacaaa

SEQ ID NO: 5806360 - DNA, 23 bp, Homo sapiens
tgtcgtgtttacaaaaggcagcc

SEQ ID NO: 5806361 - DNA, 12 bp, Homo sapiens
tgtcgtgttttc

SEQ ID NO: 5806362 - DNA, 13 bp, Homo sapiens
tgtcgttcatttt

SEQ ID NO: 5806363 - DNA, 24 bp, Homo sapiens
tgtcgttcccttgtgtctgttgct

SEQ ID NO: 5806364 - DNA, 22 bp, Homo sapiens
tgtcgttgactttagggactca

SEQ ID NO: 5806365 - DNA, 18 bp, Homo sapiens
tgtcgtttcattcatttt

SEQ ID NO: 5806366 - DNA, 19 bp, Homo sapiens
tgtcgtttcattcattttg

SEQ ID NO: 5806367 - DNA, 13 bp, Homo sapiens
tgtctaaaaaaca

SEQ ID NO: 5806368 - DNA, 18 bp, Homo sapiens
tgtctaaaaaacaaaaca

SEQ ID NO: 5806369 - DNA, 13 bp, Homo sapiens
tgtctaaaaacac

SEQ ID NO: 5806370 - DNA, 17 bp, Homo sapiens
tgtctaaaagattcttt

SEQ ID NO: 5806371 - DNA, 18 bp, Homo sapiens
tgtctaaaagattcttta

SEQ ID NO: 5806372 - DNA, 19 bp, Homo sapiens
tgtctaaaagattctttaa

SEQ ID NO: 5806373 - DNA, 20 bp, Homo sapiens
tgtctaaacaatgctgattt

SEQ ID NO: 5806374 - DNA, 21 bp, Homo sapiens
tgtctaaacaatgctgatttg

SEQ ID NO: 5806375 - DNA, 21 bp, Homo sapiens
tgtctaaagatctttttttaa

SEQ ID NO: 5806376 - DNA, 24 bp, Homo sapiens
tgtctaaagccttaactaagactc

SEQ ID NO: 5806377 - DNA, 13 bp, Homo sapiens
tgtctaacaggac

SEQ ID NO: 5806378 - DNA, 17 bp, Homo sapiens
tgtctaacccccagctg

SEQ ID NO: 5806379 - DNA, 20 bp, Homo sapiens
tgtctaactcagaattattt

SEQ ID NO: 5806380 - DNA, 21 bp, Homo sapiens
tgtctaacttttgtgaagaac

SEQ ID NO: 5806381 - DNA, 14 bp, Homo sapiens
tgtctaagaaacat

SEQ ID NO: 5806382 - DNA, 23 bp, Homo sapiens
tgtctaagaaattgaatactttg

SEQ ID NO: 5806383 - DNA, 13 bp, Homo sapiens
tgtctaagattct

SEQ ID NO: 5806384 - DNA, 16 bp, Homo sapiens
tgtctaagattctaga

SEQ ID NO: 5806385 - DNA, 17 bp, Homo sapiens
tgtctaagattctagat

SEQ ID NO: 5806386 - DNA, 22 bp, Homo sapiens
tgtctaagcagttttgtaaatg

SEQ ID NO: 5806387 - DNA, 23 bp, Homo sapiens
tgtctaagcagttttgtaaatgt

SEQ ID NO: 5806388 - DNA, 17 bp, Homo sapiens
tgtctaagtagggccag

SEQ ID NO: 5806389 - DNA, 21 bp, Homo sapiens
tgtctaagtagggccagggca

SEQ ID NO: 5806390 - DNA, 21 bp, Homo sapiens
tgtctaatagcccataaagtc

SEQ ID NO: 5806391 - DNA, 22 bp, Homo sapiens
tgtctaatatcttaattctttg

SEQ ID NO: 5806392 - DNA, 17 bp, Homo sapiens
tgtctaatgcattaact

SEQ ID NO: 5806393 - DNA, 18 bp, Homo sapiens
tgtctaatgcattaactt

SEQ ID NO: 5806394 - DNA, 13 bp, Homo sapiens
tgtctaatgtatt

SEQ ID NO: 5806395 - DNA, 18 bp, Homo sapiens
tgtctaattgcatctcaa

SEQ ID NO: 5806396 - DNA, 22 bp, Homo sapiens
tgtctacactaagagagaatga

SEQ ID NO: 5806397 - DNA, 13 bp, Homo sapiens
tgtctacagaaaa

SEQ ID NO: 5806398 - DNA, 15 bp, Homo sapiens
tgtctacagaaaatg

SEQ ID NO: 5806399 - DNA, 19 bp, Homo sapiens
tgtctacagaaaatgctgg

SEQ ID NO: 5806400 - DNA, 20 bp, Homo sapiens
tgtctacagaaaatgctggc

SEQ ID NO: 5806401 - DNA, 20 bp, Homo sapiens
tgtctacatatgatctgtct

SEQ ID NO: 5806402 - DNA, 15 bp, Homo sapiens
tgtctacatgtgcca

SEQ ID NO: 5806403 - DNA, 15 bp, Homo sapiens
tgtctactaagtgat

SEQ ID NO: 5806404 - DNA, 19 bp, Homo sapiens
tgtctactcctagaagaac

SEQ ID NO: 5806405 - DNA, 18 bp, Homo sapiens
tgtctactcctcacagca

SEQ ID NO: 5806406 - DNA, 22 bp, Homo sapiens
tgtctactttctcttgtttaaa

SEQ ID NO: 5806407 - DNA, 16 bp, Homo sapiens
tgtctagaatcctgct

SEQ ID NO: 5806408 - DNA, 15 bp, Homo sapiens
tgtctagaatgtgga

SEQ ID NO: 5806409 - DNA, 17 bp, Homo sapiens
tgtctagaatgtggatt

SEQ ID NO: 5806410 - DNA, 14 bp, Homo sapiens
tgtctagagaggga

SEQ ID NO: 5806411 - DNA, 18 bp, Homo sapiens
tgtctagagcctcttggg

SEQ ID NO: 5806412 - DNA, 14 bp, Homo sapiens
tgtctagattttga

SEQ ID NO: 5806413 - DNA, 22 bp, Homo sapiens
tgtctagcaaagccaccaaggg

SEQ ID NO: 5806414 - DNA, 17 bp, Homo sapiens
tgtctagcacatgttga

SEQ ID NO: 5806415 - DNA, 16 bp, Homo sapiens
tgtctagcacttcctt

SEQ ID NO: 5806416 - DNA, 19 bp, Homo sapiens
tgtctaggactgcagtgtg

SEQ ID NO: 5806417 - DNA, 19 bp, Homo sapiens
tgtctaggataatttttaa

SEQ ID NO: 5806418 - DNA, 12 bp, Homo sapiens
tgtctggcccag

SEQ ID NO: 5806419 - DNA, 20 bp, Homo sapiens
tgtctggcccagccatggct

SEQ ID NO: 5806420 - DNA, 20 bp, Homo sapiens
tgtctggcccgcaatactgt

SEQ ID NO: 5806421 - DNA, 22 bp, Homo sapiens
tgtctggcctcacgtgtctcag

SEQ ID NO: 5806422 - DNA, 13 bp, Homo sapiens
tgtctggcctgag

SEQ ID NO: 5806423 - DNA, 20 bp, Homo sapiens
tgtctggcgttctcaagaat

SEQ ID NO: 5806424 - DNA, 23 bp, Homo sapiens
tgtctggctgaggatttcaagcc

SEQ ID NO: 5806425 - DNA, 16 bp, Homo sapiens
tgtctggctgcagagc

SEQ ID NO: 5806426 - DNA, 15 bp, Homo sapiens
tgtctggctgtacgt

SEQ ID NO: 5806427 - DNA, 19 bp, Homo sapiens
tgtctggctttggcactct

SEQ ID NO: 5806428 - DNA, 20 bp, Homo sapiens
tgtctggctttttcctctga

SEQ ID NO: 5806429 - DNA, 22 bp, Homo sapiens
tgtctgggatcggggtggggac

SEQ ID NO: 5806430 - DNA, 12 bp, Homo sapiens
tgtctggggaca

SEQ ID NO: 5806431 - DNA, 18 bp, Homo sapiens
tgtctggggaccctgtag

SEQ ID NO: 5806432 - DNA, 14 bp, Homo sapiens
tgtctggggcagaa

SEQ ID NO: 5806433 - DNA, 14 bp, Homo sapiens
tgtctggggtgagg

SEQ ID NO: 5806434 - DNA, 14 bp, Homo sapiens
tgtctgggtgcagc

SEQ ID NO: 5806435 - DNA, 16 bp, Homo sapiens
tgtctgggtgcagctg

SEQ ID NO: 5806436 - DNA, 21 bp, Homo sapiens
tgtctgggtttggcccaagac

SEQ ID NO: 5806437 - DNA, 17 bp, Homo sapiens
tgtctgggtttttcttg

SEQ ID NO: 5806438 - DNA, 21 bp, Homo sapiens
tgtctggtccacacaccacag

SEQ ID NO: 5806439 - DNA, 22 bp, Homo sapiens
tgtctggtgaggtggcccaggc

SEQ ID NO: 5806440 - DNA, 16 bp, Homo sapiens
tgtctggtgccctggt

SEQ ID NO: 5806441 - DNA, 14 bp, Homo sapiens
tgtctggtggcccc

SEQ ID NO: 5806442 - DNA, 22 bp, Homo sapiens
tgtctggtgggtggagtcaggc

SEQ ID NO: 5806443 - DNA, 14 bp, Homo sapiens
tgtctggtgtagct

SEQ ID NO: 5806444 - DNA, 14 bp, Homo sapiens
tgtctggttaaaaa

SEQ ID NO: 5806445 - DNA, 13 bp, Homo sapiens
tgtctggttctca

SEQ ID NO: 5806446 - DNA, 17 bp, Homo sapiens
tgtctggtttctgtccc

SEQ ID NO: 5806447 - DNA, 15 bp, Homo sapiens
tgtctggttttaaca

SEQ ID NO: 5806448 - DNA, 11 bp, Homo sapiens
tgtctgtaaaa

SEQ ID NO: 5806449 - DNA, 14 bp, Homo sapiens
tgtctgtaaaaaat

SEQ ID NO: 5806450 - DNA, 16 bp, Homo sapiens
tgtctgtaaaaaatgg

SEQ ID NO: 5806451 - DNA, 22 bp, Homo sapiens
tgtctgtaaatctaacattatt

SEQ ID NO: 5806452 - DNA, 13 bp, Homo sapiens
tgtctgtaagaga

SEQ ID NO: 5806453 - DNA, 14 bp, Homo sapiens
tgtctgtaagagaa

SEQ ID NO: 5806454 - DNA, 19 bp, Homo sapiens
tgtctgtacacgtgtcctg

SEQ ID NO: 5806455 - DNA, 15 bp, Homo sapiens
tgtctgtacatactg

SEQ ID NO: 5806456 - DNA, 19 bp, Homo sapiens
tgtctgtagagggccctgg

SEQ ID NO: 5806457 - DNA, 21 bp, Homo sapiens
tgtctgtagagggccctggtg

SEQ ID NO: 5806458 - DNA, 23 bp, Homo sapiens
tgtctgtagagggccctggtgtt

SEQ ID NO: 5806459 - DNA, 17 bp, Homo sapiens
tgtctgtagctcctcaa

SEQ ID NO: 5806460 - DNA, 23 bp, Homo sapiens
tgtctgtagctcctcaactcacc

SEQ ID NO: 5806461 - DNA, 22 bp, Homo sapiens
tgtctgtaggtacgttttatat

SEQ ID NO: 5806462 - DNA, 21 bp, Homo sapiens
tgtctgtaggtgtctctgggc

SEQ ID NO: 5806463 - DNA, 23 bp, Homo sapiens
tgtctgtaggtgtctctgggcct

SEQ ID NO: 5806464 - DNA, 17 bp, Homo sapiens
tgtctgtatataactta

SEQ ID NO: 5806465 - DNA, 21 bp, Homo sapiens
tgtctgtcaaatgtttcctta

SEQ ID NO: 5806466 - DNA, 15 bp, Homo sapiens
tgtctgtcaatcaca

SEQ ID NO: 5806467 - DNA, 15 bp, Homo sapiens
tgtctgtcacaggct

SEQ ID NO: 5806468 - DNA, 14 bp, Homo sapiens
tgtctgtcatctgc

SEQ ID NO: 5806469 - DNA, 13 bp, Homo sapiens
tgtctgtcattgt

SEQ ID NO: 5806470 - DNA, 14 bp, Homo sapiens
tgtctgtcatttct

SEQ ID NO: 5806471 - DNA, 14 bp, Homo sapiens
tgtctgtccaaccc

SEQ ID NO: 5806472 - DNA, 18 bp, Homo sapiens
tgtctgtccaacccctcc

SEQ ID NO: 5806473 - DNA, 22 bp, Homo sapiens
tgtctgtccaacccctccccca

SEQ ID NO: 5806474 - DNA, 18 bp, Homo sapiens
tgtctgtccatctgtctg

SEQ ID NO: 5806475 - DNA, 18 bp, Homo sapiens
tgtctgtccctaaacata

SEQ ID NO: 5806476 - DNA, 20 bp, Homo sapiens
tgtctgtccctaaacatagt

SEQ ID NO: 5806477 - DNA, 20 bp, Homo sapiens
tgtctgtcccttttctttga

SEQ ID NO: 5806478 - DNA, 14 bp, Homo sapiens
tgtctgtcctaccc

SEQ ID NO: 5806479 - DNA, 13 bp, Homo sapiens
tgtctgtcctcag

SEQ ID NO: 5806480 - DNA, 17 bp, Homo sapiens
tgtctgtcctgatttct

SEQ ID NO: 5806481 - DNA, 21 bp, Homo sapiens
tgtctgtccttctgaagtgtg

SEQ ID NO: 5806482 - DNA, 17 bp, Homo sapiens
tgtctgtctacatttct

SEQ ID NO: 5806483 - DNA, 21 bp, Homo sapiens
tgtctgtctccctcccctctc

SEQ ID NO: 5806484 - DNA, 15 bp, Homo sapiens
tgtctgtctctcccc

SEQ ID NO: 5806485 - DNA, 15 bp, Homo sapiens
tgtctgtctgctctt

SEQ ID NO: 5806486 - DNA, 12 bp, Homo sapiens
tgtctgtcttcc

SEQ ID NO: 5806487 - DNA, 15 bp, Homo sapiens
tgtctgtcttctcct

SEQ ID NO: 5806488 - DNA, 12 bp, Homo sapiens
tgtctgtctttg

SEQ ID NO: 5806489 - DNA, 16 bp, Homo sapiens
tgtctgtctttgcaaa

SEQ ID NO: 5806490 - DNA, 18 bp, Homo sapiens
tgtctgtctttgtgggag

SEQ ID NO: 5806491 - DNA, 18 bp, Homo sapiens
tgtctgtgaagtgagacc

SEQ ID NO: 5806492 - DNA, 22 bp, Homo sapiens
tgtctgtgagtacctggtcata

SEQ ID NO: 5806493 - DNA, 20 bp, Homo sapiens
tgtctgtgatctctgctggg

SEQ ID NO: 5806494 - DNA, 22 bp, Homo sapiens
tgtctgtgatgctcccaagcaa

SEQ ID NO: 5806495 - DNA, 15 bp, Homo sapiens
tgtctgtgcacatgc

SEQ ID NO: 5806496 - DNA, 16 bp, Homo sapiens
tgtctgtgcacatgcc

SEQ ID NO: 5806497 - DNA, 21 bp, Homo sapiens
tgtctgtgcacatgcctctgt

SEQ ID NO: 5806498 - DNA, 11 bp, Homo sapiens
tgtctgtgcag

SEQ ID NO: 5806499 - DNA, 12 bp, Homo sapiens
tgtctgtgcaga

SEQ ID NO: 5806500 - DNA, 13 bp, Homo sapiens
tgtctgtgcagct

SEQ ID NO: 5806501 - DNA, 15 bp, Homo sapiens
tgtctgtgccatggc

SEQ ID NO: 5806502 - DNA, 19 bp, Homo sapiens
tgtctgtgccctccaaaga

SEQ ID NO: 5806503 - DNA, 15 bp, Homo sapiens
tgtctgtgcgtctgt

SEQ ID NO: 5806504 - DNA, 12 bp, Homo sapiens
tgtctgtgggct

SEQ ID NO: 5806505 - DNA, 17 bp, Homo sapiens
tgtctgtgggcttcagc

SEQ ID NO: 5806506 - DNA, 14 bp, Homo sapiens
tgtctgtggtccag

SEQ ID NO: 5806507 - DNA, 16 bp, Homo sapiens
tgtctgtggtccagaa

SEQ ID NO: 5806508 - DNA, 22 bp, Homo sapiens
tgtctgtggttgcagtctttcc

SEQ ID NO: 5806509 - DNA, 23 bp, Homo sapiens
tgtctgtggttgcagtctttccc

SEQ ID NO: 5806510 - DNA, 17 bp, Homo sapiens
tgtctgtgtatacatat

SEQ ID NO: 5806511 - DNA, 23 bp, Homo sapiens
tgtctgtgtatgtataggggaaa

SEQ ID NO: 5806512 - DNA, 13 bp, Homo sapiens
tgtctgtgtccca

SEQ ID NO: 5806513 - DNA, 16 bp, Homo sapiens
tgtctgtgtcccagcc

SEQ ID NO: 5806514 - DNA, 10 bp, Homo sapiens
tgtctgtgtg

SEQ ID NO: 5806515 - DNA, 19 bp, Homo sapiens
tgtctgtgtgattttcata

SEQ ID NO: 5806516 - DNA, 12 bp, Homo sapiens
tgtctgtgtgca

SEQ ID NO: 5806517 - DNA, 13 bp, Homo sapiens
tgtctgtgtgcta

SEQ ID NO: 5806518 - DNA, 19 bp, Homo sapiens
tgtctgtgtgctactaaca

SEQ ID NO: 5806519 - DNA, 23 bp, Homo sapiens
tgtctgtgtgctactaacagatt

SEQ ID NO: 5806520 - DNA, 13 bp, Homo sapiens
tgtctgtgtgtgt

SEQ ID NO: 5806521 - DNA, 14 bp, Homo sapiens
tgtctgtgttgctg

SEQ ID NO: 5806522 - DNA, 15 bp, Homo sapiens
tgtctgtgttgctgt

SEQ ID NO: 5806523 - DNA, 20 bp, Homo sapiens
tgtctgtgttgcttcaaatt

SEQ ID NO: 5806524 - DNA, 12 bp, Homo sapiens
tgtctgttacac

SEQ ID NO: 5806525 - DNA, 17 bp, Homo sapiens
tgtctgttacactggag

SEQ ID NO: 5806526 - DNA, 19 bp, Homo sapiens
tgtctgttaccatgtcact

SEQ ID NO: 5806527 - DNA, 22 bp, Homo sapiens
tgtctgttaccatgtcactgtg

SEQ ID NO: 5806528 - DNA, 17 bp, Homo sapiens
tgtctgttatttcctaa

SEQ ID NO: 5806529 - DNA, 14 bp, Homo sapiens
tgtctgttcagcaa

SEQ ID NO: 5806530 - DNA, 20 bp, Homo sapiens
tgtctgttctgcacaataaa

SEQ ID NO: 5806531 - DNA, 18 bp, Homo sapiens
tgtctgttcttcatttct

SEQ ID NO: 5806532 - DNA, 20 bp, Homo sapiens
tgtctgttcttcatttctat

SEQ ID NO: 5806533 - DNA, 12 bp, Homo sapiens
tgtctgttgaaa

SEQ ID NO: 5806534 - DNA, 18 bp, Homo sapiens
tgtctgttgaaataaaac

SEQ ID NO: 5806535 - DNA, 21 bp, Homo sapiens
tgtctgttgcttattgggagt

SEQ ID NO: 5806536 - DNA, 19 bp, Homo sapiens
tgtctgttgcttcagtaaa

SEQ ID NO: 5806537 - DNA, 16 bp, Homo sapiens
tgtctgttgtattcat

SEQ ID NO: 5806538 - DNA, 14 bp, Homo sapiens
tgtctgtttataaa

SEQ ID NO: 5806539 - DNA, 13 bp, Homo sapiens
tgtctgtttcctt

SEQ ID NO: 5806540 - DNA, 16 bp, Homo sapiens
tgtctgttttaaaaac

SEQ ID NO: 5806541 - DNA, 12 bp, Homo sapiens
tgtctgttttcc

SEQ ID NO: 5806542 - DNA, 15 bp, Homo sapiens
tgtctgttttccttc

SEQ ID NO: 5806543 - DNA, 15 bp, Homo sapiens
tgtctgtttttgtat

SEQ ID NO: 5806544 - DNA, 17 bp, Homo sapiens
tgtctgtttttgtatct

SEQ ID NO: 5806545 - DNA, 21 bp, Homo sapiens
tgtcttaaaaaatgtgaaatg

SEQ ID NO: 5806546 - DNA, 14 bp, Homo sapiens
tgtcttaaagaatt

SEQ ID NO: 5806547 - DNA, 23 bp, Homo sapiens
tgtcttaaagggaatcatttttg

SEQ ID NO: 5806548 - DNA, 15 bp, Homo sapiens
tgtcttaaataaaac

SEQ ID NO: 5806549 - DNA, 17 bp, Homo sapiens
tgtcttaaataaaacta

SEQ ID NO: 5806550 - DNA, 20 bp, Homo sapiens
tgtcttaaataaatcaagaa

SEQ ID NO: 5806551 - DNA, 23 bp, Homo sapiens
tgtcttaaataaatcaagaatca

SEQ ID NO: 5806552 - DNA, 19 bp, Homo sapiens
tgtcttaaatactttaatg

SEQ ID NO: 5806553 - DNA, 14 bp, Homo sapiens
tgtcttaaatgctc

SEQ ID NO: 5806554 - DNA, 16 bp, Homo sapiens
tgtcttaaatgctcat

SEQ ID NO: 5806555 - DNA, 17 bp, Homo sapiens
tgtcttaaggagactgg

SEQ ID NO: 5806556 - DNA, 16 bp, Homo sapiens
tgtcttaagtgtttct

SEQ ID NO: 5806557 - DNA, 14 bp, Homo sapiens
tgtcttaatgaagt

SEQ ID NO: 5806558 - DNA, 19 bp, Homo sapiens
tgtcttaatgaagtttgaa

SEQ ID NO: 5806559 - DNA, 20 bp, Homo sapiens
tgtcttaatgaagtttgaat

SEQ ID NO: 5806560 - DNA, 21 bp, Homo sapiens
tgtcttaatgaagtttgaatg

SEQ ID NO: 5806561 - DNA, 20 bp, Homo sapiens
tgtcttaattaagtaaacta

SEQ ID NO: 5806562 - DNA, 15 bp, Homo sapiens
tgtcttaattattat

SEQ ID NO: 5806563 - DNA, 20 bp, Homo sapiens
tgtcttaatttctatcttgt

SEQ ID NO: 5806564 - DNA, 19 bp, Homo sapiens
tgtcttaatttttgaaaaa

SEQ ID NO: 5806565 - DNA, 17 bp, Homo sapiens
tgtcttacaaggcaggc

SEQ ID NO: 5806566 - DNA, 15 bp, Homo sapiens
tgtcttactcaagat

SEQ ID NO: 5806567 - DNA, 18 bp, Homo sapiens
tgtcttagctctggacgt

SEQ ID NO: 5806568 - DNA, 14 bp, Homo sapiens
tgtcttagtgactt

SEQ ID NO: 5806569 - DNA, 20 bp, Homo sapiens
tgtcttataaacaaatgaat

SEQ ID NO: 5806570 - DNA, 12 bp, Homo sapiens
tgtcttataaga

SEQ ID NO: 5806571 - DNA, 19 bp, Homo sapiens
tgtcttataggtttccact

SEQ ID NO: 5806572 - DNA, 14 bp, Homo sapiens
tgtcttatatagca

SEQ ID NO: 5806573 - DNA, 15 bp, Homo sapiens
tgtcttatgaggaat

SEQ ID NO: 5806574 - DNA, 17 bp, Homo sapiens
tgtcttatggattcatt

SEQ ID NO: 5806575 - DNA, 16 bp, Homo sapiens
tgtcttatgtgaaaaa

SEQ ID NO: 5806576 - DNA, 16 bp, Homo sapiens
tgtcttattaagactg

SEQ ID NO: 5806577 - DNA, 14 bp, Homo sapiens
tgtcttattgacag

SEQ ID NO: 5806578 - DNA, 19 bp, Homo sapiens
tgtcttattgacagttgtg

SEQ ID NO: 5806579 - DNA, 14 bp, Homo sapiens
tgtcttatttttag

SEQ ID NO: 5806580 - DNA, 17 bp, Homo sapiens
tgtcttatttttagatg

SEQ ID NO: 5806581 - DNA, 16 bp, Homo sapiens
tgtcttcaaactgtga

SEQ ID NO: 5806582 - DNA, 21 bp, Homo sapiens
tgtcttcaaccctgccctgca

SEQ ID NO: 5806583 - DNA, 22 bp, Homo sapiens
tgtcttcaaccctgccctgcac

SEQ ID NO: 5806584 - DNA, 20 bp, Homo sapiens
tgtcttcaatttgtataaaa

SEQ ID NO: 5806585 - DNA, 14 bp, Homo sapiens
tgtcttcacaacag

SEQ ID NO: 5806586 - DNA, 20 bp, Homo sapiens
tgtcttcacctcatttatag

SEQ ID NO: 5806587 - DNA, 13 bp, Homo sapiens
tgtcttcacctga

SEQ ID NO: 5806588 - DNA, 24 bp, Homo sapiens
tgtcttcacctgattcaactaaaa

SEQ ID NO: 5806589 - DNA, 20 bp, Homo sapiens
tgtcttcacttaatccattt

SEQ ID NO: 5806590 - DNA, 23 bp, Homo sapiens
tgtcttcagaggctcatctaact

SEQ ID NO: 5806591 - DNA, 20 bp, Homo sapiens
tgtcttcagatcctgctgcc

SEQ ID NO: 5806592 - DNA, 21 bp, Homo sapiens
tgtcttcagatcctgctgccg

SEQ ID NO: 5806593 - DNA, 21 bp, Homo sapiens
tgtcttcagtctcacagagaa

SEQ ID NO: 5806594 - DNA, 22 bp, Homo sapiens
tgtcttcatacctacatgtatt

SEQ ID NO: 5806595 - DNA, 17 bp, Homo sapiens
tgtcttcatttcattgt

SEQ ID NO: 5806596 - DNA, 15 bp, Homo sapiens
tgtgaatttttaagc

SEQ ID NO: 5806597 - DNA, 15 bp, Homo sapiens
tgtgaatttttgcct

SEQ ID NO: 5806598 - DNA, 21 bp, Homo sapiens
tgtgacaaaaaattaaagcat

SEQ ID NO: 5806599 - DNA, 12 bp, Homo sapiens
tgtgacaaaatt

SEQ ID NO: 5806600 - DNA, 18 bp, Homo sapiens
tgtgacaaaggatgaaga

SEQ ID NO: 5806601 - DNA, 18 bp, Homo sapiens
tgtgacaacatttttgta

SEQ ID NO: 5806602 - DNA, 16 bp, Homo sapiens
tgtgacaacctttgtg

SEQ ID NO: 5806603 - DNA, 21 bp, Homo sapiens
tgtgacaacctttgtgtaata

SEQ ID NO: 5806604 - DNA, 14 bp, Homo sapiens
tgtgacaagaataa

SEQ ID NO: 5806605 - DNA, 21 bp, Homo sapiens
tgtgacaaggattgctactgt

SEQ ID NO: 5806606 - DNA, 20 bp, Homo sapiens
tgtgacaataatattgttgt

SEQ ID NO: 5806607 - DNA, 22 bp, Homo sapiens
tgtgacaataatattgttgtat

SEQ ID NO: 5806608 - DNA, 22 bp, Homo sapiens
tgtgacaatagggctaaatgtt

SEQ ID NO: 5806609 - DNA, 19 bp, Homo sapiens
tgtgacaattctgttttta

SEQ ID NO: 5806610 - DNA, 23 bp, Homo sapiens
tgtgacacagacggaggactgga

SEQ ID NO: 5806611 - DNA, 22 bp, Homo sapiens
tgtgacacatatgcaccttgtg

SEQ ID NO: 5806612 - DNA, 20 bp, Homo sapiens
tgtgacacatcgttttgggg

SEQ ID NO: 5806613 - DNA, 22 bp, Homo sapiens
tgtgacaccaccactgtgtccc

SEQ ID NO: 5806614 - DNA, 20 bp, Homo sapiens
tgtgacacctaactcttttc

SEQ ID NO: 5806615 - DNA, 12 bp, Homo sapiens
tgtgacacctgg

SEQ ID NO: 5806616 - DNA, 23 bp, Homo sapiens
tgtgacactctcgtggtatgtat

SEQ ID NO: 5806617 - DNA, 13 bp, Homo sapiens
tgtgacactgatg

SEQ ID NO: 5806618 - DNA, 21 bp, Homo sapiens
tgtgacacttataaatatcct

SEQ ID NO: 5806619 - DNA, 14 bp, Homo sapiens
tgtgacagagagag

SEQ ID NO: 5806620 - DNA, 16 bp, Homo sapiens
tgtgacagagccatgg

SEQ ID NO: 5806621 - DNA, 17 bp, Homo sapiens
tgtgacagcctctgcag

SEQ ID NO: 5806622 - DNA, 20 bp, Homo sapiens
tgtgacagcgatggcaggcc

SEQ ID NO: 5806623 - DNA, 22 bp, Homo sapiens
tgtgacagcgatggcaggcctg

SEQ ID NO: 5806624 - DNA, 16 bp, Homo sapiens
tgtgacaggaaagatt

SEQ ID NO: 5806625 - DNA, 22 bp, Homo sapiens
tgtgacaggaaagccctccccc

SEQ ID NO: 5806626 - DNA, 23 bp, Homo sapiens
tgtgacaggaaagccctccccct

SEQ ID NO: 5806627 - DNA, 21 bp, Homo sapiens
tgtgacaggaagcccaaggca

SEQ ID NO: 5806628 - DNA, 16 bp, Homo sapiens
tgtgacaggcagcaga

SEQ ID NO: 5806629 - DNA, 13 bp, Homo sapiens
tgtgacagggcca

SEQ ID NO: 5806630 - DNA, 15 bp, Homo sapiens
tgtgacagggccagt

SEQ ID NO: 5806631 - DNA, 23 bp, Homo sapiens
tgtgacagggccagtggggcctg

SEQ ID NO: 5806632 - DNA, 12 bp, Homo sapiens
tgtgacagggcg

SEQ ID NO: 5806633 - DNA, 22 bp, Homo sapiens
tgtgacagtgaaatacatcctt

SEQ ID NO: 5806634 - DNA, 18 bp, Homo sapiens
tgtgacatattatgtctt

SEQ ID NO: 5806635 - DNA, 21 bp, Homo sapiens
tgtgacatctctattccccac

SEQ ID NO: 5806636 - DNA, 17 bp, Homo sapiens
tgtgacatgcgggctgg

SEQ ID NO: 5806637 - DNA, 19 bp, Homo sapiens
tgtgacatgcgggctgggc

SEQ ID NO: 5806638 - DNA, 15 bp, Homo sapiens
tgtgacattcactca

SEQ ID NO: 5806639 - DNA, 20 bp, Homo sapiens
tgtgacattcactcagagaa

SEQ ID NO: 5806640 - DNA, 14 bp, Homo sapiens
tgtgacattccaca

SEQ ID NO: 5806641 - DNA, 14 bp, Homo sapiens
tgtgacattccttc

SEQ ID NO: 5806642 - DNA, 10 bp, Homo sapiens
tgtgacattt

SEQ ID NO: 5806643 - DNA, 12 bp, Homo sapiens
tgtgacatttac

SEQ ID NO: 5806644 - DNA, 13 bp, Homo sapiens
tgtgacatttatg

SEQ ID NO: 5806645 - DNA, 18 bp, Homo sapiens
tgtgacatttgtcatttt

SEQ ID NO: 5806646 - DNA, 19 bp, Homo sapiens
tgtgacatttgtcattttc

SEQ ID NO: 5806647 - DNA, 22 bp, Homo sapiens
tgtgacatttgtcattttcatt

SEQ ID NO: 5806648 - DNA, 15 bp, Homo sapiens
tgtgacattttacat

SEQ ID NO: 5806649 - DNA, 16 bp, Homo sapiens
tgtgacatttttccgg

SEQ ID NO: 5806650 - DNA, 17 bp, Homo sapiens
tgtgaccaaaagttaca

SEQ ID NO: 5806651 - DNA, 15 bp, Homo sapiens
tgtgaccaaaatacc

SEQ ID NO: 5806652 - DNA, 13 bp, Homo sapiens
tgtgaccaaagca

SEQ ID NO: 5806653 - DNA, 14 bp, Homo sapiens
tgtgaccaactgtg

SEQ ID NO: 5806654 - DNA, 17 bp, Homo sapiens
tgtgaccaactgtgttg

SEQ ID NO: 5806655 - DNA, 21 bp, Homo sapiens
tgtgaccaactgtgttgtatt

SEQ ID NO: 5806656 - DNA, 14 bp, Homo sapiens
tgtgaccaactgtt

SEQ ID NO: 5806657 - DNA, 15 bp, Homo sapiens
tgtgaccaagtataa

SEQ ID NO: 5806658 - DNA, 13 bp, Homo sapiens
tgtgaccaagtta

SEQ ID NO: 5806659 - DNA, 15 bp, Homo sapiens
tgtgaccaatgtctt

SEQ ID NO: 5806660 - DNA, 19 bp, Homo sapiens
tgtgaccacatacgtgtta

SEQ ID NO: 5806661 - DNA, 13 bp, Homo sapiens
tgtgaccaccacc

SEQ ID NO: 5806662 - DNA, 22 bp, Homo sapiens
tgtgaccactgcagaagacagt

SEQ ID NO: 5806663 - DNA, 20 bp, Homo sapiens
tgtgaccagaaagcttcatc

SEQ ID NO: 5806664 - DNA, 17 bp, Homo sapiens
tgtgaccagcactgtct

SEQ ID NO: 5806665 - DNA, 15 bp, Homo sapiens
tgtgaccaggggtga

SEQ ID NO: 5806666 - DNA, 20 bp, Homo sapiens
tgtgaccagttttgatattt

SEQ ID NO: 5806667 - DNA, 17 bp, Homo sapiens
tgtgaccattctgcctc

SEQ ID NO: 5806668 - DNA, 21 bp, Homo sapiens
tgtgacccaaagaagtttaag

SEQ ID NO: 5806669 - DNA, 16 bp, Homo sapiens
tgtgacccaccagtgc

SEQ ID NO: 5806670 - DNA, 17 bp, Homo sapiens
tgtgacccaccagtgcc

SEQ ID NO: 5806671 - DNA, 17 bp, Homo sapiens
tgtgacccccagctccg

SEQ ID NO: 5806672 - DNA, 12 bp, Homo sapiens
tgtgacccctcc

SEQ ID NO: 5806673 - DNA, 15 bp, Homo sapiens
tgtgaccctctcact

SEQ ID NO: 5806674 - DNA, 14 bp, Homo sapiens
tgtgaccctctttg

SEQ ID NO: 5806675 - DNA, 20 bp, Homo sapiens
tgtgaccctctttgctgaag

SEQ ID NO: 5806676 - DNA, 23 bp, Homo sapiens
tgtgaccctgagggctcctccat

SEQ ID NO: 5806677 - DNA, 15 bp, Homo sapiens
tgtgaccctgggcag

SEQ ID NO: 5806678 - DNA, 22 bp, Homo sapiens
tgtgaccggggtcctgaggctg

SEQ ID NO: 5806679 - DNA, 14 bp, Homo sapiens
tgtgacctaagaac

SEQ ID NO: 5806680 - DNA, 15 bp, Homo sapiens
tgtgacctaagaaca

SEQ ID NO: 5806681 - DNA, 15 bp, Homo sapiens
tgtgacctcctgtga

SEQ ID NO: 5806682 - DNA, 16 bp, Homo sapiens
tgtgacctgaagttca

SEQ ID NO: 5806683 - DNA, 14 bp, Homo sapiens
tgtgacctgaggcc

SEQ ID NO: 5806684 - DNA, 13 bp, Homo sapiens
tgtgacctgaggg

SEQ ID NO: 5806685 - DNA, 14 bp, Homo sapiens
tgtgacctgagggc

SEQ ID NO: 5806686 - DNA, 14 bp, Homo sapiens
tgtgacctgctcct

SEQ ID NO: 5806687 - DNA, 13 bp, Homo sapiens
tgtgacctgctga

SEQ ID NO: 5806688 - DNA, 17 bp, Homo sapiens
tgtgacctgctgagctc

SEQ ID NO: 5806689 - DNA, 18 bp, Homo sapiens
tgtgacctgctgagctct

SEQ ID NO: 5806690 - DNA, 14 bp, Homo sapiens
tgtgacctggtctg

SEQ ID NO: 5806691 - DNA, 19 bp, Homo sapiens
tgtgacctggtctggtcag

SEQ ID NO: 5806692 - DNA, 20 bp, Homo sapiens
tgtgacctggtctggtcagg

SEQ ID NO: 5806693 - DNA, 19 bp, Homo sapiens
tgtgacctgtcagaataaa

SEQ ID NO: 5806694 - DNA, 15 bp, Homo sapiens
tgtgaccttagtgtt

SEQ ID NO: 5806695 - DNA, 16 bp, Homo sapiens
tgtgaccttagtgttt

SEQ ID NO: 5806696 - DNA, 16 bp, Homo sapiens
tgtgaccttgggacca

SEQ ID NO: 5806697 - DNA, 17 bp, Homo sapiens
tgtgacctttaattcag

SEQ ID NO: 5806698 - DNA, 15 bp, Homo sapiens
tgtgacgcagacaga

SEQ ID NO: 5806699 - DNA, 17 bp, Homo sapiens
tgtgacgcagacagagg

SEQ ID NO: 5806700 - DNA, 23 bp, Homo sapiens
tgtgacggcagggaaatgtatgt

SEQ ID NO: 5806701 - DNA, 17 bp, Homo sapiens
tgtgacgtgcactgtga

SEQ ID NO: 5806702 - DNA, 15 bp, Homo sapiens
tgtgactaattgtat

SEQ ID NO: 5806703 - DNA, 19 bp, Homo sapiens
tgtgactaattgtataaca

SEQ ID NO: 5806704 - DNA, 12 bp, Homo sapiens
tgtgactagaaa

SEQ ID NO: 5806705 - DNA, 19 bp, Homo sapiens
tgtgactagaaattcttaa

SEQ ID NO: 5806706 - DNA, 15 bp, Homo sapiens
tgtgactagtgctga

SEQ ID NO: 5806707 - DNA, 16 bp, Homo sapiens
tgtgactagtgctgaa

SEQ ID NO: 5806708 - DNA, 20 bp, Homo sapiens
tgtgactagtgctgaagctt

SEQ ID NO: 5806709 - DNA, 23 bp, Homo sapiens
tgtgactagtgctgaagcttatt

SEQ ID NO: 5806710 - DNA, 17 bp, Homo sapiens
tgtgactataaagctgt

SEQ ID NO: 5806711 - DNA, 19 bp, Homo sapiens
tgtgactataaagctgtta

SEQ ID NO: 5806712 - DNA, 20 bp, Homo sapiens
tgtgactatatagagatgtt

SEQ ID NO: 5806713 - DNA, 22 bp, Homo sapiens
tgtgactatatagagatgtttt

SEQ ID NO: 5806714 - DNA, 18 bp, Homo sapiens
tgtgactattaaatgttg

SEQ ID NO: 5806715 - DNA, 16 bp, Homo sapiens
tgtgactcagcagagg

SEQ ID NO: 5806716 - DNA, 19 bp, Homo sapiens
tgtgactcagcagaggcag

SEQ ID NO: 5806717 - DNA, 17 bp, Homo sapiens
tgtgactcagtgtattt

SEQ ID NO: 5806718 - DNA, 22 bp, Homo sapiens
tgtgactcagtgtattttaaat

SEQ ID NO: 5806719 - DNA, 22 bp, Homo sapiens
tgtgactcctcccttccccact

SEQ ID NO: 5806720 - DNA, 13 bp, Homo sapiens
tgtgactcgctta

SEQ ID NO: 5806721 - DNA, 20 bp, Homo sapiens
tgtgactcgcttagctgaaa

SEQ ID NO: 5806722 - DNA, 23 bp, Homo sapiens
tgtgactcgcttagctgaaacct

SEQ ID NO: 5806723 - DNA, 21 bp, Homo sapiens
tgtgactcgggagctgcacac

SEQ ID NO: 5806724 - DNA, 15 bp, Homo sapiens
tgtgactctggcttg

SEQ ID NO: 5806725 - DNA, 20 bp, Homo sapiens
tgtgactctggcttggccta

SEQ ID NO: 5806726 - DNA, 15 bp, Homo sapiens
tgtgactctgggcag

SEQ ID NO: 5806727 - DNA, 19 bp, Homo sapiens
tgtgactcttactccttag

SEQ ID NO: 5806728 - DNA, 12 bp, Homo sapiens
tgtgactctttc

SEQ ID NO: 5806729 - DNA, 15 bp, Homo sapiens
tgtgactgaatttct

SEQ ID NO: 5806730 - DNA, 23 bp, Homo sapiens
tgtgactggcaagaggcctcatg

SEQ ID NO: 5806731 - DNA, 20 bp, Homo sapiens
tgtgactggctaaagctcga

SEQ ID NO: 5806732 - DNA, 18 bp, Homo sapiens
tgtgacttcactgtatat

SEQ ID NO: 5806733 - DNA, 15 bp, Homo sapiens
tgtgacttcatgcta

SEQ ID NO: 5806734 - DNA, 23 bp, Homo sapiens
tgtgacttcgaattagtttgcac

SEQ ID NO: 5806735 - DNA, 15 bp, Homo sapiens
tgtgacttctccagg

SEQ ID NO: 5806736 - DNA, 19 bp, Homo sapiens
tgtgacttcttcttctttg

SEQ ID NO: 5806737 - DNA, 21 bp, Homo sapiens
tgtgacttcttcttctttgtt

SEQ ID NO: 5806738 - DNA, 23 bp, Homo sapiens
tgtgacttgcatcgtggagacag

SEQ ID NO: 5806739 - DNA, 23 bp, Homo sapiens
tgtgactttcaggctactgttct

SEQ ID NO: 5806740 - DNA, 14 bp, Homo sapiens
tgtgactttgaaaa

SEQ ID NO: 5806741 - DNA, 16 bp, Homo sapiens
tgtgacttttctgatt

SEQ ID NO: 5806742 - DNA, 14 bp, Homo sapiens
tgtgacttttgctt

SEQ ID NO: 5806743 - DNA, 16 bp, Homo sapiens
tgtgacttttgcttta

SEQ ID NO: 5806744 - DNA, 12 bp, Homo sapiens
tgtgacttttta

SEQ ID NO: 5806745 - DNA, 17 bp, Homo sapiens
tgtgactttttttggta

SEQ ID NO: 5806746 - DNA, 22 bp, Homo sapiens
tgtgagaaagcagatcatctcc

SEQ ID NO: 5806747 - DNA, 13 bp, Homo sapiens
tgtgagaaaggaa

SEQ ID NO: 5806748 - DNA, 14 bp, Homo sapiens
tgtgagaaaggaaa

SEQ ID NO: 5806749 - DNA, 15 bp, Homo sapiens
tgtgagaaaggaaaa

SEQ ID NO: 5806750 - DNA, 14 bp, Homo sapiens
tgtgagaaatgtct

SEQ ID NO: 5806751 - DNA, 13 bp, Homo sapiens
tgtgagaactgtg

SEQ ID NO: 5806752 - DNA, 17 bp, Homo sapiens
tgtgagaactgtgaata

SEQ ID NO: 5806753 - DNA, 12 bp, Homo sapiens
tgtgagaacttt

SEQ ID NO: 5806754 - DNA, 19 bp, Homo sapiens
tgtgagaagatcattgcca

SEQ ID NO: 5806755 - DNA, 21 bp, Homo sapiens
tgtgagaagatgggggctgga

SEQ ID NO: 5806756 - DNA, 13 bp, Homo sapiens
tgtgagaagccag

SEQ ID NO: 5806757 - DNA, 19 bp, Homo sapiens
tgtgagaaggtttattgtt

SEQ ID NO: 5806758 - DNA, 21 bp, Homo sapiens
tgtgagaaggtttattgttaa

SEQ ID NO: 5806759 - DNA, 11 bp, Homo sapiens
tgtgagaatgg

SEQ ID NO: 5806760 - DNA, 21 bp, Homo sapiens
tgtgagaatggcctggagcag

SEQ ID NO: 5806761 - DNA, 19 bp, Homo sapiens
tgtgagacagtgggaaata

SEQ ID NO: 5806762 - DNA, 15 bp, Homo sapiens
tgtgagaccagggga

SEQ ID NO: 5806763 - DNA, 14 bp, Homo sapiens
tgtgagacccccac

SEQ ID NO: 5806764 - DNA, 21 bp, Homo sapiens
tgtgagacggctggaaattct

SEQ ID NO: 5806765 - DNA, 17 bp, Homo sapiens
tgtgagacttaaaacat

SEQ ID NO: 5806766 - DNA, 13 bp, Homo sapiens
tgtgagagagact

SEQ ID NO: 5806767 - DNA, 14 bp, Homo sapiens
tgtgagagagactg

SEQ ID NO: 5806768 - DNA, 21 bp, Homo sapiens
tgtgagagccacgctggcctt

SEQ ID NO: 5806769 - DNA, 13 bp, Homo sapiens
tgtgagagcccag

SEQ ID NO: 5806770 - DNA, 18 bp, Homo sapiens
tgtgagagtggctttcta

SEQ ID NO: 5806771 - DNA, 13 bp, Homo sapiens
tgtgagataaata

SEQ ID NO: 5806772 - DNA, 14 bp, Homo sapiens
tgtgagataaatat

SEQ ID NO: 5806773 - DNA, 19 bp, Homo sapiens
tgtgagataacttccttca

SEQ ID NO: 5806774 - DNA, 21 bp, Homo sapiens
tgtgcactgcctgcatgagct

SEQ ID NO: 5806775 - DNA, 20 bp, Homo sapiens
tgtgcactggcaccaagtgc

SEQ ID NO: 5806776 - DNA, 24 bp, Homo sapiens
tgtgcactgtataccaagttctta

SEQ ID NO: 5806777 - DNA, 21 bp, Homo sapiens
tgtgcactgtcactttgctct

SEQ ID NO: 5806778 - DNA, 17 bp, Homo sapiens
tgtgcacttagccatga

SEQ ID NO: 5806779 - DNA, 17 bp, Homo sapiens
tgtgcacttatttatga

SEQ ID NO: 5806780 - DNA, 17 bp, Homo sapiens
tgtgcagaaaacattgt

SEQ ID NO: 5806781 - DNA, 18 bp, Homo sapiens
tgtgcagaaaatatttaa

SEQ ID NO: 5806782 - DNA, 19 bp, Homo sapiens
tgtgcagaaaatatttaat

SEQ ID NO: 5806783 - DNA, 15 bp, Homo sapiens
tgtgcagaataatgg

SEQ ID NO: 5806784 - DNA, 22 bp, Homo sapiens
tgtgcagaataatggaaacatt

SEQ ID NO: 5806785 - DNA, 21 bp, Homo sapiens
tgtgcagacactcaagagccc

SEQ ID NO: 5806786 - DNA, 16 bp, Homo sapiens
tgtgcagacagccatg

SEQ ID NO: 5806787 - DNA, 19 bp, Homo sapiens
tgtgcagactcaataaaat

SEQ ID NO: 5806788 - DNA, 12 bp, Homo sapiens
tgtgcagactga

SEQ ID NO: 5806789 - DNA, 15 bp, Homo sapiens
tgtgcagactgtggc

SEQ ID NO: 5806790 - DNA, 13 bp, Homo sapiens
tgtgcagacttca

SEQ ID NO: 5806791 - DNA, 16 bp, Homo sapiens
tgtgcagagcagacag

SEQ ID NO: 5806792 - DNA, 15 bp, Homo sapiens
tgtgcagagctgaag

SEQ ID NO: 5806793 - DNA, 21 bp, Homo sapiens
tgtgcagagctgaagagctgg

SEQ ID NO: 5806794 - DNA, 20 bp, Homo sapiens
tgtgcagagtatacaagtgt

SEQ ID NO: 5806795 - DNA, 22 bp, Homo sapiens
tgtgcagataaacagaaatgct

SEQ ID NO: 5806796 - DNA, 16 bp, Homo sapiens
tgtgcagatgctttgc

SEQ ID NO: 5806797 - DNA, 23 bp, Homo sapiens
tgtgcagcaccctttcaccccca

SEQ ID NO: 5806798 - DNA, 16 bp, Homo sapiens
tgtgcagcacgtctca

SEQ ID NO: 5806799 - DNA, 13 bp, Homo sapiens
tgtgcagcagccc

SEQ ID NO: 5806800 - DNA, 18 bp, Homo sapiens
tgtgcagcagcccagctt

SEQ ID NO: 5806801 - DNA, 16 bp, Homo sapiens
tgtgcagcatttcact

SEQ ID NO: 5806802 - DNA, 20 bp, Homo sapiens
tgtgcagccccgccctctgc

SEQ ID NO: 5806803 - DNA, 23 bp, Homo sapiens
tgtgcagccccgcctccaggcca

SEQ ID NO: 5806804 - DNA, 19 bp, Homo sapiens
tgtgcagccgctgagcgag

SEQ ID NO: 5806805 - DNA, 14 bp, Homo sapiens
tgtgcagccgggga

SEQ ID NO: 5806806 - DNA, 20 bp, Homo sapiens
tgtgcagccggggagctgag

SEQ ID NO: 5806807 - DNA, 23 bp, Homo sapiens
tgtgcagccggggagctgagggg

SEQ ID NO: 5806808 - DNA, 18 bp, Homo sapiens
tgtgcagcttcgaggaca

SEQ ID NO: 5806809 - DNA, 16 bp, Homo sapiens
tgtgcagcttttggtc

SEQ ID NO: 5806810 - DNA, 17 bp, Homo sapiens
tgtgcagcttttggtca

SEQ ID NO: 5806811 - DNA, 20 bp, Homo sapiens
tgtgcaggcctgtccctggg

SEQ ID NO: 5806812 - DNA, 21 bp, Homo sapiens
tgtgcaggctgcagtggctcc

SEQ ID NO: 5806813 - DNA, 16 bp, Homo sapiens
tgtgcaggctgtctca

SEQ ID NO: 5806814 - DNA, 18 bp, Homo sapiens
tgtgcagggccctctggg

SEQ ID NO: 5806815 - DNA, 20 bp, Homo sapiens
tgtgcagggctggtttgttc

SEQ ID NO: 5806816 - DNA, 18 bp, Homo sapiens
tgtgcaggtgctattgtt

SEQ ID NO: 5806817 - DNA, 21 bp, Homo sapiens
tgtgcaggtgctattgttact

SEQ ID NO: 5806818 - DNA, 20 bp, Homo sapiens
tgtgcagtagagagcctttc

SEQ ID NO: 5806819 - DNA, 13 bp, Homo sapiens
tgtgcagtatttt

SEQ ID NO: 5806820 - DNA, 18 bp, Homo sapiens
tgtgcagtattttattaa

SEQ ID NO: 5806821 - DNA, 18 bp, Homo sapiens
tgtgcagtcactggaggt

SEQ ID NO: 5806822 - DNA, 20 bp, Homo sapiens
tgtgcagtcagcttttttcc

SEQ ID NO: 5806823 - DNA, 20 bp, Homo sapiens
tgtgcagtcctgggatgtgg

SEQ ID NO: 5806824 - DNA, 17 bp, Homo sapiens
tgtgcagtcctgggtcc

SEQ ID NO: 5806825 - DNA, 12 bp, Homo sapiens
tgtgcagtgctg

SEQ ID NO: 5806826 - DNA, 18 bp, Homo sapiens
tgtgcagtgttagtattc

SEQ ID NO: 5806827 - DNA, 21 bp, Homo sapiens
tgtgcataaaagttaacatta

SEQ ID NO: 5806828 - DNA, 18 bp, Homo sapiens
tgtgcataatgataaaat

SEQ ID NO: 5806829 - DNA, 15 bp, Homo sapiens
tgtgcataatgcttt

SEQ ID NO: 5806830 - DNA, 17 bp, Homo sapiens
tgtgcatagcgtcctgc

SEQ ID NO: 5806831 - DNA, 19 bp, Homo sapiens
tgtgcatagcgtcctgccc

SEQ ID NO: 5806832 - DNA, 20 bp, Homo sapiens
tgtgcatagcgtcctgccct

SEQ ID NO: 5806833 - DNA, 22 bp, Homo sapiens
tgtgcatagcgtcctgccctgc

SEQ ID NO: 5806834 - DNA, 12 bp, Homo sapiens
tgtgcatataaa

SEQ ID NO: 5806835 - DNA, 21 bp, Homo sapiens
tgtgcatatatactacatgag

SEQ ID NO: 5806836 - DNA, 20 bp, Homo sapiens
tgtgcatatctgcctcccct

SEQ ID NO: 5806837 - DNA, 20 bp, Homo sapiens
tgtgcatatgcatgtgtgtg

SEQ ID NO: 5806838 - DNA, 22 bp, Homo sapiens
tgtgcatatgtgtgtgtgtgca

SEQ ID NO: 5806839 - DNA, 17 bp, Homo sapiens
tgtgcatattgtacact

SEQ ID NO: 5806840 - DNA, 21 bp, Homo sapiens
tgtgcatccgcctgaaagtgt

SEQ ID NO: 5806841 - DNA, 14 bp, Homo sapiens
tgtgcatcctgtga

SEQ ID NO: 5806842 - DNA, 16 bp, Homo sapiens
tgtgcatcctgtgaaa

SEQ ID NO: 5806843 - DNA, 14 bp, Homo sapiens
tgtgcatctggcct

SEQ ID NO: 5806844 - DNA, 18 bp, Homo sapiens
tgtgcatctggcctatga

SEQ ID NO: 5806845 - DNA, 21 bp, Homo sapiens
tgtgcatctggcctatgaccc

SEQ ID NO: 5806846 - DNA, 20 bp, Homo sapiens
tgtgcatctggcctgggggc

SEQ ID NO: 5806847 - DNA, 21 bp, Homo sapiens
tgtgcatctggcctgggggct

SEQ ID NO: 5806848 - DNA, 14 bp, Homo sapiens
tgtgcatctgtgtg

SEQ ID NO: 5806849 - DNA, 15 bp, Homo sapiens
tgtgcatctgtgtgt

SEQ ID NO: 5806850 - DNA, 20 bp, Homo sapiens
tgtgcatgagaatgtcattt

SEQ ID NO: 5806851 - DNA, 15 bp, Homo sapiens
tgtgcatgcatacca

SEQ ID NO: 5806852 - DNA, 22 bp, Homo sapiens
tgtgcatgcataccacaagaca

SEQ ID NO: 5806853 - DNA, 17 bp, Homo sapiens
tgtgcatggaagtaatt

SEQ ID NO: 5806854 - DNA, 19 bp, Homo sapiens
tgtgcatggaggccctcct

SEQ ID NO: 5806855 - DNA, 15 bp, Homo sapiens
tgtgcatgggagcaa

SEQ ID NO: 5806856 - DNA, 18 bp, Homo sapiens
tgtgcatgtatgtgtgtg

SEQ ID NO: 5806857 - DNA, 13 bp, Homo sapiens
tgtgcatgtgccg

SEQ ID NO: 5806858 - DNA, 22 bp, Homo sapiens
tgtgcatgtgtgtaagtgtgtg

SEQ ID NO: 5806859 - DNA, 15 bp, Homo sapiens
tgtgcatgtgtgtat

SEQ ID NO: 5806860 - DNA, 21 bp, Homo sapiens
tgtgcatgtgtgtgtctgtct

SEQ ID NO: 5806861 - DNA, 22 bp, Homo sapiens
tgtgcatgtgtgtgtctgtctt

SEQ ID NO: 5806862 - DNA, 14 bp, Homo sapiens
tgtgcattatctag

SEQ ID NO: 5806863 - DNA, 13 bp, Homo sapiens
tgtgcattctttg

SEQ ID NO: 5806864 - DNA, 19 bp, Homo sapiens
tgtgcattctttggtaatt

SEQ ID NO: 5806865 - DNA, 21 bp, Homo sapiens
tgtgcattcttttaaaagaca

SEQ ID NO: 5806866 - DNA, 23 bp, Homo sapiens
tgtgcattcttttaaaagacaag

SEQ ID NO: 5806867 - DNA, 18 bp, Homo sapiens
tgtgcattctttttttta

SEQ ID NO: 5806868 - DNA, 16 bp, Homo sapiens
tgtgcattgtggctgt

SEQ ID NO: 5806869 - DNA, 16 bp, Homo sapiens
tgtgcatttcacctgt

SEQ ID NO: 5806870 - DNA, 17 bp, Homo sapiens
tgtgcatttctgtctct

SEQ ID NO: 5806871 - DNA, 23 bp, Homo sapiens
tgtgcatttggtggtttcagaaa

SEQ ID NO: 5806872 - DNA, 17 bp, Homo sapiens
tgtgcatttgttcagct

SEQ ID NO: 5806873 - DNA, 20 bp, Homo sapiens
tgtgcatttgttcagctccc

SEQ ID NO: 5806874 - DNA, 19 bp, Homo sapiens
tgtgcattttgtggaattt

SEQ ID NO: 5806875 - DNA, 21 bp, Homo sapiens
tgtgcattttgtgtgatgcat

SEQ ID NO: 5806876 - DNA, 17 bp, Homo sapiens
tgtgccaaaatgtcaat

SEQ ID NO: 5806877 - DNA, 21 bp, Homo sapiens
tgtgccaaaatgtcaattttt

SEQ ID NO: 5806878 - DNA, 19 bp, Homo sapiens
tgtgccaaacaaaatgaga

SEQ ID NO: 5806879 - DNA, 19 bp, Homo sapiens
tgtgccaaagatagcagaa

SEQ ID NO: 5806880 - DNA, 18 bp, Homo sapiens
tgtgccaaagcaggtcag

SEQ ID NO: 5806881 - DNA, 22 bp, Homo sapiens
tgtgccaactgccaggctgcct

SEQ ID NO: 5806882 - DNA, 20 bp, Homo sapiens
tgtgccaagattctactctt

SEQ ID NO: 5806883 - DNA, 17 bp, Homo sapiens
tgtgccaagccctggcc

SEQ ID NO: 5806884 - DNA, 16 bp, Homo sapiens
tgtgccaagccttctg

SEQ ID NO: 5806885 - DNA, 22 bp, Homo sapiens
tgtgccaatacagacaaagcat

SEQ ID NO: 5806886 - DNA, 21 bp, Homo sapiens
tgtgccacacttcgctcttga

SEQ ID NO: 5806887 - DNA, 21 bp, Homo sapiens
tgtgccacagaggccccacct

SEQ ID NO: 5806888 - DNA, 14 bp, Homo sapiens
tgtgccacattttc

SEQ ID NO: 5806889 - DNA, 13 bp, Homo sapiens
tgtgccaccaccc

SEQ ID NO: 5806890 - DNA, 14 bp, Homo sapiens
tgtgccaccacgcc

SEQ ID NO: 5806891 - DNA, 17 bp, Homo sapiens
tgtgccaccatgcctca

SEQ ID NO: 5806892 - DNA, 20 bp, Homo sapiens
tgtgccacccaccagggcga

SEQ ID NO: 5806893 - DNA, 19 bp, Homo sapiens
tgtgccaccccttcctcag

SEQ ID NO: 5806894 - DNA, 15 bp, Homo sapiens
tgtgccaccctctgc

SEQ ID NO: 5806895 - DNA, 16 bp, Homo sapiens
tgtgccaccctctgca

SEQ ID NO: 5806896 - DNA, 19 bp, Homo sapiens
tgtgccaccctctgcaggg

SEQ ID NO: 5806897 - DNA, 16 bp, Homo sapiens
tgtgccaccctgggct

SEQ ID NO: 5806898 - DNA, 22 bp, Homo sapiens
tgtgccaccctgggctctgtgg

SEQ ID NO: 5806899 - DNA, 21 bp, Homo sapiens
tgtgccacctgcaagtgcccg

SEQ ID NO: 5806900 - DNA, 21 bp, Homo sapiens
tgtgccacgctcctctgtttg

SEQ ID NO: 5806901 - DNA, 15 bp, Homo sapiens
tgtgccactgttcag

SEQ ID NO: 5806902 - DNA, 19 bp, Homo sapiens
tgtgccactgttcagcgga

SEQ ID NO: 5806903 - DNA, 21 bp, Homo sapiens
tgtgccactgttcagcggagc

SEQ ID NO: 5806904 - DNA, 19 bp, Homo sapiens
tgtgccactttgactcaga

SEQ ID NO: 5806905 - DNA, 18 bp, Homo sapiens
tgtgccagagcctggggc

SEQ ID NO: 5806906 - DNA, 21 bp, Homo sapiens
tgtgccagagcctggggctct

SEQ ID NO: 5806907 - DNA, 21 bp, Homo sapiens
tgtgccagaggaaggaaaagg

SEQ ID NO: 5806908 - DNA, 20 bp, Homo sapiens
tgtgccagaggaatcctggc

SEQ ID NO: 5806909 - DNA, 11 bp, Homo sapiens
tgtgccagctc

SEQ ID NO: 5806910 - DNA, 22 bp, Homo sapiens
tgtgccagctgcttctgcccac

SEQ ID NO: 5806911 - DNA, 21 bp, Homo sapiens
tgtgccaggcagatcctctgg

SEQ ID NO: 5806912 - DNA, 19 bp, Homo sapiens
tgtgccaggccaaagatcc

SEQ ID NO: 5806913 - DNA, 22 bp, Homo sapiens
tgtgccaggcgaggcccttggc

SEQ ID NO: 5806914 - DNA, 14 bp, Homo sapiens
tgtgccaggctggg

SEQ ID NO: 5806915 - DNA, 13 bp, Homo sapiens
tgtgccaggcttg

SEQ ID NO: 5806916 - DNA, 20 bp, Homo sapiens
tgtgccaggcttgcctgggc

SEQ ID NO: 5806917 - DNA, 15 bp, Homo sapiens
tgtgccagttcctgt

SEQ ID NO: 5806918 - DNA, 22 bp, Homo sapiens
tgtgccagttggggccccgcgg

SEQ ID NO: 5806919 - DNA, 19 bp, Homo sapiens
tgtgccatcatgcctgact

SEQ ID NO: 5806920 - DNA, 12 bp, Homo sapiens
tgtgccatctgt

SEQ ID NO: 5806921 - DNA, 13 bp, Homo sapiens
tgtgccatctgta

SEQ ID NO: 5806922 - DNA, 16 bp, Homo sapiens
tgtgccatctgtggga

SEQ ID NO: 5806923 - DNA, 12 bp, Homo sapiens
tgtgccatgccc

SEQ ID NO: 5806924 - DNA, 20 bp, Homo sapiens
tgtgccatggatctgatctg

SEQ ID NO: 5806925 - DNA, 21 bp, Homo sapiens
tgtgccatgtcaaacaaatag

SEQ ID NO: 5806926 - DNA, 21 bp, Homo sapiens
tgtgccatgttattcagctca

SEQ ID NO: 5806927 - DNA, 15 bp, Homo sapiens
tgtgccatttctcag

SEQ ID NO: 5806928 - DNA, 20 bp, Homo sapiens
tgtgccatttctcagggaag

SEQ ID NO: 5806929 - DNA, 21 bp, Homo sapiens
tgtgccatttctcagggaagt

SEQ ID NO: 5806930 - DNA, 22 bp, Homo sapiens
tgtgccattttaaaaaaaaagg

SEQ ID NO: 5806931 - DNA, 18 bp, Homo sapiens
tgtgccattttctgtaaa

SEQ ID NO: 5806932 - DNA, 23 bp, Homo sapiens
tgtgcccaagtgggcagtcacca

SEQ ID NO: 5806933 - DNA, 14 bp, Homo sapiens
tgtgcccacaggga

SEQ ID NO: 5806934 - DNA, 20 bp, Homo sapiens
tgtgcccacatcccaggctt

SEQ ID NO: 5806935 - DNA, 21 bp, Homo sapiens
tgtgcccacatcccaggcttc

SEQ ID NO: 5806936 - DNA, 14 bp, Homo sapiens
tgtgcccaccctcc

SEQ ID NO: 5806937 - DNA, 19 bp, Homo sapiens
tgtgcccacggtctgagct

SEQ ID NO: 5806938 - DNA, 23 bp, Homo sapiens
tgtgcccagatcgttctgccact

SEQ ID NO: 5806939 - DNA, 15 bp, Homo sapiens
tgtgcccagcacctg

SEQ ID NO: 5806940 - DNA, 16 bp, Homo sapiens
tgtgcccagcacctgg

SEQ ID NO: 5806941 - DNA, 12 bp, Homo sapiens
tgtgcccagcag

SEQ ID NO: 5806942 - DNA, 13 bp, Homo sapiens
tgtgcccagcagg

SEQ ID NO: 5806943 - DNA, 20 bp, Homo sapiens
tgtgcccagcaggcccagca

SEQ ID NO: 5806944 - DNA, 22 bp, Homo sapiens
tgtgcccagcaggcccagcatg

SEQ ID NO: 5806945 - DNA, 20 bp, Homo sapiens
tgtgcccagcagtttcccag

SEQ ID NO: 5806946 - DNA, 22 bp, Homo sapiens
tgtgcccagcagtttcccagaa

SEQ ID NO: 5806947 - DNA, 19 bp, Homo sapiens
tgtgcccagcccggacctt

SEQ ID NO: 5806948 - DNA, 14 bp, Homo sapiens
tgtggcactgcttg

SEQ ID NO: 5806949 - DNA, 15 bp, Homo sapiens
tgtggcacttgcctg

SEQ ID NO: 5806950 - DNA, 20 bp, Homo sapiens
tgtggcagaccgggggccag

SEQ ID NO: 5806951 - DNA, 21 bp, Homo sapiens
tgtggcagaccgggggccaga

SEQ ID NO: 5806952 - DNA, 15 bp, Homo sapiens
tgtggcagagttaca

SEQ ID NO: 5806953 - DNA, 13 bp, Homo sapiens
tgtggcagcctga

SEQ ID NO: 5806954 - DNA, 14 bp, Homo sapiens
tgtggcagctgccc

SEQ ID NO: 5806955 - DNA, 19 bp, Homo sapiens
tgtggcagctgcccctggc

SEQ ID NO: 5806956 - DNA, 11 bp, Homo sapiens
tgtggcaggag

SEQ ID NO: 5806957 - DNA, 19 bp, Homo sapiens
tgtggcaggagggcagtgg

SEQ ID NO: 5806958 - DNA, 15 bp, Homo sapiens
tgtggcaggcctagg

SEQ ID NO: 5806959 - DNA, 17 bp, Homo sapiens
tgtggcaggggcagtgg

SEQ ID NO: 5806960 - DNA, 13 bp, Homo sapiens
tgtggcagtgctg

SEQ ID NO: 5806961 - DNA, 18 bp, Homo sapiens
tgtggcagtgctgaaggg

SEQ ID NO: 5806962 - DNA, 17 bp, Homo sapiens
tgtggcagtggccaggc

SEQ ID NO: 5806963 - DNA, 21 bp, Homo sapiens
tgtggcatccagagtccctgc

SEQ ID NO: 5806964 - DNA, 18 bp, Homo sapiens
tgtggcattctctctgct

SEQ ID NO: 5806965 - DNA, 21 bp, Homo sapiens
tgtggcattctctctgctcag

SEQ ID NO: 5806966 - DNA, 15 bp, Homo sapiens
tgtggcattgaaatg

SEQ ID NO: 5806967 - DNA, 16 bp, Homo sapiens
tgtggccaaaggaggg

SEQ ID NO: 5806968 - DNA, 24 bp, Homo sapiens
tgtggccaaaggagggtcaggaag

SEQ ID NO: 5806969 - DNA, 20 bp, Homo sapiens
tgtggccaaccaggacccag

SEQ ID NO: 5806970 - DNA, 22 bp, Homo sapiens
tgtggccaaccaggacccaggg

SEQ ID NO: 5806971 - DNA, 14 bp, Homo sapiens
tgtggccaaggagc

SEQ ID NO: 5806972 - DNA, 15 bp, Homo sapiens
tgtggccaaggagct

SEQ ID NO: 5806973 - DNA, 18 bp, Homo sapiens
tgtggccaagttcttagt

SEQ ID NO: 5806974 - DNA, 15 bp, Homo sapiens
tgtggccaatggaac

SEQ ID NO: 5806975 - DNA, 13 bp, Homo sapiens
tgtggccagagca

SEQ ID NO: 5806976 - DNA, 13 bp, Homo sapiens
tgtggccagcagc

SEQ ID NO: 5806977 - DNA, 12 bp, Homo sapiens
tgtggccagcct

SEQ ID NO: 5806978 - DNA, 15 bp, Homo sapiens
tgtggccagcctggc

SEQ ID NO: 5806979 - DNA, 18 bp, Homo sapiens
tgtggccagcctggcatc

SEQ ID NO: 5806980 - DNA, 14 bp, Homo sapiens
tgtggccaggagcc

SEQ ID NO: 5806981 - DNA, 18 bp, Homo sapiens
tgtggccaggagccctgg

SEQ ID NO: 5806982 - DNA, 14 bp, Homo sapiens
tgtggccaggaggt

SEQ ID NO: 5806983 - DNA, 13 bp, Homo sapiens
tgtggccaggcct

SEQ ID NO: 5806984 - DNA, 15 bp, Homo sapiens
tgtggccaggggtgc

SEQ ID NO: 5806985 - DNA, 19 bp, Homo sapiens
tgtggccagggtgagagct

SEQ ID NO: 5806986 - DNA, 20 bp, Homo sapiens
tgtggccagggtgagagctg

SEQ ID NO: 5806987 - DNA, 20 bp, Homo sapiens
tgtggccatatatgctgtat

SEQ ID NO: 5806988 - DNA, 18 bp, Homo sapiens
tgtggccatatttataga

SEQ ID NO: 5806989 - DNA, 19 bp, Homo sapiens
tgtggccatatttatagaa

SEQ ID NO: 5806990 - DNA, 19 bp, Homo sapiens
tgtggccatcactcagccc

SEQ ID NO: 5806991 - DNA, 20 bp, Homo sapiens
tgtggccatcactcagcccc

SEQ ID NO: 5806992 - DNA, 21 bp, Homo sapiens
tgtggccatcaggactttccc

SEQ ID NO: 5806993 - DNA, 16 bp, Homo sapiens
tgtggccccaagaggg

SEQ ID NO: 5806994 - DNA, 19 bp, Homo sapiens
tgtggccccaccctgggcc

SEQ ID NO: 5806995 - DNA, 21 bp, Homo sapiens
tgtggccccaccgagctggag

SEQ ID NO: 5806996 - DNA, 13 bp, Homo sapiens
tgtggccccagcc

SEQ ID NO: 5806997 - DNA, 16 bp, Homo sapiens
tgtggccccaggtgcc

SEQ ID NO: 5806998 - DNA, 21 bp, Homo sapiens
tgtggccccgcccgagcccct

SEQ ID NO: 5806999 - DNA, 12 bp, Homo sapiens
tgtggcccctcc

SEQ ID NO: 5807000 - DNA, 17 bp, Homo sapiens
tgtggcccctcccctgc

SEQ ID NO: 5807001 - DNA, 22 bp, Homo sapiens
tgtggcccctccttctcccctc

SEQ ID NO: 5807002 - DNA, 17 bp, Homo sapiens
tgtggcccctgaacaag

SEQ ID NO: 5807003 - DNA, 22 bp, Homo sapiens
tgtggcccctgaacaagaattg

SEQ ID NO: 5807004 - DNA, 13 bp, Homo sapiens
tgtggccccttca

SEQ ID NO: 5807005 - DNA, 17 bp, Homo sapiens
tgtggcccgaggaagct

SEQ ID NO: 5807006 - DNA, 12 bp, Homo sapiens
tgtggccctctc

SEQ ID NO: 5807007 - DNA, 20 bp, Homo sapiens
tgtggccctctcccttaccc

SEQ ID NO: 5807008 - DNA, 13 bp, Homo sapiens
tgtggccctgcca

SEQ ID NO: 5807009 - DNA, 12 bp, Homo sapiens
tgtggccctgga

SEQ ID NO: 5807010 - DNA, 15 bp, Homo sapiens
tgtggccctggacac

SEQ ID NO: 5807011 - DNA, 14 bp, Homo sapiens
tgtggccctggcat

SEQ ID NO: 5807012 - DNA, 16 bp, Homo sapiens
tgtggccctgtcctgc

SEQ ID NO: 5807013 - DNA, 17 bp, Homo sapiens
tgtggccctgtgggagt

SEQ ID NO: 5807014 - DNA, 16 bp, Homo sapiens
tgtggccgccatctgc

SEQ ID NO: 5807015 - DNA, 18 bp, Homo sapiens
tgtggccgcctggcaggt

SEQ ID NO: 5807016 - DNA, 14 bp, Homo sapiens
tgtggccggtgcca

SEQ ID NO: 5807017 - DNA, 15 bp, Homo sapiens
tgtggccggtgccag

SEQ ID NO: 5807018 - DNA, 18 bp, Homo sapiens
tgtggccggtgccagctg

SEQ ID NO: 5807019 - DNA, 17 bp, Homo sapiens
tgtggcctaagaggctg

SEQ ID NO: 5807020 - DNA, 19 bp, Homo sapiens
tgtggcctaatccacctgg

SEQ ID NO: 5807021 - DNA, 15 bp, Homo sapiens
tgtggcctcacttcc

SEQ ID NO: 5807022 - DNA, 18 bp, Homo sapiens
tgtggcctcacttccctg

SEQ ID NO: 5807023 - DNA, 21 bp, Homo sapiens
tgtggcctcacttccctggga

SEQ ID NO: 5807024 - DNA, 13 bp, Homo sapiens
tgtggcctcagcc

SEQ ID NO: 5807025 - DNA, 16 bp, Homo sapiens
tgtggcctcagccctc

SEQ ID NO: 5807026 - DNA, 18 bp, Homo sapiens
tgtggcctcattcagcag

SEQ ID NO: 5807027 - DNA, 13 bp, Homo sapiens
tgtggcctccctg

SEQ ID NO: 5807028 - DNA, 21 bp, Homo sapiens
tgtggcctccctggctcctcc

SEQ ID NO: 5807029 - DNA, 22 bp, Homo sapiens
tgtggcctccctggctcctccg

SEQ ID NO: 5807030 - DNA, 16 bp, Homo sapiens
tgtggcctctcagtca

SEQ ID NO: 5807031 - DNA, 15 bp, Homo sapiens
tgtggcctcttggct

SEQ ID NO: 5807032 - DNA, 11 bp, Homo sapiens
tgtggcctgca

SEQ ID NO: 5807033 - DNA, 14 bp, Homo sapiens
tgtggcctgcagga

SEQ ID NO: 5807034 - DNA, 15 bp, Homo sapiens
tgtggcctgcaggag

SEQ ID NO: 5807035 - DNA, 13 bp, Homo sapiens
tgtggcctgccca

SEQ ID NO: 5807036 - DNA, 11 bp, Homo sapiens
tgtggcctgga

SEQ ID NO: 5807037 - DNA, 20 bp, Homo sapiens
tgtggcctgggtcctcggcc

SEQ ID NO: 5807038 - DNA, 17 bp, Homo sapiens
tgtggcctggtgggtca

SEQ ID NO: 5807039 - DNA, 24 bp, Homo sapiens
tgtggcctgtgccagcaccacagc

SEQ ID NO: 5807040 - DNA, 15 bp, Homo sapiens
tgtggcctgtgtcca

SEQ ID NO: 5807041 - DNA, 21 bp, Homo sapiens
tgtggcctgtgtccagcagct

SEQ ID NO: 5807042 - DNA, 16 bp, Homo sapiens
tgtggccttatgagct

SEQ ID NO: 5807043 - DNA, 15 bp, Homo sapiens
tgtggccttccccct

SEQ ID NO: 5807044 - DNA, 15 bp, Homo sapiens
tgtggccttctcagc

SEQ ID NO: 5807045 - DNA, 15 bp, Homo sapiens
tgtggccttggccct

SEQ ID NO: 5807046 - DNA, 14 bp, Homo sapiens
tgtggcctttatgt

SEQ ID NO: 5807047 - DNA, 21 bp, Homo sapiens
tgtggcctttatgttctttca

SEQ ID NO: 5807048 - DNA, 15 bp, Homo sapiens
tgtggccttttttat

SEQ ID NO: 5807049 - DNA, 19 bp, Homo sapiens
tgtggccttttttataact

SEQ ID NO: 5807050 - DNA, 23 bp, Homo sapiens
tgtggcgcagcatattcaggaag

SEQ ID NO: 5807051 - DNA, 19 bp, Homo sapiens
tgtggcgggaagggtgggc

SEQ ID NO: 5807052 - DNA, 16 bp, Homo sapiens
tgtggcggtgcagtgg

SEQ ID NO: 5807053 - DNA, 14 bp, Homo sapiens
tgtggctaattata

SEQ ID NO: 5807054 - DNA, 20 bp, Homo sapiens
tgtggctaattataattcag

SEQ ID NO: 5807055 - DNA, 17 bp, Homo sapiens
tgtggctactgacatat

SEQ ID NO: 5807056 - DNA, 23 bp, Homo sapiens
tgtggctcacagtggggccagca

SEQ ID NO: 5807057 - DNA, 17 bp, Homo sapiens
tgtggctccaggagcag

SEQ ID NO: 5807058 - DNA, 17 bp, Homo sapiens
tgtggctccaggccaaa

SEQ ID NO: 5807059 - DNA, 15 bp, Homo sapiens
tgtggctcccctcta

SEQ ID NO: 5807060 - DNA, 12 bp, Homo sapiens
tgtggctcctgc

SEQ ID NO: 5807061 - DNA, 21 bp, Homo sapiens
tgtggctcctgggggttcttt

SEQ ID NO: 5807062 - DNA, 18 bp, Homo sapiens
tgtggctcgggtgcccag

SEQ ID NO: 5807063 - DNA, 16 bp, Homo sapiens
tgtggctctgggtggg

SEQ ID NO: 5807064 - DNA, 20 bp, Homo sapiens
tgtggctcttatttctgaat

SEQ ID NO: 5807065 - DNA, 23 bp, Homo sapiens
tgtggctgaaaatgcaaagctga

SEQ ID NO: 5807066 - DNA, 21 bp, Homo sapiens
tgtggctgaggaggcctccat

SEQ ID NO: 5807067 - DNA, 16 bp, Homo sapiens
tgtggctgatttacta

SEQ ID NO: 5807068 - DNA, 20 bp, Homo sapiens
tgtggctgatttcaaatgca

SEQ ID NO: 5807069 - DNA, 22 bp, Homo sapiens
tgtggctgatttcaaatgcagt

SEQ ID NO: 5807070 - DNA, 14 bp, Homo sapiens
tgtggctgcagcag

SEQ ID NO: 5807071 - DNA, 17 bp, Homo sapiens
tgtggctggaggagctg

SEQ ID NO: 5807072 - DNA, 22 bp, Homo sapiens
tgtggctggctctaccttcctg

SEQ ID NO: 5807073 - DNA, 16 bp, Homo sapiens
tgtggctggggggatg

SEQ ID NO: 5807074 - DNA, 17 bp, Homo sapiens
tgtggctgggtggtcag

SEQ ID NO: 5807075 - DNA, 20 bp, Homo sapiens
tgtggctggtgtccccttcc

SEQ ID NO: 5807076 - DNA, 14 bp, Homo sapiens
tgtggctgtattca

SEQ ID NO: 5807077 - DNA, 19 bp, Homo sapiens
tgtggctgtcaaatccatg

SEQ ID NO: 5807078 - DNA, 21 bp, Homo sapiens
tgtggctgtcagcaggaagca

SEQ ID NO: 5807079 - DNA, 17 bp, Homo sapiens
tgtggctgtgaggggtg

SEQ ID NO: 5807080 - DNA, 11 bp, Homo sapiens
tgtggctgtgc

SEQ ID NO: 5807081 - DNA, 21 bp, Homo sapiens
tgtggctgtgtgtctgcttgt

SEQ ID NO: 5807082 - DNA, 19 bp, Homo sapiens
tgtggctgttgagatgtgc

SEQ ID NO: 5807083 - DNA, 15 bp, Homo sapiens
tgtggcttaaacatt

SEQ ID NO: 5807084 - DNA, 22 bp, Homo sapiens
tgtggcttctctgtctctgtgg

SEQ ID NO: 5807085 - DNA, 22 bp, Homo sapiens
tgtggcttcttaatcttttcac

SEQ ID NO: 5807086 - DNA, 12 bp, Homo sapiens
tgtggcttggaa

SEQ ID NO: 5807087 - DNA, 14 bp, Homo sapiens
tgtggcttggaaca

SEQ ID NO: 5807088 - DNA, 14 bp, Homo sapiens
tgtggcttggagga

SEQ ID NO: 5807089 - DNA, 13 bp, Homo sapiens
tgtggcttgggac

SEQ ID NO: 5807090 - DNA, 17 bp, Homo sapiens
tgtggctttcagcctct

SEQ ID NO: 5807091 - DNA, 20 bp, Homo sapiens
tgtggctttttgttcagaat

SEQ ID NO: 5807092 - DNA, 21 bp, Homo sapiens
tgtgggaaaaaaatgaatgag

SEQ ID NO: 5807093 - DNA, 18 bp, Homo sapiens
tgtgggaaaaaagaaaaa

SEQ ID NO: 5807094 - DNA, 11 bp, Homo sapiens
tgtgggaaagc

SEQ ID NO: 5807095 - DNA, 21 bp, Homo sapiens
tgtgggaagaagtaaactgga

SEQ ID NO: 5807096 - DNA, 12 bp, Homo sapiens
tgtgggaataaa

SEQ ID NO: 5807097 - DNA, 18 bp, Homo sapiens
tgtgggaatgcggcaaga

SEQ ID NO: 5807098 - DNA, 22 bp, Homo sapiens
tgtgggacacctcaaatacata

SEQ ID NO: 5807099 - DNA, 14 bp, Homo sapiens
tgtgggacacctgg

SEQ ID NO: 5807100 - DNA, 18 bp, Homo sapiens
tgtgggaccagtcccaca

SEQ ID NO: 5807101 - DNA, 15 bp, Homo sapiens
tgtgggactggccca

SEQ ID NO: 5807102 - DNA, 20 bp, Homo sapiens
tgtgggactggcccacccct

SEQ ID NO: 5807103 - DNA, 13 bp, Homo sapiens
tgtgggactgtac

SEQ ID NO: 5807104 - DNA, 17 bp, Homo sapiens
tgtgggagaagggacag

SEQ ID NO: 5807105 - DNA, 18 bp, Homo sapiens
tgtgggagaagggacagc

SEQ ID NO: 5807106 - DNA, 13 bp, Homo sapiens
tgtgggagcagcg

SEQ ID NO: 5807107 - DNA, 14 bp, Homo sapiens
tgtgggagcctcgc

SEQ ID NO: 5807108 - DNA, 21 bp, Homo sapiens
tgtgggaggctggggacccag

SEQ ID NO: 5807109 - DNA, 13 bp, Homo sapiens
tgtgggagggagc

SEQ ID NO: 5807110 - DNA, 21 bp, Homo sapiens
tgtgggagggagcagacagga

SEQ ID NO: 5807111 - DNA, 13 bp, Homo sapiens
tgtgggagtagaa

SEQ ID NO: 5807112 - DNA, 14 bp, Homo sapiens
tgtgggagtgaggg

SEQ ID NO: 5807113 - DNA, 18 bp, Homo sapiens
tgtgggagtgcagagaaa

SEQ ID NO: 5807114 - DNA, 22 bp, Homo sapiens
tgtgggatacttagtggtatgt

SEQ ID NO: 5807115 - DNA, 18 bp, Homo sapiens
tgtgggatcattgcattt

SEQ ID NO: 5807116 - DNA, 14 bp, Homo sapiens
tgtgggatctgagg

SEQ ID NO: 5807117 - DNA, 13 bp, Homo sapiens
tgtgggatgctga

SEQ ID NO: 5807118 - DNA, 21 bp, Homo sapiens
tgtgggatggagagtggggag

SEQ ID NO: 5807119 - DNA, 15 bp, Homo sapiens
tgtgggcaaaagagt

SEQ ID NO: 5807120 - DNA, 18 bp, Homo sapiens
tgtgggcaaagtcctcct

SEQ ID NO: 5807121 - DNA, 13 bp, Homo sapiens
tgtgggcagcacc

SEQ ID NO: 5807122 - DNA, 14 bp, Homo sapiens
tgtgggcagcaccc

SEQ ID NO: 5807123 - DNA, 15 bp, Homo sapiens
tgtgggcagcaccct

SEQ ID NO: 5807124 - DNA, 18 bp, Homo sapiens
tgtgggcagctggctctg

SEQ ID NO: 5807125 - DNA, 21 bp, Homo sapiens
tgtgggcagcttagggccctg

SEQ ID NO: 5807126 - DNA, 16 bp, Homo sapiens
tgtgggcaggaagtga

SEQ ID NO: 5807127 - DNA, 21 bp, Homo sapiens
tgtgggcatttcttgcgagcc

SEQ ID NO: 5807128 - DNA, 16 bp, Homo sapiens
tgtgtcacactctgtg

SEQ ID NO: 5807129 - DNA, 22 bp, Homo sapiens
tgtgtcacactgagctgggcac

SEQ ID NO: 5807130 - DNA, 18 bp, Homo sapiens
tgtgtcacgcaggctgag

SEQ ID NO: 5807131 - DNA, 19 bp, Homo sapiens
tgtgtcacgcaggctgagt

SEQ ID NO: 5807132 - DNA, 20 bp, Homo sapiens
tgtgtcacgtgaccctgtgc

SEQ ID NO: 5807133 - DNA, 21 bp, Homo sapiens
tgtgtcacgtgaccctgtgcc

SEQ ID NO: 5807134 - DNA, 18 bp, Homo sapiens
tgtgtcactggctgcctc

SEQ ID NO: 5807135 - DNA, 17 bp, Homo sapiens
tgtgtcactgtacagtt

SEQ ID NO: 5807136 - DNA, 21 bp, Homo sapiens
tgtgtcacttgtgctttgctc

SEQ ID NO: 5807137 - DNA, 15 bp, Homo sapiens
tgtgtcagaaacatg

SEQ ID NO: 5807138 - DNA, 17 bp, Homo sapiens
tgtgtcagaaaccctgg

SEQ ID NO: 5807139 - DNA, 16 bp, Homo sapiens
tgtgtcagagcccagc

SEQ ID NO: 5807140 - DNA, 17 bp, Homo sapiens
tgtgtcagagcccagcc

SEQ ID NO: 5807141 - DNA, 17 bp, Homo sapiens
tgtgtcagagcccaggg

SEQ ID NO: 5807142 - DNA, 19 bp, Homo sapiens
tgtgtcagagcccagggga

SEQ ID NO: 5807143 - DNA, 23 bp, Homo sapiens
tgtgtcagagcctaccttcacca

SEQ ID NO: 5807144 - DNA, 19 bp, Homo sapiens
tgtgtcagcatagaagtaa

SEQ ID NO: 5807145 - DNA, 23 bp, Homo sapiens
tgtgtcagcattcctattaatgt

SEQ ID NO: 5807146 - DNA, 17 bp, Homo sapiens
tgtgtcagctgaggctg

SEQ ID NO: 5807147 - DNA, 19 bp, Homo sapiens
tgtgtcaggccctctgcct

SEQ ID NO: 5807148 - DNA, 20 bp, Homo sapiens
tgtgtcaggccctctgcctg

SEQ ID NO: 5807149 - DNA, 15 bp, Homo sapiens
tgtgtcagggatgag

SEQ ID NO: 5807150 - DNA, 20 bp, Homo sapiens
tgtgtcagtttatgttttgg

SEQ ID NO: 5807151 - DNA, 15 bp, Homo sapiens
tgtgtcagttttcat

SEQ ID NO: 5807152 - DNA, 16 bp, Homo sapiens
tgtgtcagtttttcct

SEQ ID NO: 5807153 - DNA, 17 bp, Homo sapiens
tgtgtcagtttttcctc

SEQ ID NO: 5807154 - DNA, 16 bp, Homo sapiens
tgtgtcataaagttga

SEQ ID NO: 5807155 - DNA, 19 bp, Homo sapiens
tgtgtcataaagttgactt

SEQ ID NO: 5807156 - DNA, 16 bp, Homo sapiens
tgtgtcataaattaca

SEQ ID NO: 5807157 - DNA, 18 bp, Homo sapiens
tgtgtcataaattacaca

SEQ ID NO: 5807158 - DNA, 23 bp, Homo sapiens
tgtgtcatactgtgcaggcctgt

SEQ ID NO: 5807159 - DNA, 22 bp, Homo sapiens
tgtgtcatattaaacttctgat

SEQ ID NO: 5807160 - DNA, 14 bp, Homo sapiens
tgtgtcatgccagt

SEQ ID NO: 5807161 - DNA, 22 bp, Homo sapiens
tgtgtcatggtgatgcaagtca

SEQ ID NO: 5807162 - DNA, 13 bp, Homo sapiens
tgtgtcatttcaa

SEQ ID NO: 5807163 - DNA, 13 bp, Homo sapiens
tgtgtcatttctt

SEQ ID NO: 5807164 - DNA, 15 bp, Homo sapiens
tgtgtccaactccag

SEQ ID NO: 5807165 - DNA, 19 bp, Homo sapiens
tgtgtccacactaccagtt

SEQ ID NO: 5807166 - DNA, 14 bp, Homo sapiens
tgtgtccacagtga

SEQ ID NO: 5807167 - DNA, 14 bp, Homo sapiens
tgtgtccactgaga

SEQ ID NO: 5807168 - DNA, 22 bp, Homo sapiens
tgtgtccaggctctgggcacag

SEQ ID NO: 5807169 - DNA, 21 bp, Homo sapiens
tgtgtccagttttggaggctg

SEQ ID NO: 5807170 - DNA, 16 bp, Homo sapiens
tgtgtccataagagaa

SEQ ID NO: 5807171 - DNA, 17 bp, Homo sapiens
tgtgtccataagagaaa

SEQ ID NO: 5807172 - DNA, 13 bp, Homo sapiens
tgtgtccatcctg

SEQ ID NO: 5807173 - DNA, 14 bp, Homo sapiens
tgtgtccatgtgtg

SEQ ID NO: 5807174 - DNA, 17 bp, Homo sapiens
tgtgtccatgtgtgtgc

SEQ ID NO: 5807175 - DNA, 15 bp, Homo sapiens
tgtgtccatttctgc

SEQ ID NO: 5807176 - DNA, 16 bp, Homo sapiens
tgtgtcccagatgctg

SEQ ID NO: 5807177 - DNA, 14 bp, Homo sapiens
tgtgtcccagcacc

SEQ ID NO: 5807178 - DNA, 19 bp, Homo sapiens
tgtgtcccagtgtctggcc

SEQ ID NO: 5807179 - DNA, 20 bp, Homo sapiens
tgtgtcccagtgtctggccc

SEQ ID NO: 5807180 - DNA, 19 bp, Homo sapiens
tgtgtcccatgacccaccc

SEQ ID NO: 5807181 - DNA, 20 bp, Homo sapiens
tgtgtcccatgatccctgtg

SEQ ID NO: 5807182 - DNA, 22 bp, Homo sapiens
tgtgtcccccctgtggtctgtg

SEQ ID NO: 5807183 - DNA, 18 bp, Homo sapiens
tgtgtccccctctgtcca

SEQ ID NO: 5807184 - DNA, 21 bp, Homo sapiens
tgtgtcccctcacgcaagtgc

SEQ ID NO: 5807185 - DNA, 22 bp, Homo sapiens
tgtgtcccctcactctgtcagc

SEQ ID NO: 5807186 - DNA, 18 bp, Homo sapiens
tgtgtcccctctcatcta

SEQ ID NO: 5807187 - DNA, 20 bp, Homo sapiens
tgtgtcccctgacctgtcca

SEQ ID NO: 5807188 - DNA, 15 bp, Homo sapiens
tgtgtccctctctct

SEQ ID NO: 5807189 - DNA, 17 bp, Homo sapiens
tgtgtccctcttctctt

SEQ ID NO: 5807190 - DNA, 17 bp, Homo sapiens
tgtgtccctggacacag

SEQ ID NO: 5807191 - DNA, 13 bp, Homo sapiens
tgtgtccctgtgg

SEQ ID NO: 5807192 - DNA, 14 bp, Homo sapiens
tgtgtccctgtggt

SEQ ID NO: 5807193 - DNA, 17 bp, Homo sapiens
tgtgtcccttggtcctg

SEQ ID NO: 5807194 - DNA, 19 bp, Homo sapiens
tgtgtccgctaaatattta

SEQ ID NO: 5807195 - DNA, 20 bp, Homo sapiens
tgtgtccgctctctcatgtg

SEQ ID NO: 5807196 - DNA, 18 bp, Homo sapiens
tgtgtcctaaatgcaaag

SEQ ID NO: 5807197 - DNA, 17 bp, Homo sapiens
tgtgtcctccaggagct

SEQ ID NO: 5807198 - DNA, 17 bp, Homo sapiens
tgtgtcctcctgctctg

SEQ ID NO: 5807199 - DNA, 19 bp, Homo sapiens
tgtgtcctcctgctctgct

SEQ ID NO: 5807200 - DNA, 14 bp, Homo sapiens
tgtgtcctctccag

SEQ ID NO: 5807201 - DNA, 17 bp, Homo sapiens
tgtgtcctgatggccca

SEQ ID NO: 5807202 - DNA, 15 bp, Homo sapiens
tgtgtcctgctctgt

SEQ ID NO: 5807203 - DNA, 22 bp, Homo sapiens
tgtgtcctgtcctttcttgcag

SEQ ID NO: 5807204 - DNA, 23 bp, Homo sapiens
tgtgtcctgtcctttcttgcaga

SEQ ID NO: 5807205 - DNA, 17 bp, Homo sapiens
tgtgtccttccctgcat

SEQ ID NO: 5807206 - DNA, 22 bp, Homo sapiens
tgtgtccttgaactgaggccct

SEQ ID NO: 5807207 - DNA, 18 bp, Homo sapiens
tgtgtccttgcacctgca

SEQ ID NO: 5807208 - DNA, 16 bp, Homo sapiens
tgtgtccttgtgcatg

SEQ ID NO: 5807209 - DNA, 14 bp, Homo sapiens
tgtgtcctttctga

SEQ ID NO: 5807210 - DNA, 14 bp, Homo sapiens
tgtgtcgcctctca

SEQ ID NO: 5807211 - DNA, 20 bp, Homo sapiens
tgtgtcggggggcgagggag

SEQ ID NO: 5807212 - DNA, 15 bp, Homo sapiens
tgtgtctaaactgca

SEQ ID NO: 5807213 - DNA, 17 bp, Homo sapiens
tgtgtctaaactgcatt

SEQ ID NO: 5807214 - DNA, 21 bp, Homo sapiens
tgtgtctaaactgcattaccg

SEQ ID NO: 5807215 - DNA, 22 bp, Homo sapiens
tgtgtctaaatttgaatgttaa

SEQ ID NO: 5807216 - DNA, 16 bp, Homo sapiens
tgtgtctaagattcta

SEQ ID NO: 5807217 - DNA, 19 bp, Homo sapiens
tgtgtctaagattctagat

SEQ ID NO: 5807218 - DNA, 17 bp, Homo sapiens
tgtgtctagttttctag

SEQ ID NO: 5807219 - DNA, 16 bp, Homo sapiens
tgtgtctatgtacctc

SEQ ID NO: 5807220 - DNA, 17 bp, Homo sapiens
tgtgtctatttctgaaa

SEQ ID NO: 5807221 - DNA, 14 bp, Homo sapiens
tgtgtctattttgt

SEQ ID NO: 5807222 - DNA, 20 bp, Homo sapiens
tgtgtctcaaaaataatata

SEQ ID NO: 5807223 - DNA, 21 bp, Homo sapiens
tgtgtctcaggctcaagtttt

SEQ ID NO: 5807224 - DNA, 22 bp, Homo sapiens
tgtgtctccaagcctctgtctt

SEQ ID NO: 5807225 - DNA, 16 bp, Homo sapiens
tgtgtctccagctgat

SEQ ID NO: 5807226 - DNA, 14 bp, Homo sapiens
tgtgtctcccagaa

SEQ ID NO: 5807227 - DNA, 23 bp, Homo sapiens
tgtgtctcccaggtgcatttctt

SEQ ID NO: 5807228 - DNA, 19 bp, Homo sapiens
tgtgtctcctgcatgcaga

SEQ ID NO: 5807229 - DNA, 12 bp, Homo sapiens
tgtgtctcctgt

SEQ ID NO: 5807230 - DNA, 12 bp, Homo sapiens
tgtgtctctatg

SEQ ID NO: 5807231 - DNA, 12 bp, Homo sapiens
tgtgtctctgta

SEQ ID NO: 5807232 - DNA, 12 bp, Homo sapiens
tgtgtctctgtt

SEQ ID NO: 5807233 - DNA, 17 bp, Homo sapiens
tgtgtctcttggtcctg

SEQ ID NO: 5807234 - DNA, 22 bp, Homo sapiens
tgtgtctcttggtcctgctgca

SEQ ID NO: 5807235 - DNA, 14 bp, Homo sapiens
tgtgtctcttttct

SEQ ID NO: 5807236 - DNA, 16 bp, Homo sapiens
tgtgtctcttttctct

SEQ ID NO: 5807237 - DNA, 16 bp, Homo sapiens
tgtgtctgaatcatgt

SEQ ID NO: 5807238 - DNA, 13 bp, Homo sapiens
tgtgtctgactca

SEQ ID NO: 5807239 - DNA, 12 bp, Homo sapiens
tgtgtctgcagg

SEQ ID NO: 5807240 - DNA, 13 bp, Homo sapiens
tgtgtctgcctgc

SEQ ID NO: 5807241 - DNA, 17 bp, Homo sapiens
tgtgtctgcctgcctca

SEQ ID NO: 5807242 - DNA, 23 bp, Homo sapiens
tgtgtctgcctgcctcatgctct

SEQ ID NO: 5807243 - DNA, 17 bp, Homo sapiens
tgtgtctgcgaagtcct

SEQ ID NO: 5807244 - DNA, 10 bp, Homo sapiens
tgtgtctgct

SEQ ID NO: 5807245 - DNA, 16 bp, Homo sapiens
tgtgtctgctaatgta

SEQ ID NO: 5807246 - DNA, 14 bp, Homo sapiens
tgtgtctgctcagt

SEQ ID NO: 5807247 - DNA, 13 bp, Homo sapiens
tgtgtctgctgag

SEQ ID NO: 5807248 - DNA, 22 bp, Homo sapiens
tgtgtctgctttaaagggcctg

SEQ ID NO: 5807249 - DNA, 15 bp, Homo sapiens
tgtgtctggaagaag

SEQ ID NO: 5807250 - DNA, 20 bp, Homo sapiens
tgtgtctggaagaagcagcg

SEQ ID NO: 5807251 - DNA, 14 bp, Homo sapiens
tgtgtctggacctc

SEQ ID NO: 5807252 - DNA, 13 bp, Homo sapiens
tgtgtctggcccc

SEQ ID NO: 5807253 - DNA, 16 bp, Homo sapiens
tgtgtctgggagagcc

SEQ ID NO: 5807254 - DNA, 18 bp, Homo sapiens
tgtgtctgggagagcctg

SEQ ID NO: 5807255 - DNA, 19 bp, Homo sapiens
tgtgtctggtccacacacc

SEQ ID NO: 5807256 - DNA, 12 bp, Homo sapiens
tgtgtctgtagg

SEQ ID NO: 5807257 - DNA, 22 bp, Homo sapiens
tgtgtctgtaggtgtctctggg

SEQ ID NO: 5807258 - DNA, 13 bp, Homo sapiens
tgtgtctgtattc

SEQ ID NO: 5807259 - DNA, 24 bp, Homo sapiens
tgtgtctgtatttcatgtggctgt

SEQ ID NO: 5807260 - DNA, 13 bp, Homo sapiens
tgtgtctgtcaca

SEQ ID NO: 5807261 - DNA, 14 bp, Homo sapiens
tgtgtctgtcacag

SEQ ID NO: 5807262 - DNA, 20 bp, Homo sapiens
tgtgtctgtcacaggctggg

SEQ ID NO: 5807263 - DNA, 22 bp, Homo sapiens
tgtgtctgtgccctccaaagag

SEQ ID NO: 5807264 - DNA, 13 bp, Homo sapiens
tgtgtctgtggtt

SEQ ID NO: 5807265 - DNA, 16 bp, Homo sapiens
tgtgtctgttttactg

SEQ ID NO: 5807266 - DNA, 16 bp, Homo sapiens
tgtgtcttaaatactt

SEQ ID NO: 5807267 - DNA, 16 bp, Homo sapiens
tgtgtcttaattatta

SEQ ID NO: 5807268 - DNA, 18 bp, Homo sapiens
tgtgtcttcattttcatt

SEQ ID NO: 5807269 - DNA, 15 bp, Homo sapiens
tgtgtcttctgcccc

SEQ ID NO: 5807270 - DNA, 19 bp, Homo sapiens
tgtgtcttgtattatcata

SEQ ID NO: 5807271 - DNA, 9 bp, Homo sapiens
tgtgtcttt

SEQ ID NO: 5807272 - DNA, 14 bp, Homo sapiens
tgtgtctttagata

SEQ ID NO: 5807273 - DNA, 18 bp, Homo sapiens
tgtgtctttatagatgta

SEQ ID NO: 5807274 - DNA, 20 bp, Homo sapiens
tgtgtctttatagatgtaca

SEQ ID NO: 5807275 - DNA, 14 bp, Homo sapiens
tgtgtctttctctc

SEQ ID NO: 5807276 - DNA, 19 bp, Homo sapiens
tgtgtctttgtctggccac

SEQ ID NO: 5807277 - DNA, 21 bp, Homo sapiens
tgtgtcttttataaaaagttt

SEQ ID NO: 5807278 - DNA, 14 bp, Homo sapiens
tgtgtcttttgcat

SEQ ID NO: 5807279 - DNA, 16 bp, Homo sapiens
tgtgtcttttgcatga

SEQ ID NO: 5807280 - DNA, 16 bp, Homo sapiens
tgtgtctttttttact

SEQ ID NO: 5807281 - DNA, 19 bp, Homo sapiens
tgtgtgaaaaaagaaaatg

SEQ ID NO: 5807282 - DNA, 23 bp, Homo sapiens
tgtgtgaaaattcaggtgctaga

SEQ ID NO: 5807283 - DNA, 15 bp, Homo sapiens
tgtgtgaaacaatgt

SEQ ID NO: 5807284 - DNA, 14 bp, Homo sapiens
tgtgtgaaacctga

SEQ ID NO: 5807285 - DNA, 17 bp, Homo sapiens
tgtgtgaaactttcatt

SEQ ID NO: 5807286 - DNA, 22 bp, Homo sapiens
tgtgtgaaaggtacttcaaatc

SEQ ID NO: 5807287 - DNA, 18 bp, Homo sapiens
tgtgtgaataccccaaga

SEQ ID NO: 5807288 - DNA, 17 bp, Homo sapiens
tgtgtgaattctgcaac

SEQ ID NO: 5807289 - DNA, 20 bp, Homo sapiens
tgtgtgacaattctgttttt

SEQ ID NO: 5807290 - DNA, 13 bp, Homo sapiens
tgtgtgacactga

SEQ ID NO: 5807291 - DNA, 16 bp, Homo sapiens
tgtgtgacactgatga

SEQ ID NO: 5807292 - DNA, 20 bp, Homo sapiens
tgtgtgacatcacagggcct

SEQ ID NO: 5807293 - DNA, 18 bp, Homo sapiens
tgtgtgacccctcctggg

SEQ ID NO: 5807294 - DNA, 19 bp, Homo sapiens
tgtgtgacgcagataactg

SEQ ID NO: 5807295 - DNA, 15 bp, Homo sapiens
tgtgtgactgagcaa

SEQ ID NO: 5807296 - DNA, 15 bp, Homo sapiens
tgtgtgagagagagg

SEQ ID NO: 5807297 - DNA, 23 bp, Homo sapiens
tgtgtgagaggggcgccttttca

SEQ ID NO: 5807298 - DNA, 17 bp, Homo sapiens
tgtgtgagcaagcattt

SEQ ID NO: 5807299 - DNA, 14 bp, Homo sapiens
tgtgtgagcatcct

SEQ ID NO: 5807300 - DNA, 17 bp, Homo sapiens
tgtgtgagcatcctgca

SEQ ID NO: 5807301 - DNA, 21 bp, Homo sapiens
tgtgtgagcgtggccttggga

SEQ ID NO: 5807302 - DNA, 19 bp, Homo sapiens
tgtgtgagcgtgtccacag

SEQ ID NO: 5807303 - DNA, 15 bp, Homo sapiens
tgtgtgagctttttt

SEQ ID NO: 5807304 - DNA, 23 bp, Homo sapiens
tgtgtgagtcacttctacgcata

SEQ ID NO: 5807305 - DNA, 21 bp, Homo sapiens
tgtgtgagtggagttgaggtg

SEQ ID NO: 5807306 - DNA, 16 bp, Homo sapiens
tgtgttttgaaagaat

SEQ ID NO: 5807307 - DNA, 19 bp, Homo sapiens
tgtgttttgctaaaggaaa

SEQ ID NO: 5807308 - DNA, 16 bp, Homo sapiens
tgtgttttgtacataa

SEQ ID NO: 5807309 - DNA, 14 bp, Homo sapiens
tgtgttttgtccaa

SEQ ID NO: 5807310 - DNA, 14 bp, Homo sapiens
tgtgtttttaaaag

SEQ ID NO: 5807311 - DNA, 15 bp, Homo sapiens
tgtgtttttaataaa

SEQ ID NO: 5807312 - DNA, 20 bp, Homo sapiens
tgtgtttttacgtagtgtca

SEQ ID NO: 5807313 - DNA, 15 bp, Homo sapiens
tgtgtttttccaaaa

SEQ ID NO: 5807314 - DNA, 14 bp, Homo sapiens
tgtgtttttctatt

SEQ ID NO: 5807315 - DNA, 22 bp, Homo sapiens
tgtgtttttctattaaaagact

SEQ ID NO: 5807316 - DNA, 15 bp, Homo sapiens
tgtgtttttctttct

SEQ ID NO: 5807317 - DNA, 16 bp, Homo sapiens
tgtgtttttctttttc

SEQ ID NO: 5807318 - DNA, 21 bp, Homo sapiens
tgtgtttttgctatcacacag

SEQ ID NO: 5807319 - DNA, 19 bp, Homo sapiens
tgtgtttttgggatgtctt

SEQ ID NO: 5807320 - DNA, 14 bp, Homo sapiens
tgtgttttttaaga

SEQ ID NO: 5807321 - DNA, 13 bp, Homo sapiens
tgttaaaaaacaa

SEQ ID NO: 5807322 - DNA, 15 bp, Homo sapiens
tgttaaaaaagaaat

SEQ ID NO: 5807323 - DNA, 21 bp, Homo sapiens
tgttaaaaacatgtgaaagat

SEQ ID NO: 5807324 - DNA, 14 bp, Homo sapiens
tgttaaaaaccatt

SEQ ID NO: 5807325 - DNA, 13 bp, Homo sapiens
tgttaaaaataaa

SEQ ID NO: 5807326 - DNA, 9 bp, Homo sapiens
tgttaaaac

SEQ ID NO: 5807327 - DNA, 18 bp, Homo sapiens
tgttaaaacacttctgtc

SEQ ID NO: 5807328 - DNA, 19 bp, Homo sapiens
tgttaaaacataaacacat

SEQ ID NO: 5807329 - DNA, 22 bp, Homo sapiens
tgttaaaaccaaactggttcac

SEQ ID NO: 5807330 - DNA, 22 bp, Homo sapiens
tgttaaaagaaaacactgtcat

SEQ ID NO: 5807331 - DNA, 23 bp, Homo sapiens
tgttaaaaggaaaaataacaact

SEQ ID NO: 5807332 - DNA, 12 bp, Homo sapiens
tgttaaaataac

SEQ ID NO: 5807333 - DNA, 16 bp, Homo sapiens
tgttaaaataattata

SEQ ID NO: 5807334 - DNA, 15 bp, Homo sapiens
tgttaaaatacataa

SEQ ID NO: 5807335 - DNA, 18 bp, Homo sapiens
tgttaaaatagacaactc

SEQ ID NO: 5807336 - DNA, 15 bp, Homo sapiens
tgttaaaatattgat

SEQ ID NO: 5807337 - DNA, 12 bp, Homo sapiens
tgttaaaatcta

SEQ ID NO: 5807338 - DNA, 19 bp, Homo sapiens
tgttaaaatctctctctgt

SEQ ID NO: 5807339 - DNA, 22 bp, Homo sapiens
tgttaaaatgagggtctcactg

SEQ ID NO: 5807340 - DNA, 23 bp, Homo sapiens
tgttaaaatgcatgattgcagaa

SEQ ID NO: 5807341 - DNA, 16 bp, Homo sapiens
tgttaaacaaatgatt

SEQ ID NO: 5807342 - DNA, 18 bp, Homo sapiens
tgttaaacacgtgtctat

SEQ ID NO: 5807343 - DNA, 12 bp, Homo sapiens
tgttaaacacta

SEQ ID NO: 5807344 - DNA, 20 bp, Homo sapiens
tgttaaacagtagttgtatt

SEQ ID NO: 5807345 - DNA, 18 bp, Homo sapiens
tgttaaaccatgggataa

SEQ ID NO: 5807346 - DNA, 20 bp, Homo sapiens
tgttaaaccatgggataaat

SEQ ID NO: 5807347 - DNA, 21 bp, Homo sapiens
tgttaaaccatgggataaatg

SEQ ID NO: 5807348 - DNA, 18 bp, Homo sapiens
tgttaaacgtcacagcag

SEQ ID NO: 5807349 - DNA, 19 bp, Homo sapiens
tgttaaacgtcacagcagt

SEQ ID NO: 5807350 - DNA, 20 bp, Homo sapiens
tgttaaactagcatatctgc

SEQ ID NO: 5807351 - DNA, 13 bp, Homo sapiens
tgttaaactctgt

SEQ ID NO: 5807352 - DNA, 13 bp, Homo sapiens
tgttaaactgtta

SEQ ID NO: 5807353 - DNA, 19 bp, Homo sapiens
tgttaaactgttagcactg

SEQ ID NO: 5807354 - DNA, 19 bp, Homo sapiens
tgttaaagagataaagaat

SEQ ID NO: 5807355 - DNA, 14 bp, Homo sapiens
tgttaaagagcact

SEQ ID NO: 5807356 - DNA, 20 bp, Homo sapiens
tgttaaagaggcgtcttgta

SEQ ID NO: 5807357 - DNA, 18 bp, Homo sapiens
tgttaaagatttcaaata

SEQ ID NO: 5807358 - DNA, 17 bp, Homo sapiens
tgttaaagctgtacacc

SEQ ID NO: 5807359 - DNA, 12 bp, Homo sapiens
tgttaaagctta

SEQ ID NO: 5807360 - DNA, 14 bp, Homo sapiens
tgttaaagttgttt

SEQ ID NO: 5807361 - DNA, 16 bp, Homo sapiens
tgttaaataaattgta

SEQ ID NO: 5807362 - DNA, 15 bp, Homo sapiens
tgttaaatactgtgc

SEQ ID NO: 5807363 - DNA, 15 bp, Homo sapiens
tgttaaatctacaaa

SEQ ID NO: 5807364 - DNA, 19 bp, Homo sapiens
tgttaaatgaaattgtaaa

SEQ ID NO: 5807365 - DNA, 15 bp, Homo sapiens
tgttaaatgacttga

SEQ ID NO: 5807366 - DNA, 13 bp, Homo sapiens
tgttaaatggaat

SEQ ID NO: 5807367 - DNA, 14 bp, Homo sapiens
tgttaaatggaatt

SEQ ID NO: 5807368 - DNA, 17 bp, Homo sapiens
tgttaaatggaattcgt

SEQ ID NO: 5807369 - DNA, 17 bp, Homo sapiens
tgttaaattacattttt

SEQ ID NO: 5807370 - DNA, 12 bp, Homo sapiens
tgttaaattcat

SEQ ID NO: 5807371 - DNA, 16 bp, Homo sapiens
tgttaaattcatttta

SEQ ID NO: 5807372 - DNA, 20 bp, Homo sapiens
tgttaaatttaaaaataggt

SEQ ID NO: 5807373 - DNA, 14 bp, Homo sapiens
tgttaaatttagtg

SEQ ID NO: 5807374 - DNA, 15 bp, Homo sapiens
tgttaaatttgtaag

SEQ ID NO: 5807375 - DNA, 18 bp, Homo sapiens
tgttaaatttgtaagttt

SEQ ID NO: 5807376 - DNA, 17 bp, Homo sapiens
tgttaaattttctctaa

SEQ ID NO: 5807377 - DNA, 16 bp, Homo sapiens
tgttaaatttttctga

SEQ ID NO: 5807378 - DNA, 14 bp, Homo sapiens
tgttaacaatgcct

SEQ ID NO: 5807379 - DNA, 22 bp, Homo sapiens
tgttaacaatggcaggttttac

SEQ ID NO: 5807380 - DNA, 21 bp, Homo sapiens
tgttaacacattttgtataat

SEQ ID NO: 5807381 - DNA, 22 bp, Homo sapiens
tgttaacagaagggagggcaga

SEQ ID NO: 5807382 - DNA, 17 bp, Homo sapiens
tgttaacagacactgta

SEQ ID NO: 5807383 - DNA, 23 bp, Homo sapiens
tgttaacagcaacgaaccctaga

SEQ ID NO: 5807384 - DNA, 15 bp, Homo sapiens
tgttaacagtatttt

SEQ ID NO: 5807385 - DNA, 20 bp, Homo sapiens
tgttaacataggcttataca

SEQ ID NO: 5807386 - DNA, 15 bp, Homo sapiens
tgttaacattccaag

SEQ ID NO: 5807387 - DNA, 20 bp, Homo sapiens
tgttaacatttttggtagtc

SEQ ID NO: 5807388 - DNA, 15 bp, Homo sapiens
tgttaacccactgca

SEQ ID NO: 5807389 - DNA, 18 bp, Homo sapiens
tgttaacccattccagta

SEQ ID NO: 5807390 - DNA, 14 bp, Homo sapiens
tgttaacctacaaa

SEQ ID NO: 5807391 - DNA, 15 bp, Homo sapiens
tgttaacctacaaaa

SEQ ID NO: 5807392 - DNA, 15 bp, Homo sapiens
tgttaacctaggcag

SEQ ID NO: 5807393 - DNA, 17 bp, Homo sapiens
tgttaacctcagtgtca

SEQ ID NO: 5807394 - DNA, 17 bp, Homo sapiens
tgttaaccttaaataca

SEQ ID NO: 5807395 - DNA, 18 bp, Homo sapiens
tgttaaccttgtaagatg

SEQ ID NO: 5807396 - DNA, 17 bp, Homo sapiens
tgttaacctttctaacc

SEQ ID NO: 5807397 - DNA, 16 bp, Homo sapiens
tgttaacgtgcatgag

SEQ ID NO: 5807398 - DNA, 15 bp, Homo sapiens
tgttaactacatatt

SEQ ID NO: 5807399 - DNA, 22 bp, Homo sapiens
tgttaactagtgtttctgcaga

SEQ ID NO: 5807400 - DNA, 16 bp, Homo sapiens
tgttaactatgacaga

SEQ ID NO: 5807401 - DNA, 18 bp, Homo sapiens
tgttaactattattaata

SEQ ID NO: 5807402 - DNA, 17 bp, Homo sapiens
tgttaactcttgtctat

SEQ ID NO: 5807403 - DNA, 22 bp, Homo sapiens
tgttaactgaataccactctgt

SEQ ID NO: 5807404 - DNA, 13 bp, Homo sapiens
tgttaactgtctt

SEQ ID NO: 5807405 - DNA, 19 bp, Homo sapiens
tgttaactgtcttgagaga

SEQ ID NO: 5807406 - DNA, 20 bp, Homo sapiens
tgttaactgtcttgagagaa

SEQ ID NO: 5807407 - DNA, 14 bp, Homo sapiens
tgttaactgttctt

SEQ ID NO: 5807408 - DNA, 18 bp, Homo sapiens
tgttaacttatgtctctt

SEQ ID NO: 5807409 - DNA, 15 bp, Homo sapiens
tgttaacttattcaa

SEQ ID NO: 5807410 - DNA, 17 bp, Homo sapiens
tgttaacttattcaaag

SEQ ID NO: 5807411 - DNA, 18 bp, Homo sapiens
tgttaacttattcaaaga

SEQ ID NO: 5807412 - DNA, 12 bp, Homo sapiens
tgttaacttcta

SEQ ID NO: 5807413 - DNA, 17 bp, Homo sapiens
tgttaacttgcctccat

SEQ ID NO: 5807414 - DNA, 16 bp, Homo sapiens
tgttaactttcaaatc

SEQ ID NO: 5807415 - DNA, 22 bp, Homo sapiens
tgttaagaaaggatataaaagg

SEQ ID NO: 5807416 - DNA, 17 bp, Homo sapiens
tgttaagaaatctgttt

SEQ ID NO: 5807417 - DNA, 20 bp, Homo sapiens
tgttaagaatgaagttctgc

SEQ ID NO: 5807418 - DNA, 21 bp, Homo sapiens
tgttaagaatgaagttctgct

SEQ ID NO: 5807419 - DNA, 15 bp, Homo sapiens
tgttaagaatttcaa

SEQ ID NO: 5807420 - DNA, 16 bp, Homo sapiens
tgttaagaatttcaat

SEQ ID NO: 5807421 - DNA, 20 bp, Homo sapiens
tgttaagacttgacagtgga

SEQ ID NO: 5807422 - DNA, 21 bp, Homo sapiens
tgttaagagataattcttaaa

SEQ ID NO: 5807423 - DNA, 19 bp, Homo sapiens
tgttaagataacttactgt

SEQ ID NO: 5807424 - DNA, 15 bp, Homo sapiens
tgttaagataattgt

SEQ ID NO: 5807425 - DNA, 22 bp, Homo sapiens
tgttaagataattgtactttga

SEQ ID NO: 5807426 - DNA, 23 bp, Homo sapiens
tgttaagccatttaactggagct

SEQ ID NO: 5807427 - DNA, 14 bp, Homo sapiens
tgttaagctctgct

SEQ ID NO: 5807428 - DNA, 20 bp, Homo sapiens
tgttaaggaaactcttatct

SEQ ID NO: 5807429 - DNA, 21 bp, Homo sapiens
tgttaaggaaactcttatctc

SEQ ID NO: 5807430 - DNA, 17 bp, Homo sapiens
tgttaagggaccaggga

SEQ ID NO: 5807431 - DNA, 15 bp, Homo sapiens
tgttaaggttcaaga

SEQ ID NO: 5807432 - DNA, 22 bp, Homo sapiens
tgttaaggttgaactttgccaa

SEQ ID NO: 5807433 - DNA, 24 bp, Homo sapiens
tgttaagtatcagctacaattgta

SEQ ID NO: 5807434 - DNA, 18 bp, Homo sapiens
tgttaagtcctccctgac

SEQ ID NO: 5807435 - DNA, 22 bp, Homo sapiens
tgttaagtgccattactactgt

SEQ ID NO: 5807436 - DNA, 16 bp, Homo sapiens
tgttaagttcaccgta

SEQ ID NO: 5807437 - DNA, 22 bp, Homo sapiens
tgttaagttgatggtgatgaaa

SEQ ID NO: 5807438 - DNA, 12 bp, Homo sapiens
tgttaataaagg

SEQ ID NO: 5807439 - DNA, 15 bp, Homo sapiens
tgttaataaaggtct

SEQ ID NO: 5807440 - DNA, 22 bp, Homo sapiens
tgttaataaagtgcactgccac

SEQ ID NO: 5807441 - DNA, 15 bp, Homo sapiens
tgttaataaatggat

SEQ ID NO: 5807442 - DNA, 19 bp, Homo sapiens
tgttaataataagataatg

SEQ ID NO: 5807443 - DNA, 14 bp, Homo sapiens
tgttaatacaaggt

SEQ ID NO: 5807444 - DNA, 15 bp, Homo sapiens
tgttaatacacagta

SEQ ID NO: 5807445 - DNA, 21 bp, Homo sapiens
tgttaatacacagtactttat

SEQ ID NO: 5807446 - DNA, 15 bp, Homo sapiens
tgttaatacatcaca

SEQ ID NO: 5807447 - DNA, 18 bp, Homo sapiens
tgttaatacatcacatct

SEQ ID NO: 5807448 - DNA, 18 bp, Homo sapiens
tgttaatactagttgtga

SEQ ID NO: 5807449 - DNA, 21 bp, Homo sapiens
tgttaatactggatagcatga

SEQ ID NO: 5807450 - DNA, 16 bp, Homo sapiens
tgttaatatatataat

SEQ ID NO: 5807451 - DNA, 21 bp, Homo sapiens
tgttaatatctgatactgtat

SEQ ID NO: 5807452 - DNA, 19 bp, Homo sapiens
tgttaatatgtatttgttg

SEQ ID NO: 5807453 - DNA, 21 bp, Homo sapiens
tgttaatatgtatttgttgaa

SEQ ID NO: 5807454 - DNA, 15 bp, Homo sapiens
tgttaatatttctaa

SEQ ID NO: 5807455 - DNA, 17 bp, Homo sapiens
tgttaatatttctaaaa

SEQ ID NO: 5807456 - DNA, 20 bp, Homo sapiens
tgttaatatttctaaaagtt

SEQ ID NO: 5807457 - DNA, 15 bp, Homo sapiens
tgttaatatttcttc

SEQ ID NO: 5807458 - DNA, 21 bp, Homo sapiens
tgttaatattttacttttaca

SEQ ID NO: 5807459 - DNA, 13 bp, Homo sapiens
tgttaatcaattt

SEQ ID NO: 5807460 - DNA, 14 bp, Homo sapiens
tgttaatcaattta

SEQ ID NO: 5807461 - DNA, 17 bp, Homo sapiens
tgttaatcaatttaaac

SEQ ID NO: 5807462 - DNA, 20 bp, Homo sapiens
tgttaatcaatttaaaccca

SEQ ID NO: 5807463 - DNA, 22 bp, Homo sapiens
tgttaatcaatttaaacccatt

SEQ ID NO: 5807464 - DNA, 14 bp, Homo sapiens
tgttaatcatcttc

SEQ ID NO: 5807465 - DNA, 17 bp, Homo sapiens
tgttaatcatcttctct

SEQ ID NO: 5807466 - DNA, 14 bp, Homo sapiens
tgttaatcctagct

SEQ ID NO: 5807467 - DNA, 19 bp, Homo sapiens
tgttaatctctgttatgta

SEQ ID NO: 5807468 - DNA, 23 bp, Homo sapiens
tgttaatctctgttatgtactgt

SEQ ID NO: 5807469 - DNA, 19 bp, Homo sapiens
tgttaatcttaatgtatat

SEQ ID NO: 5807470 - DNA, 15 bp, Homo sapiens
tgttaatgaacagtg

SEQ ID NO: 5807471 - DNA, 18 bp, Homo sapiens
tgttaatgactctttctg

SEQ ID NO: 5807472 - DNA, 15 bp, Homo sapiens
tgttaatgagaaaat

SEQ ID NO: 5807473 - DNA, 21 bp, Homo sapiens
tgttaatgagtatatgtaaca

SEQ ID NO: 5807474 - DNA, 22 bp, Homo sapiens
tgttaatgagtatatgtaacag

SEQ ID NO: 5807475 - DNA, 16 bp, Homo sapiens
tgttaatgcattcttt

SEQ ID NO: 5807476 - DNA, 17 bp, Homo sapiens
tgttaatgcattctttc

SEQ ID NO: 5807477 - DNA, 23 bp, Homo sapiens
tgttaatgcattctttcttctct

SEQ ID NO: 5807478 - DNA, 23 bp, Homo sapiens
tgttaatggatttcagaagccta

SEQ ID NO: 5807479 - DNA, 20 bp, Homo sapiens
tgttaatggtgcaaatccta

SEQ ID NO: 5807480 - DNA, 12 bp, Homo sapiens
tgttaatgtatt

SEQ ID NO: 5807481 - DNA, 18 bp, Homo sapiens
tgttaatgtatttgttca

SEQ ID NO: 5807482 - DNA, 14 bp, Homo sapiens
tgttaatgtgatgg

SEQ ID NO: 5807483 - DNA, 18 bp, Homo sapiens
tgttaatgttgggattta

SEQ ID NO: 5807484 - DNA, 16 bp, Homo sapiens
tgttcacagccagact

SEQ ID NO: 5807485 - DNA, 15 bp, Homo sapiens
tgttcacagcttttc

SEQ ID NO: 5807486 - DNA, 19 bp, Homo sapiens
tgttcacagcttttcttga

SEQ ID NO: 5807487 - DNA, 23 bp, Homo sapiens
tgttcaccagtgcttgcttgtga

SEQ ID NO: 5807488 - DNA, 15 bp, Homo sapiens
tgttcaccattataa

SEQ ID NO: 5807489 - DNA, 23 bp, Homo sapiens
tgttcaccctgcattacatgtgt

SEQ ID NO: 5807490 - DNA, 15 bp, Homo sapiens
tgttcaccttatgta

SEQ ID NO: 5807491 - DNA, 17 bp, Homo sapiens
tgttcaccttatgtatt

SEQ ID NO: 5807492 - DNA, 17 bp, Homo sapiens
tgttcaccttctgtgca

SEQ ID NO: 5807493 - DNA, 18 bp, Homo sapiens
tgttcaccttctgtgcat

SEQ ID NO: 5807494 - DNA, 19 bp, Homo sapiens
tgttcacgtgactcctcaa

SEQ ID NO: 5807495 - DNA, 17 bp, Homo sapiens
tgttcactaaactctga

SEQ ID NO: 5807496 - DNA, 15 bp, Homo sapiens
tgttcactgtgagtt

SEQ ID NO: 5807497 - DNA, 13 bp, Homo sapiens
tgttcacttcgaa

SEQ ID NO: 5807498 - DNA, 12 bp, Homo sapiens
tgttcagaaaaa

SEQ ID NO: 5807499 - DNA, 14 bp, Homo sapiens
tgttcagaaaagca

SEQ ID NO: 5807500 - DNA, 12 bp, Homo sapiens
tgttcagaaaat

SEQ ID NO: 5807501 - DNA, 13 bp, Homo sapiens
tgttcagaaaatg

SEQ ID NO: 5807502 - DNA, 19 bp, Homo sapiens
tgttcagaacttcatctgc

SEQ ID NO: 5807503 - DNA, 21 bp, Homo sapiens
tgttcagaacttcatctgcca

SEQ ID NO: 5807504 - DNA, 11 bp, Homo sapiens
tgttcagaaga

SEQ ID NO: 5807505 - DNA, 22 bp, Homo sapiens
tgttcagaagaaattctgtcat

SEQ ID NO: 5807506 - DNA, 18 bp, Homo sapiens
tgttcagaaggttgctct

SEQ ID NO: 5807507 - DNA, 13 bp, Homo sapiens
tgttcagaagttg

SEQ ID NO: 5807508 - DNA, 15 bp, Homo sapiens
tgttcagagtggctc

SEQ ID NO: 5807509 - DNA, 16 bp, Homo sapiens
tgttcagagtggctca

SEQ ID NO: 5807510 - DNA, 22 bp, Homo sapiens
tgttcagagtggctcactggct

SEQ ID NO: 5807511 - DNA, 19 bp, Homo sapiens
tgttcagagttccacagtt

SEQ ID NO: 5807512 - DNA, 20 bp, Homo sapiens
tgttcagagttccacagttg

SEQ ID NO: 5807513 - DNA, 17 bp, Homo sapiens
tgttcagagttgtttgg

SEQ ID NO: 5807514 - DNA, 15 bp, Homo sapiens
tgttcagatgtgcat

SEQ ID NO: 5807515 - DNA, 14 bp, Homo sapiens
tgttcagattaaaa

SEQ ID NO: 5807516 - DNA, 17 bp, Homo sapiens
tgttcagcggagctgac

SEQ ID NO: 5807517 - DNA, 21 bp, Homo sapiens
tgttcagcggagctgactggt

SEQ ID NO: 5807518 - DNA, 14 bp, Homo sapiens
tgttcagctccagc

SEQ ID NO: 5807519 - DNA, 20 bp, Homo sapiens
tgttcagctccagctcacca

SEQ ID NO: 5807520 - DNA, 20 bp, Homo sapiens
tgttcagctctttccaaatt

SEQ ID NO: 5807521 - DNA, 21 bp, Homo sapiens
tgttcagctgtcctccctcca

SEQ ID NO: 5807522 - DNA, 14 bp, Homo sapiens
tgttcagcttcaga

SEQ ID NO: 5807523 - DNA, 18 bp, Homo sapiens
tgttcaggaagtccttat

SEQ ID NO: 5807524 - DNA, 13 bp, Homo sapiens
tgttcaggagctg

SEQ ID NO: 5807525 - DNA, 12 bp, Homo sapiens
tgttcaggcagg

SEQ ID NO: 5807526 - DNA, 22 bp, Homo sapiens
tgttcagtaacagggccttgct

SEQ ID NO: 5807527 - DNA, 16 bp, Homo sapiens
tgttcagtattgcaat

SEQ ID NO: 5807528 - DNA, 14 bp, Homo sapiens
tgttcagtcacttg

SEQ ID NO: 5807529 - DNA, 20 bp, Homo sapiens
tgttcagtgaggtatgatgt

SEQ ID NO: 5807530 - DNA, 14 bp, Homo sapiens
tgttcagtgccttg

SEQ ID NO: 5807531 - DNA, 18 bp, Homo sapiens
tgttcagtgccttggagc

SEQ ID NO: 5807532 - DNA, 15 bp, Homo sapiens
tgttcagtgcttttt

SEQ ID NO: 5807533 - DNA, 17 bp, Homo sapiens
tgttcagtgtaatttct

SEQ ID NO: 5807534 - DNA, 21 bp, Homo sapiens
tgttcagtgtaatttctttgc

SEQ ID NO: 5807535 - DNA, 17 bp, Homo sapiens
tgttcagtgtcccgggc

SEQ ID NO: 5807536 - DNA, 22 bp, Homo sapiens
tgttcagtgttgacatagcctt

SEQ ID NO: 5807537 - DNA, 17 bp, Homo sapiens
tgttcagttacagaaag

SEQ ID NO: 5807538 - DNA, 18 bp, Homo sapiens
tgttcagttacagaaagt

SEQ ID NO: 5807539 - DNA, 14 bp, Homo sapiens
tgttcagttcaaaa

SEQ ID NO: 5807540 - DNA, 13 bp, Homo sapiens
tgttcagttgact

SEQ ID NO: 5807541 - DNA, 21 bp, Homo sapiens
tgttcataaaacggtgctttc

SEQ ID NO: 5807542 - DNA, 17 bp, Homo sapiens
tgttcataatacataaa

SEQ ID NO: 5807543 - DNA, 23 bp, Homo sapiens
tgttcatacaagccaactggtat

SEQ ID NO: 5807544 - DNA, 12 bp, Homo sapiens
tgttcatacata

SEQ ID NO: 5807545 - DNA, 23 bp, Homo sapiens
tgttcatactttggctgtgatgt

SEQ ID NO: 5807546 - DNA, 15 bp, Homo sapiens
tgttcatagcccagt

SEQ ID NO: 5807547 - DNA, 19 bp, Homo sapiens
tgttcatatgtacttgttt

SEQ ID NO: 5807548 - DNA, 23 bp, Homo sapiens
tgttcatattaagaatgatctga

SEQ ID NO: 5807549 - DNA, 22 bp, Homo sapiens
tgttcatcaacagtgagagact

SEQ ID NO: 5807550 - DNA, 18 bp, Homo sapiens
tgttcatcatccagatgt

SEQ ID NO: 5807551 - DNA, 19 bp, Homo sapiens
tgttcatcccatgatgtag

SEQ ID NO: 5807552 - DNA, 22 bp, Homo sapiens
tgttcatcctcattgcctcctg

SEQ ID NO: 5807553 - DNA, 23 bp, Homo sapiens
tgttcatcctcattgcctcctgt

SEQ ID NO: 5807554 - DNA, 10 bp, Homo sapiens
tgttcatctc

SEQ ID NO: 5807555 - DNA, 18 bp, Homo sapiens
tgttcatctctttgtcct

SEQ ID NO: 5807556 - DNA, 20 bp, Homo sapiens
tgttcatctctttgtcctga

SEQ ID NO: 5807557 - DNA, 15 bp, Homo sapiens
tgttcatcttgtaca

SEQ ID NO: 5807558 - DNA, 20 bp, Homo sapiens
tgttcatcttgtacaaactt

SEQ ID NO: 5807559 - DNA, 14 bp, Homo sapiens
tgttcatgaaagat

SEQ ID NO: 5807560 - DNA, 23 bp, Homo sapiens
tgttcatgagtggatggatggac

SEQ ID NO: 5807561 - DNA, 16 bp, Homo sapiens
tgttcatgtgcctctg

SEQ ID NO: 5807562 - DNA, 23 bp, Homo sapiens
tgttcatgttagttttgctcctt

SEQ ID NO: 5807563 - DNA, 15 bp, Homo sapiens
tgttcattcctccag

SEQ ID NO: 5807564 - DNA, 11 bp, Homo sapiens
tgttcattcta

SEQ ID NO: 5807565 - DNA, 16 bp, Homo sapiens
tgttcattctgtgacc

SEQ ID NO: 5807566 - DNA, 21 bp, Homo sapiens
tgttcattctgtgaccctagt

SEQ ID NO: 5807567 - DNA, 17 bp, Homo sapiens
tgttcattgcacaatat

SEQ ID NO: 5807568 - DNA, 12 bp, Homo sapiens
tgttcattgtaa

SEQ ID NO: 5807569 - DNA, 19 bp, Homo sapiens
tgttcattgtaatgttact

SEQ ID NO: 5807570 - DNA, 21 bp, Homo sapiens
tgttcattgtaatgttactga

SEQ ID NO: 5807571 - DNA, 22 bp, Homo sapiens
tgttcattgtaatgttactgat

SEQ ID NO: 5807572 - DNA, 11 bp, Homo sapiens
tgttcatttag

SEQ ID NO: 5807573 - DNA, 21 bp, Homo sapiens
tgttcatttagataatttgaa

SEQ ID NO: 5807574 - DNA, 22 bp, Homo sapiens
tgttcatttagataatttgaaa

SEQ ID NO: 5807575 - DNA, 17 bp, Homo sapiens
tgttcatttcacacagt

SEQ ID NO: 5807576 - DNA, 19 bp, Homo sapiens
tgttcatttcacacagtga

SEQ ID NO: 5807577 - DNA, 13 bp, Homo sapiens
tgttcatttcatt

SEQ ID NO: 5807578 - DNA, 14 bp, Homo sapiens
tgttcatttcctca

SEQ ID NO: 5807579 - DNA, 13 bp, Homo sapiens
tgttcatttctaa

SEQ ID NO: 5807580 - DNA, 19 bp, Homo sapiens
tgttcatttctaaatttat

SEQ ID NO: 5807581 - DNA, 20 bp, Homo sapiens
tgttcatttctaaatttata

SEQ ID NO: 5807582 - DNA, 16 bp, Homo sapiens
tgttcatttctgtctc

SEQ ID NO: 5807583 - DNA, 22 bp, Homo sapiens
tgttcatttgaaagaggagtat

SEQ ID NO: 5807584 - DNA, 21 bp, Homo sapiens
tgttcatttggtgttcctgga

SEQ ID NO: 5807585 - DNA, 22 bp, Homo sapiens
tgttcattttctctgtatgaat

SEQ ID NO: 5807586 - DNA, 17 bp, Homo sapiens
tgttcattttgagctga

SEQ ID NO: 5807587 - DNA, 16 bp, Homo sapiens
tgttcatttttctctc

SEQ ID NO: 5807588 - DNA, 17 bp, Homo sapiens
tgttccaaagccagtga

SEQ ID NO: 5807589 - DNA, 21 bp, Homo sapiens
tgttccaaatactgcttagca

SEQ ID NO: 5807590 - DNA, 12 bp, Homo sapiens
tgttccaaatgt

SEQ ID NO: 5807591 - DNA, 17 bp, Homo sapiens
tgttccaaattcagttt

SEQ ID NO: 5807592 - DNA, 14 bp, Homo sapiens
tgttccaaatttag

SEQ ID NO: 5807593 - DNA, 15 bp, Homo sapiens
tgttccaaatttgct

SEQ ID NO: 5807594 - DNA, 20 bp, Homo sapiens
tgttccaacagttaaacttg

SEQ ID NO: 5807595 - DNA, 22 bp, Homo sapiens
tgttccaacagttaaacttgca

SEQ ID NO: 5807596 - DNA, 23 bp, Homo sapiens
tgttccaacagttaaacttgcaa

SEQ ID NO: 5807597 - DNA, 21 bp, Homo sapiens
tgttccaacctcctgctctgg

SEQ ID NO: 5807598 - DNA, 18 bp, Homo sapiens
tgttccaagacattgtca

SEQ ID NO: 5807599 - DNA, 14 bp, Homo sapiens
tgttccaagtctct

SEQ ID NO: 5807600 - DNA, 20 bp, Homo sapiens
tgttccaagtctctgtgtaa

SEQ ID NO: 5807601 - DNA, 16 bp, Homo sapiens
tgttccaagtgtgtgt

SEQ ID NO: 5807602 - DNA, 15 bp, Homo sapiens
tgttccaagtttcca

SEQ ID NO: 5807603 - DNA, 15 bp, Homo sapiens
tgttccaatgaaaaa

SEQ ID NO: 5807604 - DNA, 15 bp, Homo sapiens
tgttccaatgccaca

SEQ ID NO: 5807605 - DNA, 20 bp, Homo sapiens
tgttccaatgccacatactt

SEQ ID NO: 5807606 - DNA, 18 bp, Homo sapiens
tgttccaatgtcaatgtg

SEQ ID NO: 5807607 - DNA, 21 bp, Homo sapiens
tgttccacacatttaaaacat

SEQ ID NO: 5807608 - DNA, 16 bp, Homo sapiens
tgttccacattctctc

SEQ ID NO: 5807609 - DNA, 23 bp, Homo sapiens
tgttccacctggaaactgctcag

SEQ ID NO: 5807610 - DNA, 21 bp, Homo sapiens
tgttccactgcaaataaagcc

SEQ ID NO: 5807611 - DNA, 23 bp, Homo sapiens
tgttccactgcaaataaagcctt

SEQ ID NO: 5807612 - DNA, 22 bp, Homo sapiens
tgttccacttctctagagaaca

SEQ ID NO: 5807613 - DNA, 17 bp, Homo sapiens
tgttccagcctgccctc

SEQ ID NO: 5807614 - DNA, 18 bp, Homo sapiens
tgttccagctgaggcagg

SEQ ID NO: 5807615 - DNA, 23 bp, Homo sapiens
tgttccagctgaggcagggggat

SEQ ID NO: 5807616 - DNA, 14 bp, Homo sapiens
tgttccataataaa

SEQ ID NO: 5807617 - DNA, 18 bp, Homo sapiens
tgttccatagttaaagaa

SEQ ID NO: 5807618 - DNA, 19 bp, Homo sapiens
tgttccatcctgtacaagt

SEQ ID NO: 5807619 - DNA, 21 bp, Homo sapiens
tgttccatcctgtacaagtgc

SEQ ID NO: 5807620 - DNA, 20 bp, Homo sapiens
tgttccattacaccacagca

SEQ ID NO: 5807621 - DNA, 23 bp, Homo sapiens
tgttccattacaccacagcattg

SEQ ID NO: 5807622 - DNA, 16 bp, Homo sapiens
tgttccattcagtctg

SEQ ID NO: 5807623 - DNA, 15 bp, Homo sapiens
tgttcccaaaacaat

SEQ ID NO: 5807624 - DNA, 22 bp, Homo sapiens
tgttcccaaagtgaactctcaa

SEQ ID NO: 5807625 - DNA, 23 bp, Homo sapiens
tgttcccaaagtgaactctcaaa

SEQ ID NO: 5807626 - DNA, 19 bp, Homo sapiens
tgttcccaagtaggcattc

SEQ ID NO: 5807627 - DNA, 18 bp, Homo sapiens
tgttcccacacacaaacc

SEQ ID NO: 5807628 - DNA, 16 bp, Homo sapiens
tgttcccacaccccaa

SEQ ID NO: 5807629 - DNA, 17 bp, Homo sapiens
tgttcccacctgctgga

SEQ ID NO: 5807630 - DNA, 19 bp, Homo sapiens
tgttcccagcccctcctcc

SEQ ID NO: 5807631 - DNA, 21 bp, Homo sapiens
tgttcccagcccctcctccct

SEQ ID NO: 5807632 - DNA, 17 bp, Homo sapiens
tgttcccagctcagtgc

SEQ ID NO: 5807633 - DNA, 19 bp, Homo sapiens
tgttcccagctcagtgcca

SEQ ID NO: 5807634 - DNA, 22 bp, Homo sapiens
tgttcccagctcagtgccaaag

SEQ ID NO: 5807635 - DNA, 15 bp, Homo sapiens
tgttcccaggctgcc

SEQ ID NO: 5807636 - DNA, 17 bp, Homo sapiens
tgttcccatttcagctg

SEQ ID NO: 5807637 - DNA, 16 bp, Homo sapiens
tgttccccaagcgcct

SEQ ID NO: 5807638 - DNA, 23 bp, Homo sapiens
tgttccccacaggtcctccatca

SEQ ID NO: 5807639 - DNA, 15 bp, Homo sapiens
tgttccccacccagt

SEQ ID NO: 5807640 - DNA, 13 bp, Homo sapiens
tgttccccaccgc

SEQ ID NO: 5807641 - DNA, 16 bp, Homo sapiens
tgttccccactggagc

SEQ ID NO: 5807642 - DNA, 14 bp, Homo sapiens
tgttccccagctga

SEQ ID NO: 5807643 - DNA, 15 bp, Homo sapiens
tgttccccagctgat

SEQ ID NO: 5807644 - DNA, 18 bp, Homo sapiens
tgttccccagttcagtgt

SEQ ID NO: 5807645 - DNA, 13 bp, Homo sapiens
tgttccccatctg

SEQ ID NO: 5807646 - DNA, 20 bp, Homo sapiens
tgttccccccatagagacca

SEQ ID NO: 5807647 - DNA, 21 bp, Homo sapiens
tgttcccccgccgcttttctc

SEQ ID NO: 5807648 - DNA, 21 bp, Homo sapiens
tgttcccccgctggcagccac

SEQ ID NO: 5807649 - DNA, 15 bp, Homo sapiens
tgttccccctgtgca

SEQ ID NO: 5807650 - DNA, 13 bp, Homo sapiens
tgttcccctcctc

SEQ ID NO: 5807651 - DNA, 19 bp, Homo sapiens
tgttcccctcctccactct

SEQ ID NO: 5807652 - DNA, 15 bp, Homo sapiens
tgttcccctcttgtc

SEQ ID NO: 5807653 - DNA, 19 bp, Homo sapiens
tgttcccctcttgtctccc

SEQ ID NO: 5807654 - DNA, 20 bp, Homo sapiens
tgttcccctgtcctgtgaat

SEQ ID NO: 5807655 - DNA, 21 bp, Homo sapiens
tgttcccctgtcctgtgaatg

SEQ ID NO: 5807656 - DNA, 20 bp, Homo sapiens
tgttccccttccactgaggg

SEQ ID NO: 5807657 - DNA, 23 bp, Homo sapiens
tgttccccttccactgagggcag

SEQ ID NO: 5807658 - DNA, 20 bp, Homo sapiens
tgttcccgatggtctctctc

SEQ ID NO: 5807659 - DNA, 22 bp, Homo sapiens
tgttcccgatggtctctctccc

SEQ ID NO: 5807660 - DNA, 11 bp, Homo sapiens
tgttgaagagc

SEQ ID NO: 5807661 - DNA, 19 bp, Homo sapiens
tgttgaagaggttttaaag

SEQ ID NO: 5807662 - DNA, 13 bp, Homo sapiens
tgttgaagtcacc

SEQ ID NO: 5807663 - DNA, 18 bp, Homo sapiens
tgttgaagtgcatgttaa

SEQ ID NO: 5807664 - DNA, 20 bp, Homo sapiens
tgttgaagtgcatgttaaaa

SEQ ID NO: 5807665 - DNA, 17 bp, Homo sapiens
tgttgaataaatgtatc

SEQ ID NO: 5807666 - DNA, 22 bp, Homo sapiens
tgttgaatgcccacaggcaaat

SEQ ID NO: 5807667 - DNA, 13 bp, Homo sapiens
tgttgaatgtttg

SEQ ID NO: 5807668 - DNA, 15 bp, Homo sapiens
tgttgaattcttttg

SEQ ID NO: 5807669 - DNA, 17 bp, Homo sapiens
tgttgaattggtgaata

SEQ ID NO: 5807670 - DNA, 22 bp, Homo sapiens
tgttgacaaaattttctcattt

SEQ ID NO: 5807671 - DNA, 15 bp, Homo sapiens
tgttgacaactgtga

SEQ ID NO: 5807672 - DNA, 14 bp, Homo sapiens
tgttgacactgttt

SEQ ID NO: 5807673 - DNA, 12 bp, Homo sapiens
tgttgacataca

SEQ ID NO: 5807674 - DNA, 17 bp, Homo sapiens
tgttgacatagcctttg

SEQ ID NO: 5807675 - DNA, 21 bp, Homo sapiens
tgttgacatatttaatgtttt

SEQ ID NO: 5807676 - DNA, 20 bp, Homo sapiens
tgttgacatcactggcatgg

SEQ ID NO: 5807677 - DNA, 22 bp, Homo sapiens
tgttgacattaagaatgttggt

SEQ ID NO: 5807678 - DNA, 22 bp, Homo sapiens
tgttgaccaggcacctcccctc

SEQ ID NO: 5807679 - DNA, 19 bp, Homo sapiens
tgttgaccaggctggtctc

SEQ ID NO: 5807680 - DNA, 23 bp, Homo sapiens
tgttgaccattccaaagttctta

SEQ ID NO: 5807681 - DNA, 14 bp, Homo sapiens
tgttgaccggctgc

SEQ ID NO: 5807682 - DNA, 14 bp, Homo sapiens
tgttgacctaccct

SEQ ID NO: 5807683 - DNA, 15 bp, Homo sapiens
tgttgacctaccctg

SEQ ID NO: 5807684 - DNA, 18 bp, Homo sapiens
tgttgacgaagtctcttt

SEQ ID NO: 5807685 - DNA, 22 bp, Homo sapiens
tgttgactctagtactgtgaat

SEQ ID NO: 5807686 - DNA, 22 bp, Homo sapiens
tgttgactgctgctccccaccc

SEQ ID NO: 5807687 - DNA, 20 bp, Homo sapiens
tgttgagaaagaatgagcat

SEQ ID NO: 5807688 - DNA, 22 bp, Homo sapiens
tgttgagaatcccaaatttgat

SEQ ID NO: 5807689 - DNA, 20 bp, Homo sapiens
tgttgagcatcacagaatgt

SEQ ID NO: 5807690 - DNA, 21 bp, Homo sapiens
tgttgagccatgctacagtta

SEQ ID NO: 5807691 - DNA, 17 bp, Homo sapiens
tgttgagccccagtgct

SEQ ID NO: 5807692 - DNA, 17 bp, Homo sapiens
tgttgaggaggggagca

SEQ ID NO: 5807693 - DNA, 18 bp, Homo sapiens
tgttgaggcatcaaaaaa

SEQ ID NO: 5807694 - DNA, 23 bp, Homo sapiens
tgttgaggcgagcagggcaggcc

SEQ ID NO: 5807695 - DNA, 21 bp, Homo sapiens
tgttgagggcatttggcttcc

SEQ ID NO: 5807696 - DNA, 18 bp, Homo sapiens
tgttgagggccacttttt

SEQ ID NO: 5807697 - DNA, 19 bp, Homo sapiens
tgttgaggtggtctgaatg

SEQ ID NO: 5807698 - DNA, 21 bp, Homo sapiens
tgttgaggtggtctgaatgtt

SEQ ID NO: 5807699 - DNA, 14 bp, Homo sapiens
tgttgagtaaaaca

SEQ ID NO: 5807700 - DNA, 16 bp, Homo sapiens
tgttgagtatttgctg

SEQ ID NO: 5807701 - DNA, 19 bp, Homo sapiens
tgttgagtatttgctgttt

SEQ ID NO: 5807702 - DNA, 17 bp, Homo sapiens
tgttgagtctctgaaca

SEQ ID NO: 5807703 - DNA, 18 bp, Homo sapiens
tgttgagtctctgaacat

SEQ ID NO: 5807704 - DNA, 13 bp, Homo sapiens
tgttgagtgctta

SEQ ID NO: 5807705 - DNA, 18 bp, Homo sapiens
tgttgagtgttcatttta

SEQ ID NO: 5807706 - DNA, 16 bp, Homo sapiens
tgttgagttatgataa

SEQ ID NO: 5807707 - DNA, 18 bp, Homo sapiens
tgttgagttctgattgtg

SEQ ID NO: 5807708 - DNA, 15 bp, Homo sapiens
tgttgataattctta

SEQ ID NO: 5807709 - DNA, 23 bp, Homo sapiens
tgttgatacaaaccactgtgaac

SEQ ID NO: 5807710 - DNA, 17 bp, Homo sapiens
tgttgatacgtgtgtga

SEQ ID NO: 5807711 - DNA, 15 bp, Homo sapiens
tgttgatactgttgc

SEQ ID NO: 5807712 - DNA, 18 bp, Homo sapiens
tgttgatagtgatgtatt

SEQ ID NO: 5807713 - DNA, 19 bp, Homo sapiens
tgttgatattgtttgctgt

SEQ ID NO: 5807714 - DNA, 15 bp, Homo sapiens
tgttgatcaaccatt

SEQ ID NO: 5807715 - DNA, 13 bp, Homo sapiens
tgttgatcagcaa

SEQ ID NO: 5807716 - DNA, 20 bp, Homo sapiens
tgttgatcagccttatgtgg

SEQ ID NO: 5807717 - DNA, 23 bp, Homo sapiens
tgttgatcatgtactttttagta

SEQ ID NO: 5807718 - DNA, 20 bp, Homo sapiens
tgttgatccatccagcttgc

SEQ ID NO: 5807719 - DNA, 13 bp, Homo sapiens
tgttgatcccagt

SEQ ID NO: 5807720 - DNA, 22 bp, Homo sapiens
tgttgatcgatgttaaacgtca

SEQ ID NO: 5807721 - DNA, 19 bp, Homo sapiens
tgttgatctttcactatac

SEQ ID NO: 5807722 - DNA, 21 bp, Homo sapiens
tgttgatgactcgaaactgac

SEQ ID NO: 5807723 - DNA, 21 bp, Homo sapiens
tgttgatgctccgccaggaag

SEQ ID NO: 5807724 - DNA, 16 bp, Homo sapiens
tgttgatgctgtattc

SEQ ID NO: 5807725 - DNA, 20 bp, Homo sapiens
tgttgattaatttctgccat

SEQ ID NO: 5807726 - DNA, 22 bp, Homo sapiens
tgttgattatcttcagcccagg

SEQ ID NO: 5807727 - DNA, 24 bp, Homo sapiens
tgttgattctagatgatcaacata

SEQ ID NO: 5807728 - DNA, 15 bp, Homo sapiens
tgttgattctttcaa

SEQ ID NO: 5807729 - DNA, 21 bp, Homo sapiens
tgttgattctttcaatccaca

SEQ ID NO: 5807730 - DNA, 14 bp, Homo sapiens
tgttgattgctaaa

SEQ ID NO: 5807731 - DNA, 15 bp, Homo sapiens
tgttgattgctaaat

SEQ ID NO: 5807732 - DNA, 17 bp, Homo sapiens
tgttgattgctaaatgt

SEQ ID NO: 5807733 - DNA, 18 bp, Homo sapiens
tgttgattgctaaatgta

SEQ ID NO: 5807734 - DNA, 12 bp, Homo sapiens
tgttgattgtta

SEQ ID NO: 5807735 - DNA, 11 bp, Homo sapiens
tgttgatttct

SEQ ID NO: 5807736 - DNA, 21 bp, Homo sapiens
tgttgattttctagacttcag

SEQ ID NO: 5807737 - DNA, 22 bp, Homo sapiens
tgttgatttttactgtgtttta

SEQ ID NO: 5807738 - DNA, 11 bp, Homo sapiens
tgttgcaaagg

SEQ ID NO: 5807739 - DNA, 18 bp, Homo sapiens
tgttgcaaattattctag

SEQ ID NO: 5807740 - DNA, 18 bp, Homo sapiens
tgttgcaagatgtgaatt

SEQ ID NO: 5807741 - DNA, 15 bp, Homo sapiens
tgttgcaattaggat

SEQ ID NO: 5807742 - DNA, 20 bp, Homo sapiens
tgttgcaattaggattttga

SEQ ID NO: 5807743 - DNA, 21 bp, Homo sapiens
tgttgcacacccactcagctc

SEQ ID NO: 5807744 - DNA, 19 bp, Homo sapiens
tgttgcacatcattcattc

SEQ ID NO: 5807745 - DNA, 17 bp, Homo sapiens
tgttgcaccatctgctt

SEQ ID NO: 5807746 - DNA, 16 bp, Homo sapiens
tgttgcacccagccct

SEQ ID NO: 5807747 - DNA, 18 bp, Homo sapiens
tgttgcacccagccctgg

SEQ ID NO: 5807748 - DNA, 14 bp, Homo sapiens
tgttgcacgtgtgt

SEQ ID NO: 5807749 - DNA, 13 bp, Homo sapiens
tgttgcactaaaa

SEQ ID NO: 5807750 - DNA, 20 bp, Homo sapiens
tgttgcactaaaatgaggat

SEQ ID NO: 5807751 - DNA, 17 bp, Homo sapiens
tgttgcactgaaatgga

SEQ ID NO: 5807752 - DNA, 16 bp, Homo sapiens
tgttgcactgtttgca

SEQ ID NO: 5807753 - DNA, 23 bp, Homo sapiens
tgttgcactgtttgcatgcgccc

SEQ ID NO: 5807754 - DNA, 11 bp, Homo sapiens
tgttgcacttt

SEQ ID NO: 5807755 - DNA, 21 bp, Homo sapiens
tgttgcagagacgcaagggag

SEQ ID NO: 5807756 - DNA, 13 bp, Homo sapiens
tgttgcagatgaa

SEQ ID NO: 5807757 - DNA, 22 bp, Homo sapiens
tgttgcagatgaaatgttctgt

SEQ ID NO: 5807758 - DNA, 20 bp, Homo sapiens
tgttgcagccgcagagaaat

SEQ ID NO: 5807759 - DNA, 15 bp, Homo sapiens
tgttgcagctgtcac

SEQ ID NO: 5807760 - DNA, 18 bp, Homo sapiens
tgttgcagggaagtctta

SEQ ID NO: 5807761 - DNA, 19 bp, Homo sapiens
tgttgcagttaattcttgc

SEQ ID NO: 5807762 - DNA, 15 bp, Homo sapiens
tgttgcatagaataa

SEQ ID NO: 5807763 - DNA, 20 bp, Homo sapiens
tgttgcatatagttaaactg

SEQ ID NO: 5807764 - DNA, 22 bp, Homo sapiens
tgttgcatatagttaaactgag

SEQ ID NO: 5807765 - DNA, 23 bp, Homo sapiens
tgttgcatgaatccatcgatttg

SEQ ID NO: 5807766 - DNA, 15 bp, Homo sapiens
tgttgcatgtttgaa

SEQ ID NO: 5807767 - DNA, 20 bp, Homo sapiens
tgttgcattacgataaacat

SEQ ID NO: 5807768 - DNA, 16 bp, Homo sapiens
tgttgcattattcatt

SEQ ID NO: 5807769 - DNA, 11 bp, Homo sapiens
tgttgcattcc

SEQ ID NO: 5807770 - DNA, 16 bp, Homo sapiens
tgttgcatttccagct

SEQ ID NO: 5807771 - DNA, 22 bp, Homo sapiens
tgttgcatttccagctgtgcag

SEQ ID NO: 5807772 - DNA, 21 bp, Homo sapiens
tgttgccaaaatggtggcctg

SEQ ID NO: 5807773 - DNA, 22 bp, Homo sapiens
tgttgccaaatatgtcctgggg

SEQ ID NO: 5807774 - DNA, 16 bp, Homo sapiens
tgttgccacaggacac

SEQ ID NO: 5807775 - DNA, 16 bp, Homo sapiens
tgttgccactttccaa

SEQ ID NO: 5807776 - DNA, 12 bp, Homo sapiens
tgttgccagaga

SEQ ID NO: 5807777 - DNA, 23 bp, Homo sapiens
tgttgccaggttgcagctgctct

SEQ ID NO: 5807778 - DNA, 17 bp, Homo sapiens
tgttgccagttgtcctc

SEQ ID NO: 5807779 - DNA, 18 bp, Homo sapiens
tgttgccagttgtcctcc

SEQ ID NO: 5807780 - DNA, 14 bp, Homo sapiens
tgttgccatagccc

SEQ ID NO: 5807781 - DNA, 20 bp, Homo sapiens
tgttgccatgaggcctttcc

SEQ ID NO: 5807782 - DNA, 21 bp, Homo sapiens
tgttgccatgaggcctttccc

SEQ ID NO: 5807783 - DNA, 17 bp, Homo sapiens
tgttgccatttctctgc

SEQ ID NO: 5807784 - DNA, 18 bp, Homo sapiens
tgttgccattttgtctgg

SEQ ID NO: 5807785 - DNA, 13 bp, Homo sapiens
tgttgcccaggca

SEQ ID NO: 5807786 - DNA, 18 bp, Homo sapiens
tgttgcccaggcaggtct

SEQ ID NO: 5807787 - DNA, 19 bp, Homo sapiens
tgttgcccaggctgctctt

SEQ ID NO: 5807788 - DNA, 21 bp, Homo sapiens
tgttgcccaggctggagtgca

SEQ ID NO: 5807789 - DNA, 19 bp, Homo sapiens
tgttgcccaggctggcctg

SEQ ID NO: 5807790 - DNA, 20 bp, Homo sapiens
tgttgcccctttctcttttc

SEQ ID NO: 5807791 - DNA, 16 bp, Homo sapiens
tgttgcccgccctcca

SEQ ID NO: 5807792 - DNA, 13 bp, Homo sapiens
tgttgccctgagt

SEQ ID NO: 5807793 - DNA, 19 bp, Homo sapiens
tgttgccctgtttcctgct

SEQ ID NO: 5807794 - DNA, 14 bp, Homo sapiens
tgttgcccttctgt

SEQ ID NO: 5807795 - DNA, 22 bp, Homo sapiens
tgttgcctaagtattaaaacat

SEQ ID NO: 5807796 - DNA, 22 bp, Homo sapiens
tgttgcctataagccaaaatta

SEQ ID NO: 5807797 - DNA, 23 bp, Homo sapiens
tgttgcctataagccaaaattaa

SEQ ID NO: 5807798 - DNA, 14 bp, Homo sapiens
tgttgcctcctctc

SEQ ID NO: 5807799 - DNA, 19 bp, Homo sapiens
tgttgcctcctctctccct

SEQ ID NO: 5807800 - DNA, 20 bp, Homo sapiens
tgttgcctcctctctccctg

SEQ ID NO: 5807801 - DNA, 23 bp, Homo sapiens
tgttgcctcctctctccctgcct

SEQ ID NO: 5807802 - DNA, 18 bp, Homo sapiens
tgttgcctcttgcaatgc

SEQ ID NO: 5807803 - DNA, 15 bp, Homo sapiens
tgttgccttagcact

SEQ ID NO: 5807804 - DNA, 19 bp, Homo sapiens
tgttgccttagcacttctt

SEQ ID NO: 5807805 - DNA, 20 bp, Homo sapiens
tgttgccttgaaccacttcc

SEQ ID NO: 5807806 - DNA, 16 bp, Homo sapiens
tgttgccttggaaaca

SEQ ID NO: 5807807 - DNA, 22 bp, Homo sapiens
tgttgcctttttcattttccaa

SEQ ID NO: 5807808 - DNA, 16 bp, Homo sapiens
tgttgcgttcaaagag

SEQ ID NO: 5807809 - DNA, 14 bp, Homo sapiens
tgttgcgttccttt

SEQ ID NO: 5807810 - DNA, 15 bp, Homo sapiens
tgttgcgtttttcct

SEQ ID NO: 5807811 - DNA, 16 bp, Homo sapiens
tgttgctaaaaaaagt

SEQ ID NO: 5807812 - DNA, 23 bp, Homo sapiens
tgttgctaaaaaaagtgcatgat

SEQ ID NO: 5807813 - DNA, 21 bp, Homo sapiens
tgttgctaagccccagcaagc

SEQ ID NO: 5807814 - DNA, 15 bp, Homo sapiens
tgttgctacatcaga

SEQ ID NO: 5807815 - DNA, 21 bp, Homo sapiens
tgttgctacatcagagtgtat

SEQ ID NO: 5807816 - DNA, 20 bp, Homo sapiens
tgttgctagggagagggaag

SEQ ID NO: 5807817 - DNA, 21 bp, Homo sapiens
tgttgctagttttttgcttct

SEQ ID NO: 5807818 - DNA, 20 bp, Homo sapiens
tgttgctatacatgttggaa

SEQ ID NO: 5807819 - DNA, 16 bp, Homo sapiens
tgttgctatagtgaca

SEQ ID NO: 5807820 - DNA, 17 bp, Homo sapiens
tgttgctatgtgcctta

SEQ ID NO: 5807821 - DNA, 14 bp, Homo sapiens
tgttgctcagaagt

SEQ ID NO: 5807822 - DNA, 14 bp, Homo sapiens
tgttgctcagtctc

SEQ ID NO: 5807823 - DNA, 23 bp, Homo sapiens
tgttgctcagtgtttttgtgaat

SEQ ID NO: 5807824 - DNA, 15 bp, Homo sapiens
tgttgctctccattc

SEQ ID NO: 5807825 - DNA, 15 bp, Homo sapiens
tgttgctctttcacc

SEQ ID NO: 5807826 - DNA, 14 bp, Homo sapiens
tgttgctgaaacac

SEQ ID NO: 5807827 - DNA, 16 bp, Homo sapiens
tgttgctgattttatt

SEQ ID NO: 5807828 - DNA, 12 bp, Homo sapiens
tgttgctgctgc

SEQ ID NO: 5807829 - DNA, 15 bp, Homo sapiens
tgttgctgctgctgc

SEQ ID NO: 5807830 - DNA, 21 bp, Homo sapiens
tgttgctggaggggctgtcct

SEQ ID NO: 5807831 - DNA, 13 bp, Homo sapiens
tgttgctgtcaag

SEQ ID NO: 5807832 - DNA, 14 bp, Homo sapiens
tgttgctgtggctc

SEQ ID NO: 5807833 - DNA, 14 bp, Homo sapiens
tgttgctgttcaca

SEQ ID NO: 5807834 - DNA, 15 bp, Homo sapiens
tgttgctgttgctgt

SEQ ID NO: 5807835 - DNA, 18 bp, Homo sapiens
tgttgctgttgttcagaa

SEQ ID NO: 5807836 - DNA, 19 bp, Homo sapiens
tgtttactcattgccccca

SEQ ID NO: 5807837 - DNA, 20 bp, Homo sapiens
tgtttactctcttcatccgt

SEQ ID NO: 5807838 - DNA, 23 bp, Homo sapiens
tgtttactgacatggtgctgtgt

SEQ ID NO: 5807839 - DNA, 16 bp, Homo sapiens
tgtttactgattagag

SEQ ID NO: 5807840 - DNA, 17 bp, Homo sapiens
tgtttactgtatcaatt

SEQ ID NO: 5807841 - DNA, 15 bp, Homo sapiens
tgtttacttaaagat

SEQ ID NO: 5807842 - DNA, 19 bp, Homo sapiens
tgtttacttaaagatttat

SEQ ID NO: 5807843 - DNA, 22 bp, Homo sapiens
tgtttacttgaatagtattgtg

SEQ ID NO: 5807844 - DNA, 13 bp, Homo sapiens
tgtttactttaaa

SEQ ID NO: 5807845 - DNA, 14 bp, Homo sapiens
tgtttactttaaat

SEQ ID NO: 5807846 - DNA, 20 bp, Homo sapiens
tgtttactttatccaatcct

SEQ ID NO: 5807847 - DNA, 13 bp, Homo sapiens
tgtttagaaacag

SEQ ID NO: 5807848 - DNA, 16 bp, Homo sapiens
tgtttagaaacagaaa

SEQ ID NO: 5807849 - DNA, 18 bp, Homo sapiens
tgtttagaagagcctgac

SEQ ID NO: 5807850 - DNA, 14 bp, Homo sapiens
tgtttagaagccta

SEQ ID NO: 5807851 - DNA, 15 bp, Homo sapiens
tgtttagaagcctaa

SEQ ID NO: 5807852 - DNA, 23 bp, Homo sapiens
tgtttagaagcctaattgtcaca

SEQ ID NO: 5807853 - DNA, 23 bp, Homo sapiens
tgtttagaattgaaggtttttga

SEQ ID NO: 5807854 - DNA, 17 bp, Homo sapiens
tgtttagagagcctgtc

SEQ ID NO: 5807855 - DNA, 19 bp, Homo sapiens
tgtttagagagcctgtcac

SEQ ID NO: 5807856 - DNA, 21 bp, Homo sapiens
tgtttagagtaaataaactgt

SEQ ID NO: 5807857 - DNA, 22 bp, Homo sapiens
tgtttagagtaaataaactgtt

SEQ ID NO: 5807858 - DNA, 23 bp, Homo sapiens
tgtttagagtaaataaactgttt

SEQ ID NO: 5807859 - DNA, 16 bp, Homo sapiens
tgtttagataatacac

SEQ ID NO: 5807860 - DNA, 20 bp, Homo sapiens
tgtttagataatacaccact

SEQ ID NO: 5807861 - DNA, 15 bp, Homo sapiens
tgtttagatgaatgt

SEQ ID NO: 5807862 - DNA, 20 bp, Homo sapiens
tgtttagatgaatgtcagtt

SEQ ID NO: 5807863 - DNA, 15 bp, Homo sapiens
tgtttagattccagg

SEQ ID NO: 5807864 - DNA, 14 bp, Homo sapiens
tgtttagattgtat

SEQ ID NO: 5807865 - DNA, 16 bp, Homo sapiens
tgtttagcaaatacat

SEQ ID NO: 5807866 - DNA, 16 bp, Homo sapiens
tgtttagcaatgtgtt

SEQ ID NO: 5807867 - DNA, 17 bp, Homo sapiens
tgtttagcagcagcctt

SEQ ID NO: 5807868 - DNA, 16 bp, Homo sapiens
tgtttagcagtggctg

SEQ ID NO: 5807869 - DNA, 13 bp, Homo sapiens
tgtttagcattaa

SEQ ID NO: 5807870 - DNA, 17 bp, Homo sapiens
tgtttagcgaacttgta

SEQ ID NO: 5807871 - DNA, 22 bp, Homo sapiens
tgtttagctacgtttactcaca

SEQ ID NO: 5807872 - DNA, 22 bp, Homo sapiens
tgtttaggcctcatttctttgt

SEQ ID NO: 5807873 - DNA, 23 bp, Homo sapiens
tgtttagtaaatacatcactgta

SEQ ID NO: 5807874 - DNA, 14 bp, Homo sapiens
tgtttagtaataca

SEQ ID NO: 5807875 - DNA, 15 bp, Homo sapiens
tgtttagtagctgat

SEQ ID NO: 5807876 - DNA, 22 bp, Homo sapiens
tgtttagtagctgataaagaaa

SEQ ID NO: 5807877 - DNA, 21 bp, Homo sapiens
tgtttagtattctcttgtgca

SEQ ID NO: 5807878 - DNA, 19 bp, Homo sapiens
tgtttagtcagtgtactct

SEQ ID NO: 5807879 - DNA, 22 bp, Homo sapiens
tgtttagtcagtgtactctgag

SEQ ID NO: 5807880 - DNA, 13 bp, Homo sapiens
tgtttagtcttgt

SEQ ID NO: 5807881 - DNA, 17 bp, Homo sapiens
tgtttagtcttgtctca

SEQ ID NO: 5807882 - DNA, 19 bp, Homo sapiens
tgtttagtcttgtctcaga

SEQ ID NO: 5807883 - DNA, 22 bp, Homo sapiens
tgtttagtcttgtctcagattt

SEQ ID NO: 5807884 - DNA, 19 bp, Homo sapiens
tgtttagtgtgctgctgtt

SEQ ID NO: 5807885 - DNA, 14 bp, Homo sapiens
tgtttagttttaca

SEQ ID NO: 5807886 - DNA, 20 bp, Homo sapiens
tgtttataaaacaatgactt

SEQ ID NO: 5807887 - DNA, 22 bp, Homo sapiens
tgtttataaaatataaacaaag

SEQ ID NO: 5807888 - DNA, 18 bp, Homo sapiens
tgtttataatctgaagat

SEQ ID NO: 5807889 - DNA, 19 bp, Homo sapiens
tgtttataatctgaagata

SEQ ID NO: 5807890 - DNA, 17 bp, Homo sapiens
tgtttataatgtcaaat

SEQ ID NO: 5807891 - DNA, 21 bp, Homo sapiens
tgtttataatgtcaaatgaaa

SEQ ID NO: 5807892 - DNA, 15 bp, Homo sapiens
tgtttataatgttat

SEQ ID NO: 5807893 - DNA, 14 bp, Homo sapiens
tgtttataattgtt

SEQ ID NO: 5807894 - DNA, 15 bp, Homo sapiens
tgtttatacagagta

SEQ ID NO: 5807895 - DNA, 15 bp, Homo sapiens
tgtttatacagctca

SEQ ID NO: 5807896 - DNA, 14 bp, Homo sapiens
tgtttatactgtat

SEQ ID NO: 5807897 - DNA, 14 bp, Homo sapiens
tgtttatagcaaaa

SEQ ID NO: 5807898 - DNA, 21 bp, Homo sapiens
tgtttatagcaaacttggaat

SEQ ID NO: 5807899 - DNA, 13 bp, Homo sapiens
tgtttatagcatt

SEQ ID NO: 5807900 - DNA, 19 bp, Homo sapiens
tgtttatagctcatttgta

SEQ ID NO: 5807901 - DNA, 12 bp, Homo sapiens
tgtttatataaa

SEQ ID NO: 5807902 - DNA, 14 bp, Homo sapiens
tgtttatataaatg

SEQ ID NO: 5807903 - DNA, 21 bp, Homo sapiens
tgtttatataattttgcagca

SEQ ID NO: 5807904 - DNA, 16 bp, Homo sapiens
tgtttatatattgaaa

SEQ ID NO: 5807905 - DNA, 19 bp, Homo sapiens
tgtttatatggcgttttgt

SEQ ID NO: 5807906 - DNA, 15 bp, Homo sapiens
tgtttatatgtcttg

SEQ ID NO: 5807907 - DNA, 18 bp, Homo sapiens
tgtttatatgtcttgcaa

SEQ ID NO: 5807908 - DNA, 14 bp, Homo sapiens
tgtttatatgtgtt

SEQ ID NO: 5807909 - DNA, 19 bp, Homo sapiens
tgtttatcaaagagcactt

SEQ ID NO: 5807910 - DNA, 21 bp, Homo sapiens
tgtttatcaaagagcacttga

SEQ ID NO: 5807911 - DNA, 20 bp, Homo sapiens
tgtttatcacctttattgaa

SEQ ID NO: 5807912 - DNA, 14 bp, Homo sapiens
tgtttatcagcagt

SEQ ID NO: 5807913 - DNA, 19 bp, Homo sapiens
tgtttatcagcagttgtta

SEQ ID NO: 5807914 - DNA, 17 bp, Homo sapiens
tgtttatcccttaagaa

SEQ ID NO: 5807915 - DNA, 16 bp, Homo sapiens
tgtttatctagatgta

SEQ ID NO: 5807916 - DNA, 20 bp, Homo sapiens
tgtttatctagatgtaaatt

SEQ ID NO: 5807917 - DNA, 12 bp, Homo sapiens
tgtttatgaaaa

SEQ ID NO: 5807918 - DNA, 13 bp, Homo sapiens
tgtttatgaaaat

SEQ ID NO: 5807919 - DNA, 14 bp, Homo sapiens
tgtttatgaagaaa

SEQ ID NO: 5807920 - DNA, 20 bp, Homo sapiens
tgtttatgaagaaagatact

SEQ ID NO: 5807921 - DNA, 21 bp, Homo sapiens
tgtttatgatctatttgtaga

SEQ ID NO: 5807922 - DNA, 22 bp, Homo sapiens
tgtttatggaaatattaagaac

SEQ ID NO: 5807923 - DNA, 17 bp, Homo sapiens
tgtttatggccacattt

SEQ ID NO: 5807924 - DNA, 14 bp, Homo sapiens
tgtttatggcctca

SEQ ID NO: 5807925 - DNA, 13 bp, Homo sapiens
tgtttatggtaaa

SEQ ID NO: 5807926 - DNA, 22 bp, Homo sapiens
tgtttatggtagtagtttttct

SEQ ID NO: 5807927 - DNA, 15 bp, Homo sapiens
tgtttatgtaaacaa

SEQ ID NO: 5807928 - DNA, 20 bp, Homo sapiens
tgtttatgtaaacaaatctt

SEQ ID NO: 5807929 - DNA, 14 bp, Homo sapiens
tgtttatgtaattt

SEQ ID NO: 5807930 - DNA, 23 bp, Homo sapiens
tgtttatgtactgtaaacagttc

SEQ ID NO: 5807931 - DNA, 20 bp, Homo sapiens
tgtttatgtaggtacttcac

SEQ ID NO: 5807932 - DNA, 16 bp, Homo sapiens
tgtttatgtgaacatt

SEQ ID NO: 5807933 - DNA, 19 bp, Homo sapiens
tgtttatgtgaacattcct

SEQ ID NO: 5807934 - DNA, 17 bp, Homo sapiens
tgtttatgtgctattaa

SEQ ID NO: 5807935 - DNA, 13 bp, Homo sapiens
tgtttatgtgtgt

SEQ ID NO: 5807936 - DNA, 12 bp, Homo sapiens
tgtttatgttaa

SEQ ID NO: 5807937 - DNA, 19 bp, Homo sapiens
tgtttattaaaatactgtt

SEQ ID NO: 5807938 - DNA, 14 bp, Homo sapiens
tgtttattaacaaa

SEQ ID NO: 5807939 - DNA, 19 bp, Homo sapiens
tgtttattaacaaattatg

SEQ ID NO: 5807940 - DNA, 21 bp, Homo sapiens
tgtttattaatagaatgataa

SEQ ID NO: 5807941 - DNA, 14 bp, Homo sapiens
tgtttattaatctt

SEQ ID NO: 5807942 - DNA, 14 bp, Homo sapiens
tgtttattacagta

SEQ ID NO: 5807943 - DNA, 17 bp, Homo sapiens
tgtttattataaagctt

SEQ ID NO: 5807944 - DNA, 14 bp, Homo sapiens
tgtttattatacca

SEQ ID NO: 5807945 - DNA, 13 bp, Homo sapiens
tgtttattattta

SEQ ID NO: 5807946 - DNA, 16 bp, Homo sapiens
tgtttattatttacat

SEQ ID NO: 5807947 - DNA, 13 bp, Homo sapiens
tgtttattcaaaa

SEQ ID NO: 5807948 - DNA, 14 bp, Homo sapiens
tgtttattcaaaat

SEQ ID NO: 5807949 - DNA, 23 bp, Homo sapiens
tgtttattcaaaatattttatct

SEQ ID NO: 5807950 - DNA, 16 bp, Homo sapiens
tgtttattcaaactga

SEQ ID NO: 5807951 - DNA, 14 bp, Homo sapiens
tgtttattccaaag

SEQ ID NO: 5807952 - DNA, 16 bp, Homo sapiens
tgtttattcttctaga

SEQ ID NO: 5807953 - DNA, 22 bp, Homo sapiens
tgtttattgacaggtcttttca

SEQ ID NO: 5807954 - DNA, 13 bp, Homo sapiens
tgtttattgagct

SEQ ID NO: 5807955 - DNA, 19 bp, Homo sapiens
tgtttattgtcaaagtggt

SEQ ID NO: 5807956 - DNA, 14 bp, Homo sapiens
tgtttattgttttt

SEQ ID NO: 5807957 - DNA, 17 bp, Homo sapiens
tgtttatttaaggatgg

SEQ ID NO: 5807958 - DNA, 14 bp, Homo sapiens
tgtttatttacaag

SEQ ID NO: 5807959 - DNA, 17 bp, Homo sapiens
tgtttatttagaaactg

SEQ ID NO: 5807960 - DNA, 14 bp, Homo sapiens
tgtttatttataga

SEQ ID NO: 5807961 - DNA, 13 bp, Homo sapiens
tgtttatttcagg

SEQ ID NO: 5807962 - DNA, 15 bp, Homo sapiens
tgtttatttcatgtg

SEQ ID NO: 5807963 - DNA, 17 bp, Homo sapiens
tgtttatttctgtttct

SEQ ID NO: 5807964 - DNA, 14 bp, Homo sapiens
tgtttatttgcaat

SEQ ID NO: 5807965 - DNA, 19 bp, Homo sapiens
tgtttatttgcaatttgag

SEQ ID NO: 5807966 - DNA, 13 bp, Homo sapiens
tgtttattttaga

SEQ ID NO: 5807967 - DNA, 20 bp, Homo sapiens
tgtttattttctacgtttct

SEQ ID NO: 5807968 - DNA, 22 bp, Homo sapiens
tgtttatttttatatagcttga

SEQ ID NO: 5807969 - DNA, 23 bp, Homo sapiens
tgtttatttttatatagcttgaa

SEQ ID NO: 5807970 - DNA, 14 bp, Homo sapiens
tgtttatttttcat

SEQ ID NO: 5807971 - DNA, 23 bp, Homo sapiens
tgtttatttttcttgtctttatt

SEQ ID NO: 5807972 - DNA, 21 bp, Homo sapiens
tgtttattttttattattttt

SEQ ID NO: 5807973 - DNA, 22 bp, Homo sapiens
tgtttcaaaaataaaagaacac

SEQ ID NO: 5807974 - DNA, 23 bp, Homo sapiens
tgtttcaaaataagtatttctga

SEQ ID NO: 5807975 - DNA, 21 bp, Homo sapiens
tgtttcaaaatagacaagttt

SEQ ID NO: 5807976 - DNA, 19 bp, Homo sapiens
tgtttcaaacatatataac

SEQ ID NO: 5807977 - DNA, 22 bp, Homo sapiens
tgtttcaaacatatataacaat

SEQ ID NO: 5807978 - DNA, 14 bp, Homo sapiens
tgtttcaaacatgc

SEQ ID NO: 5807979 - DNA, 17 bp, Homo sapiens
tgtttcaaacatgccca

SEQ ID NO: 5807980 - DNA, 15 bp, Homo sapiens
tgtttcaaactgagt

SEQ ID NO: 5807981 - DNA, 15 bp, Homo sapiens
tgtttcaaactgtaa

SEQ ID NO: 5807982 - DNA, 18 bp, Homo sapiens
tgtttcaaatgcagaaac

SEQ ID NO: 5807983 - DNA, 16 bp, Homo sapiens
tgtttcaaatgtgcat

SEQ ID NO: 5807984 - DNA, 14 bp, Homo sapiens
tgtttcaacaattt

SEQ ID NO: 5807985 - DNA, 16 bp, Homo sapiens
tgtttcaactgtataa

SEQ ID NO: 5807986 - DNA, 16 bp, Homo sapiens
tgtttcaagaacctgg

SEQ ID NO: 5807987 - DNA, 12 bp, Homo sapiens
tgtttcaagagg

SEQ ID NO: 5807988 - DNA, 19 bp, Homo sapiens
tgtttcaagaggagccccc

SEQ ID NO: 5807989 - DNA, 22 bp, Homo sapiens
tgtttcaagaggagcccccacc

SEQ ID NO: 5807990 - DNA, 15 bp, Homo sapiens
tgtttcaaggcactc

SEQ ID NO: 5807991 - DNA, 20 bp, Homo sapiens
tgtttcaaggcactctagat

SEQ ID NO: 5807992 - DNA, 21 bp, Homo sapiens
tgtttcaaggcactctagatt

SEQ ID NO: 5807993 - DNA, 22 bp, Homo sapiens
tgtttcaagttcacacctgcag

SEQ ID NO: 5807994 - DNA, 14 bp, Homo sapiens
tgtttcaatcactg

SEQ ID NO: 5807995 - DNA, 15 bp, Homo sapiens
tgtttcaatctctga

SEQ ID NO: 5807996 - DNA, 16 bp, Homo sapiens
tgtttcaattctgtaa

SEQ ID NO: 5807997 - DNA, 19 bp, Homo sapiens
tgtttcacagtgtctgtaa

SEQ ID NO: 5807998 - DNA, 12 bp, Homo sapiens
tgtttcacagtt

SEQ ID NO: 5807999 - DNA, 19 bp, Homo sapiens
tgtttcacagtttgaaata

SEQ ID NO: 5808000 - DNA, 20 bp, Homo sapiens
tgtttcacagtttgaaataa

SEQ ID NO: 5808001 - DNA, 23 bp, Homo sapiens
tgtttcacggggcccttacctgt

SEQ ID NO: 5808002 - DNA, 16 bp, Homo sapiens
tgtttcactatgattt

SEQ ID NO: 5808003 - DNA, 21 bp, Homo sapiens
tgtttcactggaaaggaaaga

SEQ ID NO: 5808004 - DNA, 14 bp, Homo sapiens
tgtttcagaccccc

SEQ ID NO: 5808005 - DNA, 15 bp, Homo sapiens
tgtttcagatttttt

SEQ ID NO: 5808006 - DNA, 19 bp, Homo sapiens
tgtttcagctaagggaaga

SEQ ID NO: 5808007 - DNA, 22 bp, Homo sapiens
tgtttcagctaagggaagacat

SEQ ID NO: 5808008 - DNA, 23 bp, Homo sapiens
tgtttcagctaagggaagacatt

SEQ ID NO: 5808009 - DNA, 16 bp, Homo sapiens
tgtttcagctgcagtt

SEQ ID NO: 5808010 - DNA, 19 bp, Homo sapiens
tgtttcaggacagctgctt

SEQ ID NO: 5808011 - DNA, 17 bp, Homo sapiens
tgtttcagtgtgagtca

SEQ ID NO: 5808012 - DNA, 22 bp, Homo sapiens
tgtttcataacaaaccatctgg

SEQ ID NO: 5808013 - DNA, 16 bp, Homo sapiens
tgttttgttttaatct

SEQ ID NO: 5808014 - DNA, 18 bp, Homo sapiens
tgttttgttttgtagatg

SEQ ID NO: 5808015 - DNA, 15 bp, Homo sapiens
tgttttgtttttaca

SEQ ID NO: 5808016 - DNA, 16 bp, Homo sapiens
tgttttgtttttacaa

SEQ ID NO: 5808017 - DNA, 14 bp, Homo sapiens
tgtttttaaaaacc

SEQ ID NO: 5808018 - DNA, 21 bp, Homo sapiens
tgtttttaaaaagaaaatcag

SEQ ID NO: 5808019 - DNA, 16 bp, Homo sapiens
tgtttttaaactgtac

SEQ ID NO: 5808020 - DNA, 19 bp, Homo sapiens
tgtttttaaactgtacagt

SEQ ID NO: 5808021 - DNA, 13 bp, Homo sapiens
tgtttttaacaga

SEQ ID NO: 5808022 - DNA, 19 bp, Homo sapiens
tgtttttaacatgtcaatc

SEQ ID NO: 5808023 - DNA, 15 bp, Homo sapiens
tgtttttaagaaaaa

SEQ ID NO: 5808024 - DNA, 18 bp, Homo sapiens
tgtttttaagaaaaacat

SEQ ID NO: 5808025 - DNA, 17 bp, Homo sapiens
tgtttttaagctgtttc

SEQ ID NO: 5808026 - DNA, 22 bp, Homo sapiens
tgtttttaagtgctatgcatat

SEQ ID NO: 5808027 - DNA, 17 bp, Homo sapiens
tgtttttaatctcctgt

SEQ ID NO: 5808028 - DNA, 19 bp, Homo sapiens
tgtttttaatgctatttga

SEQ ID NO: 5808029 - DNA, 13 bp, Homo sapiens
tgtttttacatta

SEQ ID NO: 5808030 - DNA, 12 bp, Homo sapiens
tgtttttactga

SEQ ID NO: 5808031 - DNA, 13 bp, Homo sapiens
tgtttttactgta

SEQ ID NO: 5808032 - DNA, 15 bp, Homo sapiens
tgtttttactgtatg

SEQ ID NO: 5808033 - DNA, 17 bp, Homo sapiens
tgtttttagacaccttc

SEQ ID NO: 5808034 - DNA, 23 bp, Homo sapiens
tgtttttagaggggcaaaaatat

SEQ ID NO: 5808035 - DNA, 18 bp, Homo sapiens
tgtttttaggctgttcct

SEQ ID NO: 5808036 - DNA, 13 bp, Homo sapiens
tgtttttataaaa

SEQ ID NO: 5808037 - DNA, 15 bp, Homo sapiens
tgtttttattattaa

SEQ ID NO: 5808038 - DNA, 22 bp, Homo sapiens
tgtttttcagcgttaatgtaaa

SEQ ID NO: 5808039 - DNA, 13 bp, Homo sapiens
tgtttttcagtta

SEQ ID NO: 5808040 - DNA, 14 bp, Homo sapiens
tgtttttcagttca

SEQ ID NO: 5808041 - DNA, 14 bp, Homo sapiens
tgtttttcatgaaa

SEQ ID NO: 5808042 - DNA, 19 bp, Homo sapiens
tgtttttccatgtgttttg

SEQ ID NO: 5808043 - DNA, 18 bp, Homo sapiens
tgtttttccctccccaga

SEQ ID NO: 5808044 - DNA, 16 bp, Homo sapiens
tgtttttccttccaat

SEQ ID NO: 5808045 - DNA, 17 bp, Homo sapiens
tgtttttcgtcattcca

SEQ ID NO: 5808046 - DNA, 12 bp, Homo sapiens
tgtttttctcac

SEQ ID NO: 5808047 - DNA, 16 bp, Homo sapiens
tgtttttcttttagac

SEQ ID NO: 5808048 - DNA, 16 bp, Homo sapiens
tgtttttgaaggcaga

SEQ ID NO: 5808049 - DNA, 20 bp, Homo sapiens
tgtttttgaatttaaataaa

SEQ ID NO: 5808050 - DNA, 14 bp, Homo sapiens
tgtttttgcactgt

SEQ ID NO: 5808051 - DNA, 18 bp, Homo sapiens
tgtttttgcactgtctgt

SEQ ID NO: 5808052 - DNA, 22 bp, Homo sapiens
tgtttttgcactgtctgtacct

SEQ ID NO: 5808053 - DNA, 13 bp, Homo sapiens
tgtttttgccact

SEQ ID NO: 5808054 - DNA, 12 bp, Homo sapiens
tgtttttgcttt

SEQ ID NO: 5808055 - DNA, 18 bp, Homo sapiens
tgtttttgctttctgaaa

SEQ ID NO: 5808056 - DNA, 13 bp, Homo sapiens
tgtttttgtaaag

SEQ ID NO: 5808057 - DNA, 16 bp, Homo sapiens
tgtttttgtaaagaaa

SEQ ID NO: 5808058 - DNA, 12 bp, Homo sapiens
tgtttttgtaat

SEQ ID NO: 5808059 - DNA, 23 bp, Homo sapiens
tgtttttgtatattgggtgtaga

SEQ ID NO: 5808060 - DNA, 13 bp, Homo sapiens
tgtttttgtatct

SEQ ID NO: 5808061 - DNA, 22 bp, Homo sapiens
tgtttttgtatttattaatttg

SEQ ID NO: 5808062 - DNA, 19 bp, Homo sapiens
tgtttttgtatttttaatg

SEQ ID NO: 5808063 - DNA, 13 bp, Homo sapiens
tgtttttgtctta

SEQ ID NO: 5808064 - DNA, 13 bp, Homo sapiens
tgtttttgttctt

SEQ ID NO: 5808065 - DNA, 15 bp, Homo sapiens
tgtttttgttgtgtg

SEQ ID NO: 5808066 - DNA, 14 bp, Homo sapiens
tgtttttgttttgt

SEQ ID NO: 5808067 - DNA, 14 bp, Homo sapiens
tgttttttaaaatg

SEQ ID NO: 5808068 - DNA, 20 bp, Homo sapiens
tgttttttaaactaggaaaa

SEQ ID NO: 5808069 - DNA, 15 bp, Homo sapiens
tgttttttaaagtct

SEQ ID NO: 5808070 - DNA, 19 bp, Homo sapiens
tgttttttaagatggcaat

SEQ ID NO: 5808071 - DNA, 12 bp, Homo sapiens
tgttttttaagt

SEQ ID NO: 5808072 - DNA, 17 bp, Homo sapiens
tgttttttaatatacta

SEQ ID NO: 5808073 - DNA, 18 bp, Homo sapiens
tgttttttaattctctgt

SEQ ID NO: 5808074 - DNA, 19 bp, Homo sapiens
tgttttttaattctctgtt

SEQ ID NO: 5808075 - DNA, 17 bp, Homo sapiens
tgttttttagatcaaat

SEQ ID NO: 5808076 - DNA, 21 bp, Homo sapiens
tgttttttagatcaaatactt

SEQ ID NO: 5808077 - DNA, 16 bp, Homo sapiens
tgttttttatacttca

SEQ ID NO: 5808078 - DNA, 14 bp, Homo sapiens
tgttttttatcttt

SEQ ID NO: 5808079 - DNA, 23 bp, Homo sapiens
tgttttttatcttttctacagca

SEQ ID NO: 5808080 - DNA, 14 bp, Homo sapiens
tgttttttcaagaa

SEQ ID NO: 5808081 - DNA, 18 bp, Homo sapiens
tgttttttcatagtgcct

SEQ ID NO: 5808082 - DNA, 15 bp, Homo sapiens
tgttttttcatttgt

SEQ ID NO: 5808083 - DNA, 12 bp, Homo sapiens
tgttttttcctt

SEQ ID NO: 5808084 - DNA, 14 bp, Homo sapiens
tgttttttccttta

SEQ ID NO: 5808085 - DNA, 13 bp, Homo sapiens
tgttttttctgta

SEQ ID NO: 5808086 - DNA, 9 bp, Homo sapiens
tgttttttg

SEQ ID NO: 5808087 - DNA, 14 bp, Homo sapiens
tgttttttgaaaac

SEQ ID NO: 5808088 - DNA, 19 bp, Homo sapiens
tgttttttgaaaacatggt

SEQ ID NO: 5808089 - DNA, 15 bp, Homo sapiens
tgttttttgaagtgt

SEQ ID NO: 5808090 - DNA, 16 bp, Homo sapiens
tgttttttgaagtgtt

SEQ ID NO: 5808091 - DNA, 17 bp, Homo sapiens
tgttttttgagtctttt

SEQ ID NO: 5808092 - DNA, 12 bp, Homo sapiens
tgttttttgcaa

SEQ ID NO: 5808093 - DNA, 23 bp, Homo sapiens
tgttttttgccacagcttttgca

SEQ ID NO: 5808094 - DNA, 17 bp, Homo sapiens
tgttttttggaaattca

SEQ ID NO: 5808095 - DNA, 11 bp, Homo sapiens
tgttttttggg

SEQ ID NO: 5808096 - DNA, 12 bp, Homo sapiens
tgttttttgggg

SEQ ID NO: 5808097 - DNA, 14 bp, Homo sapiens
tgttttttggtctt

SEQ ID NO: 5808098 - DNA, 14 bp, Homo sapiens
tgttttttgtaact

SEQ ID NO: 5808099 - DNA, 11 bp, Homo sapiens
tgttttttgtt

SEQ ID NO: 5808100 - DNA, 14 bp, Homo sapiens
tgttttttgttctt

SEQ ID NO: 5808101 - DNA, 19 bp, Homo sapiens
tgttttttgttttcattaa

SEQ ID NO: 5808102 - DNA, 15 bp, Homo sapiens
tgtttttttaattaa

SEQ ID NO: 5808103 - DNA, 14 bp, Homo sapiens
tgtttttttccttt

SEQ ID NO: 5808104 - DNA, 21 bp, Homo sapiens
tgtttttttgagatggagtct

SEQ ID NO: 5808105 - DNA, 22 bp, Homo sapiens
tgttttttttccaaaaacaaag

SEQ ID NO: 5808106 - DNA, 18 bp, Homo sapiens
tgtttttttttaaagact

SEQ ID NO: 5808107 - DNA, 15 bp, Homo sapiens
tgttttttttttaaa

SEQ ID NO: 5808108 - DNA, 21 bp, Homo sapiens
tgttttttttttgtgtgtgct

SEQ ID NO: 5808109 - DNA, 20 bp, Homo sapiens
tgttttttttttttgtattt

SEQ ID NO: 5808110 - DNA, 18 bp, Homo sapiens
tgtttttttttttttaag

SEQ ID NO: 5808111 - DNA, 21 bp, Homo sapiens
tgttttttttttttttttaat

SEQ ID NO: 5808112 - DNA, 23 bp, Homo sapiens
ttaaaaaaaaaaaaaaaagacta

SEQ ID NO: 5808113 - DNA, 20 bp, Homo sapiens
ttaaaaaaaaaaaaaagctt

SEQ ID NO: 5808114 - DNA, 23 bp, Homo sapiens
ttaaaaaaaaaaaaaagctttat

SEQ ID NO: 5808115 - DNA, 15 bp, Homo sapiens
ttaaaaaaaaaattg

SEQ ID NO: 5808116 - DNA, 18 bp, Homo sapiens
ttaaaaaaaaagatctgt

SEQ ID NO: 5808117 - DNA, 16 bp, Homo sapiens
ttaaaaaaaaaggcat

SEQ ID NO: 5808118 - DNA, 17 bp, Homo sapiens
ttaaaaaaaaatcttgt

SEQ ID NO: 5808119 - DNA, 16 bp, Homo sapiens
ttaaaaaaaaattgta

SEQ ID NO: 5808120 - DNA, 14 bp, Homo sapiens
ttaaaaaaaacaaa

SEQ ID NO: 5808121 - DNA, 15 bp, Homo sapiens
ttaaaaaaaacaaaa

SEQ ID NO: 5808122 - DNA, 22 bp, Homo sapiens
ttaaaaaaaacaaaaagaacaa

SEQ ID NO: 5808123 - DNA, 21 bp, Homo sapiens
ttaaaaaaaactctttaactt

SEQ ID NO: 5808124 - DNA, 18 bp, Homo sapiens
ttaaaaaaaagaaacttt

SEQ ID NO: 5808125 - DNA, 22 bp, Homo sapiens
ttaaaaaaaatattctgtcatt

SEQ ID NO: 5808126 - DNA, 21 bp, Homo sapiens
ttaaaaaaaatcatcattatt

SEQ ID NO: 5808127 - DNA, 19 bp, Homo sapiens
ttaaaaaaaatgtgaaatt

SEQ ID NO: 5808128 - DNA, 19 bp, Homo sapiens
ttaaaaaaactgaaggttt

SEQ ID NO: 5808129 - DNA, 13 bp, Homo sapiens
ttaaaaaaactgg

SEQ ID NO: 5808130 - DNA, 18 bp, Homo sapiens
ttaaaaaaactggatatt

SEQ ID NO: 5808131 - DNA, 14 bp, Homo sapiens
ttaaaaaaagaaat

SEQ ID NO: 5808132 - DNA, 18 bp, Homo sapiens
ttaaaaaaagaagagaaa

SEQ ID NO: 5808133 - DNA, 19 bp, Homo sapiens
ttaaaaaaaggcattgttt

SEQ ID NO: 5808134 - DNA, 21 bp, Homo sapiens
ttaaaaaaaggcattgtttga

SEQ ID NO: 5808135 - DNA, 18 bp, Homo sapiens
ttaaaaaaagtatatatt

SEQ ID NO: 5808136 - DNA, 15 bp, Homo sapiens
ttaaaaaaataaaat

SEQ ID NO: 5808137 - DNA, 15 bp, Homo sapiens
ttaaaaaaataatat

SEQ ID NO: 5808138 - DNA, 21 bp, Homo sapiens
ttaaaaaaataatataaatga

SEQ ID NO: 5808139 - DNA, 23 bp, Homo sapiens
ttaaaaaaatcacaaaaatttga

SEQ ID NO: 5808140 - DNA, 12 bp, Homo sapiens
ttaaaaaaatgg

SEQ ID NO: 5808141 - DNA, 14 bp, Homo sapiens
ttaaaaaaatttta

SEQ ID NO: 5808142 - DNA, 20 bp, Homo sapiens
ttaaaaaaatttttataaat

SEQ ID NO: 5808143 - DNA, 23 bp, Homo sapiens
ttaaaaaaatttttataaattac

SEQ ID NO: 5808144 - DNA, 13 bp, Homo sapiens
ttaaaaaacaaaa

SEQ ID NO: 5808145 - DNA, 19 bp, Homo sapiens
ttaaaaaacaaaaaaagac

SEQ ID NO: 5808146 - DNA, 23 bp, Homo sapiens
ttaaaaaacaaaaaccagcaggt

SEQ ID NO: 5808147 - DNA, 17 bp, Homo sapiens
ttaaaaaacaaatgttc

SEQ ID NO: 5808148 - DNA, 22 bp, Homo sapiens
ttaaaaaacaattaactgccct

SEQ ID NO: 5808149 - DNA, 16 bp, Homo sapiens
ttaaaaaacaattggt

SEQ ID NO: 5808150 - DNA, 23 bp, Homo sapiens
ttaaaaaacaattggttgtatat

SEQ ID NO: 5808151 - DNA, 11 bp, Homo sapiens
ttaaaaaacag

SEQ ID NO: 5808152 - DNA, 17 bp, Homo sapiens
ttaaaaaacattttaca

SEQ ID NO: 5808153 - DNA, 13 bp, Homo sapiens
ttaaaaaactaaa

SEQ ID NO: 5808154 - DNA, 16 bp, Homo sapiens
ttaaaaaactctttgg

SEQ ID NO: 5808155 - DNA, 11 bp, Homo sapiens
ttaaaaaactg

SEQ ID NO: 5808156 - DNA, 23 bp, Homo sapiens
ttaaaaaactgacaggcactata

SEQ ID NO: 5808157 - DNA, 13 bp, Homo sapiens
ttaaaaaacttca

SEQ ID NO: 5808158 - DNA, 15 bp, Homo sapiens
ttaaaaaagaaacat

SEQ ID NO: 5808159 - DNA, 17 bp, Homo sapiens
ttaaaaaagaaatctgt

SEQ ID NO: 5808160 - DNA, 18 bp, Homo sapiens
ttaaaaaagacatttaaa

SEQ ID NO: 5808161 - DNA, 15 bp, Homo sapiens
ttaaaaaagataaac

SEQ ID NO: 5808162 - DNA, 17 bp, Homo sapiens
ttaaaaaagataaacac

SEQ ID NO: 5808163 - DNA, 18 bp, Homo sapiens
ttaaaaaagataaacaca

SEQ ID NO: 5808164 - DNA, 15 bp, Homo sapiens
ttaaaaaagcaaagg

SEQ ID NO: 5808165 - DNA, 23 bp, Homo sapiens
ttaaaaaagcctggtttttctca

SEQ ID NO: 5808166 - DNA, 12 bp, Homo sapiens
ttaaaaaagttt

SEQ ID NO: 5808167 - DNA, 20 bp, Homo sapiens
ttaaaaaagtttaaaatgta

SEQ ID NO: 5808168 - DNA, 11 bp, Homo sapiens
ttaaaaaataa

SEQ ID NO: 5808169 - DNA, 17 bp, Homo sapiens
ttaaaaaataaatataa

SEQ ID NO: 5808170 - DNA, 22 bp, Homo sapiens
ttaaaaaataaatataattggg

SEQ ID NO: 5808171 - DNA, 22 bp, Homo sapiens
ttaaaaaataacttcattgttt

SEQ ID NO: 5808172 - DNA, 11 bp, Homo sapiens
ttaaaaaatac

SEQ ID NO: 5808173 - DNA, 13 bp, Homo sapiens
ttaaaaaatacac

SEQ ID NO: 5808174 - DNA, 17 bp, Homo sapiens
ttaaaaaatacagtatt

SEQ ID NO: 5808175 - DNA, 13 bp, Homo sapiens
ttaaaaaatactt

SEQ ID NO: 5808176 - DNA, 11 bp, Homo sapiens
ttaaaaaatat

SEQ ID NO: 5808177 - DNA, 14 bp, Homo sapiens
ttaaaaaatatttt

SEQ ID NO: 5808178 - DNA, 17 bp, Homo sapiens
ttaaaaaatattttaag

SEQ ID NO: 5808179 - DNA, 18 bp, Homo sapiens
ttaaaaaatattttaaga

SEQ ID NO: 5808180 - DNA, 19 bp, Homo sapiens
ttaaaaaatattttaagaa

SEQ ID NO: 5808181 - DNA, 23 bp, Homo sapiens
ttaaaaaatattttaagaaagag

SEQ ID NO: 5808182 - DNA, 16 bp, Homo sapiens
ttaaaaaatattttct

SEQ ID NO: 5808183 - DNA, 20 bp, Homo sapiens
ttaaaaaatattttctctgt

SEQ ID NO: 5808184 - DNA, 11 bp, Homo sapiens
ttaaaaaatca

SEQ ID NO: 5808185 - DNA, 22 bp, Homo sapiens
ttaaaaaatcaatcaatggtgc

SEQ ID NO: 5808186 - DNA, 17 bp, Homo sapiens
ttaaaaaatgctgggtt

SEQ ID NO: 5808187 - DNA, 16 bp, Homo sapiens
ttaaaaaatggaacat

SEQ ID NO: 5808188 - DNA, 13 bp, Homo sapiens
ttaaaaaatgttt

SEQ ID NO: 5808189 - DNA, 14 bp, Homo sapiens
ttaaaaaattaaaa

SEQ ID NO: 5808190 - DNA, 21 bp, Homo sapiens
ttaaaaaattatggaatatca

SEQ ID NO: 5808191 - DNA, 23 bp, Homo sapiens
ttaaaaaattatggaatatcatc

SEQ ID NO: 5808192 - DNA, 13 bp, Homo sapiens
ttaaaaaattctc

SEQ ID NO: 5808193 - DNA, 18 bp, Homo sapiens
ttaaacatgattatcttg

SEQ ID NO: 5808194 - DNA, 15 bp, Homo sapiens
ttaaacatgcagaag

SEQ ID NO: 5808195 - DNA, 19 bp, Homo sapiens
ttaaacatgctgtacatac

SEQ ID NO: 5808196 - DNA, 15 bp, Homo sapiens
ttaaacatgctgtta

SEQ ID NO: 5808197 - DNA, 13 bp, Homo sapiens
ttaaacattaaaa

SEQ ID NO: 5808198 - DNA, 19 bp, Homo sapiens
ttaaacattaatagcagcc

SEQ ID NO: 5808199 - DNA, 13 bp, Homo sapiens
ttaaacattgaag

SEQ ID NO: 5808200 - DNA, 13 bp, Homo sapiens
ttaaacattttca

SEQ ID NO: 5808201 - DNA, 12 bp, Homo sapiens
ttaaacattttt

SEQ ID NO: 5808202 - DNA, 21 bp, Homo sapiens
ttaaaccaacctttaaaattg

SEQ ID NO: 5808203 - DNA, 15 bp, Homo sapiens
ttaaaccaattataa

SEQ ID NO: 5808204 - DNA, 22 bp, Homo sapiens
ttaaaccagactctgttgcaat

SEQ ID NO: 5808205 - DNA, 13 bp, Homo sapiens
ttaaaccagcaga

SEQ ID NO: 5808206 - DNA, 17 bp, Homo sapiens
ttaaaccagcagaaaag

SEQ ID NO: 5808207 - DNA, 21 bp, Homo sapiens
ttaaaccagcagaaaagtgct

SEQ ID NO: 5808208 - DNA, 19 bp, Homo sapiens
ttaaaccataaaaagctga

SEQ ID NO: 5808209 - DNA, 18 bp, Homo sapiens
ttaaaccatctccctggt

SEQ ID NO: 5808210 - DNA, 21 bp, Homo sapiens
ttaaaccatctccctggtgct

SEQ ID NO: 5808211 - DNA, 23 bp, Homo sapiens
ttaaaccatctccctggtgctta

SEQ ID NO: 5808212 - DNA, 16 bp, Homo sapiens
ttaaaccatgtgacta

SEQ ID NO: 5808213 - DNA, 20 bp, Homo sapiens
ttaaaccatttttgctgaat

SEQ ID NO: 5808214 - DNA, 23 bp, Homo sapiens
ttaaaccatttttgctgaattca

SEQ ID NO: 5808215 - DNA, 19 bp, Homo sapiens
ttaaacccaatcagatgcc

SEQ ID NO: 5808216 - DNA, 20 bp, Homo sapiens
ttaaacccacaagctgcctc

SEQ ID NO: 5808217 - DNA, 21 bp, Homo sapiens
ttaaacccacaagctgcctct

SEQ ID NO: 5808218 - DNA, 16 bp, Homo sapiens
ttaaacccacataaac

SEQ ID NO: 5808219 - DNA, 17 bp, Homo sapiens
ttaaacccacataaaca

SEQ ID NO: 5808220 - DNA, 21 bp, Homo sapiens
ttaaacccacataaacacttc

SEQ ID NO: 5808221 - DNA, 17 bp, Homo sapiens
ttaaacccatacaatgt

SEQ ID NO: 5808222 - DNA, 19 bp, Homo sapiens
ttaaacccatacaatgtat

SEQ ID NO: 5808223 - DNA, 20 bp, Homo sapiens
ttaaacccatacaatgtatg

SEQ ID NO: 5808224 - DNA, 22 bp, Homo sapiens
ttaaacccatacaatgtatgta

SEQ ID NO: 5808225 - DNA, 22 bp, Homo sapiens
ttaaaccgtgattcttgaaagg

SEQ ID NO: 5808226 - DNA, 17 bp, Homo sapiens
ttaaacctatactcact

SEQ ID NO: 5808227 - DNA, 18 bp, Homo sapiens
ttaaacctctcttctacc

SEQ ID NO: 5808228 - DNA, 18 bp, Homo sapiens
ttaaacctgaactcagac

SEQ ID NO: 5808229 - DNA, 18 bp, Homo sapiens
ttaaacctgaagatgtct

SEQ ID NO: 5808230 - DNA, 19 bp, Homo sapiens
ttaaacctgaagatgtctc

SEQ ID NO: 5808231 - DNA, 19 bp, Homo sapiens
ttaaacctgtctccactgt

SEQ ID NO: 5808232 - DNA, 16 bp, Homo sapiens
ttaaacctgttcctga

SEQ ID NO: 5808233 - DNA, 22 bp, Homo sapiens
ttaaacctgttcctgactgttc

SEQ ID NO: 5808234 - DNA, 21 bp, Homo sapiens
ttaaacctgtttttttttcat

SEQ ID NO: 5808235 - DNA, 17 bp, Homo sapiens
ttaaacctttcagtact

SEQ ID NO: 5808236 - DNA, 14 bp, Homo sapiens
ttaaaccttttttg

SEQ ID NO: 5808237 - DNA, 15 bp, Homo sapiens
ttaaacgatttttaa

SEQ ID NO: 5808238 - DNA, 18 bp, Homo sapiens
ttaaacgatttttaaaat

SEQ ID NO: 5808239 - DNA, 16 bp, Homo sapiens
ttaaacggattatttt

SEQ ID NO: 5808240 - DNA, 23 bp, Homo sapiens
ttaaacggattattttttcagac

SEQ ID NO: 5808241 - DNA, 13 bp, Homo sapiens
ttaaacgtagcat

SEQ ID NO: 5808242 - DNA, 19 bp, Homo sapiens
ttaaacgtagcatgtggca

SEQ ID NO: 5808243 - DNA, 20 bp, Homo sapiens
ttaaacgtatgcatgtgaag

SEQ ID NO: 5808244 - DNA, 17 bp, Homo sapiens
ttaaactaaattactgt

SEQ ID NO: 5808245 - DNA, 19 bp, Homo sapiens
ttaaactaatgaacaaata

SEQ ID NO: 5808246 - DNA, 23 bp, Homo sapiens
ttaaactacctcaaaacactttc

SEQ ID NO: 5808247 - DNA, 12 bp, Homo sapiens
ttaaactactga

SEQ ID NO: 5808248 - DNA, 22 bp, Homo sapiens
ttaaactagcatatctgccttt

SEQ ID NO: 5808249 - DNA, 18 bp, Homo sapiens
ttaaactatgttcctaac

SEQ ID NO: 5808250 - DNA, 22 bp, Homo sapiens
ttaaactattagagtatttccc

SEQ ID NO: 5808251 - DNA, 20 bp, Homo sapiens
ttaaactcagggacagagcc

SEQ ID NO: 5808252 - DNA, 18 bp, Homo sapiens
ttaaactccctttcatgt

SEQ ID NO: 5808253 - DNA, 17 bp, Homo sapiens
ttaaactctcctttgat

SEQ ID NO: 5808254 - DNA, 22 bp, Homo sapiens
ttaaactctgaatttatctttg

SEQ ID NO: 5808255 - DNA, 16 bp, Homo sapiens
ttaaactctgccagaa

SEQ ID NO: 5808256 - DNA, 19 bp, Homo sapiens
ttaaactctgccagaaaaa

SEQ ID NO: 5808257 - DNA, 20 bp, Homo sapiens
ttaaactgagagtaattcat

SEQ ID NO: 5808258 - DNA, 17 bp, Homo sapiens
ttaaactggcttaactt

SEQ ID NO: 5808259 - DNA, 21 bp, Homo sapiens
ttaaactgtacagaatttcca

SEQ ID NO: 5808260 - DNA, 18 bp, Homo sapiens
ttaaactgtacagtgtct

SEQ ID NO: 5808261 - DNA, 20 bp, Homo sapiens
ttaaactgtacagtgtcttt

SEQ ID NO: 5808262 - DNA, 21 bp, Homo sapiens
ttaaactgtacagtgtctttt

SEQ ID NO: 5808263 - DNA, 19 bp, Homo sapiens
ttaaactgtgtacataact

SEQ ID NO: 5808264 - DNA, 15 bp, Homo sapiens
ttaaactgtgtttta

SEQ ID NO: 5808265 - DNA, 16 bp, Homo sapiens
ttaaacttataaatca

SEQ ID NO: 5808266 - DNA, 16 bp, Homo sapiens
ttaaacttatgaatgt

SEQ ID NO: 5808267 - DNA, 13 bp, Homo sapiens
ttaaacttcagca

SEQ ID NO: 5808268 - DNA, 15 bp, Homo sapiens
ttaaacttcagcaac

SEQ ID NO: 5808269 - DNA, 20 bp, Homo sapiens
ttaaacttcagttttactgc

SEQ ID NO: 5808270 - DNA, 13 bp, Homo sapiens
ttaaacttctgat

SEQ ID NO: 5808271 - DNA, 14 bp, Homo sapiens
ttaaacttgaaata

SEQ ID NO: 5808272 - DNA, 15 bp, Homo sapiens
ttaaacttgaaatat

SEQ ID NO: 5808273 - DNA, 16 bp, Homo sapiens
ttaaacttgcacattt

SEQ ID NO: 5808274 - DNA, 15 bp, Homo sapiens
ttaaacttgtctttt

SEQ ID NO: 5808275 - DNA, 21 bp, Homo sapiens
ttaaactttagtgctacagaa

SEQ ID NO: 5808276 - DNA, 14 bp, Homo sapiens
ttaaactttgtcac

SEQ ID NO: 5808277 - DNA, 14 bp, Homo sapiens
ttaaacttttcatt

SEQ ID NO: 5808278 - DNA, 14 bp, Homo sapiens
ttaaactttttaaa

SEQ ID NO: 5808279 - DNA, 21 bp, Homo sapiens
ttaaagaaaaaaaatttctag

SEQ ID NO: 5808280 - DNA, 20 bp, Homo sapiens
ttaaagaaaaaaatgtattt

SEQ ID NO: 5808281 - DNA, 21 bp, Homo sapiens
ttaaagaaaaaaatgtatttt

SEQ ID NO: 5808282 - DNA, 17 bp, Homo sapiens
ttaaagaaaaaaattga

SEQ ID NO: 5808283 - DNA, 14 bp, Homo sapiens
ttaaagaaaaacca

SEQ ID NO: 5808284 - DNA, 18 bp, Homo sapiens
ttaaagaaaagttttgta

SEQ ID NO: 5808285 - DNA, 23 bp, Homo sapiens
ttaaagaaaataaaattaagaat

SEQ ID NO: 5808286 - DNA, 16 bp, Homo sapiens
ttaaagaaaattgcat

SEQ ID NO: 5808287 - DNA, 17 bp, Homo sapiens
ttaaagaaaattgcatg

SEQ ID NO: 5808288 - DNA, 16 bp, Homo sapiens
ttaaagaaaattgcca

SEQ ID NO: 5808289 - DNA, 19 bp, Homo sapiens
ttaaagaaaattgccaaaa

SEQ ID NO: 5808290 - DNA, 17 bp, Homo sapiens
ttaaagaaacactaaat

SEQ ID NO: 5808291 - DNA, 14 bp, Homo sapiens
ttaaagaaacagct

SEQ ID NO: 5808292 - DNA, 17 bp, Homo sapiens
ttaaagaaactgatttt

SEQ ID NO: 5808293 - DNA, 12 bp, Homo sapiens
ttaaagaaagtg

SEQ ID NO: 5808294 - DNA, 12 bp, Homo sapiens
ttaaagaaatga

SEQ ID NO: 5808295 - DNA, 14 bp, Homo sapiens
ttaaagaagaatgt

SEQ ID NO: 5808296 - DNA, 17 bp, Homo sapiens
ttaaagaagctgcatgt

SEQ ID NO: 5808297 - DNA, 14 bp, Homo sapiens
ttaaagaagcttta

SEQ ID NO: 5808298 - DNA, 18 bp, Homo sapiens
ttaaagaagtaaatttgt

SEQ ID NO: 5808299 - DNA, 16 bp, Homo sapiens
ttaaagaatatgaaac

SEQ ID NO: 5808300 - DNA, 17 bp, Homo sapiens
ttaaagaatcattattt

SEQ ID NO: 5808301 - DNA, 14 bp, Homo sapiens
ttaaagaatgttag

SEQ ID NO: 5808302 - DNA, 12 bp, Homo sapiens
ttaaagacaggt

SEQ ID NO: 5808303 - DNA, 14 bp, Homo sapiens
ttaaagacatacct

SEQ ID NO: 5808304 - DNA, 18 bp, Homo sapiens
ttaaagaccaataaactt

SEQ ID NO: 5808305 - DNA, 15 bp, Homo sapiens
ttaaagactacaata

SEQ ID NO: 5808306 - DNA, 16 bp, Homo sapiens
ttaaagactacaataa

SEQ ID NO: 5808307 - DNA, 16 bp, Homo sapiens
ttaaagacttaagatt

SEQ ID NO: 5808308 - DNA, 18 bp, Homo sapiens
ttaaagacttaagattaa

SEQ ID NO: 5808309 - DNA, 22 bp, Homo sapiens
ttaaagagaaaagggaaaaaag

SEQ ID NO: 5808310 - DNA, 23 bp, Homo sapiens
ttaaagagaaaagggaaaaaaga

SEQ ID NO: 5808311 - DNA, 20 bp, Homo sapiens
ttaaagagaggttatagagt

SEQ ID NO: 5808312 - DNA, 16 bp, Homo sapiens
ttaaagagatagcttc

SEQ ID NO: 5808313 - DNA, 18 bp, Homo sapiens
ttaaagagatagcttctc

SEQ ID NO: 5808314 - DNA, 22 bp, Homo sapiens
ttaaagagatttcccttcattt

SEQ ID NO: 5808315 - DNA, 22 bp, Homo sapiens
ttaaagagcatggaaaaatact

SEQ ID NO: 5808316 - DNA, 21 bp, Homo sapiens
ttaaagagccattctggcact

SEQ ID NO: 5808317 - DNA, 20 bp, Homo sapiens
ttaaagaggagaaggaaaac

SEQ ID NO: 5808318 - DNA, 16 bp, Homo sapiens
ttaaagaggagccttt

SEQ ID NO: 5808319 - DNA, 22 bp, Homo sapiens
ttaaagaggagcctttccagaa

SEQ ID NO: 5808320 - DNA, 20 bp, Homo sapiens
ttaaagaggcgtcttgtatt

SEQ ID NO: 5808321 - DNA, 22 bp, Homo sapiens
ttaaagaggcgtcttgtatttt

SEQ ID NO: 5808322 - DNA, 19 bp, Homo sapiens
ttaaagagtcctccttccc

SEQ ID NO: 5808323 - DNA, 22 bp, Homo sapiens
ttaaagagtcctccttcccagc

SEQ ID NO: 5808324 - DNA, 17 bp, Homo sapiens
ttaaagagtctagattc

SEQ ID NO: 5808325 - DNA, 15 bp, Homo sapiens
ttaaagagtgtgtta

SEQ ID NO: 5808326 - DNA, 16 bp, Homo sapiens
ttaaagagtgtgttat

SEQ ID NO: 5808327 - DNA, 16 bp, Homo sapiens
ttaaagataagacttc

SEQ ID NO: 5808328 - DNA, 14 bp, Homo sapiens
ttaaagatatcaat

SEQ ID NO: 5808329 - DNA, 19 bp, Homo sapiens
ttaaagatatttttattca

SEQ ID NO: 5808330 - DNA, 22 bp, Homo sapiens
ttaaagatctgtaagtaacttc

SEQ ID NO: 5808331 - DNA, 18 bp, Homo sapiens
ttaaagatgaactctgaa

SEQ ID NO: 5808332 - DNA, 18 bp, Homo sapiens
ttaaagatgattgttctt

SEQ ID NO: 5808333 - DNA, 19 bp, Homo sapiens
ttaaagatgattgttcttt

SEQ ID NO: 5808334 - DNA, 11 bp, Homo sapiens
ttaaagatgta

SEQ ID NO: 5808335 - DNA, 15 bp, Homo sapiens
ttaaagatgtagcaa

SEQ ID NO: 5808336 - DNA, 16 bp, Homo sapiens
ttaaagatgtagcaaa

SEQ ID NO: 5808337 - DNA, 12 bp, Homo sapiens
ttaaagatgtgt

SEQ ID NO: 5808338 - DNA, 13 bp, Homo sapiens
ttaaagatgttcc

SEQ ID NO: 5808339 - DNA, 19 bp, Homo sapiens
ttaaagattacccccagtc

SEQ ID NO: 5808340 - DNA, 14 bp, Homo sapiens
ttaaagattctctt

SEQ ID NO: 5808341 - DNA, 13 bp, Homo sapiens
ttaaagatttaaa

SEQ ID NO: 5808342 - DNA, 21 bp, Homo sapiens
ttaaagatttatcaaatcagt

SEQ ID NO: 5808343 - DNA, 16 bp, Homo sapiens
ttaaagatttcaaata

SEQ ID NO: 5808344 - DNA, 13 bp, Homo sapiens
ttaaagatttctg

SEQ ID NO: 5808345 - DNA, 16 bp, Homo sapiens
ttaaagatttgtttgt

SEQ ID NO: 5808346 - DNA, 22 bp, Homo sapiens
ttaaagcaaagcgctaagtaaa

SEQ ID NO: 5808347 - DNA, 15 bp, Homo sapiens
ttaaagcaacatttt

SEQ ID NO: 5808348 - DNA, 16 bp, Homo sapiens
ttaaagcaagcaacac

SEQ ID NO: 5808349 - DNA, 15 bp, Homo sapiens
ttaaagcaataagtt

SEQ ID NO: 5808350 - DNA, 15 bp, Homo sapiens
ttaaagcaccaaatt

SEQ ID NO: 5808351 - DNA, 22 bp, Homo sapiens
ttaaagcacttacagataggcc

SEQ ID NO: 5808352 - DNA, 21 bp, Homo sapiens
ttaaagcagagggactttgta

SEQ ID NO: 5808353 - DNA, 20 bp, Homo sapiens
ttaaagcatcaccactcatt

SEQ ID NO: 5808354 - DNA, 14 bp, Homo sapiens
ttaaagcatctgta

SEQ ID NO: 5808355 - DNA, 16 bp, Homo sapiens
ttaaagcatctgtaaa

SEQ ID NO: 5808356 - DNA, 15 bp, Homo sapiens
ttaaagcatttccta

SEQ ID NO: 5808357 - DNA, 14 bp, Homo sapiens
ttaaagccaaatgt

SEQ ID NO: 5808358 - DNA, 14 bp, Homo sapiens
ttaaagccatgttt

SEQ ID NO: 5808359 - DNA, 20 bp, Homo sapiens
ttaaagcctgaaaattccaa

SEQ ID NO: 5808360 - DNA, 16 bp, Homo sapiens
ttaaagcctggcttct

SEQ ID NO: 5808361 - DNA, 21 bp, Homo sapiens
ttaaagccttaagcacaatta

SEQ ID NO: 5808362 - DNA, 14 bp, Homo sapiens
ttaaagctaaactg

SEQ ID NO: 5808363 - DNA, 17 bp, Homo sapiens
ttaaagctaaattttgt

SEQ ID NO: 5808364 - DNA, 16 bp, Homo sapiens
ttaaagctactgtaga

SEQ ID NO: 5808365 - DNA, 17 bp, Homo sapiens
ttaaagctcttcatttc

SEQ ID NO: 5808366 - DNA, 19 bp, Homo sapiens
ttaaagctgagagaccctg

SEQ ID NO: 5808367 - DNA, 14 bp, Homo sapiens
ttaaagctgcctgt

SEQ ID NO: 5808368 - DNA, 17 bp, Homo sapiens
ttaaagctgcctgtagt

SEQ ID NO: 5808369 - DNA, 18 bp, Homo sapiens
ttaaagcttaaactgaat

SEQ ID NO: 5808370 - DNA, 21 bp, Homo sapiens
ttaacaaagttactggctctt

SEQ ID NO: 5808371 - DNA, 13 bp, Homo sapiens
ttaacaaatacat

SEQ ID NO: 5808372 - DNA, 12 bp, Homo sapiens
ttaacaaatatg

SEQ ID NO: 5808373 - DNA, 21 bp, Homo sapiens
ttaacaaatatgctaatttgg

SEQ ID NO: 5808374 - DNA, 14 bp, Homo sapiens
ttaacaaatcagat

SEQ ID NO: 5808375 - DNA, 17 bp, Homo sapiens
ttaacaaatgactgtat

SEQ ID NO: 5808376 - DNA, 12 bp, Homo sapiens
ttaacaaatgag

SEQ ID NO: 5808377 - DNA, 18 bp, Homo sapiens
ttaacaaattgcatttgt

SEQ ID NO: 5808378 - DNA, 15 bp, Homo sapiens
ttaacaacagcttct

SEQ ID NO: 5808379 - DNA, 18 bp, Homo sapiens
ttaacaaccctgttgagt

SEQ ID NO: 5808380 - DNA, 15 bp, Homo sapiens
ttaacaactgggtca

SEQ ID NO: 5808381 - DNA, 17 bp, Homo sapiens
ttaacaagaactcatta

SEQ ID NO: 5808382 - DNA, 17 bp, Homo sapiens
ttaacaagaagatgaat

SEQ ID NO: 5808383 - DNA, 20 bp, Homo sapiens
ttaacaaggaatgcctgtgc

SEQ ID NO: 5808384 - DNA, 11 bp, Homo sapiens
ttaacaagtca

SEQ ID NO: 5808385 - DNA, 19 bp, Homo sapiens
ttaacaataactactgtgt

SEQ ID NO: 5808386 - DNA, 20 bp, Homo sapiens
ttaacaataactactgtgtt

SEQ ID NO: 5808387 - DNA, 23 bp, Homo sapiens
ttaacaataactactgtgttcct

SEQ ID NO: 5808388 - DNA, 17 bp, Homo sapiens
ttaacaataataaaaag

SEQ ID NO: 5808389 - DNA, 15 bp, Homo sapiens
ttaacaatctaacaa

SEQ ID NO: 5808390 - DNA, 17 bp, Homo sapiens
ttaacaatctaacaata

SEQ ID NO: 5808391 - DNA, 14 bp, Homo sapiens
ttaacaatgcaact

SEQ ID NO: 5808392 - DNA, 17 bp, Homo sapiens
ttaacaatgcaactttt

SEQ ID NO: 5808393 - DNA, 19 bp, Homo sapiens
ttaacaatgcaacttttaa

SEQ ID NO: 5808394 - DNA, 21 bp, Homo sapiens
ttaacaatgcctattgtaata

SEQ ID NO: 5808395 - DNA, 23 bp, Homo sapiens
ttaacaatggcaggttttacacg

SEQ ID NO: 5808396 - DNA, 18 bp, Homo sapiens
ttaacaatgtctgaaaag

SEQ ID NO: 5808397 - DNA, 21 bp, Homo sapiens
ttaacaatgtcttgtaagcaa

SEQ ID NO: 5808398 - DNA, 17 bp, Homo sapiens
ttaacaattaggcagac

SEQ ID NO: 5808399 - DNA, 13 bp, Homo sapiens
ttaacaattgtct

SEQ ID NO: 5808400 - DNA, 16 bp, Homo sapiens
ttaacaattgtcttaa

SEQ ID NO: 5808401 - DNA, 21 bp, Homo sapiens
ttaacaattgtcttaaaacca

SEQ ID NO: 5808402 - DNA, 17 bp, Homo sapiens
ttaacaatttattctga

SEQ ID NO: 5808403 - DNA, 15 bp, Homo sapiens
ttaacaatttctgtc

SEQ ID NO: 5808404 - DNA, 17 bp, Homo sapiens
ttaacacaatgtgaatt

SEQ ID NO: 5808405 - DNA, 14 bp, Homo sapiens
ttaacacacataaa

SEQ ID NO: 5808406 - DNA, 16 bp, Homo sapiens
ttaacacacataaagg

SEQ ID NO: 5808407 - DNA, 18 bp, Homo sapiens
ttaacacacataaaggat

SEQ ID NO: 5808408 - DNA, 14 bp, Homo sapiens
ttaacacacatata

SEQ ID NO: 5808409 - DNA, 17 bp, Homo sapiens
ttaacacagtgtctggc

SEQ ID NO: 5808410 - DNA, 18 bp, Homo sapiens
ttaacacatggcttccta

SEQ ID NO: 5808411 - DNA, 22 bp, Homo sapiens
ttaacacattgttatttctgta

SEQ ID NO: 5808412 - DNA, 12 bp, Homo sapiens
ttaacacatttt

SEQ ID NO: 5808413 - DNA, 14 bp, Homo sapiens
ttaacacattttgt

SEQ ID NO: 5808414 - DNA, 17 bp, Homo sapiens
ttaacactactcaaagc

SEQ ID NO: 5808415 - DNA, 18 bp, Homo sapiens
ttaacactgaaattgcct

SEQ ID NO: 5808416 - DNA, 23 bp, Homo sapiens
ttaacactgagtgaaatattact

SEQ ID NO: 5808417 - DNA, 18 bp, Homo sapiens
ttaacactgtaatatctt

SEQ ID NO: 5808418 - DNA, 14 bp, Homo sapiens
ttaacactgtcatc

SEQ ID NO: 5808419 - DNA, 13 bp, Homo sapiens
ttaacacttccta

SEQ ID NO: 5808420 - DNA, 17 bp, Homo sapiens
ttaacactttctttttt

SEQ ID NO: 5808421 - DNA, 21 bp, Homo sapiens
ttaacactttgtattacttag

SEQ ID NO: 5808422 - DNA, 14 bp, Homo sapiens
ttaacagaaaaaca

SEQ ID NO: 5808423 - DNA, 21 bp, Homo sapiens
ttaacagaaactttcaaaagg

SEQ ID NO: 5808424 - DNA, 20 bp, Homo sapiens
ttaacagaaatgtacagcaa

SEQ ID NO: 5808425 - DNA, 16 bp, Homo sapiens
ttaacagaaattgtat

SEQ ID NO: 5808426 - DNA, 17 bp, Homo sapiens
ttaacagaaattgtata

SEQ ID NO: 5808427 - DNA, 14 bp, Homo sapiens
ttaacagaaccaga

SEQ ID NO: 5808428 - DNA, 16 bp, Homo sapiens
ttaacagaaccagagg

SEQ ID NO: 5808429 - DNA, 14 bp, Homo sapiens
ttaacagaagggag

SEQ ID NO: 5808430 - DNA, 14 bp, Homo sapiens
ttaacagacatgta

SEQ ID NO: 5808431 - DNA, 14 bp, Homo sapiens
ttaacagagacaga

SEQ ID NO: 5808432 - DNA, 23 bp, Homo sapiens
ttaacagagcaaatttgaataat

SEQ ID NO: 5808433 - DNA, 19 bp, Homo sapiens
ttaacagagtctgaaccta

SEQ ID NO: 5808434 - DNA, 19 bp, Homo sapiens
ttaacagatgatccatttg

SEQ ID NO: 5808435 - DNA, 16 bp, Homo sapiens
ttaacagcatgacaaa

SEQ ID NO: 5808436 - DNA, 17 bp, Homo sapiens
ttaacagcatgacaaaa

SEQ ID NO: 5808437 - DNA, 21 bp, Homo sapiens
ttaacagcatgacaaaaatta

SEQ ID NO: 5808438 - DNA, 21 bp, Homo sapiens
ttaacagcatgctgctttgcc

SEQ ID NO: 5808439 - DNA, 19 bp, Homo sapiens
ttaacagcgtgtcaacttt

SEQ ID NO: 5808440 - DNA, 13 bp, Homo sapiens
ttaacagctgtat

SEQ ID NO: 5808441 - DNA, 15 bp, Homo sapiens
ttaacagctgtatta

SEQ ID NO: 5808442 - DNA, 20 bp, Homo sapiens
ttaacagctttctccagaac

SEQ ID NO: 5808443 - DNA, 22 bp, Homo sapiens
ttaacagggtctctagtgctgt

SEQ ID NO: 5808444 - DNA, 16 bp, Homo sapiens
ttaacaggtattttca

SEQ ID NO: 5808445 - DNA, 16 bp, Homo sapiens
ttaacaggtctttgaa

SEQ ID NO: 5808446 - DNA, 19 bp, Homo sapiens
ttaacagtaaatatacact

SEQ ID NO: 5808447 - DNA, 16 bp, Homo sapiens
ttaacagtatctcaaa

SEQ ID NO: 5808448 - DNA, 15 bp, Homo sapiens
ttaacagtattttaa

SEQ ID NO: 5808449 - DNA, 16 bp, Homo sapiens
ttaacagtattttaag

SEQ ID NO: 5808450 - DNA, 15 bp, Homo sapiens
ttaacagtctccaat

SEQ ID NO: 5808451 - DNA, 18 bp, Homo sapiens
ttaacagtggagctgaat

SEQ ID NO: 5808452 - DNA, 13 bp, Homo sapiens
ttaacagttttcc

SEQ ID NO: 5808453 - DNA, 14 bp, Homo sapiens
ttaacagttttcca

SEQ ID NO: 5808454 - DNA, 17 bp, Homo sapiens
ttaacagttttccatga

SEQ ID NO: 5808455 - DNA, 20 bp, Homo sapiens
ttaacataaacttgtactta

SEQ ID NO: 5808456 - DNA, 22 bp, Homo sapiens
ttaacataaagaaatcatactt

SEQ ID NO: 5808457 - DNA, 14 bp, Homo sapiens
ttaacataagctat

SEQ ID NO: 5808458 - DNA, 16 bp, Homo sapiens
ttaacataagctattt

SEQ ID NO: 5808459 - DNA, 21 bp, Homo sapiens
ttaacatacaagaaaatgtat

SEQ ID NO: 5808460 - DNA, 14 bp, Homo sapiens
ttaacatacatcat

SEQ ID NO: 5808461 - DNA, 15 bp, Homo sapiens
ttaacatacatctaa

SEQ ID NO: 5808462 - DNA, 11 bp, Homo sapiens
ttaacatagca

SEQ ID NO: 5808463 - DNA, 15 bp, Homo sapiens
ttaacatagcagctg

SEQ ID NO: 5808464 - DNA, 18 bp, Homo sapiens
ttaacatagcagctggtt

SEQ ID NO: 5808465 - DNA, 17 bp, Homo sapiens
ttaacatagtaagttca

SEQ ID NO: 5808466 - DNA, 18 bp, Homo sapiens
ttaacatagtaattctta

SEQ ID NO: 5808467 - DNA, 13 bp, Homo sapiens
ttaacatataata

SEQ ID NO: 5808468 - DNA, 12 bp, Homo sapiens
ttaacatatata

SEQ ID NO: 5808469 - DNA, 16 bp, Homo sapiens
ttaacatatattgtta

SEQ ID NO: 5808470 - DNA, 19 bp, Homo sapiens
ttaacatatcattcagaat

SEQ ID NO: 5808471 - DNA, 17 bp, Homo sapiens
ttaacatattatttcat

SEQ ID NO: 5808472 - DNA, 19 bp, Homo sapiens
ttaacatcagaactgaaat

SEQ ID NO: 5808473 - DNA, 16 bp, Homo sapiens
ttaacatcatcacttt

SEQ ID NO: 5808474 - DNA, 22 bp, Homo sapiens
ttaacatcatcaggcttggaat

SEQ ID NO: 5808475 - DNA, 14 bp, Homo sapiens
ttaacatcatgaat

SEQ ID NO: 5808476 - DNA, 13 bp, Homo sapiens
ttaacatctttgt

SEQ ID NO: 5808477 - DNA, 22 bp, Homo sapiens
ttaacatgaacacccttagaaa

SEQ ID NO: 5808478 - DNA, 21 bp, Homo sapiens
ttaacatgacatttaccagca

SEQ ID NO: 5808479 - DNA, 15 bp, Homo sapiens
ttaacatgatgtact

SEQ ID NO: 5808480 - DNA, 13 bp, Homo sapiens
ttaacatgcaata

SEQ ID NO: 5808481 - DNA, 14 bp, Homo sapiens
ttaacatgcaataa

SEQ ID NO: 5808482 - DNA, 16 bp, Homo sapiens
ttaacatgcaataaca

SEQ ID NO: 5808483 - DNA, 23 bp, Homo sapiens
ttaacatgctgtgtaagctgtgt

SEQ ID NO: 5808484 - DNA, 19 bp, Homo sapiens
ttaacatgcttatgacaat

SEQ ID NO: 5808485 - DNA, 22 bp, Homo sapiens
ttaacatgggctcttcactagt

SEQ ID NO: 5808486 - DNA, 18 bp, Homo sapiens
ttaacatgttaaaccatg

SEQ ID NO: 5808487 - DNA, 19 bp, Homo sapiens
ttaacatgttaaaccatgg

SEQ ID NO: 5808488 - DNA, 22 bp, Homo sapiens
ttaacattaggaccttagaatt

SEQ ID NO: 5808489 - DNA, 23 bp, Homo sapiens
ttaacattaggaccttagaattt

SEQ ID NO: 5808490 - DNA, 13 bp, Homo sapiens
ttaacattccaag

SEQ ID NO: 5808491 - DNA, 14 bp, Homo sapiens
ttaacattccaaga

SEQ ID NO: 5808492 - DNA, 23 bp, Homo sapiens
ttaacattcctcatgaatgtaaa

SEQ ID NO: 5808493 - DNA, 19 bp, Homo sapiens
ttaacattgaccaagaact

SEQ ID NO: 5808494 - DNA, 21 bp, Homo sapiens
ttaacattgaccaagaactgc

SEQ ID NO: 5808495 - DNA, 19 bp, Homo sapiens
ttaacattgacttcttggt

SEQ ID NO: 5808496 - DNA, 20 bp, Homo sapiens
ttaacattgcataaacactt

SEQ ID NO: 5808497 - DNA, 20 bp, Homo sapiens
ttaacatttatatatttcca

SEQ ID NO: 5808498 - DNA, 17 bp, Homo sapiens
ttaacatttctctccac

SEQ ID NO: 5808499 - DNA, 22 bp, Homo sapiens
ttaacatttgtgtaatatgaaa

SEQ ID NO: 5808500 - DNA, 10 bp, Homo sapiens
ttaacatttt

SEQ ID NO: 5808501 - DNA, 15 bp, Homo sapiens
ttaacattttacagt

SEQ ID NO: 5808502 - DNA, 14 bp, Homo sapiens
ttaacattttgagc

SEQ ID NO: 5808503 - DNA, 19 bp, Homo sapiens
ttaacattttgagctattt

SEQ ID NO: 5808504 - DNA, 18 bp, Homo sapiens
ttaacattttggaaattg

SEQ ID NO: 5808505 - DNA, 19 bp, Homo sapiens
ttaacattttggaaattgt

SEQ ID NO: 5808506 - DNA, 21 bp, Homo sapiens
ttaacattttgtttccaaagc

SEQ ID NO: 5808507 - DNA, 19 bp, Homo sapiens
ttaaccaaaaagaccagac

SEQ ID NO: 5808508 - DNA, 12 bp, Homo sapiens
ttaaccaaaggt

SEQ ID NO: 5808509 - DNA, 15 bp, Homo sapiens
ttaaccaaggagggg

SEQ ID NO: 5808510 - DNA, 17 bp, Homo sapiens
ttaaccaaggaggggcc

SEQ ID NO: 5808511 - DNA, 21 bp, Homo sapiens
ttaaccaagttgtttattcca

SEQ ID NO: 5808512 - DNA, 23 bp, Homo sapiens
ttaaccaccgcatatgcatgcca

SEQ ID NO: 5808513 - DNA, 14 bp, Homo sapiens
ttaaccagaaagtc

SEQ ID NO: 5808514 - DNA, 18 bp, Homo sapiens
ttaaccaggggtcctaac

SEQ ID NO: 5808515 - DNA, 19 bp, Homo sapiens
ttaaccagttatttttatt

SEQ ID NO: 5808516 - DNA, 17 bp, Homo sapiens
ttaaccattattatgca

SEQ ID NO: 5808517 - DNA, 19 bp, Homo sapiens
ttaaccattattatgcaaa

SEQ ID NO: 5808518 - DNA, 17 bp, Homo sapiens
ttaaccatttaataaag

SEQ ID NO: 5808519 - DNA, 21 bp, Homo sapiens
ttaaccatttaataaagaaat

SEQ ID NO: 5808520 - DNA, 18 bp, Homo sapiens
ttaaccccataattagat

SEQ ID NO: 5808521 - DNA, 17 bp, Homo sapiens
ttaacccccctgtacac

SEQ ID NO: 5808522 - DNA, 20 bp, Homo sapiens
ttaacccccctgtacacaac

SEQ ID NO: 5808523 - DNA, 12 bp, Homo sapiens
ttaacccctcca

SEQ ID NO: 5808524 - DNA, 15 bp, Homo sapiens
ttaacccttcatctt

SEQ ID NO: 5808525 - DNA, 15 bp, Homo sapiens
ttaaccgtttcagga

SEQ ID NO: 5808526 - DNA, 17 bp, Homo sapiens
ttaaccgtttttcaaga

SEQ ID NO: 5808527 - DNA, 22 bp, Homo sapiens
ttaaccgtttttcaagaaaact

SEQ ID NO: 5808528 - DNA, 16 bp, Homo sapiens
ttaacctaaataatta

SEQ ID NO: 5808529 - DNA, 15 bp, Homo sapiens
ttaacctacctgtaa

SEQ ID NO: 5808530 - DNA, 14 bp, Homo sapiens
ttaacctacctgtg

SEQ ID NO: 5808531 - DNA, 17 bp, Homo sapiens
ttaacctacctgtgaat

SEQ ID NO: 5808532 - DNA, 22 bp, Homo sapiens
ttaacctagatgtttaacaaat

SEQ ID NO: 5808533 - DNA, 20 bp, Homo sapiens
ttaacctccctcaacaaggt

SEQ ID NO: 5808534 - DNA, 15 bp, Homo sapiens
ttaacctctgctttt

SEQ ID NO: 5808535 - DNA, 17 bp, Homo sapiens
ttaacctcttaaacatg

SEQ ID NO: 5808536 - DNA, 16 bp, Homo sapiens
ttaacctgaattattc

SEQ ID NO: 5808537 - DNA, 13 bp, Homo sapiens
ttaacctgatgca

SEQ ID NO: 5808538 - DNA, 16 bp, Homo sapiens
ttaacctgcagaaaca

SEQ ID NO: 5808539 - DNA, 12 bp, Homo sapiens
ttaacctgggac

SEQ ID NO: 5808540 - DNA, 13 bp, Homo sapiens
ttaacctgggacc

SEQ ID NO: 5808541 - DNA, 20 bp, Homo sapiens
ttaacctgggcattgttgag

SEQ ID NO: 5808542 - DNA, 17 bp, Homo sapiens
ttaacctggtgctggat

SEQ ID NO: 5808543 - DNA, 17 bp, Homo sapiens
ttaacctgttttgttaa

SEQ ID NO: 5808544 - DNA, 21 bp, Homo sapiens
ttaaccttccaagactgaaga

SEQ ID NO: 5808545 - DNA, 14 bp, Homo sapiens
ttaaccttgcctta

SEQ ID NO: 5808546 - DNA, 15 bp, Homo sapiens
ttaacctttcaggaa

SEQ ID NO: 5808547 - DNA, 19 bp, Homo sapiens
ttaacctttccgctgtcgc

SEQ ID NO: 5808548 - DNA, 12 bp, Homo sapiens
ttaacctttgat

SEQ ID NO: 5808549 - DNA, 22 bp, Homo sapiens
ttaatacaaggtataataaaat

SEQ ID NO: 5808550 - DNA, 20 bp, Homo sapiens
ttaatacacagtactttatt

SEQ ID NO: 5808551 - DNA, 16 bp, Homo sapiens
ttaatacagattgaaa

SEQ ID NO: 5808552 - DNA, 14 bp, Homo sapiens
ttaatacaggaaat

SEQ ID NO: 5808553 - DNA, 20 bp, Homo sapiens
ttaatacataagttaatatt

SEQ ID NO: 5808554 - DNA, 23 bp, Homo sapiens
ttaatacatcattttttgtttct

SEQ ID NO: 5808555 - DNA, 17 bp, Homo sapiens
ttaataccaaatatttt

SEQ ID NO: 5808556 - DNA, 15 bp, Homo sapiens
ttaataccacagctt

SEQ ID NO: 5808557 - DNA, 23 bp, Homo sapiens
ttaataccagataccttatctta

SEQ ID NO: 5808558 - DNA, 17 bp, Homo sapiens
ttaatacctttaaatat

SEQ ID NO: 5808559 - DNA, 13 bp, Homo sapiens
ttaatacctttgg

SEQ ID NO: 5808560 - DNA, 20 bp, Homo sapiens
ttaatactaattttccataa

SEQ ID NO: 5808561 - DNA, 22 bp, Homo sapiens
ttaatactcaaatgagtaacat

SEQ ID NO: 5808562 - DNA, 18 bp, Homo sapiens
ttaatactcacctcctcc

SEQ ID NO: 5808563 - DNA, 20 bp, Homo sapiens
ttaatactcatccttgtata

SEQ ID NO: 5808564 - DNA, 14 bp, Homo sapiens
ttaatactgagaaa

SEQ ID NO: 5808565 - DNA, 18 bp, Homo sapiens
ttaatactgttattcttt

SEQ ID NO: 5808566 - DNA, 15 bp, Homo sapiens
ttaatacttaacatt

SEQ ID NO: 5808567 - DNA, 18 bp, Homo sapiens
ttaatacttccttataaa

SEQ ID NO: 5808568 - DNA, 13 bp, Homo sapiens
ttaatacttttcc

SEQ ID NO: 5808569 - DNA, 20 bp, Homo sapiens
ttaatagaaataaattccta

SEQ ID NO: 5808570 - DNA, 21 bp, Homo sapiens
ttaatagacagtagccaagtt

SEQ ID NO: 5808571 - DNA, 13 bp, Homo sapiens
ttaatagacattt

SEQ ID NO: 5808572 - DNA, 15 bp, Homo sapiens
ttaatagacattttt

SEQ ID NO: 5808573 - DNA, 12 bp, Homo sapiens
ttaatagacttc

SEQ ID NO: 5808574 - DNA, 17 bp, Homo sapiens
ttaatagacttctctta

SEQ ID NO: 5808575 - DNA, 20 bp, Homo sapiens
ttaatagacttctcttacat

SEQ ID NO: 5808576 - DNA, 12 bp, Homo sapiens
ttaatagagttg

SEQ ID NO: 5808577 - DNA, 20 bp, Homo sapiens
ttaatagcaaagaattgact

SEQ ID NO: 5808578 - DNA, 18 bp, Homo sapiens
ttaatagccaaagatttc

SEQ ID NO: 5808579 - DNA, 19 bp, Homo sapiens
ttaatagccaaagatttca

SEQ ID NO: 5808580 - DNA, 13 bp, Homo sapiens
ttaatagccctcc

SEQ ID NO: 5808581 - DNA, 22 bp, Homo sapiens
ttaatagcttttattgtataaa

SEQ ID NO: 5808582 - DNA, 18 bp, Homo sapiens
ttaatagcttttgattag

SEQ ID NO: 5808583 - DNA, 22 bp, Homo sapiens
ttaataggaaagatttaatgtt

SEQ ID NO: 5808584 - DNA, 17 bp, Homo sapiens
ttaataggaggacagaa

SEQ ID NO: 5808585 - DNA, 19 bp, Homo sapiens
ttaataggatgaatgggaa

SEQ ID NO: 5808586 - DNA, 17 bp, Homo sapiens
ttaatagggaatatatc

SEQ ID NO: 5808587 - DNA, 15 bp, Homo sapiens
ttaatagtaatttgt

SEQ ID NO: 5808588 - DNA, 18 bp, Homo sapiens
ttaatagtaatttgtaaa

SEQ ID NO: 5808589 - DNA, 19 bp, Homo sapiens
ttaatagtaatttgtaaag

SEQ ID NO: 5808590 - DNA, 18 bp, Homo sapiens
ttaatagtagttagctta

SEQ ID NO: 5808591 - DNA, 14 bp, Homo sapiens
ttaatagtatatct

SEQ ID NO: 5808592 - DNA, 23 bp, Homo sapiens
ttaatagtcaccttcatgattat

SEQ ID NO: 5808593 - DNA, 19 bp, Homo sapiens
ttaatagtcattccaaata

SEQ ID NO: 5808594 - DNA, 20 bp, Homo sapiens
ttaatagtctagaatgttat

SEQ ID NO: 5808595 - DNA, 23 bp, Homo sapiens
ttaatagtgtcataaagattata

SEQ ID NO: 5808596 - DNA, 21 bp, Homo sapiens
ttaatagtgttaatcaattta

SEQ ID NO: 5808597 - DNA, 14 bp, Homo sapiens
ttaatagtgttctc

SEQ ID NO: 5808598 - DNA, 19 bp, Homo sapiens
ttaatagtttctaaaccat

SEQ ID NO: 5808599 - DNA, 19 bp, Homo sapiens
ttaatagtttgaagtgcct

SEQ ID NO: 5808600 - DNA, 15 bp, Homo sapiens
ttaatagtttgtcta

SEQ ID NO: 5808601 - DNA, 16 bp, Homo sapiens
ttaatagtttgtctat

SEQ ID NO: 5808602 - DNA, 18 bp, Homo sapiens
ttaatagtttgtctattt

SEQ ID NO: 5808603 - DNA, 13 bp, Homo sapiens
ttaatataaatcg

SEQ ID NO: 5808604 - DNA, 14 bp, Homo sapiens
ttaatataaatgca

SEQ ID NO: 5808605 - DNA, 17 bp, Homo sapiens
ttaatataagtttcttt

SEQ ID NO: 5808606 - DNA, 22 bp, Homo sapiens
ttaatataatattatactgcta

SEQ ID NO: 5808607 - DNA, 14 bp, Homo sapiens
ttaatatacaatct

SEQ ID NO: 5808608 - DNA, 19 bp, Homo sapiens
ttaatataccccaaattgt

SEQ ID NO: 5808609 - DNA, 17 bp, Homo sapiens
ttaatatactaaccatt

SEQ ID NO: 5808610 - DNA, 16 bp, Homo sapiens
ttaatatactcaggga

SEQ ID NO: 5808611 - DNA, 15 bp, Homo sapiens
ttaatatactcctta

SEQ ID NO: 5808612 - DNA, 16 bp, Homo sapiens
ttaatatactccttaa

SEQ ID NO: 5808613 - DNA, 21 bp, Homo sapiens
ttaatatagtgaaatggccac

SEQ ID NO: 5808614 - DNA, 13 bp, Homo sapiens
ttaatatataatt

SEQ ID NO: 5808615 - DNA, 15 bp, Homo sapiens
ttaatatataattta

SEQ ID NO: 5808616 - DNA, 15 bp, Homo sapiens
ttaatatatgtatta

SEQ ID NO: 5808617 - DNA, 18 bp, Homo sapiens
ttaatatattaaaattcc

SEQ ID NO: 5808618 - DNA, 20 bp, Homo sapiens
ttaatatattaaaattccaa

SEQ ID NO: 5808619 - DNA, 17 bp, Homo sapiens
ttaatatattgaataaa

SEQ ID NO: 5808620 - DNA, 23 bp, Homo sapiens
ttaatatcactttggtctccatt

SEQ ID NO: 5808621 - DNA, 14 bp, Homo sapiens
ttaatatctgagaa

SEQ ID NO: 5808622 - DNA, 17 bp, Homo sapiens
ttaatatctgagaagtg

SEQ ID NO: 5808623 - DNA, 20 bp, Homo sapiens
ttaatatctgatactgtatc

SEQ ID NO: 5808624 - DNA, 19 bp, Homo sapiens
ttaatatctggcactgtta

SEQ ID NO: 5808625 - DNA, 12 bp, Homo sapiens
ttaatatgaaaa

SEQ ID NO: 5808626 - DNA, 16 bp, Homo sapiens
ttaatatgaaaactta

SEQ ID NO: 5808627 - DNA, 20 bp, Homo sapiens
ttaatatgagcttcaatata

SEQ ID NO: 5808628 - DNA, 18 bp, Homo sapiens
ttaatatgatctgtggag

SEQ ID NO: 5808629 - DNA, 22 bp, Homo sapiens
ttaatatgatctgtggagaatg

SEQ ID NO: 5808630 - DNA, 14 bp, Homo sapiens
ttaatatgattcta

SEQ ID NO: 5808631 - DNA, 13 bp, Homo sapiens
ttaatatggctct

SEQ ID NO: 5808632 - DNA, 16 bp, Homo sapiens
ttaatatgtacttttc

SEQ ID NO: 5808633 - DNA, 14 bp, Homo sapiens
ttaatatgtctttt

SEQ ID NO: 5808634 - DNA, 22 bp, Homo sapiens
ttaatattaaaaagtctgtatg

SEQ ID NO: 5808635 - DNA, 14 bp, Homo sapiens
ttaatattaaagcc

SEQ ID NO: 5808636 - DNA, 17 bp, Homo sapiens
ttaatattaaagccatg

SEQ ID NO: 5808637 - DNA, 19 bp, Homo sapiens
ttaatattaaagccatgtt

SEQ ID NO: 5808638 - DNA, 17 bp, Homo sapiens
ttaatattaactacaga

SEQ ID NO: 5808639 - DNA, 23 bp, Homo sapiens
ttaatattactgtctttattctt

SEQ ID NO: 5808640 - DNA, 14 bp, Homo sapiens
ttaatattattggg

SEQ ID NO: 5808641 - DNA, 20 bp, Homo sapiens
ttaatattctttcaataacg

SEQ ID NO: 5808642 - DNA, 16 bp, Homo sapiens
ttaatattcttttgtt

SEQ ID NO: 5808643 - DNA, 20 bp, Homo sapiens
ttaatattcttttgtttcca

SEQ ID NO: 5808644 - DNA, 17 bp, Homo sapiens
ttaatattgagaatcag

SEQ ID NO: 5808645 - DNA, 16 bp, Homo sapiens
ttaatattgatttatt

SEQ ID NO: 5808646 - DNA, 22 bp, Homo sapiens
ttaatattgtattgctgctgtg

SEQ ID NO: 5808647 - DNA, 17 bp, Homo sapiens
ttaatatttaaacagca

SEQ ID NO: 5808648 - DNA, 21 bp, Homo sapiens
ttaatatttaaacagcagtgt

SEQ ID NO: 5808649 - DNA, 12 bp, Homo sapiens
ttaatatttaac

SEQ ID NO: 5808650 - DNA, 13 bp, Homo sapiens
ttaatatttacca

SEQ ID NO: 5808651 - DNA, 19 bp, Homo sapiens
ttaatatttatgtgtttta

SEQ ID NO: 5808652 - DNA, 16 bp, Homo sapiens
ttaatatttattgaat

SEQ ID NO: 5808653 - DNA, 12 bp, Homo sapiens
ttaatatttcct

SEQ ID NO: 5808654 - DNA, 12 bp, Homo sapiens
ttaatatttctt

SEQ ID NO: 5808655 - DNA, 20 bp, Homo sapiens
ttaatatttgcacatgggat

SEQ ID NO: 5808656 - DNA, 14 bp, Homo sapiens
ttaatatttgtgct

SEQ ID NO: 5808657 - DNA, 16 bp, Homo sapiens
ttaatattttatattg

SEQ ID NO: 5808658 - DNA, 18 bp, Homo sapiens
ttaatattttatgtgtaa

SEQ ID NO: 5808659 - DNA, 16 bp, Homo sapiens
ttaatattttgtattt

SEQ ID NO: 5808660 - DNA, 19 bp, Homo sapiens
ttaatattttgttcttatt

SEQ ID NO: 5808661 - DNA, 17 bp, Homo sapiens
ttaatatttttacatgc

SEQ ID NO: 5808662 - DNA, 15 bp, Homo sapiens
ttaatatttttcaaa

SEQ ID NO: 5808663 - DNA, 16 bp, Homo sapiens
ttaatatttttcaaaa

SEQ ID NO: 5808664 - DNA, 17 bp, Homo sapiens
ttaatatttttcaaaat

SEQ ID NO: 5808665 - DNA, 19 bp, Homo sapiens
ttaatattttttcttttcc

SEQ ID NO: 5808666 - DNA, 12 bp, Homo sapiens
ttaatcaaaggc

SEQ ID NO: 5808667 - DNA, 14 bp, Homo sapiens
ttaatcaaaggcat

SEQ ID NO: 5808668 - DNA, 19 bp, Homo sapiens
ttaatcaaaggcatatctt

SEQ ID NO: 5808669 - DNA, 17 bp, Homo sapiens
ttaatcaagttgaattg

SEQ ID NO: 5808670 - DNA, 15 bp, Homo sapiens
ttaatcaatgtgaca

SEQ ID NO: 5808671 - DNA, 17 bp, Homo sapiens
ttaatcaattaattttt

SEQ ID NO: 5808672 - DNA, 19 bp, Homo sapiens
ttaatcacaaatttcactt

SEQ ID NO: 5808673 - DNA, 21 bp, Homo sapiens
ttaatcacaaatttcacttat

SEQ ID NO: 5808674 - DNA, 22 bp, Homo sapiens
ttaatcacagtcatctttaaca

SEQ ID NO: 5808675 - DNA, 20 bp, Homo sapiens
ttaatcacctctctgtagtt

SEQ ID NO: 5808676 - DNA, 14 bp, Homo sapiens
ttaatcaccttctt

SEQ ID NO: 5808677 - DNA, 17 bp, Homo sapiens
ttaatcaccttctttgt

SEQ ID NO: 5808678 - DNA, 14 bp, Homo sapiens
ttaatcactactgt

SEQ ID NO: 5808679 - DNA, 11 bp, Homo sapiens
ttaatcactgt

SEQ ID NO: 5808680 - DNA, 14 bp, Homo sapiens
ttaatcactgtgta

SEQ ID NO: 5808681 - DNA, 15 bp, Homo sapiens
ttaatcactgtgtat

SEQ ID NO: 5808682 - DNA, 18 bp, Homo sapiens
ttaatcagaaacatcatg

SEQ ID NO: 5808683 - DNA, 22 bp, Homo sapiens
ttaatcagaaaccccacttcca

SEQ ID NO: 5808684 - DNA, 18 bp, Homo sapiens
ttaatcagagtatctgaa

SEQ ID NO: 5808685 - DNA, 17 bp, Homo sapiens
ttaatcagatagatatt

SEQ ID NO: 5808686 - DNA, 13 bp, Homo sapiens
ttaatcagctgtt

SEQ ID NO: 5808687 - DNA, 16 bp, Homo sapiens
ttaatcagctgttgca

SEQ ID NO: 5808688 - DNA, 22 bp, Homo sapiens
ttaatcagctgttgcaggcagt

SEQ ID NO: 5808689 - DNA, 22 bp, Homo sapiens
ttaatcagttcattagaaatat

SEQ ID NO: 5808690 - DNA, 15 bp, Homo sapiens
ttaatcatacaaact

SEQ ID NO: 5808691 - DNA, 21 bp, Homo sapiens
ttaatcatacaaactctcacc

SEQ ID NO: 5808692 - DNA, 16 bp, Homo sapiens
ttaatcatagattatt

SEQ ID NO: 5808693 - DNA, 21 bp, Homo sapiens
ttaatcatagattattataaa

SEQ ID NO: 5808694 - DNA, 18 bp, Homo sapiens
ttaatcatagttactgtg

SEQ ID NO: 5808695 - DNA, 19 bp, Homo sapiens
ttaatcatagttactgtgt

SEQ ID NO: 5808696 - DNA, 15 bp, Homo sapiens
ttaatcatataaata

SEQ ID NO: 5808697 - DNA, 16 bp, Homo sapiens
ttaatcatataaatag

SEQ ID NO: 5808698 - DNA, 17 bp, Homo sapiens
ttaatcatataaataga

SEQ ID NO: 5808699 - DNA, 16 bp, Homo sapiens
ttaatcatatcaactt

SEQ ID NO: 5808700 - DNA, 21 bp, Homo sapiens
ttaatcatatcaacttaattc

SEQ ID NO: 5808701 - DNA, 13 bp, Homo sapiens
ttaatcatatttg

SEQ ID NO: 5808702 - DNA, 17 bp, Homo sapiens
ttaatcatatttgaaaa

SEQ ID NO: 5808703 - DNA, 23 bp, Homo sapiens
ttaatcatatttgaaaaccatat

SEQ ID NO: 5808704 - DNA, 16 bp, Homo sapiens
ttaatcatcaagagaa

SEQ ID NO: 5808705 - DNA, 21 bp, Homo sapiens
ttaatcatctataaagaagaa

SEQ ID NO: 5808706 - DNA, 13 bp, Homo sapiens
ttaatcatgaaat

SEQ ID NO: 5808707 - DNA, 18 bp, Homo sapiens
ttaatcatgaatgtgtaa

SEQ ID NO: 5808708 - DNA, 16 bp, Homo sapiens
ttaatcatgagcctgt

SEQ ID NO: 5808709 - DNA, 19 bp, Homo sapiens
ttaatcatgagcctgttta

SEQ ID NO: 5808710 - DNA, 13 bp, Homo sapiens
ttaatcattaggt

SEQ ID NO: 5808711 - DNA, 14 bp, Homo sapiens
ttaatcattatttg

SEQ ID NO: 5808712 - DNA, 16 bp, Homo sapiens
ttaatcatttccagca

SEQ ID NO: 5808713 - DNA, 12 bp, Homo sapiens
ttaatcatttta

SEQ ID NO: 5808714 - DNA, 15 bp, Homo sapiens
ttaatcattttcatt

SEQ ID NO: 5808715 - DNA, 22 bp, Homo sapiens
ttaatcattttgcctcttttct

SEQ ID NO: 5808716 - DNA, 12 bp, Homo sapiens
ttaatccagaga

SEQ ID NO: 5808717 - DNA, 20 bp, Homo sapiens
ttaatccagttataagaaga

SEQ ID NO: 5808718 - DNA, 15 bp, Homo sapiens
ttaatcccagcactt

SEQ ID NO: 5808719 - DNA, 21 bp, Homo sapiens
ttaatccccagtaaaattgcc

SEQ ID NO: 5808720 - DNA, 24 bp, Homo sapiens
ttaatcccctgcactaggcaggta

SEQ ID NO: 5808721 - DNA, 21 bp, Homo sapiens
ttaatccgtagttattttgca

SEQ ID NO: 5808722 - DNA, 17 bp, Homo sapiens
ttaatcctgtaccaaat

SEQ ID NO: 5808723 - DNA, 14 bp, Homo sapiens
ttaatccttctagt

SEQ ID NO: 5808724 - DNA, 17 bp, Homo sapiens
ttaatccttctttgtaa

SEQ ID NO: 5808725 - DNA, 18 bp, Homo sapiens
ttaatcgaaatgaattta

SEQ ID NO: 5808726 - DNA, 21 bp, Homo sapiens
ttaatcgaaatgaatttatct

SEQ ID NO: 5808727 - DNA, 23 bp, Homo sapiens
ttacacctccactcagcactctg

SEQ ID NO: 5808728 - DNA, 22 bp, Homo sapiens
ttacacctcgttagggaagaga

SEQ ID NO: 5808729 - DNA, 20 bp, Homo sapiens
ttacacctgttatggaaaat

SEQ ID NO: 5808730 - DNA, 14 bp, Homo sapiens
ttacacgagatttc

SEQ ID NO: 5808731 - DNA, 14 bp, Homo sapiens
ttacacgcttttgt

SEQ ID NO: 5808732 - DNA, 14 bp, Homo sapiens
ttacactattgtga

SEQ ID NO: 5808733 - DNA, 19 bp, Homo sapiens
ttacactcccccagcccca

SEQ ID NO: 5808734 - DNA, 20 bp, Homo sapiens
ttacactctctgtacaaaaa

SEQ ID NO: 5808735 - DNA, 21 bp, Homo sapiens
ttacactgaaatccaaaatag

SEQ ID NO: 5808736 - DNA, 13 bp, Homo sapiens
ttacactgaggac

SEQ ID NO: 5808737 - DNA, 19 bp, Homo sapiens
ttacactgcctgtatactt

SEQ ID NO: 5808738 - DNA, 22 bp, Homo sapiens
ttacactgcctgtatactttag

SEQ ID NO: 5808739 - DNA, 17 bp, Homo sapiens
ttacactgcggaagcca

SEQ ID NO: 5808740 - DNA, 19 bp, Homo sapiens
ttacactgcggaagccaaa

SEQ ID NO: 5808741 - DNA, 22 bp, Homo sapiens
ttacactgcggaagccaaaggc

SEQ ID NO: 5808742 - DNA, 22 bp, Homo sapiens
ttacactggaggagagaagaat

SEQ ID NO: 5808743 - DNA, 20 bp, Homo sapiens
ttacactggcaatggtagtt

SEQ ID NO: 5808744 - DNA, 13 bp, Homo sapiens
ttacactgggaga

SEQ ID NO: 5808745 - DNA, 13 bp, Homo sapiens
ttacactgggctg

SEQ ID NO: 5808746 - DNA, 18 bp, Homo sapiens
ttacactggtctaatgtt

SEQ ID NO: 5808747 - DNA, 21 bp, Homo sapiens
ttacactgtaccatatagcaa

SEQ ID NO: 5808748 - DNA, 21 bp, Homo sapiens
ttacactgtgccttttcccca

SEQ ID NO: 5808749 - DNA, 13 bp, Homo sapiens
ttacactgttaga

SEQ ID NO: 5808750 - DNA, 21 bp, Homo sapiens
ttacactgttattttcagcat

SEQ ID NO: 5808751 - DNA, 15 bp, Homo sapiens
ttacacttactgttg

SEQ ID NO: 5808752 - DNA, 13 bp, Homo sapiens
ttacactttatgc

SEQ ID NO: 5808753 - DNA, 23 bp, Homo sapiens
ttacactttatgccggatgtgct

SEQ ID NO: 5808754 - DNA, 14 bp, Homo sapiens
ttacactttattct

SEQ ID NO: 5808755 - DNA, 22 bp, Homo sapiens
ttacagaaaataccacctcgag

SEQ ID NO: 5808756 - DNA, 17 bp, Homo sapiens
ttacagaaaatttgcaa

SEQ ID NO: 5808757 - DNA, 14 bp, Homo sapiens
ttacagaaactgat

SEQ ID NO: 5808758 - DNA, 18 bp, Homo sapiens
ttacagaaactgatgcca

SEQ ID NO: 5808759 - DNA, 22 bp, Homo sapiens
ttacagaaagtggtgctcagtt

SEQ ID NO: 5808760 - DNA, 20 bp, Homo sapiens
ttacagaacacgctttcaca

SEQ ID NO: 5808761 - DNA, 22 bp, Homo sapiens
ttacagaagagtaaactggtga

SEQ ID NO: 5808762 - DNA, 12 bp, Homo sapiens
ttacagaagccc

SEQ ID NO: 5808763 - DNA, 20 bp, Homo sapiens
ttacagaatcttccttttat

SEQ ID NO: 5808764 - DNA, 14 bp, Homo sapiens
ttacagacagaaga

SEQ ID NO: 5808765 - DNA, 14 bp, Homo sapiens
ttacagactctgat

SEQ ID NO: 5808766 - DNA, 16 bp, Homo sapiens
ttacagactgaaaggt

SEQ ID NO: 5808767 - DNA, 19 bp, Homo sapiens
ttacagactgaaaggtgtg

SEQ ID NO: 5808768 - DNA, 17 bp, Homo sapiens
ttacagagaatttctaa

SEQ ID NO: 5808769 - DNA, 20 bp, Homo sapiens
ttacagagacagaaagcaga

SEQ ID NO: 5808770 - DNA, 16 bp, Homo sapiens
ttacagagatataaat

SEQ ID NO: 5808771 - DNA, 19 bp, Homo sapiens
ttacagagatataaatgaa

SEQ ID NO: 5808772 - DNA, 15 bp, Homo sapiens
ttacagatcatataa

SEQ ID NO: 5808773 - DNA, 20 bp, Homo sapiens
ttacagatgtagatataaat

SEQ ID NO: 5808774 - DNA, 13 bp, Homo sapiens
ttacagatgtgaa

SEQ ID NO: 5808775 - DNA, 14 bp, Homo sapiens
ttacagatgtgaaa

SEQ ID NO: 5808776 - DNA, 19 bp, Homo sapiens
ttacagatgttttccactg

SEQ ID NO: 5808777 - DNA, 20 bp, Homo sapiens
ttacagatgttttccactga

SEQ ID NO: 5808778 - DNA, 19 bp, Homo sapiens
ttacagatttattcctttg

SEQ ID NO: 5808779 - DNA, 20 bp, Homo sapiens
ttacagatttattcctttgt

SEQ ID NO: 5808780 - DNA, 15 bp, Homo sapiens
ttacagcacaaaatg

SEQ ID NO: 5808781 - DNA, 20 bp, Homo sapiens
ttacagctatgcactgtaaa

SEQ ID NO: 5808782 - DNA, 19 bp, Homo sapiens
ttacagctcattaaacttt

SEQ ID NO: 5808783 - DNA, 23 bp, Homo sapiens
ttacagctctcctccagccctgg

SEQ ID NO: 5808784 - DNA, 11 bp, Homo sapiens
ttacagctgaa

SEQ ID NO: 5808785 - DNA, 13 bp, Homo sapiens
ttacagctgcctg

SEQ ID NO: 5808786 - DNA, 21 bp, Homo sapiens
ttacagctgggtggcactgcc

SEQ ID NO: 5808787 - DNA, 14 bp, Homo sapiens
ttacagctgtgctc

SEQ ID NO: 5808788 - DNA, 21 bp, Homo sapiens
ttacaggaaaaaaaattctgt

SEQ ID NO: 5808789 - DNA, 15 bp, Homo sapiens
ttacaggaacccagc

SEQ ID NO: 5808790 - DNA, 15 bp, Homo sapiens
ttacaggaacttcat

SEQ ID NO: 5808791 - DNA, 15 bp, Homo sapiens
ttacaggaagctttt

SEQ ID NO: 5808792 - DNA, 22 bp, Homo sapiens
ttacaggaagtactggagaaaa

SEQ ID NO: 5808793 - DNA, 18 bp, Homo sapiens
ttacaggaatgaagaact

SEQ ID NO: 5808794 - DNA, 22 bp, Homo sapiens
ttacaggaatgaagaactgttg

SEQ ID NO: 5808795 - DNA, 16 bp, Homo sapiens
ttacaggacttctctt

SEQ ID NO: 5808796 - DNA, 19 bp, Homo sapiens
ttacaggacttctctttat

SEQ ID NO: 5808797 - DNA, 11 bp, Homo sapiens
ttacaggagcc

SEQ ID NO: 5808798 - DNA, 12 bp, Homo sapiens
ttacaggagcca

SEQ ID NO: 5808799 - DNA, 13 bp, Homo sapiens
ttacaggagccag

SEQ ID NO: 5808800 - DNA, 19 bp, Homo sapiens
ttacaggaggttgtggatg

SEQ ID NO: 5808801 - DNA, 17 bp, Homo sapiens
ttacaggatattccaaa

SEQ ID NO: 5808802 - DNA, 17 bp, Homo sapiens
ttacaggcacaaaatga

SEQ ID NO: 5808803 - DNA, 11 bp, Homo sapiens
ttacaggccct

SEQ ID NO: 5808804 - DNA, 18 bp, Homo sapiens
ttacaggcgtgagccact

SEQ ID NO: 5808805 - DNA, 16 bp, Homo sapiens
ttacaggctaaaatta

SEQ ID NO: 5808806 - DNA, 14 bp, Homo sapiens
ttacagggagcctc

SEQ ID NO: 5808807 - DNA, 20 bp, Homo sapiens
ttacagggcacaggccatgg

SEQ ID NO: 5808808 - DNA, 16 bp, Homo sapiens
ttacagggcccaggtg

SEQ ID NO: 5808809 - DNA, 23 bp, Homo sapiens
ttacaggggagaaggaaatgcag

SEQ ID NO: 5808810 - DNA, 22 bp, Homo sapiens
ttacagggtaactgtgctgaat

SEQ ID NO: 5808811 - DNA, 15 bp, Homo sapiens
ttacaggttcttagg

SEQ ID NO: 5808812 - DNA, 21 bp, Homo sapiens
ttacagtaaagtatagaaata

SEQ ID NO: 5808813 - DNA, 15 bp, Homo sapiens
ttacagtaaataaat

SEQ ID NO: 5808814 - DNA, 18 bp, Homo sapiens
ttacagtaaataaattgt

SEQ ID NO: 5808815 - DNA, 20 bp, Homo sapiens
ttacagtaaatacactgtga

SEQ ID NO: 5808816 - DNA, 14 bp, Homo sapiens
ttacagtaatgtca

SEQ ID NO: 5808817 - DNA, 19 bp, Homo sapiens
ttacagtaggagcccagct

SEQ ID NO: 5808818 - DNA, 17 bp, Homo sapiens
ttacagtataattaaca

SEQ ID NO: 5808819 - DNA, 20 bp, Homo sapiens
ttacagtatgatgaaaataa

SEQ ID NO: 5808820 - DNA, 17 bp, Homo sapiens
ttacagtatgcttgctc

SEQ ID NO: 5808821 - DNA, 14 bp, Homo sapiens
ttacagtatttcta

SEQ ID NO: 5808822 - DNA, 18 bp, Homo sapiens
ttacagtatttttctgtg

SEQ ID NO: 5808823 - DNA, 16 bp, Homo sapiens
ttacagtccttcaaaa

SEQ ID NO: 5808824 - DNA, 17 bp, Homo sapiens
ttacagtccttcaaaat

SEQ ID NO: 5808825 - DNA, 15 bp, Homo sapiens
ttacagtctatttga

SEQ ID NO: 5808826 - DNA, 16 bp, Homo sapiens
ttacagtgaagatgtt

SEQ ID NO: 5808827 - DNA, 19 bp, Homo sapiens
ttacagtgaccttttcttc

SEQ ID NO: 5808828 - DNA, 12 bp, Homo sapiens
ttacagtgactg

SEQ ID NO: 5808829 - DNA, 14 bp, Homo sapiens
ttacagtgcagtgc

SEQ ID NO: 5808830 - DNA, 17 bp, Homo sapiens
ttacagtggcagtattg

SEQ ID NO: 5808831 - DNA, 20 bp, Homo sapiens
ttacagtggcagtattgaca

SEQ ID NO: 5808832 - DNA, 16 bp, Homo sapiens
ttacagtgtatttaag

SEQ ID NO: 5808833 - DNA, 18 bp, Homo sapiens
ttacagttaaagaagcaa

SEQ ID NO: 5808834 - DNA, 16 bp, Homo sapiens
ttacagttacttttcc

SEQ ID NO: 5808835 - DNA, 18 bp, Homo sapiens
ttacagttacttttcctt

SEQ ID NO: 5808836 - DNA, 21 bp, Homo sapiens
ttacagttagggttttgcaat

SEQ ID NO: 5808837 - DNA, 13 bp, Homo sapiens
ttacagttatcct

SEQ ID NO: 5808838 - DNA, 11 bp, Homo sapiens
ttacagttctg

SEQ ID NO: 5808839 - DNA, 18 bp, Homo sapiens
ttacagttctggaggagg

SEQ ID NO: 5808840 - DNA, 13 bp, Homo sapiens
ttacagttctgtg

SEQ ID NO: 5808841 - DNA, 13 bp, Homo sapiens
ttacagttgatgt

SEQ ID NO: 5808842 - DNA, 21 bp, Homo sapiens
ttacagtttgtgctctactgt

SEQ ID NO: 5808843 - DNA, 17 bp, Homo sapiens
ttacataaagctccctt

SEQ ID NO: 5808844 - DNA, 19 bp, Homo sapiens
ttacataactgatctattt

SEQ ID NO: 5808845 - DNA, 17 bp, Homo sapiens
ttacataagagaaagag

SEQ ID NO: 5808846 - DNA, 23 bp, Homo sapiens
ttacataagagaaagaggccaga

SEQ ID NO: 5808847 - DNA, 23 bp, Homo sapiens
ttacataatcagtatatttggtt

SEQ ID NO: 5808848 - DNA, 21 bp, Homo sapiens
ttacataatctgtacaatgaa

SEQ ID NO: 5808849 - DNA, 19 bp, Homo sapiens
ttacataattgccaataat

SEQ ID NO: 5808850 - DNA, 16 bp, Homo sapiens
ttacataatttgcaat

SEQ ID NO: 5808851 - DNA, 16 bp, Homo sapiens
ttacatactttatcaa

SEQ ID NO: 5808852 - DNA, 21 bp, Homo sapiens
ttacatactttatcaatgtgt

SEQ ID NO: 5808853 - DNA, 24 bp, Homo sapiens
ttacatactttatcaatgtgtctt

SEQ ID NO: 5808854 - DNA, 15 bp, Homo sapiens
ttacatacttttgca

SEQ ID NO: 5808855 - DNA, 15 bp, Homo sapiens
ttacatagaacactt

SEQ ID NO: 5808856 - DNA, 17 bp, Homo sapiens
ttacatagacttaggca

SEQ ID NO: 5808857 - DNA, 19 bp, Homo sapiens
ttacatagacttaggcatt

SEQ ID NO: 5808858 - DNA, 13 bp, Homo sapiens
ttacataggatta

SEQ ID NO: 5808859 - DNA, 13 bp, Homo sapiens
ttacatagtctga

SEQ ID NO: 5808860 - DNA, 19 bp, Homo sapiens
ttacatagttgagattgta

SEQ ID NO: 5808861 - DNA, 21 bp, Homo sapiens
ttacatatctgtcccctgcta

SEQ ID NO: 5808862 - DNA, 19 bp, Homo sapiens
ttacatatgtatacatgtg

SEQ ID NO: 5808863 - DNA, 12 bp, Homo sapiens
ttacatcacttt

SEQ ID NO: 5808864 - DNA, 23 bp, Homo sapiens
ttacatcactttgtgaattaaca

SEQ ID NO: 5808865 - DNA, 15 bp, Homo sapiens
ttacatcagaagttt

SEQ ID NO: 5808866 - DNA, 17 bp, Homo sapiens
ttacatcagtagcattt

SEQ ID NO: 5808867 - DNA, 18 bp, Homo sapiens
ttacatcagtagcatttt

SEQ ID NO: 5808868 - DNA, 13 bp, Homo sapiens
ttacatccagagt

SEQ ID NO: 5808869 - DNA, 18 bp, Homo sapiens
ttacatcccataacttgt

SEQ ID NO: 5808870 - DNA, 17 bp, Homo sapiens
ttacatccgctttatgg

SEQ ID NO: 5808871 - DNA, 21 bp, Homo sapiens
ttacatccgtaggacaagttt

SEQ ID NO: 5808872 - DNA, 13 bp, Homo sapiens
ttacatccttaaa

SEQ ID NO: 5808873 - DNA, 17 bp, Homo sapiens
ttacatccttgtggcac

SEQ ID NO: 5808874 - DNA, 21 bp, Homo sapiens
ttacatccttgtggcacattt

SEQ ID NO: 5808875 - DNA, 20 bp, Homo sapiens
ttacatctctaattttggat

SEQ ID NO: 5808876 - DNA, 13 bp, Homo sapiens
ttacatctgcctt

SEQ ID NO: 5808877 - DNA, 14 bp, Homo sapiens
ttacatctgcctta

SEQ ID NO: 5808878 - DNA, 15 bp, Homo sapiens
ttacatctgccttaa

SEQ ID NO: 5808879 - DNA, 15 bp, Homo sapiens
ttacatcttctgtga

SEQ ID NO: 5808880 - DNA, 21 bp, Homo sapiens
ttacatcttctgtgaaatata

SEQ ID NO: 5808881 - DNA, 14 bp, Homo sapiens
ttacatgaagtatt

SEQ ID NO: 5808882 - DNA, 14 bp, Homo sapiens
ttacatgacacagc

SEQ ID NO: 5808883 - DNA, 14 bp, Homo sapiens
ttacatgatttaaa

SEQ ID NO: 5808884 - DNA, 20 bp, Homo sapiens
ttacatgatttaaagactac

SEQ ID NO: 5808885 - DNA, 13 bp, Homo sapiens
ttacatgcatgag

SEQ ID NO: 5808886 - DNA, 17 bp, Homo sapiens
ttacatgcatgagcacc

SEQ ID NO: 5808887 - DNA, 13 bp, Homo sapiens
ttacatgcatttg

SEQ ID NO: 5808888 - DNA, 16 bp, Homo sapiens
ttacatgctactaaat

SEQ ID NO: 5808889 - DNA, 19 bp, Homo sapiens
ttacatgctgctatacaca

SEQ ID NO: 5808890 - DNA, 19 bp, Homo sapiens
ttacatgctgtgctctttg

SEQ ID NO: 5808891 - DNA, 13 bp, Homo sapiens
ttacatgcttatt

SEQ ID NO: 5808892 - DNA, 17 bp, Homo sapiens
ttacatggacagaattt

SEQ ID NO: 5808893 - DNA, 22 bp, Homo sapiens
ttacatggttaaggtaaagtaa

SEQ ID NO: 5808894 - DNA, 17 bp, Homo sapiens
ttacatgtaaagctgtt

SEQ ID NO: 5808895 - DNA, 15 bp, Homo sapiens
ttacatgtaaattaa

SEQ ID NO: 5808896 - DNA, 17 bp, Homo sapiens
ttacatgtataaagtga

SEQ ID NO: 5808897 - DNA, 21 bp, Homo sapiens
ttacatgtataaagtgattga

SEQ ID NO: 5808898 - DNA, 18 bp, Homo sapiens
ttacatgtgtagcctatg

SEQ ID NO: 5808899 - DNA, 13 bp, Homo sapiens
ttacatgtgttta

SEQ ID NO: 5808900 - DNA, 12 bp, Homo sapiens
ttacatgtttgc

SEQ ID NO: 5808901 - DNA, 12 bp, Homo sapiens
ttacatgttttc

SEQ ID NO: 5808902 - DNA, 22 bp, Homo sapiens
ttacattaaaaagccttacagt

SEQ ID NO: 5808903 - DNA, 18 bp, Homo sapiens
ttacattaaaacaaaaaa

SEQ ID NO: 5808904 - DNA, 17 bp, Homo sapiens
ttacattaatgcccagc

SEQ ID NO: 5808905 - DNA, 16 bp, Homo sapiens
ttactcagcccagctg

SEQ ID NO: 5808906 - DNA, 16 bp, Homo sapiens
ttactcaggctttcta

SEQ ID NO: 5808907 - DNA, 18 bp, Homo sapiens
ttactcaggctttctatt

SEQ ID NO: 5808908 - DNA, 12 bp, Homo sapiens
ttactcagggtt

SEQ ID NO: 5808909 - DNA, 14 bp, Homo sapiens
ttactcagggttca

SEQ ID NO: 5808910 - DNA, 19 bp, Homo sapiens
ttactcatcgggcccaggg

SEQ ID NO: 5808911 - DNA, 23 bp, Homo sapiens
ttactcattactgcaaattgatt

SEQ ID NO: 5808912 - DNA, 17 bp, Homo sapiens
ttactcattatcgcctt

SEQ ID NO: 5808913 - DNA, 13 bp, Homo sapiens
ttactcattgaaa

SEQ ID NO: 5808914 - DNA, 16 bp, Homo sapiens
ttactcattgaaatgt

SEQ ID NO: 5808915 - DNA, 19 bp, Homo sapiens
ttactcattgaaatgtcac

SEQ ID NO: 5808916 - DNA, 19 bp, Homo sapiens
ttactcattgcccccacct

SEQ ID NO: 5808917 - DNA, 22 bp, Homo sapiens
ttactcattgcccccacctctg

SEQ ID NO: 5808918 - DNA, 21 bp, Homo sapiens
ttactccaaggtttataaagc

SEQ ID NO: 5808919 - DNA, 16 bp, Homo sapiens
ttactcccccaccact

SEQ ID NO: 5808920 - DNA, 20 bp, Homo sapiens
ttactcccccaccactcagg

SEQ ID NO: 5808921 - DNA, 19 bp, Homo sapiens
ttactcccctggctggaaa

SEQ ID NO: 5808922 - DNA, 18 bp, Homo sapiens
ttactccctacactgatg

SEQ ID NO: 5808923 - DNA, 19 bp, Homo sapiens
ttactccctacactgatgc

SEQ ID NO: 5808924 - DNA, 21 bp, Homo sapiens
ttactccctacactgatgcaa

SEQ ID NO: 5808925 - DNA, 20 bp, Homo sapiens
ttactccctatagagaaacc

SEQ ID NO: 5808926 - DNA, 16 bp, Homo sapiens
ttactcccttcctggc

SEQ ID NO: 5808927 - DNA, 18 bp, Homo sapiens
ttactcccttcctggcct

SEQ ID NO: 5808928 - DNA, 19 bp, Homo sapiens
ttactcccttctcgtgttt

SEQ ID NO: 5808929 - DNA, 22 bp, Homo sapiens
ttactcctatttttgtaaactg

SEQ ID NO: 5808930 - DNA, 12 bp, Homo sapiens
ttactcctccat

SEQ ID NO: 5808931 - DNA, 12 bp, Homo sapiens
ttactcctcctc

SEQ ID NO: 5808932 - DNA, 13 bp, Homo sapiens
ttactcctcctgc

SEQ ID NO: 5808933 - DNA, 21 bp, Homo sapiens
ttactcctgaagtgagtttta

SEQ ID NO: 5808934 - DNA, 19 bp, Homo sapiens
ttactcctgtgggagcctc

SEQ ID NO: 5808935 - DNA, 15 bp, Homo sapiens
ttactcctttgcatt

SEQ ID NO: 5808936 - DNA, 21 bp, Homo sapiens
ttactcgatcaaaaccttcct

SEQ ID NO: 5808937 - DNA, 12 bp, Homo sapiens
ttactctaagat

SEQ ID NO: 5808938 - DNA, 19 bp, Homo sapiens
ttactctaagatcttagat

SEQ ID NO: 5808939 - DNA, 14 bp, Homo sapiens
ttactctattgata

SEQ ID NO: 5808940 - DNA, 19 bp, Homo sapiens
ttactctccaacctggaca

SEQ ID NO: 5808941 - DNA, 12 bp, Homo sapiens
ttactctcttca

SEQ ID NO: 5808942 - DNA, 14 bp, Homo sapiens
ttactctgcctaca

SEQ ID NO: 5808943 - DNA, 20 bp, Homo sapiens
ttactctgcctgtcaagttt

SEQ ID NO: 5808944 - DNA, 19 bp, Homo sapiens
ttactctgtctcccaggct

SEQ ID NO: 5808945 - DNA, 23 bp, Homo sapiens
ttactctgtgctaagttgtctta

SEQ ID NO: 5808946 - DNA, 17 bp, Homo sapiens
ttactctgtgtaaagac

SEQ ID NO: 5808947 - DNA, 13 bp, Homo sapiens
ttactctgttgaa

SEQ ID NO: 5808948 - DNA, 22 bp, Homo sapiens
ttactcttaaatcatttggtta

SEQ ID NO: 5808949 - DNA, 14 bp, Homo sapiens
ttactcttagagat

SEQ ID NO: 5808950 - DNA, 23 bp, Homo sapiens
ttactcttcagttaagcctttgg

SEQ ID NO: 5808951 - DNA, 12 bp, Homo sapiens
ttactcttggga

SEQ ID NO: 5808952 - DNA, 14 bp, Homo sapiens
ttactcttgtaaga

SEQ ID NO: 5808953 - DNA, 22 bp, Homo sapiens
ttactcttgtaagattttgaaa

SEQ ID NO: 5808954 - DNA, 19 bp, Homo sapiens
ttactctttcatgccattt

SEQ ID NO: 5808955 - DNA, 14 bp, Homo sapiens
ttactctttttcaa

SEQ ID NO: 5808956 - DNA, 21 bp, Homo sapiens
ttactctttttctaaagtgtt

SEQ ID NO: 5808957 - DNA, 18 bp, Homo sapiens
ttactgaaaaaggtgatt

SEQ ID NO: 5808958 - DNA, 13 bp, Homo sapiens
ttactgaaagaca

SEQ ID NO: 5808959 - DNA, 23 bp, Homo sapiens
ttactgaaatcttgtaagtattt

SEQ ID NO: 5808960 - DNA, 15 bp, Homo sapiens
ttactgaacagtaac

SEQ ID NO: 5808961 - DNA, 23 bp, Homo sapiens
ttactgaacagtaacatagctgt

SEQ ID NO: 5808962 - DNA, 15 bp, Homo sapiens
ttactgaagccttac

SEQ ID NO: 5808963 - DNA, 19 bp, Homo sapiens
ttactgaagccttacaagg

SEQ ID NO: 5808964 - DNA, 18 bp, Homo sapiens
ttactgaaggtaaaattg

SEQ ID NO: 5808965 - DNA, 19 bp, Homo sapiens
ttactgaaggtaaaattga

SEQ ID NO: 5808966 - DNA, 16 bp, Homo sapiens
ttactgaataatatca

SEQ ID NO: 5808967 - DNA, 13 bp, Homo sapiens
ttactgaatgatc

SEQ ID NO: 5808968 - DNA, 12 bp, Homo sapiens
ttactgaatgca

SEQ ID NO: 5808969 - DNA, 23 bp, Homo sapiens
ttactgaatgcaccatggtcaaa

SEQ ID NO: 5808970 - DNA, 18 bp, Homo sapiens
ttactgaatgttagaaga

SEQ ID NO: 5808971 - DNA, 14 bp, Homo sapiens
ttactgaattgtat

SEQ ID NO: 5808972 - DNA, 18 bp, Homo sapiens
ttactgaatttttaaaat

SEQ ID NO: 5808973 - DNA, 21 bp, Homo sapiens
ttactgacatggtgctgtgtg

SEQ ID NO: 5808974 - DNA, 14 bp, Homo sapiens
ttactgacatttct

SEQ ID NO: 5808975 - DNA, 18 bp, Homo sapiens
ttactgagacttcgaaga

SEQ ID NO: 5808976 - DNA, 18 bp, Homo sapiens
ttactgagcttctctgtg

SEQ ID NO: 5808977 - DNA, 20 bp, Homo sapiens
ttactgaggaaatatttcca

SEQ ID NO: 5808978 - DNA, 18 bp, Homo sapiens
ttactgataaacctaata

SEQ ID NO: 5808979 - DNA, 14 bp, Homo sapiens
ttactgatatattt

SEQ ID NO: 5808980 - DNA, 23 bp, Homo sapiens
ttactgatatattttacaatttt

SEQ ID NO: 5808981 - DNA, 17 bp, Homo sapiens
ttactgatcatctgctg

SEQ ID NO: 5808982 - DNA, 13 bp, Homo sapiens
ttactgatcatgc

SEQ ID NO: 5808983 - DNA, 17 bp, Homo sapiens
ttactgatcatgcattg

SEQ ID NO: 5808984 - DNA, 21 bp, Homo sapiens
ttactgatcatgcattgttga

SEQ ID NO: 5808985 - DNA, 15 bp, Homo sapiens
ttactgatgagagaa

SEQ ID NO: 5808986 - DNA, 20 bp, Homo sapiens
ttactgattaacaaataaat

SEQ ID NO: 5808987 - DNA, 15 bp, Homo sapiens
ttactgatttagaag

SEQ ID NO: 5808988 - DNA, 18 bp, Homo sapiens
ttactgatttagaagcaa

SEQ ID NO: 5808989 - DNA, 18 bp, Homo sapiens
ttactgcaaatgtcatca

SEQ ID NO: 5808990 - DNA, 16 bp, Homo sapiens
ttactgcagcctgggc

SEQ ID NO: 5808991 - DNA, 21 bp, Homo sapiens
ttactgcatggggaaagagat

SEQ ID NO: 5808992 - DNA, 15 bp, Homo sapiens
ttactgcattttcac

SEQ ID NO: 5808993 - DNA, 18 bp, Homo sapiens
ttactgcattttcacaac

SEQ ID NO: 5808994 - DNA, 22 bp, Homo sapiens
ttactgccctttcaaagcactt

SEQ ID NO: 5808995 - DNA, 22 bp, Homo sapiens
ttactgcctataatcttataca

SEQ ID NO: 5808996 - DNA, 12 bp, Homo sapiens
ttactgcctttg

SEQ ID NO: 5808997 - DNA, 21 bp, Homo sapiens
ttactgctaagtatttcccag

SEQ ID NO: 5808998 - DNA, 23 bp, Homo sapiens
ttactgctaagtatttcccagca

SEQ ID NO: 5808999 - DNA, 15 bp, Homo sapiens
ttactgctctgagaa

SEQ ID NO: 5809000 - DNA, 18 bp, Homo sapiens
ttactgctgattcttgta

SEQ ID NO: 5809001 - DNA, 20 bp, Homo sapiens
ttactgctgattcttgtaaa

SEQ ID NO: 5809002 - DNA, 17 bp, Homo sapiens
ttactgctgctgtgctt

SEQ ID NO: 5809003 - DNA, 14 bp, Homo sapiens
ttactgcttcattt

SEQ ID NO: 5809004 - DNA, 15 bp, Homo sapiens
ttactgcttcatttt

SEQ ID NO: 5809005 - DNA, 22 bp, Homo sapiens
ttactgcttcccattgagtaat

SEQ ID NO: 5809006 - DNA, 14 bp, Homo sapiens
ttactgctttctga

SEQ ID NO: 5809007 - DNA, 20 bp, Homo sapiens
ttactgcttttcattagcag

SEQ ID NO: 5809008 - DNA, 18 bp, Homo sapiens
ttactggaaactaattgt

SEQ ID NO: 5809009 - DNA, 20 bp, Homo sapiens
ttactggagccatgtctaca

SEQ ID NO: 5809010 - DNA, 16 bp, Homo sapiens
ttactggataaattgt

SEQ ID NO: 5809011 - DNA, 15 bp, Homo sapiens
ttactggcactgtgg

SEQ ID NO: 5809012 - DNA, 23 bp, Homo sapiens
ttactggcactgtggcactgcca

SEQ ID NO: 5809013 - DNA, 18 bp, Homo sapiens
ttactggccttttcactg

SEQ ID NO: 5809014 - DNA, 23 bp, Homo sapiens
ttactgggccttagtgggccagg

SEQ ID NO: 5809015 - DNA, 18 bp, Homo sapiens
ttactggggcctggggct

SEQ ID NO: 5809016 - DNA, 22 bp, Homo sapiens
ttactggggctggggaaggaag

SEQ ID NO: 5809017 - DNA, 23 bp, Homo sapiens
ttactggggctggggaaggaagc

SEQ ID NO: 5809018 - DNA, 17 bp, Homo sapiens
ttactgggtaggttctg

SEQ ID NO: 5809019 - DNA, 23 bp, Homo sapiens
ttactgggtaggttctgaacagc

SEQ ID NO: 5809020 - DNA, 15 bp, Homo sapiens
ttactggtccaaaag

SEQ ID NO: 5809021 - DNA, 17 bp, Homo sapiens
ttactgtaagacattag

SEQ ID NO: 5809022 - DNA, 12 bp, Homo sapiens
ttactgtaatat

SEQ ID NO: 5809023 - DNA, 15 bp, Homo sapiens
ttactgtaattcctc

SEQ ID NO: 5809024 - DNA, 12 bp, Homo sapiens
ttactgtacatg

SEQ ID NO: 5809025 - DNA, 19 bp, Homo sapiens
ttactgtatcaatttctaa

SEQ ID NO: 5809026 - DNA, 12 bp, Homo sapiens
ttactgtatgta

SEQ ID NO: 5809027 - DNA, 16 bp, Homo sapiens
ttactgtatgttttta

SEQ ID NO: 5809028 - DNA, 19 bp, Homo sapiens
ttactgtatttaagaaaac

SEQ ID NO: 5809029 - DNA, 18 bp, Homo sapiens
ttactgtatttttcagaa

SEQ ID NO: 5809030 - DNA, 13 bp, Homo sapiens
ttactgtcaataa

SEQ ID NO: 5809031 - DNA, 14 bp, Homo sapiens
ttactgtcaataaa

SEQ ID NO: 5809032 - DNA, 15 bp, Homo sapiens
ttactgtcaataaac

SEQ ID NO: 5809033 - DNA, 15 bp, Homo sapiens
ttactgtcagattaa

SEQ ID NO: 5809034 - DNA, 12 bp, Homo sapiens
ttactgtcattc

SEQ ID NO: 5809035 - DNA, 13 bp, Homo sapiens
ttactgtcccagg

SEQ ID NO: 5809036 - DNA, 19 bp, Homo sapiens
ttactgtccccttgatata

SEQ ID NO: 5809037 - DNA, 23 bp, Homo sapiens
ttactgtctcactcgttctgtta

SEQ ID NO: 5809038 - DNA, 14 bp, Homo sapiens
ttactgtctgtaag

SEQ ID NO: 5809039 - DNA, 14 bp, Homo sapiens
ttactgtctgtagt

SEQ ID NO: 5809040 - DNA, 18 bp, Homo sapiens
ttactgtctgtagtgttt

SEQ ID NO: 5809041 - DNA, 17 bp, Homo sapiens
ttactgtcttttctatt

SEQ ID NO: 5809042 - DNA, 14 bp, Homo sapiens
ttactgtgaaactg

SEQ ID NO: 5809043 - DNA, 14 bp, Homo sapiens
ttactgtgaagaga

SEQ ID NO: 5809044 - DNA, 18 bp, Homo sapiens
ttactgtgaggagtctgg

SEQ ID NO: 5809045 - DNA, 15 bp, Homo sapiens
ttactgtgatttctg

SEQ ID NO: 5809046 - DNA, 15 bp, Homo sapiens
ttactgtggaggtgg

SEQ ID NO: 5809047 - DNA, 15 bp, Homo sapiens
ttactgtggctgtct

SEQ ID NO: 5809048 - DNA, 16 bp, Homo sapiens
ttactgtggcttctta

SEQ ID NO: 5809049 - DNA, 12 bp, Homo sapiens
ttactgtgtaaa

SEQ ID NO: 5809050 - DNA, 19 bp, Homo sapiens
ttactgtgtaaatatatgt

SEQ ID NO: 5809051 - DNA, 13 bp, Homo sapiens
ttactgtgtatct

SEQ ID NO: 5809052 - DNA, 11 bp, Homo sapiens
ttactgtgtta

SEQ ID NO: 5809053 - DNA, 20 bp, Homo sapiens
ttactgtgttttataaaata

SEQ ID NO: 5809054 - DNA, 18 bp, Homo sapiens
ttactgttaaaactgtac

SEQ ID NO: 5809055 - DNA, 16 bp, Homo sapiens
ttactgttatagaata

SEQ ID NO: 5809056 - DNA, 22 bp, Homo sapiens
ttactgttctgaaattaggaaa

SEQ ID NO: 5809057 - DNA, 11 bp, Homo sapiens
ttactgttctt

SEQ ID NO: 5809058 - DNA, 19 bp, Homo sapiens
ttactgttgtacaatcatg

SEQ ID NO: 5809059 - DNA, 21 bp, Homo sapiens
ttactgttgtacaatcatgtt

SEQ ID NO: 5809060 - DNA, 14 bp, Homo sapiens
ttactgttgtgacc

SEQ ID NO: 5809061 - DNA, 15 bp, Homo sapiens
ttactgttgtgacct

SEQ ID NO: 5809062 - DNA, 15 bp, Homo sapiens
ttactgtttatttct

SEQ ID NO: 5809063 - DNA, 13 bp, Homo sapiens
ttactgtttctaa

SEQ ID NO: 5809064 - DNA, 21 bp, Homo sapiens
ttactgtttctcaagtgtttt

SEQ ID NO: 5809065 - DNA, 15 bp, Homo sapiens
ttactgtttctgtca

SEQ ID NO: 5809066 - DNA, 22 bp, Homo sapiens
ttactgtttgtcttctccccag

SEQ ID NO: 5809067 - DNA, 21 bp, Homo sapiens
ttactgttttaattgtagttc

SEQ ID NO: 5809068 - DNA, 16 bp, Homo sapiens
ttactgttttgaggaa

SEQ ID NO: 5809069 - DNA, 19 bp, Homo sapiens
ttacttaagattcagtttt

SEQ ID NO: 5809070 - DNA, 20 bp, Homo sapiens
ttacttaaggcagtatcctt

SEQ ID NO: 5809071 - DNA, 13 bp, Homo sapiens
ttacttaagtgtt

SEQ ID NO: 5809072 - DNA, 14 bp, Homo sapiens
ttacttaagtgttc

SEQ ID NO: 5809073 - DNA, 17 bp, Homo sapiens
ttacttaagtgttcatt

SEQ ID NO: 5809074 - DNA, 16 bp, Homo sapiens
ttacttaatcaaaact

SEQ ID NO: 5809075 - DNA, 12 bp, Homo sapiens
ttacttaatgtg

SEQ ID NO: 5809076 - DNA, 11 bp, Homo sapiens
ttacttacaaa

SEQ ID NO: 5809077 - DNA, 20 bp, Homo sapiens
ttacttactgttaaaactgt

SEQ ID NO: 5809078 - DNA, 23 bp, Homo sapiens
ttacttagaatgccataaaattg

SEQ ID NO: 5809079 - DNA, 16 bp, Homo sapiens
ttacttagaatttatc

SEQ ID NO: 5809080 - DNA, 20 bp, Homo sapiens
ttacttagaggaaataagaa

SEQ ID NO: 5809081 - DNA, 12 bp, Homo sapiens
ttacttaggact

SEQ ID NO: 5809082 - DNA, 19 bp, Homo sapiens
ttacttaggttattttgct

SEQ ID NO: 5809083 - DNA, 13 bp, Homo sapiens
ttacttagtattg

SEQ ID NO: 5809084 - DNA, 21 bp, Homo sapiens
ttagaggtgagttttaaagaa

SEQ ID NO: 5809085 - DNA, 16 bp, Homo sapiens
ttagaggttaatcaga

SEQ ID NO: 5809086 - DNA, 14 bp, Homo sapiens
ttagaggtttgtca

SEQ ID NO: 5809087 - DNA, 13 bp, Homo sapiens
ttagaggttttaa

SEQ ID NO: 5809088 - DNA, 13 bp, Homo sapiens
ttagagtaaataa

SEQ ID NO: 5809089 - DNA, 17 bp, Homo sapiens
ttagagtaaataaactg

SEQ ID NO: 5809090 - DNA, 23 bp, Homo sapiens
ttagagtaaataaactgtttata

SEQ ID NO: 5809091 - DNA, 15 bp, Homo sapiens
ttagagtaagaaatt

SEQ ID NO: 5809092 - DNA, 22 bp, Homo sapiens
ttagagtatgcaagaagaatat

SEQ ID NO: 5809093 - DNA, 18 bp, Homo sapiens
ttagagtcgtcactctct

SEQ ID NO: 5809094 - DNA, 12 bp, Homo sapiens
ttagagtgccca

SEQ ID NO: 5809095 - DNA, 17 bp, Homo sapiens
ttagagtgcccagcaga

SEQ ID NO: 5809096 - DNA, 20 bp, Homo sapiens
ttagagtgcccttaaaataa

SEQ ID NO: 5809097 - DNA, 15 bp, Homo sapiens
ttagagtgtagctgt

SEQ ID NO: 5809098 - DNA, 17 bp, Homo sapiens
ttagagtgtctttccac

SEQ ID NO: 5809099 - DNA, 18 bp, Homo sapiens
ttagagttagactgttgg

SEQ ID NO: 5809100 - DNA, 16 bp, Homo sapiens
ttagagttcttctttc

SEQ ID NO: 5809101 - DNA, 14 bp, Homo sapiens
ttagagttgatact

SEQ ID NO: 5809102 - DNA, 15 bp, Homo sapiens
ttagagtttctgttt

SEQ ID NO: 5809103 - DNA, 17 bp, Homo sapiens
ttagagtttctgtttga

SEQ ID NO: 5809104 - DNA, 18 bp, Homo sapiens
ttagagtttctgtttgat

SEQ ID NO: 5809105 - DNA, 22 bp, Homo sapiens
ttagagttttttttttctttca

SEQ ID NO: 5809106 - DNA, 19 bp, Homo sapiens
ttagataaacacaggcagg

SEQ ID NO: 5809107 - DNA, 17 bp, Homo sapiens
ttagataaagatttcta

SEQ ID NO: 5809108 - DNA, 19 bp, Homo sapiens
ttagataaagatttctagt

SEQ ID NO: 5809109 - DNA, 20 bp, Homo sapiens
ttagataaccatattcacaa

SEQ ID NO: 5809110 - DNA, 24 bp, Homo sapiens
ttagataacgcttaaaggaagtca

SEQ ID NO: 5809111 - DNA, 21 bp, Homo sapiens
ttagataataactgtcttctg

SEQ ID NO: 5809112 - DNA, 20 bp, Homo sapiens
ttagatacactaaaaatctg

SEQ ID NO: 5809113 - DNA, 18 bp, Homo sapiens
ttagatacacttcttaaa

SEQ ID NO: 5809114 - DNA, 14 bp, Homo sapiens
ttagatacagtagt

SEQ ID NO: 5809115 - DNA, 13 bp, Homo sapiens
ttagatagaaaag

SEQ ID NO: 5809116 - DNA, 17 bp, Homo sapiens
ttagatagccctgtcct

SEQ ID NO: 5809117 - DNA, 22 bp, Homo sapiens
ttagatagtcatgctgctagat

SEQ ID NO: 5809118 - DNA, 21 bp, Homo sapiens
ttagatatataactttagaaa

SEQ ID NO: 5809119 - DNA, 16 bp, Homo sapiens
ttagatatctttttat

SEQ ID NO: 5809120 - DNA, 23 bp, Homo sapiens
ttagatatctttttattgatgtg

SEQ ID NO: 5809121 - DNA, 21 bp, Homo sapiens
ttagatattcatactttccaa

SEQ ID NO: 5809122 - DNA, 20 bp, Homo sapiens
ttagatattgctactataat

SEQ ID NO: 5809123 - DNA, 22 bp, Homo sapiens
ttagatattgctactataatca

SEQ ID NO: 5809124 - DNA, 19 bp, Homo sapiens
ttagatattttccatatat

SEQ ID NO: 5809125 - DNA, 22 bp, Homo sapiens
ttagatattttccatatattgg

SEQ ID NO: 5809126 - DNA, 19 bp, Homo sapiens
ttagatcaaggcaaaaata

SEQ ID NO: 5809127 - DNA, 18 bp, Homo sapiens
ttagatcccatatttact

SEQ ID NO: 5809128 - DNA, 22 bp, Homo sapiens
ttagatctaaacagttatttct

SEQ ID NO: 5809129 - DNA, 14 bp, Homo sapiens
ttagatctagttca

SEQ ID NO: 5809130 - DNA, 14 bp, Homo sapiens
ttagatctgagccc

SEQ ID NO: 5809131 - DNA, 20 bp, Homo sapiens
ttagatgcagttctgaagaa

SEQ ID NO: 5809132 - DNA, 22 bp, Homo sapiens
ttagatgcagttctgaagaaga

SEQ ID NO: 5809133 - DNA, 16 bp, Homo sapiens
ttagatgctctgagaa

SEQ ID NO: 5809134 - DNA, 17 bp, Homo sapiens
ttagatgctctgagaaa

SEQ ID NO: 5809135 - DNA, 20 bp, Homo sapiens
ttagatgggaagcctgtgta

SEQ ID NO: 5809136 - DNA, 13 bp, Homo sapiens
ttagatggttaca

SEQ ID NO: 5809137 - DNA, 21 bp, Homo sapiens
ttagatgtagatatttgaaat

SEQ ID NO: 5809138 - DNA, 13 bp, Homo sapiens
ttagatgtgattt

SEQ ID NO: 5809139 - DNA, 22 bp, Homo sapiens
ttagatgtgccaataaccaagt

SEQ ID NO: 5809140 - DNA, 18 bp, Homo sapiens
ttagatgtgctgctttga

SEQ ID NO: 5809141 - DNA, 20 bp, Homo sapiens
ttagatgtgctgctttgata

SEQ ID NO: 5809142 - DNA, 18 bp, Homo sapiens
ttagatgtgtatacagaa

SEQ ID NO: 5809143 - DNA, 22 bp, Homo sapiens
ttagatgttccagtaatctaat

SEQ ID NO: 5809144 - DNA, 22 bp, Homo sapiens
ttagatgttctctatcatttaa

SEQ ID NO: 5809145 - DNA, 19 bp, Homo sapiens
ttagatgttgccatgtgtt

SEQ ID NO: 5809146 - DNA, 21 bp, Homo sapiens
ttagatgttttgggatcagga

SEQ ID NO: 5809147 - DNA, 17 bp, Homo sapiens
ttagattaaagattgct

SEQ ID NO: 5809148 - DNA, 15 bp, Homo sapiens
ttagattaagaaata

SEQ ID NO: 5809149 - DNA, 19 bp, Homo sapiens
ttagattaagaaatagaca

SEQ ID NO: 5809150 - DNA, 19 bp, Homo sapiens
ttagattaagattttactt

SEQ ID NO: 5809151 - DNA, 17 bp, Homo sapiens
ttagattagctctggac

SEQ ID NO: 5809152 - DNA, 22 bp, Homo sapiens
ttagattatattgagacaaaaa

SEQ ID NO: 5809153 - DNA, 15 bp, Homo sapiens
ttagattccaggatc

SEQ ID NO: 5809154 - DNA, 18 bp, Homo sapiens
ttagattcctacttaaac

SEQ ID NO: 5809155 - DNA, 22 bp, Homo sapiens
ttagattcctacttaaacaaaa

SEQ ID NO: 5809156 - DNA, 13 bp, Homo sapiens
ttagattctcatt

SEQ ID NO: 5809157 - DNA, 20 bp, Homo sapiens
ttagattctctgtgtctaag

SEQ ID NO: 5809158 - DNA, 22 bp, Homo sapiens
ttagattctctgtgtctaagat

SEQ ID NO: 5809159 - DNA, 20 bp, Homo sapiens
ttagattcttaattcatgag

SEQ ID NO: 5809160 - DNA, 23 bp, Homo sapiens
ttagattgaaaacttttctcaga

SEQ ID NO: 5809161 - DNA, 13 bp, Homo sapiens
ttagattgaaatt

SEQ ID NO: 5809162 - DNA, 19 bp, Homo sapiens
ttagattgaaatttatgac

SEQ ID NO: 5809163 - DNA, 20 bp, Homo sapiens
ttagattgaaatttatgact

SEQ ID NO: 5809164 - DNA, 19 bp, Homo sapiens
ttagattgatgtgcactgc

SEQ ID NO: 5809165 - DNA, 12 bp, Homo sapiens
ttagattgcaaa

SEQ ID NO: 5809166 - DNA, 13 bp, Homo sapiens
ttagattgcaaag

SEQ ID NO: 5809167 - DNA, 15 bp, Homo sapiens
ttagatttaaaataa

SEQ ID NO: 5809168 - DNA, 12 bp, Homo sapiens
ttagatttaatg

SEQ ID NO: 5809169 - DNA, 21 bp, Homo sapiens
ttagatttctcacactctaac

SEQ ID NO: 5809170 - DNA, 16 bp, Homo sapiens
ttagatttgccataga

SEQ ID NO: 5809171 - DNA, 13 bp, Homo sapiens
ttagattttaatc

SEQ ID NO: 5809172 - DNA, 23 bp, Homo sapiens
ttagattttacatgaagtatttt

SEQ ID NO: 5809173 - DNA, 13 bp, Homo sapiens
ttagattttatga

SEQ ID NO: 5809174 - DNA, 18 bp, Homo sapiens
ttagattttgtgcagtta

SEQ ID NO: 5809175 - DNA, 18 bp, Homo sapiens
ttagattttgtgtttatt

SEQ ID NO: 5809176 - DNA, 14 bp, Homo sapiens
ttagcaaaaaaagt

SEQ ID NO: 5809177 - DNA, 16 bp, Homo sapiens
ttagcaaaaaaagttg

SEQ ID NO: 5809178 - DNA, 20 bp, Homo sapiens
ttagcaaactgatgctgagg

SEQ ID NO: 5809179 - DNA, 14 bp, Homo sapiens
ttagcaaactttgt

SEQ ID NO: 5809180 - DNA, 13 bp, Homo sapiens
ttagcaaagagtt

SEQ ID NO: 5809181 - DNA, 19 bp, Homo sapiens
ttagcaaagagttaatata

SEQ ID NO: 5809182 - DNA, 20 bp, Homo sapiens
ttagcaagaatcattttgtg

SEQ ID NO: 5809183 - DNA, 23 bp, Homo sapiens
ttagcaagcaactaattttctcc

SEQ ID NO: 5809184 - DNA, 15 bp, Homo sapiens
ttagcaaggcagagc

SEQ ID NO: 5809185 - DNA, 18 bp, Homo sapiens
ttagcaaggcagagcctt

SEQ ID NO: 5809186 - DNA, 13 bp, Homo sapiens
ttagcaatattta

SEQ ID NO: 5809187 - DNA, 14 bp, Homo sapiens
ttagcaatcatttt

SEQ ID NO: 5809188 - DNA, 21 bp, Homo sapiens
ttagcaatgaattagttgcat

SEQ ID NO: 5809189 - DNA, 16 bp, Homo sapiens
ttagcacaatttgaga

SEQ ID NO: 5809190 - DNA, 10 bp, Homo sapiens
ttagcacaga

SEQ ID NO: 5809191 - DNA, 15 bp, Homo sapiens
ttagcacagagaggg

SEQ ID NO: 5809192 - DNA, 23 bp, Homo sapiens
ttagcacagattttaattgtcat

SEQ ID NO: 5809193 - DNA, 14 bp, Homo sapiens
ttagcacagtattt

SEQ ID NO: 5809194 - DNA, 17 bp, Homo sapiens
ttagcacagtatttaac

SEQ ID NO: 5809195 - DNA, 21 bp, Homo sapiens
ttagcacagtatttaacattc

SEQ ID NO: 5809196 - DNA, 20 bp, Homo sapiens
ttagcacccttctgctgtat

SEQ ID NO: 5809197 - DNA, 22 bp, Homo sapiens
ttagcacgtttaaagttctgtg

SEQ ID NO: 5809198 - DNA, 18 bp, Homo sapiens
ttagcagaagtgaccaaa

SEQ ID NO: 5809199 - DNA, 15 bp, Homo sapiens
ttagcagaatcaaaa

SEQ ID NO: 5809200 - DNA, 17 bp, Homo sapiens
ttagcagaatggagaaa

SEQ ID NO: 5809201 - DNA, 19 bp, Homo sapiens
ttagcagagacaaagagtt

SEQ ID NO: 5809202 - DNA, 14 bp, Homo sapiens
ttagcagatgtggt

SEQ ID NO: 5809203 - DNA, 20 bp, Homo sapiens
ttagcagcaactgaagacaa

SEQ ID NO: 5809204 - DNA, 14 bp, Homo sapiens
ttagcagcccagca

SEQ ID NO: 5809205 - DNA, 13 bp, Homo sapiens
ttagcagccctgg

SEQ ID NO: 5809206 - DNA, 12 bp, Homo sapiens
ttagcagctcag

SEQ ID NO: 5809207 - DNA, 13 bp, Homo sapiens
ttagcagctcagg

SEQ ID NO: 5809208 - DNA, 14 bp, Homo sapiens
ttagcagctcaggc

SEQ ID NO: 5809209 - DNA, 21 bp, Homo sapiens
ttagcagctcttcccctttcc

SEQ ID NO: 5809210 - DNA, 23 bp, Homo sapiens
ttagcagctcttcccctttcctg

SEQ ID NO: 5809211 - DNA, 21 bp, Homo sapiens
ttagcagctgactttcaaagt

SEQ ID NO: 5809212 - DNA, 15 bp, Homo sapiens
ttagcagctgggttg

SEQ ID NO: 5809213 - DNA, 15 bp, Homo sapiens
ttagcagcttccaga

SEQ ID NO: 5809214 - DNA, 18 bp, Homo sapiens
ttagcaggaagctgtgag

SEQ ID NO: 5809215 - DNA, 22 bp, Homo sapiens
ttagcaggagaggagagccaga

SEQ ID NO: 5809216 - DNA, 19 bp, Homo sapiens
ttagcaggccaaggtctga

SEQ ID NO: 5809217 - DNA, 22 bp, Homo sapiens
ttagcagggattctctcatcta

SEQ ID NO: 5809218 - DNA, 13 bp, Homo sapiens
ttagcagtattgt

SEQ ID NO: 5809219 - DNA, 15 bp, Homo sapiens
ttagcagtccatttt

SEQ ID NO: 5809220 - DNA, 22 bp, Homo sapiens
ttagcagtcgcgagcacatgtt

SEQ ID NO: 5809221 - DNA, 17 bp, Homo sapiens
ttagcagtgatttttat

SEQ ID NO: 5809222 - DNA, 16 bp, Homo sapiens
ttagcagttctgcaaa

SEQ ID NO: 5809223 - DNA, 15 bp, Homo sapiens
ttagcagtttcctca

SEQ ID NO: 5809224 - DNA, 19 bp, Homo sapiens
ttagcagtttcctcagtga

SEQ ID NO: 5809225 - DNA, 18 bp, Homo sapiens
ttagcataaatttaatgt

SEQ ID NO: 5809226 - DNA, 23 bp, Homo sapiens
ttagcataattttgtgttgtaca

SEQ ID NO: 5809227 - DNA, 13 bp, Homo sapiens
ttagcatattaat

SEQ ID NO: 5809228 - DNA, 15 bp, Homo sapiens
ttagcatcctaagaa

SEQ ID NO: 5809229 - DNA, 23 bp, Homo sapiens
ttagcatcctgcccgagggcagc

SEQ ID NO: 5809230 - DNA, 17 bp, Homo sapiens
ttagcatctaatttcaa

SEQ ID NO: 5809231 - DNA, 16 bp, Homo sapiens
ttagcatgaaaggtaa

SEQ ID NO: 5809232 - DNA, 18 bp, Homo sapiens
ttagcatgagctttccag

SEQ ID NO: 5809233 - DNA, 21 bp, Homo sapiens
ttagcatgagttctgcacata

SEQ ID NO: 5809234 - DNA, 21 bp, Homo sapiens
ttagcatgatgaaactgtcat

SEQ ID NO: 5809235 - DNA, 22 bp, Homo sapiens
ttagcatgcctccaaaaattca

SEQ ID NO: 5809236 - DNA, 23 bp, Homo sapiens
ttagcatgctgctttttgtactt

SEQ ID NO: 5809237 - DNA, 23 bp, Homo sapiens
ttagcatgtgttgcagctgtcac

SEQ ID NO: 5809238 - DNA, 12 bp, Homo sapiens
ttagcattaaaa

SEQ ID NO: 5809239 - DNA, 15 bp, Homo sapiens
ttagcattaaaaata

SEQ ID NO: 5809240 - DNA, 19 bp, Homo sapiens
ttagcatttaccaacatgt

SEQ ID NO: 5809241 - DNA, 16 bp, Homo sapiens
ttagccaaccaggcta

SEQ ID NO: 5809242 - DNA, 20 bp, Homo sapiens
ttagccaactgtttccctgc

SEQ ID NO: 5809243 - DNA, 14 bp, Homo sapiens
ttagccaagcccta

SEQ ID NO: 5809244 - DNA, 13 bp, Homo sapiens
ttagccacaaaat

SEQ ID NO: 5809245 - DNA, 18 bp, Homo sapiens
ttagccactgctggtgtt

SEQ ID NO: 5809246 - DNA, 21 bp, Homo sapiens
ttagccagaatctcattactg

SEQ ID NO: 5809247 - DNA, 15 bp, Homo sapiens
ttagccagaatgttt

SEQ ID NO: 5809248 - DNA, 21 bp, Homo sapiens
ttagccagaatgtttcctgtg

SEQ ID NO: 5809249 - DNA, 23 bp, Homo sapiens
ttagccagaatgtttcctgtgga

SEQ ID NO: 5809250 - DNA, 23 bp, Homo sapiens
ttagccaggatcatggtgtaata

SEQ ID NO: 5809251 - DNA, 21 bp, Homo sapiens
ttagccagtaatcctgtagga

SEQ ID NO: 5809252 - DNA, 15 bp, Homo sapiens
ttagccagtcattgt

SEQ ID NO: 5809253 - DNA, 15 bp, Homo sapiens
ttagccatcagatga

SEQ ID NO: 5809254 - DNA, 14 bp, Homo sapiens
ttagccattgaaat

SEQ ID NO: 5809255 - DNA, 21 bp, Homo sapiens
ttagcccaagaggtctgagcc

SEQ ID NO: 5809256 - DNA, 14 bp, Homo sapiens
ttagccccataatt

SEQ ID NO: 5809257 - DNA, 13 bp, Homo sapiens
ttagcccccaccc

SEQ ID NO: 5809258 - DNA, 17 bp, Homo sapiens
ttagcccccacccactt

SEQ ID NO: 5809259 - DNA, 15 bp, Homo sapiens
ttagcccgaggctgg

SEQ ID NO: 5809260 - DNA, 23 bp, Homo sapiens
ttagtggctcaacattgtgttcc

SEQ ID NO: 5809261 - DNA, 18 bp, Homo sapiens
ttagtgggtgagaaattt

SEQ ID NO: 5809262 - DNA, 15 bp, Homo sapiens
ttagtggtatgtctc

SEQ ID NO: 5809263 - DNA, 17 bp, Homo sapiens
ttagtggtggtagaaat

SEQ ID NO: 5809264 - DNA, 13 bp, Homo sapiens
ttagtgtaaaaat

SEQ ID NO: 5809265 - DNA, 14 bp, Homo sapiens
ttagtgtaaaaatg

SEQ ID NO: 5809266 - DNA, 17 bp, Homo sapiens
ttagtgtaaaaatgaga

SEQ ID NO: 5809267 - DNA, 18 bp, Homo sapiens
ttagtgtaaaaatgagaa

SEQ ID NO: 5809268 - DNA, 16 bp, Homo sapiens
ttagtgtatgctttga

SEQ ID NO: 5809269 - DNA, 15 bp, Homo sapiens
ttagtgtatgtgaat

SEQ ID NO: 5809270 - DNA, 13 bp, Homo sapiens
ttagtgtattaat

SEQ ID NO: 5809271 - DNA, 12 bp, Homo sapiens
ttagtgtatttt

SEQ ID NO: 5809272 - DNA, 14 bp, Homo sapiens
ttagtgtcacttac

SEQ ID NO: 5809273 - DNA, 17 bp, Homo sapiens
ttagtgtccccccttga

SEQ ID NO: 5809274 - DNA, 21 bp, Homo sapiens
ttagtgtccccccttgaagca

SEQ ID NO: 5809275 - DNA, 22 bp, Homo sapiens
ttagtgtccccccttgaagcaa

SEQ ID NO: 5809276 - DNA, 15 bp, Homo sapiens
ttagtgtctaaggaa

SEQ ID NO: 5809277 - DNA, 12 bp, Homo sapiens
ttagtgtctgac

SEQ ID NO: 5809278 - DNA, 13 bp, Homo sapiens
ttagtgtctgacc

SEQ ID NO: 5809279 - DNA, 22 bp, Homo sapiens
ttagtgtgaaatagttctgcca

SEQ ID NO: 5809280 - DNA, 16 bp, Homo sapiens
ttagtgtgaagttgat

SEQ ID NO: 5809281 - DNA, 17 bp, Homo sapiens
ttagtgtgacagtttcc

SEQ ID NO: 5809282 - DNA, 22 bp, Homo sapiens
ttagtgtgacagtttccaaatt

SEQ ID NO: 5809283 - DNA, 16 bp, Homo sapiens
ttagtgtgtaaaatta

SEQ ID NO: 5809284 - DNA, 17 bp, Homo sapiens
ttagtgtgtaaaattaa

SEQ ID NO: 5809285 - DNA, 22 bp, Homo sapiens
ttagtgtgtgtgcatgtgtgtg

SEQ ID NO: 5809286 - DNA, 18 bp, Homo sapiens
ttagtgtgttgtctgtgc

SEQ ID NO: 5809287 - DNA, 22 bp, Homo sapiens
ttagtgtgttgtctgtgcagct

SEQ ID NO: 5809288 - DNA, 22 bp, Homo sapiens
ttagtgtttagcattaaaaata

SEQ ID NO: 5809289 - DNA, 14 bp, Homo sapiens
ttagtgtttgaaaa

SEQ ID NO: 5809290 - DNA, 18 bp, Homo sapiens
ttagtgttttcattctgg

SEQ ID NO: 5809291 - DNA, 17 bp, Homo sapiens
ttagttaaaacacatat

SEQ ID NO: 5809292 - DNA, 23 bp, Homo sapiens
ttagttaaaatctattttgtctg

SEQ ID NO: 5809293 - DNA, 20 bp, Homo sapiens
ttagttaaattgaagaaagt

SEQ ID NO: 5809294 - DNA, 15 bp, Homo sapiens
ttagttaagatgtct

SEQ ID NO: 5809295 - DNA, 13 bp, Homo sapiens
ttagttaataaaa

SEQ ID NO: 5809296 - DNA, 13 bp, Homo sapiens
ttagttaatatat

SEQ ID NO: 5809297 - DNA, 12 bp, Homo sapiens
ttagttaatatt

SEQ ID NO: 5809298 - DNA, 23 bp, Homo sapiens
ttagttaatctttgaaaactcat

SEQ ID NO: 5809299 - DNA, 15 bp, Homo sapiens
ttagttacatttcta

SEQ ID NO: 5809300 - DNA, 15 bp, Homo sapiens
ttagttactttagat

SEQ ID NO: 5809301 - DNA, 14 bp, Homo sapiens
ttagttatagtgtt

SEQ ID NO: 5809302 - DNA, 20 bp, Homo sapiens
ttagttatagtgtttaactg

SEQ ID NO: 5809303 - DNA, 13 bp, Homo sapiens
ttagttcaataca

SEQ ID NO: 5809304 - DNA, 12 bp, Homo sapiens
ttagttcagtag

SEQ ID NO: 5809305 - DNA, 16 bp, Homo sapiens
ttagttcatatataca

SEQ ID NO: 5809306 - DNA, 12 bp, Homo sapiens
ttagttcccaac

SEQ ID NO: 5809307 - DNA, 20 bp, Homo sapiens
ttagttctgctttctgcctc

SEQ ID NO: 5809308 - DNA, 12 bp, Homo sapiens
ttagttctgttg

SEQ ID NO: 5809309 - DNA, 22 bp, Homo sapiens
ttagttctgttgacctgtgcac

SEQ ID NO: 5809310 - DNA, 14 bp, Homo sapiens
ttagttcttgaatt

SEQ ID NO: 5809311 - DNA, 17 bp, Homo sapiens
ttagttcttgggggagg

SEQ ID NO: 5809312 - DNA, 16 bp, Homo sapiens
ttagttctttggaaat

SEQ ID NO: 5809313 - DNA, 16 bp, Homo sapiens
ttagttctttttgcca

SEQ ID NO: 5809314 - DNA, 13 bp, Homo sapiens
ttagttgaaaaat

SEQ ID NO: 5809315 - DNA, 21 bp, Homo sapiens
ttagttgaatataagaaaatg

SEQ ID NO: 5809316 - DNA, 21 bp, Homo sapiens
ttagttgacaacctagaatgt

SEQ ID NO: 5809317 - DNA, 22 bp, Homo sapiens
ttagttgaccaactatattgcg

SEQ ID NO: 5809318 - DNA, 16 bp, Homo sapiens
ttagttgactaatgag

SEQ ID NO: 5809319 - DNA, 13 bp, Homo sapiens
ttagttgcaactt

SEQ ID NO: 5809320 - DNA, 16 bp, Homo sapiens
ttagttgccaatatgc

SEQ ID NO: 5809321 - DNA, 19 bp, Homo sapiens
ttagttggcagagaaaatg

SEQ ID NO: 5809322 - DNA, 19 bp, Homo sapiens
ttagttggtgctgatggag

SEQ ID NO: 5809323 - DNA, 21 bp, Homo sapiens
ttagtttaacttccactgtta

SEQ ID NO: 5809324 - DNA, 16 bp, Homo sapiens
ttagtttaatagtttg

SEQ ID NO: 5809325 - DNA, 15 bp, Homo sapiens
ttagtttacaatatt

SEQ ID NO: 5809326 - DNA, 17 bp, Homo sapiens
ttagtttaccaatcaac

SEQ ID NO: 5809327 - DNA, 20 bp, Homo sapiens
ttagtttacccggtttcttt

SEQ ID NO: 5809328 - DNA, 19 bp, Homo sapiens
ttagtttaggtgtttggga

SEQ ID NO: 5809329 - DNA, 17 bp, Homo sapiens
ttagtttcaagagtcta

SEQ ID NO: 5809330 - DNA, 13 bp, Homo sapiens
ttagtttctcata

SEQ ID NO: 5809331 - DNA, 15 bp, Homo sapiens
ttagtttctccaagc

SEQ ID NO: 5809332 - DNA, 13 bp, Homo sapiens
ttagtttctgaac

SEQ ID NO: 5809333 - DNA, 13 bp, Homo sapiens
ttagtttctgagt

SEQ ID NO: 5809334 - DNA, 20 bp, Homo sapiens
ttagtttctgttctgtggaa

SEQ ID NO: 5809335 - DNA, 18 bp, Homo sapiens
ttagtttggattcttatg

SEQ ID NO: 5809336 - DNA, 15 bp, Homo sapiens
ttagtttgtatatat

SEQ ID NO: 5809337 - DNA, 22 bp, Homo sapiens
ttagtttgtatgccaagtgaga

SEQ ID NO: 5809338 - DNA, 15 bp, Homo sapiens
ttagtttgtgtgttg

SEQ ID NO: 5809339 - DNA, 16 bp, Homo sapiens
ttagtttgttaattga

SEQ ID NO: 5809340 - DNA, 17 bp, Homo sapiens
ttagttttagaattaca

SEQ ID NO: 5809341 - DNA, 20 bp, Homo sapiens
ttagttttagaggcattgtt

SEQ ID NO: 5809342 - DNA, 14 bp, Homo sapiens
ttagttttatacta

SEQ ID NO: 5809343 - DNA, 13 bp, Homo sapiens
ttagttttcttgt

SEQ ID NO: 5809344 - DNA, 20 bp, Homo sapiens
ttagttttggttatttctaa

SEQ ID NO: 5809345 - DNA, 21 bp, Homo sapiens
ttagttttggttatttctaaa

SEQ ID NO: 5809346 - DNA, 21 bp, Homo sapiens
ttagttttgtaaaaactgaag

SEQ ID NO: 5809347 - DNA, 18 bp, Homo sapiens
ttagttttgtgaaggtga

SEQ ID NO: 5809348 - DNA, 15 bp, Homo sapiens
ttagttttgttccaa

SEQ ID NO: 5809349 - DNA, 23 bp, Homo sapiens
ttagtttttaacaatctaacaat

SEQ ID NO: 5809350 - DNA, 17 bp, Homo sapiens
ttagtttttcattaaat

SEQ ID NO: 5809351 - DNA, 15 bp, Homo sapiens
ttagtttttctgtcc

SEQ ID NO: 5809352 - DNA, 18 bp, Homo sapiens
ttagtttttggttgggaa

SEQ ID NO: 5809353 - DNA, 18 bp, Homo sapiens
ttagtttttgtaatttat

SEQ ID NO: 5809354 - DNA, 19 bp, Homo sapiens
ttagttttttttgtttgcc

SEQ ID NO: 5809355 - DNA, 22 bp, Homo sapiens
ttataaaaaaaatgaaatgttt

SEQ ID NO: 5809356 - DNA, 18 bp, Homo sapiens
ttataaaaaatggttcag

SEQ ID NO: 5809357 - DNA, 13 bp, Homo sapiens
ttataaaaaatgt

SEQ ID NO: 5809358 - DNA, 14 bp, Homo sapiens
ttataaaaaatgta

SEQ ID NO: 5809359 - DNA, 20 bp, Homo sapiens
ttataaaaaattaacttagt

SEQ ID NO: 5809360 - DNA, 13 bp, Homo sapiens
ttataaaaacatt

SEQ ID NO: 5809361 - DNA, 18 bp, Homo sapiens
ttataaaaacattgaaat

SEQ ID NO: 5809362 - DNA, 17 bp, Homo sapiens
ttataaaaagtgaaata

SEQ ID NO: 5809363 - DNA, 21 bp, Homo sapiens
ttataaaaataaaaaacactg

SEQ ID NO: 5809364 - DNA, 18 bp, Homo sapiens
ttataaaaatataaattg

SEQ ID NO: 5809365 - DNA, 13 bp, Homo sapiens
ttataaaaatatt

SEQ ID NO: 5809366 - DNA, 16 bp, Homo sapiens
ttataaaaatattaag

SEQ ID NO: 5809367 - DNA, 19 bp, Homo sapiens
ttataaaacagagtaatct

SEQ ID NO: 5809368 - DNA, 23 bp, Homo sapiens
ttataaaagaataaaattgcact

SEQ ID NO: 5809369 - DNA, 10 bp, Homo sapiens
ttataaaata

SEQ ID NO: 5809370 - DNA, 14 bp, Homo sapiens
ttataaaataatgt

SEQ ID NO: 5809371 - DNA, 22 bp, Homo sapiens
ttataaaataatgtactgaatt

SEQ ID NO: 5809372 - DNA, 13 bp, Homo sapiens
ttataaaatataa

SEQ ID NO: 5809373 - DNA, 18 bp, Homo sapiens
ttataaaatcctgtgcaa

SEQ ID NO: 5809374 - DNA, 12 bp, Homo sapiens
ttataaaatctg

SEQ ID NO: 5809375 - DNA, 21 bp, Homo sapiens
ttataaaatctttccatctca

SEQ ID NO: 5809376 - DNA, 21 bp, Homo sapiens
ttataaaatgggaagactgag

SEQ ID NO: 5809377 - DNA, 13 bp, Homo sapiens
ttataaaatgtat

SEQ ID NO: 5809378 - DNA, 14 bp, Homo sapiens
ttataaaattaaaa

SEQ ID NO: 5809379 - DNA, 15 bp, Homo sapiens
ttataaaattatttt

SEQ ID NO: 5809380 - DNA, 17 bp, Homo sapiens
ttataaaattgaaaaca

SEQ ID NO: 5809381 - DNA, 18 bp, Homo sapiens
ttataaaatttaacttct

SEQ ID NO: 5809382 - DNA, 17 bp, Homo sapiens
ttataaaattttgcttt

SEQ ID NO: 5809383 - DNA, 20 bp, Homo sapiens
ttataaacaagaatgaaggt

SEQ ID NO: 5809384 - DNA, 17 bp, Homo sapiens
ttataaacagaaatgga

SEQ ID NO: 5809385 - DNA, 13 bp, Homo sapiens
ttataaacagcag

SEQ ID NO: 5809386 - DNA, 19 bp, Homo sapiens
ttataaaccacttgagcct

SEQ ID NO: 5809387 - DNA, 16 bp, Homo sapiens
ttataaacctctaatt

SEQ ID NO: 5809388 - DNA, 18 bp, Homo sapiens
ttataaactaaagttgta

SEQ ID NO: 5809389 - DNA, 20 bp, Homo sapiens
ttataaactaccaaattagt

SEQ ID NO: 5809390 - DNA, 17 bp, Homo sapiens
ttataaactagatctcc

SEQ ID NO: 5809391 - DNA, 20 bp, Homo sapiens
ttataaactatttttttctt

SEQ ID NO: 5809392 - DNA, 23 bp, Homo sapiens
ttataaactatttttttcttaaa

SEQ ID NO: 5809393 - DNA, 13 bp, Homo sapiens
ttataaactttta

SEQ ID NO: 5809394 - DNA, 17 bp, Homo sapiens
ttataaacttttaaaga

SEQ ID NO: 5809395 - DNA, 22 bp, Homo sapiens
ttataaacttttttcttactgt

SEQ ID NO: 5809396 - DNA, 12 bp, Homo sapiens
ttataaagaaag

SEQ ID NO: 5809397 - DNA, 21 bp, Homo sapiens
ttataaagatcatttataata

SEQ ID NO: 5809398 - DNA, 15 bp, Homo sapiens
ttataaagtagaaat

SEQ ID NO: 5809399 - DNA, 18 bp, Homo sapiens
ttataaagtgcttgtgta

SEQ ID NO: 5809400 - DNA, 19 bp, Homo sapiens
ttataaagtggaagtatgt

SEQ ID NO: 5809401 - DNA, 12 bp, Homo sapiens
ttataaagttca

SEQ ID NO: 5809402 - DNA, 19 bp, Homo sapiens
ttataaataaactgttgct

SEQ ID NO: 5809403 - DNA, 17 bp, Homo sapiens
ttataaataaatgccaa

SEQ ID NO: 5809404 - DNA, 21 bp, Homo sapiens
ttataaatataagccttttat

SEQ ID NO: 5809405 - DNA, 17 bp, Homo sapiens
ttataaatatgtgaaaa

SEQ ID NO: 5809406 - DNA, 19 bp, Homo sapiens
ttataaatcatattgatga

SEQ ID NO: 5809407 - DNA, 17 bp, Homo sapiens
ttataaatccaaagtaa

SEQ ID NO: 5809408 - DNA, 14 bp, Homo sapiens
ttataaatcgcttt

SEQ ID NO: 5809409 - DNA, 11 bp, Homo sapiens
ttataaatgac

SEQ ID NO: 5809410 - DNA, 11 bp, Homo sapiens
ttataaatgtt

SEQ ID NO: 5809411 - DNA, 17 bp, Homo sapiens
ttataaatgttagttct

SEQ ID NO: 5809412 - DNA, 18 bp, Homo sapiens
ttataaatgttagttcta

SEQ ID NO: 5809413 - DNA, 13 bp, Homo sapiens
ttataaatgttct

SEQ ID NO: 5809414 - DNA, 19 bp, Homo sapiens
ttataaatgttctggtatg

SEQ ID NO: 5809415 - DNA, 13 bp, Homo sapiens
ttataaatgtttc

SEQ ID NO: 5809416 - DNA, 16 bp, Homo sapiens
ttataaatgttttaaa

SEQ ID NO: 5809417 - DNA, 16 bp, Homo sapiens
ttataaattaaaaggt

SEQ ID NO: 5809418 - DNA, 15 bp, Homo sapiens
ttataaattaaatat

SEQ ID NO: 5809419 - DNA, 18 bp, Homo sapiens
ttataaattaaatatatg

SEQ ID NO: 5809420 - DNA, 18 bp, Homo sapiens
ttataaattactatctgt

SEQ ID NO: 5809421 - DNA, 16 bp, Homo sapiens
ttataaattataatgc

SEQ ID NO: 5809422 - DNA, 15 bp, Homo sapiens
ttataaattatgttt

SEQ ID NO: 5809423 - DNA, 21 bp, Homo sapiens
ttataaattggtgatgcttgt

SEQ ID NO: 5809424 - DNA, 17 bp, Homo sapiens
ttataaatttctatttt

SEQ ID NO: 5809425 - DNA, 15 bp, Homo sapiens
ttataaattttgtac

SEQ ID NO: 5809426 - DNA, 12 bp, Homo sapiens
ttataacaatat

SEQ ID NO: 5809427 - DNA, 20 bp, Homo sapiens
ttataacaatgttaaatgca

SEQ ID NO: 5809428 - DNA, 19 bp, Homo sapiens
ttataacagatgtgaaaat

SEQ ID NO: 5809429 - DNA, 17 bp, Homo sapiens
ttataacagcattcttg

SEQ ID NO: 5809430 - DNA, 15 bp, Homo sapiens
ttataacagttataa

SEQ ID NO: 5809431 - DNA, 17 bp, Homo sapiens
ttataacagttataaag

SEQ ID NO: 5809432 - DNA, 16 bp, Homo sapiens
ttataacagttatatt

SEQ ID NO: 5809433 - DNA, 18 bp, Homo sapiens
ttataacatgttaaaatg

SEQ ID NO: 5809434 - DNA, 14 bp, Homo sapiens
ttataacattgtaa

SEQ ID NO: 5809435 - DNA, 15 bp, Homo sapiens
ttataacattgtaaa

SEQ ID NO: 5809436 - DNA, 19 bp, Homo sapiens
ttataacattgtatgttaa

SEQ ID NO: 5809437 - DNA, 23 bp, Homo sapiens
ttataaccatgagaattttactt

SEQ ID NO: 5809438 - DNA, 15 bp, Homo sapiens
ttataaccccagcct

SEQ ID NO: 5809439 - DNA, 15 bp, Homo sapiens
ttataacctggcaaa

SEQ ID NO: 5809440 - DNA, 15 bp, Homo sapiens
ttatccatttgtaat

SEQ ID NO: 5809441 - DNA, 19 bp, Homo sapiens
ttatccatttgtaattaaa

SEQ ID NO: 5809442 - DNA, 23 bp, Homo sapiens
ttatcccaaatcctgtctgaaaa

SEQ ID NO: 5809443 - DNA, 16 bp, Homo sapiens
ttatcccagctgccta

SEQ ID NO: 5809444 - DNA, 12 bp, Homo sapiens
ttatcccagctt

SEQ ID NO: 5809445 - DNA, 14 bp, Homo sapiens
ttatcccatttagt

SEQ ID NO: 5809446 - DNA, 14 bp, Homo sapiens
ttatccccagctgt

SEQ ID NO: 5809447 - DNA, 17 bp, Homo sapiens
ttatccccgtttcttgc

SEQ ID NO: 5809448 - DNA, 23 bp, Homo sapiens
ttatccctattttgctgatgagg

SEQ ID NO: 5809449 - DNA, 15 bp, Homo sapiens
ttatccctcacctgt

SEQ ID NO: 5809450 - DNA, 17 bp, Homo sapiens
ttatccctcacctgtag

SEQ ID NO: 5809451 - DNA, 20 bp, Homo sapiens
ttatccctcacctgtagcag

SEQ ID NO: 5809452 - DNA, 13 bp, Homo sapiens
ttatccctctcca

SEQ ID NO: 5809453 - DNA, 12 bp, Homo sapiens
ttatccctctct

SEQ ID NO: 5809454 - DNA, 16 bp, Homo sapiens
ttatccctctcttccc

SEQ ID NO: 5809455 - DNA, 17 bp, Homo sapiens
ttatccctctcttcccc

SEQ ID NO: 5809456 - DNA, 18 bp, Homo sapiens
ttatccctctcttcccct

SEQ ID NO: 5809457 - DNA, 13 bp, Homo sapiens
ttatccctgccca

SEQ ID NO: 5809458 - DNA, 12 bp, Homo sapiens
ttatccctgctt

SEQ ID NO: 5809459 - DNA, 15 bp, Homo sapiens
ttatcccttcttata

SEQ ID NO: 5809460 - DNA, 21 bp, Homo sapiens
ttatccctttacaatgtgaat

SEQ ID NO: 5809461 - DNA, 20 bp, Homo sapiens
ttatcctagattatatcaaa

SEQ ID NO: 5809462 - DNA, 13 bp, Homo sapiens
ttatcctcaagtt

SEQ ID NO: 5809463 - DNA, 15 bp, Homo sapiens
ttatcctcctctcca

SEQ ID NO: 5809464 - DNA, 14 bp, Homo sapiens
ttatcctctgatct

SEQ ID NO: 5809465 - DNA, 15 bp, Homo sapiens
ttatcctctttagag

SEQ ID NO: 5809466 - DNA, 20 bp, Homo sapiens
ttatcctctttagagttaga

SEQ ID NO: 5809467 - DNA, 14 bp, Homo sapiens
ttatcctctttgta

SEQ ID NO: 5809468 - DNA, 15 bp, Homo sapiens
ttatcctctttgtaa

SEQ ID NO: 5809469 - DNA, 16 bp, Homo sapiens
ttatcctgaaatttca

SEQ ID NO: 5809470 - DNA, 21 bp, Homo sapiens
ttatcctgagcagtgtacact

SEQ ID NO: 5809471 - DNA, 23 bp, Homo sapiens
ttatcctgagcagtgtacactgt

SEQ ID NO: 5809472 - DNA, 13 bp, Homo sapiens
ttatcctgcaagg

SEQ ID NO: 5809473 - DNA, 18 bp, Homo sapiens
ttatcctgtattcttgtt

SEQ ID NO: 5809474 - DNA, 13 bp, Homo sapiens
ttatcctgtctga

SEQ ID NO: 5809475 - DNA, 12 bp, Homo sapiens
ttatcctgtgct

SEQ ID NO: 5809476 - DNA, 22 bp, Homo sapiens
ttatccttacaatgtgaataat

SEQ ID NO: 5809477 - DNA, 16 bp, Homo sapiens
ttatccttcacaattt

SEQ ID NO: 5809478 - DNA, 17 bp, Homo sapiens
ttatccttgtttcctta

SEQ ID NO: 5809479 - DNA, 22 bp, Homo sapiens
ttatcctttgtgagcctatgat

SEQ ID NO: 5809480 - DNA, 15 bp, Homo sapiens
ttatccttttatctc

SEQ ID NO: 5809481 - DNA, 13 bp, Homo sapiens
ttatcgaaataac

SEQ ID NO: 5809482 - DNA, 15 bp, Homo sapiens
ttatcgaaataacaa

SEQ ID NO: 5809483 - DNA, 21 bp, Homo sapiens
ttatcgaaataacaatgttaa

SEQ ID NO: 5809484 - DNA, 23 bp, Homo sapiens
ttatcgaacgtggtctgattttg

SEQ ID NO: 5809485 - DNA, 15 bp, Homo sapiens
ttatcgcatacagat

SEQ ID NO: 5809486 - DNA, 20 bp, Homo sapiens
ttatcgccctggcaggcagg

SEQ ID NO: 5809487 - DNA, 17 bp, Homo sapiens
ttatcggacattctaat

SEQ ID NO: 5809488 - DNA, 19 bp, Homo sapiens
ttatcggacattctaatgc

SEQ ID NO: 5809489 - DNA, 23 bp, Homo sapiens
ttatcggacattctaatgcatat

SEQ ID NO: 5809490 - DNA, 21 bp, Homo sapiens
ttatcggctctattctctaaa

SEQ ID NO: 5809491 - DNA, 22 bp, Homo sapiens
ttatcggctctattctctaaac

SEQ ID NO: 5809492 - DNA, 23 bp, Homo sapiens
ttatcgggaacagtgtttcccat

SEQ ID NO: 5809493 - DNA, 17 bp, Homo sapiens
ttatcgtccagtgactt

SEQ ID NO: 5809494 - DNA, 18 bp, Homo sapiens
ttatcgtccagtgacttt

SEQ ID NO: 5809495 - DNA, 16 bp, Homo sapiens
ttatcgttttcttaaa

SEQ ID NO: 5809496 - DNA, 15 bp, Homo sapiens
ttatcgtttttgtat

SEQ ID NO: 5809497 - DNA, 15 bp, Homo sapiens
ttatctaaaagaaat

SEQ ID NO: 5809498 - DNA, 18 bp, Homo sapiens
ttatctaaatgaatgagc

SEQ ID NO: 5809499 - DNA, 15 bp, Homo sapiens
ttatctaagaataca

SEQ ID NO: 5809500 - DNA, 22 bp, Homo sapiens
ttatctaatcatgaaactccct

SEQ ID NO: 5809501 - DNA, 11 bp, Homo sapiens
ttatctaattt

SEQ ID NO: 5809502 - DNA, 14 bp, Homo sapiens
ttatctaccattga

SEQ ID NO: 5809503 - DNA, 20 bp, Homo sapiens
ttatctacccagtcatgtac

SEQ ID NO: 5809504 - DNA, 17 bp, Homo sapiens
ttatctacctgttctgt

SEQ ID NO: 5809505 - DNA, 18 bp, Homo sapiens
ttatctacctgttctgta

SEQ ID NO: 5809506 - DNA, 19 bp, Homo sapiens
ttatctacctgttctgtag

SEQ ID NO: 5809507 - DNA, 21 bp, Homo sapiens
ttatctacctgttctgtagct

SEQ ID NO: 5809508 - DNA, 19 bp, Homo sapiens
ttatctacttccaaactaa

SEQ ID NO: 5809509 - DNA, 16 bp, Homo sapiens
ttatctagatactgta

SEQ ID NO: 5809510 - DNA, 19 bp, Homo sapiens
ttatctagatgtaaatttt

SEQ ID NO: 5809511 - DNA, 14 bp, Homo sapiens
ttatctagcaagaa

SEQ ID NO: 5809512 - DNA, 20 bp, Homo sapiens
ttatctagtaggtctgcaca

SEQ ID NO: 5809513 - DNA, 22 bp, Homo sapiens
ttatctagtaggtctgcacaca

SEQ ID NO: 5809514 - DNA, 22 bp, Homo sapiens
ttatctagtagttgtagaagaa

SEQ ID NO: 5809515 - DNA, 14 bp, Homo sapiens
ttatctataattta

SEQ ID NO: 5809516 - DNA, 17 bp, Homo sapiens
ttatctatacatatctt

SEQ ID NO: 5809517 - DNA, 18 bp, Homo sapiens
ttatctatagctaagtac

SEQ ID NO: 5809518 - DNA, 15 bp, Homo sapiens
ttatctatataaaat

SEQ ID NO: 5809519 - DNA, 18 bp, Homo sapiens
ttatctatcggaagaaca

SEQ ID NO: 5809520 - DNA, 22 bp, Homo sapiens
ttatctatcggaagaacatgaa

SEQ ID NO: 5809521 - DNA, 15 bp, Homo sapiens
ttatctatggaaatg

SEQ ID NO: 5809522 - DNA, 18 bp, Homo sapiens
ttatctatggaaatgtga

SEQ ID NO: 5809523 - DNA, 23 bp, Homo sapiens
ttatctatggaaatgtgagaaat

SEQ ID NO: 5809524 - DNA, 23 bp, Homo sapiens
ttatctatgtggaaaacacaata

SEQ ID NO: 5809525 - DNA, 15 bp, Homo sapiens
ttatctattgtaaga

SEQ ID NO: 5809526 - DNA, 16 bp, Homo sapiens
ttatctattgtaagat

SEQ ID NO: 5809527 - DNA, 17 bp, Homo sapiens
ttatctattgtaagata

SEQ ID NO: 5809528 - DNA, 21 bp, Homo sapiens
ttatctattgtaagataaaaa

SEQ ID NO: 5809529 - DNA, 13 bp, Homo sapiens
ttatctcaagtaa

SEQ ID NO: 5809530 - DNA, 18 bp, Homo sapiens
ttatctcaagtaaaacaa

SEQ ID NO: 5809531 - DNA, 19 bp, Homo sapiens
ttatctcagatatttgcac

SEQ ID NO: 5809532 - DNA, 16 bp, Homo sapiens
ttatctcagatgttaa

SEQ ID NO: 5809533 - DNA, 19 bp, Homo sapiens
ttatctcagtcatgcataa

SEQ ID NO: 5809534 - DNA, 17 bp, Homo sapiens
ttatctcatcctttcct

SEQ ID NO: 5809535 - DNA, 13 bp, Homo sapiens
ttatctcatttct

SEQ ID NO: 5809536 - DNA, 20 bp, Homo sapiens
ttatctccagccaatttcaa

SEQ ID NO: 5809537 - DNA, 21 bp, Homo sapiens
ttatctccagccaatttcaaa

SEQ ID NO: 5809538 - DNA, 22 bp, Homo sapiens
ttatctccagccaatttcaaag

SEQ ID NO: 5809539 - DNA, 23 bp, Homo sapiens
ttatctcctaattgtatgttaga

SEQ ID NO: 5809540 - DNA, 18 bp, Homo sapiens
ttatctcgaatttgaaga

SEQ ID NO: 5809541 - DNA, 14 bp, Homo sapiens
ttatctctatttaa

SEQ ID NO: 5809542 - DNA, 12 bp, Homo sapiens
ttatctctgtgt

SEQ ID NO: 5809543 - DNA, 13 bp, Homo sapiens
ttatctcttcttc

SEQ ID NO: 5809544 - DNA, 16 bp, Homo sapiens
ttatctctttctctct

SEQ ID NO: 5809545 - DNA, 20 bp, Homo sapiens
ttatctcttttatatttgta

SEQ ID NO: 5809546 - DNA, 15 bp, Homo sapiens
ttatctgaaacttcc

SEQ ID NO: 5809547 - DNA, 19 bp, Homo sapiens
ttatctgaaacttcccaac

SEQ ID NO: 5809548 - DNA, 20 bp, Homo sapiens
ttatctgaaggaccccaggt

SEQ ID NO: 5809549 - DNA, 16 bp, Homo sapiens
ttatctgaatattaga

SEQ ID NO: 5809550 - DNA, 17 bp, Homo sapiens
ttatctgaatattagat

SEQ ID NO: 5809551 - DNA, 20 bp, Homo sapiens
ttatctgagcaataacttct

SEQ ID NO: 5809552 - DNA, 18 bp, Homo sapiens
ttatctgagtcaactcct

SEQ ID NO: 5809553 - DNA, 12 bp, Homo sapiens
ttatctgagttg

SEQ ID NO: 5809554 - DNA, 18 bp, Homo sapiens
ttatctgagttttattga

SEQ ID NO: 5809555 - DNA, 22 bp, Homo sapiens
ttatctgatcgggataacaaaa

SEQ ID NO: 5809556 - DNA, 16 bp, Homo sapiens
ttatctgatctgtgat

SEQ ID NO: 5809557 - DNA, 13 bp, Homo sapiens
ttatctgcattta

SEQ ID NO: 5809558 - DNA, 17 bp, Homo sapiens
ttatctgcccctccccc

SEQ ID NO: 5809559 - DNA, 18 bp, Homo sapiens
ttatctgcctctcttgta

SEQ ID NO: 5809560 - DNA, 15 bp, Homo sapiens
ttatctgcctggcct

SEQ ID NO: 5809561 - DNA, 16 bp, Homo sapiens
ttatctgcctggcctg

SEQ ID NO: 5809562 - DNA, 18 bp, Homo sapiens
ttatctgcctggcctggc

SEQ ID NO: 5809563 - DNA, 18 bp, Homo sapiens
ttatctgcggctttaaac

SEQ ID NO: 5809564 - DNA, 20 bp, Homo sapiens
ttatctgcggctttaaactg

SEQ ID NO: 5809565 - DNA, 13 bp, Homo sapiens
ttatctgctgttc

SEQ ID NO: 5809566 - DNA, 15 bp, Homo sapiens
ttatctgctgttcct

SEQ ID NO: 5809567 - DNA, 22 bp, Homo sapiens
ttatctggatttttatgtttta

SEQ ID NO: 5809568 - DNA, 14 bp, Homo sapiens
ttatctggcttcaa

SEQ ID NO: 5809569 - DNA, 20 bp, Homo sapiens
ttatctgggcatagatgcag

SEQ ID NO: 5809570 - DNA, 12 bp, Homo sapiens
ttatctgggctt

SEQ ID NO: 5809571 - DNA, 16 bp, Homo sapiens
ttatctgggttttaga

SEQ ID NO: 5809572 - DNA, 21 bp, Homo sapiens
ttatctgtataagctgtaata

SEQ ID NO: 5809573 - DNA, 11 bp, Homo sapiens
ttatctgtctg

SEQ ID NO: 5809574 - DNA, 20 bp, Homo sapiens
ttatctgtctgagccctgcc

SEQ ID NO: 5809575 - DNA, 13 bp, Homo sapiens
ttatctgtcttta

SEQ ID NO: 5809576 - DNA, 17 bp, Homo sapiens
ttatctgtggagttcct

SEQ ID NO: 5809577 - DNA, 13 bp, Homo sapiens
ttatctgttctat

SEQ ID NO: 5809578 - DNA, 16 bp, Homo sapiens
ttatctgttctatgga

SEQ ID NO: 5809579 - DNA, 19 bp, Homo sapiens
ttatctgtttaaagcatat

SEQ ID NO: 5809580 - DNA, 22 bp, Homo sapiens
ttatctgtttcctgacattgtc

SEQ ID NO: 5809581 - DNA, 13 bp, Homo sapiens
ttatctgttttct

SEQ ID NO: 5809582 - DNA, 21 bp, Homo sapiens
ttatcttaaaagggtggtagt

SEQ ID NO: 5809583 - DNA, 22 bp, Homo sapiens
ttatcttaaacccacataaaca

SEQ ID NO: 5809584 - DNA, 15 bp, Homo sapiens
ttatcttaaagcact

SEQ ID NO: 5809585 - DNA, 14 bp, Homo sapiens
ttatcttaaatatg

SEQ ID NO: 5809586 - DNA, 15 bp, Homo sapiens
ttatcttaacactga

SEQ ID NO: 5809587 - DNA, 20 bp, Homo sapiens
ttatcttaacactgaaattg

SEQ ID NO: 5809588 - DNA, 15 bp, Homo sapiens
ttatcttacaatatt

SEQ ID NO: 5809589 - DNA, 19 bp, Homo sapiens
ttatcttagtctatagaaa

SEQ ID NO: 5809590 - DNA, 14 bp, Homo sapiens
ttatcttatactga

SEQ ID NO: 5809591 - DNA, 18 bp, Homo sapiens
ttatcttatactgtacaa

SEQ ID NO: 5809592 - DNA, 20 bp, Homo sapiens
ttatcttatgaataagcact

SEQ ID NO: 5809593 - DNA, 17 bp, Homo sapiens
ttatcttatttaatttt

SEQ ID NO: 5809594 - DNA, 20 bp, Homo sapiens
ttatcttatttaatttttgc

SEQ ID NO: 5809595 - DNA, 20 bp, Homo sapiens
ttatcttcaggacactcact

SEQ ID NO: 5809596 - DNA, 18 bp, Homo sapiens
ttatcttctcaagttcta

SEQ ID NO: 5809597 - DNA, 21 bp, Homo sapiens
ttatcttctgctctttcttct

SEQ ID NO: 5809598 - DNA, 22 bp, Homo sapiens
ttatcttctggactatagctgt

SEQ ID NO: 5809599 - DNA, 14 bp, Homo sapiens
ttatcttctggatt

SEQ ID NO: 5809600 - DNA, 14 bp, Homo sapiens
ttatcttctgtttt

SEQ ID NO: 5809601 - DNA, 23 bp, Homo sapiens
ttatcttctgtttttctcaaata

SEQ ID NO: 5809602 - DNA, 19 bp, Homo sapiens
ttatcttgaaaaagtattg

SEQ ID NO: 5809603 - DNA, 17 bp, Homo sapiens
ttatcttgagtgttatg

SEQ ID NO: 5809604 - DNA, 18 bp, Homo sapiens
ttatcttgatacattcaa

SEQ ID NO: 5809605 - DNA, 19 bp, Homo sapiens
ttatcttgggactgggttt

SEQ ID NO: 5809606 - DNA, 14 bp, Homo sapiens
ttatcttgtgtatg

SEQ ID NO: 5809607 - DNA, 16 bp, Homo sapiens
ttatcttgtgtatgga

SEQ ID NO: 5809608 - DNA, 23 bp, Homo sapiens
ttatctttccatgggagccagct

SEQ ID NO: 5809609 - DNA, 14 bp, Homo sapiens
ttatctttccctct

SEQ ID NO: 5809610 - DNA, 14 bp, Homo sapiens
ttatctttgaatat

SEQ ID NO: 5809611 - DNA, 11 bp, Homo sapiens
ttatctttgat

SEQ ID NO: 5809612 - DNA, 15 bp, Homo sapiens
ttatctttgtaatta

SEQ ID NO: 5809613 - DNA, 12 bp, Homo sapiens
ttatcttttcat

SEQ ID NO: 5809614 - DNA, 17 bp, Homo sapiens
ttatcttttgtatatct

SEQ ID NO: 5809615 - DNA, 21 bp, Homo sapiens
ttatcttttgtatatctaaga

SEQ ID NO: 5809616 - DNA, 13 bp, Homo sapiens
ttatctttttaaa

SEQ ID NO: 5809617 - DNA, 14 bp, Homo sapiens
ttatgaaaaaatgt

SEQ ID NO: 5809618 - DNA, 17 bp, Homo sapiens
ttatggatatgaaaaat

SEQ ID NO: 5809619 - DNA, 14 bp, Homo sapiens
ttatggatatgctg

SEQ ID NO: 5809620 - DNA, 16 bp, Homo sapiens
ttatggatgattaaat

SEQ ID NO: 5809621 - DNA, 17 bp, Homo sapiens
ttatggatgatttaagt

SEQ ID NO: 5809622 - DNA, 18 bp, Homo sapiens
ttatggcaagtgatatca

SEQ ID NO: 5809623 - DNA, 21 bp, Homo sapiens
ttatggcaagtgatatcacct

SEQ ID NO: 5809624 - DNA, 16 bp, Homo sapiens
ttatggcagaagggaa

SEQ ID NO: 5809625 - DNA, 21 bp, Homo sapiens
ttatggcagcccggctgctgc

SEQ ID NO: 5809626 - DNA, 22 bp, Homo sapiens
ttatggccaatctattctcaaa

SEQ ID NO: 5809627 - DNA, 16 bp, Homo sapiens
ttatggccgggcaggg

SEQ ID NO: 5809628 - DNA, 15 bp, Homo sapiens
ttatggcctcagctg

SEQ ID NO: 5809629 - DNA, 23 bp, Homo sapiens
ttatggcgtttttctcgtccccc

SEQ ID NO: 5809630 - DNA, 18 bp, Homo sapiens
ttatggctataggtgcta

SEQ ID NO: 5809631 - DNA, 14 bp, Homo sapiens
ttatggcttgtgaa

SEQ ID NO: 5809632 - DNA, 15 bp, Homo sapiens
ttatggcttgtgaac

SEQ ID NO: 5809633 - DNA, 17 bp, Homo sapiens
ttatggcttttgtgcat

SEQ ID NO: 5809634 - DNA, 17 bp, Homo sapiens
ttatgggaatcaagatt

SEQ ID NO: 5809635 - DNA, 18 bp, Homo sapiens
ttatgggaatgccttttc

SEQ ID NO: 5809636 - DNA, 24 bp, Homo sapiens
ttatgggagctgtcaagcatgtat

SEQ ID NO: 5809637 - DNA, 17 bp, Homo sapiens
ttatgggatgtaaacaa

SEQ ID NO: 5809638 - DNA, 17 bp, Homo sapiens
ttatgggcattgacaaa

SEQ ID NO: 5809639 - DNA, 22 bp, Homo sapiens
ttatgggctgggttctacccag

SEQ ID NO: 5809640 - DNA, 22 bp, Homo sapiens
ttatgggggggagggagggcta

SEQ ID NO: 5809641 - DNA, 11 bp, Homo sapiens
ttatgggtcac

SEQ ID NO: 5809642 - DNA, 15 bp, Homo sapiens
ttatgggtcacagga

SEQ ID NO: 5809643 - DNA, 23 bp, Homo sapiens
ttatgggttataatcagggaaac

SEQ ID NO: 5809644 - DNA, 18 bp, Homo sapiens
ttatggtaatcatattag

SEQ ID NO: 5809645 - DNA, 19 bp, Homo sapiens
ttatggtagaaaaatttca

SEQ ID NO: 5809646 - DNA, 21 bp, Homo sapiens
ttatggtattttcgtgcattt

SEQ ID NO: 5809647 - DNA, 23 bp, Homo sapiens
ttatggtattttcgtgcatttgt

SEQ ID NO: 5809648 - DNA, 13 bp, Homo sapiens
ttatggtccagaa

SEQ ID NO: 5809649 - DNA, 19 bp, Homo sapiens
ttatggtcctaaaagcaaa

SEQ ID NO: 5809650 - DNA, 10 bp, Homo sapiens
ttatggtgaa

SEQ ID NO: 5809651 - DNA, 13 bp, Homo sapiens
ttatggtgaaatt

SEQ ID NO: 5809652 - DNA, 15 bp, Homo sapiens
ttatggtgatactcc

SEQ ID NO: 5809653 - DNA, 17 bp, Homo sapiens
ttatggtgatgtcactc

SEQ ID NO: 5809654 - DNA, 19 bp, Homo sapiens
ttatggtgatgtcactcac

SEQ ID NO: 5809655 - DNA, 21 bp, Homo sapiens
ttatggtggaagaggttctca

SEQ ID NO: 5809656 - DNA, 14 bp, Homo sapiens
ttatggtgtaatgc

SEQ ID NO: 5809657 - DNA, 17 bp, Homo sapiens
ttatggtgtaatgcaca

SEQ ID NO: 5809658 - DNA, 14 bp, Homo sapiens
ttatggttacttct

SEQ ID NO: 5809659 - DNA, 15 bp, Homo sapiens
ttatggttatgtttt

SEQ ID NO: 5809660 - DNA, 13 bp, Homo sapiens
ttatggtttctgc

SEQ ID NO: 5809661 - DNA, 17 bp, Homo sapiens
ttatggttttgtgatgt

SEQ ID NO: 5809662 - DNA, 22 bp, Homo sapiens
ttatgtaaacaaatctttccat

SEQ ID NO: 5809663 - DNA, 12 bp, Homo sapiens
ttatgtaaagta

SEQ ID NO: 5809664 - DNA, 13 bp, Homo sapiens
ttatgtaaagtat

SEQ ID NO: 5809665 - DNA, 14 bp, Homo sapiens
ttatgtaaagtatg

SEQ ID NO: 5809666 - DNA, 13 bp, Homo sapiens
ttatgtaaataat

SEQ ID NO: 5809667 - DNA, 13 bp, Homo sapiens
ttatgtaaatccc

SEQ ID NO: 5809668 - DNA, 22 bp, Homo sapiens
ttatgtaaattatcaggcaaat

SEQ ID NO: 5809669 - DNA, 16 bp, Homo sapiens
ttatgtaaatttttta

SEQ ID NO: 5809670 - DNA, 16 bp, Homo sapiens
ttatgtaagcatttgt

SEQ ID NO: 5809671 - DNA, 16 bp, Homo sapiens
ttatgtaagtttctaa

SEQ ID NO: 5809672 - DNA, 15 bp, Homo sapiens
ttatgtaagtttgca

SEQ ID NO: 5809673 - DNA, 17 bp, Homo sapiens
ttatgtaagtttgcata

SEQ ID NO: 5809674 - DNA, 21 bp, Homo sapiens
ttatgtaataatgtgaatcat

SEQ ID NO: 5809675 - DNA, 16 bp, Homo sapiens
ttatgtaatatattgt

SEQ ID NO: 5809676 - DNA, 14 bp, Homo sapiens
ttatgtaatgcttt

SEQ ID NO: 5809677 - DNA, 14 bp, Homo sapiens
ttatgtaattatat

SEQ ID NO: 5809678 - DNA, 18 bp, Homo sapiens
ttatgtaattattttctt

SEQ ID NO: 5809679 - DNA, 14 bp, Homo sapiens
ttatgtacaaaatg

SEQ ID NO: 5809680 - DNA, 22 bp, Homo sapiens
ttatgtacaaggatgaaagaaa

SEQ ID NO: 5809681 - DNA, 21 bp, Homo sapiens
ttatgtacatacgctctcgtc

SEQ ID NO: 5809682 - DNA, 22 bp, Homo sapiens
ttatgtacatctgtttgtagcc

SEQ ID NO: 5809683 - DNA, 21 bp, Homo sapiens
ttatgtaccatgaatatttat

SEQ ID NO: 5809684 - DNA, 20 bp, Homo sapiens
ttatgtactagtgttctgtt

SEQ ID NO: 5809685 - DNA, 14 bp, Homo sapiens
ttatgtactgtaaa

SEQ ID NO: 5809686 - DNA, 15 bp, Homo sapiens
ttatgtactgtaaac

SEQ ID NO: 5809687 - DNA, 18 bp, Homo sapiens
ttatgtactgtaaacagt

SEQ ID NO: 5809688 - DNA, 13 bp, Homo sapiens
ttatgtactgtac

SEQ ID NO: 5809689 - DNA, 17 bp, Homo sapiens
ttatgtactgtactaat

SEQ ID NO: 5809690 - DNA, 13 bp, Homo sapiens
ttatgtacttgat

SEQ ID NO: 5809691 - DNA, 15 bp, Homo sapiens
ttatgtagaaactga

SEQ ID NO: 5809692 - DNA, 13 bp, Homo sapiens
ttatgtagaaata

SEQ ID NO: 5809693 - DNA, 23 bp, Homo sapiens
ttatgtagacattgtaaataaat

SEQ ID NO: 5809694 - DNA, 15 bp, Homo sapiens
ttatgtagatatttg

SEQ ID NO: 5809695 - DNA, 22 bp, Homo sapiens
ttatgtagatatttggcttaaa

SEQ ID NO: 5809696 - DNA, 15 bp, Homo sapiens
ttatgtagtaattga

SEQ ID NO: 5809697 - DNA, 19 bp, Homo sapiens
ttatgtagtttcttgtctt

SEQ ID NO: 5809698 - DNA, 17 bp, Homo sapiens
ttatgtataaaatgtaa

SEQ ID NO: 5809699 - DNA, 19 bp, Homo sapiens
ttatgtataaaatgtaaca

SEQ ID NO: 5809700 - DNA, 20 bp, Homo sapiens
ttatgtataaaatgtaacac

SEQ ID NO: 5809701 - DNA, 21 bp, Homo sapiens
ttatgtatatactatacaaca

SEQ ID NO: 5809702 - DNA, 21 bp, Homo sapiens
ttatgtatcagctctctgctg

SEQ ID NO: 5809703 - DNA, 22 bp, Homo sapiens
ttatgtatcagtgtcctttcca

SEQ ID NO: 5809704 - DNA, 20 bp, Homo sapiens
ttatgtatctaatttcattc

SEQ ID NO: 5809705 - DNA, 13 bp, Homo sapiens
ttatgtatcttag

SEQ ID NO: 5809706 - DNA, 17 bp, Homo sapiens
ttatgtatcttgatgtt

SEQ ID NO: 5809707 - DNA, 23 bp, Homo sapiens
ttatgtatgaaggaatcattcca

SEQ ID NO: 5809708 - DNA, 17 bp, Homo sapiens
ttatgtatgtaaataga

SEQ ID NO: 5809709 - DNA, 23 bp, Homo sapiens
ttatgtattattttctatagctc

SEQ ID NO: 5809710 - DNA, 14 bp, Homo sapiens
ttatgtattcctat

SEQ ID NO: 5809711 - DNA, 14 bp, Homo sapiens
ttatgtattgtgca

SEQ ID NO: 5809712 - DNA, 18 bp, Homo sapiens
ttatgtatttataattta

SEQ ID NO: 5809713 - DNA, 20 bp, Homo sapiens
ttatgtatttcctggatgtt

SEQ ID NO: 5809714 - DNA, 17 bp, Homo sapiens
ttatgtattttgaaaaa

SEQ ID NO: 5809715 - DNA, 16 bp, Homo sapiens
ttatgtcaaatggatg

SEQ ID NO: 5809716 - DNA, 16 bp, Homo sapiens
ttatgtcagcagctct

SEQ ID NO: 5809717 - DNA, 11 bp, Homo sapiens
ttatgtcatac

SEQ ID NO: 5809718 - DNA, 17 bp, Homo sapiens
ttatgtcatcatacatg

SEQ ID NO: 5809719 - DNA, 14 bp, Homo sapiens
ttatgtcattgtgt

SEQ ID NO: 5809720 - DNA, 17 bp, Homo sapiens
ttatgtcccttcacata

SEQ ID NO: 5809721 - DNA, 18 bp, Homo sapiens
ttatgtcccttcacatag

SEQ ID NO: 5809722 - DNA, 20 bp, Homo sapiens
ttatgtcctgtgagatgtgt

SEQ ID NO: 5809723 - DNA, 22 bp, Homo sapiens
ttatgtcctgtgagatgtgtat

SEQ ID NO: 5809724 - DNA, 17 bp, Homo sapiens
ttatgtctagaaagtaa

SEQ ID NO: 5809725 - DNA, 17 bp, Homo sapiens
ttatgtctatttaagcc

SEQ ID NO: 5809726 - DNA, 19 bp, Homo sapiens
ttatgtctcaaaataagtt

SEQ ID NO: 5809727 - DNA, 19 bp, Homo sapiens
ttatgtctcttgagcatca

SEQ ID NO: 5809728 - DNA, 21 bp, Homo sapiens
ttatgtctcttgagcatcaat

SEQ ID NO: 5809729 - DNA, 24 bp, Homo sapiens
ttatgtctcttgagcatcaatctt

SEQ ID NO: 5809730 - DNA, 11 bp, Homo sapiens
ttatgtctggg

SEQ ID NO: 5809731 - DNA, 17 bp, Homo sapiens
ttatgtctgtggatttt

SEQ ID NO: 5809732 - DNA, 23 bp, Homo sapiens
ttatgtcttgtatttaaaaacat

SEQ ID NO: 5809733 - DNA, 15 bp, Homo sapiens
ttatgtcttgttctt

SEQ ID NO: 5809734 - DNA, 19 bp, Homo sapiens
ttatgtcttgttcttgaga

SEQ ID NO: 5809735 - DNA, 12 bp, Homo sapiens
ttatgtgaaaga

SEQ ID NO: 5809736 - DNA, 20 bp, Homo sapiens
ttatgtgaaatgcttatgct

SEQ ID NO: 5809737 - DNA, 17 bp, Homo sapiens
ttatgtgaacattccta

SEQ ID NO: 5809738 - DNA, 15 bp, Homo sapiens
ttatgtgaactttga

SEQ ID NO: 5809739 - DNA, 11 bp, Homo sapiens
ttatgtgaatt

SEQ ID NO: 5809740 - DNA, 16 bp, Homo sapiens
ttatgtgacaaccttt

SEQ ID NO: 5809741 - DNA, 23 bp, Homo sapiens
ttatgtgacaacctttgtgtaat

SEQ ID NO: 5809742 - DNA, 14 bp, Homo sapiens
ttatgtgacatttt

SEQ ID NO: 5809743 - DNA, 19 bp, Homo sapiens
ttatgtgacattttacatt

SEQ ID NO: 5809744 - DNA, 16 bp, Homo sapiens
ttatgtgatataaaat

SEQ ID NO: 5809745 - DNA, 18 bp, Homo sapiens
ttatgtgatataaaatat

SEQ ID NO: 5809746 - DNA, 13 bp, Homo sapiens
ttatgtgatatgt

SEQ ID NO: 5809747 - DNA, 22 bp, Homo sapiens
ttatgtgatatgttttaaagtt

SEQ ID NO: 5809748 - DNA, 20 bp, Homo sapiens
ttatgtgatgccaaagatgt

SEQ ID NO: 5809749 - DNA, 21 bp, Homo sapiens
ttatgtgatgccaaagatgtt

SEQ ID NO: 5809750 - DNA, 13 bp, Homo sapiens
ttatgtgatgtaa

SEQ ID NO: 5809751 - DNA, 16 bp, Homo sapiens
ttatgtgcactgcctg

SEQ ID NO: 5809752 - DNA, 16 bp, Homo sapiens
ttatgtgcgctgataa

SEQ ID NO: 5809753 - DNA, 21 bp, Homo sapiens
ttatgtgctattaatatttgt

SEQ ID NO: 5809754 - DNA, 16 bp, Homo sapiens
ttatgtgctgttagaa

SEQ ID NO: 5809755 - DNA, 18 bp, Homo sapiens
ttatgtgcttgaagattc

SEQ ID NO: 5809756 - DNA, 16 bp, Homo sapiens
ttatgtggaagaactg

SEQ ID NO: 5809757 - DNA, 17 bp, Homo sapiens
ttatgtgggtggcttct

SEQ ID NO: 5809758 - DNA, 18 bp, Homo sapiens
ttatgtggttttagattt

SEQ ID NO: 5809759 - DNA, 15 bp, Homo sapiens
ttatgtgtaaataca

SEQ ID NO: 5809760 - DNA, 14 bp, Homo sapiens
ttatgtgtaggtga

SEQ ID NO: 5809761 - DNA, 14 bp, Homo sapiens
ttatgtgtatattt

SEQ ID NO: 5809762 - DNA, 18 bp, Homo sapiens
ttatgtgtatgtgccatt

SEQ ID NO: 5809763 - DNA, 19 bp, Homo sapiens
ttatgtgtatgtgccattt

SEQ ID NO: 5809764 - DNA, 15 bp, Homo sapiens
ttatgtgtctggaag

SEQ ID NO: 5809765 - DNA, 15 bp, Homo sapiens
ttatgtgtgaagctg

SEQ ID NO: 5809766 - DNA, 19 bp, Homo sapiens
ttatgtgtgaggagctgct

SEQ ID NO: 5809767 - DNA, 17 bp, Homo sapiens
ttatgtgtgcatgtgtg

SEQ ID NO: 5809768 - DNA, 12 bp, Homo sapiens
ttatgtgtgtat

SEQ ID NO: 5809769 - DNA, 18 bp, Homo sapiens
ttatgtgtgtatatgtat

SEQ ID NO: 5809770 - DNA, 22 bp, Homo sapiens
ttatgtgtgtatatgtatgtgt

SEQ ID NO: 5809771 - DNA, 14 bp, Homo sapiens
ttatgtgtgtgtgt

SEQ ID NO: 5809772 - DNA, 12 bp, Homo sapiens
ttatgtgttaca

SEQ ID NO: 5809773 - DNA, 21 bp, Homo sapiens
ttatgtgtttggatacatctg

SEQ ID NO: 5809774 - DNA, 10 bp, Homo sapiens
ttatgttaaa

SEQ ID NO: 5809775 - DNA, 19 bp, Homo sapiens
ttatgttaaaactgggaca

SEQ ID NO: 5809776 - DNA, 13 bp, Homo sapiens
ttatgttaaaatc

SEQ ID NO: 5809777 - DNA, 11 bp, Homo sapiens
ttatgttaaac

SEQ ID NO: 5809778 - DNA, 16 bp, Homo sapiens
ttatgttaaactctgt

SEQ ID NO: 5809779 - DNA, 17 bp, Homo sapiens
ttatgttagagtcattt

SEQ ID NO: 5809780 - DNA, 23 bp, Homo sapiens
ttatgttagtttaaaaggtcaat

SEQ ID NO: 5809781 - DNA, 17 bp, Homo sapiens
ttatgttatatataaat

SEQ ID NO: 5809782 - DNA, 15 bp, Homo sapiens
ttatgttatgaaaac

SEQ ID NO: 5809783 - DNA, 16 bp, Homo sapiens
ttatgttattggaatt

SEQ ID NO: 5809784 - DNA, 23 bp, Homo sapiens
ttatgttcagaaatgtaaatgtt

SEQ ID NO: 5809785 - DNA, 19 bp, Homo sapiens
ttatgttcctgctgtattt

SEQ ID NO: 5809786 - DNA, 15 bp, Homo sapiens
ttatgttgaaaaaat

SEQ ID NO: 5809787 - DNA, 10 bp, Homo sapiens
ttatgttgac

SEQ ID NO: 5809788 - DNA, 13 bp, Homo sapiens
ttatgttgacatt

SEQ ID NO: 5809789 - DNA, 17 bp, Homo sapiens
ttatgttgcatagaata

SEQ ID NO: 5809790 - DNA, 21 bp, Homo sapiens
ttatgttgttcaaatgcattt

SEQ ID NO: 5809791 - DNA, 19 bp, Homo sapiens
ttatgtttaaaatggcatt

SEQ ID NO: 5809792 - DNA, 15 bp, Homo sapiens
ttatgtttacctcac

SEQ ID NO: 5809793 - DNA, 16 bp, Homo sapiens
ttatgtttattacaat

SEQ ID NO: 5809794 - DNA, 12 bp, Homo sapiens
ttatgtttctta

SEQ ID NO: 5809795 - DNA, 13 bp, Homo sapiens
ttatgtttgaata

SEQ ID NO: 5809796 - DNA, 14 bp, Homo sapiens
ttatgtttgaatga

SEQ ID NO: 5809797 - DNA, 19 bp, Homo sapiens
ttatttgtaaatttagtgt

SEQ ID NO: 5809798 - DNA, 12 bp, Homo sapiens
ttatttgtaata

SEQ ID NO: 5809799 - DNA, 16 bp, Homo sapiens
ttatttgtaatagatg

SEQ ID NO: 5809800 - DNA, 13 bp, Homo sapiens
ttatttgtataat

SEQ ID NO: 5809801 - DNA, 21 bp, Homo sapiens
ttatttgtcggggaagatgaa

SEQ ID NO: 5809802 - DNA, 16 bp, Homo sapiens
ttatttgtctgtaaaa

SEQ ID NO: 5809803 - DNA, 13 bp, Homo sapiens
ttatttgtgtaat

SEQ ID NO: 5809804 - DNA, 21 bp, Homo sapiens
ttatttgtgtaatagaaaact

SEQ ID NO: 5809805 - DNA, 14 bp, Homo sapiens
ttatttgttgagag

SEQ ID NO: 5809806 - DNA, 16 bp, Homo sapiens
ttatttgttgttttct

SEQ ID NO: 5809807 - DNA, 13 bp, Homo sapiens
ttattttaaaaga

SEQ ID NO: 5809808 - DNA, 17 bp, Homo sapiens
ttattttaaaatcaaag

SEQ ID NO: 5809809 - DNA, 21 bp, Homo sapiens
ttattttaaatataaatagct

SEQ ID NO: 5809810 - DNA, 12 bp, Homo sapiens
ttattttaaatc

SEQ ID NO: 5809811 - DNA, 13 bp, Homo sapiens
ttattttaaatta

SEQ ID NO: 5809812 - DNA, 15 bp, Homo sapiens
ttattttaaatttct

SEQ ID NO: 5809813 - DNA, 19 bp, Homo sapiens
ttattttaaccagttattt

SEQ ID NO: 5809814 - DNA, 15 bp, Homo sapiens
ttattttaataatgt

SEQ ID NO: 5809815 - DNA, 17 bp, Homo sapiens
ttattttaataatgttg

SEQ ID NO: 5809816 - DNA, 14 bp, Homo sapiens
ttattttaatacct

SEQ ID NO: 5809817 - DNA, 15 bp, Homo sapiens
ttattttaatattta

SEQ ID NO: 5809818 - DNA, 13 bp, Homo sapiens
ttattttaatgta

SEQ ID NO: 5809819 - DNA, 18 bp, Homo sapiens
ttattttaatgtgatgat

SEQ ID NO: 5809820 - DNA, 19 bp, Homo sapiens
ttattttacacagcaattt

SEQ ID NO: 5809821 - DNA, 13 bp, Homo sapiens
ttattttacagtc

SEQ ID NO: 5809822 - DNA, 13 bp, Homo sapiens
ttattttactttt

SEQ ID NO: 5809823 - DNA, 15 bp, Homo sapiens
ttattttactttttg

SEQ ID NO: 5809824 - DNA, 14 bp, Homo sapiens
ttattttagacttt

SEQ ID NO: 5809825 - DNA, 13 bp, Homo sapiens
ttattttagagca

SEQ ID NO: 5809826 - DNA, 15 bp, Homo sapiens
ttattttagcaaatc

SEQ ID NO: 5809827 - DNA, 19 bp, Homo sapiens
ttattttagcaaatcagta

SEQ ID NO: 5809828 - DNA, 23 bp, Homo sapiens
ttattttagcaaatcagtatatt

SEQ ID NO: 5809829 - DNA, 21 bp, Homo sapiens
ttattttagcagttctgcaaa

SEQ ID NO: 5809830 - DNA, 16 bp, Homo sapiens
ttattttagcttcagt

SEQ ID NO: 5809831 - DNA, 15 bp, Homo sapiens
ttattttaggcactg

SEQ ID NO: 5809832 - DNA, 13 bp, Homo sapiens
ttattttagtata

SEQ ID NO: 5809833 - DNA, 14 bp, Homo sapiens
ttattttagtgtgt

SEQ ID NO: 5809834 - DNA, 17 bp, Homo sapiens
ttattttagtgtgtaaa

SEQ ID NO: 5809835 - DNA, 19 bp, Homo sapiens
ttattttagtgtgtaaaat

SEQ ID NO: 5809836 - DNA, 16 bp, Homo sapiens
ttattttagtttctgt

SEQ ID NO: 5809837 - DNA, 12 bp, Homo sapiens
ttattttataat

SEQ ID NO: 5809838 - DNA, 23 bp, Homo sapiens
ttattttataattttaaaattgc

SEQ ID NO: 5809839 - DNA, 20 bp, Homo sapiens
ttattttataggggatactt

SEQ ID NO: 5809840 - DNA, 15 bp, Homo sapiens
ttattttatatttga

SEQ ID NO: 5809841 - DNA, 12 bp, Homo sapiens
ttattttatgag

SEQ ID NO: 5809842 - DNA, 19 bp, Homo sapiens
ttattttatgagaaatgta

SEQ ID NO: 5809843 - DNA, 20 bp, Homo sapiens
ttattttatgttgcatagaa

SEQ ID NO: 5809844 - DNA, 14 bp, Homo sapiens
ttattttattatga

SEQ ID NO: 5809845 - DNA, 16 bp, Homo sapiens
ttattttattatgaaa

SEQ ID NO: 5809846 - DNA, 18 bp, Homo sapiens
ttattttattatgcatga

SEQ ID NO: 5809847 - DNA, 15 bp, Homo sapiens
ttattttatttgctt

SEQ ID NO: 5809848 - DNA, 16 bp, Homo sapiens
ttattttcaaaggaaa

SEQ ID NO: 5809849 - DNA, 16 bp, Homo sapiens
ttattttcaatgaaac

SEQ ID NO: 5809850 - DNA, 12 bp, Homo sapiens
ttattttcactg

SEQ ID NO: 5809851 - DNA, 19 bp, Homo sapiens
ttattttcagtatactgtg

SEQ ID NO: 5809852 - DNA, 15 bp, Homo sapiens
ttattttcagtgata

SEQ ID NO: 5809853 - DNA, 17 bp, Homo sapiens
ttattttcagtgctttg

SEQ ID NO: 5809854 - DNA, 13 bp, Homo sapiens
ttattttcatata

SEQ ID NO: 5809855 - DNA, 15 bp, Homo sapiens
ttattttcattgtga

SEQ ID NO: 5809856 - DNA, 13 bp, Homo sapiens
ttattttccaaaa

SEQ ID NO: 5809857 - DNA, 16 bp, Homo sapiens
ttattttccaaaatct

SEQ ID NO: 5809858 - DNA, 13 bp, Homo sapiens
ttattttccaata

SEQ ID NO: 5809859 - DNA, 21 bp, Homo sapiens
ttattttcccatttgctgtct

SEQ ID NO: 5809860 - DNA, 12 bp, Homo sapiens
ttattttctaaa

SEQ ID NO: 5809861 - DNA, 13 bp, Homo sapiens
ttattttctgaat

SEQ ID NO: 5809862 - DNA, 14 bp, Homo sapiens
ttattttctgaatt

SEQ ID NO: 5809863 - DNA, 21 bp, Homo sapiens
ttattttctggtagatagaaa

SEQ ID NO: 5809864 - DNA, 15 bp, Homo sapiens
ttattttctgtaatt

SEQ ID NO: 5809865 - DNA, 16 bp, Homo sapiens
ttattttcttatgtaa

SEQ ID NO: 5809866 - DNA, 16 bp, Homo sapiens
ttattttcttccccaa

SEQ ID NO: 5809867 - DNA, 15 bp, Homo sapiens
ttattttcttgttta

SEQ ID NO: 5809868 - DNA, 18 bp, Homo sapiens
ttattttcttttgaattg

SEQ ID NO: 5809869 - DNA, 15 bp, Homo sapiens
ttattttctttttgt

SEQ ID NO: 5809870 - DNA, 23 bp, Homo sapiens
ttattttcttttttgataattta

SEQ ID NO: 5809871 - DNA, 21 bp, Homo sapiens
ttattttgaaaagcttcttaa

SEQ ID NO: 5809872 - DNA, 15 bp, Homo sapiens
ttattttgaaatttg

SEQ ID NO: 5809873 - DNA, 13 bp, Homo sapiens
ttattttgaatgt

SEQ ID NO: 5809874 - DNA, 17 bp, Homo sapiens
ttattttgacataaagt

SEQ ID NO: 5809875 - DNA, 23 bp, Homo sapiens
ttattttgagtcctaggacttaa

SEQ ID NO: 5809876 - DNA, 13 bp, Homo sapiens
ttattttgatgta

SEQ ID NO: 5809877 - DNA, 22 bp, Homo sapiens
ttattttgattgtttgatgaat

SEQ ID NO: 5809878 - DNA, 12 bp, Homo sapiens
ttattttgcaac

SEQ ID NO: 5809879 - DNA, 22 bp, Homo sapiens
ttattttgccaagggcataaat

SEQ ID NO: 5809880 - DNA, 13 bp, Homo sapiens
ttattttgctccc

SEQ ID NO: 5809881 - DNA, 14 bp, Homo sapiens
ttattttgctccct

SEQ ID NO: 5809882 - DNA, 19 bp, Homo sapiens
ttattttgctccctctgtt

SEQ ID NO: 5809883 - DNA, 12 bp, Homo sapiens
ttattttgctct

SEQ ID NO: 5809884 - DNA, 15 bp, Homo sapiens
ttattttgctgagtt

SEQ ID NO: 5809885 - DNA, 16 bp, Homo sapiens
ttattttgctgagttg

SEQ ID NO: 5809886 - DNA, 16 bp, Homo sapiens
ttattttgctttaatt

SEQ ID NO: 5809887 - DNA, 15 bp, Homo sapiens
ttattttgctttggt

SEQ ID NO: 5809888 - DNA, 18 bp, Homo sapiens
ttattttggaactatgaa

SEQ ID NO: 5809889 - DNA, 21 bp, Homo sapiens
ttattttggagagataggaag

SEQ ID NO: 5809890 - DNA, 16 bp, Homo sapiens
ttattttggatatatt

SEQ ID NO: 5809891 - DNA, 23 bp, Homo sapiens
ttattttggcttcatttcaatca

SEQ ID NO: 5809892 - DNA, 18 bp, Homo sapiens
ttattttggtacttttat

SEQ ID NO: 5809893 - DNA, 12 bp, Homo sapiens
ttattttgtaag

SEQ ID NO: 5809894 - DNA, 12 bp, Homo sapiens
ttattttgtaat

SEQ ID NO: 5809895 - DNA, 17 bp, Homo sapiens
ttattttgtaatattga

SEQ ID NO: 5809896 - DNA, 13 bp, Homo sapiens
ttattttgtaatt

SEQ ID NO: 5809897 - DNA, 15 bp, Homo sapiens
ttattttgtaattat

SEQ ID NO: 5809898 - DNA, 17 bp, Homo sapiens
ttattttgtaattatga

SEQ ID NO: 5809899 - DNA, 18 bp, Homo sapiens
ttattttgtaattattgt

SEQ ID NO: 5809900 - DNA, 17 bp, Homo sapiens
ttattttgtactagtgt

SEQ ID NO: 5809901 - DNA, 15 bp, Homo sapiens
ttattttgtcataaa

SEQ ID NO: 5809902 - DNA, 14 bp, Homo sapiens
ttattttgtgaact

SEQ ID NO: 5809903 - DNA, 16 bp, Homo sapiens
ttattttgttcataca

SEQ ID NO: 5809904 - DNA, 17 bp, Homo sapiens
ttattttgttcatacat

SEQ ID NO: 5809905 - DNA, 23 bp, Homo sapiens
ttattttgttgaccattttgtta

SEQ ID NO: 5809906 - DNA, 21 bp, Homo sapiens
ttattttgttgtgattttgta

SEQ ID NO: 5809907 - DNA, 13 bp, Homo sapiens
ttatttttaaaat

SEQ ID NO: 5809908 - DNA, 14 bp, Homo sapiens
ttatttttaaaata

SEQ ID NO: 5809909 - DNA, 16 bp, Homo sapiens
ttatttttaaaataaa

SEQ ID NO: 5809910 - DNA, 20 bp, Homo sapiens
ttatttttaaaataaaaata

SEQ ID NO: 5809911 - DNA, 20 bp, Homo sapiens
ttatttttaagaaaaattca

SEQ ID NO: 5809912 - DNA, 18 bp, Homo sapiens
ttatttttacattctgaa

SEQ ID NO: 5809913 - DNA, 13 bp, Homo sapiens
ttatttttacgta

SEQ ID NO: 5809914 - DNA, 22 bp, Homo sapiens
ttatttttacgtagaagctctt

SEQ ID NO: 5809915 - DNA, 13 bp, Homo sapiens
ttatttttagatg

SEQ ID NO: 5809916 - DNA, 14 bp, Homo sapiens
ttatttttataatt

SEQ ID NO: 5809917 - DNA, 13 bp, Homo sapiens
ttatttttataca

SEQ ID NO: 5809918 - DNA, 19 bp, Homo sapiens
ttatttttatacaccattg

SEQ ID NO: 5809919 - DNA, 21 bp, Homo sapiens
ttatttttatacaccattgtt

SEQ ID NO: 5809920 - DNA, 14 bp, Homo sapiens
ttatttttatacag

SEQ ID NO: 5809921 - DNA, 15 bp, Homo sapiens
ttatttttatacagt

SEQ ID NO: 5809922 - DNA, 17 bp, Homo sapiens
ttatttttatacagtag

SEQ ID NO: 5809923 - DNA, 17 bp, Homo sapiens
ttatttttatactgaat

SEQ ID NO: 5809924 - DNA, 15 bp, Homo sapiens
ttatttttatttatt

SEQ ID NO: 5809925 - DNA, 13 bp, Homo sapiens
ttatttttcaatt

SEQ ID NO: 5809926 - DNA, 14 bp, Homo sapiens
ttatttttcatatt

SEQ ID NO: 5809927 - DNA, 17 bp, Homo sapiens
ttatttttcctgtcctg

SEQ ID NO: 5809928 - DNA, 10 bp, Homo sapiens
ttatttttct

SEQ ID NO: 5809929 - DNA, 20 bp, Homo sapiens
ttatttttctcttgtaccat

SEQ ID NO: 5809930 - DNA, 14 bp, Homo sapiens
ttatttttcttgtc

SEQ ID NO: 5809931 - DNA, 16 bp, Homo sapiens
ttatttttctttaaag

SEQ ID NO: 5809932 - DNA, 14 bp, Homo sapiens
ttatttttggactt

SEQ ID NO: 5809933 - DNA, 23 bp, Homo sapiens
ttatttttgggtttggccaggga

SEQ ID NO: 5809934 - DNA, 14 bp, Homo sapiens
ttatttttgtacat

SEQ ID NO: 5809935 - DNA, 15 bp, Homo sapiens
ttatttttgtaccat

SEQ ID NO: 5809936 - DNA, 23 bp, Homo sapiens
ttatttttgtcacggaaagcatc

SEQ ID NO: 5809937 - DNA, 15 bp, Homo sapiens
ttatttttgtccctg

SEQ ID NO: 5809938 - DNA, 23 bp, Homo sapiens
ttatttttgtccctgctcctccc

SEQ ID NO: 5809939 - DNA, 23 bp, Homo sapiens
ttatttttgtttcttccaaagca

SEQ ID NO: 5809940 - DNA, 17 bp, Homo sapiens
ttattttttaaaataat

SEQ ID NO: 5809941 - DNA, 17 bp, Homo sapiens
ttattttttaaatgtaa

SEQ ID NO: 5809942 - DNA, 14 bp, Homo sapiens
ttattttttaagaa

SEQ ID NO: 5809943 - DNA, 14 bp, Homo sapiens
ttattttttaatta

SEQ ID NO: 5809944 - DNA, 13 bp, Homo sapiens
ttattttttatac

SEQ ID NO: 5809945 - DNA, 14 bp, Homo sapiens
ttattttttataca

SEQ ID NO: 5809946 - DNA, 12 bp, Homo sapiens
ttattttttcag

SEQ ID NO: 5809947 - DNA, 13 bp, Homo sapiens
ttattttttcaga

SEQ ID NO: 5809948 - DNA, 19 bp, Homo sapiens
ttattttttcagaccgaaa

SEQ ID NO: 5809949 - DNA, 20 bp, Homo sapiens
ttattttttcagaccgaaaa

SEQ ID NO: 5809950 - DNA, 18 bp, Homo sapiens
ttattttttcagactgtg

SEQ ID NO: 5809951 - DNA, 15 bp, Homo sapiens
ttattttttctatga

SEQ ID NO: 5809952 - DNA, 13 bp, Homo sapiens
ttattttttgcat

SEQ ID NO: 5809953 - DNA, 17 bp, Homo sapiens
ttatttttttaaaattt

SEQ ID NO: 5809954 - DNA, 14 bp, Homo sapiens
ttatttttttctac

SEQ ID NO: 5809955 - DNA, 22 bp, Homo sapiens
ttatttttttgatggctaagat

SEQ ID NO: 5809956 - DNA, 16 bp, Homo sapiens
ttattttttttctgta

SEQ ID NO: 5809957 - DNA, 15 bp, Homo sapiens
ttcaaaaaaaaaata

SEQ ID NO: 5809958 - DNA, 15 bp, Homo sapiens
ttcaaaaaaatctat

SEQ ID NO: 5809959 - DNA, 13 bp, Homo sapiens
ttcaaaaaaatgt

SEQ ID NO: 5809960 - DNA, 14 bp, Homo sapiens
ttcaaaaacctggt

SEQ ID NO: 5809961 - DNA, 14 bp, Homo sapiens
ttcaaaaactgttt

SEQ ID NO: 5809962 - DNA, 20 bp, Homo sapiens
ttcaaaaactgttttgggta

SEQ ID NO: 5809963 - DNA, 21 bp, Homo sapiens
ttcaaaaactgttttgggtag

SEQ ID NO: 5809964 - DNA, 23 bp, Homo sapiens
ttcaaaaagagagattctccatt

SEQ ID NO: 5809965 - DNA, 17 bp, Homo sapiens
ttcaaaaagcaatctgg

SEQ ID NO: 5809966 - DNA, 16 bp, Homo sapiens
ttcaaaaagcatttta

SEQ ID NO: 5809967 - DNA, 22 bp, Homo sapiens
ttcaaaaagccaaaatagagag

SEQ ID NO: 5809968 - DNA, 22 bp, Homo sapiens
ttcaaaaagccacagcagagca

SEQ ID NO: 5809969 - DNA, 22 bp, Homo sapiens
ttcaaaaagggaagtaagcaaa

SEQ ID NO: 5809970 - DNA, 21 bp, Homo sapiens
ttcaaaaagtcacagttaagg

SEQ ID NO: 5809971 - DNA, 21 bp, Homo sapiens
ttcaaaaataaaaaatctgaa

SEQ ID NO: 5809972 - DNA, 12 bp, Homo sapiens
ttcaaaaataat

SEQ ID NO: 5809973 - DNA, 22 bp, Homo sapiens
ttcaaaaatcattaacactttt

SEQ ID NO: 5809974 - DNA, 18 bp, Homo sapiens
ttcaaaaatctgaagatt

SEQ ID NO: 5809975 - DNA, 17 bp, Homo sapiens
ttcaaaaattatatttt

SEQ ID NO: 5809976 - DNA, 17 bp, Homo sapiens
ttcaaaaatttggaatt

SEQ ID NO: 5809977 - DNA, 16 bp, Homo sapiens
ttcaaaacaaaatgaa

SEQ ID NO: 5809978 - DNA, 16 bp, Homo sapiens
ttcaaaacaaacagat

SEQ ID NO: 5809979 - DNA, 15 bp, Homo sapiens
ttcaagtgtaaatga

SEQ ID NO: 5809980 - DNA, 14 bp, Homo sapiens
ttcaagtgttacct

SEQ ID NO: 5809981 - DNA, 21 bp, Homo sapiens
ttcaagtgttgctcttggaaa

SEQ ID NO: 5809982 - DNA, 16 bp, Homo sapiens
ttcaagtgttttcaca

SEQ ID NO: 5809983 - DNA, 14 bp, Homo sapiens
ttcaagttattcaa

SEQ ID NO: 5809984 - DNA, 16 bp, Homo sapiens
ttcaagttattcaaat

SEQ ID NO: 5809985 - DNA, 21 bp, Homo sapiens
ttcaagttgcagtcagaagat

SEQ ID NO: 5809986 - DNA, 14 bp, Homo sapiens
ttcaagtttgctgc

SEQ ID NO: 5809987 - DNA, 14 bp, Homo sapiens
ttcaagttttaaag

SEQ ID NO: 5809988 - DNA, 16 bp, Homo sapiens
ttcaagttttaaagtt

SEQ ID NO: 5809989 - DNA, 14 bp, Homo sapiens
ttcaagtttttcat

SEQ ID NO: 5809990 - DNA, 15 bp, Homo sapiens
ttcaagtttttcata

SEQ ID NO: 5809991 - DNA, 16 bp, Homo sapiens
ttcaagtttttcatac

SEQ ID NO: 5809992 - DNA, 13 bp, Homo sapiens
ttcaataaaactt

SEQ ID NO: 5809993 - DNA, 21 bp, Homo sapiens
ttcaataaaagataaattatt

SEQ ID NO: 5809994 - DNA, 14 bp, Homo sapiens
ttcaataaaatggt

SEQ ID NO: 5809995 - DNA, 12 bp, Homo sapiens
ttcaataaagca

SEQ ID NO: 5809996 - DNA, 12 bp, Homo sapiens
ttcaataaagct

SEQ ID NO: 5809997 - DNA, 21 bp, Homo sapiens
ttcaataaagtactgcaaaat

SEQ ID NO: 5809998 - DNA, 23 bp, Homo sapiens
ttcaataaagtactgcaaaatgc

SEQ ID NO: 5809999 - DNA, 13 bp, Homo sapiens
ttcaataaagtat

SEQ ID NO: 5810000 - DNA, 22 bp, Homo sapiens
ttcaataaagttgttgcattcc

SEQ ID NO: 5810001 - DNA, 15 bp, Homo sapiens
ttcaataaagtttga

SEQ ID NO: 5810002 - DNA, 19 bp, Homo sapiens
ttcaataaagtttgatctt

SEQ ID NO: 5810003 - DNA, 19 bp, Homo sapiens
ttcaataaatgtctgttga

SEQ ID NO: 5810004 - DNA, 23 bp, Homo sapiens
ttcaatacaaacaatctcttaaa

SEQ ID NO: 5810005 - DNA, 14 bp, Homo sapiens
ttcaatacactcaa

SEQ ID NO: 5810006 - DNA, 16 bp, Homo sapiens
ttcaatacagatatat

SEQ ID NO: 5810007 - DNA, 17 bp, Homo sapiens
ttcaatacagatatatt

SEQ ID NO: 5810008 - DNA, 22 bp, Homo sapiens
ttcaatactgctgaaacagaca

SEQ ID NO: 5810009 - DNA, 13 bp, Homo sapiens
ttcaatactgtat

SEQ ID NO: 5810010 - DNA, 22 bp, Homo sapiens
ttcaatactgtcccacttctca

SEQ ID NO: 5810011 - DNA, 23 bp, Homo sapiens
ttcaatacttacatatctgactt

SEQ ID NO: 5810012 - DNA, 20 bp, Homo sapiens
ttcaataggaaaaactgatt

SEQ ID NO: 5810013 - DNA, 23 bp, Homo sapiens
ttcaatagtggcataccaaatgg

SEQ ID NO: 5810014 - DNA, 18 bp, Homo sapiens
ttcaatagttcaaggaac

SEQ ID NO: 5810015 - DNA, 17 bp, Homo sapiens
ttcaatataagaagcaa

SEQ ID NO: 5810016 - DNA, 19 bp, Homo sapiens
ttcaatataagcttttctt

SEQ ID NO: 5810017 - DNA, 15 bp, Homo sapiens
ttcaatatattgaac

SEQ ID NO: 5810018 - DNA, 18 bp, Homo sapiens
ttcaatatattgaacttt

SEQ ID NO: 5810019 - DNA, 16 bp, Homo sapiens
ttcaatatgaatctat

SEQ ID NO: 5810020 - DNA, 19 bp, Homo sapiens
ttcaatatgcaagcagctt

SEQ ID NO: 5810021 - DNA, 15 bp, Homo sapiens
ttcaatattgacatt

SEQ ID NO: 5810022 - DNA, 18 bp, Homo sapiens
ttcaatatttagaaaatt

SEQ ID NO: 5810023 - DNA, 11 bp, Homo sapiens
ttcaatatttt

SEQ ID NO: 5810024 - DNA, 12 bp, Homo sapiens
ttcaatcaaagc

SEQ ID NO: 5810025 - DNA, 19 bp, Homo sapiens
ttcaatcaaagctaccttt

SEQ ID NO: 5810026 - DNA, 14 bp, Homo sapiens
ttcaatcaaccaaa

SEQ ID NO: 5810027 - DNA, 16 bp, Homo sapiens
ttcaatcaaccaaagt

SEQ ID NO: 5810028 - DNA, 18 bp, Homo sapiens
ttcaatcaactttactgt

SEQ ID NO: 5810029 - DNA, 19 bp, Homo sapiens
ttcaatcaactttactgta

SEQ ID NO: 5810030 - DNA, 11 bp, Homo sapiens
ttcaatcactg

SEQ ID NO: 5810031 - DNA, 20 bp, Homo sapiens
ttcaatcactgtaacctgat

SEQ ID NO: 5810032 - DNA, 21 bp, Homo sapiens
ttcaatcactgtaacctgatt

SEQ ID NO: 5810033 - DNA, 14 bp, Homo sapiens
ttcaatcatcaaaa

SEQ ID NO: 5810034 - DNA, 17 bp, Homo sapiens
ttcaatcccaattctgt

SEQ ID NO: 5810035 - DNA, 16 bp, Homo sapiens
ttcaatcccaggatgt

SEQ ID NO: 5810036 - DNA, 22 bp, Homo sapiens
ttcaatcctcaaatcagtcttc

SEQ ID NO: 5810037 - DNA, 23 bp, Homo sapiens
ttcaatctggattcatatttaat

SEQ ID NO: 5810038 - DNA, 16 bp, Homo sapiens
ttcaatctgtaaactg

SEQ ID NO: 5810039 - DNA, 20 bp, Homo sapiens
ttcaatctgtaaactgtgta

SEQ ID NO: 5810040 - DNA, 23 bp, Homo sapiens
ttcaatctgtgaagcctttatct

SEQ ID NO: 5810041 - DNA, 19 bp, Homo sapiens
ttcaatgatctaggtttaa

SEQ ID NO: 5810042 - DNA, 22 bp, Homo sapiens
ttcaatgatctaggtttaactc

SEQ ID NO: 5810043 - DNA, 16 bp, Homo sapiens
ttcaatgattcttcct

SEQ ID NO: 5810044 - DNA, 10 bp, Homo sapiens
ttcaatgcaa

SEQ ID NO: 5810045 - DNA, 12 bp, Homo sapiens
ttcaatgcaaag

SEQ ID NO: 5810046 - DNA, 11 bp, Homo sapiens
ttcaatgcaat

SEQ ID NO: 5810047 - DNA, 12 bp, Homo sapiens
ttcaatgcaatg

SEQ ID NO: 5810048 - DNA, 15 bp, Homo sapiens
ttcaatgcaatgaaa

SEQ ID NO: 5810049 - DNA, 13 bp, Homo sapiens
ttcaatgcaatgc

SEQ ID NO: 5810050 - DNA, 20 bp, Homo sapiens
ttcaatgcaatgcatctgaa

SEQ ID NO: 5810051 - DNA, 16 bp, Homo sapiens
ttcaatgcatacaata

SEQ ID NO: 5810052 - DNA, 13 bp, Homo sapiens
ttcaatgcattta

SEQ ID NO: 5810053 - DNA, 16 bp, Homo sapiens
ttcaatgctacaaaat

SEQ ID NO: 5810054 - DNA, 13 bp, Homo sapiens
ttcaatgctttct

SEQ ID NO: 5810055 - DNA, 21 bp, Homo sapiens
ttcaatgggacaggaactagg

SEQ ID NO: 5810056 - DNA, 22 bp, Homo sapiens
ttcaatggtttgcaaggaagcc

SEQ ID NO: 5810057 - DNA, 23 bp, Homo sapiens
ttcaatggtttgcaaggaagcca

SEQ ID NO: 5810058 - DNA, 15 bp, Homo sapiens
ttcaatgtactgtat

SEQ ID NO: 5810059 - DNA, 17 bp, Homo sapiens
ttcaatgtactgtattg

SEQ ID NO: 5810060 - DNA, 17 bp, Homo sapiens
ttcaatgtgaaactgag

SEQ ID NO: 5810061 - DNA, 16 bp, Homo sapiens
ttcaatgtgactgaaa

SEQ ID NO: 5810062 - DNA, 22 bp, Homo sapiens
ttcaatgtgatataaacagctt

SEQ ID NO: 5810063 - DNA, 15 bp, Homo sapiens
ttcaatgtgcataat

SEQ ID NO: 5810064 - DNA, 16 bp, Homo sapiens
ttcaatgtgcataatg

SEQ ID NO: 5810065 - DNA, 19 bp, Homo sapiens
ttcaatgtgtataaattgt

SEQ ID NO: 5810066 - DNA, 14 bp, Homo sapiens
ttcaatgtgttctt

SEQ ID NO: 5810067 - DNA, 13 bp, Homo sapiens
ttcaatgttaaat

SEQ ID NO: 5810068 - DNA, 15 bp, Homo sapiens
ttcaatgtttgaaat

SEQ ID NO: 5810069 - DNA, 12 bp, Homo sapiens
ttcaattaaacg

SEQ ID NO: 5810070 - DNA, 15 bp, Homo sapiens
ttcaattaaacggat

SEQ ID NO: 5810071 - DNA, 16 bp, Homo sapiens
ttcaattaaacggatt

SEQ ID NO: 5810072 - DNA, 16 bp, Homo sapiens
ttcaattaaagaaata

SEQ ID NO: 5810073 - DNA, 21 bp, Homo sapiens
ttcaattaatattaattttct

SEQ ID NO: 5810074 - DNA, 13 bp, Homo sapiens
ttcaattaatgct

SEQ ID NO: 5810075 - DNA, 15 bp, Homo sapiens
ttcaattaatggaaa

SEQ ID NO: 5810076 - DNA, 21 bp, Homo sapiens
ttcaattagatttaaaataaa

SEQ ID NO: 5810077 - DNA, 18 bp, Homo sapiens
ttcaattagtggtcataa

SEQ ID NO: 5810078 - DNA, 12 bp, Homo sapiens
ttcaattatttc

SEQ ID NO: 5810079 - DNA, 15 bp, Homo sapiens
ttcaattatttcaat

SEQ ID NO: 5810080 - DNA, 14 bp, Homo sapiens
ttcaattatttccc

SEQ ID NO: 5810081 - DNA, 15 bp, Homo sapiens
ttcaattatttccca

SEQ ID NO: 5810082 - DNA, 17 bp, Homo sapiens
ttcaattatttccccca

SEQ ID NO: 5810083 - DNA, 16 bp, Homo sapiens
ttcaattcaaaaatgt

SEQ ID NO: 5810084 - DNA, 20 bp, Homo sapiens
ttcaattcaaaaatgtacaa

SEQ ID NO: 5810085 - DNA, 15 bp, Homo sapiens
ttcaattcaaagctg

SEQ ID NO: 5810086 - DNA, 17 bp, Homo sapiens
ttcaattcaacactccc

SEQ ID NO: 5810087 - DNA, 13 bp, Homo sapiens
ttcaattcagtgc

SEQ ID NO: 5810088 - DNA, 22 bp, Homo sapiens
ttcaattcatgtaacactgttg

SEQ ID NO: 5810089 - DNA, 15 bp, Homo sapiens
ttcaattccaccagg

SEQ ID NO: 5810090 - DNA, 16 bp, Homo sapiens
ttcaattcctgggccc

SEQ ID NO: 5810091 - DNA, 13 bp, Homo sapiens
ttcaattctcaaa

SEQ ID NO: 5810092 - DNA, 19 bp, Homo sapiens
ttcaattctgtaattacat

SEQ ID NO: 5810093 - DNA, 15 bp, Homo sapiens
ttcaattgcatctcc

SEQ ID NO: 5810094 - DNA, 21 bp, Homo sapiens
ttcaattgcttctgtgcaata

SEQ ID NO: 5810095 - DNA, 19 bp, Homo sapiens
ttcaattgctttgtgactt

SEQ ID NO: 5810096 - DNA, 18 bp, Homo sapiens
ttcaattggacaattatt

SEQ ID NO: 5810097 - DNA, 23 bp, Homo sapiens
ttcaatttaattcttatttctgt

SEQ ID NO: 5810098 - DNA, 20 bp, Homo sapiens
ttcaatttactttttaaaca

SEQ ID NO: 5810099 - DNA, 21 bp, Homo sapiens
ttcaatttactttttaaacag

SEQ ID NO: 5810100 - DNA, 18 bp, Homo sapiens
ttcaatttatacctagca

SEQ ID NO: 5810101 - DNA, 17 bp, Homo sapiens
ttcaatttattcaagaa

SEQ ID NO: 5810102 - DNA, 17 bp, Homo sapiens
ttcaatttattgcacaa

SEQ ID NO: 5810103 - DNA, 20 bp, Homo sapiens
ttcaatttattgcacaaaat

SEQ ID NO: 5810104 - DNA, 19 bp, Homo sapiens
ttcaatttgctatttacaa

SEQ ID NO: 5810105 - DNA, 15 bp, Homo sapiens
ttcaatttgtcatgt

SEQ ID NO: 5810106 - DNA, 20 bp, Homo sapiens
ttcaatttgttaacagagca

SEQ ID NO: 5810107 - DNA, 21 bp, Homo sapiens
ttcaatttgttaacagagcaa

SEQ ID NO: 5810108 - DNA, 16 bp, Homo sapiens
ttcacaaaaaaatgtt

SEQ ID NO: 5810109 - DNA, 18 bp, Homo sapiens
ttcacaaaaaaatgttca

SEQ ID NO: 5810110 - DNA, 20 bp, Homo sapiens
ttcacaaaaaaatgttcatt

SEQ ID NO: 5810111 - DNA, 14 bp, Homo sapiens
ttcacaaaatgcac

SEQ ID NO: 5810112 - DNA, 18 bp, Homo sapiens
ttcacaaaatgcacttct

SEQ ID NO: 5810113 - DNA, 19 bp, Homo sapiens
ttcacaaacattagtatag

SEQ ID NO: 5810114 - DNA, 14 bp, Homo sapiens
ttcacaaactgtga

SEQ ID NO: 5810115 - DNA, 23 bp, Homo sapiens
ttcacaaagtataacaattaaaa

SEQ ID NO: 5810116 - DNA, 13 bp, Homo sapiens
ttcacaaatatag

SEQ ID NO: 5810117 - DNA, 18 bp, Homo sapiens
ttcacaaatatagttgaa

SEQ ID NO: 5810118 - DNA, 14 bp, Homo sapiens
ttcacaaatattaa

SEQ ID NO: 5810119 - DNA, 18 bp, Homo sapiens
ttcacaaatgtcattgtc

SEQ ID NO: 5810120 - DNA, 16 bp, Homo sapiens
ttcacaacagatttct

SEQ ID NO: 5810121 - DNA, 21 bp, Homo sapiens
ttcacaacataaggagaatgt

SEQ ID NO: 5810122 - DNA, 16 bp, Homo sapiens
ttcacaaccagccaca

SEQ ID NO: 5810123 - DNA, 12 bp, Homo sapiens
ttcacaacctgg

SEQ ID NO: 5810124 - DNA, 21 bp, Homo sapiens
ttcacaaccttctgtggctca

SEQ ID NO: 5810125 - DNA, 13 bp, Homo sapiens
ttcacaactagga

SEQ ID NO: 5810126 - DNA, 13 bp, Homo sapiens
ttcacaagctaac

SEQ ID NO: 5810127 - DNA, 16 bp, Homo sapiens
ttcacaagctgcctcc

SEQ ID NO: 5810128 - DNA, 17 bp, Homo sapiens
ttcacaagctgcctccc

SEQ ID NO: 5810129 - DNA, 18 bp, Homo sapiens
ttcacaaggtaccccaaa

SEQ ID NO: 5810130 - DNA, 22 bp, Homo sapiens
ttcacaagtgagccctcttgcc

SEQ ID NO: 5810131 - DNA, 15 bp, Homo sapiens
ttcacaagttaagat

SEQ ID NO: 5810132 - DNA, 19 bp, Homo sapiens
ttcacaatcttggggctga

SEQ ID NO: 5810133 - DNA, 16 bp, Homo sapiens
ttcacaatgtcagtat

SEQ ID NO: 5810134 - DNA, 15 bp, Homo sapiens
ttcacaatgtgaaac

SEQ ID NO: 5810135 - DNA, 22 bp, Homo sapiens
ttcacaatgttggcctgtcaga

SEQ ID NO: 5810136 - DNA, 19 bp, Homo sapiens
ttcacaattattaaattgt

SEQ ID NO: 5810137 - DNA, 13 bp, Homo sapiens
ttcacaatttcaa

SEQ ID NO: 5810138 - DNA, 18 bp, Homo sapiens
ttcacaatttcaatgctt

SEQ ID NO: 5810139 - DNA, 16 bp, Homo sapiens
ttcacacaaagcctgt

SEQ ID NO: 5810140 - DNA, 19 bp, Homo sapiens
ttcacacaaagtgaaatta

SEQ ID NO: 5810141 - DNA, 15 bp, Homo sapiens
ttcacacaactactt

SEQ ID NO: 5810142 - DNA, 22 bp, Homo sapiens
ttcacacacacacaatggcaag

SEQ ID NO: 5810143 - DNA, 21 bp, Homo sapiens
ttcacacacaggcaactgagg

SEQ ID NO: 5810144 - DNA, 23 bp, Homo sapiens
ttcacacactcacaatttaaaat

SEQ ID NO: 5810145 - DNA, 14 bp, Homo sapiens
ttcacacagataga

SEQ ID NO: 5810146 - DNA, 14 bp, Homo sapiens
ttcacaccccacct

SEQ ID NO: 5810147 - DNA, 19 bp, Homo sapiens
ttcacaccccacctgcgct

SEQ ID NO: 5810148 - DNA, 21 bp, Homo sapiens
ttcacacccctcagcgctccc

SEQ ID NO: 5810149 - DNA, 13 bp, Homo sapiens
ttcacaccctgca

SEQ ID NO: 5810150 - DNA, 14 bp, Homo sapiens
ttcacaccctgcaa

SEQ ID NO: 5810151 - DNA, 19 bp, Homo sapiens
ttcacacctcacgctctgg

SEQ ID NO: 5810152 - DNA, 19 bp, Homo sapiens
ttcacaccttacaaagcca

SEQ ID NO: 5810153 - DNA, 20 bp, Homo sapiens
ttcacaccttacaaagccag

SEQ ID NO: 5810154 - DNA, 14 bp, Homo sapiens
ttcacactctcaca

SEQ ID NO: 5810155 - DNA, 13 bp, Homo sapiens
ttcacactgtctg

SEQ ID NO: 5810156 - DNA, 12 bp, Homo sapiens
ttcacacttcca

SEQ ID NO: 5810157 - DNA, 18 bp, Homo sapiens
ttcacacttccaccagcc

SEQ ID NO: 5810158 - DNA, 15 bp, Homo sapiens
ttcagctccagctca

SEQ ID NO: 5810159 - DNA, 21 bp, Homo sapiens
ttcagctcccatagcgctggc

SEQ ID NO: 5810160 - DNA, 18 bp, Homo sapiens
ttcagctcccttcccttg

SEQ ID NO: 5810161 - DNA, 10 bp, Homo sapiens
ttcagctcct

SEQ ID NO: 5810162 - DNA, 14 bp, Homo sapiens
ttcagctcctgagt

SEQ ID NO: 5810163 - DNA, 19 bp, Homo sapiens
ttcagctcctgagtagctg

SEQ ID NO: 5810164 - DNA, 17 bp, Homo sapiens
ttcagctctctgtataa

SEQ ID NO: 5810165 - DNA, 11 bp, Homo sapiens
ttcagctctgg

SEQ ID NO: 5810166 - DNA, 14 bp, Homo sapiens
ttcagctctggaga

SEQ ID NO: 5810167 - DNA, 15 bp, Homo sapiens
ttcagctctggagaa

SEQ ID NO: 5810168 - DNA, 17 bp, Homo sapiens
ttcagctcttaaaaaga

SEQ ID NO: 5810169 - DNA, 19 bp, Homo sapiens
ttcagctcttaaaaagaca

SEQ ID NO: 5810170 - DNA, 19 bp, Homo sapiens
ttcagctgacagctgctca

SEQ ID NO: 5810171 - DNA, 18 bp, Homo sapiens
ttcagctgcatacagttt

SEQ ID NO: 5810172 - DNA, 17 bp, Homo sapiens
ttcagctgcctgaaaca

SEQ ID NO: 5810173 - DNA, 16 bp, Homo sapiens
ttcagctgcttctctt

SEQ ID NO: 5810174 - DNA, 20 bp, Homo sapiens
ttcagctggtggatggtgac

SEQ ID NO: 5810175 - DNA, 21 bp, Homo sapiens
ttcagctggtggatggtgact

SEQ ID NO: 5810176 - DNA, 16 bp, Homo sapiens
ttcagctgtcctccct

SEQ ID NO: 5810177 - DNA, 18 bp, Homo sapiens
ttcagctgtcctccctcc

SEQ ID NO: 5810178 - DNA, 19 bp, Homo sapiens
ttcagctgtttcgcatcca

SEQ ID NO: 5810179 - DNA, 20 bp, Homo sapiens
ttcagcttataatgaaatct

SEQ ID NO: 5810180 - DNA, 22 bp, Homo sapiens
ttcagcttcctgctgctggggc

SEQ ID NO: 5810181 - DNA, 16 bp, Homo sapiens
ttcagcttctgctggg

SEQ ID NO: 5810182 - DNA, 20 bp, Homo sapiens
ttcagcttctgctgggctgg

SEQ ID NO: 5810183 - DNA, 22 bp, Homo sapiens
ttcagcttctgctgggctgggg

SEQ ID NO: 5810184 - DNA, 14 bp, Homo sapiens
ttcagcttctgttg

SEQ ID NO: 5810185 - DNA, 22 bp, Homo sapiens
ttcagcttgtaaatagctcagg

SEQ ID NO: 5810186 - DNA, 15 bp, Homo sapiens
ttcagcttgtttcta

SEQ ID NO: 5810187 - DNA, 20 bp, Homo sapiens
ttcagctttatttttcttta

SEQ ID NO: 5810188 - DNA, 22 bp, Homo sapiens
ttcagctttctcgcgccctccc

SEQ ID NO: 5810189 - DNA, 14 bp, Homo sapiens
ttcagctttcttca

SEQ ID NO: 5810190 - DNA, 22 bp, Homo sapiens
ttcagctttggctctggctgct

SEQ ID NO: 5810191 - DNA, 19 bp, Homo sapiens
ttcaggaaaagcctctgtg

SEQ ID NO: 5810192 - DNA, 19 bp, Homo sapiens
ttcaggaaaaggcctgggg

SEQ ID NO: 5810193 - DNA, 13 bp, Homo sapiens
ttcaggaaaatgt

SEQ ID NO: 5810194 - DNA, 22 bp, Homo sapiens
ttcaggaaatctacttcctaca

SEQ ID NO: 5810195 - DNA, 13 bp, Homo sapiens
ttcaggaaatttt

SEQ ID NO: 5810196 - DNA, 14 bp, Homo sapiens
ttcaggaaattttt

SEQ ID NO: 5810197 - DNA, 18 bp, Homo sapiens
ttcaggaaatttttgcat

SEQ ID NO: 5810198 - DNA, 14 bp, Homo sapiens
ttcaggaagatgaa

SEQ ID NO: 5810199 - DNA, 16 bp, Homo sapiens
ttcaggaagctcaggg

SEQ ID NO: 5810200 - DNA, 20 bp, Homo sapiens
ttcaggaatttaatttatag

SEQ ID NO: 5810201 - DNA, 14 bp, Homo sapiens
ttcaggacatgggg

SEQ ID NO: 5810202 - DNA, 20 bp, Homo sapiens
ttcaggacatggggcataga

SEQ ID NO: 5810203 - DNA, 15 bp, Homo sapiens
ttcaggacccttcta

SEQ ID NO: 5810204 - DNA, 13 bp, Homo sapiens
ttcaggagacttt

SEQ ID NO: 5810205 - DNA, 14 bp, Homo sapiens
ttcaggagcgcaag

SEQ ID NO: 5810206 - DNA, 18 bp, Homo sapiens
ttcaggagcgcaagatag

SEQ ID NO: 5810207 - DNA, 18 bp, Homo sapiens
ttcaggaggaatactgaa

SEQ ID NO: 5810208 - DNA, 19 bp, Homo sapiens
ttcaggaggagacagtcag

SEQ ID NO: 5810209 - DNA, 12 bp, Homo sapiens
ttcaggagggat

SEQ ID NO: 5810210 - DNA, 19 bp, Homo sapiens
ttcaggagtccaaaccttc

SEQ ID NO: 5810211 - DNA, 17 bp, Homo sapiens
ttcaggagttggaatgt

SEQ ID NO: 5810212 - DNA, 18 bp, Homo sapiens
ttcaggagtttgagacca

SEQ ID NO: 5810213 - DNA, 16 bp, Homo sapiens
ttcaggatacatgtgc

SEQ ID NO: 5810214 - DNA, 21 bp, Homo sapiens
ttcaggatactctgtcagatg

SEQ ID NO: 5810215 - DNA, 17 bp, Homo sapiens
ttcaggcagcactgaca

SEQ ID NO: 5810216 - DNA, 12 bp, Homo sapiens
ttcaggcagcag

SEQ ID NO: 5810217 - DNA, 16 bp, Homo sapiens
ttcaggcagctgaaat

SEQ ID NO: 5810218 - DNA, 17 bp, Homo sapiens
ttcaggcagctgaaatt

SEQ ID NO: 5810219 - DNA, 16 bp, Homo sapiens
ttcaggcatattttaa

SEQ ID NO: 5810220 - DNA, 17 bp, Homo sapiens
ttcaggcattttccccc

SEQ ID NO: 5810221 - DNA, 15 bp, Homo sapiens
ttcaggcattttgtt

SEQ ID NO: 5810222 - DNA, 15 bp, Homo sapiens
ttcaggccagcccag

SEQ ID NO: 5810223 - DNA, 22 bp, Homo sapiens
ttcaggccaggtagcagcaaat

SEQ ID NO: 5810224 - DNA, 17 bp, Homo sapiens
ttcaggccagtgtggtg

SEQ ID NO: 5810225 - DNA, 21 bp, Homo sapiens
ttcaggcccgctgccctagga

SEQ ID NO: 5810226 - DNA, 14 bp, Homo sapiens
ttcaggccttgcct

SEQ ID NO: 5810227 - DNA, 23 bp, Homo sapiens
ttcaggctcgccaaggcctagga

SEQ ID NO: 5810228 - DNA, 15 bp, Homo sapiens
ttcaggctcttctcc

SEQ ID NO: 5810229 - DNA, 18 bp, Homo sapiens
ttcagggaagataagttg

SEQ ID NO: 5810230 - DNA, 23 bp, Homo sapiens
ttcagggaagataagttggaaac

SEQ ID NO: 5810231 - DNA, 13 bp, Homo sapiens
ttcagggaagcag

SEQ ID NO: 5810232 - DNA, 18 bp, Homo sapiens
ttcagggaccgtccaggg

SEQ ID NO: 5810233 - DNA, 16 bp, Homo sapiens
ttcagggacctcaggg

SEQ ID NO: 5810234 - DNA, 17 bp, Homo sapiens
ttcagggacctcagggg

SEQ ID NO: 5810235 - DNA, 21 bp, Homo sapiens
ttcagggacctcaggggcacc

SEQ ID NO: 5810236 - DNA, 22 bp, Homo sapiens
ttcagggacctcaggggcacct

SEQ ID NO: 5810237 - DNA, 22 bp, Homo sapiens
ttcagggaggtagtttcaaagg

SEQ ID NO: 5810238 - DNA, 18 bp, Homo sapiens
ttcagggcagattttagt

SEQ ID NO: 5810239 - DNA, 20 bp, Homo sapiens
ttcagggcagattttagttt

SEQ ID NO: 5810240 - DNA, 18 bp, Homo sapiens
ttcagggcagggctctga

SEQ ID NO: 5810241 - DNA, 16 bp, Homo sapiens
ttcagggccagaagga

SEQ ID NO: 5810242 - DNA, 23 bp, Homo sapiens
ttcagggccagaaggagggcaga

SEQ ID NO: 5810243 - DNA, 15 bp, Homo sapiens
ttcaggggaagagaa

SEQ ID NO: 5810244 - DNA, 17 bp, Homo sapiens
ttcaggggaagagaaga

SEQ ID NO: 5810245 - DNA, 23 bp, Homo sapiens
ttcaggggactcagccctgaggt

SEQ ID NO: 5810246 - DNA, 21 bp, Homo sapiens
ttcaggggagtcccgtcagga

SEQ ID NO: 5810247 - DNA, 23 bp, Homo sapiens
ttcaggggctagctaagccaaga

SEQ ID NO: 5810248 - DNA, 22 bp, Homo sapiens
ttcaggggctgcccgctcccag

SEQ ID NO: 5810249 - DNA, 23 bp, Homo sapiens
ttcaggggctgggggtgctggat

SEQ ID NO: 5810250 - DNA, 15 bp, Homo sapiens
ttcaggggctttggg

SEQ ID NO: 5810251 - DNA, 16 bp, Homo sapiens
ttcaggggctttgggc

SEQ ID NO: 5810252 - DNA, 22 bp, Homo sapiens
ttcagggggccaggtgcacaga

SEQ ID NO: 5810253 - DNA, 22 bp, Homo sapiens
ttcagggggcctttaaagactt

SEQ ID NO: 5810254 - DNA, 21 bp, Homo sapiens
ttcagggtaggtttgtgtctt

SEQ ID NO: 5810255 - DNA, 16 bp, Homo sapiens
ttcagggtcctgagat

SEQ ID NO: 5810256 - DNA, 15 bp, Homo sapiens
ttcagggtgatgcca

SEQ ID NO: 5810257 - DNA, 14 bp, Homo sapiens
ttcagggttataca

SEQ ID NO: 5810258 - DNA, 14 bp, Homo sapiens
ttcagggttggccc

SEQ ID NO: 5810259 - DNA, 16 bp, Homo sapiens
ttcagggttggcccct

SEQ ID NO: 5810260 - DNA, 19 bp, Homo sapiens
ttcagggttggcccctgcc

SEQ ID NO: 5810261 - DNA, 22 bp, Homo sapiens
ttcagggttggcccctgcccgg

SEQ ID NO: 5810262 - DNA, 16 bp, Homo sapiens
ttcaggtaaaaacttc

SEQ ID NO: 5810263 - DNA, 16 bp, Homo sapiens
ttcaggtaacaggcag

SEQ ID NO: 5810264 - DNA, 20 bp, Homo sapiens
ttcaggtagaggtgcatgcc

SEQ ID NO: 5810265 - DNA, 16 bp, Homo sapiens
ttcaggtatgttgcct

SEQ ID NO: 5810266 - DNA, 18 bp, Homo sapiens
ttcaggtcaactctgaag

SEQ ID NO: 5810267 - DNA, 23 bp, Homo sapiens
ttcaggtcaactctgaagagtat

SEQ ID NO: 5810268 - DNA, 16 bp, Homo sapiens
ttcaggtccaggccag

SEQ ID NO: 5810269 - DNA, 20 bp, Homo sapiens
ttcaggtcccagttgctgtc

SEQ ID NO: 5810270 - DNA, 23 bp, Homo sapiens
ttcaggtcccagttgctgtcaca

SEQ ID NO: 5810271 - DNA, 22 bp, Homo sapiens
ttcaggtcccctggcccttcct

SEQ ID NO: 5810272 - DNA, 15 bp, Homo sapiens
ttcaggtgaaaatgt

SEQ ID NO: 5810273 - DNA, 14 bp, Homo sapiens
ttcaggtgacatgt

SEQ ID NO: 5810274 - DNA, 22 bp, Homo sapiens
ttcaggtgacatgtgaaacctt

SEQ ID NO: 5810275 - DNA, 18 bp, Homo sapiens
ttcaggtgacctcctgca

SEQ ID NO: 5810276 - DNA, 18 bp, Homo sapiens
ttcaggtgcagaggaagt

SEQ ID NO: 5810277 - DNA, 20 bp, Homo sapiens
ttcaggtgcttttgatgtga

SEQ ID NO: 5810278 - DNA, 18 bp, Homo sapiens
ttcaggtggagagcacta

SEQ ID NO: 5810279 - DNA, 21 bp, Homo sapiens
ttcaggtggagagcactagaa

SEQ ID NO: 5810280 - DNA, 21 bp, Homo sapiens
ttcaggtgtagtagttctgtg

SEQ ID NO: 5810281 - DNA, 23 bp, Homo sapiens
ttcaggtgtagtagttctgtgtt

SEQ ID NO: 5810282 - DNA, 19 bp, Homo sapiens
ttcaggttatcgaaataac

SEQ ID NO: 5810283 - DNA, 24 bp, Homo sapiens
ttcaggttatcgaaataacaatgt

SEQ ID NO: 5810284 - DNA, 17 bp, Homo sapiens
ttcaggttcctcctagg

SEQ ID NO: 5810285 - DNA, 15 bp, Homo sapiens
ttcaggttgcattgg

SEQ ID NO: 5810286 - DNA, 22 bp, Homo sapiens
ttcaggttgtgcattttgtgtg

SEQ ID NO: 5810287 - DNA, 19 bp, Homo sapiens
ttcaggttttgtaaagatg

SEQ ID NO: 5810288 - DNA, 16 bp, Homo sapiens
ttcaggtttttccttt

SEQ ID NO: 5810289 - DNA, 22 bp, Homo sapiens
ttcagtaaaaggacctcgggga

SEQ ID NO: 5810290 - DNA, 14 bp, Homo sapiens
ttcagtaagccgtg

SEQ ID NO: 5810291 - DNA, 18 bp, Homo sapiens
ttcagtaagttctgtggt

SEQ ID NO: 5810292 - DNA, 20 bp, Homo sapiens
ttcagtaataaactgtgttt

SEQ ID NO: 5810293 - DNA, 14 bp, Homo sapiens
ttcagtaataactc

SEQ ID NO: 5810294 - DNA, 16 bp, Homo sapiens
ttcagtaatgtcttca

SEQ ID NO: 5810295 - DNA, 15 bp, Homo sapiens
ttcagtacctggagg

SEQ ID NO: 5810296 - DNA, 23 bp, Homo sapiens
ttcagtactctacaattcctctg

SEQ ID NO: 5810297 - DNA, 14 bp, Homo sapiens
ttcagtactgcagc

SEQ ID NO: 5810298 - DNA, 15 bp, Homo sapiens
ttcagtacttcagca

SEQ ID NO: 5810299 - DNA, 17 bp, Homo sapiens
ttcagtagaattaccat

SEQ ID NO: 5810300 - DNA, 18 bp, Homo sapiens
ttcagtagaattaccatt

SEQ ID NO: 5810301 - DNA, 17 bp, Homo sapiens
ttcagtagaattttagt

SEQ ID NO: 5810302 - DNA, 19 bp, Homo sapiens
ttcagtaggatttatgtat

SEQ ID NO: 5810303 - DNA, 23 bp, Homo sapiens
ttcagtagtttctaagtctgtta

SEQ ID NO: 5810304 - DNA, 16 bp, Homo sapiens
ttcagtataatttaac

SEQ ID NO: 5810305 - DNA, 20 bp, Homo sapiens
ttcagtataatttaacttca

SEQ ID NO: 5810306 - DNA, 23 bp, Homo sapiens
ttcagtataatttaacttcagag

SEQ ID NO: 5810307 - DNA, 16 bp, Homo sapiens
ttcagtatactgtgtg

SEQ ID NO: 5810308 - DNA, 17 bp, Homo sapiens
ttcagtatactgtgtgg

SEQ ID NO: 5810309 - DNA, 15 bp, Homo sapiens
ttcagtatcaaggct

SEQ ID NO: 5810310 - DNA, 17 bp, Homo sapiens
ttcagtatcttagagtt

SEQ ID NO: 5810311 - DNA, 19 bp, Homo sapiens
ttcagtatgttttacactg

SEQ ID NO: 5810312 - DNA, 20 bp, Homo sapiens
ttcagtatgttttacactgt

SEQ ID NO: 5810313 - DNA, 21 bp, Homo sapiens
ttcagtattaaactctccttt

SEQ ID NO: 5810314 - DNA, 16 bp, Homo sapiens
ttcagtattatttgta

SEQ ID NO: 5810315 - DNA, 17 bp, Homo sapiens
ttcagtatttaatgaaa

SEQ ID NO: 5810316 - DNA, 19 bp, Homo sapiens
ttcagtatttattgagcat

SEQ ID NO: 5810317 - DNA, 14 bp, Homo sapiens
ttcagtattttcca

SEQ ID NO: 5810318 - DNA, 18 bp, Homo sapiens
ttcagtattttccagcct

SEQ ID NO: 5810319 - DNA, 20 bp, Homo sapiens
ttcagtcagggtttgtcaga

SEQ ID NO: 5810320 - DNA, 22 bp, Homo sapiens
ttcagtcatctccaaaaacagt

SEQ ID NO: 5810321 - DNA, 13 bp, Homo sapiens
ttcagtcattaaa

SEQ ID NO: 5810322 - DNA, 15 bp, Homo sapiens
ttcagtcattaaatt

SEQ ID NO: 5810323 - DNA, 16 bp, Homo sapiens
ttcagtcattaaatta

SEQ ID NO: 5810324 - DNA, 19 bp, Homo sapiens
ttcagtcccctctctctgg

SEQ ID NO: 5810325 - DNA, 21 bp, Homo sapiens
ttcagtccctgagcagtctac

SEQ ID NO: 5810326 - DNA, 22 bp, Homo sapiens
ttcagtcctgggagacccatgt

SEQ ID NO: 5810327 - DNA, 19 bp, Homo sapiens
ttcagtcctgggcaaaggt

SEQ ID NO: 5810328 - DNA, 15 bp, Homo sapiens
ttcagtcctggtctg

SEQ ID NO: 5810329 - DNA, 16 bp, Homo sapiens
ttcagtcctgtagttt

SEQ ID NO: 5810330 - DNA, 17 bp, Homo sapiens
ttcagtcctttgtcttt

SEQ ID NO: 5810331 - DNA, 20 bp, Homo sapiens
ttcagtcctttgtctttctt

SEQ ID NO: 5810332 - DNA, 12 bp, Homo sapiens
ttcagtctagaa

SEQ ID NO: 5810333 - DNA, 17 bp, Homo sapiens
ttcagtctagaagaatt

SEQ ID NO: 5810334 - DNA, 13 bp, Homo sapiens
ttcattgcacttt

SEQ ID NO: 5810335 - DNA, 19 bp, Homo sapiens
ttcattgcactttgattag

SEQ ID NO: 5810336 - DNA, 17 bp, Homo sapiens
ttcattgccagtgtctt

SEQ ID NO: 5810337 - DNA, 16 bp, Homo sapiens
ttcattgcccactagg

SEQ ID NO: 5810338 - DNA, 18 bp, Homo sapiens
ttcattgcctgtgtatgg

SEQ ID NO: 5810339 - DNA, 22 bp, Homo sapiens
ttcattgctacacttacaagta

SEQ ID NO: 5810340 - DNA, 13 bp, Homo sapiens
ttcattggatgca

SEQ ID NO: 5810341 - DNA, 22 bp, Homo sapiens
ttcattggctatataaaatgtg

SEQ ID NO: 5810342 - DNA, 19 bp, Homo sapiens
ttcattggtactgccttaa

SEQ ID NO: 5810343 - DNA, 22 bp, Homo sapiens
ttcattggtactgccttaaaga

SEQ ID NO: 5810344 - DNA, 22 bp, Homo sapiens
ttcattggtctaatttattcaa

SEQ ID NO: 5810345 - DNA, 16 bp, Homo sapiens
ttcattggttaatttt

SEQ ID NO: 5810346 - DNA, 14 bp, Homo sapiens
ttcattgtaaatca

SEQ ID NO: 5810347 - DNA, 21 bp, Homo sapiens
ttcattgtaaatcacttgttt

SEQ ID NO: 5810348 - DNA, 17 bp, Homo sapiens
ttcattgtaatgttact

SEQ ID NO: 5810349 - DNA, 18 bp, Homo sapiens
ttcattgtaatgttactg

SEQ ID NO: 5810350 - DNA, 12 bp, Homo sapiens
ttcattgtacaa

SEQ ID NO: 5810351 - DNA, 17 bp, Homo sapiens
ttcattgtataaaaata

SEQ ID NO: 5810352 - DNA, 14 bp, Homo sapiens
ttcattgtctgtga

SEQ ID NO: 5810353 - DNA, 19 bp, Homo sapiens
ttcattgtggttattttta

SEQ ID NO: 5810354 - DNA, 24 bp, Homo sapiens
ttcattgtggttatttttatacag

SEQ ID NO: 5810355 - DNA, 12 bp, Homo sapiens
ttcattgtgtat

SEQ ID NO: 5810356 - DNA, 10 bp, Homo sapiens
ttcattgttt

SEQ ID NO: 5810357 - DNA, 14 bp, Homo sapiens
ttcatttaaactaa

SEQ ID NO: 5810358 - DNA, 16 bp, Homo sapiens
ttcatttaacactgag

SEQ ID NO: 5810359 - DNA, 19 bp, Homo sapiens
ttcatttaacactgagtga

SEQ ID NO: 5810360 - DNA, 23 bp, Homo sapiens
ttcatttaacactgagtgaaata

SEQ ID NO: 5810361 - DNA, 16 bp, Homo sapiens
ttcatttaactacaaa

SEQ ID NO: 5810362 - DNA, 15 bp, Homo sapiens
ttcatttaactttat

SEQ ID NO: 5810363 - DNA, 17 bp, Homo sapiens
ttcatttaactttataa

SEQ ID NO: 5810364 - DNA, 15 bp, Homo sapiens
ttcatttaagggaaa

SEQ ID NO: 5810365 - DNA, 20 bp, Homo sapiens
ttcatttaagggaaagaaaa

SEQ ID NO: 5810366 - DNA, 14 bp, Homo sapiens
ttcatttaatatat

SEQ ID NO: 5810367 - DNA, 13 bp, Homo sapiens
ttcatttacaatt

SEQ ID NO: 5810368 - DNA, 20 bp, Homo sapiens
ttcatttacaatttcaaaag

SEQ ID NO: 5810369 - DNA, 22 bp, Homo sapiens
ttcatttactgatcatctgctg

SEQ ID NO: 5810370 - DNA, 16 bp, Homo sapiens
ttcatttactgtggct

SEQ ID NO: 5810371 - DNA, 22 bp, Homo sapiens
ttcatttagagctagtctttca

SEQ ID NO: 5810372 - DNA, 19 bp, Homo sapiens
ttcatttagataatttgaa

SEQ ID NO: 5810373 - DNA, 21 bp, Homo sapiens
ttcatttagctaaacggattc

SEQ ID NO: 5810374 - DNA, 18 bp, Homo sapiens
ttcatttaggtgaggaag

SEQ ID NO: 5810375 - DNA, 19 bp, Homo sapiens
ttcatttagtcatgtgacc

SEQ ID NO: 5810376 - DNA, 14 bp, Homo sapiens
ttcatttattaagt

SEQ ID NO: 5810377 - DNA, 23 bp, Homo sapiens
ttcatttattaagtatatttgta

SEQ ID NO: 5810378 - DNA, 13 bp, Homo sapiens
ttcatttcaatca

SEQ ID NO: 5810379 - DNA, 21 bp, Homo sapiens
ttcatttcaatcattgaagta

SEQ ID NO: 5810380 - DNA, 18 bp, Homo sapiens
ttcatttcacatttttgt

SEQ ID NO: 5810381 - DNA, 15 bp, Homo sapiens
ttcatttcactttaa

SEQ ID NO: 5810382 - DNA, 18 bp, Homo sapiens
ttcatttcagggtcttgg

SEQ ID NO: 5810383 - DNA, 14 bp, Homo sapiens
ttcatttcatcctt

SEQ ID NO: 5810384 - DNA, 11 bp, Homo sapiens
ttcatttcatt

SEQ ID NO: 5810385 - DNA, 12 bp, Homo sapiens
ttcatttccagc

SEQ ID NO: 5810386 - DNA, 17 bp, Homo sapiens
ttcatttcctctgagct

SEQ ID NO: 5810387 - DNA, 22 bp, Homo sapiens
ttcatttcctctgagctgttat

SEQ ID NO: 5810388 - DNA, 12 bp, Homo sapiens
ttcatttcctgc

SEQ ID NO: 5810389 - DNA, 15 bp, Homo sapiens
ttcatttctaacata

SEQ ID NO: 5810390 - DNA, 14 bp, Homo sapiens
ttcatttctagact

SEQ ID NO: 5810391 - DNA, 22 bp, Homo sapiens
ttcatttctatagccaaagctg

SEQ ID NO: 5810392 - DNA, 19 bp, Homo sapiens
ttcatttctgatatagaat

SEQ ID NO: 5810393 - DNA, 11 bp, Homo sapiens
ttcatttctta

SEQ ID NO: 5810394 - DNA, 15 bp, Homo sapiens
ttcatttctttcctt

SEQ ID NO: 5810395 - DNA, 14 bp, Homo sapiens
ttcatttgaaacct

SEQ ID NO: 5810396 - DNA, 21 bp, Homo sapiens
ttcatttgacacaaagcttct

SEQ ID NO: 5810397 - DNA, 22 bp, Homo sapiens
ttcatttgctaagtgtatgatg

SEQ ID NO: 5810398 - DNA, 16 bp, Homo sapiens
ttcatttgctttggaa

SEQ ID NO: 5810399 - DNA, 22 bp, Homo sapiens
ttcatttggttcattaattcta

SEQ ID NO: 5810400 - DNA, 18 bp, Homo sapiens
ttcatttgtaaaaatgag

SEQ ID NO: 5810401 - DNA, 12 bp, Homo sapiens
ttcatttgtaca

SEQ ID NO: 5810402 - DNA, 21 bp, Homo sapiens
ttcatttgtacaaggtaattg

SEQ ID NO: 5810403 - DNA, 17 bp, Homo sapiens
ttcatttgtatgtcaaa

SEQ ID NO: 5810404 - DNA, 13 bp, Homo sapiens
ttcatttgtgcca

SEQ ID NO: 5810405 - DNA, 15 bp, Homo sapiens
ttcatttgtgccaca

SEQ ID NO: 5810406 - DNA, 22 bp, Homo sapiens
ttcatttgtttgtttgtttgtc

SEQ ID NO: 5810407 - DNA, 19 bp, Homo sapiens
ttcatttgttttgcttttg

SEQ ID NO: 5810408 - DNA, 17 bp, Homo sapiens
ttcatttgttttttcaa

SEQ ID NO: 5810409 - DNA, 21 bp, Homo sapiens
ttcattttaacatctgagaaa

SEQ ID NO: 5810410 - DNA, 18 bp, Homo sapiens
ttcattttaactggcatg

SEQ ID NO: 5810411 - DNA, 12 bp, Homo sapiens
ttcattttactg

SEQ ID NO: 5810412 - DNA, 18 bp, Homo sapiens
ttcattttactgtatatt

SEQ ID NO: 5810413 - DNA, 23 bp, Homo sapiens
ttcattttagtgtatctttaaaa

SEQ ID NO: 5810414 - DNA, 18 bp, Homo sapiens
ttcattttatattgaaaa

SEQ ID NO: 5810415 - DNA, 15 bp, Homo sapiens
ttcattttatgaaga

SEQ ID NO: 5810416 - DNA, 16 bp, Homo sapiens
ttcattttcagagtga

SEQ ID NO: 5810417 - DNA, 11 bp, Homo sapiens
ttcattttcat

SEQ ID NO: 5810418 - DNA, 18 bp, Homo sapiens
ttcattttcattatttca

SEQ ID NO: 5810419 - DNA, 11 bp, Homo sapiens
ttcattttcca

SEQ ID NO: 5810420 - DNA, 13 bp, Homo sapiens
ttcattttcctgt

SEQ ID NO: 5810421 - DNA, 19 bp, Homo sapiens
ttcattttctagatacaat

SEQ ID NO: 5810422 - DNA, 20 bp, Homo sapiens
ttcattttctagatacaata

SEQ ID NO: 5810423 - DNA, 17 bp, Homo sapiens
ttcattttctgacatgc

SEQ ID NO: 5810424 - DNA, 16 bp, Homo sapiens
ttcattttctttcctt

SEQ ID NO: 5810425 - DNA, 23 bp, Homo sapiens
ttcattttgaaaatatgtactgt

SEQ ID NO: 5810426 - DNA, 13 bp, Homo sapiens
ttcattttgcaga

SEQ ID NO: 5810427 - DNA, 15 bp, Homo sapiens
ttcattttgcagaag

SEQ ID NO: 5810428 - DNA, 17 bp, Homo sapiens
ttcattttgctttaatt

SEQ ID NO: 5810429 - DNA, 16 bp, Homo sapiens
ttcattttgggccttg

SEQ ID NO: 5810430 - DNA, 14 bp, Homo sapiens
ttcattttgtataa

SEQ ID NO: 5810431 - DNA, 18 bp, Homo sapiens
ttcattttgttttgctct

SEQ ID NO: 5810432 - DNA, 20 bp, Homo sapiens
ttcattttgttttgctctga

SEQ ID NO: 5810433 - DNA, 14 bp, Homo sapiens
ttcatttttaagaa

SEQ ID NO: 5810434 - DNA, 21 bp, Homo sapiens
ttcatttttatcccttcctgt

SEQ ID NO: 5810435 - DNA, 12 bp, Homo sapiens
ttcatttttcaa

SEQ ID NO: 5810436 - DNA, 16 bp, Homo sapiens
ttcatttttctgttag

SEQ ID NO: 5810437 - DNA, 16 bp, Homo sapiens
ttcatttttgtaataa

SEQ ID NO: 5810438 - DNA, 18 bp, Homo sapiens
ttcatttttgtaataaca

SEQ ID NO: 5810439 - DNA, 23 bp, Homo sapiens
ttcatttttgtgagcctctttgt

SEQ ID NO: 5810440 - DNA, 19 bp, Homo sapiens
ttcatttttttctctctgg

SEQ ID NO: 5810441 - DNA, 21 bp, Homo sapiens
ttcatttttttctctctggag

SEQ ID NO: 5810442 - DNA, 20 bp, Homo sapiens
ttccaaaaacaaagtgcaaa

SEQ ID NO: 5810443 - DNA, 22 bp, Homo sapiens
ttccaaaacatttctggacagt

SEQ ID NO: 5810444 - DNA, 18 bp, Homo sapiens
ttccaaaacctgcttcct

SEQ ID NO: 5810445 - DNA, 20 bp, Homo sapiens
ttccaaaacctgcttccttc

SEQ ID NO: 5810446 - DNA, 16 bp, Homo sapiens
ttccaaaagccaatgg

SEQ ID NO: 5810447 - DNA, 17 bp, Homo sapiens
ttccaaaagtgatagtg

SEQ ID NO: 5810448 - DNA, 18 bp, Homo sapiens
ttccaaaagtggcctctt

SEQ ID NO: 5810449 - DNA, 21 bp, Homo sapiens
ttccaaaagtggcctctttgt

SEQ ID NO: 5810450 - DNA, 22 bp, Homo sapiens
ttccaaaagtggcctctttgtc

SEQ ID NO: 5810451 - DNA, 12 bp, Homo sapiens
ttccaaaataat

SEQ ID NO: 5810452 - DNA, 19 bp, Homo sapiens
ttccaaaatattgacattg

SEQ ID NO: 5810453 - DNA, 21 bp, Homo sapiens
ttccaaacagacaaaacagat

SEQ ID NO: 5810454 - DNA, 22 bp, Homo sapiens
ttccaaacatgaggttctctct

SEQ ID NO: 5810455 - DNA, 14 bp, Homo sapiens
ttccaaacatggtt

SEQ ID NO: 5810456 - DNA, 16 bp, Homo sapiens
ttccaaacctggttca

SEQ ID NO: 5810457 - DNA, 15 bp, Homo sapiens
ttccaaaccttatct

SEQ ID NO: 5810458 - DNA, 21 bp, Homo sapiens
ttccaaagaaaagtattgttt

SEQ ID NO: 5810459 - DNA, 13 bp, Homo sapiens
ttccaaagaatgt

SEQ ID NO: 5810460 - DNA, 16 bp, Homo sapiens
ttccaaagaattctta

SEQ ID NO: 5810461 - DNA, 22 bp, Homo sapiens
ttccaaagagtagaattgcatt

SEQ ID NO: 5810462 - DNA, 18 bp, Homo sapiens
ttccaaagagtcatcatg

SEQ ID NO: 5810463 - DNA, 19 bp, Homo sapiens
ttccaaagcacattgaaag

SEQ ID NO: 5810464 - DNA, 21 bp, Homo sapiens
ttccaaagccagtgaaatgtg

SEQ ID NO: 5810465 - DNA, 21 bp, Homo sapiens
ttccaaagggcagtaaagttt

SEQ ID NO: 5810466 - DNA, 17 bp, Homo sapiens
ttccaaaggttgtacat

SEQ ID NO: 5810467 - DNA, 16 bp, Homo sapiens
ttccaaagtacactgt

SEQ ID NO: 5810468 - DNA, 16 bp, Homo sapiens
ttccaaagtctctaat

SEQ ID NO: 5810469 - DNA, 17 bp, Homo sapiens
ttccaaagtctctaatt

SEQ ID NO: 5810470 - DNA, 11 bp, Homo sapiens
ttccaaagtgc

SEQ ID NO: 5810471 - DNA, 12 bp, Homo sapiens
ttccaaagtgca

SEQ ID NO: 5810472 - DNA, 19 bp, Homo sapiens
ttccaaagtgcatgtcaca

SEQ ID NO: 5810473 - DNA, 20 bp, Homo sapiens
ttccaaagtgcatgtcacat

SEQ ID NO: 5810474 - DNA, 20 bp, Homo sapiens
ttccaaagtgtaagtttgtg

SEQ ID NO: 5810475 - DNA, 19 bp, Homo sapiens
ttccaaagttcttatctct

SEQ ID NO: 5810476 - DNA, 23 bp, Homo sapiens
ttccaaagttcttatctctagct

SEQ ID NO: 5810477 - DNA, 16 bp, Homo sapiens
ttccaaataaacattt

SEQ ID NO: 5810478 - DNA, 14 bp, Homo sapiens
ttccaaataaataa

SEQ ID NO: 5810479 - DNA, 19 bp, Homo sapiens
ttccaaataaggatttgtt

SEQ ID NO: 5810480 - DNA, 18 bp, Homo sapiens
ttccaaatacattccagt

SEQ ID NO: 5810481 - DNA, 19 bp, Homo sapiens
ttccaaatattagccaaag

SEQ ID NO: 5810482 - DNA, 17 bp, Homo sapiens
ttccaaatcaggctggg

SEQ ID NO: 5810483 - DNA, 21 bp, Homo sapiens
ttccaaatgaatgttgtctgt

SEQ ID NO: 5810484 - DNA, 14 bp, Homo sapiens
ttccaaatgcttct

SEQ ID NO: 5810485 - DNA, 16 bp, Homo sapiens
ttccaaatgtccctcc

SEQ ID NO: 5810486 - DNA, 19 bp, Homo sapiens
ttccaaattattaattgtc

SEQ ID NO: 5810487 - DNA, 23 bp, Homo sapiens
ttccaaattattaattgtcctgt

SEQ ID NO: 5810488 - DNA, 15 bp, Homo sapiens
ttccaaattcagttt

SEQ ID NO: 5810489 - DNA, 18 bp, Homo sapiens
ttccaaattcagtttcat

SEQ ID NO: 5810490 - DNA, 15 bp, Homo sapiens
ttccaaattctgctt

SEQ ID NO: 5810491 - DNA, 15 bp, Homo sapiens
ttccaaattgatggg

SEQ ID NO: 5810492 - DNA, 16 bp, Homo sapiens
ttccaaattgatgggt

SEQ ID NO: 5810493 - DNA, 16 bp, Homo sapiens
ttccaaatttggctca

SEQ ID NO: 5810494 - DNA, 15 bp, Homo sapiens
ttccaacaaagaaag

SEQ ID NO: 5810495 - DNA, 21 bp, Homo sapiens
ttccaacaatggggtgggccc

SEQ ID NO: 5810496 - DNA, 19 bp, Homo sapiens
ttccaacaccacagacaca

SEQ ID NO: 5810497 - DNA, 15 bp, Homo sapiens
ttccaacaggcacct

SEQ ID NO: 5810498 - DNA, 19 bp, Homo sapiens
ttccaacaggcacctctaa

SEQ ID NO: 5810499 - DNA, 16 bp, Homo sapiens
ttccaacatacaattt

SEQ ID NO: 5810500 - DNA, 17 bp, Homo sapiens
ttccaacatacaattta

SEQ ID NO: 5810501 - DNA, 15 bp, Homo sapiens
ttccaacatttctca

SEQ ID NO: 5810502 - DNA, 14 bp, Homo sapiens
ttccaacatttctt

SEQ ID NO: 5810503 - DNA, 16 bp, Homo sapiens
ttccaacatttcttgt

SEQ ID NO: 5810504 - DNA, 13 bp, Homo sapiens
ttccaaccaggca

SEQ ID NO: 5810505 - DNA, 16 bp, Homo sapiens
ttccaaccaggcagta

SEQ ID NO: 5810506 - DNA, 18 bp, Homo sapiens
ttccaaccccagctggcc

SEQ ID NO: 5810507 - DNA, 21 bp, Homo sapiens
ttccaaccccagctggcctct

SEQ ID NO: 5810508 - DNA, 23 bp, Homo sapiens
ttccaacctcctgctctgggacg

SEQ ID NO: 5810509 - DNA, 17 bp, Homo sapiens
ttccaacctgttcacgt

SEQ ID NO: 5810510 - DNA, 18 bp, Homo sapiens
ttccaaccttcctttttt

SEQ ID NO: 5810511 - DNA, 15 bp, Homo sapiens
ttccaactgctgccc

SEQ ID NO: 5810512 - DNA, 17 bp, Homo sapiens
ttccagtcttcctgaca

SEQ ID NO: 5810513 - DNA, 20 bp, Homo sapiens
ttccagtcttcctgacactt

SEQ ID NO: 5810514 - DNA, 19 bp, Homo sapiens
ttccagtgacttgcaatcc

SEQ ID NO: 5810515 - DNA, 22 bp, Homo sapiens
ttccagtgaggctctgcccttg

SEQ ID NO: 5810516 - DNA, 19 bp, Homo sapiens
ttccagtgcaacactgaag

SEQ ID NO: 5810517 - DNA, 14 bp, Homo sapiens
ttccagtgcagaga

SEQ ID NO: 5810518 - DNA, 17 bp, Homo sapiens
ttccagtgcagagatcc

SEQ ID NO: 5810519 - DNA, 13 bp, Homo sapiens
ttccagtgctgct

SEQ ID NO: 5810520 - DNA, 16 bp, Homo sapiens
ttccagtggaccctgg

SEQ ID NO: 5810521 - DNA, 18 bp, Homo sapiens
ttccagtggaccctggac

SEQ ID NO: 5810522 - DNA, 18 bp, Homo sapiens
ttccagtggcttctccca

SEQ ID NO: 5810523 - DNA, 19 bp, Homo sapiens
ttccagtggcttctcccaa

SEQ ID NO: 5810524 - DNA, 19 bp, Homo sapiens
ttccagtggtaccagctca

SEQ ID NO: 5810525 - DNA, 22 bp, Homo sapiens
ttccagtgtctataaaagaaac

SEQ ID NO: 5810526 - DNA, 15 bp, Homo sapiens
ttccagtgtctgtct

SEQ ID NO: 5810527 - DNA, 16 bp, Homo sapiens
ttccagttatttattt

SEQ ID NO: 5810528 - DNA, 22 bp, Homo sapiens
ttccagttatttatttccaaaa

SEQ ID NO: 5810529 - DNA, 21 bp, Homo sapiens
ttccagttgcgtgtctgtttc

SEQ ID NO: 5810530 - DNA, 16 bp, Homo sapiens
ttccagttgctgtgga

SEQ ID NO: 5810531 - DNA, 18 bp, Homo sapiens
ttccagttgtatttgaag

SEQ ID NO: 5810532 - DNA, 20 bp, Homo sapiens
ttccagttgttactgaagtt

SEQ ID NO: 5810533 - DNA, 16 bp, Homo sapiens
ttccagtttctccttg

SEQ ID NO: 5810534 - DNA, 21 bp, Homo sapiens
ttccagtttctgtaaggtctt

SEQ ID NO: 5810535 - DNA, 23 bp, Homo sapiens
ttccagttttttgccactgcaaa

SEQ ID NO: 5810536 - DNA, 18 bp, Homo sapiens
ttccataaagaagatgtt

SEQ ID NO: 5810537 - DNA, 17 bp, Homo sapiens
ttccataaagtgtaatt

SEQ ID NO: 5810538 - DNA, 20 bp, Homo sapiens
ttccataaatttggactgtc

SEQ ID NO: 5810539 - DNA, 22 bp, Homo sapiens
ttccataaccccaggcatccca

SEQ ID NO: 5810540 - DNA, 12 bp, Homo sapiens
ttccataataaa

SEQ ID NO: 5810541 - DNA, 22 bp, Homo sapiens
ttccataataaacttctggtgt

SEQ ID NO: 5810542 - DNA, 13 bp, Homo sapiens
ttccataataatt

SEQ ID NO: 5810543 - DNA, 19 bp, Homo sapiens
ttccataatctggactcct

SEQ ID NO: 5810544 - DNA, 23 bp, Homo sapiens
ttccataatctggactcctctgt

SEQ ID NO: 5810545 - DNA, 12 bp, Homo sapiens
ttccataattat

SEQ ID NO: 5810546 - DNA, 18 bp, Homo sapiens
ttccataattatgacagt

SEQ ID NO: 5810547 - DNA, 22 bp, Homo sapiens
ttccataattatgacagttata

SEQ ID NO: 5810548 - DNA, 20 bp, Homo sapiens
ttccatacgtgcccatttca

SEQ ID NO: 5810549 - DNA, 16 bp, Homo sapiens
ttccatactgtttgcc

SEQ ID NO: 5810550 - DNA, 17 bp, Homo sapiens
ttccatagctcaataaa

SEQ ID NO: 5810551 - DNA, 22 bp, Homo sapiens
ttccatagctcaataaaagaat

SEQ ID NO: 5810552 - DNA, 16 bp, Homo sapiens
ttccatagctgctgcc

SEQ ID NO: 5810553 - DNA, 17 bp, Homo sapiens
ttccatagctgctgccc

SEQ ID NO: 5810554 - DNA, 19 bp, Homo sapiens
ttccataggaaggctgtga

SEQ ID NO: 5810555 - DNA, 22 bp, Homo sapiens
ttccataggacatactgcatgt

SEQ ID NO: 5810556 - DNA, 14 bp, Homo sapiens
ttccatagtatatt

SEQ ID NO: 5810557 - DNA, 18 bp, Homo sapiens
ttccatagtatattaaaa

SEQ ID NO: 5810558 - DNA, 21 bp, Homo sapiens
ttccatagtgttaactgtcag

SEQ ID NO: 5810559 - DNA, 17 bp, Homo sapiens
ttccatagttaaagaag

SEQ ID NO: 5810560 - DNA, 22 bp, Homo sapiens
ttccatagttttgatgactggc

SEQ ID NO: 5810561 - DNA, 13 bp, Homo sapiens
ttccatatagtct

SEQ ID NO: 5810562 - DNA, 22 bp, Homo sapiens
ttccatatattggcactgctaa

SEQ ID NO: 5810563 - DNA, 23 bp, Homo sapiens
ttccatatccctgcccagcctgt

SEQ ID NO: 5810564 - DNA, 15 bp, Homo sapiens
ttccatatccgggtg

SEQ ID NO: 5810565 - DNA, 18 bp, Homo sapiens
ttccatatccgggtgctc

SEQ ID NO: 5810566 - DNA, 15 bp, Homo sapiens
ttccatatcctggtg

SEQ ID NO: 5810567 - DNA, 15 bp, Homo sapiens
ttccatatgacctca

SEQ ID NO: 5810568 - DNA, 16 bp, Homo sapiens
ttccatatgctccagg

SEQ ID NO: 5810569 - DNA, 14 bp, Homo sapiens
ttccatatgctgtt

SEQ ID NO: 5810570 - DNA, 19 bp, Homo sapiens
ttccatatggatccactgg

SEQ ID NO: 5810571 - DNA, 21 bp, Homo sapiens
ttccatatggatccactggct

SEQ ID NO: 5810572 - DNA, 13 bp, Homo sapiens
ttccatattaaaa

SEQ ID NO: 5810573 - DNA, 18 bp, Homo sapiens
ttccatattagaaaactt

SEQ ID NO: 5810574 - DNA, 15 bp, Homo sapiens
ttccatattcatgta

SEQ ID NO: 5810575 - DNA, 22 bp, Homo sapiens
ttccatattgggaatatgtaga

SEQ ID NO: 5810576 - DNA, 22 bp, Homo sapiens
ttccatatttaacctatttcca

SEQ ID NO: 5810577 - DNA, 12 bp, Homo sapiens
ttccatatttgg

SEQ ID NO: 5810578 - DNA, 14 bp, Homo sapiens
ttccatatttggaa

SEQ ID NO: 5810579 - DNA, 19 bp, Homo sapiens
ttccatattttttgcacag

SEQ ID NO: 5810580 - DNA, 18 bp, Homo sapiens
ttccatatttttttcctt

SEQ ID NO: 5810581 - DNA, 19 bp, Homo sapiens
ttccatcacagccagccca

SEQ ID NO: 5810582 - DNA, 23 bp, Homo sapiens
ttccatcacagccagcccagctc

SEQ ID NO: 5810583 - DNA, 12 bp, Homo sapiens
ttccatcagctt

SEQ ID NO: 5810584 - DNA, 17 bp, Homo sapiens
ttccatcatcactgtaa

SEQ ID NO: 5810585 - DNA, 12 bp, Homo sapiens
ttccatccacca

SEQ ID NO: 5810586 - DNA, 18 bp, Homo sapiens
ttccatccaccaccttgc

SEQ ID NO: 5810587 - DNA, 20 bp, Homo sapiens
ttccatccaccaccttgcca

SEQ ID NO: 5810588 - DNA, 18 bp, Homo sapiens
ttccatcccaaccagtgc

SEQ ID NO: 5810589 - DNA, 20 bp, Homo sapiens
ttccatcccaaccagtgcca

SEQ ID NO: 5810590 - DNA, 23 bp, Homo sapiens
ttccatcccaaccagtgccaagg

SEQ ID NO: 5810591 - DNA, 14 bp, Homo sapiens
ttccatcccactcc

SEQ ID NO: 5810592 - DNA, 15 bp, Homo sapiens
ttccatccccaaact

SEQ ID NO: 5810593 - DNA, 15 bp, Homo sapiens
ttccatccccgtcca

SEQ ID NO: 5810594 - DNA, 20 bp, Homo sapiens
ttccatccctaagaattccc

SEQ ID NO: 5810595 - DNA, 21 bp, Homo sapiens
ttccatccctaccccctaaga

SEQ ID NO: 5810596 - DNA, 17 bp, Homo sapiens
ttccatcccttcctgaa

SEQ ID NO: 5810597 - DNA, 23 bp, Homo sapiens
ttccatcctgaggaccgccccaa

SEQ ID NO: 5810598 - DNA, 19 bp, Homo sapiens
ttccatcctgaggtgcctc

SEQ ID NO: 5810599 - DNA, 21 bp, Homo sapiens
ttccatcctgaggtgcctccc

SEQ ID NO: 5810600 - DNA, 24 bp, Homo sapiens
ttccatcctgtacaagtgctcagt

SEQ ID NO: 5810601 - DNA, 17 bp, Homo sapiens
ttccatcctttgcattt

SEQ ID NO: 5810602 - DNA, 12 bp, Homo sapiens
ttccatctaaaa

SEQ ID NO: 5810603 - DNA, 14 bp, Homo sapiens
ttccatctagtcac

SEQ ID NO: 5810604 - DNA, 15 bp, Homo sapiens
ttccatctcattaca

SEQ ID NO: 5810605 - DNA, 22 bp, Homo sapiens
ttccatctcctataatctgtca

SEQ ID NO: 5810606 - DNA, 14 bp, Homo sapiens
ttccatctctgcct

SEQ ID NO: 5810607 - DNA, 18 bp, Homo sapiens
ttccatctctgcctgtca

SEQ ID NO: 5810608 - DNA, 12 bp, Homo sapiens
ttccatctctgg

SEQ ID NO: 5810609 - DNA, 13 bp, Homo sapiens
ttccatctctggt

SEQ ID NO: 5810610 - DNA, 16 bp, Homo sapiens
ttccatctcttccttc

SEQ ID NO: 5810611 - DNA, 17 bp, Homo sapiens
ttccatctcttcctttc

SEQ ID NO: 5810612 - DNA, 14 bp, Homo sapiens
ttccatctgattcc

SEQ ID NO: 5810613 - DNA, 13 bp, Homo sapiens
ttccatcttctcc

SEQ ID NO: 5810614 - DNA, 15 bp, Homo sapiens
ttccatcttctccat

SEQ ID NO: 5810615 - DNA, 14 bp, Homo sapiens
ttccatcttgctaa

SEQ ID NO: 5810616 - DNA, 15 bp, Homo sapiens
ttccatcttgctaat

SEQ ID NO: 5810617 - DNA, 21 bp, Homo sapiens
ttccatcttgtggggccagga

SEQ ID NO: 5810618 - DNA, 18 bp, Homo sapiens
ttccatctttacaaaact

SEQ ID NO: 5810619 - DNA, 13 bp, Homo sapiens
ttccatgaaaacg

SEQ ID NO: 5810620 - DNA, 22 bp, Homo sapiens
ttccatgaaaacgttttattgt

SEQ ID NO: 5810621 - DNA, 15 bp, Homo sapiens
ttccatgaaaatgca

SEQ ID NO: 5810622 - DNA, 20 bp, Homo sapiens
ttccatgaatcgcttctctt

SEQ ID NO: 5810623 - DNA, 12 bp, Homo sapiens
ttccatgaatgt

SEQ ID NO: 5810624 - DNA, 16 bp, Homo sapiens
ttccatgacatcaaga

SEQ ID NO: 5810625 - DNA, 15 bp, Homo sapiens
ttccatgacattttt

SEQ ID NO: 5810626 - DNA, 18 bp, Homo sapiens
ttccatgactgcatttta

SEQ ID NO: 5810627 - DNA, 16 bp, Homo sapiens
ttccatgacttcagag

SEQ ID NO: 5810628 - DNA, 15 bp, Homo sapiens
ttccatgagctgctc

SEQ ID NO: 5810629 - DNA, 16 bp, Homo sapiens
ttccatgatgcacagt

SEQ ID NO: 5810630 - DNA, 20 bp, Homo sapiens
ttccatgatttagcaagcaa

SEQ ID NO: 5810631 - DNA, 21 bp, Homo sapiens
ttccatgatttagcaagcaac

SEQ ID NO: 5810632 - DNA, 22 bp, Homo sapiens
ttccatgcaactggagttcctt

SEQ ID NO: 5810633 - DNA, 23 bp, Homo sapiens
ttccatgcaactggagttcctta

SEQ ID NO: 5810634 - DNA, 15 bp, Homo sapiens
ttccatgcactctct

SEQ ID NO: 5810635 - DNA, 19 bp, Homo sapiens
ttccatgcactcttcatgt

SEQ ID NO: 5810636 - DNA, 15 bp, Homo sapiens
ttccatgcagccttg

SEQ ID NO: 5810637 - DNA, 21 bp, Homo sapiens
ttccatgcagttattagaact

SEQ ID NO: 5810638 - DNA, 22 bp, Homo sapiens
ttccatgccctgggatgcctca

SEQ ID NO: 5810639 - DNA, 14 bp, Homo sapiens
ttccatgcctggcc

SEQ ID NO: 5810640 - DNA, 20 bp, Homo sapiens
ttccatgcctggcccttgcc

SEQ ID NO: 5810641 - DNA, 21 bp, Homo sapiens
ttccatgcgtgtttctgactc

SEQ ID NO: 5810642 - DNA, 19 bp, Homo sapiens
ttccatggacatgggcagc

SEQ ID NO: 5810643 - DNA, 20 bp, Homo sapiens
ttccatggcaaatgggcagc

SEQ ID NO: 5810644 - DNA, 16 bp, Homo sapiens
ttccatggcacactgc

SEQ ID NO: 5810645 - DNA, 15 bp, Homo sapiens
ttccatggccctcat

SEQ ID NO: 5810646 - DNA, 16 bp, Homo sapiens
ttccatggccctcatt

SEQ ID NO: 5810647 - DNA, 17 bp, Homo sapiens
ttccatggccctcatta

SEQ ID NO: 5810648 - DNA, 12 bp, Homo sapiens
ttccatggcctc

SEQ ID NO: 5810649 - DNA, 18 bp, Homo sapiens
ttccatggcttcctgaga

SEQ ID NO: 5810650 - DNA, 22 bp, Homo sapiens
ttccatgggaccacaactattt

SEQ ID NO: 5810651 - DNA, 22 bp, Homo sapiens
ttccatgggactttccttccct

SEQ ID NO: 5810652 - DNA, 21 bp, Homo sapiens
ttccatgggagcaaatatcta

SEQ ID NO: 5810653 - DNA, 23 bp, Homo sapiens
ttccatgggagccagctgctttt

SEQ ID NO: 5810654 - DNA, 18 bp, Homo sapiens
ttccatgggcccgctgcc

SEQ ID NO: 5810655 - DNA, 21 bp, Homo sapiens
ttccatgggttgaacaagcca

SEQ ID NO: 5810656 - DNA, 21 bp, Homo sapiens
ttccatggtgtgatcgtctga

SEQ ID NO: 5810657 - DNA, 14 bp, Homo sapiens
ttccatggttacca

SEQ ID NO: 5810658 - DNA, 23 bp, Homo sapiens
ttccatgtataagtgtaaatata

SEQ ID NO: 5810659 - DNA, 17 bp, Homo sapiens
ttccatgtcaagattca

SEQ ID NO: 5810660 - DNA, 20 bp, Homo sapiens
ttccatgtcccctcccagag

SEQ ID NO: 5810661 - DNA, 17 bp, Homo sapiens
ttccatgtcgcctctgc

SEQ ID NO: 5810662 - DNA, 19 bp, Homo sapiens
ttccatgtcgcctctgcat

SEQ ID NO: 5810663 - DNA, 21 bp, Homo sapiens
ttccatgtcgcctctgcattc

SEQ ID NO: 5810664 - DNA, 16 bp, Homo sapiens
ttccatgtcggcctct

SEQ ID NO: 5810665 - DNA, 18 bp, Homo sapiens
ttccatgtgaacagcata

SEQ ID NO: 5810666 - DNA, 13 bp, Homo sapiens
ttccatgtgcctt

SEQ ID NO: 5810667 - DNA, 19 bp, Homo sapiens
ttccatgtgcctttctttg

SEQ ID NO: 5810668 - DNA, 22 bp, Homo sapiens
ttccatgtgcctttctttgcct

SEQ ID NO: 5810669 - DNA, 12 bp, Homo sapiens
ttccatgtgtgg

SEQ ID NO: 5810670 - DNA, 12 bp, Homo sapiens
ttccatgttaaa

SEQ ID NO: 5810671 - DNA, 13 bp, Homo sapiens
ttccatgttgctg

SEQ ID NO: 5810672 - DNA, 21 bp, Homo sapiens
ttccatgttgtcttataaaca

SEQ ID NO: 5810673 - DNA, 16 bp, Homo sapiens
ttccatgttttaaaat

SEQ ID NO: 5810674 - DNA, 18 bp, Homo sapiens
ttccattaaatcaatcag

SEQ ID NO: 5810675 - DNA, 16 bp, Homo sapiens
ttccattaatttcaac

SEQ ID NO: 5810676 - DNA, 18 bp, Homo sapiens
ttccattaatttcaacat

SEQ ID NO: 5810677 - DNA, 23 bp, Homo sapiens
ttccattacaagtatttttaatt

SEQ ID NO: 5810678 - DNA, 13 bp, Homo sapiens
ttccattacacca

SEQ ID NO: 5810679 - DNA, 18 bp, Homo sapiens
ttccattacaccacagca

SEQ ID NO: 5810680 - DNA, 13 bp, Homo sapiens
ttccattacatga

SEQ ID NO: 5810681 - DNA, 23 bp, Homo sapiens
ttccattatacatcaattggaaa

SEQ ID NO: 5810682 - DNA, 13 bp, Homo sapiens
ttccattcccttc

SEQ ID NO: 5810683 - DNA, 16 bp, Homo sapiens
ttccattcccttcggc

SEQ ID NO: 5810684 - DNA, 12 bp, Homo sapiens
ttccattctatg

SEQ ID NO: 5810685 - DNA, 13 bp, Homo sapiens
ttccattctggaa

SEQ ID NO: 5810686 - DNA, 20 bp, Homo sapiens
ttccattctggattttgtca

SEQ ID NO: 5810687 - DNA, 16 bp, Homo sapiens
ttccattcttggcatc

SEQ ID NO: 5810688 - DNA, 19 bp, Homo sapiens
ttccattcttggcatctac

SEQ ID NO: 5810689 - DNA, 22 bp, Homo sapiens
ttccctgccggccccccaagga

SEQ ID NO: 5810690 - DNA, 22 bp, Homo sapiens
ttccctgcctaggagctgggga

SEQ ID NO: 5810691 - DNA, 15 bp, Homo sapiens
ttccctgcctccagc

SEQ ID NO: 5810692 - DNA, 20 bp, Homo sapiens
ttccctgcctccagctgtca

SEQ ID NO: 5810693 - DNA, 14 bp, Homo sapiens
ttccctgcctctca

SEQ ID NO: 5810694 - DNA, 15 bp, Homo sapiens
ttccctgccttgctg

SEQ ID NO: 5810695 - DNA, 21 bp, Homo sapiens
ttccctgcgcgcagctggcgc

SEQ ID NO: 5810696 - DNA, 15 bp, Homo sapiens
ttccctgctcttgca

SEQ ID NO: 5810697 - DNA, 15 bp, Homo sapiens
ttccctgctgagtgg

SEQ ID NO: 5810698 - DNA, 12 bp, Homo sapiens
ttccctgctggc

SEQ ID NO: 5810699 - DNA, 19 bp, Homo sapiens
ttccctgctggccaaagtc

SEQ ID NO: 5810700 - DNA, 21 bp, Homo sapiens
ttccctgctggccaaagtcag

SEQ ID NO: 5810701 - DNA, 22 bp, Homo sapiens
ttccctgctgtgaaagaagtaa

SEQ ID NO: 5810702 - DNA, 17 bp, Homo sapiens
ttccctgcttaatgaaa

SEQ ID NO: 5810703 - DNA, 13 bp, Homo sapiens
ttccctgcttcca

SEQ ID NO: 5810704 - DNA, 17 bp, Homo sapiens
ttccctgctttgcatct

SEQ ID NO: 5810705 - DNA, 20 bp, Homo sapiens
ttccctgcttttctcccaga

SEQ ID NO: 5810706 - DNA, 20 bp, Homo sapiens
ttccctggaaaccttccacc

SEQ ID NO: 5810707 - DNA, 20 bp, Homo sapiens
ttccctggaactcctggcct

SEQ ID NO: 5810708 - DNA, 23 bp, Homo sapiens
ttccctggaagctctccgagctc

SEQ ID NO: 5810709 - DNA, 12 bp, Homo sapiens
ttccctggacca

SEQ ID NO: 5810710 - DNA, 19 bp, Homo sapiens
ttccctggaccagatgctg

SEQ ID NO: 5810711 - DNA, 15 bp, Homo sapiens
ttccctggagaaaaa

SEQ ID NO: 5810712 - DNA, 18 bp, Homo sapiens
ttccctggaggagaagta

SEQ ID NO: 5810713 - DNA, 19 bp, Homo sapiens
ttccctggaggagaagtat

SEQ ID NO: 5810714 - DNA, 20 bp, Homo sapiens
ttccctggcatgatggacaa

SEQ ID NO: 5810715 - DNA, 22 bp, Homo sapiens
ttccctggccgcttctccccag

SEQ ID NO: 5810716 - DNA, 23 bp, Homo sapiens
ttccctggccgcttctccccaga

SEQ ID NO: 5810717 - DNA, 12 bp, Homo sapiens
ttccctggcctg

SEQ ID NO: 5810718 - DNA, 16 bp, Homo sapiens
ttccctggcctttcat

SEQ ID NO: 5810719 - DNA, 20 bp, Homo sapiens
ttccctggcggccccaactc

SEQ ID NO: 5810720 - DNA, 23 bp, Homo sapiens
ttccctggctacttcccttcctc

SEQ ID NO: 5810721 - DNA, 11 bp, Homo sapiens
ttccctgggag

SEQ ID NO: 5810722 - DNA, 17 bp, Homo sapiens
ttccctgggccaacaga

SEQ ID NO: 5810723 - DNA, 20 bp, Homo sapiens
ttccctggggagccctcagg

SEQ ID NO: 5810724 - DNA, 21 bp, Homo sapiens
ttccctggggagccctcaggc

SEQ ID NO: 5810725 - DNA, 21 bp, Homo sapiens
ttccctgggttagactgccag

SEQ ID NO: 5810726 - DNA, 23 bp, Homo sapiens
ttccctgggttagactgccagct

SEQ ID NO: 5810727 - DNA, 21 bp, Homo sapiens
ttccctgggtttgggagccag

SEQ ID NO: 5810728 - DNA, 16 bp, Homo sapiens
ttccctggtaagaaaa

SEQ ID NO: 5810729 - DNA, 22 bp, Homo sapiens
ttccctggtaagaaaaagcaaa

SEQ ID NO: 5810730 - DNA, 16 bp, Homo sapiens
ttccctggtccctctg

SEQ ID NO: 5810731 - DNA, 23 bp, Homo sapiens
ttccctggtcccttgtatcccct

SEQ ID NO: 5810732 - DNA, 23 bp, Homo sapiens
ttccctggtgcccttccctggag

SEQ ID NO: 5810733 - DNA, 12 bp, Homo sapiens
ttccctgtagga

SEQ ID NO: 5810734 - DNA, 18 bp, Homo sapiens
ttccctgtgcctcctccc

SEQ ID NO: 5810735 - DNA, 16 bp, Homo sapiens
ttccctgtgtggacca

SEQ ID NO: 5810736 - DNA, 18 bp, Homo sapiens
ttccctgttctccctttc

SEQ ID NO: 5810737 - DNA, 16 bp, Homo sapiens
ttccctgttcttcctc

SEQ ID NO: 5810738 - DNA, 17 bp, Homo sapiens
ttccctgttcttcctcc

SEQ ID NO: 5810739 - DNA, 18 bp, Homo sapiens
ttccctgttcttcctcca

SEQ ID NO: 5810740 - DNA, 21 bp, Homo sapiens
ttccctgttgaattggtgaat

SEQ ID NO: 5810741 - DNA, 16 bp, Homo sapiens
ttccctgttttaaatt

SEQ ID NO: 5810742 - DNA, 14 bp, Homo sapiens
ttcccttaaaattt

SEQ ID NO: 5810743 - DNA, 15 bp, Homo sapiens
ttcccttaaatacag

SEQ ID NO: 5810744 - DNA, 17 bp, Homo sapiens
ttcccttaactccaaga

SEQ ID NO: 5810745 - DNA, 14 bp, Homo sapiens
ttcccttagcctct

SEQ ID NO: 5810746 - DNA, 17 bp, Homo sapiens
ttcccttagcctctccc

SEQ ID NO: 5810747 - DNA, 18 bp, Homo sapiens
ttcccttagcctctccca

SEQ ID NO: 5810748 - DNA, 14 bp, Homo sapiens
ttcccttagtgact

SEQ ID NO: 5810749 - DNA, 18 bp, Homo sapiens
ttcccttatcttttactt

SEQ ID NO: 5810750 - DNA, 14 bp, Homo sapiens
ttcccttattgcct

SEQ ID NO: 5810751 - DNA, 20 bp, Homo sapiens
ttcccttattgcctcccagg

SEQ ID NO: 5810752 - DNA, 21 bp, Homo sapiens
ttcccttattgcctcccaggc

SEQ ID NO: 5810753 - DNA, 19 bp, Homo sapiens
ttcccttcagtaccctctc

SEQ ID NO: 5810754 - DNA, 14 bp, Homo sapiens
ttcccttcatctgg

SEQ ID NO: 5810755 - DNA, 16 bp, Homo sapiens
ttcccttcatgtttta

SEQ ID NO: 5810756 - DNA, 20 bp, Homo sapiens
ttcccttcatttaaactaaa

SEQ ID NO: 5810757 - DNA, 15 bp, Homo sapiens
ttcccttccactgcc

SEQ ID NO: 5810758 - DNA, 15 bp, Homo sapiens
ttcccttccctcacc

SEQ ID NO: 5810759 - DNA, 15 bp, Homo sapiens
ttcccttcccttcca

SEQ ID NO: 5810760 - DNA, 14 bp, Homo sapiens
ttcccttcctcacc

SEQ ID NO: 5810761 - DNA, 14 bp, Homo sapiens
ttcccttcctcagc

SEQ ID NO: 5810762 - DNA, 22 bp, Homo sapiens
ttcccttcctcttcctgccctt

SEQ ID NO: 5810763 - DNA, 21 bp, Homo sapiens
ttcccttcctgttccctcctg

SEQ ID NO: 5810764 - DNA, 22 bp, Homo sapiens
ttcccttcctgttccctcctgg

SEQ ID NO: 5810765 - DNA, 23 bp, Homo sapiens
ttcccttcctgttccctcctggt

SEQ ID NO: 5810766 - DNA, 16 bp, Homo sapiens
ttcccttcggccaaac

SEQ ID NO: 5810767 - DNA, 11 bp, Homo sapiens
ttcccttctcc

SEQ ID NO: 5810768 - DNA, 12 bp, Homo sapiens
ttcccttctcca

SEQ ID NO: 5810769 - DNA, 20 bp, Homo sapiens
ttcccttctccatctctctg

SEQ ID NO: 5810770 - DNA, 15 bp, Homo sapiens
ttcccttctccccct

SEQ ID NO: 5810771 - DNA, 17 bp, Homo sapiens
ttcccttctccttccaa

SEQ ID NO: 5810772 - DNA, 23 bp, Homo sapiens
ttcccttctcttctaacatgaaa

SEQ ID NO: 5810773 - DNA, 23 bp, Homo sapiens
ttcccttcttttcctgggtgctc

SEQ ID NO: 5810774 - DNA, 15 bp, Homo sapiens
ttcccttgaaattta

SEQ ID NO: 5810775 - DNA, 23 bp, Homo sapiens
ttcccttgaaattttaaactata

SEQ ID NO: 5810776 - DNA, 12 bp, Homo sapiens
ttcccttgacca

SEQ ID NO: 5810777 - DNA, 20 bp, Homo sapiens
ttcccttgaccattggctgc

SEQ ID NO: 5810778 - DNA, 20 bp, Homo sapiens
ttcccttgagatgagtttct

SEQ ID NO: 5810779 - DNA, 14 bp, Homo sapiens
ttcccttgagccct

SEQ ID NO: 5810780 - DNA, 15 bp, Homo sapiens
ttcccttgagccctc

SEQ ID NO: 5810781 - DNA, 17 bp, Homo sapiens
ttcccttgatgaagaag

SEQ ID NO: 5810782 - DNA, 16 bp, Homo sapiens
ttcccttgattcaaat

SEQ ID NO: 5810783 - DNA, 19 bp, Homo sapiens
ttcccttgccactttgcac

SEQ ID NO: 5810784 - DNA, 16 bp, Homo sapiens
ttcccttgccctgggc

SEQ ID NO: 5810785 - DNA, 18 bp, Homo sapiens
ttcccttgcttttccctc

SEQ ID NO: 5810786 - DNA, 11 bp, Homo sapiens
ttcccttggaa

SEQ ID NO: 5810787 - DNA, 12 bp, Homo sapiens
ttcccttggcct

SEQ ID NO: 5810788 - DNA, 16 bp, Homo sapiens
ttcccttggcctcaga

SEQ ID NO: 5810789 - DNA, 15 bp, Homo sapiens
ttcccttggtggcaa

SEQ ID NO: 5810790 - DNA, 12 bp, Homo sapiens
ttcccttgtatt

SEQ ID NO: 5810791 - DNA, 18 bp, Homo sapiens
ttccctttaccactgtgg

SEQ ID NO: 5810792 - DNA, 23 bp, Homo sapiens
ttccctttagcacgtttaaagtt

SEQ ID NO: 5810793 - DNA, 17 bp, Homo sapiens
ttccctttatttcacat

SEQ ID NO: 5810794 - DNA, 19 bp, Homo sapiens
ttccctttcactgaagtga

SEQ ID NO: 5810795 - DNA, 13 bp, Homo sapiens
ttccctttcccca

SEQ ID NO: 5810796 - DNA, 14 bp, Homo sapiens
ttccctttccccat

SEQ ID NO: 5810797 - DNA, 15 bp, Homo sapiens
ttccctttccttcca

SEQ ID NO: 5810798 - DNA, 19 bp, Homo sapiens
ttccctttgacgccatccc

SEQ ID NO: 5810799 - DNA, 22 bp, Homo sapiens
ttccctttgacgccatcccagc

SEQ ID NO: 5810800 - DNA, 18 bp, Homo sapiens
ttccctttgagtccagtg

SEQ ID NO: 5810801 - DNA, 13 bp, Homo sapiens
ttccctttgcctt

SEQ ID NO: 5810802 - DNA, 21 bp, Homo sapiens
ttccctttgccttaaacctga

SEQ ID NO: 5810803 - DNA, 17 bp, Homo sapiens
ttccctttgtctttcaa

SEQ ID NO: 5810804 - DNA, 12 bp, Homo sapiens
ttccctttgtga

SEQ ID NO: 5810805 - DNA, 22 bp, Homo sapiens
ttccctttgtgagtcaatacat

SEQ ID NO: 5810806 - DNA, 20 bp, Homo sapiens
ttccctttgtgtatcttacc

SEQ ID NO: 5810807 - DNA, 21 bp, Homo sapiens
ttcccttttaaacacattttg

SEQ ID NO: 5810808 - DNA, 21 bp, Homo sapiens
ttcccttttaaagaatttttg

SEQ ID NO: 5810809 - DNA, 17 bp, Homo sapiens
ttccctttttaaatgag

SEQ ID NO: 5810810 - DNA, 20 bp, Homo sapiens
ttcccttttttggctgctga

SEQ ID NO: 5810811 - DNA, 20 bp, Homo sapiens
ttccgaaaccaaagaagaaa

SEQ ID NO: 5810812 - DNA, 19 bp, Homo sapiens
ttccgaagaccttctgaag

SEQ ID NO: 5810813 - DNA, 23 bp, Homo sapiens
ttccgaagagggaatggatgggg

SEQ ID NO: 5810814 - DNA, 16 bp, Homo sapiens
ttccgaagatgctgta

SEQ ID NO: 5810815 - DNA, 22 bp, Homo sapiens
ttccgacaaccgatgctccagc

SEQ ID NO: 5810816 - DNA, 18 bp, Homo sapiens
ttccgacacatttaccaa

SEQ ID NO: 5810817 - DNA, 17 bp, Homo sapiens
ttccgacaccactggga

SEQ ID NO: 5810818 - DNA, 12 bp, Homo sapiens
ttccgacatccc

SEQ ID NO: 5810819 - DNA, 16 bp, Homo sapiens
ttccgaccctctggga

SEQ ID NO: 5810820 - DNA, 18 bp, Homo sapiens
ttccgaccctctgggaac

SEQ ID NO: 5810821 - DNA, 20 bp, Homo sapiens
ttccgagatccccagggcag

SEQ ID NO: 5810822 - DNA, 15 bp, Homo sapiens
ttccgagattcagac

SEQ ID NO: 5810823 - DNA, 14 bp, Homo sapiens
ttccgagtagctgg

SEQ ID NO: 5810824 - DNA, 21 bp, Homo sapiens
ttccgagtctttctcactgcc

SEQ ID NO: 5810825 - DNA, 22 bp, Homo sapiens
ttccgagtctttctcactgcct

SEQ ID NO: 5810826 - DNA, 21 bp, Homo sapiens
ttccgatcaacatttatgacc

SEQ ID NO: 5810827 - DNA, 18 bp, Homo sapiens
ttccgcattctttgtaca

SEQ ID NO: 5810828 - DNA, 16 bp, Homo sapiens
ttccgccactcagcca

SEQ ID NO: 5810829 - DNA, 22 bp, Homo sapiens
ttccgcccccgccccacagggc

SEQ ID NO: 5810830 - DNA, 16 bp, Homo sapiens
ttccgcccctgcctgc

SEQ ID NO: 5810831 - DNA, 21 bp, Homo sapiens
ttccgcgcggagacctcctga

SEQ ID NO: 5810832 - DNA, 16 bp, Homo sapiens
ttccgcgtcagcaagt

SEQ ID NO: 5810833 - DNA, 16 bp, Homo sapiens
ttccgctaatctcttc

SEQ ID NO: 5810834 - DNA, 13 bp, Homo sapiens
ttccgctccctgg

SEQ ID NO: 5810835 - DNA, 15 bp, Homo sapiens
ttccgctcctttacc

SEQ ID NO: 5810836 - DNA, 22 bp, Homo sapiens
ttccgctcctttacctaccacc

SEQ ID NO: 5810837 - DNA, 13 bp, Homo sapiens
ttccgcttggagc

SEQ ID NO: 5810838 - DNA, 19 bp, Homo sapiens
ttccgcttggagcagaggg

SEQ ID NO: 5810839 - DNA, 19 bp, Homo sapiens
ttccgctttgaaagaagca

SEQ ID NO: 5810840 - DNA, 22 bp, Homo sapiens
ttccgctttgaaagaagcaaga

SEQ ID NO: 5810841 - DNA, 23 bp, Homo sapiens
ttccgctttgaaagaagcaagac

SEQ ID NO: 5810842 - DNA, 20 bp, Homo sapiens
ttccggaagtaaatacagca

SEQ ID NO: 5810843 - DNA, 23 bp, Homo sapiens
ttccggaagtaaatacagcaatt

SEQ ID NO: 5810844 - DNA, 22 bp, Homo sapiens
ttccggatcctaagcatctaag

SEQ ID NO: 5810845 - DNA, 23 bp, Homo sapiens
ttccggccacatcattctgtgtc

SEQ ID NO: 5810846 - DNA, 17 bp, Homo sapiens
ttccggcccctcccctc

SEQ ID NO: 5810847 - DNA, 18 bp, Homo sapiens
ttccggcccctcccctcc

SEQ ID NO: 5810848 - DNA, 21 bp, Homo sapiens
ttccggcccctcccctccaaa

SEQ ID NO: 5810849 - DNA, 15 bp, Homo sapiens
ttccggccctggctg

SEQ ID NO: 5810850 - DNA, 14 bp, Homo sapiens
ttccggctcctgtg

SEQ ID NO: 5810851 - DNA, 22 bp, Homo sapiens
ttccgggcagaaacaataaaac

SEQ ID NO: 5810852 - DNA, 18 bp, Homo sapiens
ttccggggaggagccttg

SEQ ID NO: 5810853 - DNA, 19 bp, Homo sapiens
ttccggggctgctggcctg

SEQ ID NO: 5810854 - DNA, 13 bp, Homo sapiens
ttccgtaaatgtc

SEQ ID NO: 5810855 - DNA, 16 bp, Homo sapiens
ttccgtaaatgtctgc

SEQ ID NO: 5810856 - DNA, 17 bp, Homo sapiens
ttccgtaaatgtctgca

SEQ ID NO: 5810857 - DNA, 17 bp, Homo sapiens
ttccgtaacccaactct

SEQ ID NO: 5810858 - DNA, 21 bp, Homo sapiens
ttccgtaataacacccttcct

SEQ ID NO: 5810859 - DNA, 14 bp, Homo sapiens
ttccgtagcagttt

SEQ ID NO: 5810860 - DNA, 19 bp, Homo sapiens
ttccgtaggttattttcag

SEQ ID NO: 5810861 - DNA, 23 bp, Homo sapiens
ttccgtatctccctggagaagca

SEQ ID NO: 5810862 - DNA, 19 bp, Homo sapiens
ttccgtcaacgttgtactg

SEQ ID NO: 5810863 - DNA, 16 bp, Homo sapiens
ttccgtccccccccag

SEQ ID NO: 5810864 - DNA, 13 bp, Homo sapiens
ttccgtctccccc

SEQ ID NO: 5810865 - DNA, 21 bp, Homo sapiens
ttcctcttagaagaatattgt

SEQ ID NO: 5810866 - DNA, 12 bp, Homo sapiens
ttcctcttagcc

SEQ ID NO: 5810867 - DNA, 15 bp, Homo sapiens
ttcctcttagcctct

SEQ ID NO: 5810868 - DNA, 18 bp, Homo sapiens
ttcctcttagcctctgga

SEQ ID NO: 5810869 - DNA, 22 bp, Homo sapiens
ttcctcttagcctctggatcta

SEQ ID NO: 5810870 - DNA, 20 bp, Homo sapiens
ttcctcttataacttctgaa

SEQ ID NO: 5810871 - DNA, 12 bp, Homo sapiens
ttcctcttccaa

SEQ ID NO: 5810872 - DNA, 15 bp, Homo sapiens
ttcctcttcctgccc

SEQ ID NO: 5810873 - DNA, 13 bp, Homo sapiens
ttcctcttgaacc

SEQ ID NO: 5810874 - DNA, 17 bp, Homo sapiens
ttcctcttgaccctgca

SEQ ID NO: 5810875 - DNA, 22 bp, Homo sapiens
ttcctcttgaccctgcaccctc

SEQ ID NO: 5810876 - DNA, 19 bp, Homo sapiens
ttcctcttgcctctctcag

SEQ ID NO: 5810877 - DNA, 17 bp, Homo sapiens
ttcctcttgtcctggcc

SEQ ID NO: 5810878 - DNA, 22 bp, Homo sapiens
ttcctcttgtcctggcccttca

SEQ ID NO: 5810879 - DNA, 22 bp, Homo sapiens
ttcctctttccatctaccctcc

SEQ ID NO: 5810880 - DNA, 18 bp, Homo sapiens
ttcctctttctgctctgc

SEQ ID NO: 5810881 - DNA, 21 bp, Homo sapiens
ttcctctttctgctctgccat

SEQ ID NO: 5810882 - DNA, 12 bp, Homo sapiens
ttcctctttgca

SEQ ID NO: 5810883 - DNA, 16 bp, Homo sapiens
ttcctctttgccctga

SEQ ID NO: 5810884 - DNA, 13 bp, Homo sapiens
ttcctctttgctt

SEQ ID NO: 5810885 - DNA, 15 bp, Homo sapiens
ttcctctttgctttg

SEQ ID NO: 5810886 - DNA, 16 bp, Homo sapiens
ttcctctttgctttgc

SEQ ID NO: 5810887 - DNA, 23 bp, Homo sapiens
ttcctcttttgtgagaagatggg

SEQ ID NO: 5810888 - DNA, 16 bp, Homo sapiens
ttcctgaaaagttgaa

SEQ ID NO: 5810889 - DNA, 17 bp, Homo sapiens
ttcctgaaactatattt

SEQ ID NO: 5810890 - DNA, 12 bp, Homo sapiens
ttcctgaaagaa

SEQ ID NO: 5810891 - DNA, 14 bp, Homo sapiens
ttcctgaaagctgt

SEQ ID NO: 5810892 - DNA, 16 bp, Homo sapiens
ttcctgaaataaacac

SEQ ID NO: 5810893 - DNA, 14 bp, Homo sapiens
ttcctgaacaggat

SEQ ID NO: 5810894 - DNA, 15 bp, Homo sapiens
ttcctgaactataac

SEQ ID NO: 5810895 - DNA, 19 bp, Homo sapiens
ttcctgaagaaccagtccc

SEQ ID NO: 5810896 - DNA, 15 bp, Homo sapiens
ttcctgaagcattta

SEQ ID NO: 5810897 - DNA, 19 bp, Homo sapiens
ttcctgaagctgctgtgtc

SEQ ID NO: 5810898 - DNA, 13 bp, Homo sapiens
ttcctgaagggaa

SEQ ID NO: 5810899 - DNA, 23 bp, Homo sapiens
ttcctgaagtgtcgagtccagtc

SEQ ID NO: 5810900 - DNA, 18 bp, Homo sapiens
ttcctgaatattaatccc

SEQ ID NO: 5810901 - DNA, 14 bp, Homo sapiens
ttcctgaatgaaat

SEQ ID NO: 5810902 - DNA, 22 bp, Homo sapiens
ttcctgaattctatttgctggg

SEQ ID NO: 5810903 - DNA, 22 bp, Homo sapiens
ttcctgacactttaattaccaa

SEQ ID NO: 5810904 - DNA, 16 bp, Homo sapiens
ttcctgacatcacagc

SEQ ID NO: 5810905 - DNA, 15 bp, Homo sapiens
ttcctgacattgtct

SEQ ID NO: 5810906 - DNA, 22 bp, Homo sapiens
ttcctgacccggattggccctg

SEQ ID NO: 5810907 - DNA, 12 bp, Homo sapiens
ttcctgaccctc

SEQ ID NO: 5810908 - DNA, 15 bp, Homo sapiens
ttcctgaccctccct

SEQ ID NO: 5810909 - DNA, 20 bp, Homo sapiens
ttcctgacctccgccatcca

SEQ ID NO: 5810910 - DNA, 16 bp, Homo sapiens
ttcctgactctcacct

SEQ ID NO: 5810911 - DNA, 14 bp, Homo sapiens
ttcctgactggcaa

SEQ ID NO: 5810912 - DNA, 12 bp, Homo sapiens
ttcctgactggg

SEQ ID NO: 5810913 - DNA, 13 bp, Homo sapiens
ttcctgacttgag

SEQ ID NO: 5810914 - DNA, 23 bp, Homo sapiens
ttcctgagaaacgtccatctctc

SEQ ID NO: 5810915 - DNA, 19 bp, Homo sapiens
ttcctgagaaagcccacct

SEQ ID NO: 5810916 - DNA, 20 bp, Homo sapiens
ttcctgagaaagcccacctg

SEQ ID NO: 5810917 - DNA, 17 bp, Homo sapiens
ttcctgagacaaatttt

SEQ ID NO: 5810918 - DNA, 18 bp, Homo sapiens
ttcctgagacacccgatt

SEQ ID NO: 5810919 - DNA, 14 bp, Homo sapiens
ttcctgagattctg

SEQ ID NO: 5810920 - DNA, 21 bp, Homo sapiens
ttcctgagatttcctcctggc

SEQ ID NO: 5810921 - DNA, 20 bp, Homo sapiens
ttcctgagcagtccctgctt

SEQ ID NO: 5810922 - DNA, 16 bp, Homo sapiens
ttcctgagcttggcca

SEQ ID NO: 5810923 - DNA, 20 bp, Homo sapiens
ttcctgagcttggccagaag

SEQ ID NO: 5810924 - DNA, 14 bp, Homo sapiens
ttcctgagctttat

SEQ ID NO: 5810925 - DNA, 17 bp, Homo sapiens
ttcctgaggtcatctgt

SEQ ID NO: 5810926 - DNA, 20 bp, Homo sapiens
ttcctgatagcatatgacaa

SEQ ID NO: 5810927 - DNA, 19 bp, Homo sapiens
ttcctgatcaaggtgctct

SEQ ID NO: 5810928 - DNA, 18 bp, Homo sapiens
ttcctgatgacagaacac

SEQ ID NO: 5810929 - DNA, 21 bp, Homo sapiens
ttcctgatgacagaacacaga

SEQ ID NO: 5810930 - DNA, 23 bp, Homo sapiens
ttcctgatgacagaacacagatc

SEQ ID NO: 5810931 - DNA, 13 bp, Homo sapiens
ttcctgatgaccc

SEQ ID NO: 5810932 - DNA, 15 bp, Homo sapiens
ttcctgatgcttctt

SEQ ID NO: 5810933 - DNA, 16 bp, Homo sapiens
ttcctgatgggaacag

SEQ ID NO: 5810934 - DNA, 19 bp, Homo sapiens
ttcctgatggtacaggaaa

SEQ ID NO: 5810935 - DNA, 16 bp, Homo sapiens
ttcctgcaaccactct

SEQ ID NO: 5810936 - DNA, 19 bp, Homo sapiens
ttcctgcaactcaaggact

SEQ ID NO: 5810937 - DNA, 14 bp, Homo sapiens
ttcctgcacccgta

SEQ ID NO: 5810938 - DNA, 16 bp, Homo sapiens
ttcctgcacccgtacc

SEQ ID NO: 5810939 - DNA, 11 bp, Homo sapiens
ttcctgcactc

SEQ ID NO: 5810940 - DNA, 13 bp, Homo sapiens
ttcctgcactcca

SEQ ID NO: 5810941 - DNA, 19 bp, Homo sapiens
ttcctgcagacctggctgg

SEQ ID NO: 5810942 - DNA, 10 bp, Homo sapiens
ttcctgcagc

SEQ ID NO: 5810943 - DNA, 17 bp, Homo sapiens
ttcctgcagccccagaa

SEQ ID NO: 5810944 - DNA, 13 bp, Homo sapiens
ttcctgcaggact

SEQ ID NO: 5810945 - DNA, 21 bp, Homo sapiens
ttcctgcaggccaggccagct

SEQ ID NO: 5810946 - DNA, 18 bp, Homo sapiens
ttcctgcatctttcatag

SEQ ID NO: 5810947 - DNA, 22 bp, Homo sapiens
ttcctgcatctttcatagttct

SEQ ID NO: 5810948 - DNA, 18 bp, Homo sapiens
ttcctgcatttctcttct

SEQ ID NO: 5810949 - DNA, 16 bp, Homo sapiens
ttcctgcatttgtgaa

SEQ ID NO: 5810950 - DNA, 20 bp, Homo sapiens
ttcctgccagcccctgccat

SEQ ID NO: 5810951 - DNA, 14 bp, Homo sapiens
ttcctgccccaccc

SEQ ID NO: 5810952 - DNA, 13 bp, Homo sapiens
ttcctgcccctct

SEQ ID NO: 5810953 - DNA, 22 bp, Homo sapiens
ttcctgcccctctttctctttc

SEQ ID NO: 5810954 - DNA, 12 bp, Homo sapiens
ttcctgccctag

SEQ ID NO: 5810955 - DNA, 13 bp, Homo sapiens
ttcctgccctgta

SEQ ID NO: 5810956 - DNA, 13 bp, Homo sapiens
ttcctgccctgtc

SEQ ID NO: 5810957 - DNA, 16 bp, Homo sapiens
ttcctgccctgtccaa

SEQ ID NO: 5810958 - DNA, 15 bp, Homo sapiens
ttcctgcccttccct

SEQ ID NO: 5810959 - DNA, 16 bp, Homo sapiens
ttcctgcccttccctc

SEQ ID NO: 5810960 - DNA, 19 bp, Homo sapiens
ttcctgcccttccctctgg

SEQ ID NO: 5810961 - DNA, 16 bp, Homo sapiens
ttcctgcccttcctca

SEQ ID NO: 5810962 - DNA, 23 bp, Homo sapiens
ttcctgcccttgaaccccctccc

SEQ ID NO: 5810963 - DNA, 22 bp, Homo sapiens
ttcctgccgagtgctctgatgc

SEQ ID NO: 5810964 - DNA, 18 bp, Homo sapiens
ttcctgccgcaacagttt

SEQ ID NO: 5810965 - DNA, 15 bp, Homo sapiens
ttcctgcctggtctc

SEQ ID NO: 5810966 - DNA, 16 bp, Homo sapiens
ttcctgcctggtctcc

SEQ ID NO: 5810967 - DNA, 17 bp, Homo sapiens
ttcctgcctggtctcct

SEQ ID NO: 5810968 - DNA, 16 bp, Homo sapiens
ttcctgccttcagagt

SEQ ID NO: 5810969 - DNA, 13 bp, Homo sapiens
ttcctgccttctc

SEQ ID NO: 5810970 - DNA, 18 bp, Homo sapiens
ttcctgccttctcttcta

SEQ ID NO: 5810971 - DNA, 21 bp, Homo sapiens
ttcctgccttggcctcccaag

SEQ ID NO: 5810972 - DNA, 17 bp, Homo sapiens
ttcctgcctttaagcca

SEQ ID NO: 5810973 - DNA, 19 bp, Homo sapiens
ttcctgcctttaagccaaa

SEQ ID NO: 5810974 - DNA, 17 bp, Homo sapiens
ttcctgcggagtgaaga

SEQ ID NO: 5810975 - DNA, 20 bp, Homo sapiens
ttcctgcggagtgaagaggg

SEQ ID NO: 5810976 - DNA, 16 bp, Homo sapiens
ttcctgcgtcctcctc

SEQ ID NO: 5810977 - DNA, 19 bp, Homo sapiens
ttcctgcgtcctcctcacc

SEQ ID NO: 5810978 - DNA, 15 bp, Homo sapiens
ttcctgctacagtag

SEQ ID NO: 5810979 - DNA, 19 bp, Homo sapiens
ttcctgctacttaaatttg

SEQ ID NO: 5810980 - DNA, 16 bp, Homo sapiens
ttcctgctagaaatgg

SEQ ID NO: 5810981 - DNA, 11 bp, Homo sapiens
ttcctgctcca

SEQ ID NO: 5810982 - DNA, 18 bp, Homo sapiens
ttcctgctctcccactgc

SEQ ID NO: 5810983 - DNA, 15 bp, Homo sapiens
ttcctgctcttccca

SEQ ID NO: 5810984 - DNA, 22 bp, Homo sapiens
ttcctgctgaacgtttccccga

SEQ ID NO: 5810985 - DNA, 14 bp, Homo sapiens
ttcctgctgagcct

SEQ ID NO: 5810986 - DNA, 16 bp, Homo sapiens
ttcctgctgagtcctt

SEQ ID NO: 5810987 - DNA, 14 bp, Homo sapiens
ttcctgctgcaccc

SEQ ID NO: 5810988 - DNA, 18 bp, Homo sapiens
ttcctgctgcaccctgcg

SEQ ID NO: 5810989 - DNA, 12 bp, Homo sapiens
ttcctgctgctg

SEQ ID NO: 5810990 - DNA, 15 bp, Homo sapiens
ttcctgctgctgcta

SEQ ID NO: 5810991 - DNA, 24 bp, Homo sapiens
ttcctgctgctgtaactgctgagc

SEQ ID NO: 5810992 - DNA, 14 bp, Homo sapiens
ttcctgctgctgtc

SEQ ID NO: 5810993 - DNA, 10 bp, Homo sapiens
ttcctgctgg

SEQ ID NO: 5810994 - DNA, 11 bp, Homo sapiens
ttcctgctggt

SEQ ID NO: 5810995 - DNA, 16 bp, Homo sapiens
ttcctgctgtatttcc

SEQ ID NO: 5810996 - DNA, 11 bp, Homo sapiens
ttcctgctgtc

SEQ ID NO: 5810997 - DNA, 18 bp, Homo sapiens
ttcctgctgtcctggtgg

SEQ ID NO: 5810998 - DNA, 19 bp, Homo sapiens
ttcctgctgtcctggtggc

SEQ ID NO: 5810999 - DNA, 23 bp, Homo sapiens
ttcctgctgtcctggtggctggg

SEQ ID NO: 5811000 - DNA, 13 bp, Homo sapiens
ttcctgctgtggg

SEQ ID NO: 5811001 - DNA, 12 bp, Homo sapiens
ttcctgcttccc

SEQ ID NO: 5811002 - DNA, 13 bp, Homo sapiens
ttcctgcttgcca

SEQ ID NO: 5811003 - DNA, 20 bp, Homo sapiens
ttcctgctttccatgggccc

SEQ ID NO: 5811004 - DNA, 17 bp, Homo sapiens
ttcctgctttctctttc

SEQ ID NO: 5811005 - DNA, 9 bp, Homo sapiens
ttcctggaa

SEQ ID NO: 5811006 - DNA, 15 bp, Homo sapiens
ttcctggaaaactgg

SEQ ID NO: 5811007 - DNA, 16 bp, Homo sapiens
ttcctggaaacagcat

SEQ ID NO: 5811008 - DNA, 17 bp, Homo sapiens
ttcctggaaacagcatg

SEQ ID NO: 5811009 - DNA, 18 bp, Homo sapiens
ttcctggaaacagcatga

SEQ ID NO: 5811010 - DNA, 15 bp, Homo sapiens
ttcctggaacctgga

SEQ ID NO: 5811011 - DNA, 18 bp, Homo sapiens
ttcctggaacctggaccc

SEQ ID NO: 5811012 - DNA, 22 bp, Homo sapiens
ttcctggaacctggaccccagc

SEQ ID NO: 5811013 - DNA, 14 bp, Homo sapiens
ttcctggaagccag

SEQ ID NO: 5811014 - DNA, 21 bp, Homo sapiens
ttcctggaagtcaaataaatg

SEQ ID NO: 5811015 - DNA, 23 bp, Homo sapiens
ttcctggaagtcaaataaatgtt

SEQ ID NO: 5811016 - DNA, 16 bp, Homo sapiens
ttcctggaataaacat

SEQ ID NO: 5811017 - DNA, 22 bp, Homo sapiens
ttcctggaattgccagctgaca

SEQ ID NO: 5811018 - DNA, 20 bp, Homo sapiens
ttcctggacagctgtgcctc

SEQ ID NO: 5811019 - DNA, 16 bp, Homo sapiens
ttcctggacagtgaga

SEQ ID NO: 5811020 - DNA, 11 bp, Homo sapiens
ttcctggaccg

SEQ ID NO: 5811021 - DNA, 15 bp, Homo sapiens
ttcctggagcccaga

SEQ ID NO: 5811022 - DNA, 16 bp, Homo sapiens
ttcctggagtgccctg

SEQ ID NO: 5811023 - DNA, 22 bp, Homo sapiens
ttcctggagttttgatttggtg

SEQ ID NO: 5811024 - DNA, 20 bp, Homo sapiens
ttcctggatggggcagagct

SEQ ID NO: 5811025 - DNA, 23 bp, Homo sapiens
ttcctggatggggcagagcttct

SEQ ID NO: 5811026 - DNA, 13 bp, Homo sapiens
ttcctggatgtct

SEQ ID NO: 5811027 - DNA, 15 bp, Homo sapiens
ttcctggatgtctga

SEQ ID NO: 5811028 - DNA, 14 bp, Homo sapiens
ttcctggattttct

SEQ ID NO: 5811029 - DNA, 21 bp, Homo sapiens
ttcctggattttctttctatg

SEQ ID NO: 5811030 - DNA, 22 bp, Homo sapiens
ttcctggattttctttctatgt

SEQ ID NO: 5811031 - DNA, 20 bp, Homo sapiens
ttcctggcaatagtgtgttc

SEQ ID NO: 5811032 - DNA, 23 bp, Homo sapiens
ttcctggcaatagtgtgttctga

SEQ ID NO: 5811033 - DNA, 20 bp, Homo sapiens
ttcctggcacattgcccctc

SEQ ID NO: 5811034 - DNA, 19 bp, Homo sapiens
ttcctggcactgcttccag

SEQ ID NO: 5811035 - DNA, 21 bp, Homo sapiens
ttcctggcactggaccccagc

SEQ ID NO: 5811036 - DNA, 19 bp, Homo sapiens
ttcctggcagctgctgtgg

SEQ ID NO: 5811037 - DNA, 11 bp, Homo sapiens
ttcctggcagt

SEQ ID NO: 5811038 - DNA, 15 bp, Homo sapiens
ttcctggcatttgct

SEQ ID NO: 5811039 - DNA, 21 bp, Homo sapiens
ttcctggcccactctgtaata

SEQ ID NO: 5811040 - DNA, 13 bp, Homo sapiens
ttcctggcccagg

SEQ ID NO: 5811041 - DNA, 19 bp, Homo sapiens
ttcctggccccctcattca

SEQ ID NO: 5811042 - DNA, 23 bp, Homo sapiens
ttcctggccccgggctctggcca

SEQ ID NO: 5811043 - DNA, 15 bp, Homo sapiens
ttcctggccctccac

SEQ ID NO: 5811044 - DNA, 20 bp, Homo sapiens
ttcctttttaatatgcttaa

SEQ ID NO: 5811045 - DNA, 20 bp, Homo sapiens
ttcctttttatttgtttgca

SEQ ID NO: 5811046 - DNA, 14 bp, Homo sapiens
ttcctttttcctcc

SEQ ID NO: 5811047 - DNA, 15 bp, Homo sapiens
ttcctttttctgatt

SEQ ID NO: 5811048 - DNA, 22 bp, Homo sapiens
ttcctttttctgattagctttg

SEQ ID NO: 5811049 - DNA, 16 bp, Homo sapiens
ttcctttttgcagtat

SEQ ID NO: 5811050 - DNA, 16 bp, Homo sapiens
ttcctttttggggagt

SEQ ID NO: 5811051 - DNA, 16 bp, Homo sapiens
ttccttttttcaaaat

SEQ ID NO: 5811052 - DNA, 19 bp, Homo sapiens
ttccttttttcccataaga

SEQ ID NO: 5811053 - DNA, 22 bp, Homo sapiens
ttccttttttcccataagacaa

SEQ ID NO: 5811054 - DNA, 18 bp, Homo sapiens
ttccttttttgagatttt

SEQ ID NO: 5811055 - DNA, 16 bp, Homo sapiens
ttcctttttttaaatt

SEQ ID NO: 5811056 - DNA, 20 bp, Homo sapiens
ttcctttttttaaattttct

SEQ ID NO: 5811057 - DNA, 13 bp, Homo sapiens
ttcgaaaggcctt

SEQ ID NO: 5811058 - DNA, 17 bp, Homo sapiens
ttcgaaaggccttcaga

SEQ ID NO: 5811059 - DNA, 13 bp, Homo sapiens
ttcgaacatgttt

SEQ ID NO: 5811060 - DNA, 14 bp, Homo sapiens
ttcgaactgtgctc

SEQ ID NO: 5811061 - DNA, 19 bp, Homo sapiens
ttcgaactgtgctcccacg

SEQ ID NO: 5811062 - DNA, 21 bp, Homo sapiens
ttcgaagaaacccttgctgct

SEQ ID NO: 5811063 - DNA, 22 bp, Homo sapiens
ttcgaagccttgcctaaattta

SEQ ID NO: 5811064 - DNA, 15 bp, Homo sapiens
ttcgaagtcattaaa

SEQ ID NO: 5811065 - DNA, 22 bp, Homo sapiens
ttcgaagtttgcaacctttata

SEQ ID NO: 5811066 - DNA, 15 bp, Homo sapiens
ttcgaatctctgccc

SEQ ID NO: 5811067 - DNA, 23 bp, Homo sapiens
ttcgaatgacggtaagtgttctc

SEQ ID NO: 5811068 - DNA, 14 bp, Homo sapiens
ttcgaccagccagg

SEQ ID NO: 5811069 - DNA, 17 bp, Homo sapiens
ttcgacctgatttacag

SEQ ID NO: 5811070 - DNA, 17 bp, Homo sapiens
ttcgactcagcctcagg

SEQ ID NO: 5811071 - DNA, 17 bp, Homo sapiens
ttcgactggtccagctc

SEQ ID NO: 5811072 - DNA, 21 bp, Homo sapiens
ttcgactggtccagctctgac

SEQ ID NO: 5811073 - DNA, 17 bp, Homo sapiens
ttcgacttgcatttttg

SEQ ID NO: 5811074 - DNA, 19 bp, Homo sapiens
ttcgagacaggcagaatca

SEQ ID NO: 5811075 - DNA, 23 bp, Homo sapiens
ttcgagattatcgttttcttaaa

SEQ ID NO: 5811076 - DNA, 23 bp, Homo sapiens
ttcgagcaaacaactttctggaa

SEQ ID NO: 5811077 - DNA, 12 bp, Homo sapiens
ttcgaggcctga

SEQ ID NO: 5811078 - DNA, 15 bp, Homo sapiens
ttcgaggcctgaagc

SEQ ID NO: 5811079 - DNA, 20 bp, Homo sapiens
ttcgaggcctgaagccagct

SEQ ID NO: 5811080 - DNA, 21 bp, Homo sapiens
ttcgaggcggtttccaggaag

SEQ ID NO: 5811081 - DNA, 23 bp, Homo sapiens
ttcgaggggttccttccacttct

SEQ ID NO: 5811082 - DNA, 19 bp, Homo sapiens
ttcgagggttccaggctgt

SEQ ID NO: 5811083 - DNA, 20 bp, Homo sapiens
ttcgaggtttacttattttc

SEQ ID NO: 5811084 - DNA, 18 bp, Homo sapiens
ttcgagtaaacttgaaaa

SEQ ID NO: 5811085 - DNA, 12 bp, Homo sapiens
ttcgagtagaga

SEQ ID NO: 5811086 - DNA, 22 bp, Homo sapiens
ttcgataaaggatatagcaaca

SEQ ID NO: 5811087 - DNA, 23 bp, Homo sapiens
ttcgatacccaggaccaagccac

SEQ ID NO: 5811088 - DNA, 18 bp, Homo sapiens
ttcgatatttattgatgt

SEQ ID NO: 5811089 - DNA, 12 bp, Homo sapiens
ttcgatgaggtt

SEQ ID NO: 5811090 - DNA, 13 bp, Homo sapiens
ttcgatgatgatg

SEQ ID NO: 5811091 - DNA, 18 bp, Homo sapiens
ttcgatgcgtattctgtg

SEQ ID NO: 5811092 - DNA, 18 bp, Homo sapiens
ttcgatggtacgtgaccc

SEQ ID NO: 5811093 - DNA, 12 bp, Homo sapiens
ttcgatttctac

SEQ ID NO: 5811094 - DNA, 13 bp, Homo sapiens
ttcgatttctacc

SEQ ID NO: 5811095 - DNA, 17 bp, Homo sapiens
ttcgatttctacctcag

SEQ ID NO: 5811096 - DNA, 19 bp, Homo sapiens
ttcgcaccgtgctgggctc

SEQ ID NO: 5811097 - DNA, 23 bp, Homo sapiens
ttcgcacctaccatcagggacag

SEQ ID NO: 5811098 - DNA, 16 bp, Homo sapiens
ttcgcagaacatgagt

SEQ ID NO: 5811099 - DNA, 15 bp, Homo sapiens
ttcgcagaggcaagc

SEQ ID NO: 5811100 - DNA, 15 bp, Homo sapiens
ttcgcagccaccctg

SEQ ID NO: 5811101 - DNA, 18 bp, Homo sapiens
ttcgcagctcatcttttc

SEQ ID NO: 5811102 - DNA, 17 bp, Homo sapiens
ttcgcagtgatatactt

SEQ ID NO: 5811103 - DNA, 18 bp, Homo sapiens
ttcgcatcaaaagacaat

SEQ ID NO: 5811104 - DNA, 19 bp, Homo sapiens
ttcgcatcaaaagacaatt

SEQ ID NO: 5811105 - DNA, 20 bp, Homo sapiens
ttcgcatcaaaagacaattc

SEQ ID NO: 5811106 - DNA, 21 bp, Homo sapiens
ttcgcatcaaaagacaattct

SEQ ID NO: 5811107 - DNA, 22 bp, Homo sapiens
ttcgcatcaaaagacaattctt

SEQ ID NO: 5811108 - DNA, 21 bp, Homo sapiens
ttcgcatccaccgccacccca

SEQ ID NO: 5811109 - DNA, 16 bp, Homo sapiens
ttcgcatggtcacaca

SEQ ID NO: 5811110 - DNA, 17 bp, Homo sapiens
ttcgcatggtcacacac

SEQ ID NO: 5811111 - DNA, 18 bp, Homo sapiens
ttcgcatggtcacacact

SEQ ID NO: 5811112 - DNA, 20 bp, Homo sapiens
ttcgcatggtcacacactga

SEQ ID NO: 5811113 - DNA, 21 bp, Homo sapiens
ttcgcatggtcacacactgat

SEQ ID NO: 5811114 - DNA, 17 bp, Homo sapiens
ttcgcatgtttaatgtg

SEQ ID NO: 5811115 - DNA, 14 bp, Homo sapiens
ttcgccaaactgtc

SEQ ID NO: 5811116 - DNA, 16 bp, Homo sapiens
ttcgccaatctcatac

SEQ ID NO: 5811117 - DNA, 21 bp, Homo sapiens
ttcgccaatctcatacaagcc

SEQ ID NO: 5811118 - DNA, 15 bp, Homo sapiens
ttcgccccattttct

SEQ ID NO: 5811119 - DNA, 20 bp, Homo sapiens
ttcgccccattttctttaca

SEQ ID NO: 5811120 - DNA, 17 bp, Homo sapiens
ttcgcccccatgtgact

SEQ ID NO: 5811121 - DNA, 16 bp, Homo sapiens
ttcgccccctgcctgc

SEQ ID NO: 5811122 - DNA, 22 bp, Homo sapiens
ttcgccgtctggcgagccctta

SEQ ID NO: 5811123 - DNA, 12 bp, Homo sapiens
ttcgcctcctcc

SEQ ID NO: 5811124 - DNA, 13 bp, Homo sapiens
ttcgcctcctcca

SEQ ID NO: 5811125 - DNA, 20 bp, Homo sapiens
ttcgcctcctccagctcctg

SEQ ID NO: 5811126 - DNA, 14 bp, Homo sapiens
ttcgcctggagccc

SEQ ID NO: 5811127 - DNA, 15 bp, Homo sapiens
ttcgcctggagccct

SEQ ID NO: 5811128 - DNA, 15 bp, Homo sapiens
ttcgcctttcccacc

SEQ ID NO: 5811129 - DNA, 21 bp, Homo sapiens
ttcgcctttgtcttgtacttc

SEQ ID NO: 5811130 - DNA, 15 bp, Homo sapiens
ttcgcgctctgctca

SEQ ID NO: 5811131 - DNA, 23 bp, Homo sapiens
ttcgcgctggaatccagaaggaa

SEQ ID NO: 5811132 - DNA, 22 bp, Homo sapiens
ttcgcgggtaactggggttgag

SEQ ID NO: 5811133 - DNA, 21 bp, Homo sapiens
ttcgctaagggcttgtttttc

SEQ ID NO: 5811134 - DNA, 15 bp, Homo sapiens
ttcgctcctgtgtct

SEQ ID NO: 5811135 - DNA, 19 bp, Homo sapiens
ttcgctcctgtgtcttgca

SEQ ID NO: 5811136 - DNA, 15 bp, Homo sapiens
ttcgctgaaattgct

SEQ ID NO: 5811137 - DNA, 15 bp, Homo sapiens
ttcgctgccaggaca

SEQ ID NO: 5811138 - DNA, 20 bp, Homo sapiens
ttcgctgccaggacacctgc

SEQ ID NO: 5811139 - DNA, 23 bp, Homo sapiens
ttcgctgccaggacacctgcccc

SEQ ID NO: 5811140 - DNA, 17 bp, Homo sapiens
ttcgctgctagagaagg

SEQ ID NO: 5811141 - DNA, 19 bp, Homo sapiens
ttcgctgctagagaagggg

SEQ ID NO: 5811142 - DNA, 19 bp, Homo sapiens
ttcgctgctctagctggca

SEQ ID NO: 5811143 - DNA, 20 bp, Homo sapiens
ttcgctggactattgtgcca

SEQ ID NO: 5811144 - DNA, 23 bp, Homo sapiens
ttcgctggctcctaccccatctc

SEQ ID NO: 5811145 - DNA, 11 bp, Homo sapiens
ttcgctgggga

SEQ ID NO: 5811146 - DNA, 15 bp, Homo sapiens
ttcgctgtgttcatg

SEQ ID NO: 5811147 - DNA, 22 bp, Homo sapiens
ttcgcttcttgcctctgtgctg

SEQ ID NO: 5811148 - DNA, 17 bp, Homo sapiens
ttcgcttgcttctgcag

SEQ ID NO: 5811149 - DNA, 17 bp, Homo sapiens
ttcgcttggctccatgc

SEQ ID NO: 5811150 - DNA, 18 bp, Homo sapiens
ttcggaagggaaaacagt

SEQ ID NO: 5811151 - DNA, 20 bp, Homo sapiens
ttcggacagtttatttgttg

SEQ ID NO: 5811152 - DNA, 23 bp, Homo sapiens
ttcggacatgcttttctgccact

SEQ ID NO: 5811153 - DNA, 15 bp, Homo sapiens
ttcggagaaattctc

SEQ ID NO: 5811154 - DNA, 19 bp, Homo sapiens
ttcggataattttcatttt

SEQ ID NO: 5811155 - DNA, 20 bp, Homo sapiens
ttcggataattttcattttt

SEQ ID NO: 5811156 - DNA, 18 bp, Homo sapiens
ttcggatcgctccgccgt

SEQ ID NO: 5811157 - DNA, 15 bp, Homo sapiens
ttcggatttgacaaa

SEQ ID NO: 5811158 - DNA, 14 bp, Homo sapiens
ttcggcaccttccc

SEQ ID NO: 5811159 - DNA, 19 bp, Homo sapiens
ttcggcagaggaaccccca

SEQ ID NO: 5811160 - DNA, 21 bp, Homo sapiens
ttcggcagaggaacccccacc

SEQ ID NO: 5811161 - DNA, 20 bp, Homo sapiens
ttcggcatttaacttacatt

SEQ ID NO: 5811162 - DNA, 17 bp, Homo sapiens
ttcggccaaacagacag

SEQ ID NO: 5811163 - DNA, 18 bp, Homo sapiens
ttcggccccatgtatctc

SEQ ID NO: 5811164 - DNA, 20 bp, Homo sapiens
ttcggccgagctggtttcct

SEQ ID NO: 5811165 - DNA, 15 bp, Homo sapiens
ttcggcctccatcct

SEQ ID NO: 5811166 - DNA, 15 bp, Homo sapiens
ttcggctaaaaagaa

SEQ ID NO: 5811167 - DNA, 18 bp, Homo sapiens
ttcggctatgtctcatgt

SEQ ID NO: 5811168 - DNA, 20 bp, Homo sapiens
ttcggctctagggcctcagt

SEQ ID NO: 5811169 - DNA, 16 bp, Homo sapiens
ttcggctctgggtggg

SEQ ID NO: 5811170 - DNA, 11 bp, Homo sapiens
ttcgggaagaa

SEQ ID NO: 5811171 - DNA, 23 bp, Homo sapiens
ttcgggaagagaggagttcaatg

SEQ ID NO: 5811172 - DNA, 15 bp, Homo sapiens
ttcgggagcagggct

SEQ ID NO: 5811173 - DNA, 14 bp, Homo sapiens
ttcgggccctgcct

SEQ ID NO: 5811174 - DNA, 18 bp, Homo sapiens
ttcgggcgtctgtgtgcg

SEQ ID NO: 5811175 - DNA, 14 bp, Homo sapiens
ttcgggctggccat

SEQ ID NO: 5811176 - DNA, 13 bp, Homo sapiens
ttcgggctgtgcc

SEQ ID NO: 5811177 - DNA, 11 bp, Homo sapiens
ttcggggaggg

SEQ ID NO: 5811178 - DNA, 13 bp, Homo sapiens
ttcggggcctcct

SEQ ID NO: 5811179 - DNA, 22 bp, Homo sapiens
ttcggggcgatgctccctcagc

SEQ ID NO: 5811180 - DNA, 19 bp, Homo sapiens
ttcgggggagcagagagag

SEQ ID NO: 5811181 - DNA, 19 bp, Homo sapiens
ttcggggtgatcctgttct

SEQ ID NO: 5811182 - DNA, 15 bp, Homo sapiens
ttcggggtgtgatga

SEQ ID NO: 5811183 - DNA, 17 bp, Homo sapiens
ttcgggtgtgcaatgtc

SEQ ID NO: 5811184 - DNA, 21 bp, Homo sapiens
ttcgggtgtgcaatgtctgag

SEQ ID NO: 5811185 - DNA, 16 bp, Homo sapiens
ttcgggttaagtgatg

SEQ ID NO: 5811186 - DNA, 15 bp, Homo sapiens
ttcggtacccaccac

SEQ ID NO: 5811187 - DNA, 19 bp, Homo sapiens
ttcggtggccttgagtctc

SEQ ID NO: 5811188 - DNA, 19 bp, Homo sapiens
ttcggtgggacagccccag

SEQ ID NO: 5811189 - DNA, 22 bp, Homo sapiens
ttcggtgggacagccccagggc

SEQ ID NO: 5811190 - DNA, 13 bp, Homo sapiens
ttcggtgtgcacc

SEQ ID NO: 5811191 - DNA, 19 bp, Homo sapiens
ttcggttctccagaatgta

SEQ ID NO: 5811192 - DNA, 18 bp, Homo sapiens
ttcggttgagaatggaaa

SEQ ID NO: 5811193 - DNA, 13 bp, Homo sapiens
ttcggtttctgag

SEQ ID NO: 5811194 - DNA, 20 bp, Homo sapiens
ttcggtttttttcctgtttc

SEQ ID NO: 5811195 - DNA, 15 bp, Homo sapiens
ttcgtaagaacatgt

SEQ ID NO: 5811196 - DNA, 15 bp, Homo sapiens
ttcgtacagttcttc

SEQ ID NO: 5811197 - DNA, 15 bp, Homo sapiens
ttcgtaccttcccac

SEQ ID NO: 5811198 - DNA, 14 bp, Homo sapiens
ttcgtatagaaaaa

SEQ ID NO: 5811199 - DNA, 15 bp, Homo sapiens
ttcgtatagaaaaag

SEQ ID NO: 5811200 - DNA, 17 bp, Homo sapiens
ttcgtatagaaaaagca

SEQ ID NO: 5811201 - DNA, 13 bp, Homo sapiens
ttcgtatgaaaat

SEQ ID NO: 5811202 - DNA, 17 bp, Homo sapiens
ttcgtcatcttccctgc

SEQ ID NO: 5811203 - DNA, 18 bp, Homo sapiens
ttcgtcatcttccctgcc

SEQ ID NO: 5811204 - DNA, 21 bp, Homo sapiens
ttcgtcatgttggccaggctg

SEQ ID NO: 5811205 - DNA, 16 bp, Homo sapiens
ttcgtccacagcttcc

SEQ ID NO: 5811206 - DNA, 18 bp, Homo sapiens
ttcgtcctgatccctcca

SEQ ID NO: 5811207 - DNA, 21 bp, Homo sapiens
ttcgtcctgatccctccaccc

SEQ ID NO: 5811208 - DNA, 12 bp, Homo sapiens
ttcgtctactgc

SEQ ID NO: 5811209 - DNA, 17 bp, Homo sapiens
ttcgtctccatctctgg

SEQ ID NO: 5811210 - DNA, 12 bp, Homo sapiens
ttcgtctgtccc

SEQ ID NO: 5811211 - DNA, 13 bp, Homo sapiens
ttcgtctgtccca

SEQ ID NO: 5811212 - DNA, 14 bp, Homo sapiens
ttcgtcttcactct

SEQ ID NO: 5811213 - DNA, 17 bp, Homo sapiens
ttcgtgaacatcccctc

SEQ ID NO: 5811214 - DNA, 18 bp, Homo sapiens
ttcgtgaagtatactgta

SEQ ID NO: 5811215 - DNA, 15 bp, Homo sapiens
ttcgtgatgacatat

SEQ ID NO: 5811216 - DNA, 16 bp, Homo sapiens
ttcgtgatgacatatc

SEQ ID NO: 5811217 - DNA, 16 bp, Homo sapiens
ttcgtgcactctgcta

SEQ ID NO: 5811218 - DNA, 12 bp, Homo sapiens
ttcgtgcatttg

SEQ ID NO: 5811219 - DNA, 14 bp, Homo sapiens
ttcgtgcatttgtg

SEQ ID NO: 5811220 - DNA, 15 bp, Homo sapiens
ttcgtgcatttgtga

SEQ ID NO: 5811221 - DNA, 17 bp, Homo sapiens
ttcgtgcatttgtgagc

SEQ ID NO: 5811222 - DNA, 15 bp, Homo sapiens
ttctagcaggcagga

SEQ ID NO: 5811223 - DNA, 21 bp, Homo sapiens
ttctagcagtatgtgtgctct

SEQ ID NO: 5811224 - DNA, 14 bp, Homo sapiens
ttctagcatggcat

SEQ ID NO: 5811225 - DNA, 18 bp, Homo sapiens
ttctagcatggcatattt

SEQ ID NO: 5811226 - DNA, 21 bp, Homo sapiens
ttctagcatggcatatttttc

SEQ ID NO: 5811227 - DNA, 20 bp, Homo sapiens
ttctagccacagttctaaga

SEQ ID NO: 5811228 - DNA, 15 bp, Homo sapiens
ttctagccataataa

SEQ ID NO: 5811229 - DNA, 18 bp, Homo sapiens
ttctagcccatggacttc

SEQ ID NO: 5811230 - DNA, 18 bp, Homo sapiens
ttctagcccgaatacaaa

SEQ ID NO: 5811231 - DNA, 21 bp, Homo sapiens
ttctagcccgaatacaaacac

SEQ ID NO: 5811232 - DNA, 17 bp, Homo sapiens
ttctagccctctccctc

SEQ ID NO: 5811233 - DNA, 13 bp, Homo sapiens
ttctagcctctga

SEQ ID NO: 5811234 - DNA, 21 bp, Homo sapiens
ttctagcctggggcttgaatt

SEQ ID NO: 5811235 - DNA, 16 bp, Homo sapiens
ttctagcgcagttttt

SEQ ID NO: 5811236 - DNA, 16 bp, Homo sapiens
ttctagctagaaatat

SEQ ID NO: 5811237 - DNA, 18 bp, Homo sapiens
ttctagctagaaatatga

SEQ ID NO: 5811238 - DNA, 22 bp, Homo sapiens
ttctagctagaaatatgatttt

SEQ ID NO: 5811239 - DNA, 20 bp, Homo sapiens
ttctagctataacaactcta

SEQ ID NO: 5811240 - DNA, 22 bp, Homo sapiens
ttctagctataacaactctatt

SEQ ID NO: 5811241 - DNA, 18 bp, Homo sapiens
ttctagctctcacagaca

SEQ ID NO: 5811242 - DNA, 14 bp, Homo sapiens
ttctagctttcaaa

SEQ ID NO: 5811243 - DNA, 18 bp, Homo sapiens
ttctagctttgttgtcct

SEQ ID NO: 5811244 - DNA, 15 bp, Homo sapiens
ttctagcttttctct

SEQ ID NO: 5811245 - DNA, 12 bp, Homo sapiens
ttctaggaaaat

SEQ ID NO: 5811246 - DNA, 22 bp, Homo sapiens
ttctaggaaacccaaggaacaa

SEQ ID NO: 5811247 - DNA, 14 bp, Homo sapiens
ttctaggactgaat

SEQ ID NO: 5811248 - DNA, 23 bp, Homo sapiens
ttctaggactgaattatgaaact

SEQ ID NO: 5811249 - DNA, 18 bp, Homo sapiens
ttctaggatgaacaatgt

SEQ ID NO: 5811250 - DNA, 22 bp, Homo sapiens
ttctaggatgaacaatgtatac

SEQ ID NO: 5811251 - DNA, 19 bp, Homo sapiens
ttctaggcatctcctctcc

SEQ ID NO: 5811252 - DNA, 22 bp, Homo sapiens
ttctaggcatctcctctcccca

SEQ ID NO: 5811253 - DNA, 22 bp, Homo sapiens
ttctaggcccattgtcctcctt

SEQ ID NO: 5811254 - DNA, 13 bp, Homo sapiens
ttctaggcctggg

SEQ ID NO: 5811255 - DNA, 21 bp, Homo sapiens
ttctaggcctttcctctgcac

SEQ ID NO: 5811256 - DNA, 15 bp, Homo sapiens
ttctagggaaatgaa

SEQ ID NO: 5811257 - DNA, 16 bp, Homo sapiens
ttctagggacatgaaa

SEQ ID NO: 5811258 - DNA, 19 bp, Homo sapiens
ttctagggctgggaaacac

SEQ ID NO: 5811259 - DNA, 20 bp, Homo sapiens
ttctagggctgggaaacact

SEQ ID NO: 5811260 - DNA, 22 bp, Homo sapiens
ttctaggggagaagagccctgg

SEQ ID NO: 5811261 - DNA, 15 bp, Homo sapiens
ttctagggtattctg

SEQ ID NO: 5811262 - DNA, 18 bp, Homo sapiens
ttctaggtaggaaatgtg

SEQ ID NO: 5811263 - DNA, 17 bp, Homo sapiens
ttctaggtcctggcttc

SEQ ID NO: 5811264 - DNA, 18 bp, Homo sapiens
ttctaggtcctggcttct

SEQ ID NO: 5811265 - DNA, 22 bp, Homo sapiens
ttctaggtggaggttgtgcatg

SEQ ID NO: 5811266 - DNA, 18 bp, Homo sapiens
ttctaggtggcaaggctg

SEQ ID NO: 5811267 - DNA, 14 bp, Homo sapiens
ttctaggtggcagg

SEQ ID NO: 5811268 - DNA, 15 bp, Homo sapiens
ttctaggttctaaaa

SEQ ID NO: 5811269 - DNA, 17 bp, Homo sapiens
ttctaggtttcaaagat

SEQ ID NO: 5811270 - DNA, 20 bp, Homo sapiens
ttctaggtttcaaagatgct

SEQ ID NO: 5811271 - DNA, 15 bp, Homo sapiens
ttctagtaacagtat

SEQ ID NO: 5811272 - DNA, 19 bp, Homo sapiens
ttctagtacctgtgactct

SEQ ID NO: 5811273 - DNA, 12 bp, Homo sapiens
ttctagtactgt

SEQ ID NO: 5811274 - DNA, 14 bp, Homo sapiens
ttctagtactgtat

SEQ ID NO: 5811275 - DNA, 18 bp, Homo sapiens
ttctagtatctattgtgt

SEQ ID NO: 5811276 - DNA, 23 bp, Homo sapiens
ttctagtatctattgtgttggct

SEQ ID NO: 5811277 - DNA, 14 bp, Homo sapiens
ttctagtattttat

SEQ ID NO: 5811278 - DNA, 15 bp, Homo sapiens
ttctagtcaactgct

SEQ ID NO: 5811279 - DNA, 14 bp, Homo sapiens
ttctagtctctgtt

SEQ ID NO: 5811280 - DNA, 22 bp, Homo sapiens
ttctagtctggaactgctgctg

SEQ ID NO: 5811281 - DNA, 18 bp, Homo sapiens
ttctagtctggtgttctg

SEQ ID NO: 5811282 - DNA, 20 bp, Homo sapiens
ttctagtctggtgttctgag

SEQ ID NO: 5811283 - DNA, 18 bp, Homo sapiens
ttctagtctgtttcatta

SEQ ID NO: 5811284 - DNA, 18 bp, Homo sapiens
ttctagtgcagctgaaat

SEQ ID NO: 5811285 - DNA, 13 bp, Homo sapiens
ttctagtgctgct

SEQ ID NO: 5811286 - DNA, 17 bp, Homo sapiens
ttctagtggtctttgta

SEQ ID NO: 5811287 - DNA, 18 bp, Homo sapiens
ttctagtggtctttgtaa

SEQ ID NO: 5811288 - DNA, 19 bp, Homo sapiens
ttctagtggtctttgtaag

SEQ ID NO: 5811289 - DNA, 20 bp, Homo sapiens
ttctagtggtctttgtaaga

SEQ ID NO: 5811290 - DNA, 21 bp, Homo sapiens
ttctagtggtctttgtaagag

SEQ ID NO: 5811291 - DNA, 21 bp, Homo sapiens
ttctagtgtaacactgcaaga

SEQ ID NO: 5811292 - DNA, 17 bp, Homo sapiens
ttctagtgtatactctg

SEQ ID NO: 5811293 - DNA, 21 bp, Homo sapiens
ttctagtgtccataaataaag

SEQ ID NO: 5811294 - DNA, 15 bp, Homo sapiens
ttctagtgtgtgttt

SEQ ID NO: 5811295 - DNA, 20 bp, Homo sapiens
ttctagttagctgctttaaa

SEQ ID NO: 5811296 - DNA, 11 bp, Homo sapiens
ttctagttcaa

SEQ ID NO: 5811297 - DNA, 14 bp, Homo sapiens
ttctagttgaaaat

SEQ ID NO: 5811298 - DNA, 20 bp, Homo sapiens
ttctagttgaggagtttcct

SEQ ID NO: 5811299 - DNA, 22 bp, Homo sapiens
ttctagttgattgcgagaattt

SEQ ID NO: 5811300 - DNA, 15 bp, Homo sapiens
ttctagtttgctcat

SEQ ID NO: 5811301 - DNA, 13 bp, Homo sapiens
ttctagttttatg

SEQ ID NO: 5811302 - DNA, 13 bp, Homo sapiens
ttctataaaaacc

SEQ ID NO: 5811303 - DNA, 13 bp, Homo sapiens
ttctataaatcag

SEQ ID NO: 5811304 - DNA, 16 bp, Homo sapiens
ttctataaatgaatgt

SEQ ID NO: 5811305 - DNA, 14 bp, Homo sapiens
ttctataaatgact

SEQ ID NO: 5811306 - DNA, 22 bp, Homo sapiens
ttctataaattcaacacttatt

SEQ ID NO: 5811307 - DNA, 14 bp, Homo sapiens
ttctataacagata

SEQ ID NO: 5811308 - DNA, 23 bp, Homo sapiens
ttctataaggccataaaacaggt

SEQ ID NO: 5811309 - DNA, 17 bp, Homo sapiens
ttctataagttgtacca

SEQ ID NO: 5811310 - DNA, 18 bp, Homo sapiens
ttctataagttgtaccaa

SEQ ID NO: 5811311 - DNA, 21 bp, Homo sapiens
ttctataagttttatgttaaa

SEQ ID NO: 5811312 - DNA, 14 bp, Homo sapiens
ttctataatttaaa

SEQ ID NO: 5811313 - DNA, 21 bp, Homo sapiens
ttctatacacaccctgcccct

SEQ ID NO: 5811314 - DNA, 22 bp, Homo sapiens
ttctatacacaccctgcccctg

SEQ ID NO: 5811315 - DNA, 12 bp, Homo sapiens
ttctatactgtt

SEQ ID NO: 5811316 - DNA, 13 bp, Homo sapiens
ttctatactgttt

SEQ ID NO: 5811317 - DNA, 24 bp, Homo sapiens
ttctatactgtttgtaatatacag

SEQ ID NO: 5811318 - DNA, 21 bp, Homo sapiens
ttctatagccaaaaatagcta

SEQ ID NO: 5811319 - DNA, 16 bp, Homo sapiens
ttctatagccaaagct

SEQ ID NO: 5811320 - DNA, 14 bp, Homo sapiens
ttctatagccaact

SEQ ID NO: 5811321 - DNA, 20 bp, Homo sapiens
ttctatagccataaacctga

SEQ ID NO: 5811322 - DNA, 20 bp, Homo sapiens
ttctatagctcttctattta

SEQ ID NO: 5811323 - DNA, 22 bp, Homo sapiens
ttctataggtttttaaatggaa

SEQ ID NO: 5811324 - DNA, 14 bp, Homo sapiens
ttctatagttctag

SEQ ID NO: 5811325 - DNA, 15 bp, Homo sapiens
ttctatagttctaga

SEQ ID NO: 5811326 - DNA, 16 bp, Homo sapiens
ttctatataatttttc

SEQ ID NO: 5811327 - DNA, 23 bp, Homo sapiens
ttctatatagttccttgccttaa

SEQ ID NO: 5811328 - DNA, 14 bp, Homo sapiens
ttctatatatacaa

SEQ ID NO: 5811329 - DNA, 18 bp, Homo sapiens
ttctatatgaatgctatt

SEQ ID NO: 5811330 - DNA, 20 bp, Homo sapiens
ttctatatgcgagttagcca

SEQ ID NO: 5811331 - DNA, 14 bp, Homo sapiens
ttctatatgtaact

SEQ ID NO: 5811332 - DNA, 19 bp, Homo sapiens
ttctatattattatatata

SEQ ID NO: 5811333 - DNA, 19 bp, Homo sapiens
ttctatattctttattctc

SEQ ID NO: 5811334 - DNA, 15 bp, Homo sapiens
ttctatatttatttt

SEQ ID NO: 5811335 - DNA, 23 bp, Homo sapiens
ttctatatttggattcacagcct

SEQ ID NO: 5811336 - DNA, 17 bp, Homo sapiens
ttctatatttgtaactt

SEQ ID NO: 5811337 - DNA, 15 bp, Homo sapiens
ttctatattttaata

SEQ ID NO: 5811338 - DNA, 16 bp, Homo sapiens
ttctatattttaatag

SEQ ID NO: 5811339 - DNA, 15 bp, Homo sapiens
ttctatattttcatt

SEQ ID NO: 5811340 - DNA, 22 bp, Homo sapiens
ttctatcactggcaatatttgt

SEQ ID NO: 5811341 - DNA, 23 bp, Homo sapiens
ttctatcaggaaaacaaatcact

SEQ ID NO: 5811342 - DNA, 21 bp, Homo sapiens
ttctatcaggggtgcattctg

SEQ ID NO: 5811343 - DNA, 17 bp, Homo sapiens
ttctatcagttatcctt

SEQ ID NO: 5811344 - DNA, 20 bp, Homo sapiens
ttctatcagttatcctttgt

SEQ ID NO: 5811345 - DNA, 20 bp, Homo sapiens
ttctatcattccaattctaa

SEQ ID NO: 5811346 - DNA, 22 bp, Homo sapiens
ttctatcattccaattctaaat

SEQ ID NO: 5811347 - DNA, 20 bp, Homo sapiens
ttctatcatttttgtacagt

SEQ ID NO: 5811348 - DNA, 20 bp, Homo sapiens
ttctatccaaacatgtattt

SEQ ID NO: 5811349 - DNA, 16 bp, Homo sapiens
ttctatccatctcctg

SEQ ID NO: 5811350 - DNA, 14 bp, Homo sapiens
ttctatcccaaact

SEQ ID NO: 5811351 - DNA, 16 bp, Homo sapiens
ttctatccccaagctg

SEQ ID NO: 5811352 - DNA, 17 bp, Homo sapiens
ttctatccccaagctgg

SEQ ID NO: 5811353 - DNA, 20 bp, Homo sapiens
ttctatccccaagctggcca

SEQ ID NO: 5811354 - DNA, 14 bp, Homo sapiens
ttctatcctgttta

SEQ ID NO: 5811355 - DNA, 12 bp, Homo sapiens
ttctatcctttc

SEQ ID NO: 5811356 - DNA, 17 bp, Homo sapiens
ttctatctactgatttg

SEQ ID NO: 5811357 - DNA, 18 bp, Homo sapiens
ttctatctcatctgtctc

SEQ ID NO: 5811358 - DNA, 13 bp, Homo sapiens
ttctatcttcttt

SEQ ID NO: 5811359 - DNA, 13 bp, Homo sapiens
ttctatcttttgt

SEQ ID NO: 5811360 - DNA, 16 bp, Homo sapiens
ttctatgaaagactca

SEQ ID NO: 5811361 - DNA, 21 bp, Homo sapiens
ttctatgaaatattatgttaa

SEQ ID NO: 5811362 - DNA, 16 bp, Homo sapiens
ttctatgaactagtct

SEQ ID NO: 5811363 - DNA, 17 bp, Homo sapiens
ttctatgaagagtatta

SEQ ID NO: 5811364 - DNA, 16 bp, Homo sapiens
ttctatgaatctattt

SEQ ID NO: 5811365 - DNA, 22 bp, Homo sapiens
ttctatgaattgctaattctga

SEQ ID NO: 5811366 - DNA, 14 bp, Homo sapiens
ttctatgacaaatt

SEQ ID NO: 5811367 - DNA, 18 bp, Homo sapiens
ttctatgagcatctctgt

SEQ ID NO: 5811368 - DNA, 16 bp, Homo sapiens
ttctatgatccttttt

SEQ ID NO: 5811369 - DNA, 16 bp, Homo sapiens
ttctatgcaaagttct

SEQ ID NO: 5811370 - DNA, 18 bp, Homo sapiens
ttctatgcaagccttgct

SEQ ID NO: 5811371 - DNA, 13 bp, Homo sapiens
ttctatgccattt

SEQ ID NO: 5811372 - DNA, 14 bp, Homo sapiens
ttctatgcctgtat

SEQ ID NO: 5811373 - DNA, 19 bp, Homo sapiens
ttctatgcctgtatttcca

SEQ ID NO: 5811374 - DNA, 15 bp, Homo sapiens
ttctatggaccaaat

SEQ ID NO: 5811375 - DNA, 17 bp, Homo sapiens
ttctatggaccaaatgt

SEQ ID NO: 5811376 - DNA, 21 bp, Homo sapiens
ttctatggaccaaatgtaaaa

SEQ ID NO: 5811377 - DNA, 21 bp, Homo sapiens
ttctatggagactttgctgtt

SEQ ID NO: 5811378 - DNA, 22 bp, Homo sapiens
ttctatggagcaaaacaaagct

SEQ ID NO: 5811379 - DNA, 19 bp, Homo sapiens
ttctatggattcacttcta

SEQ ID NO: 5811380 - DNA, 23 bp, Homo sapiens
ttctatggcatattgataataaa

SEQ ID NO: 5811381 - DNA, 17 bp, Homo sapiens
ttctatggctttcaaag

SEQ ID NO: 5811382 - DNA, 18 bp, Homo sapiens
ttctatgggtgttatcac

SEQ ID NO: 5811383 - DNA, 23 bp, Homo sapiens
ttctatggttatgaaagaatata

SEQ ID NO: 5811384 - DNA, 18 bp, Homo sapiens
ttctatgtaaaaatcact

SEQ ID NO: 5811385 - DNA, 15 bp, Homo sapiens
ttctatgtaaattat

SEQ ID NO: 5811386 - DNA, 23 bp, Homo sapiens
ttctatgtaaattattgtaaact

SEQ ID NO: 5811387 - DNA, 16 bp, Homo sapiens
ttctatgtaacttgtt

SEQ ID NO: 5811388 - DNA, 12 bp, Homo sapiens
ttctatgtatgt

SEQ ID NO: 5811389 - DNA, 17 bp, Homo sapiens
ttctatgtatgttaatt

SEQ ID NO: 5811390 - DNA, 12 bp, Homo sapiens
ttctatgtatta

SEQ ID NO: 5811391 - DNA, 21 bp, Homo sapiens
ttctatgtcatttttaatgta

SEQ ID NO: 5811392 - DNA, 17 bp, Homo sapiens
ttctatgtccattctca

SEQ ID NO: 5811393 - DNA, 18 bp, Homo sapiens
ttctatgtctagcacatg

SEQ ID NO: 5811394 - DNA, 15 bp, Homo sapiens
ttctatgtgacattt

SEQ ID NO: 5811395 - DNA, 15 bp, Homo sapiens
ttctatgttaaatac

SEQ ID NO: 5811396 - DNA, 12 bp, Homo sapiens
ttctatgttaat

SEQ ID NO: 5811397 - DNA, 18 bp, Homo sapiens
ttctatgttcataaaaaa

SEQ ID NO: 5811398 - DNA, 19 bp, Homo sapiens
ttctatgttggtttcagtg

SEQ ID NO: 5811399 - DNA, 17 bp, Homo sapiens
ttctcctcttgtaaata

SEQ ID NO: 5811400 - DNA, 17 bp, Homo sapiens
ttctcctctttgaacat

SEQ ID NO: 5811401 - DNA, 18 bp, Homo sapiens
ttctcctctttgaacatg

SEQ ID NO: 5811402 - DNA, 20 bp, Homo sapiens
ttctcctctttgaacatggt

SEQ ID NO: 5811403 - DNA, 13 bp, Homo sapiens
ttctcctgaaatc

SEQ ID NO: 5811404 - DNA, 17 bp, Homo sapiens
ttctcctgacctacttc

SEQ ID NO: 5811405 - DNA, 21 bp, Homo sapiens
ttctcctgaggatgtgtccca

SEQ ID NO: 5811406 - DNA, 21 bp, Homo sapiens
ttctcctgatagtcacctgct

SEQ ID NO: 5811407 - DNA, 11 bp, Homo sapiens
ttctcctgccc

SEQ ID NO: 5811408 - DNA, 13 bp, Homo sapiens
ttctcctgcctca

SEQ ID NO: 5811409 - DNA, 16 bp, Homo sapiens
ttctcctgcctcagcc

SEQ ID NO: 5811410 - DNA, 21 bp, Homo sapiens
ttctcctgcctcagcctcctg

SEQ ID NO: 5811411 - DNA, 18 bp, Homo sapiens
ttctcctgcctcagcctt

SEQ ID NO: 5811412 - DNA, 15 bp, Homo sapiens
ttctcctgcctgtgc

SEQ ID NO: 5811413 - DNA, 21 bp, Homo sapiens
ttctcctgcctgtgctgtgac

SEQ ID NO: 5811414 - DNA, 22 bp, Homo sapiens
ttctcctgcctttgcctccaga

SEQ ID NO: 5811415 - DNA, 13 bp, Homo sapiens
ttctcctgcgggg

SEQ ID NO: 5811416 - DNA, 20 bp, Homo sapiens
ttctcctgcgtgttctcaga

SEQ ID NO: 5811417 - DNA, 22 bp, Homo sapiens
ttctcctgctgctccctcagac

SEQ ID NO: 5811418 - DNA, 17 bp, Homo sapiens
ttctcctgctgctcctg

SEQ ID NO: 5811419 - DNA, 10 bp, Homo sapiens
ttctcctgga

SEQ ID NO: 5811420 - DNA, 21 bp, Homo sapiens
ttctcctggagatagctgggg

SEQ ID NO: 5811421 - DNA, 22 bp, Homo sapiens
ttctcctggagatagctggggc

SEQ ID NO: 5811422 - DNA, 14 bp, Homo sapiens
ttctcctggatgct

SEQ ID NO: 5811423 - DNA, 18 bp, Homo sapiens
ttctcctggcccctgcct

SEQ ID NO: 5811424 - DNA, 23 bp, Homo sapiens
ttctcctggtagaggggccggct

SEQ ID NO: 5811425 - DNA, 22 bp, Homo sapiens
ttctcctgtctcagcctcctga

SEQ ID NO: 5811426 - DNA, 22 bp, Homo sapiens
ttctcctgtgaccccaccttga

SEQ ID NO: 5811427 - DNA, 21 bp, Homo sapiens
ttctcctgtggtttgctccag

SEQ ID NO: 5811428 - DNA, 22 bp, Homo sapiens
ttctcctgtttatgggtttctt

SEQ ID NO: 5811429 - DNA, 20 bp, Homo sapiens
ttctcctgtttattcccatc

SEQ ID NO: 5811430 - DNA, 14 bp, Homo sapiens
ttctccttaacccc

SEQ ID NO: 5811431 - DNA, 22 bp, Homo sapiens
ttctccttcattaatgatgatc

SEQ ID NO: 5811432 - DNA, 10 bp, Homo sapiens
ttctccttcc

SEQ ID NO: 5811433 - DNA, 12 bp, Homo sapiens
ttctccttccca

SEQ ID NO: 5811434 - DNA, 18 bp, Homo sapiens
ttctccttcgctttcctg

SEQ ID NO: 5811435 - DNA, 17 bp, Homo sapiens
ttctccttctccttccc

SEQ ID NO: 5811436 - DNA, 18 bp, Homo sapiens
ttctccttgataacagct

SEQ ID NO: 5811437 - DNA, 23 bp, Homo sapiens
ttctccttgatatcattcagcat

SEQ ID NO: 5811438 - DNA, 18 bp, Homo sapiens
ttctccttggaggacagt

SEQ ID NO: 5811439 - DNA, 18 bp, Homo sapiens
ttctcctttccttcccag

SEQ ID NO: 5811440 - DNA, 20 bp, Homo sapiens
ttctcctttgataaaataaa

SEQ ID NO: 5811441 - DNA, 13 bp, Homo sapiens
ttctcctttgcaa

SEQ ID NO: 5811442 - DNA, 14 bp, Homo sapiens
ttctcctttgtact

SEQ ID NO: 5811443 - DNA, 12 bp, Homo sapiens
ttctccttttcc

SEQ ID NO: 5811444 - DNA, 21 bp, Homo sapiens
ttctcgattctttgaagagat

SEQ ID NO: 5811445 - DNA, 17 bp, Homo sapiens
ttctcgattttatcttt

SEQ ID NO: 5811446 - DNA, 19 bp, Homo sapiens
ttctcgcaactgaaggaag

SEQ ID NO: 5811447 - DNA, 18 bp, Homo sapiens
ttctcgcctaggatttca

SEQ ID NO: 5811448 - DNA, 19 bp, Homo sapiens
ttctcgcctaggatttcag

SEQ ID NO: 5811449 - DNA, 18 bp, Homo sapiens
ttctcgcgccctccccca

SEQ ID NO: 5811450 - DNA, 19 bp, Homo sapiens
ttctcgctgtcctttctag

SEQ ID NO: 5811451 - DNA, 15 bp, Homo sapiens
ttctcggaattcata

SEQ ID NO: 5811452 - DNA, 14 bp, Homo sapiens
ttctcggagctggc

SEQ ID NO: 5811453 - DNA, 14 bp, Homo sapiens
ttctcggaggccag

SEQ ID NO: 5811454 - DNA, 20 bp, Homo sapiens
ttctcggaggccaggccctc

SEQ ID NO: 5811455 - DNA, 21 bp, Homo sapiens
ttctcggggtgggacagacga

SEQ ID NO: 5811456 - DNA, 19 bp, Homo sapiens
ttctcgtagatgctgccta

SEQ ID NO: 5811457 - DNA, 23 bp, Homo sapiens
ttctcgtccccctccctgcccaa

SEQ ID NO: 5811458 - DNA, 13 bp, Homo sapiens
ttctcgtgaccca

SEQ ID NO: 5811459 - DNA, 13 bp, Homo sapiens
ttctcgtgtttgc

SEQ ID NO: 5811460 - DNA, 14 bp, Homo sapiens
ttctcgtgtttgct

SEQ ID NO: 5811461 - DNA, 14 bp, Homo sapiens
ttctcgttgcctct

SEQ ID NO: 5811462 - DNA, 20 bp, Homo sapiens
ttctcgttgcctctgatttt

SEQ ID NO: 5811463 - DNA, 17 bp, Homo sapiens
ttctcgttgtcacaccc

SEQ ID NO: 5811464 - DNA, 16 bp, Homo sapiens
ttctcgttttgaaact

SEQ ID NO: 5811465 - DNA, 12 bp, Homo sapiens
ttctctaaaaca

SEQ ID NO: 5811466 - DNA, 20 bp, Homo sapiens
ttctctaaaatagccactta

SEQ ID NO: 5811467 - DNA, 12 bp, Homo sapiens
ttctctaaactg

SEQ ID NO: 5811468 - DNA, 14 bp, Homo sapiens
ttctctaaactgtt

SEQ ID NO: 5811469 - DNA, 18 bp, Homo sapiens
ttctctaaactgtttctt

SEQ ID NO: 5811470 - DNA, 21 bp, Homo sapiens
ttctctaacccctagtgtctt

SEQ ID NO: 5811471 - DNA, 15 bp, Homo sapiens
ttctctaagcctata

SEQ ID NO: 5811472 - DNA, 13 bp, Homo sapiens
ttctctaaggaat

SEQ ID NO: 5811473 - DNA, 20 bp, Homo sapiens
ttctctaaggaattatttca

SEQ ID NO: 5811474 - DNA, 12 bp, Homo sapiens
ttctctaataaa

SEQ ID NO: 5811475 - DNA, 15 bp, Homo sapiens
ttctctaataaaatt

SEQ ID NO: 5811476 - DNA, 21 bp, Homo sapiens
ttctctaataaaattcagaat

SEQ ID NO: 5811477 - DNA, 17 bp, Homo sapiens
ttctctaataataaata

SEQ ID NO: 5811478 - DNA, 19 bp, Homo sapiens
ttctctaataataaatagt

SEQ ID NO: 5811479 - DNA, 20 bp, Homo sapiens
ttctctaataataaatagtt

SEQ ID NO: 5811480 - DNA, 21 bp, Homo sapiens
ttctctaatatggcaaccatt

SEQ ID NO: 5811481 - DNA, 12 bp, Homo sapiens
ttctctaatatt

SEQ ID NO: 5811482 - DNA, 20 bp, Homo sapiens
ttctctaatgtaacttcctc

SEQ ID NO: 5811483 - DNA, 17 bp, Homo sapiens
ttctctacccatctccc

SEQ ID NO: 5811484 - DNA, 15 bp, Homo sapiens
ttctctactccatgg

SEQ ID NO: 5811485 - DNA, 19 bp, Homo sapiens
ttctctactccatggttct

SEQ ID NO: 5811486 - DNA, 21 bp, Homo sapiens
ttctctactccatggttctca

SEQ ID NO: 5811487 - DNA, 18 bp, Homo sapiens
ttctctactccctcttgt

SEQ ID NO: 5811488 - DNA, 15 bp, Homo sapiens
ttctctactttaaat

SEQ ID NO: 5811489 - DNA, 16 bp, Homo sapiens
ttctctactttaaatt

SEQ ID NO: 5811490 - DNA, 19 bp, Homo sapiens
ttctctactttgaggaaac

SEQ ID NO: 5811491 - DNA, 20 bp, Homo sapiens
ttctctagctctctaggcct

SEQ ID NO: 5811492 - DNA, 21 bp, Homo sapiens
ttctctagctgatcagaattt

SEQ ID NO: 5811493 - DNA, 12 bp, Homo sapiens
ttctctaggaaa

SEQ ID NO: 5811494 - DNA, 20 bp, Homo sapiens
ttctctagggaaggccacct

SEQ ID NO: 5811495 - DNA, 22 bp, Homo sapiens
ttctctagtgtattatcactgt

SEQ ID NO: 5811496 - DNA, 15 bp, Homo sapiens
ttctctagtttgatt

SEQ ID NO: 5811497 - DNA, 17 bp, Homo sapiens
ttctctagtttgattaa

SEQ ID NO: 5811498 - DNA, 16 bp, Homo sapiens
ttctctatcatttaat

SEQ ID NO: 5811499 - DNA, 17 bp, Homo sapiens
ttctctatgaaaagcaa

SEQ ID NO: 5811500 - DNA, 15 bp, Homo sapiens
ttctctatgataatt

SEQ ID NO: 5811501 - DNA, 17 bp, Homo sapiens
ttctctattcctgaccc

SEQ ID NO: 5811502 - DNA, 20 bp, Homo sapiens
ttctctcaaccttggccttc

SEQ ID NO: 5811503 - DNA, 19 bp, Homo sapiens
ttctctcaatttgaaacac

SEQ ID NO: 5811504 - DNA, 22 bp, Homo sapiens
ttctctcacccatcccacccct

SEQ ID NO: 5811505 - DNA, 13 bp, Homo sapiens
ttctctcacttct

SEQ ID NO: 5811506 - DNA, 21 bp, Homo sapiens
ttctctcagaccgtcttcctc

SEQ ID NO: 5811507 - DNA, 21 bp, Homo sapiens
ttctctcagatttccacagag

SEQ ID NO: 5811508 - DNA, 19 bp, Homo sapiens
ttctctcagcctccactcc

SEQ ID NO: 5811509 - DNA, 13 bp, Homo sapiens
ttctctcagctcc

SEQ ID NO: 5811510 - DNA, 17 bp, Homo sapiens
ttctctcagctcccagg

SEQ ID NO: 5811511 - DNA, 20 bp, Homo sapiens
ttctctcagctcccaggcca

SEQ ID NO: 5811512 - DNA, 14 bp, Homo sapiens
ttctctcatagtgt

SEQ ID NO: 5811513 - DNA, 13 bp, Homo sapiens
ttctctcatctct

SEQ ID NO: 5811514 - DNA, 14 bp, Homo sapiens
ttctctcatctgtt

SEQ ID NO: 5811515 - DNA, 15 bp, Homo sapiens
ttctctccaacatga

SEQ ID NO: 5811516 - DNA, 16 bp, Homo sapiens
ttctctccaatttaac

SEQ ID NO: 5811517 - DNA, 17 bp, Homo sapiens
ttctctccacttctggt

SEQ ID NO: 5811518 - DNA, 14 bp, Homo sapiens
ttctctccagcccc

SEQ ID NO: 5811519 - DNA, 15 bp, Homo sapiens
ttctctccagcccct

SEQ ID NO: 5811520 - DNA, 18 bp, Homo sapiens
ttctctccagcccctgga

SEQ ID NO: 5811521 - DNA, 23 bp, Homo sapiens
ttctctcccaggggctggcttca

SEQ ID NO: 5811522 - DNA, 11 bp, Homo sapiens
ttctctcccat

SEQ ID NO: 5811523 - DNA, 15 bp, Homo sapiens
ttctctccccaaccc

SEQ ID NO: 5811524 - DNA, 22 bp, Homo sapiens
ttctctccccaacccccattct

SEQ ID NO: 5811525 - DNA, 23 bp, Homo sapiens
ttctctccccaacccccattctc

SEQ ID NO: 5811526 - DNA, 14 bp, Homo sapiens
ttctctccccagcc

SEQ ID NO: 5811527 - DNA, 23 bp, Homo sapiens
ttctctccccagccccctcccac

SEQ ID NO: 5811528 - DNA, 11 bp, Homo sapiens
ttctctcccct

SEQ ID NO: 5811529 - DNA, 13 bp, Homo sapiens
ttctctcccctca

SEQ ID NO: 5811530 - DNA, 12 bp, Homo sapiens
ttctctccctcc

SEQ ID NO: 5811531 - DNA, 17 bp, Homo sapiens
ttctctccctctttttc

SEQ ID NO: 5811532 - DNA, 18 bp, Homo sapiens
ttctctccctgccagagg

SEQ ID NO: 5811533 - DNA, 23 bp, Homo sapiens
ttctctccgacttcccctgggca

SEQ ID NO: 5811534 - DNA, 19 bp, Homo sapiens
ttctctccgcgggtgggac

SEQ ID NO: 5811535 - DNA, 16 bp, Homo sapiens
ttctctcctaatgatg

SEQ ID NO: 5811536 - DNA, 19 bp, Homo sapiens
ttctctcctaatgatgact

SEQ ID NO: 5811537 - DNA, 17 bp, Homo sapiens
ttctctcctcagtttct

SEQ ID NO: 5811538 - DNA, 23 bp, Homo sapiens
ttctctcctctccccatgatgtt

SEQ ID NO: 5811539 - DNA, 20 bp, Homo sapiens
ttctctcctgattatttatc

SEQ ID NO: 5811540 - DNA, 14 bp, Homo sapiens
ttctctcctgtacc

SEQ ID NO: 5811541 - DNA, 18 bp, Homo sapiens
ttctctcctgtacctctt

SEQ ID NO: 5811542 - DNA, 17 bp, Homo sapiens
ttctctcctgtcctccc

SEQ ID NO: 5811543 - DNA, 12 bp, Homo sapiens
ttctctcctgtg

SEQ ID NO: 5811544 - DNA, 15 bp, Homo sapiens
ttctctcctgtgagc

SEQ ID NO: 5811545 - DNA, 14 bp, Homo sapiens
ttctctccttccct

SEQ ID NO: 5811546 - DNA, 14 bp, Homo sapiens
ttctctccttgccc

SEQ ID NO: 5811547 - DNA, 22 bp, Homo sapiens
ttctctcctttctccctgcagc

SEQ ID NO: 5811548 - DNA, 20 bp, Homo sapiens
ttctctcggagtatctggga

SEQ ID NO: 5811549 - DNA, 16 bp, Homo sapiens
ttctctctaaaaataa

SEQ ID NO: 5811550 - DNA, 20 bp, Homo sapiens
ttctctctatctggaattta

SEQ ID NO: 5811551 - DNA, 12 bp, Homo sapiens
ttctctctatgc

SEQ ID NO: 5811552 - DNA, 23 bp, Homo sapiens
ttctctctatgcaaaatgtctgt

SEQ ID NO: 5811553 - DNA, 20 bp, Homo sapiens
ttctctctatggtaaagata

SEQ ID NO: 5811554 - DNA, 18 bp, Homo sapiens
ttctctctcatgcctcct

SEQ ID NO: 5811555 - DNA, 11 bp, Homo sapiens
ttctctctcca

SEQ ID NO: 5811556 - DNA, 19 bp, Homo sapiens
ttctctctccctgtcacac

SEQ ID NO: 5811557 - DNA, 20 bp, Homo sapiens
ttctctctcctggtgtgggt

SEQ ID NO: 5811558 - DNA, 15 bp, Homo sapiens
ttctctctctctcac

SEQ ID NO: 5811559 - DNA, 16 bp, Homo sapiens
ttctctctctctcaca

SEQ ID NO: 5811560 - DNA, 15 bp, Homo sapiens
ttctctctctctctc

SEQ ID NO: 5811561 - DNA, 20 bp, Homo sapiens
ttctctctctctctctcgct

SEQ ID NO: 5811562 - DNA, 18 bp, Homo sapiens
ttctctctctctcttcct

SEQ ID NO: 5811563 - DNA, 15 bp, Homo sapiens
ttctctctctctttg

SEQ ID NO: 5811564 - DNA, 11 bp, Homo sapiens
ttctctctctt

SEQ ID NO: 5811565 - DNA, 10 bp, Homo sapiens
ttctctctga

SEQ ID NO: 5811566 - DNA, 15 bp, Homo sapiens
ttctctctgctgagc

SEQ ID NO: 5811567 - DNA, 12 bp, Homo sapiens
ttctctctggac

SEQ ID NO: 5811568 - DNA, 12 bp, Homo sapiens
ttctctctggat

SEQ ID NO: 5811569 - DNA, 21 bp, Homo sapiens
ttctctctggcttctctcttt

SEQ ID NO: 5811570 - DNA, 13 bp, Homo sapiens
ttctctctgtgct

SEQ ID NO: 5811571 - DNA, 12 bp, Homo sapiens
ttctctctgtgt

SEQ ID NO: 5811572 - DNA, 16 bp, Homo sapiens
ttctctctgtgtggca

SEQ ID NO: 5811573 - DNA, 23 bp, Homo sapiens
ttctctctgtgtggcaaacattt

SEQ ID NO: 5811574 - DNA, 13 bp, Homo sapiens
ttctctcttccct

SEQ ID NO: 5811575 - DNA, 12 bp, Homo sapiens
ttctctcttggt

SEQ ID NO: 5811576 - DNA, 13 bp, Homo sapiens
ttctctcttttaa

SEQ ID NO: 5811577 - DNA, 14 bp, Homo sapiens
ttctctcttttcct

SEQ ID NO: 5811578 - DNA, 22 bp, Homo sapiens
ttctgcagaaatttgcaactca

SEQ ID NO: 5811579 - DNA, 20 bp, Homo sapiens
ttctgcagacacgccttccc

SEQ ID NO: 5811580 - DNA, 20 bp, Homo sapiens
ttctgcagcaactcccacga

SEQ ID NO: 5811581 - DNA, 20 bp, Homo sapiens
ttctgcagcatgacctgtga

SEQ ID NO: 5811582 - DNA, 22 bp, Homo sapiens
ttctgcagcatgacctgtgacc

SEQ ID NO: 5811583 - DNA, 19 bp, Homo sapiens
ttctgcagccactattgtt

SEQ ID NO: 5811584 - DNA, 19 bp, Homo sapiens
ttctgcagcccttgggcag

SEQ ID NO: 5811585 - DNA, 16 bp, Homo sapiens
ttctgcagcctcggcc

SEQ ID NO: 5811586 - DNA, 14 bp, Homo sapiens
ttctgcagctgttt

SEQ ID NO: 5811587 - DNA, 15 bp, Homo sapiens
ttctgcagtaaatct

SEQ ID NO: 5811588 - DNA, 23 bp, Homo sapiens
ttctgcatatgttgaatactttt

SEQ ID NO: 5811589 - DNA, 16 bp, Homo sapiens
ttctgcatcagctgct

SEQ ID NO: 5811590 - DNA, 19 bp, Homo sapiens
ttctgcatcagttcactgc

SEQ ID NO: 5811591 - DNA, 16 bp, Homo sapiens
ttctgcatctccactt

SEQ ID NO: 5811592 - DNA, 23 bp, Homo sapiens
ttctgcattactattaactctgc

SEQ ID NO: 5811593 - DNA, 14 bp, Homo sapiens
ttctgcattcacag

SEQ ID NO: 5811594 - DNA, 15 bp, Homo sapiens
ttctgcattcctgta

SEQ ID NO: 5811595 - DNA, 19 bp, Homo sapiens
ttctgcattgagaaggaac

SEQ ID NO: 5811596 - DNA, 13 bp, Homo sapiens
ttctgcattgcta

SEQ ID NO: 5811597 - DNA, 16 bp, Homo sapiens
ttctgcattgctagat

SEQ ID NO: 5811598 - DNA, 20 bp, Homo sapiens
ttctgcattgctagataaaa

SEQ ID NO: 5811599 - DNA, 21 bp, Homo sapiens
ttctgcattttgctattgtaa

SEQ ID NO: 5811600 - DNA, 11 bp, Homo sapiens
ttctgccaaaa

SEQ ID NO: 5811601 - DNA, 18 bp, Homo sapiens
ttctgccaaaataaacct

SEQ ID NO: 5811602 - DNA, 18 bp, Homo sapiens
ttctgccaacgcctcctg

SEQ ID NO: 5811603 - DNA, 20 bp, Homo sapiens
ttctgccaataaattctaaa

SEQ ID NO: 5811604 - DNA, 22 bp, Homo sapiens
ttctgccaataaattctaaatt

SEQ ID NO: 5811605 - DNA, 17 bp, Homo sapiens
ttctgccaccagcccct

SEQ ID NO: 5811606 - DNA, 18 bp, Homo sapiens
ttctgccaccagcccctc

SEQ ID NO: 5811607 - DNA, 16 bp, Homo sapiens
ttctgccacctctgac

SEQ ID NO: 5811608 - DNA, 15 bp, Homo sapiens
ttctgccactgagga

SEQ ID NO: 5811609 - DNA, 14 bp, Homo sapiens
ttctgccacttccc

SEQ ID NO: 5811610 - DNA, 18 bp, Homo sapiens
ttctgccacttgcactgt

SEQ ID NO: 5811611 - DNA, 23 bp, Homo sapiens
ttctgccaggcaacttttaaagc

SEQ ID NO: 5811612 - DNA, 16 bp, Homo sapiens
ttctgccagggagctt

SEQ ID NO: 5811613 - DNA, 13 bp, Homo sapiens
ttctgccagggat

SEQ ID NO: 5811614 - DNA, 20 bp, Homo sapiens
ttctgccagggatggcagtg

SEQ ID NO: 5811615 - DNA, 17 bp, Homo sapiens
ttctgccaggtttgtta

SEQ ID NO: 5811616 - DNA, 19 bp, Homo sapiens
ttctgcccaaaaatatggt

SEQ ID NO: 5811617 - DNA, 23 bp, Homo sapiens
ttctgcccacgatcccctccccc

SEQ ID NO: 5811618 - DNA, 22 bp, Homo sapiens
ttctgccccacacccagccagc

SEQ ID NO: 5811619 - DNA, 18 bp, Homo sapiens
ttctgccccagctttatc

SEQ ID NO: 5811620 - DNA, 14 bp, Homo sapiens
ttctgcccccagcc

SEQ ID NO: 5811621 - DNA, 16 bp, Homo sapiens
ttctgcccccagccca

SEQ ID NO: 5811622 - DNA, 20 bp, Homo sapiens
ttctgcccccgttccagctg

SEQ ID NO: 5811623 - DNA, 21 bp, Homo sapiens
ttctgccctcagcttcaaata

SEQ ID NO: 5811624 - DNA, 23 bp, Homo sapiens
ttctgccctcagcttcaaataaa

SEQ ID NO: 5811625 - DNA, 11 bp, Homo sapiens
ttctgccctgc

SEQ ID NO: 5811626 - DNA, 15 bp, Homo sapiens
ttctgccctgccagc

SEQ ID NO: 5811627 - DNA, 15 bp, Homo sapiens
ttctgccctgcccac

SEQ ID NO: 5811628 - DNA, 19 bp, Homo sapiens
ttctgccctgcctgaggag

SEQ ID NO: 5811629 - DNA, 13 bp, Homo sapiens
ttctgccctggct

SEQ ID NO: 5811630 - DNA, 14 bp, Homo sapiens
ttctgccctggctg

SEQ ID NO: 5811631 - DNA, 16 bp, Homo sapiens
ttctgccctggctgct

SEQ ID NO: 5811632 - DNA, 15 bp, Homo sapiens
ttctgcccttcctcc

SEQ ID NO: 5811633 - DNA, 13 bp, Homo sapiens
ttctgccgcagcc

SEQ ID NO: 5811634 - DNA, 15 bp, Homo sapiens
ttctgccgccccctc

SEQ ID NO: 5811635 - DNA, 21 bp, Homo sapiens
ttctgccgccccctcctgaac

SEQ ID NO: 5811636 - DNA, 13 bp, Homo sapiens
ttctgccgctgtc

SEQ ID NO: 5811637 - DNA, 18 bp, Homo sapiens
ttctgccggccctggggc

SEQ ID NO: 5811638 - DNA, 19 bp, Homo sapiens
ttctgcctaataaaaaaca

SEQ ID NO: 5811639 - DNA, 21 bp, Homo sapiens
ttctgcctacgttctctttaa

SEQ ID NO: 5811640 - DNA, 20 bp, Homo sapiens
ttctgcctagagtgtagcct

SEQ ID NO: 5811641 - DNA, 15 bp, Homo sapiens
ttctgcctataaatt

SEQ ID NO: 5811642 - DNA, 12 bp, Homo sapiens
ttctgcctcagc

SEQ ID NO: 5811643 - DNA, 18 bp, Homo sapiens
ttctgcctcagcctcctg

SEQ ID NO: 5811644 - DNA, 14 bp, Homo sapiens
ttctgcctcccctt

SEQ ID NO: 5811645 - DNA, 13 bp, Homo sapiens
ttctgcctcctgg

SEQ ID NO: 5811646 - DNA, 13 bp, Homo sapiens
ttctgcctccttt

SEQ ID NO: 5811647 - DNA, 13 bp, Homo sapiens
ttctgcctctcct

SEQ ID NO: 5811648 - DNA, 14 bp, Homo sapiens
ttctgcctctctgg

SEQ ID NO: 5811649 - DNA, 12 bp, Homo sapiens
ttctgcctgcca

SEQ ID NO: 5811650 - DNA, 16 bp, Homo sapiens
ttctgcctgccagctg

SEQ ID NO: 5811651 - DNA, 18 bp, Homo sapiens
ttctgcctgccagctgca

SEQ ID NO: 5811652 - DNA, 16 bp, Homo sapiens
ttctgcctgcccaggc

SEQ ID NO: 5811653 - DNA, 13 bp, Homo sapiens
ttctgcctgccct

SEQ ID NO: 5811654 - DNA, 18 bp, Homo sapiens
ttctgcctgcctgggaac

SEQ ID NO: 5811655 - DNA, 14 bp, Homo sapiens
ttctgcctggagac

SEQ ID NO: 5811656 - DNA, 21 bp, Homo sapiens
ttctgcctgtcctagtctcct

SEQ ID NO: 5811657 - DNA, 21 bp, Homo sapiens
ttctgcctgttataactctgc

SEQ ID NO: 5811658 - DNA, 21 bp, Homo sapiens
ttctgccttagcctaccatgt

SEQ ID NO: 5811659 - DNA, 10 bp, Homo sapiens
ttctgccttt

SEQ ID NO: 5811660 - DNA, 13 bp, Homo sapiens
ttctgcctttaat
